United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 159

SEQ ID NO: 6748792 - DNA, 17 bp, Homo sapiens
tgtatgtcttaaaacct

SEQ ID NO: 6748793 - DNA, 13 bp, Homo sapiens
tgtatgtgaaagt

SEQ ID NO: 6748794 - DNA, 23 bp, Homo sapiens
tgtatgtgaaagtgtaaaataga

SEQ ID NO: 6748795 - DNA, 12 bp, Homo sapiens
tgtatgtgaaca

SEQ ID NO: 6748796 - DNA, 14 bp, Homo sapiens
tgtatgtgagagat

SEQ ID NO: 6748797 - DNA, 17 bp, Homo sapiens
tgtatgtgcacatgtgt

SEQ ID NO: 6748798 - DNA, 17 bp, Homo sapiens
tgtatgtgcactgtcac

SEQ ID NO: 6748799 - DNA, 13 bp, Homo sapiens
tgtatgtgccagt

SEQ ID NO: 6748800 - DNA, 16 bp, Homo sapiens
tgtatgtgccatttat

SEQ ID NO: 6748801 - DNA, 17 bp, Homo sapiens
tgtatgtggatacagtc

SEQ ID NO: 6748802 - DNA, 12 bp, Homo sapiens
tgtatgtggggg

SEQ ID NO: 6748803 - DNA, 18 bp, Homo sapiens
tgtatgtgtctttatcag

SEQ ID NO: 6748804 - DNA, 13 bp, Homo sapiens
tgtatgtgtgaag

SEQ ID NO: 6748805 - DNA, 20 bp, Homo sapiens
tgtatgtgtgagtgtatgta

SEQ ID NO: 6748806 - DNA, 21 bp, Homo sapiens
tgtatgtgtgagtgtatgtat

SEQ ID NO: 6748807 - DNA, 19 bp, Homo sapiens
tgtatgtgtgtagactgta

SEQ ID NO: 6748808 - DNA, 16 bp, Homo sapiens
tgtatgtgtgtgagtg

SEQ ID NO: 6748809 - DNA, 23 bp, Homo sapiens
tgtatgtgtgtggtgtgtgtgct

SEQ ID NO: 6748810 - DNA, 16 bp, Homo sapiens
tgtatgtgtgtgtgta

SEQ ID NO: 6748811 - DNA, 19 bp, Homo sapiens
tgtatgtgtgtttctgtcc

SEQ ID NO: 6748812 - DNA, 12 bp, Homo sapiens
tgtatgtgttta

SEQ ID NO: 6748813 - DNA, 14 bp, Homo sapiens
tgtatgtgtttaga

SEQ ID NO: 6748814 - DNA, 19 bp, Homo sapiens
tgtatgtgtttagaattga

SEQ ID NO: 6748815 - DNA, 16 bp, Homo sapiens
tgtatgttatgaacat

SEQ ID NO: 6748816 - DNA, 17 bp, Homo sapiens
tgtatgttatgaacatg

SEQ ID NO: 6748817 - DNA, 16 bp, Homo sapiens
tgtatgttgacttttt

SEQ ID NO: 6748818 - DNA, 15 bp, Homo sapiens
tgtatgttgcatgaa

SEQ ID NO: 6748819 - DNA, 20 bp, Homo sapiens
tgtatgttgtacaatcaaaa

SEQ ID NO: 6748820 - DNA, 14 bp, Homo sapiens
tgtatgttgtgaag

SEQ ID NO: 6748821 - DNA, 22 bp, Homo sapiens
tgtatgttgtgaagatgtttgc

SEQ ID NO: 6748822 - DNA, 13 bp, Homo sapiens
tgtatgtttctct

SEQ ID NO: 6748823 - DNA, 22 bp, Homo sapiens
tgtatgtttcttctttctttta

SEQ ID NO: 6748824 - DNA, 18 bp, Homo sapiens
tgtatgttttatatcaaa

SEQ ID NO: 6748825 - DNA, 21 bp, Homo sapiens
tgtatgtttttcagttcaaag

SEQ ID NO: 6748826 - DNA, 15 bp, Homo sapiens
tgtatgtttttctgt

SEQ ID NO: 6748827 - DNA, 16 bp, Homo sapiens
tgtatgtttttctgta

SEQ ID NO: 6748828 - DNA, 22 bp, Homo sapiens
tgtatgtttttgactcttttga

SEQ ID NO: 6748829 - DNA, 20 bp, Homo sapiens
tgtattaaaacacattatgt

SEQ ID NO: 6748830 - DNA, 21 bp, Homo sapiens
tgtattaaaacacattatgta

SEQ ID NO: 6748831 - DNA, 15 bp, Homo sapiens
tgtattaaacttgaa

SEQ ID NO: 6748832 - DNA, 16 bp, Homo sapiens
tgtattaaagaaaaat

SEQ ID NO: 6748833 - DNA, 12 bp, Homo sapiens
tgtattaaatct

SEQ ID NO: 6748834 - DNA, 13 bp, Homo sapiens
tgtattaaatctt

SEQ ID NO: 6748835 - DNA, 16 bp, Homo sapiens
tgtattaaatcttaaa

SEQ ID NO: 6748836 - DNA, 18 bp, Homo sapiens
tgtattaaatcttaaaca

SEQ ID NO: 6748837 - DNA, 21 bp, Homo sapiens
tgtattaaattacatttgtaa

SEQ ID NO: 6748838 - DNA, 22 bp, Homo sapiens
tgtattaacactactcaaagca

SEQ ID NO: 6748839 - DNA, 13 bp, Homo sapiens
tgtattaacttgt

SEQ ID NO: 6748840 - DNA, 16 bp, Homo sapiens
tgtattaagaaaggaa

SEQ ID NO: 6748841 - DNA, 20 bp, Homo sapiens
tgtattaagaaaggaagcat

SEQ ID NO: 6748842 - DNA, 16 bp, Homo sapiens
tgtattaagagtgaaa

SEQ ID NO: 6748843 - DNA, 17 bp, Homo sapiens
tgtattaagccaaacat

SEQ ID NO: 6748844 - DNA, 19 bp, Homo sapiens
tgtattaagccaaacatga

SEQ ID NO: 6748845 - DNA, 21 bp, Homo sapiens
tgtattaagccaaacatgagt

SEQ ID NO: 6748846 - DNA, 14 bp, Homo sapiens
tgtattaagccaat

SEQ ID NO: 6748847 - DNA, 14 bp, Homo sapiens
tgtattaagccact

SEQ ID NO: 6748848 - DNA, 22 bp, Homo sapiens
tgtattaagcccacagtatatt

SEQ ID NO: 6748849 - DNA, 14 bp, Homo sapiens
tgtattaagtgact

SEQ ID NO: 6748850 - DNA, 16 bp, Homo sapiens
tgtattaataaagcat

SEQ ID NO: 6748851 - DNA, 16 bp, Homo sapiens
tgtattaataaataga

SEQ ID NO: 6748852 - DNA, 18 bp, Homo sapiens
tgtattaatatctccata

SEQ ID NO: 6748853 - DNA, 15 bp, Homo sapiens
tgtattaatgtatgt

SEQ ID NO: 6748854 - DNA, 19 bp, Homo sapiens
tgtattaattataccagtg

SEQ ID NO: 6748855 - DNA, 17 bp, Homo sapiens
tgtattaattatttaaa

SEQ ID NO: 6748856 - DNA, 16 bp, Homo sapiens
tgtattaatttctgat

SEQ ID NO: 6748857 - DNA, 19 bp, Homo sapiens
tgtattacatctaatgctt

SEQ ID NO: 6748858 - DNA, 22 bp, Homo sapiens
tgtattacatgactgtttcttt

SEQ ID NO: 6748859 - DNA, 14 bp, Homo sapiens
tgtattaccaaagc

SEQ ID NO: 6748860 - DNA, 16 bp, Homo sapiens
tgtattaccagccccc

SEQ ID NO: 6748861 - DNA, 21 bp, Homo sapiens
tgtattaccttccacttccat

SEQ ID NO: 6748862 - DNA, 18 bp, Homo sapiens
tgtattactgaataatat

SEQ ID NO: 6748863 - DNA, 20 bp, Homo sapiens
tgtattagagcgccagctcc

SEQ ID NO: 6748864 - DNA, 14 bp, Homo sapiens
tgtattagatgttc

SEQ ID NO: 6748865 - DNA, 21 bp, Homo sapiens
tgtattagccagtcattgtaa

SEQ ID NO: 6748866 - DNA, 15 bp, Homo sapiens
tgtattagctcactg

SEQ ID NO: 6748867 - DNA, 15 bp, Homo sapiens
tgtattaggaaaata

SEQ ID NO: 6748868 - DNA, 19 bp, Homo sapiens
tgtattaggactggctttg

SEQ ID NO: 6748869 - DNA, 13 bp, Homo sapiens
tgtattataattg

SEQ ID NO: 6748870 - DNA, 14 bp, Homo sapiens
tgtattatcactgt

SEQ ID NO: 6748871 - DNA, 12 bp, Homo sapiens
tgtattatcata

SEQ ID NO: 6748872 - DNA, 19 bp, Homo sapiens
tgtattatctcctttgaag

SEQ ID NO: 6748873 - DNA, 19 bp, Homo sapiens
tgtattatgttccaaggct

SEQ ID NO: 6748874 - DNA, 15 bp, Homo sapiens
tgtattattattaaa

SEQ ID NO: 6748875 - DNA, 16 bp, Homo sapiens
tgtattattctgcagc

SEQ ID NO: 6748876 - DNA, 15 bp, Homo sapiens
tgtattattgctgtt

SEQ ID NO: 6748877 - DNA, 23 bp, Homo sapiens
tgtattattgtaaagtttatttt

SEQ ID NO: 6748878 - DNA, 16 bp, Homo sapiens
tgtattatttaaatgt

SEQ ID NO: 6748879 - DNA, 23 bp, Homo sapiens
tgtattatttctggctttttgaa

SEQ ID NO: 6748880 - DNA, 15 bp, Homo sapiens
tgtattatttgcaca

SEQ ID NO: 6748881 - DNA, 16 bp, Homo sapiens
tgtattattttctata

SEQ ID NO: 6748882 - DNA, 17 bp, Homo sapiens
tgtattcaattaaagaa

SEQ ID NO: 6748883 - DNA, 23 bp, Homo sapiens
tgtattcacatagtcctcagggc

SEQ ID NO: 6748884 - DNA, 23 bp, Homo sapiens
tgtattcacgtgcagcagcaaca

SEQ ID NO: 6748885 - DNA, 14 bp, Homo sapiens
tgtattcagaggca

SEQ ID NO: 6748886 - DNA, 14 bp, Homo sapiens
tgtattcagcttta

SEQ ID NO: 6748887 - DNA, 17 bp, Homo sapiens
tgtattcagtgagggtc

SEQ ID NO: 6748888 - DNA, 15 bp, Homo sapiens
tgtattcatacagca

SEQ ID NO: 6748889 - DNA, 16 bp, Homo sapiens
tgtattcatacagcac

SEQ ID NO: 6748890 - DNA, 14 bp, Homo sapiens
tgtattcatatatt

SEQ ID NO: 6748891 - DNA, 17 bp, Homo sapiens
tgtcacatacaactttt

SEQ ID NO: 6748892 - DNA, 18 bp, Homo sapiens
tgtcacatagtttttcct

SEQ ID NO: 6748893 - DNA, 17 bp, Homo sapiens
tgtcacatcaagcatca

SEQ ID NO: 6748894 - DNA, 17 bp, Homo sapiens
tgtcacattatttatta

SEQ ID NO: 6748895 - DNA, 15 bp, Homo sapiens
tgtcacattcctgac

SEQ ID NO: 6748896 - DNA, 17 bp, Homo sapiens
tgtcacattgcattcta

SEQ ID NO: 6748897 - DNA, 19 bp, Homo sapiens
tgtcacattgcattctatt

SEQ ID NO: 6748898 - DNA, 13 bp, Homo sapiens
tgtcaccaagaag

SEQ ID NO: 6748899 - DNA, 14 bp, Homo sapiens
tgtcaccaagaagg

SEQ ID NO: 6748900 - DNA, 23 bp, Homo sapiens
tgtcaccaatgtacccaccgggc

SEQ ID NO: 6748901 - DNA, 18 bp, Homo sapiens
tgtcaccacatcttgtct

SEQ ID NO: 6748902 - DNA, 22 bp, Homo sapiens
tgtcaccaccctgctcatccac

SEQ ID NO: 6748903 - DNA, 21 bp, Homo sapiens
tgtcaccaccttcccagctct

SEQ ID NO: 6748904 - DNA, 13 bp, Homo sapiens
tgtcaccagagct

SEQ ID NO: 6748905 - DNA, 19 bp, Homo sapiens
tgtcaccagagcttctctg

SEQ ID NO: 6748906 - DNA, 15 bp, Homo sapiens
tgtcaccagctatct

SEQ ID NO: 6748907 - DNA, 17 bp, Homo sapiens
tgtcaccagctgccaaa

SEQ ID NO: 6748908 - DNA, 13 bp, Homo sapiens
tgtcacccaaagc

SEQ ID NO: 6748909 - DNA, 18 bp, Homo sapiens
tgtcacccaaagcctgtc

SEQ ID NO: 6748910 - DNA, 16 bp, Homo sapiens
tgtcacccagactgga

SEQ ID NO: 6748911 - DNA, 15 bp, Homo sapiens
tgtcaccccagagcc

SEQ ID NO: 6748912 - DNA, 17 bp, Homo sapiens
tgtcaccccagagccac

SEQ ID NO: 6748913 - DNA, 21 bp, Homo sapiens
tgtcaccccagagccacacat

SEQ ID NO: 6748914 - DNA, 21 bp, Homo sapiens
tgtcaccctccaccgagccac

SEQ ID NO: 6748915 - DNA, 14 bp, Homo sapiens
tgtcaccctgcaga

SEQ ID NO: 6748916 - DNA, 13 bp, Homo sapiens
tgtcaccctggcc

SEQ ID NO: 6748917 - DNA, 15 bp, Homo sapiens
tgtcaccctggccac

SEQ ID NO: 6748918 - DNA, 18 bp, Homo sapiens
tgtcaccctggccaccac

SEQ ID NO: 6748919 - DNA, 14 bp, Homo sapiens
tgtcaccctggccc

SEQ ID NO: 6748920 - DNA, 18 bp, Homo sapiens
tgtcaccctggccccaac

SEQ ID NO: 6748921 - DNA, 16 bp, Homo sapiens
tgtcaccgcaggtgct

SEQ ID NO: 6748922 - DNA, 17 bp, Homo sapiens
tgtcaccgccatgcaac

SEQ ID NO: 6748923 - DNA, 19 bp, Homo sapiens
tgtcaccggatcctgggtg

SEQ ID NO: 6748924 - DNA, 17 bp, Homo sapiens
tgtcaccggtcagtgcc

SEQ ID NO: 6748925 - DNA, 19 bp, Homo sapiens
tgtcaccgtggaccttcct

SEQ ID NO: 6748926 - DNA, 21 bp, Homo sapiens
tgtcaccgtggaccttcctgc

SEQ ID NO: 6748927 - DNA, 20 bp, Homo sapiens
tgtcacctagcagatatgta

SEQ ID NO: 6748928 - DNA, 12 bp, Homo sapiens
tgtcacctcagc

SEQ ID NO: 6748929 - DNA, 19 bp, Homo sapiens
tgtcacctcagctgatatt

SEQ ID NO: 6748930 - DNA, 16 bp, Homo sapiens
tgtcacctccttcccc

SEQ ID NO: 6748931 - DNA, 18 bp, Homo sapiens
tgtcacctccttccccag

SEQ ID NO: 6748932 - DNA, 22 bp, Homo sapiens
tgtcacctccttccccagctcc

SEQ ID NO: 6748933 - DNA, 14 bp, Homo sapiens
tgtcacctctcagc

SEQ ID NO: 6748934 - DNA, 18 bp, Homo sapiens
tgtcacctctcagctgct

SEQ ID NO: 6748935 - DNA, 19 bp, Homo sapiens
tgtcacctctcagctgctg

SEQ ID NO: 6748936 - DNA, 21 bp, Homo sapiens
tgtcacctctcagctgctgga

SEQ ID NO: 6748937 - DNA, 21 bp, Homo sapiens
tgtcacctctctcagagcatc

SEQ ID NO: 6748938 - DNA, 23 bp, Homo sapiens
tgtcacctcttccgactctttct

SEQ ID NO: 6748939 - DNA, 20 bp, Homo sapiens
tgtcacctgctcacagggat

SEQ ID NO: 6748940 - DNA, 18 bp, Homo sapiens
tgtcacctgcttctctgc

SEQ ID NO: 6748941 - DNA, 18 bp, Homo sapiens
tgtcacctggcacattca

SEQ ID NO: 6748942 - DNA, 15 bp, Homo sapiens
tgtcacctggctgct

SEQ ID NO: 6748943 - DNA, 21 bp, Homo sapiens
tgtcacctggctgctaggcca

SEQ ID NO: 6748944 - DNA, 15 bp, Homo sapiens
tgtcaccttcctagt

SEQ ID NO: 6748945 - DNA, 15 bp, Homo sapiens
tgtcacctttttaat

SEQ ID NO: 6748946 - DNA, 15 bp, Homo sapiens
tgtcacggccaggca

SEQ ID NO: 6748947 - DNA, 18 bp, Homo sapiens
tgtcacgtactgtctgat

SEQ ID NO: 6748948 - DNA, 19 bp, Homo sapiens
tgtcacgtactgtctgatt

SEQ ID NO: 6748949 - DNA, 22 bp, Homo sapiens
tgtcacgtgaaatatttaagta

SEQ ID NO: 6748950 - DNA, 16 bp, Homo sapiens
tgtcacgtgaccctgt

SEQ ID NO: 6748951 - DNA, 23 bp, Homo sapiens
tgtcacgtggtcaaggcccggcc

SEQ ID NO: 6748952 - DNA, 15 bp, Homo sapiens
tgtcacgttctggaa

SEQ ID NO: 6748953 - DNA, 14 bp, Homo sapiens
tgtcactaaagcag

SEQ ID NO: 6748954 - DNA, 13 bp, Homo sapiens
tgtcactactggt

SEQ ID NO: 6748955 - DNA, 16 bp, Homo sapiens
tgtcactactggtctg

SEQ ID NO: 6748956 - DNA, 14 bp, Homo sapiens
tgtcactatatctt

SEQ ID NO: 6748957 - DNA, 23 bp, Homo sapiens
tgtcactatgctatttctggcct

SEQ ID NO: 6748958 - DNA, 21 bp, Homo sapiens
tgtcactatggcactgttgtc

SEQ ID NO: 6748959 - DNA, 14 bp, Homo sapiens
tgtcactcaaggcg

SEQ ID NO: 6748960 - DNA, 22 bp, Homo sapiens
tgtcactcaaggcggtgcttga

SEQ ID NO: 6748961 - DNA, 20 bp, Homo sapiens
tgtcactcactgaggccatc

SEQ ID NO: 6748962 - DNA, 21 bp, Homo sapiens
tgtcactccataaaaagaaag

SEQ ID NO: 6748963 - DNA, 21 bp, Homo sapiens
tgtcactcccagaccacctcc

SEQ ID NO: 6748964 - DNA, 16 bp, Homo sapiens
tgtcactctaggaaga

SEQ ID NO: 6748965 - DNA, 13 bp, Homo sapiens
tgtcactgaagat

SEQ ID NO: 6748966 - DNA, 15 bp, Homo sapiens
tgtcactgaagtgat

SEQ ID NO: 6748967 - DNA, 20 bp, Homo sapiens
tgtcactgaagtgattgaaa

SEQ ID NO: 6748968 - DNA, 22 bp, Homo sapiens
tgtcactgaatatcaactctga

SEQ ID NO: 6748969 - DNA, 17 bp, Homo sapiens
tgtcactgacacacacg

SEQ ID NO: 6748970 - DNA, 17 bp, Homo sapiens
tgtcactgacctttgtt

SEQ ID NO: 6748971 - DNA, 16 bp, Homo sapiens
tgtcactgactcaggc

SEQ ID NO: 6748972 - DNA, 13 bp, Homo sapiens
tgtcactgagctg

SEQ ID NO: 6748973 - DNA, 13 bp, Homo sapiens
tgtcactgctgta

SEQ ID NO: 6748974 - DNA, 15 bp, Homo sapiens
tgtcactgctgtaaa

SEQ ID NO: 6748975 - DNA, 17 bp, Homo sapiens
tgtcactgctgtaaagc

SEQ ID NO: 6748976 - DNA, 21 bp, Homo sapiens
tgtcactgcttttggcctgga

SEQ ID NO: 6748977 - DNA, 16 bp, Homo sapiens
tgtcactggcagagca

SEQ ID NO: 6748978 - DNA, 20 bp, Homo sapiens
tgtcactggcagagcacagc

SEQ ID NO: 6748979 - DNA, 21 bp, Homo sapiens
tgtcactggctgcctccactc

SEQ ID NO: 6748980 - DNA, 18 bp, Homo sapiens
tgtcactggctggctcct

SEQ ID NO: 6748981 - DNA, 21 bp, Homo sapiens
tgtcactggctggctcctagg

SEQ ID NO: 6748982 - DNA, 22 bp, Homo sapiens
tgtcactgttataaattttgta

SEQ ID NO: 6748983 - DNA, 21 bp, Homo sapiens
tgtcacttactgtttctgtca

SEQ ID NO: 6748984 - DNA, 20 bp, Homo sapiens
tgtcacttagggataacact

SEQ ID NO: 6748985 - DNA, 18 bp, Homo sapiens
tgtcacttaggttttgtc

SEQ ID NO: 6748986 - DNA, 14 bp, Homo sapiens
tgtcacttccacac

SEQ ID NO: 6748987 - DNA, 12 bp, Homo sapiens
tgtcacttctgg

SEQ ID NO: 6748988 - DNA, 15 bp, Homo sapiens
tgtcacttgactctt

SEQ ID NO: 6748989 - DNA, 17 bp, Homo sapiens
tgtcacttgcacagagg

SEQ ID NO: 6748990 - DNA, 19 bp, Homo sapiens
tgtcacttgctgctttttc

SEQ ID NO: 6748991 - DNA, 20 bp, Homo sapiens
tgtcacttgctggctgtgaa

SEQ ID NO: 6748992 - DNA, 23 bp, Homo sapiens
tgtcacttgtaggtttctctgcc

SEQ ID NO: 6748993 - DNA, 14 bp, Homo sapiens
tgtcacttgtcggg

SEQ ID NO: 6748994 - DNA, 20 bp, Homo sapiens
tgtcacttgtcgggggccca

SEQ ID NO: 6748995 - DNA, 15 bp, Homo sapiens
tgtcacttgtgcttt

SEQ ID NO: 6748996 - DNA, 20 bp, Homo sapiens
tgtcacttgtgctttgctct

SEQ ID NO: 6748997 - DNA, 17 bp, Homo sapiens
tgtcactttctctctta

SEQ ID NO: 6748998 - DNA, 12 bp, Homo sapiens
tgtcacttttta

SEQ ID NO: 6748999 - DNA, 22 bp, Homo sapiens
tgtcactttttaaaccactgta

SEQ ID NO: 6749000 - DNA, 19 bp, Homo sapiens
tgtcactttttgaggcaaa

SEQ ID NO: 6749001 - DNA, 15 bp, Homo sapiens
tgtcacttttttcct

SEQ ID NO: 6749002 - DNA, 22 bp, Homo sapiens
tgtcacttttttcctgtcaata

SEQ ID NO: 6749003 - DNA, 21 bp, Homo sapiens
tgtcagaaaataacagatgct

SEQ ID NO: 6749004 - DNA, 15 bp, Homo sapiens
tgtcagaaacaatga

SEQ ID NO: 6749005 - DNA, 22 bp, Homo sapiens
tgtcagaaacaatgacatccag

SEQ ID NO: 6749006 - DNA, 14 bp, Homo sapiens
tgtcagaaacatga

SEQ ID NO: 6749007 - DNA, 16 bp, Homo sapiens
tgtcagaaacatgaaa

SEQ ID NO: 6749008 - DNA, 12 bp, Homo sapiens
tgtcagaaactc

SEQ ID NO: 6749009 - DNA, 21 bp, Homo sapiens
tgtcagaacagagtgcaaccc

SEQ ID NO: 6749010 - DNA, 15 bp, Homo sapiens
tgtcagaagctggga

SEQ ID NO: 6749011 - DNA, 15 bp, Homo sapiens
tgtcagaaggagaca

SEQ ID NO: 6749012 - DNA, 22 bp, Homo sapiens
tgtcagaaggagacagaatgag

SEQ ID NO: 6749013 - DNA, 22 bp, Homo sapiens
tgtcagaagggggttgtggcaa

SEQ ID NO: 6749014 - DNA, 12 bp, Homo sapiens
tgtcagaagtgc

SEQ ID NO: 6749015 - DNA, 21 bp, Homo sapiens
tgtcagaataaagaacattct

SEQ ID NO: 6749016 - DNA, 17 bp, Homo sapiens
tgtcagaataggaaaac

SEQ ID NO: 6749017 - DNA, 21 bp, Homo sapiens
tgtcagaataggaaaacattg

SEQ ID NO: 6749018 - DNA, 17 bp, Homo sapiens
tgtcagaatcatgctgt

SEQ ID NO: 6749019 - DNA, 22 bp, Homo sapiens
tgtcagaatgctattgaaaatg

SEQ ID NO: 6749020 - DNA, 20 bp, Homo sapiens
tgtcagaatggaatccatct

SEQ ID NO: 6749021 - DNA, 17 bp, Homo sapiens
tgtcagaatgttgtgtt

SEQ ID NO: 6749022 - DNA, 17 bp, Homo sapiens
tgtcagaattaaaataa

SEQ ID NO: 6749023 - DNA, 18 bp, Homo sapiens
tgtcagaatttctttgtc

SEQ ID NO: 6749024 - DNA, 21 bp, Homo sapiens
tgtcagacagaacttgaatgt

SEQ ID NO: 6749025 - DNA, 14 bp, Homo sapiens
tgtcagacataaag

SEQ ID NO: 6749026 - DNA, 15 bp, Homo sapiens
tgtcagacataaagc

SEQ ID NO: 6749027 - DNA, 16 bp, Homo sapiens
tgtcagacatgaaaac

SEQ ID NO: 6749028 - DNA, 20 bp, Homo sapiens
tgtcagaccttcttccacag

SEQ ID NO: 6749029 - DNA, 20 bp, Homo sapiens
tgtcagacgttggtcccaag

SEQ ID NO: 6749030 - DNA, 23 bp, Homo sapiens
tgtcagacgttggtcccaagttt

SEQ ID NO: 6749031 - DNA, 14 bp, Homo sapiens
tgtcagactttaaa

SEQ ID NO: 6749032 - DNA, 23 bp, Homo sapiens
tgtcagactttaaagaataatat

SEQ ID NO: 6749033 - DNA, 23 bp, Homo sapiens
tgtcagagacagaccccttggct

SEQ ID NO: 6749034 - DNA, 11 bp, Homo sapiens
tgtcagagatg

SEQ ID NO: 6749035 - DNA, 23 bp, Homo sapiens
tgtcagagcactttaaaaacagg

SEQ ID NO: 6749036 - DNA, 16 bp, Homo sapiens
tgtcagagccaggctc

SEQ ID NO: 6749037 - DNA, 17 bp, Homo sapiens
tgtcagagccaggctct

SEQ ID NO: 6749038 - DNA, 19 bp, Homo sapiens
tgtcagagccaggctctgc

SEQ ID NO: 6749039 - DNA, 20 bp, Homo sapiens
tgtcagagccaggctctgcc

SEQ ID NO: 6749040 - DNA, 12 bp, Homo sapiens
tgtcagagccca

SEQ ID NO: 6749041 - DNA, 13 bp, Homo sapiens
tgtcagagcccag

SEQ ID NO: 6749042 - DNA, 12 bp, Homo sapiens
tgtcagagccta

SEQ ID NO: 6749043 - DNA, 11 bp, Homo sapiens
tgtcagagctg

SEQ ID NO: 6749044 - DNA, 14 bp, Homo sapiens
tgtcagaggaacaa

SEQ ID NO: 6749045 - DNA, 16 bp, Homo sapiens
tgtcagaggaccccag

SEQ ID NO: 6749046 - DNA, 18 bp, Homo sapiens
tgtcagaggaccccaggg

SEQ ID NO: 6749047 - DNA, 20 bp, Homo sapiens
tgtcagaggaccccagggtg

SEQ ID NO: 6749048 - DNA, 20 bp, Homo sapiens
tgtcagaggcacaaaagggt

SEQ ID NO: 6749049 - DNA, 15 bp, Homo sapiens
tgtcagatacaatgt

SEQ ID NO: 6749050 - DNA, 18 bp, Homo sapiens
tgtcagatccaggagctc

SEQ ID NO: 6749051 - DNA, 24 bp, Homo sapiens
tgtcagatccaggagctccagtgt

SEQ ID NO: 6749052 - DNA, 16 bp, Homo sapiens
tgtcagatgagaacaa

SEQ ID NO: 6749053 - DNA, 18 bp, Homo sapiens
tgtcagatgagaacaaag

SEQ ID NO: 6749054 - DNA, 15 bp, Homo sapiens
tgtcagatgcccgag

SEQ ID NO: 6749055 - DNA, 15 bp, Homo sapiens
tgtcagattcctttc

SEQ ID NO: 6749056 - DNA, 17 bp, Homo sapiens
tgtcagatttctggttg

SEQ ID NO: 6749057 - DNA, 11 bp, Homo sapiens
tgtcagatttt

SEQ ID NO: 6749058 - DNA, 12 bp, Homo sapiens
tgtcagcatcaa

SEQ ID NO: 6749059 - DNA, 21 bp, Homo sapiens
tgtcagcatctgaccatctgt

SEQ ID NO: 6749060 - DNA, 23 bp, Homo sapiens
tgtcagcatctggctgtctagaa

SEQ ID NO: 6749061 - DNA, 14 bp, Homo sapiens
tgtcagcatgaatt

SEQ ID NO: 6749062 - DNA, 16 bp, Homo sapiens
tgtcagcatgacaaaa

SEQ ID NO: 6749063 - DNA, 21 bp, Homo sapiens
tgtcagcatgacaaaagtgac

SEQ ID NO: 6749064 - DNA, 18 bp, Homo sapiens
tgtcagccacctccctct

SEQ ID NO: 6749065 - DNA, 16 bp, Homo sapiens
tgtcagccagccgccc

SEQ ID NO: 6749066 - DNA, 17 bp, Homo sapiens
tgtcagccagccgccct

SEQ ID NO: 6749067 - DNA, 20 bp, Homo sapiens
tgtcagccagccgccctggg

SEQ ID NO: 6749068 - DNA, 19 bp, Homo sapiens
tgtgacagcgatggcaggc

SEQ ID NO: 6749069 - DNA, 21 bp, Homo sapiens
tgtgacagcgatggcaggcct

SEQ ID NO: 6749070 - DNA, 23 bp, Homo sapiens
tgtgacagcgatggcaggcctga

SEQ ID NO: 6749071 - DNA, 18 bp, Homo sapiens
tgtgacaggaaagccctc

SEQ ID NO: 6749072 - DNA, 15 bp, Homo sapiens
tgtgacaggcagcag

SEQ ID NO: 6749073 - DNA, 17 bp, Homo sapiens
tgtgacaggcagcagag

SEQ ID NO: 6749074 - DNA, 12 bp, Homo sapiens
tgtgacagggcc

SEQ ID NO: 6749075 - DNA, 14 bp, Homo sapiens
tgtgacagggccag

SEQ ID NO: 6749076 - DNA, 18 bp, Homo sapiens
tgtgacagtcactgcatt

SEQ ID NO: 6749077 - DNA, 13 bp, Homo sapiens
tgtgacagtgcct

SEQ ID NO: 6749078 - DNA, 15 bp, Homo sapiens
tgtgacagtgcctct

SEQ ID NO: 6749079 - DNA, 21 bp, Homo sapiens
tgtgacagtgcctcttccagt

SEQ ID NO: 6749080 - DNA, 13 bp, Homo sapiens
tgtgacagtgttg

SEQ ID NO: 6749081 - DNA, 21 bp, Homo sapiens
tgtgacagtttccaaattgcc

SEQ ID NO: 6749082 - DNA, 20 bp, Homo sapiens
tgtgacatcacagggcctca

SEQ ID NO: 6749083 - DNA, 20 bp, Homo sapiens
tgtgacatctctattcccca

SEQ ID NO: 6749084 - DNA, 12 bp, Homo sapiens
tgtgacatgccc

SEQ ID NO: 6749085 - DNA, 18 bp, Homo sapiens
tgtgacatggtgcctgag

SEQ ID NO: 6749086 - DNA, 12 bp, Homo sapiens
tgtgacatgtaa

SEQ ID NO: 6749087 - DNA, 15 bp, Homo sapiens
tgtgacatgttttat

SEQ ID NO: 6749088 - DNA, 11 bp, Homo sapiens
tgtgacattcc

SEQ ID NO: 6749089 - DNA, 20 bp, Homo sapiens
tgtgacattccatgacgaca

SEQ ID NO: 6749090 - DNA, 14 bp, Homo sapiens
tgtgacattcctga

SEQ ID NO: 6749091 - DNA, 15 bp, Homo sapiens
tgtgacattcctgat

SEQ ID NO: 6749092 - DNA, 23 bp, Homo sapiens
tgtgacattgctggtcatccttg

SEQ ID NO: 6749093 - DNA, 22 bp, Homo sapiens
tgtgacatttacaccacacttt

SEQ ID NO: 6749094 - DNA, 20 bp, Homo sapiens
tgtgacatttgtcattttca

SEQ ID NO: 6749095 - DNA, 18 bp, Homo sapiens
tgtgacattttacattaa

SEQ ID NO: 6749096 - DNA, 12 bp, Homo sapiens
tgtgaccaaagc

SEQ ID NO: 6749097 - DNA, 13 bp, Homo sapiens
tgtgaccaactgt

SEQ ID NO: 6749098 - DNA, 16 bp, Homo sapiens
tgtgaccaactgtgtt

SEQ ID NO: 6749099 - DNA, 22 bp, Homo sapiens
tgtgaccaactgtgttgtatta

SEQ ID NO: 6749100 - DNA, 19 bp, Homo sapiens
tgtgaccacaggctggtgt

SEQ ID NO: 6749101 - DNA, 21 bp, Homo sapiens
tgtgaccacatacgtgttagg

SEQ ID NO: 6749102 - DNA, 19 bp, Homo sapiens
tgtgaccaccttctgtccc

SEQ ID NO: 6749103 - DNA, 13 bp, Homo sapiens
tgtgaccactgaa

SEQ ID NO: 6749104 - DNA, 14 bp, Homo sapiens
tgtgaccactgaat

SEQ ID NO: 6749105 - DNA, 21 bp, Homo sapiens
tgtgaccactgaattcactcc

SEQ ID NO: 6749106 - DNA, 22 bp, Homo sapiens
tgtgaccagaaagcttcatcca

SEQ ID NO: 6749107 - DNA, 13 bp, Homo sapiens
tgtgaccagcgga

SEQ ID NO: 6749108 - DNA, 13 bp, Homo sapiens
tgtgaccatgtga

SEQ ID NO: 6749109 - DNA, 16 bp, Homo sapiens
tgtgaccatgttcatt

SEQ ID NO: 6749110 - DNA, 15 bp, Homo sapiens
tgtgaccattctgcc

SEQ ID NO: 6749111 - DNA, 20 bp, Homo sapiens
tgtgacccaaagaagtttaa

SEQ ID NO: 6749112 - DNA, 13 bp, Homo sapiens
tgtgacccaccag

SEQ ID NO: 6749113 - DNA, 19 bp, Homo sapiens
tgtgacccaccagtgcctt

SEQ ID NO: 6749114 - DNA, 17 bp, Homo sapiens
tgtgacccactgcgcac

SEQ ID NO: 6749115 - DNA, 22 bp, Homo sapiens
tgtgacccagcactgcccaaag

SEQ ID NO: 6749116 - DNA, 16 bp, Homo sapiens
tgtgacccagggtgca

SEQ ID NO: 6749117 - DNA, 16 bp, Homo sapiens
tgtgaccccactgcca

SEQ ID NO: 6749118 - DNA, 15 bp, Homo sapiens
tgtgacccccagctc

SEQ ID NO: 6749119 - DNA, 15 bp, Homo sapiens
tgtgacccctcctgg

SEQ ID NO: 6749120 - DNA, 14 bp, Homo sapiens
tgtgacccctcctt

SEQ ID NO: 6749121 - DNA, 17 bp, Homo sapiens
tgtgacccgtgaatgtg

SEQ ID NO: 6749122 - DNA, 17 bp, Homo sapiens
tgtgaccctcaattcat

SEQ ID NO: 6749123 - DNA, 11 bp, Homo sapiens
tgtgaccctcc

SEQ ID NO: 6749124 - DNA, 17 bp, Homo sapiens
tgtgaccctccaaatgg

SEQ ID NO: 6749125 - DNA, 14 bp, Homo sapiens
tgtgaccctctgaa

SEQ ID NO: 6749126 - DNA, 16 bp, Homo sapiens
tgtgaccctctgaatg

SEQ ID NO: 6749127 - DNA, 19 bp, Homo sapiens
tgtgaccctctttgctgaa

SEQ ID NO: 6749128 - DNA, 23 bp, Homo sapiens
tgtgaccctctttgctgaagaat

SEQ ID NO: 6749129 - DNA, 19 bp, Homo sapiens
tgtgaccctgagggctcct

SEQ ID NO: 6749130 - DNA, 13 bp, Homo sapiens
tgtgaccctgggc

SEQ ID NO: 6749131 - DNA, 21 bp, Homo sapiens
tgtgaccggggtcctgaggct

SEQ ID NO: 6749132 - DNA, 13 bp, Homo sapiens
tgtgacctcaggc

SEQ ID NO: 6749133 - DNA, 15 bp, Homo sapiens
tgtgacctgacacct

SEQ ID NO: 6749134 - DNA, 16 bp, Homo sapiens
tgtgacctgacacctg

SEQ ID NO: 6749135 - DNA, 21 bp, Homo sapiens
tgtgacctgacacctgccgct

SEQ ID NO: 6749136 - DNA, 17 bp, Homo sapiens
tgtgacctgctcctgcc

SEQ ID NO: 6749137 - DNA, 18 bp, Homo sapiens
tgtgacctgctcctgccc

SEQ ID NO: 6749138 - DNA, 15 bp, Homo sapiens
tgtgacctggggcag

SEQ ID NO: 6749139 - DNA, 17 bp, Homo sapiens
tgtgacctggtctggtc

SEQ ID NO: 6749140 - DNA, 23 bp, Homo sapiens
tgtgacctggtctggtcaggcaa

SEQ ID NO: 6749141 - DNA, 16 bp, Homo sapiens
tgtgacctgtcagaat

SEQ ID NO: 6749142 - DNA, 19 bp, Homo sapiens
tgtgaccttgagaagattc

SEQ ID NO: 6749143 - DNA, 16 bp, Homo sapiens
tgtgacgctttcaaca

SEQ ID NO: 6749144 - DNA, 19 bp, Homo sapiens
tgtgacgggggttggggtg

SEQ ID NO: 6749145 - DNA, 13 bp, Homo sapiens
tgtgacgtcggcc

SEQ ID NO: 6749146 - DNA, 19 bp, Homo sapiens
tgtgacgtcgggcattcat

SEQ ID NO: 6749147 - DNA, 17 bp, Homo sapiens
tgtgactaattgtataa

SEQ ID NO: 6749148 - DNA, 16 bp, Homo sapiens
tgtgactaccgtgcca

SEQ ID NO: 6749149 - DNA, 17 bp, Homo sapiens
tgtgactaccgtgccag

SEQ ID NO: 6749150 - DNA, 19 bp, Homo sapiens
tgtgactaccgtgccagca

SEQ ID NO: 6749151 - DNA, 20 bp, Homo sapiens
tgtgactaccgtgccagcag

SEQ ID NO: 6749152 - DNA, 17 bp, Homo sapiens
tgtgactaggcatacac

SEQ ID NO: 6749153 - DNA, 22 bp, Homo sapiens
tgtgactagtgctgaagcttat

SEQ ID NO: 6749154 - DNA, 18 bp, Homo sapiens
tgtgactataaagctgtt

SEQ ID NO: 6749155 - DNA, 18 bp, Homo sapiens
tgtgactatatagagatg

SEQ ID NO: 6749156 - DNA, 16 bp, Homo sapiens
tgtgactcattcccag

SEQ ID NO: 6749157 - DNA, 17 bp, Homo sapiens
tgtgactcctcccttcc

SEQ ID NO: 6749158 - DNA, 21 bp, Homo sapiens
tgtgactcctgttgccatgga

SEQ ID NO: 6749159 - DNA, 15 bp, Homo sapiens
tgtgactccttatct

SEQ ID NO: 6749160 - DNA, 16 bp, Homo sapiens
tgtgactctggcttgg

SEQ ID NO: 6749161 - DNA, 17 bp, Homo sapiens
tgtgactctggcttggc

SEQ ID NO: 6749162 - DNA, 21 bp, Homo sapiens
tgtgactcttactccttaggt

SEQ ID NO: 6749163 - DNA, 16 bp, Homo sapiens
tgtgactcttctctca

SEQ ID NO: 6749164 - DNA, 18 bp, Homo sapiens
tgtgactcttctctcaac

SEQ ID NO: 6749165 - DNA, 15 bp, Homo sapiens
tgtgactctttccaa

SEQ ID NO: 6749166 - DNA, 17 bp, Homo sapiens
tgtgactctttccaacc

SEQ ID NO: 6749167 - DNA, 21 bp, Homo sapiens
tgtgactctttcctaaagcca

SEQ ID NO: 6749168 - DNA, 20 bp, Homo sapiens
tgtgactgaagaagatgagc

SEQ ID NO: 6749169 - DNA, 22 bp, Homo sapiens
tgtgactgaagaagatgagcct

SEQ ID NO: 6749170 - DNA, 13 bp, Homo sapiens
tgtgactgaaggg

SEQ ID NO: 6749171 - DNA, 14 bp, Homo sapiens
tgtgactgagaaat

SEQ ID NO: 6749172 - DNA, 20 bp, Homo sapiens
tgtgactgagcaagactctt

SEQ ID NO: 6749173 - DNA, 19 bp, Homo sapiens
tgtgactgagggcctggtc

SEQ ID NO: 6749174 - DNA, 15 bp, Homo sapiens
tgtgactgcatcata

SEQ ID NO: 6749175 - DNA, 22 bp, Homo sapiens
tgtgactgccaggataaagctt

SEQ ID NO: 6749176 - DNA, 12 bp, Homo sapiens
tgtgactggatc

SEQ ID NO: 6749177 - DNA, 21 bp, Homo sapiens
tgtgactggcaagaggcctca

SEQ ID NO: 6749178 - DNA, 17 bp, Homo sapiens
tgtgactggctaaagct

SEQ ID NO: 6749179 - DNA, 14 bp, Homo sapiens
tgtgactgtcactt

SEQ ID NO: 6749180 - DNA, 20 bp, Homo sapiens
tgtgactgtggccctgtctg

SEQ ID NO: 6749181 - DNA, 14 bp, Homo sapiens
tgtgacttacaatt

SEQ ID NO: 6749182 - DNA, 15 bp, Homo sapiens
tgtgacttcactgta

SEQ ID NO: 6749183 - DNA, 19 bp, Homo sapiens
tgtgacttcttacacataa

SEQ ID NO: 6749184 - DNA, 13 bp, Homo sapiens
tgtgacttggccg

SEQ ID NO: 6749185 - DNA, 13 bp, Homo sapiens
tgtgactttgaaa

SEQ ID NO: 6749186 - DNA, 16 bp, Homo sapiens
tgtgactttgctttga

SEQ ID NO: 6749187 - DNA, 20 bp, Homo sapiens
tgtgacttttagacagtggt

SEQ ID NO: 6749188 - DNA, 19 bp, Homo sapiens
tgtgacttttatatgcttt

SEQ ID NO: 6749189 - DNA, 23 bp, Homo sapiens
tgtgacttttgctttaattccat

SEQ ID NO: 6749190 - DNA, 12 bp, Homo sapiens
tgtgactttttt

SEQ ID NO: 6749191 - DNA, 20 bp, Homo sapiens
tgtgagaaaaccccttccca

SEQ ID NO: 6749192 - DNA, 21 bp, Homo sapiens
tgtgagaaagcagatcatctc

SEQ ID NO: 6749193 - DNA, 14 bp, Homo sapiens
tgtgagaactgtga

SEQ ID NO: 6749194 - DNA, 16 bp, Homo sapiens
tgtgagaactgtgaat

SEQ ID NO: 6749195 - DNA, 18 bp, Homo sapiens
tgtgagaactgtgaatat

SEQ ID NO: 6749196 - DNA, 21 bp, Homo sapiens
tgtgagaagccagccagaggc

SEQ ID NO: 6749197 - DNA, 21 bp, Homo sapiens
tgtgagaagtgaatgctggga

SEQ ID NO: 6749198 - DNA, 23 bp, Homo sapiens
tgtgagaagtgaatgctgggact

SEQ ID NO: 6749199 - DNA, 24 bp, Homo sapiens
tgtgagaagtgaatgctgggactc

SEQ ID NO: 6749200 - DNA, 17 bp, Homo sapiens
tgtgagaagtgccttct

SEQ ID NO: 6749201 - DNA, 20 bp, Homo sapiens
tgtgagaagtgccttctcct

SEQ ID NO: 6749202 - DNA, 14 bp, Homo sapiens
tgtgagaatcaaaa

SEQ ID NO: 6749203 - DNA, 20 bp, Homo sapiens
tgtgagaatggcctggagca

SEQ ID NO: 6749204 - DNA, 22 bp, Homo sapiens
tgtgagaatggcctggagcagg

SEQ ID NO: 6749205 - DNA, 18 bp, Homo sapiens
tgtgagaattactgtttg

SEQ ID NO: 6749206 - DNA, 16 bp, Homo sapiens
tgtgagacaccaggca

SEQ ID NO: 6749207 - DNA, 13 bp, Homo sapiens
tgtgagacagcaa

SEQ ID NO: 6749208 - DNA, 15 bp, Homo sapiens
tgtgagacagcaagt

SEQ ID NO: 6749209 - DNA, 13 bp, Homo sapiens
tgtgagaccccaa

SEQ ID NO: 6749210 - DNA, 16 bp, Homo sapiens
tgtgagacccccacac

SEQ ID NO: 6749211 - DNA, 18 bp, Homo sapiens
tgtgagacccccacacct

SEQ ID NO: 6749212 - DNA, 19 bp, Homo sapiens
tgtgagacttaaaacatgg

SEQ ID NO: 6749213 - DNA, 13 bp, Homo sapiens
tgtgagagaaagt

SEQ ID NO: 6749214 - DNA, 15 bp, Homo sapiens
tgtgagagagactga

SEQ ID NO: 6749215 - DNA, 20 bp, Homo sapiens
tgtgagagagagggcgccca

SEQ ID NO: 6749216 - DNA, 21 bp, Homo sapiens
tgtgagagagagggcgcccag

SEQ ID NO: 6749217 - DNA, 14 bp, Homo sapiens
tgtgagagaggacc

SEQ ID NO: 6749218 - DNA, 17 bp, Homo sapiens
tgtgagagaggacctcc

SEQ ID NO: 6749219 - DNA, 20 bp, Homo sapiens
tgtgagagccacgctggcct

SEQ ID NO: 6749220 - DNA, 16 bp, Homo sapiens
tgtgagagcccagtca

SEQ ID NO: 6749221 - DNA, 17 bp, Homo sapiens
tgtgagagcccagtcat

SEQ ID NO: 6749222 - DNA, 21 bp, Homo sapiens
tgtgagagcccagtcattgta

SEQ ID NO: 6749223 - DNA, 13 bp, Homo sapiens
tgtgagagcccat

SEQ ID NO: 6749224 - DNA, 15 bp, Homo sapiens
tgtgagaggtttgac

SEQ ID NO: 6749225 - DNA, 16 bp, Homo sapiens
tgtgagaggtttgact

SEQ ID NO: 6749226 - DNA, 21 bp, Homo sapiens
tgtgagatatacaaatatatt

SEQ ID NO: 6749227 - DNA, 22 bp, Homo sapiens
tgtgagatccttcacaggcagt

SEQ ID NO: 6749228 - DNA, 16 bp, Homo sapiens
tgtgagatgagagtgg

SEQ ID NO: 6749229 - DNA, 18 bp, Homo sapiens
tgtgagatgatttgtact

SEQ ID NO: 6749230 - DNA, 15 bp, Homo sapiens
tgtgagatgctagaa

SEQ ID NO: 6749231 - DNA, 15 bp, Homo sapiens
tgtgagatggatgta

SEQ ID NO: 6749232 - DNA, 13 bp, Homo sapiens
tgtgagatgtgta

SEQ ID NO: 6749233 - DNA, 20 bp, Homo sapiens
tgtgagcacaaagaagaaag

SEQ ID NO: 6749234 - DNA, 15 bp, Homo sapiens
tgtgagcagcaccca

SEQ ID NO: 6749235 - DNA, 14 bp, Homo sapiens
tgtgagcagtgagt

SEQ ID NO: 6749236 - DNA, 18 bp, Homo sapiens
tgtgagcatcacagtttt

SEQ ID NO: 6749237 - DNA, 14 bp, Homo sapiens
tgtgagcatcctgc

SEQ ID NO: 6749238 - DNA, 19 bp, Homo sapiens
tgtgagccacagtgcctgg

SEQ ID NO: 6749239 - DNA, 23 bp, Homo sapiens
tgtgagccactgtgcccagcagt

SEQ ID NO: 6749240 - DNA, 20 bp, Homo sapiens
tgtgagccagagggagctgt

SEQ ID NO: 6749241 - DNA, 17 bp, Homo sapiens
tgtgagccatgcctccc

SEQ ID NO: 6749242 - DNA, 15 bp, Homo sapiens
tgtgagccccacagc

SEQ ID NO: 6749243 - DNA, 14 bp, Homo sapiens
tgtgagccccaggg

SEQ ID NO: 6749244 - DNA, 20 bp, Homo sapiens
tgtgagccccaggggggcct

SEQ ID NO: 6749245 - DNA, 14 bp, Homo sapiens
tgtgagcctatgat

SEQ ID NO: 6749246 - DNA, 13 bp, Homo sapiens
tgtgcctgcagcc

SEQ ID NO: 6749247 - DNA, 11 bp, Homo sapiens
tgtgcctgcca

SEQ ID NO: 6749248 - DNA, 19 bp, Homo sapiens
tgtgcctgccatgggccag

SEQ ID NO: 6749249 - DNA, 21 bp, Homo sapiens
tgtgcctgccatgggccagcc

SEQ ID NO: 6749250 - DNA, 22 bp, Homo sapiens
tgtgcctgccatgggccagcct

SEQ ID NO: 6749251 - DNA, 14 bp, Homo sapiens
tgtgcctgccctgg

SEQ ID NO: 6749252 - DNA, 17 bp, Homo sapiens
tgtgcctgctatccagc

SEQ ID NO: 6749253 - DNA, 21 bp, Homo sapiens
tgtgcctgctatccagccgca

SEQ ID NO: 6749254 - DNA, 20 bp, Homo sapiens
tgtgcctgctcagcagccag

SEQ ID NO: 6749255 - DNA, 14 bp, Homo sapiens
tgtgcctgcttcag

SEQ ID NO: 6749256 - DNA, 14 bp, Homo sapiens
tgtgcctgcttctg

SEQ ID NO: 6749257 - DNA, 15 bp, Homo sapiens
tgtgcctgcttctgt

SEQ ID NO: 6749258 - DNA, 19 bp, Homo sapiens
tgtgcctggagctcctggg

SEQ ID NO: 6749259 - DNA, 16 bp, Homo sapiens
tgtgcctggccccagc

SEQ ID NO: 6749260 - DNA, 23 bp, Homo sapiens
tgtgcctggccccagcctgggcc

SEQ ID NO: 6749261 - DNA, 14 bp, Homo sapiens
tgtgcctggcctct

SEQ ID NO: 6749262 - DNA, 15 bp, Homo sapiens
tgtgcctggctcaga

SEQ ID NO: 6749263 - DNA, 14 bp, Homo sapiens
tgtgcctggctccc

SEQ ID NO: 6749264 - DNA, 20 bp, Homo sapiens
tgtgcctggctccctgatgg

SEQ ID NO: 6749265 - DNA, 13 bp, Homo sapiens
tgtgcctgggccc

SEQ ID NO: 6749266 - DNA, 14 bp, Homo sapiens
tgtgcctgggccct

SEQ ID NO: 6749267 - DNA, 22 bp, Homo sapiens
tgtgcctgggggagttttcctc

SEQ ID NO: 6749268 - DNA, 20 bp, Homo sapiens
tgtgcctgggtggacatggc

SEQ ID NO: 6749269 - DNA, 21 bp, Homo sapiens
tgtgcctggttcgtgccatgc

SEQ ID NO: 6749270 - DNA, 18 bp, Homo sapiens
tgtgcctggtttgatttt

SEQ ID NO: 6749271 - DNA, 18 bp, Homo sapiens
tgtgcctgtaatcttttt

SEQ ID NO: 6749272 - DNA, 21 bp, Homo sapiens
tgtgcctgtaatctttttctc

SEQ ID NO: 6749273 - DNA, 17 bp, Homo sapiens
tgtgcctgtattcccag

SEQ ID NO: 6749274 - DNA, 19 bp, Homo sapiens
tgtgcctgtattcccagct

SEQ ID NO: 6749275 - DNA, 21 bp, Homo sapiens
tgtgcctgtattcccagctac

SEQ ID NO: 6749276 - DNA, 18 bp, Homo sapiens
tgtgcctgtcactactgg

SEQ ID NO: 6749277 - DNA, 22 bp, Homo sapiens
tgtgcctgtcactactggtctg

SEQ ID NO: 6749278 - DNA, 13 bp, Homo sapiens
tgtgcctgtgctc

SEQ ID NO: 6749279 - DNA, 15 bp, Homo sapiens
tgtgcctgtggcaga

SEQ ID NO: 6749280 - DNA, 14 bp, Homo sapiens
tgtgcctgtgggag

SEQ ID NO: 6749281 - DNA, 18 bp, Homo sapiens
tgtgcctgtgggaggggg

SEQ ID NO: 6749282 - DNA, 20 bp, Homo sapiens
tgtgcctgtgtgcgagtctg

SEQ ID NO: 6749283 - DNA, 23 bp, Homo sapiens
tgtgcctgtgtgcgagtctgagt

SEQ ID NO: 6749284 - DNA, 16 bp, Homo sapiens
tgtgccttaagtttta

SEQ ID NO: 6749285 - DNA, 14 bp, Homo sapiens
tgtgccttactaaa

SEQ ID NO: 6749286 - DNA, 18 bp, Homo sapiens
tgtgccttactaaatatg

SEQ ID NO: 6749287 - DNA, 15 bp, Homo sapiens
tgtgccttatgttga

SEQ ID NO: 6749288 - DNA, 19 bp, Homo sapiens
tgtgccttctctatggcct

SEQ ID NO: 6749289 - DNA, 17 bp, Homo sapiens
tgtgccttgtcacgcca

SEQ ID NO: 6749290 - DNA, 18 bp, Homo sapiens
tgtgccttgttttttgtt

SEQ ID NO: 6749291 - DNA, 10 bp, Homo sapiens
tgtgcctttc

SEQ ID NO: 6749292 - DNA, 16 bp, Homo sapiens
tgtgcctttcccgggc

SEQ ID NO: 6749293 - DNA, 19 bp, Homo sapiens
tgtgcctttcccgggccct

SEQ ID NO: 6749294 - DNA, 22 bp, Homo sapiens
tgtgcctttcccgggccctcag

SEQ ID NO: 6749295 - DNA, 17 bp, Homo sapiens
tgtgcctttcctatcac

SEQ ID NO: 6749296 - DNA, 14 bp, Homo sapiens
tgtgcctttctttg

SEQ ID NO: 6749297 - DNA, 16 bp, Homo sapiens
tgtgcctttctttgcc

SEQ ID NO: 6749298 - DNA, 17 bp, Homo sapiens
tgtgcctttctttgcct

SEQ ID NO: 6749299 - DNA, 18 bp, Homo sapiens
tgtgcctttctttgcctc

SEQ ID NO: 6749300 - DNA, 21 bp, Homo sapiens
tgtgcctttctttgcctctgc

SEQ ID NO: 6749301 - DNA, 22 bp, Homo sapiens
tgtgcctttctttgcctctgca

SEQ ID NO: 6749302 - DNA, 18 bp, Homo sapiens
tgtgcctttgcaaatcag

SEQ ID NO: 6749303 - DNA, 16 bp, Homo sapiens
tgtgcctttggcctgg

SEQ ID NO: 6749304 - DNA, 15 bp, Homo sapiens
tgtgccttttctgaa

SEQ ID NO: 6749305 - DNA, 17 bp, Homo sapiens
tgtgccttttgtaggct

SEQ ID NO: 6749306 - DNA, 14 bp, Homo sapiens
tgtgccttttttat

SEQ ID NO: 6749307 - DNA, 20 bp, Homo sapiens
tgtgccttttttatatcttg

SEQ ID NO: 6749308 - DNA, 23 bp, Homo sapiens
tgtgcgaacacagtgacacgttt

SEQ ID NO: 6749309 - DNA, 19 bp, Homo sapiens
tgtgcgaagcaagaagaat

SEQ ID NO: 6749310 - DNA, 14 bp, Homo sapiens
tgtgcgagtctgag

SEQ ID NO: 6749311 - DNA, 15 bp, Homo sapiens
tgtgcgagtctgagt

SEQ ID NO: 6749312 - DNA, 23 bp, Homo sapiens
tgtgcgctaaacttttctgatag

SEQ ID NO: 6749313 - DNA, 14 bp, Homo sapiens
tgtgcgctgcctgg

SEQ ID NO: 6749314 - DNA, 16 bp, Homo sapiens
tgtgcgctgcctggcc

SEQ ID NO: 6749315 - DNA, 18 bp, Homo sapiens
tgtgcgctgcctggccag

SEQ ID NO: 6749316 - DNA, 23 bp, Homo sapiens
tgtgcgctgcctggccaggccct

SEQ ID NO: 6749317 - DNA, 16 bp, Homo sapiens
tgtgcggaattcaagt

SEQ ID NO: 6749318 - DNA, 16 bp, Homo sapiens
tgtgcggagcagcctt

SEQ ID NO: 6749319 - DNA, 15 bp, Homo sapiens
tgtgcggaggcagga

SEQ ID NO: 6749320 - DNA, 21 bp, Homo sapiens
tgtgcggatgataactactga

SEQ ID NO: 6749321 - DNA, 20 bp, Homo sapiens
tgtgcggcacaggaaacagc

SEQ ID NO: 6749322 - DNA, 17 bp, Homo sapiens
tgtgcggctccagccca

SEQ ID NO: 6749323 - DNA, 15 bp, Homo sapiens
tgtgcgtcccagctg

SEQ ID NO: 6749324 - DNA, 23 bp, Homo sapiens
tgtgcgtcccagctgaaggcagt

SEQ ID NO: 6749325 - DNA, 14 bp, Homo sapiens
tgtgcgtcctgtcg

SEQ ID NO: 6749326 - DNA, 13 bp, Homo sapiens
tgtgcgtctgttt

SEQ ID NO: 6749327 - DNA, 22 bp, Homo sapiens
tgtgcgtgaaacacaccaggct

SEQ ID NO: 6749328 - DNA, 16 bp, Homo sapiens
tgtgcgtgcgtgtgtg

SEQ ID NO: 6749329 - DNA, 23 bp, Homo sapiens
tgtgcgtgcgtgttagtgtgtgt

SEQ ID NO: 6749330 - DNA, 20 bp, Homo sapiens
tgtgcgtgcttgagtgtgtt

SEQ ID NO: 6749331 - DNA, 21 bp, Homo sapiens
tgtgcgtggggctcccgcctc

SEQ ID NO: 6749332 - DNA, 22 bp, Homo sapiens
tgtgcgtggggctcccgcctcc

SEQ ID NO: 6749333 - DNA, 16 bp, Homo sapiens
tgtgcgtggtggtccc

SEQ ID NO: 6749334 - DNA, 19 bp, Homo sapiens
tgtgcgtggtggtccctgg

SEQ ID NO: 6749335 - DNA, 14 bp, Homo sapiens
tgtgcgtgtgtgca

SEQ ID NO: 6749336 - DNA, 20 bp, Homo sapiens
tgtgcgtgtgtgcatgtatg

SEQ ID NO: 6749337 - DNA, 14 bp, Homo sapiens
tgtgcgttcaaacc

SEQ ID NO: 6749338 - DNA, 15 bp, Homo sapiens
tgtgcgttttagagt

SEQ ID NO: 6749339 - DNA, 15 bp, Homo sapiens
tgtgctaaacgtgta

SEQ ID NO: 6749340 - DNA, 18 bp, Homo sapiens
tgtgctaacctcactgcc

SEQ ID NO: 6749341 - DNA, 21 bp, Homo sapiens
tgtgctaacctcactgcctca

SEQ ID NO: 6749342 - DNA, 16 bp, Homo sapiens
tgtgctaagttgtctt

SEQ ID NO: 6749343 - DNA, 18 bp, Homo sapiens
tgtgctaatcaaaacttt

SEQ ID NO: 6749344 - DNA, 20 bp, Homo sapiens
tgtgctaatttctgtccaga

SEQ ID NO: 6749345 - DNA, 11 bp, Homo sapiens
tgtgctacaga

SEQ ID NO: 6749346 - DNA, 20 bp, Homo sapiens
tgtgctacagaaaataatct

SEQ ID NO: 6749347 - DNA, 18 bp, Homo sapiens
tgtgctacagagaaaatc

SEQ ID NO: 6749348 - DNA, 15 bp, Homo sapiens
tgtgctacaggggcc

SEQ ID NO: 6749349 - DNA, 20 bp, Homo sapiens
tgtgctacaggggccagaag

SEQ ID NO: 6749350 - DNA, 17 bp, Homo sapiens
tgtgctacatgacgaca

SEQ ID NO: 6749351 - DNA, 16 bp, Homo sapiens
tgtgctacccctttga

SEQ ID NO: 6749352 - DNA, 13 bp, Homo sapiens
tgtgctacctcta

SEQ ID NO: 6749353 - DNA, 21 bp, Homo sapiens
tgtgctacgtgtgaaatctgt

SEQ ID NO: 6749354 - DNA, 15 bp, Homo sapiens
tgtgctactaacaga

SEQ ID NO: 6749355 - DNA, 17 bp, Homo sapiens
tgtgctagaaattttca

SEQ ID NO: 6749356 - DNA, 18 bp, Homo sapiens
tgtgctagaatacttttt

SEQ ID NO: 6749357 - DNA, 19 bp, Homo sapiens
tgtgctagctaaaagacaa

SEQ ID NO: 6749358 - DNA, 13 bp, Homo sapiens
tgtgctatactgc

SEQ ID NO: 6749359 - DNA, 13 bp, Homo sapiens
tgtgctatagtat

SEQ ID NO: 6749360 - DNA, 13 bp, Homo sapiens
tgtgctatagtgt

SEQ ID NO: 6749361 - DNA, 21 bp, Homo sapiens
tgtgctatatttttaaagaag

SEQ ID NO: 6749362 - DNA, 16 bp, Homo sapiens
tgtgctattaatattt

SEQ ID NO: 6749363 - DNA, 11 bp, Homo sapiens
tgtgctatttg

SEQ ID NO: 6749364 - DNA, 19 bp, Homo sapiens
tgtgctatttgtacaaata

SEQ ID NO: 6749365 - DNA, 20 bp, Homo sapiens
tgtgctatttgtacaaataa

SEQ ID NO: 6749366 - DNA, 16 bp, Homo sapiens
tgtgctcaaaatttga

SEQ ID NO: 6749367 - DNA, 20 bp, Homo sapiens
tgtgctcaaccagacagata

SEQ ID NO: 6749368 - DNA, 22 bp, Homo sapiens
tgtgctcacccattgtctcatt

SEQ ID NO: 6749369 - DNA, 13 bp, Homo sapiens
tgtgctcaccctc

SEQ ID NO: 6749370 - DNA, 14 bp, Homo sapiens
tgtgctcacgctcc

SEQ ID NO: 6749371 - DNA, 17 bp, Homo sapiens
tgtgctcacgctccccc

SEQ ID NO: 6749372 - DNA, 21 bp, Homo sapiens
tgtgctcagaattattaatta

SEQ ID NO: 6749373 - DNA, 15 bp, Homo sapiens
tgtgctcagagacac

SEQ ID NO: 6749374 - DNA, 22 bp, Homo sapiens
tgtgctcagagacctgaagtgt

SEQ ID NO: 6749375 - DNA, 20 bp, Homo sapiens
tgtgctcagccaaatttcct

SEQ ID NO: 6749376 - DNA, 15 bp, Homo sapiens
tgtgctcagccctga

SEQ ID NO: 6749377 - DNA, 18 bp, Homo sapiens
tgtgctcaggactcagaa

SEQ ID NO: 6749378 - DNA, 10 bp, Homo sapiens
tgtgctcagt

SEQ ID NO: 6749379 - DNA, 22 bp, Homo sapiens
tgtgctccaacctgaaggtccc

SEQ ID NO: 6749380 - DNA, 16 bp, Homo sapiens
tgtgctccacactcag

SEQ ID NO: 6749381 - DNA, 16 bp, Homo sapiens
tgtgctccatagagca

SEQ ID NO: 6749382 - DNA, 17 bp, Homo sapiens
tgtgctcccctgccaca

SEQ ID NO: 6749383 - DNA, 16 bp, Homo sapiens
tgtgctccgtgcctcc

SEQ ID NO: 6749384 - DNA, 23 bp, Homo sapiens
tgtgctcctaaaggcagcaacca

SEQ ID NO: 6749385 - DNA, 16 bp, Homo sapiens
tgtgctcctccttggt

SEQ ID NO: 6749386 - DNA, 21 bp, Homo sapiens
tgtgctcctcggtgttacttc

SEQ ID NO: 6749387 - DNA, 16 bp, Homo sapiens
tgtgctcctgcccagg

SEQ ID NO: 6749388 - DNA, 20 bp, Homo sapiens
tgtgctcctgcccaggagca

SEQ ID NO: 6749389 - DNA, 15 bp, Homo sapiens
tgtgctcctgtccct

SEQ ID NO: 6749390 - DNA, 17 bp, Homo sapiens
tgtgctcgctctgcatg

SEQ ID NO: 6749391 - DNA, 16 bp, Homo sapiens
tgtgctcggacacagt

SEQ ID NO: 6749392 - DNA, 18 bp, Homo sapiens
tgtgctctatagcagaca

SEQ ID NO: 6749393 - DNA, 14 bp, Homo sapiens
tgtgctctccaagc

SEQ ID NO: 6749394 - DNA, 21 bp, Homo sapiens
tgtgctctccattctgctcct

SEQ ID NO: 6749395 - DNA, 14 bp, Homo sapiens
tgtgctctctgtgg

SEQ ID NO: 6749396 - DNA, 22 bp, Homo sapiens
tgtgctctgaatgggagccaga

SEQ ID NO: 6749397 - DNA, 18 bp, Homo sapiens
tgtgctctggacaggcat

SEQ ID NO: 6749398 - DNA, 15 bp, Homo sapiens
tgtgctctggcacca

SEQ ID NO: 6749399 - DNA, 21 bp, Homo sapiens
tgtgctctggcaccatcagcc

SEQ ID NO: 6749400 - DNA, 13 bp, Homo sapiens
tgtgctctgggga

SEQ ID NO: 6749401 - DNA, 12 bp, Homo sapiens
tgtgctctgtga

SEQ ID NO: 6749402 - DNA, 19 bp, Homo sapiens
tgtgctcttcctctggttt

SEQ ID NO: 6749403 - DNA, 21 bp, Homo sapiens
tgtgctcttcctctggtttct

SEQ ID NO: 6749404 - DNA, 16 bp, Homo sapiens
tgtgctctttgaagag

SEQ ID NO: 6749405 - DNA, 23 bp, Homo sapiens
tgtgctgaagcaaagtgcccatg

SEQ ID NO: 6749406 - DNA, 19 bp, Homo sapiens
tgtgctgaattctgcaatg

SEQ ID NO: 6749407 - DNA, 15 bp, Homo sapiens
tgtgctgacttttta

SEQ ID NO: 6749408 - DNA, 23 bp, Homo sapiens
tgtgctgagaatagtgtctgatt

SEQ ID NO: 6749409 - DNA, 13 bp, Homo sapiens
tgtgctgagcctg

SEQ ID NO: 6749410 - DNA, 21 bp, Homo sapiens
tgtgctgagcctgcccagttg

SEQ ID NO: 6749411 - DNA, 20 bp, Homo sapiens
tgtgctgaggactccctcca

SEQ ID NO: 6749412 - DNA, 14 bp, Homo sapiens
tgtgctgaggcctt

SEQ ID NO: 6749413 - DNA, 21 bp, Homo sapiens
tgtgctgaggccttatcattc

SEQ ID NO: 6749414 - DNA, 15 bp, Homo sapiens
tgtgctgaggtgggc

SEQ ID NO: 6749415 - DNA, 18 bp, Homo sapiens
tgtgctgaggtgggcctt

SEQ ID NO: 6749416 - DNA, 19 bp, Homo sapiens
tgtgctgagtctgaaggct

SEQ ID NO: 6749417 - DNA, 20 bp, Homo sapiens
tgtgctgatcatttgaggaa

SEQ ID NO: 6749418 - DNA, 22 bp, Homo sapiens
tgtgctgattcaataaaatgca

SEQ ID NO: 6749419 - DNA, 14 bp, Homo sapiens
tgtgctgcatccca

SEQ ID NO: 6749420 - DNA, 12 bp, Homo sapiens
tgtgctgccagt

SEQ ID NO: 6749421 - DNA, 18 bp, Homo sapiens
tgtgctgccagtcagcct

SEQ ID NO: 6749422 - DNA, 20 bp, Homo sapiens
tgtgctgcccgtcttcagcc

SEQ ID NO: 6749423 - DNA, 17 bp, Homo sapiens
tgtggtagttaataaaa

SEQ ID NO: 6749424 - DNA, 14 bp, Homo sapiens
tgtggtattttggc

SEQ ID NO: 6749425 - DNA, 23 bp, Homo sapiens
tgtggtcacagctgtatagctgc

SEQ ID NO: 6749426 - DNA, 20 bp, Homo sapiens
tgtggtcagcggcctgggga

SEQ ID NO: 6749427 - DNA, 18 bp, Homo sapiens
tgtggtcagcggtatgtg

SEQ ID NO: 6749428 - DNA, 14 bp, Homo sapiens
tgtggtcaggccca

SEQ ID NO: 6749429 - DNA, 13 bp, Homo sapiens
tgtggtcatgtaa

SEQ ID NO: 6749430 - DNA, 20 bp, Homo sapiens
tgtggtcatgtgagtctggg

SEQ ID NO: 6749431 - DNA, 15 bp, Homo sapiens
tgtggtccagaagaa

SEQ ID NO: 6749432 - DNA, 17 bp, Homo sapiens
tgtggtccagaagaaat

SEQ ID NO: 6749433 - DNA, 18 bp, Homo sapiens
tgtggtccagaagaaatt

SEQ ID NO: 6749434 - DNA, 14 bp, Homo sapiens
tgtggtccatgccc

SEQ ID NO: 6749435 - DNA, 16 bp, Homo sapiens
tgtggtccatgcccac

SEQ ID NO: 6749436 - DNA, 15 bp, Homo sapiens
tgtggtcccacccca

SEQ ID NO: 6749437 - DNA, 21 bp, Homo sapiens
tgtggtccctccactaggagt

SEQ ID NO: 6749438 - DNA, 16 bp, Homo sapiens
tgtggtcgtcaacttt

SEQ ID NO: 6749439 - DNA, 21 bp, Homo sapiens
tgtggtcgtcaactttcctca

SEQ ID NO: 6749440 - DNA, 15 bp, Homo sapiens
tgtggtctaaagtgt

SEQ ID NO: 6749441 - DNA, 20 bp, Homo sapiens
tgtggtctataaaataaact

SEQ ID NO: 6749442 - DNA, 14 bp, Homo sapiens
tgtggtctattgtc

SEQ ID NO: 6749443 - DNA, 13 bp, Homo sapiens
tgtggtctgccaa

SEQ ID NO: 6749444 - DNA, 23 bp, Homo sapiens
tgtggtctgccaatctgtacaaa

SEQ ID NO: 6749445 - DNA, 19 bp, Homo sapiens
tgtggtgaagtgtggctgg

SEQ ID NO: 6749446 - DNA, 23 bp, Homo sapiens
tgtggtgaagtgtggctggtgtc

SEQ ID NO: 6749447 - DNA, 15 bp, Homo sapiens
tgtggtgaagtttgt

SEQ ID NO: 6749448 - DNA, 19 bp, Homo sapiens
tgtggtgacttctgctgct

SEQ ID NO: 6749449 - DNA, 16 bp, Homo sapiens
tgtggtgagggaagac

SEQ ID NO: 6749450 - DNA, 14 bp, Homo sapiens
tgtggtgaggggct

SEQ ID NO: 6749451 - DNA, 20 bp, Homo sapiens
tgtggtgaggggctttctct

SEQ ID NO: 6749452 - DNA, 22 bp, Homo sapiens
tgtggtgaggggtgtgggaaga

SEQ ID NO: 6749453 - DNA, 20 bp, Homo sapiens
tgtggtgatacctataaaga

SEQ ID NO: 6749454 - DNA, 20 bp, Homo sapiens
tgtggtgatggagatgcagt

SEQ ID NO: 6749455 - DNA, 16 bp, Homo sapiens
tgtggtgatgtgcctg

SEQ ID NO: 6749456 - DNA, 18 bp, Homo sapiens
tgtggtgatgtgcctgta

SEQ ID NO: 6749457 - DNA, 13 bp, Homo sapiens
tgtggtgcagtgt

SEQ ID NO: 6749458 - DNA, 16 bp, Homo sapiens
tgtggtgcattcctga

SEQ ID NO: 6749459 - DNA, 15 bp, Homo sapiens
tgtggtgcctgaggt

SEQ ID NO: 6749460 - DNA, 16 bp, Homo sapiens
tgtggtgctgacaaag

SEQ ID NO: 6749461 - DNA, 23 bp, Homo sapiens
tgtggtgctgggagatgctctct

SEQ ID NO: 6749462 - DNA, 22 bp, Homo sapiens
tgtggtggctccccctctgctt

SEQ ID NO: 6749463 - DNA, 16 bp, Homo sapiens
tgtggtggctgtctct

SEQ ID NO: 6749464 - DNA, 14 bp, Homo sapiens
tgtggtgggccctg

SEQ ID NO: 6749465 - DNA, 18 bp, Homo sapiens
tgtggtgggcgctgggga

SEQ ID NO: 6749466 - DNA, 14 bp, Homo sapiens
tgtggtggttgtga

SEQ ID NO: 6749467 - DNA, 17 bp, Homo sapiens
tgtggtgtaaagctggc

SEQ ID NO: 6749468 - DNA, 15 bp, Homo sapiens
tgtggtgtagactgt

SEQ ID NO: 6749469 - DNA, 18 bp, Homo sapiens
tgtggtgtcaccagcctg

SEQ ID NO: 6749470 - DNA, 22 bp, Homo sapiens
tgtggtgtcccctatcctcccc

SEQ ID NO: 6749471 - DNA, 17 bp, Homo sapiens
tgtggtgtcgtctgtga

SEQ ID NO: 6749472 - DNA, 15 bp, Homo sapiens
tgtggtgtgaccatg

SEQ ID NO: 6749473 - DNA, 17 bp, Homo sapiens
tgtggtgttagggtgca

SEQ ID NO: 6749474 - DNA, 16 bp, Homo sapiens
tgtggtgtttcctggc

SEQ ID NO: 6749475 - DNA, 20 bp, Homo sapiens
tgtggtgtttcctggcactg

SEQ ID NO: 6749476 - DNA, 19 bp, Homo sapiens
tgtggttaccgagtatctg

SEQ ID NO: 6749477 - DNA, 21 bp, Homo sapiens
tgtggttaccgagtatctgta

SEQ ID NO: 6749478 - DNA, 23 bp, Homo sapiens
tgtggttatggggagagggcata

SEQ ID NO: 6749479 - DNA, 18 bp, Homo sapiens
tgtggttatttttataca

SEQ ID NO: 6749480 - DNA, 22 bp, Homo sapiens
tgtggttcagctactttccatt

SEQ ID NO: 6749481 - DNA, 20 bp, Homo sapiens
tgtggttcatccatcatctg

SEQ ID NO: 6749482 - DNA, 22 bp, Homo sapiens
tgtggttccatgcagccttggg

SEQ ID NO: 6749483 - DNA, 18 bp, Homo sapiens
tgtggttccctaaagaca

SEQ ID NO: 6749484 - DNA, 21 bp, Homo sapiens
tgtggttcctaagcctgttgc

SEQ ID NO: 6749485 - DNA, 17 bp, Homo sapiens
tgtggttcctctgctca

SEQ ID NO: 6749486 - DNA, 13 bp, Homo sapiens
tgtggttctattt

SEQ ID NO: 6749487 - DNA, 21 bp, Homo sapiens
tgtggttctgagatggctccc

SEQ ID NO: 6749488 - DNA, 12 bp, Homo sapiens
tgtggttgaaaa

SEQ ID NO: 6749489 - DNA, 16 bp, Homo sapiens
tgtggttgaaaaccac

SEQ ID NO: 6749490 - DNA, 21 bp, Homo sapiens
tgtggttgaaaaccacagtca

SEQ ID NO: 6749491 - DNA, 19 bp, Homo sapiens
tgtggttgggggtgggagg

SEQ ID NO: 6749492 - DNA, 22 bp, Homo sapiens
tgtggtttaaatacataaatag

SEQ ID NO: 6749493 - DNA, 15 bp, Homo sapiens
tgtggtttagtgtaa

SEQ ID NO: 6749494 - DNA, 21 bp, Homo sapiens
tgtggtttagtgtaaaaatga

SEQ ID NO: 6749495 - DNA, 22 bp, Homo sapiens
tgtggtttagttataaaaggct

SEQ ID NO: 6749496 - DNA, 14 bp, Homo sapiens
tgtggtttatatat

SEQ ID NO: 6749497 - DNA, 15 bp, Homo sapiens
tgtggtttatatatt

SEQ ID NO: 6749498 - DNA, 22 bp, Homo sapiens
tgtggtttcatgttagttacct

SEQ ID NO: 6749499 - DNA, 12 bp, Homo sapiens
tgtggtttcatt

SEQ ID NO: 6749500 - DNA, 18 bp, Homo sapiens
tgtggtttccaaggagct

SEQ ID NO: 6749501 - DNA, 19 bp, Homo sapiens
tgtggtttcccctttcttt

SEQ ID NO: 6749502 - DNA, 16 bp, Homo sapiens
tgtggtttctttttga

SEQ ID NO: 6749503 - DNA, 18 bp, Homo sapiens
tgtggtttggaatattaa

SEQ ID NO: 6749504 - DNA, 18 bp, Homo sapiens
tgtggtttggttcctctc

SEQ ID NO: 6749505 - DNA, 21 bp, Homo sapiens
tgtggtttggttcctctctgg

SEQ ID NO: 6749506 - DNA, 22 bp, Homo sapiens
tgtggtttggttcctctctggt

SEQ ID NO: 6749507 - DNA, 10 bp, Homo sapiens
tgtggtttta

SEQ ID NO: 6749508 - DNA, 16 bp, Homo sapiens
tgtggttttcccctcc

SEQ ID NO: 6749509 - DNA, 21 bp, Homo sapiens
tgtggttttcccctccctggg

SEQ ID NO: 6749510 - DNA, 18 bp, Homo sapiens
tgtggttttctgtttcta

SEQ ID NO: 6749511 - DNA, 21 bp, Homo sapiens
tgtggttttcttttgccatga

SEQ ID NO: 6749512 - DNA, 11 bp, Homo sapiens
tgtggttttga

SEQ ID NO: 6749513 - DNA, 13 bp, Homo sapiens
tgtgtaaaaagca

SEQ ID NO: 6749514 - DNA, 17 bp, Homo sapiens
tgtgtaaaatgtaatgc

SEQ ID NO: 6749515 - DNA, 11 bp, Homo sapiens
tgtgtaaaatt

SEQ ID NO: 6749516 - DNA, 15 bp, Homo sapiens
tgtgtaaaattaatg

SEQ ID NO: 6749517 - DNA, 12 bp, Homo sapiens
tgtgtaaaattg

SEQ ID NO: 6749518 - DNA, 21 bp, Homo sapiens
tgtgtaaacctaattgtggta

SEQ ID NO: 6749519 - DNA, 13 bp, Homo sapiens
tgtgtaaaggaac

SEQ ID NO: 6749520 - DNA, 19 bp, Homo sapiens
tgtgtaaaggtttcatgtt

SEQ ID NO: 6749521 - DNA, 21 bp, Homo sapiens
tgtgtaaagtgtaaatccttt

SEQ ID NO: 6749522 - DNA, 17 bp, Homo sapiens
tgtgtaaagttagtcta

SEQ ID NO: 6749523 - DNA, 21 bp, Homo sapiens
tgtgtaaataagcgtttaatg

SEQ ID NO: 6749524 - DNA, 12 bp, Homo sapiens
tgtgtaaataat

SEQ ID NO: 6749525 - DNA, 18 bp, Homo sapiens
tgtgtaaatatgtacatt

SEQ ID NO: 6749526 - DNA, 21 bp, Homo sapiens
tgtgtaaatatttttccctcc

SEQ ID NO: 6749527 - DNA, 10 bp, Homo sapiens
tgtgtaaatg

SEQ ID NO: 6749528 - DNA, 20 bp, Homo sapiens
tgtgtaaatgcttaaatttc

SEQ ID NO: 6749529 - DNA, 15 bp, Homo sapiens
tgtgtaaatgttatg

SEQ ID NO: 6749530 - DNA, 18 bp, Homo sapiens
tgtgtaaatgttatgact

SEQ ID NO: 6749531 - DNA, 19 bp, Homo sapiens
tgtgtaaatgttatgactc

SEQ ID NO: 6749532 - DNA, 15 bp, Homo sapiens
tgtgtaacagctcct

SEQ ID NO: 6749533 - DNA, 23 bp, Homo sapiens
tgtgtaacagttagccactgctg

SEQ ID NO: 6749534 - DNA, 20 bp, Homo sapiens
tgtgtaacatccaagccaga

SEQ ID NO: 6749535 - DNA, 22 bp, Homo sapiens
tgtgtaacatccaagccagagt

SEQ ID NO: 6749536 - DNA, 16 bp, Homo sapiens
tgtgtaaccagcagtc

SEQ ID NO: 6749537 - DNA, 14 bp, Homo sapiens
tgtgtaactgttct

SEQ ID NO: 6749538 - DNA, 20 bp, Homo sapiens
tgtgtaactgttctttgcag

SEQ ID NO: 6749539 - DNA, 21 bp, Homo sapiens
tgtgtaacttttttttagtat

SEQ ID NO: 6749540 - DNA, 16 bp, Homo sapiens
tgtgtaagaaaacaaa

SEQ ID NO: 6749541 - DNA, 14 bp, Homo sapiens
tgtgtaagattttt

SEQ ID NO: 6749542 - DNA, 13 bp, Homo sapiens
tgtgtaaggagta

SEQ ID NO: 6749543 - DNA, 19 bp, Homo sapiens
tgtgtaaggatgagcagca

SEQ ID NO: 6749544 - DNA, 14 bp, Homo sapiens
tgtgtaataaagtg

SEQ ID NO: 6749545 - DNA, 21 bp, Homo sapiens
tgtgtaataaagtgttttcag

SEQ ID NO: 6749546 - DNA, 22 bp, Homo sapiens
tgtgtaataaagtgttttcaga

SEQ ID NO: 6749547 - DNA, 21 bp, Homo sapiens
tgtgtaataatgtaacatgat

SEQ ID NO: 6749548 - DNA, 21 bp, Homo sapiens
tgtgtaatagaaaactgaaaa

SEQ ID NO: 6749549 - DNA, 23 bp, Homo sapiens
tgtgtaatagaataaaggcctgc

SEQ ID NO: 6749550 - DNA, 17 bp, Homo sapiens
tgtgtaatatcatttca

SEQ ID NO: 6749551 - DNA, 23 bp, Homo sapiens
tgtgtaatattactttaacatgc

SEQ ID NO: 6749552 - DNA, 20 bp, Homo sapiens
tgtgtaatcaataaacgatt

SEQ ID NO: 6749553 - DNA, 21 bp, Homo sapiens
tgtgtaatcatttcttgggcc

SEQ ID NO: 6749554 - DNA, 13 bp, Homo sapiens
tgtgtaatgaaaa

SEQ ID NO: 6749555 - DNA, 17 bp, Homo sapiens
tgtgtaattgttccttt

SEQ ID NO: 6749556 - DNA, 23 bp, Homo sapiens
tgtgtaatttaaaattgtgatgt

SEQ ID NO: 6749557 - DNA, 15 bp, Homo sapiens
tgtgtaatttctgcc

SEQ ID NO: 6749558 - DNA, 23 bp, Homo sapiens
tgtgtacaaaccaagagctttta

SEQ ID NO: 6749559 - DNA, 14 bp, Homo sapiens
tgtgtacaaagaaa

SEQ ID NO: 6749560 - DNA, 17 bp, Homo sapiens
tgtgtacaaatacatgt

SEQ ID NO: 6749561 - DNA, 21 bp, Homo sapiens
tgtgtacacctgcggggccac

SEQ ID NO: 6749562 - DNA, 15 bp, Homo sapiens
tgtgtacagtatgtg

SEQ ID NO: 6749563 - DNA, 16 bp, Homo sapiens
tgtgtacagtatgtgt

SEQ ID NO: 6749564 - DNA, 23 bp, Homo sapiens
tgtgtacagtatgtgtctagcaa

SEQ ID NO: 6749565 - DNA, 12 bp, Homo sapiens
tgtgtacagtga

SEQ ID NO: 6749566 - DNA, 13 bp, Homo sapiens
tgtgtacagtgaa

SEQ ID NO: 6749567 - DNA, 20 bp, Homo sapiens
tgtgtacagtgaattgtctt

SEQ ID NO: 6749568 - DNA, 23 bp, Homo sapiens
tgtgtacatagagcaatgttggt

SEQ ID NO: 6749569 - DNA, 16 bp, Homo sapiens
tgtgtacatatatgta

SEQ ID NO: 6749570 - DNA, 19 bp, Homo sapiens
tgtgtacatggcagagttt

SEQ ID NO: 6749571 - DNA, 14 bp, Homo sapiens
tgtgtacatgtaca

SEQ ID NO: 6749572 - DNA, 15 bp, Homo sapiens
tgtgtacatgtacat

SEQ ID NO: 6749573 - DNA, 21 bp, Homo sapiens
tgtgtacatgtgtgcagagca

SEQ ID NO: 6749574 - DNA, 20 bp, Homo sapiens
tgtgtaccacaccctgcctg

SEQ ID NO: 6749575 - DNA, 20 bp, Homo sapiens
tgtgtaccacttctgtgggc

SEQ ID NO: 6749576 - DNA, 22 bp, Homo sapiens
tgtgtactcagggcattctgtt

SEQ ID NO: 6749577 - DNA, 12 bp, Homo sapiens
tgtgtactctgt

SEQ ID NO: 6749578 - DNA, 14 bp, Homo sapiens
tgtgtactctgtcc

SEQ ID NO: 6749579 - DNA, 20 bp, Homo sapiens
tgtgtactgattcaagaaca

SEQ ID NO: 6749580 - DNA, 17 bp, Homo sapiens
tgtgtactgtaaagaat

SEQ ID NO: 6749581 - DNA, 17 bp, Homo sapiens
tgtgtactgtatagaca

SEQ ID NO: 6749582 - DNA, 18 bp, Homo sapiens
tgtgtacttcagtcttgg

SEQ ID NO: 6749583 - DNA, 19 bp, Homo sapiens
tgtgtacttcagtcttgga

SEQ ID NO: 6749584 - DNA, 15 bp, Homo sapiens
tgtgtacttttaaga

SEQ ID NO: 6749585 - DNA, 15 bp, Homo sapiens
tgtgtacttttcctt

SEQ ID NO: 6749586 - DNA, 16 bp, Homo sapiens
tgtgtagacaaatatt

SEQ ID NO: 6749587 - DNA, 21 bp, Homo sapiens
tgtgtagagcccctactgtgg

SEQ ID NO: 6749588 - DNA, 21 bp, Homo sapiens
tgtgtagagcctgcatctgtc

SEQ ID NO: 6749589 - DNA, 22 bp, Homo sapiens
tgtgtagagtggcgattgaatg

SEQ ID NO: 6749590 - DNA, 13 bp, Homo sapiens
tgtgtagagttaa

SEQ ID NO: 6749591 - DNA, 19 bp, Homo sapiens
tgtgtagagttaagaagct

SEQ ID NO: 6749592 - DNA, 21 bp, Homo sapiens
tgtgtagagttaagaagctgt

SEQ ID NO: 6749593 - DNA, 15 bp, Homo sapiens
tgtgtagatagtatg

SEQ ID NO: 6749594 - DNA, 13 bp, Homo sapiens
tgtgtagatttga

SEQ ID NO: 6749595 - DNA, 19 bp, Homo sapiens
tgtgtagcatactggcttc

SEQ ID NO: 6749596 - DNA, 14 bp, Homo sapiens
tgtgtagccttttt

SEQ ID NO: 6749597 - DNA, 20 bp, Homo sapiens
tgtgtagcctttttgtataa

SEQ ID NO: 6749598 - DNA, 18 bp, Homo sapiens
tgtgtagctctgtccact

SEQ ID NO: 6749599 - DNA, 15 bp, Homo sapiens
tgtgtttctgtataa

SEQ ID NO: 6749600 - DNA, 21 bp, Homo sapiens
tgtgtttctgtcctgtaactg

SEQ ID NO: 6749601 - DNA, 17 bp, Homo sapiens
tgtgtttcttgctttga

SEQ ID NO: 6749602 - DNA, 14 bp, Homo sapiens
tgtgtttctttata

SEQ ID NO: 6749603 - DNA, 12 bp, Homo sapiens
tgtgtttgacat

SEQ ID NO: 6749604 - DNA, 14 bp, Homo sapiens
tgtgtttgattggc

SEQ ID NO: 6749605 - DNA, 18 bp, Homo sapiens
tgtgtttgatttgtctca

SEQ ID NO: 6749606 - DNA, 18 bp, Homo sapiens
tgtgtttgcattgtctaa

SEQ ID NO: 6749607 - DNA, 21 bp, Homo sapiens
tgtgtttgccactgtgtttcc

SEQ ID NO: 6749608 - DNA, 13 bp, Homo sapiens
tgtgtttgctgca

SEQ ID NO: 6749609 - DNA, 15 bp, Homo sapiens
tgtgtttggatttgt

SEQ ID NO: 6749610 - DNA, 14 bp, Homo sapiens
tgtgtttgtatata

SEQ ID NO: 6749611 - DNA, 16 bp, Homo sapiens
tgtgtttgtcctgggt

SEQ ID NO: 6749612 - DNA, 10 bp, Homo sapiens
tgtgtttgtt

SEQ ID NO: 6749613 - DNA, 18 bp, Homo sapiens
tgtgtttgttcataataa

SEQ ID NO: 6749614 - DNA, 23 bp, Homo sapiens
tgtgtttgtttgtttgcagtctc

SEQ ID NO: 6749615 - DNA, 14 bp, Homo sapiens
tgtgttttaaaaaa

SEQ ID NO: 6749616 - DNA, 22 bp, Homo sapiens
tgtgttttaacaccaacactgt

SEQ ID NO: 6749617 - DNA, 16 bp, Homo sapiens
tgtgttttaattttct

SEQ ID NO: 6749618 - DNA, 19 bp, Homo sapiens
tgtgttttacagtatatct

SEQ ID NO: 6749619 - DNA, 14 bp, Homo sapiens
tgtgttttagagta

SEQ ID NO: 6749620 - DNA, 20 bp, Homo sapiens
tgtgttttattcacttgtgt

SEQ ID NO: 6749621 - DNA, 16 bp, Homo sapiens
tgtgttttcagactgc

SEQ ID NO: 6749622 - DNA, 22 bp, Homo sapiens
tgtgttttcccaaagcactttt

SEQ ID NO: 6749623 - DNA, 14 bp, Homo sapiens
tgtgttttcgatga

SEQ ID NO: 6749624 - DNA, 17 bp, Homo sapiens
tgtgttttctctggaat

SEQ ID NO: 6749625 - DNA, 23 bp, Homo sapiens
tgtgttttctgaataacatttgt

SEQ ID NO: 6749626 - DNA, 16 bp, Homo sapiens
tgtgttttcttgtaaa

SEQ ID NO: 6749627 - DNA, 16 bp, Homo sapiens
tgtgttttggttaata

SEQ ID NO: 6749628 - DNA, 21 bp, Homo sapiens
tgtgttttgtccaaaactgta

SEQ ID NO: 6749629 - DNA, 22 bp, Homo sapiens
tgtgttttgtcctgcctcttgt

SEQ ID NO: 6749630 - DNA, 15 bp, Homo sapiens
tgtgttttgtctgag

SEQ ID NO: 6749631 - DNA, 15 bp, Homo sapiens
tgtgtttttaacatg

SEQ ID NO: 6749632 - DNA, 20 bp, Homo sapiens
tgtgtttttaataaagacag

SEQ ID NO: 6749633 - DNA, 14 bp, Homo sapiens
tgtgtttttattgt

SEQ ID NO: 6749634 - DNA, 19 bp, Homo sapiens
tgtgtttttattgttaact

SEQ ID NO: 6749635 - DNA, 18 bp, Homo sapiens
tgtgtttttcataaagca

SEQ ID NO: 6749636 - DNA, 14 bp, Homo sapiens
tgtgtttttccctt

SEQ ID NO: 6749637 - DNA, 16 bp, Homo sapiens
tgtgtttttctattaa

SEQ ID NO: 6749638 - DNA, 21 bp, Homo sapiens
tgtgtttttctattaaaagac

SEQ ID NO: 6749639 - DNA, 16 bp, Homo sapiens
tgtgtttttctccagt

SEQ ID NO: 6749640 - DNA, 15 bp, Homo sapiens
tgtgtttttgcactg

SEQ ID NO: 6749641 - DNA, 19 bp, Homo sapiens
tgtgtttttgcactgtctg

SEQ ID NO: 6749642 - DNA, 20 bp, Homo sapiens
tgtgtttttgggaagaagaa

SEQ ID NO: 6749643 - DNA, 20 bp, Homo sapiens
tgtgtttttgggatgtctta

SEQ ID NO: 6749644 - DNA, 16 bp, Homo sapiens
tgtgttttttaagata

SEQ ID NO: 6749645 - DNA, 16 bp, Homo sapiens
tgtgtttttttctaaa

SEQ ID NO: 6749646 - DNA, 23 bp, Homo sapiens
tgttaaaaaaataagaagaatgc

SEQ ID NO: 6749647 - DNA, 18 bp, Homo sapiens
tgttaaaaaatttttgaa

SEQ ID NO: 6749648 - DNA, 19 bp, Homo sapiens
tgttaaaaaatttttgaaa

SEQ ID NO: 6749649 - DNA, 23 bp, Homo sapiens
tgttaaaaaccattataaaatct

SEQ ID NO: 6749650 - DNA, 21 bp, Homo sapiens
tgttaaaacaaattaaaaaca

SEQ ID NO: 6749651 - DNA, 12 bp, Homo sapiens
tgttaaaacaac

SEQ ID NO: 6749652 - DNA, 14 bp, Homo sapiens
tgttaaaacacaaa

SEQ ID NO: 6749653 - DNA, 20 bp, Homo sapiens
tgttaaaacacaaaatgaat

SEQ ID NO: 6749654 - DNA, 22 bp, Homo sapiens
tgttaaaacacaaaatgaataa

SEQ ID NO: 6749655 - DNA, 15 bp, Homo sapiens
tgttaaaacatcaaa

SEQ ID NO: 6749656 - DNA, 20 bp, Homo sapiens
tgttaaaagaaaataaatta

SEQ ID NO: 6749657 - DNA, 15 bp, Homo sapiens
tgttaaaagattttt

SEQ ID NO: 6749658 - DNA, 15 bp, Homo sapiens
tgttaaaagttttat

SEQ ID NO: 6749659 - DNA, 10 bp, Homo sapiens
tgttaaaata

SEQ ID NO: 6749660 - DNA, 20 bp, Homo sapiens
tgttaaaatatttgcctttt

SEQ ID NO: 6749661 - DNA, 16 bp, Homo sapiens
tgttaaaattaatata

SEQ ID NO: 6749662 - DNA, 23 bp, Homo sapiens
tgttaaaccatgggataaatgcc

SEQ ID NO: 6749663 - DNA, 16 bp, Homo sapiens
tgttaaactagcacag

SEQ ID NO: 6749664 - DNA, 22 bp, Homo sapiens
tgttaaactagcatatctgcct

SEQ ID NO: 6749665 - DNA, 14 bp, Homo sapiens
tgttaaactgttag

SEQ ID NO: 6749666 - DNA, 17 bp, Homo sapiens
tgttaaactttttacca

SEQ ID NO: 6749667 - DNA, 13 bp, Homo sapiens
tgttaaagatatt

SEQ ID NO: 6749668 - DNA, 21 bp, Homo sapiens
tgttaaagatatttttattca

SEQ ID NO: 6749669 - DNA, 18 bp, Homo sapiens
tgttaaagatgtagcaaa

SEQ ID NO: 6749670 - DNA, 19 bp, Homo sapiens
tgttaaagatgtagcaaac

SEQ ID NO: 6749671 - DNA, 12 bp, Homo sapiens
tgttaaagctgt

SEQ ID NO: 6749672 - DNA, 15 bp, Homo sapiens
tgttaaagctgtaca

SEQ ID NO: 6749673 - DNA, 16 bp, Homo sapiens
tgttaaagctgtacac

SEQ ID NO: 6749674 - DNA, 17 bp, Homo sapiens
tgttaaagtacttgaaa

SEQ ID NO: 6749675 - DNA, 19 bp, Homo sapiens
tgttaaagttgttttgatt

SEQ ID NO: 6749676 - DNA, 13 bp, Homo sapiens
tgttaaagtttaa

SEQ ID NO: 6749677 - DNA, 14 bp, Homo sapiens
tgttaaataaattg

SEQ ID NO: 6749678 - DNA, 15 bp, Homo sapiens
tgttaaataaggcct

SEQ ID NO: 6749679 - DNA, 19 bp, Homo sapiens
tgttaaatacacattatca

SEQ ID NO: 6749680 - DNA, 16 bp, Homo sapiens
tgttaaatactgtgca

SEQ ID NO: 6749681 - DNA, 18 bp, Homo sapiens
tgttaaatactgtgcaga

SEQ ID NO: 6749682 - DNA, 20 bp, Homo sapiens
tgttaaatactgtgcagaat

SEQ ID NO: 6749683 - DNA, 16 bp, Homo sapiens
tgttaaatatttacat

SEQ ID NO: 6749684 - DNA, 14 bp, Homo sapiens
tgttaaatctacaa

SEQ ID NO: 6749685 - DNA, 14 bp, Homo sapiens
tgttaaatgaaacc

SEQ ID NO: 6749686 - DNA, 13 bp, Homo sapiens
tgttaaatgactt

SEQ ID NO: 6749687 - DNA, 18 bp, Homo sapiens
tgttaaatgataaggttt

SEQ ID NO: 6749688 - DNA, 19 bp, Homo sapiens
tgttaaatggaattcgtgt

SEQ ID NO: 6749689 - DNA, 15 bp, Homo sapiens
tgttaaattaattat

SEQ ID NO: 6749690 - DNA, 13 bp, Homo sapiens
tgttaaattacat

SEQ ID NO: 6749691 - DNA, 19 bp, Homo sapiens
tgttaaatttgtaagtttc

SEQ ID NO: 6749692 - DNA, 21 bp, Homo sapiens
tgttaaatttgtaagtttcag

SEQ ID NO: 6749693 - DNA, 19 bp, Homo sapiens
tgttaacaatgcctattgt

SEQ ID NO: 6749694 - DNA, 23 bp, Homo sapiens
tgttaacaatgcctattgtaata

SEQ ID NO: 6749695 - DNA, 13 bp, Homo sapiens
tgttaacacattt

SEQ ID NO: 6749696 - DNA, 22 bp, Homo sapiens
tgttaacacattttgtataatt

SEQ ID NO: 6749697 - DNA, 16 bp, Homo sapiens
tgttaacactgtaata

SEQ ID NO: 6749698 - DNA, 19 bp, Homo sapiens
tgttaacactgtaatatct

SEQ ID NO: 6749699 - DNA, 21 bp, Homo sapiens
tgttaacagaagggagggcag

SEQ ID NO: 6749700 - DNA, 18 bp, Homo sapiens
tgttaacagacactgtaa

SEQ ID NO: 6749701 - DNA, 13 bp, Homo sapiens
tgttaacagagca

SEQ ID NO: 6749702 - DNA, 14 bp, Homo sapiens
tgttaacagtattt

SEQ ID NO: 6749703 - DNA, 12 bp, Homo sapiens
tgttaacatcta

SEQ ID NO: 6749704 - DNA, 16 bp, Homo sapiens
tgttaacattccaaga

SEQ ID NO: 6749705 - DNA, 19 bp, Homo sapiens
tgttaaccaaataaaacat

SEQ ID NO: 6749706 - DNA, 14 bp, Homo sapiens
tgttaaccaaattt

SEQ ID NO: 6749707 - DNA, 23 bp, Homo sapiens
tgttaacccactgcatgcagaaa

SEQ ID NO: 6749708 - DNA, 21 bp, Homo sapiens
tgttaaccctccacctcctct

SEQ ID NO: 6749709 - DNA, 17 bp, Homo sapiens
tgttaacctaggcagtg

SEQ ID NO: 6749710 - DNA, 15 bp, Homo sapiens
tgttaacctcagtgt

SEQ ID NO: 6749711 - DNA, 15 bp, Homo sapiens
tgttaacctttctaa

SEQ ID NO: 6749712 - DNA, 19 bp, Homo sapiens
tgttaacgtgatgtgccac

SEQ ID NO: 6749713 - DNA, 23 bp, Homo sapiens
tgttaactagtgtttctgcagag

SEQ ID NO: 6749714 - DNA, 19 bp, Homo sapiens
tgttaactcttgtctattt

SEQ ID NO: 6749715 - DNA, 18 bp, Homo sapiens
tgttaactgaataccact

SEQ ID NO: 6749716 - DNA, 22 bp, Homo sapiens
tgttaactgagtgccttttggt

SEQ ID NO: 6749717 - DNA, 14 bp, Homo sapiens
tgttaactgccaag

SEQ ID NO: 6749718 - DNA, 18 bp, Homo sapiens
tgttaactgtactgaagg

SEQ ID NO: 6749719 - DNA, 22 bp, Homo sapiens
tgttaactgtactgaaggtgtg

SEQ ID NO: 6749720 - DNA, 19 bp, Homo sapiens
tgttaactgttaactatga

SEQ ID NO: 6749721 - DNA, 23 bp, Homo sapiens
tgttaagaattgaccatctgctt

SEQ ID NO: 6749722 - DNA, 23 bp, Homo sapiens
tgttaagataacttactgtatat

SEQ ID NO: 6749723 - DNA, 23 bp, Homo sapiens
tgttaagcagatggaatgctgtg

SEQ ID NO: 6749724 - DNA, 23 bp, Homo sapiens
tgttaagcagctaaattttctga

SEQ ID NO: 6749725 - DNA, 13 bp, Homo sapiens
tgttaagcatcta

SEQ ID NO: 6749726 - DNA, 21 bp, Homo sapiens
tgttaagccatttaactggag

SEQ ID NO: 6749727 - DNA, 15 bp, Homo sapiens
tgttaagctcaggat

SEQ ID NO: 6749728 - DNA, 23 bp, Homo sapiens
tgttaagcttgcgtagaattgca

SEQ ID NO: 6749729 - DNA, 14 bp, Homo sapiens
tgttaaggaaactc

SEQ ID NO: 6749730 - DNA, 15 bp, Homo sapiens
tgttaaggaaactct

SEQ ID NO: 6749731 - DNA, 20 bp, Homo sapiens
tgttaaggacttctgcagct

SEQ ID NO: 6749732 - DNA, 20 bp, Homo sapiens
tgttaagggaagaattccag

SEQ ID NO: 6749733 - DNA, 16 bp, Homo sapiens
tgttaagggaagctga

SEQ ID NO: 6749734 - DNA, 21 bp, Homo sapiens
tgttaagggaagctgatacag

SEQ ID NO: 6749735 - DNA, 16 bp, Homo sapiens
tgttaagggcattttt

SEQ ID NO: 6749736 - DNA, 22 bp, Homo sapiens
tgttaaggtcctgaaagtaact

SEQ ID NO: 6749737 - DNA, 24 bp, Homo sapiens
tgttaaggtcctgaaagtaactca

SEQ ID NO: 6749738 - DNA, 16 bp, Homo sapiens
tgttaaggttgaactt

SEQ ID NO: 6749739 - DNA, 20 bp, Homo sapiens
tgttaagtatcagctacaat

SEQ ID NO: 6749740 - DNA, 16 bp, Homo sapiens
tgttaagtatgtgtaa

SEQ ID NO: 6749741 - DNA, 15 bp, Homo sapiens
tgttaagtattttca

SEQ ID NO: 6749742 - DNA, 17 bp, Homo sapiens
tgttaagttatagtgaa

SEQ ID NO: 6749743 - DNA, 19 bp, Homo sapiens
tgttaataaaagtacatgt

SEQ ID NO: 6749744 - DNA, 16 bp, Homo sapiens
tgttaatacaaggtat

SEQ ID NO: 6749745 - DNA, 17 bp, Homo sapiens
tgttaatacaaggtata

SEQ ID NO: 6749746 - DNA, 14 bp, Homo sapiens
tgttaatacacagt

SEQ ID NO: 6749747 - DNA, 14 bp, Homo sapiens
tgttaatacatcac

SEQ ID NO: 6749748 - DNA, 18 bp, Homo sapiens
tgttaatacatcattttt

SEQ ID NO: 6749749 - DNA, 15 bp, Homo sapiens
tgttaatactgagaa

SEQ ID NO: 6749750 - DNA, 20 bp, Homo sapiens
tgttaatataccccaaattg

SEQ ID NO: 6749751 - DNA, 23 bp, Homo sapiens
tgttaatatatataatacttaaa

SEQ ID NO: 6749752 - DNA, 17 bp, Homo sapiens
tgttaatatcactcatt

SEQ ID NO: 6749753 - DNA, 19 bp, Homo sapiens
tgttaatatcactcattaa

SEQ ID NO: 6749754 - DNA, 16 bp, Homo sapiens
tgttaatatcttcaca

SEQ ID NO: 6749755 - DNA, 22 bp, Homo sapiens
tgttaatatgcagccatatatg

SEQ ID NO: 6749756 - DNA, 17 bp, Homo sapiens
tgttaatattctttcaa

SEQ ID NO: 6749757 - DNA, 16 bp, Homo sapiens
tgttaatatttgaatt

SEQ ID NO: 6749758 - DNA, 17 bp, Homo sapiens
tgttaatattttatgtg

SEQ ID NO: 6749759 - DNA, 15 bp, Homo sapiens
tgttaatcatgggtt

SEQ ID NO: 6749760 - DNA, 13 bp, Homo sapiens
tgttaatccagag

SEQ ID NO: 6749761 - DNA, 16 bp, Homo sapiens
tgttaatccagagaac

SEQ ID NO: 6749762 - DNA, 16 bp, Homo sapiens
tgttaatctcccagcc

SEQ ID NO: 6749763 - DNA, 21 bp, Homo sapiens
tgttaatctgatgtataatgt

SEQ ID NO: 6749764 - DNA, 16 bp, Homo sapiens
tgttaatctttttcat

SEQ ID NO: 6749765 - DNA, 19 bp, Homo sapiens
tgttaatgaaaatgtcaga

SEQ ID NO: 6749766 - DNA, 17 bp, Homo sapiens
tgttaatgagtatatgt

SEQ ID NO: 6749767 - DNA, 20 bp, Homo sapiens
tgttaatgagtatatgtaac

SEQ ID NO: 6749768 - DNA, 19 bp, Homo sapiens
tgttaatgatagctactgt

SEQ ID NO: 6749769 - DNA, 19 bp, Homo sapiens
tgttaatgcattctttctt

SEQ ID NO: 6749770 - DNA, 22 bp, Homo sapiens
tgttaatgcattgttgtaaagt

SEQ ID NO: 6749771 - DNA, 16 bp, Homo sapiens
tgttaatgctctatgt

SEQ ID NO: 6749772 - DNA, 13 bp, Homo sapiens
tgttaatgctttt

SEQ ID NO: 6749773 - DNA, 19 bp, Homo sapiens
tgttaatggatttcagaag

SEQ ID NO: 6749774 - DNA, 16 bp, Homo sapiens
tgttaatgtcattgct

SEQ ID NO: 6749775 - DNA, 17 bp, Homo sapiens
tgttaatgtcattgcta

SEQ ID NO: 6749776 - DNA, 20 bp, Homo sapiens
tgttaggtgtacatcctgca

SEQ ID NO: 6749777 - DNA, 12 bp, Homo sapiens
tgttaggtttta

SEQ ID NO: 6749778 - DNA, 15 bp, Homo sapiens
tgttagtaatacctc

SEQ ID NO: 6749779 - DNA, 16 bp, Homo sapiens
tgttagtaatacctct

SEQ ID NO: 6749780 - DNA, 15 bp, Homo sapiens
tgttagtagcagaaa

SEQ ID NO: 6749781 - DNA, 17 bp, Homo sapiens
tgttagtatgaggcatt

SEQ ID NO: 6749782 - DNA, 20 bp, Homo sapiens
tgttagtattttaatcctgt

SEQ ID NO: 6749783 - DNA, 14 bp, Homo sapiens
tgttagtctcccca

SEQ ID NO: 6749784 - DNA, 15 bp, Homo sapiens
tgttagtctccccac

SEQ ID NO: 6749785 - DNA, 14 bp, Homo sapiens
tgttagtcttaccg

SEQ ID NO: 6749786 - DNA, 14 bp, Homo sapiens
tgttagtgcaaatt

SEQ ID NO: 6749787 - DNA, 14 bp, Homo sapiens
tgttagtggcaccg

SEQ ID NO: 6749788 - DNA, 18 bp, Homo sapiens
tgttagtgtgtgtgcatg

SEQ ID NO: 6749789 - DNA, 19 bp, Homo sapiens
tgttagtgtgtgtgcatgt

SEQ ID NO: 6749790 - DNA, 21 bp, Homo sapiens
tgttagtgtgtgtgcatgtgt

SEQ ID NO: 6749791 - DNA, 23 bp, Homo sapiens
tgttagtgtgtgtgcatgtgtgt

SEQ ID NO: 6749792 - DNA, 21 bp, Homo sapiens
tgttagtgttttaagaaatgt

SEQ ID NO: 6749793 - DNA, 22 bp, Homo sapiens
tgttagtgttttaagaaatgta

SEQ ID NO: 6749794 - DNA, 14 bp, Homo sapiens
tgttagttcacttc

SEQ ID NO: 6749795 - DNA, 20 bp, Homo sapiens
tgttagttcctgtatgaaag

SEQ ID NO: 6749796 - DNA, 18 bp, Homo sapiens
tgttagttctagctctat

SEQ ID NO: 6749797 - DNA, 15 bp, Homo sapiens
tgttagttgtccaca

SEQ ID NO: 6749798 - DNA, 16 bp, Homo sapiens
tgttagtttacaatat

SEQ ID NO: 6749799 - DNA, 18 bp, Homo sapiens
tgttagttttgctccttc

SEQ ID NO: 6749800 - DNA, 22 bp, Homo sapiens
tgttagttttgtaaaaactgaa

SEQ ID NO: 6749801 - DNA, 12 bp, Homo sapiens
tgttataaaata

SEQ ID NO: 6749802 - DNA, 13 bp, Homo sapiens
tgttataaaataa

SEQ ID NO: 6749803 - DNA, 13 bp, Homo sapiens
tgttataaaatct

SEQ ID NO: 6749804 - DNA, 21 bp, Homo sapiens
tgttataaaatctgtattgct

SEQ ID NO: 6749805 - DNA, 14 bp, Homo sapiens
tgttataaataaaa

SEQ ID NO: 6749806 - DNA, 16 bp, Homo sapiens
tgttataaattttgta

SEQ ID NO: 6749807 - DNA, 19 bp, Homo sapiens
tgttataaattttgtacat

SEQ ID NO: 6749808 - DNA, 21 bp, Homo sapiens
tgttataaattttgtacattt

SEQ ID NO: 6749809 - DNA, 19 bp, Homo sapiens
tgttataacaccatctgga

SEQ ID NO: 6749810 - DNA, 15 bp, Homo sapiens
tgttataactctgca

SEQ ID NO: 6749811 - DNA, 23 bp, Homo sapiens
tgttataactctgcactactcct

SEQ ID NO: 6749812 - DNA, 16 bp, Homo sapiens
tgttataataaatgta

SEQ ID NO: 6749813 - DNA, 22 bp, Homo sapiens
tgttataattagagttgtgata

SEQ ID NO: 6749814 - DNA, 16 bp, Homo sapiens
tgttataatttgcaca

SEQ ID NO: 6749815 - DNA, 20 bp, Homo sapiens
tgttatacaaccttcattta

SEQ ID NO: 6749816 - DNA, 16 bp, Homo sapiens
tgttatacaatacaga

SEQ ID NO: 6749817 - DNA, 17 bp, Homo sapiens
tgttataccccatatat

SEQ ID NO: 6749818 - DNA, 18 bp, Homo sapiens
tgttataccccatatatt

SEQ ID NO: 6749819 - DNA, 16 bp, Homo sapiens
tgttatagattgtctt

SEQ ID NO: 6749820 - DNA, 18 bp, Homo sapiens
tgttataggttgttggat

SEQ ID NO: 6749821 - DNA, 13 bp, Homo sapiens
tgttatataaatg

SEQ ID NO: 6749822 - DNA, 14 bp, Homo sapiens
tgttatataaatgg

SEQ ID NO: 6749823 - DNA, 15 bp, Homo sapiens
tgttatataatttag

SEQ ID NO: 6749824 - DNA, 19 bp, Homo sapiens
tgttatatataataaatac

SEQ ID NO: 6749825 - DNA, 15 bp, Homo sapiens
tgttatatcagcaga

SEQ ID NO: 6749826 - DNA, 14 bp, Homo sapiens
tgttatatcaggga

SEQ ID NO: 6749827 - DNA, 16 bp, Homo sapiens
tgttatatcccctgct

SEQ ID NO: 6749828 - DNA, 12 bp, Homo sapiens
tgttatatgaac

SEQ ID NO: 6749829 - DNA, 19 bp, Homo sapiens
tgttatatgttgttcttac

SEQ ID NO: 6749830 - DNA, 21 bp, Homo sapiens
tgttatattaaagaaaaactt

SEQ ID NO: 6749831 - DNA, 18 bp, Homo sapiens
tgttatattccaaggaaa

SEQ ID NO: 6749832 - DNA, 18 bp, Homo sapiens
tgttatattgcttcctgt

SEQ ID NO: 6749833 - DNA, 17 bp, Homo sapiens
tgttatcaaactgctgt

SEQ ID NO: 6749834 - DNA, 18 bp, Homo sapiens
tgttatcaaactgctgtc

SEQ ID NO: 6749835 - DNA, 13 bp, Homo sapiens
tgttatcaaactt

SEQ ID NO: 6749836 - DNA, 12 bp, Homo sapiens
tgttatcaaata

SEQ ID NO: 6749837 - DNA, 23 bp, Homo sapiens
tgttatcacctatcctgaagatg

SEQ ID NO: 6749838 - DNA, 17 bp, Homo sapiens
tgttatcaccttccaaa

SEQ ID NO: 6749839 - DNA, 18 bp, Homo sapiens
tgttatcccaatcattgt

SEQ ID NO: 6749840 - DNA, 20 bp, Homo sapiens
tgttatcggacattctaatg

SEQ ID NO: 6749841 - DNA, 15 bp, Homo sapiens
tgttatctcttgtta

SEQ ID NO: 6749842 - DNA, 12 bp, Homo sapiens
tgttatctgtct

SEQ ID NO: 6749843 - DNA, 13 bp, Homo sapiens
tgttatctgtctt

SEQ ID NO: 6749844 - DNA, 23 bp, Homo sapiens
tgttatctgtctttatgatttca

SEQ ID NO: 6749845 - DNA, 14 bp, Homo sapiens
tgttatctgtttga

SEQ ID NO: 6749846 - DNA, 17 bp, Homo sapiens
tgttatctgtttgagaa

SEQ ID NO: 6749847 - DNA, 19 bp, Homo sapiens
tgttatcttaacactgaaa

SEQ ID NO: 6749848 - DNA, 20 bp, Homo sapiens
tgttatcttctcaagttcta

SEQ ID NO: 6749849 - DNA, 22 bp, Homo sapiens
tgttatcttctcaagttctaag

SEQ ID NO: 6749850 - DNA, 12 bp, Homo sapiens
tgttatcttgtg

SEQ ID NO: 6749851 - DNA, 12 bp, Homo sapiens
tgttatgaaaat

SEQ ID NO: 6749852 - DNA, 13 bp, Homo sapiens
tgttatgaaataa

SEQ ID NO: 6749853 - DNA, 21 bp, Homo sapiens
tgttatgaaataaagaaattg

SEQ ID NO: 6749854 - DNA, 13 bp, Homo sapiens
tgttatgaacatg

SEQ ID NO: 6749855 - DNA, 15 bp, Homo sapiens
tgttatgaacatgca

SEQ ID NO: 6749856 - DNA, 14 bp, Homo sapiens
tgttatgacagtga

SEQ ID NO: 6749857 - DNA, 16 bp, Homo sapiens
tgttatgactatgtaa

SEQ ID NO: 6749858 - DNA, 17 bp, Homo sapiens
tgttatgactatgtaaa

SEQ ID NO: 6749859 - DNA, 20 bp, Homo sapiens
tgttatgactatgtaaacta

SEQ ID NO: 6749860 - DNA, 13 bp, Homo sapiens
tgttatgagccag

SEQ ID NO: 6749861 - DNA, 12 bp, Homo sapiens
tgttatgataaa

SEQ ID NO: 6749862 - DNA, 21 bp, Homo sapiens
tgttatgataaaaaattttgt

SEQ ID NO: 6749863 - DNA, 23 bp, Homo sapiens
tgttatgataaaaggaagtagat

SEQ ID NO: 6749864 - DNA, 18 bp, Homo sapiens
tgttatgatattgtttaa

SEQ ID NO: 6749865 - DNA, 14 bp, Homo sapiens
tgttatgatgtgct

SEQ ID NO: 6749866 - DNA, 19 bp, Homo sapiens
tgttatgatgtgcttaaca

SEQ ID NO: 6749867 - DNA, 18 bp, Homo sapiens
tgttatgatttgtaacat

SEQ ID NO: 6749868 - DNA, 17 bp, Homo sapiens
tgttatgcaaaagcaag

SEQ ID NO: 6749869 - DNA, 14 bp, Homo sapiens
tgttatgcaaatga

SEQ ID NO: 6749870 - DNA, 15 bp, Homo sapiens
tgttatgcaaatgag

SEQ ID NO: 6749871 - DNA, 20 bp, Homo sapiens
tgttatgcactgtggtttca

SEQ ID NO: 6749872 - DNA, 13 bp, Homo sapiens
tgttatgcagtga

SEQ ID NO: 6749873 - DNA, 17 bp, Homo sapiens
tgttatgctgtttccta

SEQ ID NO: 6749874 - DNA, 15 bp, Homo sapiens
tgttatggcttattg

SEQ ID NO: 6749875 - DNA, 23 bp, Homo sapiens
tgttatggcttattgtgtgaagg

SEQ ID NO: 6749876 - DNA, 22 bp, Homo sapiens
tgttatgtaaaaggccaaacct

SEQ ID NO: 6749877 - DNA, 14 bp, Homo sapiens
tgttatgtaaacat

SEQ ID NO: 6749878 - DNA, 13 bp, Homo sapiens
tgttatgtactgt

SEQ ID NO: 6749879 - DNA, 15 bp, Homo sapiens
tgttatgtactgtac

SEQ ID NO: 6749880 - DNA, 20 bp, Homo sapiens
tgttatgtagtgtgcttttt

SEQ ID NO: 6749881 - DNA, 17 bp, Homo sapiens
tgttatgtattcctatg

SEQ ID NO: 6749882 - DNA, 21 bp, Homo sapiens
tgttatgtctgtttaagaaaa

SEQ ID NO: 6749883 - DNA, 14 bp, Homo sapiens
tgttatgtgaattt

SEQ ID NO: 6749884 - DNA, 18 bp, Homo sapiens
tgttatgtgagaacatta

SEQ ID NO: 6749885 - DNA, 17 bp, Homo sapiens
tgttatgtttaataagc

SEQ ID NO: 6749886 - DNA, 20 bp, Homo sapiens
tgttatgttttcgaaaatca

SEQ ID NO: 6749887 - DNA, 19 bp, Homo sapiens
tgttattaaaaaaacacaa

SEQ ID NO: 6749888 - DNA, 20 bp, Homo sapiens
tgttattaaaaaaacacaaa

SEQ ID NO: 6749889 - DNA, 13 bp, Homo sapiens
tgttattaaacag

SEQ ID NO: 6749890 - DNA, 22 bp, Homo sapiens
tgttattaaacgtatgcatgtg

SEQ ID NO: 6749891 - DNA, 17 bp, Homo sapiens
tgttattaatgtttctt

SEQ ID NO: 6749892 - DNA, 18 bp, Homo sapiens
tgttattaatgtttcttc

SEQ ID NO: 6749893 - DNA, 14 bp, Homo sapiens
tgttattataacat

SEQ ID NO: 6749894 - DNA, 15 bp, Homo sapiens
tgttattatatttga

SEQ ID NO: 6749895 - DNA, 20 bp, Homo sapiens
tgttattatcctgcatttta

SEQ ID NO: 6749896 - DNA, 14 bp, Homo sapiens
tgttattatgaagg

SEQ ID NO: 6749897 - DNA, 22 bp, Homo sapiens
tgttattattactctacactga

SEQ ID NO: 6749898 - DNA, 22 bp, Homo sapiens
tgttattcaaatttgatgatgt

SEQ ID NO: 6749899 - DNA, 16 bp, Homo sapiens
tgttattcaacagcaa

SEQ ID NO: 6749900 - DNA, 21 bp, Homo sapiens
tgttattcaataactattgct

SEQ ID NO: 6749901 - DNA, 14 bp, Homo sapiens
tgttattctttgca

SEQ ID NO: 6749902 - DNA, 14 bp, Homo sapiens
tgttattgaagtgt

SEQ ID NO: 6749903 - DNA, 21 bp, Homo sapiens
tgttattgcactatgaaaatc

SEQ ID NO: 6749904 - DNA, 18 bp, Homo sapiens
tgttattgcctaatcact

SEQ ID NO: 6749905 - DNA, 16 bp, Homo sapiens
tgttattggaattttc

SEQ ID NO: 6749906 - DNA, 19 bp, Homo sapiens
tgttattgtgaatgattca

SEQ ID NO: 6749907 - DNA, 15 bp, Homo sapiens
tgttattgtggaaga

SEQ ID NO: 6749908 - DNA, 13 bp, Homo sapiens
tgttattgttgaa

SEQ ID NO: 6749909 - DNA, 14 bp, Homo sapiens
tgttattgttgaac

SEQ ID NO: 6749910 - DNA, 14 bp, Homo sapiens
tgttattgttttca

SEQ ID NO: 6749911 - DNA, 16 bp, Homo sapiens
tgttattgttttgtta

SEQ ID NO: 6749912 - DNA, 19 bp, Homo sapiens
tgttatttaacccatttgt

SEQ ID NO: 6749913 - DNA, 15 bp, Homo sapiens
tgttatttacactgg

SEQ ID NO: 6749914 - DNA, 21 bp, Homo sapiens
tgttatttatccctcattcat

SEQ ID NO: 6749915 - DNA, 17 bp, Homo sapiens
tgttatttattctttat

SEQ ID NO: 6749916 - DNA, 15 bp, Homo sapiens
tgttatttccccagc

SEQ ID NO: 6749917 - DNA, 22 bp, Homo sapiens
tgttatttctatttttgtagaa

SEQ ID NO: 6749918 - DNA, 14 bp, Homo sapiens
tgttatttctgcaa

SEQ ID NO: 6749919 - DNA, 17 bp, Homo sapiens
tgttatttcttaaaatt

SEQ ID NO: 6749920 - DNA, 13 bp, Homo sapiens
tgttatttcttcc

SEQ ID NO: 6749921 - DNA, 16 bp, Homo sapiens
tgttatttgtacagtt

SEQ ID NO: 6749922 - DNA, 14 bp, Homo sapiens
tgttattttcaatg

SEQ ID NO: 6749923 - DNA, 19 bp, Homo sapiens
tgttattttcagtgctttg

SEQ ID NO: 6749924 - DNA, 17 bp, Homo sapiens
tgttatttttcaaggaa

SEQ ID NO: 6749925 - DNA, 19 bp, Homo sapiens
tgttatttttcaaggaagg

SEQ ID NO: 6749926 - DNA, 18 bp, Homo sapiens
tgttatttttgtattttt

SEQ ID NO: 6749927 - DNA, 14 bp, Homo sapiens
tgttcaaaaataac

SEQ ID NO: 6749928 - DNA, 22 bp, Homo sapiens
tgttcaaaacaaaatgaaacaa

SEQ ID NO: 6749929 - DNA, 16 bp, Homo sapiens
tgttcaaaatgttaat

SEQ ID NO: 6749930 - DNA, 17 bp, Homo sapiens
tgttcaaaatgttaata

SEQ ID NO: 6749931 - DNA, 19 bp, Homo sapiens
tgttcaaacaatatcatat

SEQ ID NO: 6749932 - DNA, 20 bp, Homo sapiens
tgttcaaacacaacctactc

SEQ ID NO: 6749933 - DNA, 17 bp, Homo sapiens
tgttcaaactactgtac

SEQ ID NO: 6749934 - DNA, 19 bp, Homo sapiens
tgttcaaactactgtacat

SEQ ID NO: 6749935 - DNA, 20 bp, Homo sapiens
tgttcaaactactgtacatt

SEQ ID NO: 6749936 - DNA, 19 bp, Homo sapiens
tgttcaaagaacccccctc

SEQ ID NO: 6749937 - DNA, 20 bp, Homo sapiens
tgttcaaagaacccccctcc

SEQ ID NO: 6749938 - DNA, 15 bp, Homo sapiens
tgttcaaagactgtg

SEQ ID NO: 6749939 - DNA, 22 bp, Homo sapiens
tgttcaaagccagcgtcctcct

SEQ ID NO: 6749940 - DNA, 15 bp, Homo sapiens
tgttcaaagctgcct

SEQ ID NO: 6749941 - DNA, 22 bp, Homo sapiens
tgttcaaaggagcaagaacttt

SEQ ID NO: 6749942 - DNA, 12 bp, Homo sapiens
tgttcaaagtac

SEQ ID NO: 6749943 - DNA, 14 bp, Homo sapiens
tgttcaaatattgt

SEQ ID NO: 6749944 - DNA, 17 bp, Homo sapiens
tgttcaaatattgtaaa

SEQ ID NO: 6749945 - DNA, 23 bp, Homo sapiens
tgttcaaattcacgttctagtga

SEQ ID NO: 6749946 - DNA, 13 bp, Homo sapiens
tgttcaacaagag

SEQ ID NO: 6749947 - DNA, 18 bp, Homo sapiens
tgttcaacttaatgaaga

SEQ ID NO: 6749948 - DNA, 19 bp, Homo sapiens
tgttcaagttttcagcttt

SEQ ID NO: 6749949 - DNA, 22 bp, Homo sapiens
tgttcaatagatttaggagcag

SEQ ID NO: 6749950 - DNA, 23 bp, Homo sapiens
tgttcaatctgtgtaagaaaaca

SEQ ID NO: 6749951 - DNA, 14 bp, Homo sapiens
tgttcaatgttcca

SEQ ID NO: 6749952 - DNA, 18 bp, Homo sapiens
tgttcaattatttccccc

SEQ ID NO: 6749953 - DNA, 14 bp, Homo sapiens
tgttcaatttcaga

SEQ ID NO: 6749954 - DNA, 14 bp, Homo sapiens
tgttcacaaactgt

SEQ ID NO: 6749955 - DNA, 21 bp, Homo sapiens
tgttggaaaagaatacagaaa

SEQ ID NO: 6749956 - DNA, 15 bp, Homo sapiens
tgttggaaactgtaa

SEQ ID NO: 6749957 - DNA, 16 bp, Homo sapiens
tgttggaaactgtaaa

SEQ ID NO: 6749958 - DNA, 20 bp, Homo sapiens
tgttggaaactgtaaaatga

SEQ ID NO: 6749959 - DNA, 13 bp, Homo sapiens
tgttggaaagtaa

SEQ ID NO: 6749960 - DNA, 15 bp, Homo sapiens
tgttggaaatgtgtt

SEQ ID NO: 6749961 - DNA, 24 bp, Homo sapiens
tgttggaactctgtgcaggtgctg

SEQ ID NO: 6749962 - DNA, 21 bp, Homo sapiens
tgttggaagcttgttttccag

SEQ ID NO: 6749963 - DNA, 12 bp, Homo sapiens
tgttggaatgaa

SEQ ID NO: 6749964 - DNA, 23 bp, Homo sapiens
tgttggaatgggagtctgaaatg

SEQ ID NO: 6749965 - DNA, 15 bp, Homo sapiens
tgttggaatgttgtt

SEQ ID NO: 6749966 - DNA, 22 bp, Homo sapiens
tgttggaatgttgttaaatgct

SEQ ID NO: 6749967 - DNA, 16 bp, Homo sapiens
tgttggaattttcaaa

SEQ ID NO: 6749968 - DNA, 14 bp, Homo sapiens
tgttggacaaatgt

SEQ ID NO: 6749969 - DNA, 22 bp, Homo sapiens
tgttggacagacactgttgcaa

SEQ ID NO: 6749970 - DNA, 23 bp, Homo sapiens
tgttggacagacactgttgcaaa

SEQ ID NO: 6749971 - DNA, 14 bp, Homo sapiens
tgttggacatgaga

SEQ ID NO: 6749972 - DNA, 13 bp, Homo sapiens
tgttggacccgct

SEQ ID NO: 6749973 - DNA, 18 bp, Homo sapiens
tgttggacccgctctgga

SEQ ID NO: 6749974 - DNA, 14 bp, Homo sapiens
tgttggactctgag

SEQ ID NO: 6749975 - DNA, 19 bp, Homo sapiens
tgttggagaagaactgaaa

SEQ ID NO: 6749976 - DNA, 14 bp, Homo sapiens
tgttggaggacccc

SEQ ID NO: 6749977 - DNA, 17 bp, Homo sapiens
tgttggaggagagagcc

SEQ ID NO: 6749978 - DNA, 18 bp, Homo sapiens
tgttggaggagagagcct

SEQ ID NO: 6749979 - DNA, 19 bp, Homo sapiens
tgttggaggagagagcctt

SEQ ID NO: 6749980 - DNA, 19 bp, Homo sapiens
tgttggaggggcaggcctt

SEQ ID NO: 6749981 - DNA, 23 bp, Homo sapiens
tgttggagtgaagcatttaaaag

SEQ ID NO: 6749982 - DNA, 11 bp, Homo sapiens
tgttggatctt

SEQ ID NO: 6749983 - DNA, 20 bp, Homo sapiens
tgttggatttgtttaaaagg

SEQ ID NO: 6749984 - DNA, 17 bp, Homo sapiens
tgttggatttttgtctt

SEQ ID NO: 6749985 - DNA, 17 bp, Homo sapiens
tgttggcaaatttgtga

SEQ ID NO: 6749986 - DNA, 18 bp, Homo sapiens
tgttggcaaatttgtgaa

SEQ ID NO: 6749987 - DNA, 13 bp, Homo sapiens
tgttggcacagaa

SEQ ID NO: 6749988 - DNA, 21 bp, Homo sapiens
tgttggcacagaacaggaggt

SEQ ID NO: 6749989 - DNA, 23 bp, Homo sapiens
tgttggcactcacagacctggag

SEQ ID NO: 6749990 - DNA, 23 bp, Homo sapiens
tgttggcagagcttttgcatttc

SEQ ID NO: 6749991 - DNA, 13 bp, Homo sapiens
tgttggcaggccc

SEQ ID NO: 6749992 - DNA, 19 bp, Homo sapiens
tgttggccaggctggtttc

SEQ ID NO: 6749993 - DNA, 20 bp, Homo sapiens
tgttggccatcatttcattc

SEQ ID NO: 6749994 - DNA, 16 bp, Homo sapiens
tgttggcccctctgct

SEQ ID NO: 6749995 - DNA, 11 bp, Homo sapiens
tgttggcctcg

SEQ ID NO: 6749996 - DNA, 17 bp, Homo sapiens
tgttggcctcttcaggc

SEQ ID NO: 6749997 - DNA, 15 bp, Homo sapiens
tgttggcctgtgggc

SEQ ID NO: 6749998 - DNA, 18 bp, Homo sapiens
tgttggcctgtgggcctc

SEQ ID NO: 6749999 - DNA, 24 bp, Homo sapiens
tgttggcgtaggctacagagaagc

SEQ ID NO: 6750000 - DNA, 20 bp, Homo sapiens
tgttggctatttgaaatact

SEQ ID NO: 6750001 - DNA, 16 bp, Homo sapiens
tgttggctcagaaaat

SEQ ID NO: 6750002 - DNA, 17 bp, Homo sapiens
tgttggctgggggcctc

SEQ ID NO: 6750003 - DNA, 19 bp, Homo sapiens
tgttggctgggggcctcag

SEQ ID NO: 6750004 - DNA, 14 bp, Homo sapiens
tgttggctttacaa

SEQ ID NO: 6750005 - DNA, 15 bp, Homo sapiens
tgttggctttacaaa

SEQ ID NO: 6750006 - DNA, 17 bp, Homo sapiens
tgttggctttacaaata

SEQ ID NO: 6750007 - DNA, 15 bp, Homo sapiens
tgttggctttttgaa

SEQ ID NO: 6750008 - DNA, 14 bp, Homo sapiens
tgttgggaaaggaa

SEQ ID NO: 6750009 - DNA, 14 bp, Homo sapiens
tgttgggaaagtat

SEQ ID NO: 6750010 - DNA, 18 bp, Homo sapiens
tgttgggaaggggtcctg

SEQ ID NO: 6750011 - DNA, 21 bp, Homo sapiens
tgttgggaaggggtcctgcag

SEQ ID NO: 6750012 - DNA, 15 bp, Homo sapiens
tgttgggacagccat

SEQ ID NO: 6750013 - DNA, 13 bp, Homo sapiens
tgttgggacctgc

SEQ ID NO: 6750014 - DNA, 20 bp, Homo sapiens
tgttgggacctgctgctcca

SEQ ID NO: 6750015 - DNA, 14 bp, Homo sapiens
tgttgggactgcta

SEQ ID NO: 6750016 - DNA, 13 bp, Homo sapiens
tgttgggagaaag

SEQ ID NO: 6750017 - DNA, 17 bp, Homo sapiens
tgttgggagagggcgca

SEQ ID NO: 6750018 - DNA, 14 bp, Homo sapiens
tgttgggaggaggg

SEQ ID NO: 6750019 - DNA, 20 bp, Homo sapiens
tgttgggattataggagtga

SEQ ID NO: 6750020 - DNA, 15 bp, Homo sapiens
tgttgggattcctga

SEQ ID NO: 6750021 - DNA, 17 bp, Homo sapiens
tgttgggattcctgacc

SEQ ID NO: 6750022 - DNA, 18 bp, Homo sapiens
tgttggggaaaccttcat

SEQ ID NO: 6750023 - DNA, 17 bp, Homo sapiens
tgttgggggggaccctg

SEQ ID NO: 6750024 - DNA, 18 bp, Homo sapiens
tgttggggtgggtataaa

SEQ ID NO: 6750025 - DNA, 22 bp, Homo sapiens
tgttgggtcctctgcttcctga

SEQ ID NO: 6750026 - DNA, 14 bp, Homo sapiens
tgttgggtggaccc

SEQ ID NO: 6750027 - DNA, 18 bp, Homo sapiens
tgttggtatttatctatt

SEQ ID NO: 6750028 - DNA, 17 bp, Homo sapiens
tgttggtcagaggagtg

SEQ ID NO: 6750029 - DNA, 17 bp, Homo sapiens
tgttggtcaggctggtc

SEQ ID NO: 6750030 - DNA, 20 bp, Homo sapiens
tgttggtcaggctggtctca

SEQ ID NO: 6750031 - DNA, 18 bp, Homo sapiens
tgttggtcatctctcctg

SEQ ID NO: 6750032 - DNA, 14 bp, Homo sapiens
tgttggtgcaatta

SEQ ID NO: 6750033 - DNA, 21 bp, Homo sapiens
tgttggtgcaattaactctgg

SEQ ID NO: 6750034 - DNA, 11 bp, Homo sapiens
tgttggtgcac

SEQ ID NO: 6750035 - DNA, 20 bp, Homo sapiens
tgttggtgctttagcgattg

SEQ ID NO: 6750036 - DNA, 14 bp, Homo sapiens
tgttggtgttggct

SEQ ID NO: 6750037 - DNA, 21 bp, Homo sapiens
tgttggttagccgactgtctt

SEQ ID NO: 6750038 - DNA, 17 bp, Homo sapiens
tgttggttcaaactttt

SEQ ID NO: 6750039 - DNA, 14 bp, Homo sapiens
tgttggttccaagc

SEQ ID NO: 6750040 - DNA, 19 bp, Homo sapiens
tgttggttgcactttgtag

SEQ ID NO: 6750041 - DNA, 16 bp, Homo sapiens
tgttggttgttttttc

SEQ ID NO: 6750042 - DNA, 13 bp, Homo sapiens
tgttggtttactt

SEQ ID NO: 6750043 - DNA, 20 bp, Homo sapiens
tgttggtttactttcaaatc

SEQ ID NO: 6750044 - DNA, 19 bp, Homo sapiens
tgttggtttcactgagagc

SEQ ID NO: 6750045 - DNA, 16 bp, Homo sapiens
tgttggtttcagtggc

SEQ ID NO: 6750046 - DNA, 22 bp, Homo sapiens
tgttggtttcagtggctggaat

SEQ ID NO: 6750047 - DNA, 15 bp, Homo sapiens
tgttggtttcatttg

SEQ ID NO: 6750048 - DNA, 21 bp, Homo sapiens
tgttggttttgggggtgtgag

SEQ ID NO: 6750049 - DNA, 22 bp, Homo sapiens
tgttgtaaaacaaaatttgact

SEQ ID NO: 6750050 - DNA, 15 bp, Homo sapiens
tgttgtaaaatgaat

SEQ ID NO: 6750051 - DNA, 16 bp, Homo sapiens
tgttgtaaacatttct

SEQ ID NO: 6750052 - DNA, 17 bp, Homo sapiens
tgttgtaaagagtggag

SEQ ID NO: 6750053 - DNA, 15 bp, Homo sapiens
tgttgtaaatgacca

SEQ ID NO: 6750054 - DNA, 22 bp, Homo sapiens
tgttgtaaatgaccaagaaaaa

SEQ ID NO: 6750055 - DNA, 14 bp, Homo sapiens
tgttgtaacctgct

SEQ ID NO: 6750056 - DNA, 12 bp, Homo sapiens
tgttgtaactta

SEQ ID NO: 6750057 - DNA, 13 bp, Homo sapiens
tgttgtaacttat

SEQ ID NO: 6750058 - DNA, 24 bp, Homo sapiens
tgttgtaacttatgtagatatttg

SEQ ID NO: 6750059 - DNA, 17 bp, Homo sapiens
tgttgtaagcaacaggc

SEQ ID NO: 6750060 - DNA, 20 bp, Homo sapiens
tgttgtaagtaataatttgt

SEQ ID NO: 6750061 - DNA, 15 bp, Homo sapiens
tgttgtaatatcagt

SEQ ID NO: 6750062 - DNA, 17 bp, Homo sapiens
tgttgtaatattttgct

SEQ ID NO: 6750063 - DNA, 18 bp, Homo sapiens
tgttgtaattcttcagtt

SEQ ID NO: 6750064 - DNA, 21 bp, Homo sapiens
tgttgtacatacgatttaagg

SEQ ID NO: 6750065 - DNA, 13 bp, Homo sapiens
tgttgtacattta

SEQ ID NO: 6750066 - DNA, 17 bp, Homo sapiens
tgttgtacatttatgat

SEQ ID NO: 6750067 - DNA, 15 bp, Homo sapiens
tgttgtaccatatgt

SEQ ID NO: 6750068 - DNA, 16 bp, Homo sapiens
tgttgtacttaaatgg

SEQ ID NO: 6750069 - DNA, 23 bp, Homo sapiens
tgttgtagaaaaactatgtgatg

SEQ ID NO: 6750070 - DNA, 15 bp, Homo sapiens
tgttgtagaataata

SEQ ID NO: 6750071 - DNA, 22 bp, Homo sapiens
tgttgtagatacaatcagctgc

SEQ ID NO: 6750072 - DNA, 22 bp, Homo sapiens
tgttgtagattaggtcttgctg

SEQ ID NO: 6750073 - DNA, 15 bp, Homo sapiens
tgttgtagcattttc

SEQ ID NO: 6750074 - DNA, 11 bp, Homo sapiens
tgttgtataaa

SEQ ID NO: 6750075 - DNA, 14 bp, Homo sapiens
tgttgtataaattt

SEQ ID NO: 6750076 - DNA, 17 bp, Homo sapiens
tgttgtatacttcatta

SEQ ID NO: 6750077 - DNA, 15 bp, Homo sapiens
tgttgtatctttgta

SEQ ID NO: 6750078 - DNA, 16 bp, Homo sapiens
tgttgtattaacaaaa

SEQ ID NO: 6750079 - DNA, 17 bp, Homo sapiens
tgttgtattcctgcctt

SEQ ID NO: 6750080 - DNA, 14 bp, Homo sapiens
tgttgtatttcaaa

SEQ ID NO: 6750081 - DNA, 14 bp, Homo sapiens
tgttgtatttctat

SEQ ID NO: 6750082 - DNA, 21 bp, Homo sapiens
tgttgtatttctatacagtag

SEQ ID NO: 6750083 - DNA, 12 bp, Homo sapiens
tgttgtcaagga

SEQ ID NO: 6750084 - DNA, 15 bp, Homo sapiens
tgttgtcagcatctt

SEQ ID NO: 6750085 - DNA, 18 bp, Homo sapiens
tgttgtcagcctgtgctg

SEQ ID NO: 6750086 - DNA, 13 bp, Homo sapiens
tgttgtcagctga

SEQ ID NO: 6750087 - DNA, 13 bp, Homo sapiens
tgttgtcataaca

SEQ ID NO: 6750088 - DNA, 23 bp, Homo sapiens
tgttgtcataacatttaaagaga

SEQ ID NO: 6750089 - DNA, 15 bp, Homo sapiens
tgttgtcatgtgtat

SEQ ID NO: 6750090 - DNA, 17 bp, Homo sapiens
tgttgtcattgctttac

SEQ ID NO: 6750091 - DNA, 20 bp, Homo sapiens
tgttgtcattgctttactgg

SEQ ID NO: 6750092 - DNA, 21 bp, Homo sapiens
tgttgtcattgtaaacaaact

SEQ ID NO: 6750093 - DNA, 17 bp, Homo sapiens
tgttgtcatttccaaat

SEQ ID NO: 6750094 - DNA, 17 bp, Homo sapiens
tgttgtccaacaataaa

SEQ ID NO: 6750095 - DNA, 19 bp, Homo sapiens
tgttgtcccaatgaaatac

SEQ ID NO: 6750096 - DNA, 21 bp, Homo sapiens
tgttgtcccagggctgatgct

SEQ ID NO: 6750097 - DNA, 18 bp, Homo sapiens
tgttgtcccatctgccct

SEQ ID NO: 6750098 - DNA, 19 bp, Homo sapiens
tgttgtcccatctgccctc

SEQ ID NO: 6750099 - DNA, 19 bp, Homo sapiens
tgttgtccctactttctct

SEQ ID NO: 6750100 - DNA, 13 bp, Homo sapiens
tgttgtccctgca

SEQ ID NO: 6750101 - DNA, 15 bp, Homo sapiens
tgttgtcctcccagg

SEQ ID NO: 6750102 - DNA, 14 bp, Homo sapiens
tgttgtccttttca

SEQ ID NO: 6750103 - DNA, 17 bp, Homo sapiens
tgttgtccttttgtctt

SEQ ID NO: 6750104 - DNA, 22 bp, Homo sapiens
tgttgtctaagaaattgaatac

SEQ ID NO: 6750105 - DNA, 19 bp, Homo sapiens
tgttgtctataatggggaa

SEQ ID NO: 6750106 - DNA, 14 bp, Homo sapiens
tgttgtctccactt

SEQ ID NO: 6750107 - DNA, 15 bp, Homo sapiens
tgttgtctccctctt

SEQ ID NO: 6750108 - DNA, 15 bp, Homo sapiens
tgttgtctcttctcc

SEQ ID NO: 6750109 - DNA, 17 bp, Homo sapiens
tgttgtctgaaacatag

SEQ ID NO: 6750110 - DNA, 15 bp, Homo sapiens
tgttgtctgaactaa

SEQ ID NO: 6750111 - DNA, 22 bp, Homo sapiens
tgttgtctgcgcctgaaaaggg

SEQ ID NO: 6750112 - DNA, 14 bp, Homo sapiens
tgttgtctgtgcag

SEQ ID NO: 6750113 - DNA, 13 bp, Homo sapiens
tgttgtcttattc

SEQ ID NO: 6750114 - DNA, 14 bp, Homo sapiens
tgttgtctttttta

SEQ ID NO: 6750115 - DNA, 12 bp, Homo sapiens
tgttgtgaaata

SEQ ID NO: 6750116 - DNA, 17 bp, Homo sapiens
tgttgtgaataattaca

SEQ ID NO: 6750117 - DNA, 19 bp, Homo sapiens
tgttgtgaataattacagt

SEQ ID NO: 6750118 - DNA, 12 bp, Homo sapiens
tgttgtgaatgt

SEQ ID NO: 6750119 - DNA, 13 bp, Homo sapiens
tgttgtgaatgtt

SEQ ID NO: 6750120 - DNA, 20 bp, Homo sapiens
tgttgtgagaatggcctgga

SEQ ID NO: 6750121 - DNA, 16 bp, Homo sapiens
tgttgtgatcttgcat

SEQ ID NO: 6750122 - DNA, 14 bp, Homo sapiens
tgttgtgatgtatt

SEQ ID NO: 6750123 - DNA, 21 bp, Homo sapiens
tgttgtgattttgtacagaat

SEQ ID NO: 6750124 - DNA, 15 bp, Homo sapiens
tgttgtgcagtgtgc

SEQ ID NO: 6750125 - DNA, 12 bp, Homo sapiens
tgttgtgccaca

SEQ ID NO: 6750126 - DNA, 19 bp, Homo sapiens
tgttgtgctccatagagca

SEQ ID NO: 6750127 - DNA, 16 bp, Homo sapiens
tgttgtgcttagaatt

SEQ ID NO: 6750128 - DNA, 15 bp, Homo sapiens
tgttgtgctttcaag

SEQ ID NO: 6750129 - DNA, 14 bp, Homo sapiens
tgttgtggagaaaa

SEQ ID NO: 6750130 - DNA, 15 bp, Homo sapiens
tgttgtggagaaaag

SEQ ID NO: 6750131 - DNA, 15 bp, Homo sapiens
tgttgtgggcttcct

SEQ ID NO: 6750132 - DNA, 13 bp, Homo sapiens
tgttgtggggatg

SEQ ID NO: 6750133 - DNA, 17 bp, Homo sapiens
tgttgtggtttaaatac

SEQ ID NO: 6750134 - DNA, 15 bp, Homo sapiens
tgttgtggtttttag

SEQ ID NO: 6750135 - DNA, 19 bp, Homo sapiens
tgtttcctgtgtctccaag

SEQ ID NO: 6750136 - DNA, 12 bp, Homo sapiens
tgtttccttcag

SEQ ID NO: 6750137 - DNA, 16 bp, Homo sapiens
tgtttccttcatttct

SEQ ID NO: 6750138 - DNA, 13 bp, Homo sapiens
tgtttccttccct

SEQ ID NO: 6750139 - DNA, 23 bp, Homo sapiens
tgtttccttgaggggagccagga

SEQ ID NO: 6750140 - DNA, 22 bp, Homo sapiens
tgtttccttgttggtcagagga

SEQ ID NO: 6750141 - DNA, 23 bp, Homo sapiens
tgtttccttgtttatcagataca

SEQ ID NO: 6750142 - DNA, 11 bp, Homo sapiens
tgtttcctttt

SEQ ID NO: 6750143 - DNA, 16 bp, Homo sapiens
tgtttcctttttcaga

SEQ ID NO: 6750144 - DNA, 21 bp, Homo sapiens
tgtttcgagtaaacttgaaaa

SEQ ID NO: 6750145 - DNA, 14 bp, Homo sapiens
tgtttcgcatccac

SEQ ID NO: 6750146 - DNA, 15 bp, Homo sapiens
tgtttcgtggggagg

SEQ ID NO: 6750147 - DNA, 16 bp, Homo sapiens
tgtttcgttaagcagt

SEQ ID NO: 6750148 - DNA, 17 bp, Homo sapiens
tgtttctaaacagttga

SEQ ID NO: 6750149 - DNA, 14 bp, Homo sapiens
tgtttctaagaaaa

SEQ ID NO: 6750150 - DNA, 22 bp, Homo sapiens
tgtttctaaggtaacaagatga

SEQ ID NO: 6750151 - DNA, 20 bp, Homo sapiens
tgtttctaagtggcctgcag

SEQ ID NO: 6750152 - DNA, 16 bp, Homo sapiens
tgtttctacaataatt

SEQ ID NO: 6750153 - DNA, 21 bp, Homo sapiens
tgtttctacacattgctacct

SEQ ID NO: 6750154 - DNA, 23 bp, Homo sapiens
tgtttctagagcctgctggatct

SEQ ID NO: 6750155 - DNA, 21 bp, Homo sapiens
tgtttctagctaaataaatgg

SEQ ID NO: 6750156 - DNA, 22 bp, Homo sapiens
tgtttctagttgaggagtttcc

SEQ ID NO: 6750157 - DNA, 15 bp, Homo sapiens
tgtttctataaatga

SEQ ID NO: 6750158 - DNA, 16 bp, Homo sapiens
tgtttctatacaaata

SEQ ID NO: 6750159 - DNA, 19 bp, Homo sapiens
tgtttctatatgtaacttc

SEQ ID NO: 6750160 - DNA, 16 bp, Homo sapiens
tgtttctatcctgttt

SEQ ID NO: 6750161 - DNA, 16 bp, Homo sapiens
tgtttctattttttga

SEQ ID NO: 6750162 - DNA, 18 bp, Homo sapiens
tgtttctcaaaagaggtt

SEQ ID NO: 6750163 - DNA, 15 bp, Homo sapiens
tgtttctcaaatctt

SEQ ID NO: 6750164 - DNA, 14 bp, Homo sapiens
tgtttctcaagtgt

SEQ ID NO: 6750165 - DNA, 23 bp, Homo sapiens
tgtttctccacaacagcctgggg

SEQ ID NO: 6750166 - DNA, 12 bp, Homo sapiens
tgtttctcccca

SEQ ID NO: 6750167 - DNA, 13 bp, Homo sapiens
tgtttctccccca

SEQ ID NO: 6750168 - DNA, 15 bp, Homo sapiens
tgtttctcccgtgct

SEQ ID NO: 6750169 - DNA, 15 bp, Homo sapiens
tgtttctcctctgaa

SEQ ID NO: 6750170 - DNA, 17 bp, Homo sapiens
tgtttctccttctgaaa

SEQ ID NO: 6750171 - DNA, 22 bp, Homo sapiens
tgtttctcggcaccagtgcctc

SEQ ID NO: 6750172 - DNA, 19 bp, Homo sapiens
tgtttctcgtgctgcatcc

SEQ ID NO: 6750173 - DNA, 13 bp, Homo sapiens
tgtttctctgctg

SEQ ID NO: 6750174 - DNA, 22 bp, Homo sapiens
tgtttctctgttgtaagaatag

SEQ ID NO: 6750175 - DNA, 20 bp, Homo sapiens
tgtttctcttgagctggcct

SEQ ID NO: 6750176 - DNA, 14 bp, Homo sapiens
tgtttctctttcct

SEQ ID NO: 6750177 - DNA, 20 bp, Homo sapiens
tgtttctctttgtctgcctt

SEQ ID NO: 6750178 - DNA, 13 bp, Homo sapiens
tgtttctgaaaag

SEQ ID NO: 6750179 - DNA, 22 bp, Homo sapiens
tgtttctgaaaagaaataataa

SEQ ID NO: 6750180 - DNA, 21 bp, Homo sapiens
tgtttctgaatgtttgtgtct

SEQ ID NO: 6750181 - DNA, 18 bp, Homo sapiens
tgtttctgacacaagatc

SEQ ID NO: 6750182 - DNA, 17 bp, Homo sapiens
tgtttctgacccactga

SEQ ID NO: 6750183 - DNA, 19 bp, Homo sapiens
tgtttctgactctgagcta

SEQ ID NO: 6750184 - DNA, 17 bp, Homo sapiens
tgtttctgagaaaagaa

SEQ ID NO: 6750185 - DNA, 17 bp, Homo sapiens
tgtttctgatgacagtg

SEQ ID NO: 6750186 - DNA, 17 bp, Homo sapiens
tgtttctgatttctgaa

SEQ ID NO: 6750187 - DNA, 12 bp, Homo sapiens
tgtttctgcaga

SEQ ID NO: 6750188 - DNA, 13 bp, Homo sapiens
tgtttctgcagag

SEQ ID NO: 6750189 - DNA, 16 bp, Homo sapiens
tgtttctgcagccctt

SEQ ID NO: 6750190 - DNA, 14 bp, Homo sapiens
tgtttctgcatagc

SEQ ID NO: 6750191 - DNA, 14 bp, Homo sapiens
tgtttctggacatt

SEQ ID NO: 6750192 - DNA, 19 bp, Homo sapiens
tgtttctggacattctctt

SEQ ID NO: 6750193 - DNA, 22 bp, Homo sapiens
tgtttctggacccttataaaat

SEQ ID NO: 6750194 - DNA, 20 bp, Homo sapiens
tgtttctgggtcctgaagaa

SEQ ID NO: 6750195 - DNA, 23 bp, Homo sapiens
tgtttctgtactttttggcataa

SEQ ID NO: 6750196 - DNA, 14 bp, Homo sapiens
tgtttctgtagaaa

SEQ ID NO: 6750197 - DNA, 22 bp, Homo sapiens
tgtttctgtcctgtaactgtta

SEQ ID NO: 6750198 - DNA, 12 bp, Homo sapiens
tgtttctgttat

SEQ ID NO: 6750199 - DNA, 13 bp, Homo sapiens
tgtttctgttatt

SEQ ID NO: 6750200 - DNA, 12 bp, Homo sapiens
tgtttctgttta

SEQ ID NO: 6750201 - DNA, 22 bp, Homo sapiens
tgtttctgtttataatgaagaa

SEQ ID NO: 6750202 - DNA, 14 bp, Homo sapiens
tgtttctgtttctt

SEQ ID NO: 6750203 - DNA, 13 bp, Homo sapiens
tgtttcttagccc

SEQ ID NO: 6750204 - DNA, 18 bp, Homo sapiens
tgtttcttagctgcactg

SEQ ID NO: 6750205 - DNA, 23 bp, Homo sapiens
tgtttcttagctgcactgtttat

SEQ ID NO: 6750206 - DNA, 17 bp, Homo sapiens
tgtttcttattctctgt

SEQ ID NO: 6750207 - DNA, 15 bp, Homo sapiens
tgtttcttcatttct

SEQ ID NO: 6750208 - DNA, 21 bp, Homo sapiens
tgtttcttcctgttaatgtat

SEQ ID NO: 6750209 - DNA, 14 bp, Homo sapiens
tgtttcttctccaa

SEQ ID NO: 6750210 - DNA, 23 bp, Homo sapiens
tgtttcttcttttcctttatcca

SEQ ID NO: 6750211 - DNA, 15 bp, Homo sapiens
tgtttcttgcctcat

SEQ ID NO: 6750212 - DNA, 15 bp, Homo sapiens
tgtttcttgctctct

SEQ ID NO: 6750213 - DNA, 14 bp, Homo sapiens
tgtttcttgctgta

SEQ ID NO: 6750214 - DNA, 15 bp, Homo sapiens
tgtttcttgcttgta

SEQ ID NO: 6750215 - DNA, 23 bp, Homo sapiens
tgtttcttgggcaagcagaaaaa

SEQ ID NO: 6750216 - DNA, 17 bp, Homo sapiens
tgtttcttgtgtttgag

SEQ ID NO: 6750217 - DNA, 22 bp, Homo sapiens
tgtttcttgttcatccaaggaa

SEQ ID NO: 6750218 - DNA, 15 bp, Homo sapiens
tgtttctttaaaatt

SEQ ID NO: 6750219 - DNA, 13 bp, Homo sapiens
tgtttctttctag

SEQ ID NO: 6750220 - DNA, 15 bp, Homo sapiens
tgtttctttctgtct

SEQ ID NO: 6750221 - DNA, 15 bp, Homo sapiens
tgtttctttcttcct

SEQ ID NO: 6750222 - DNA, 12 bp, Homo sapiens
tgtttctttgtg

SEQ ID NO: 6750223 - DNA, 16 bp, Homo sapiens
tgtttctttgttttat

SEQ ID NO: 6750224 - DNA, 21 bp, Homo sapiens
tgtttcttttgtaaagagaat

SEQ ID NO: 6750225 - DNA, 14 bp, Homo sapiens
tgtttcttttgtat

SEQ ID NO: 6750226 - DNA, 21 bp, Homo sapiens
tgtttcttttgtatgtaaatg

SEQ ID NO: 6750227 - DNA, 15 bp, Homo sapiens
tgtttcttttgtttg

SEQ ID NO: 6750228 - DNA, 18 bp, Homo sapiens
tgtttcttttgtttggta

SEQ ID NO: 6750229 - DNA, 21 bp, Homo sapiens
tgtttctttttttatgactgt

SEQ ID NO: 6750230 - DNA, 21 bp, Homo sapiens
tgtttgaaaaagctggtcttt

SEQ ID NO: 6750231 - DNA, 16 bp, Homo sapiens
tgtttgaaaactgaca

SEQ ID NO: 6750232 - DNA, 19 bp, Homo sapiens
tgtttgaaaacttcagaag

SEQ ID NO: 6750233 - DNA, 22 bp, Homo sapiens
tgtttgaaaataggatttgcac

SEQ ID NO: 6750234 - DNA, 16 bp, Homo sapiens
tgtttgaaaatagttt

SEQ ID NO: 6750235 - DNA, 19 bp, Homo sapiens
tgtttgaaaatagtttatt

SEQ ID NO: 6750236 - DNA, 19 bp, Homo sapiens
tgtttgaaaatattatctt

SEQ ID NO: 6750237 - DNA, 13 bp, Homo sapiens
tgtttgaaaatgc

SEQ ID NO: 6750238 - DNA, 24 bp, Homo sapiens
tgtttgaaacactcgtgtgcatga

SEQ ID NO: 6750239 - DNA, 13 bp, Homo sapiens
tgtttgaaagtag

SEQ ID NO: 6750240 - DNA, 13 bp, Homo sapiens
tgtttgaaatctt

SEQ ID NO: 6750241 - DNA, 21 bp, Homo sapiens
tgtttgaaatgaggtctgttt

SEQ ID NO: 6750242 - DNA, 18 bp, Homo sapiens
tgtttgaacacttactgt

SEQ ID NO: 6750243 - DNA, 15 bp, Homo sapiens
tgtttgaatatggac

SEQ ID NO: 6750244 - DNA, 19 bp, Homo sapiens
tgtttgaatatggacaaga

SEQ ID NO: 6750245 - DNA, 22 bp, Homo sapiens
tgtttgaatcccacgcttctct

SEQ ID NO: 6750246 - DNA, 15 bp, Homo sapiens
tgtttgaatgttaga

SEQ ID NO: 6750247 - DNA, 21 bp, Homo sapiens
tgtttgaattgatttttaaac

SEQ ID NO: 6750248 - DNA, 21 bp, Homo sapiens
tgtttgacactaagaaaatag

SEQ ID NO: 6750249 - DNA, 21 bp, Homo sapiens
tgtttgacgggaaacaaaact

SEQ ID NO: 6750250 - DNA, 15 bp, Homo sapiens
tgtttgagatgtgat

SEQ ID NO: 6750251 - DNA, 16 bp, Homo sapiens
tgtttgagatgtgatg

SEQ ID NO: 6750252 - DNA, 22 bp, Homo sapiens
tgtttgagtttttcctcccagt

SEQ ID NO: 6750253 - DNA, 15 bp, Homo sapiens
tgtttgatcacacag

SEQ ID NO: 6750254 - DNA, 12 bp, Homo sapiens
tgtttgatgcag

SEQ ID NO: 6750255 - DNA, 19 bp, Homo sapiens
tgtttgatgcattaaaaga

SEQ ID NO: 6750256 - DNA, 14 bp, Homo sapiens
tgtttgatgtatgt

SEQ ID NO: 6750257 - DNA, 16 bp, Homo sapiens
tgtttgatgtgtatgt

SEQ ID NO: 6750258 - DNA, 19 bp, Homo sapiens
tgtttgatgtgtatgtgtt

SEQ ID NO: 6750259 - DNA, 14 bp, Homo sapiens
tgtttgatgttttt

SEQ ID NO: 6750260 - DNA, 14 bp, Homo sapiens
tgtttgattggctt

SEQ ID NO: 6750261 - DNA, 21 bp, Homo sapiens
tgtttgatttgtctcatatat

SEQ ID NO: 6750262 - DNA, 18 bp, Homo sapiens
tgtttgcaactggtatat

SEQ ID NO: 6750263 - DNA, 10 bp, Homo sapiens
tgtttgcaat

SEQ ID NO: 6750264 - DNA, 18 bp, Homo sapiens
tgtttgcaatatcgatca

SEQ ID NO: 6750265 - DNA, 24 bp, Homo sapiens
tgtttgcactgtgtgctgactgaa

SEQ ID NO: 6750266 - DNA, 13 bp, Homo sapiens
tgtttgcagctgt

SEQ ID NO: 6750267 - DNA, 15 bp, Homo sapiens
tgtttgcaggagaaa

SEQ ID NO: 6750268 - DNA, 13 bp, Homo sapiens
tgtttgccaggac

SEQ ID NO: 6750269 - DNA, 16 bp, Homo sapiens
tgtttgccaggacatg

SEQ ID NO: 6750270 - DNA, 19 bp, Homo sapiens
tgtttgccaggacatgcaa

SEQ ID NO: 6750271 - DNA, 22 bp, Homo sapiens
tgtttgccatactttgtctgaa

SEQ ID NO: 6750272 - DNA, 12 bp, Homo sapiens
tgtttgcccaaa

SEQ ID NO: 6750273 - DNA, 19 bp, Homo sapiens
tgtttgcgtacttgtaata

SEQ ID NO: 6750274 - DNA, 19 bp, Homo sapiens
tgtttgctcaaaattgctt

SEQ ID NO: 6750275 - DNA, 22 bp, Homo sapiens
tgtttgctcaaaattgcttcta

SEQ ID NO: 6750276 - DNA, 14 bp, Homo sapiens
tgtttgctgaaatt

SEQ ID NO: 6750277 - DNA, 19 bp, Homo sapiens
tgtttgctgattatttatg

SEQ ID NO: 6750278 - DNA, 23 bp, Homo sapiens
tgtttgctgccttgctcctagca

SEQ ID NO: 6750279 - DNA, 20 bp, Homo sapiens
tgtttgctgttgggtttttg

SEQ ID NO: 6750280 - DNA, 24 bp, Homo sapiens
tgtttgcttaatttccttctgtta

SEQ ID NO: 6750281 - DNA, 15 bp, Homo sapiens
tgtttgcttattgtt

SEQ ID NO: 6750282 - DNA, 18 bp, Homo sapiens
tgtttgcttattgttcca

SEQ ID NO: 6750283 - DNA, 22 bp, Homo sapiens
tgtttgcttcatgtgtcccaga

SEQ ID NO: 6750284 - DNA, 23 bp, Homo sapiens
tgtttgcttcatgtgtcccagaa

SEQ ID NO: 6750285 - DNA, 14 bp, Homo sapiens
tgtttgcttccatt

SEQ ID NO: 6750286 - DNA, 19 bp, Homo sapiens
tgtttgcttcttgccatca

SEQ ID NO: 6750287 - DNA, 23 bp, Homo sapiens
tgtttgcttcttgccatcactgg

SEQ ID NO: 6750288 - DNA, 12 bp, Homo sapiens
tgtttggaaaaa

SEQ ID NO: 6750289 - DNA, 12 bp, Homo sapiens
tgtttggaaata

SEQ ID NO: 6750290 - DNA, 16 bp, Homo sapiens
tgtttggaattttctg

SEQ ID NO: 6750291 - DNA, 13 bp, Homo sapiens
tgtttggacagct

SEQ ID NO: 6750292 - DNA, 19 bp, Homo sapiens
tgtttggaccaaaaaccag

SEQ ID NO: 6750293 - DNA, 22 bp, Homo sapiens
tgtttggacctgcatatttagc

SEQ ID NO: 6750294 - DNA, 17 bp, Homo sapiens
tgtttggactgttttca

SEQ ID NO: 6750295 - DNA, 14 bp, Homo sapiens
tgtttggacttcac

SEQ ID NO: 6750296 - DNA, 19 bp, Homo sapiens
tgtttggagacattcctgg

SEQ ID NO: 6750297 - DNA, 19 bp, Homo sapiens
tgtttggagacgtttataa

SEQ ID NO: 6750298 - DNA, 21 bp, Homo sapiens
tgtttggaggagcaaagttaa

SEQ ID NO: 6750299 - DNA, 16 bp, Homo sapiens
tgtttggaggctgctg

SEQ ID NO: 6750300 - DNA, 17 bp, Homo sapiens
tgtttggaggctgctgc

SEQ ID NO: 6750301 - DNA, 18 bp, Homo sapiens
tgtttggatacagctgct

SEQ ID NO: 6750302 - DNA, 21 bp, Homo sapiens
tgtttggatgtaatttagggt

SEQ ID NO: 6750303 - DNA, 15 bp, Homo sapiens
tgtttggcaaggaaa

SEQ ID NO: 6750304 - DNA, 19 bp, Homo sapiens
tgtttggcactgatgcaat

SEQ ID NO: 6750305 - DNA, 17 bp, Homo sapiens
tgtttggcacttgtatt

SEQ ID NO: 6750306 - DNA, 18 bp, Homo sapiens
tgtttggcacttgtattt

SEQ ID NO: 6750307 - DNA, 19 bp, Homo sapiens
tgtttggcacttgtattta

SEQ ID NO: 6750308 - DNA, 22 bp, Homo sapiens
tgtttggcctttcttggggaga

SEQ ID NO: 6750309 - DNA, 23 bp, Homo sapiens
tgtttgggaaaggcagggccctg

SEQ ID NO: 6750310 - DNA, 18 bp, Homo sapiens
tgtttgggaggctggagt

SEQ ID NO: 6750311 - DNA, 22 bp, Homo sapiens
tgtttgggatcagcttcttgca

SEQ ID NO: 6750312 - DNA, 16 bp, Homo sapiens
ttaaaaattgtttctt

SEQ ID NO: 6750313 - DNA, 19 bp, Homo sapiens
ttaaaacaaaaggaaagaa

SEQ ID NO: 6750314 - DNA, 20 bp, Homo sapiens
ttaaaacaaaagggtgtata

SEQ ID NO: 6750315 - DNA, 13 bp, Homo sapiens
ttaaaacaaacca

SEQ ID NO: 6750316 - DNA, 16 bp, Homo sapiens
ttaaaacaaatataca

SEQ ID NO: 6750317 - DNA, 16 bp, Homo sapiens
ttaaaacaaattaaaa

SEQ ID NO: 6750318 - DNA, 16 bp, Homo sapiens
ttaaaacaagagacca

SEQ ID NO: 6750319 - DNA, 23 bp, Homo sapiens
ttaaaacaaggcttaaaagagta

SEQ ID NO: 6750320 - DNA, 16 bp, Homo sapiens
ttaaaacacagaaact

SEQ ID NO: 6750321 - DNA, 17 bp, Homo sapiens
ttaaaacacagtattgt

SEQ ID NO: 6750322 - DNA, 13 bp, Homo sapiens
ttaaaacacatat

SEQ ID NO: 6750323 - DNA, 13 bp, Homo sapiens
ttaaaacacatga

SEQ ID NO: 6750324 - DNA, 16 bp, Homo sapiens
ttaaaacacctttcct

SEQ ID NO: 6750325 - DNA, 13 bp, Homo sapiens
ttaaaacacgttt

SEQ ID NO: 6750326 - DNA, 18 bp, Homo sapiens
ttaaaacactttcaaaac

SEQ ID NO: 6750327 - DNA, 17 bp, Homo sapiens
ttaaaacagaagcaaat

SEQ ID NO: 6750328 - DNA, 21 bp, Homo sapiens
ttaaaacagctgcattagaaa

SEQ ID NO: 6750329 - DNA, 22 bp, Homo sapiens
ttaaaacaggcaaagttttaca

SEQ ID NO: 6750330 - DNA, 23 bp, Homo sapiens
ttaaaacagtatttattttgtaa

SEQ ID NO: 6750331 - DNA, 22 bp, Homo sapiens
ttaaaacatatttcattttaac

SEQ ID NO: 6750332 - DNA, 13 bp, Homo sapiens
ttaaaacatcaaa

SEQ ID NO: 6750333 - DNA, 19 bp, Homo sapiens
ttaaaacatcagaaactga

SEQ ID NO: 6750334 - DNA, 18 bp, Homo sapiens
ttaaaacatgctgtttat

SEQ ID NO: 6750335 - DNA, 20 bp, Homo sapiens
ttaaaacatgctgtttatga

SEQ ID NO: 6750336 - DNA, 13 bp, Homo sapiens
ttaaaacattttt

SEQ ID NO: 6750337 - DNA, 16 bp, Homo sapiens
ttaaaaccacagaaca

SEQ ID NO: 6750338 - DNA, 18 bp, Homo sapiens
ttaaaaccataaactgta

SEQ ID NO: 6750339 - DNA, 22 bp, Homo sapiens
ttaaaaccattaccttaaaatt

SEQ ID NO: 6750340 - DNA, 18 bp, Homo sapiens
ttaaaaccattatttaat

SEQ ID NO: 6750341 - DNA, 19 bp, Homo sapiens
ttaaaacctggaccttttc

SEQ ID NO: 6750342 - DNA, 15 bp, Homo sapiens
ttaaaacgtcttaga

SEQ ID NO: 6750343 - DNA, 18 bp, Homo sapiens
ttaaaacgtgtaaatgaa

SEQ ID NO: 6750344 - DNA, 16 bp, Homo sapiens
ttaaaactacttagca

SEQ ID NO: 6750345 - DNA, 19 bp, Homo sapiens
ttaaaactaggcatttgta

SEQ ID NO: 6750346 - DNA, 22 bp, Homo sapiens
ttaaaactagttagattcactt

SEQ ID NO: 6750347 - DNA, 19 bp, Homo sapiens
ttaaaactataacattata

SEQ ID NO: 6750348 - DNA, 15 bp, Homo sapiens
ttaaaactatattta

SEQ ID NO: 6750349 - DNA, 15 bp, Homo sapiens
ttaaaactatttagt

SEQ ID NO: 6750350 - DNA, 12 bp, Homo sapiens
ttaaaactcctg

SEQ ID NO: 6750351 - DNA, 23 bp, Homo sapiens
ttaaaactgaacttgaagctaac

SEQ ID NO: 6750352 - DNA, 12 bp, Homo sapiens
ttaaaactgagt

SEQ ID NO: 6750353 - DNA, 23 bp, Homo sapiens
ttaaaactgagtccatgaaaata

SEQ ID NO: 6750354 - DNA, 19 bp, Homo sapiens
ttaaaactgtaccttttgc

SEQ ID NO: 6750355 - DNA, 14 bp, Homo sapiens
ttaaaacttcatct

SEQ ID NO: 6750356 - DNA, 15 bp, Homo sapiens
ttaaaacttcttaaa

SEQ ID NO: 6750357 - DNA, 15 bp, Homo sapiens
ttaaaacttgtaatt

SEQ ID NO: 6750358 - DNA, 17 bp, Homo sapiens
ttaaaactttattaaaa

SEQ ID NO: 6750359 - DNA, 16 bp, Homo sapiens
ttaaaactttctaaat

SEQ ID NO: 6750360 - DNA, 20 bp, Homo sapiens
ttaaaactttgtagacattt

SEQ ID NO: 6750361 - DNA, 23 bp, Homo sapiens
ttaaaagaaaataaaaaaaagaa

SEQ ID NO: 6750362 - DNA, 22 bp, Homo sapiens
ttaaaagaaagggttctgtaaa

SEQ ID NO: 6750363 - DNA, 13 bp, Homo sapiens
ttaaaagaaatat

SEQ ID NO: 6750364 - DNA, 19 bp, Homo sapiens
ttaaaagaaatctctagct

SEQ ID NO: 6750365 - DNA, 18 bp, Homo sapiens
ttaaaagaagactggaag

SEQ ID NO: 6750366 - DNA, 14 bp, Homo sapiens
ttaaaagaatgact

SEQ ID NO: 6750367 - DNA, 16 bp, Homo sapiens
ttaaaagaatgagtga

SEQ ID NO: 6750368 - DNA, 15 bp, Homo sapiens
ttaaaagacaaacac

SEQ ID NO: 6750369 - DNA, 16 bp, Homo sapiens
ttaaaagacaaacacc

SEQ ID NO: 6750370 - DNA, 14 bp, Homo sapiens
ttaaaagacaaata

SEQ ID NO: 6750371 - DNA, 12 bp, Homo sapiens
ttaaaagacaag

SEQ ID NO: 6750372 - DNA, 15 bp, Homo sapiens
ttaaaagacaagact

SEQ ID NO: 6750373 - DNA, 16 bp, Homo sapiens
ttaaaagacaagactt

SEQ ID NO: 6750374 - DNA, 23 bp, Homo sapiens
ttaaaagacatttttatttagtt

SEQ ID NO: 6750375 - DNA, 18 bp, Homo sapiens
ttaaaagactcatccgtc

SEQ ID NO: 6750376 - DNA, 12 bp, Homo sapiens
ttaaaagactcc

SEQ ID NO: 6750377 - DNA, 17 bp, Homo sapiens
ttaaaagagctcagaca

SEQ ID NO: 6750378 - DNA, 16 bp, Homo sapiens
ttaaaagaggaaatta

SEQ ID NO: 6750379 - DNA, 18 bp, Homo sapiens
ttaaaagataaacagttt

SEQ ID NO: 6750380 - DNA, 18 bp, Homo sapiens
ttaaaagatgaaaatatt

SEQ ID NO: 6750381 - DNA, 14 bp, Homo sapiens
ttaaaagattttat

SEQ ID NO: 6750382 - DNA, 16 bp, Homo sapiens
ttaaaagattttatgg

SEQ ID NO: 6750383 - DNA, 17 bp, Homo sapiens
ttaaaagattttatggt

SEQ ID NO: 6750384 - DNA, 19 bp, Homo sapiens
ttaaaagcaaaaagatgta

SEQ ID NO: 6750385 - DNA, 14 bp, Homo sapiens
ttaaaagcaaatca

SEQ ID NO: 6750386 - DNA, 21 bp, Homo sapiens
ttaaaagcaaatcatttgttt

SEQ ID NO: 6750387 - DNA, 12 bp, Homo sapiens
ttaaaagcagca

SEQ ID NO: 6750388 - DNA, 12 bp, Homo sapiens
ttaaaagcatat

SEQ ID NO: 6750389 - DNA, 18 bp, Homo sapiens
ttaaaagcatttttatta

SEQ ID NO: 6750390 - DNA, 11 bp, Homo sapiens
ttaaaagccac

SEQ ID NO: 6750391 - DNA, 19 bp, Homo sapiens
ttaaaagccactgttacat

SEQ ID NO: 6750392 - DNA, 15 bp, Homo sapiens
ttaaaagccatgtat

SEQ ID NO: 6750393 - DNA, 16 bp, Homo sapiens
ttaaaagctatcttca

SEQ ID NO: 6750394 - DNA, 21 bp, Homo sapiens
ttaaaagctatcttcatgtaa

SEQ ID NO: 6750395 - DNA, 23 bp, Homo sapiens
ttaaaaggaaagtcaagaagaat

SEQ ID NO: 6750396 - DNA, 15 bp, Homo sapiens
ttaaaaggatagtat

SEQ ID NO: 6750397 - DNA, 13 bp, Homo sapiens
ttaaaaggcaact

SEQ ID NO: 6750398 - DNA, 16 bp, Homo sapiens
ttaaaagggggggagc

SEQ ID NO: 6750399 - DNA, 17 bp, Homo sapiens
ttaaaaggtataattaa

SEQ ID NO: 6750400 - DNA, 17 bp, Homo sapiens
ttaaaagtaaaatgtct

SEQ ID NO: 6750401 - DNA, 16 bp, Homo sapiens
ttaaaagtaaaattgt

SEQ ID NO: 6750402 - DNA, 15 bp, Homo sapiens
ttaaaagtaataaag

SEQ ID NO: 6750403 - DNA, 16 bp, Homo sapiens
ttaaaagtaataaaga

SEQ ID NO: 6750404 - DNA, 19 bp, Homo sapiens
ttaaaagtaataaagagaa

SEQ ID NO: 6750405 - DNA, 21 bp, Homo sapiens
ttaaaagtactttaaaaagga

SEQ ID NO: 6750406 - DNA, 12 bp, Homo sapiens
ttaaaagtattc

SEQ ID NO: 6750407 - DNA, 23 bp, Homo sapiens
ttaaaagtcagtatcatattatt

SEQ ID NO: 6750408 - DNA, 20 bp, Homo sapiens
ttaaaagtgtacaagttgct

SEQ ID NO: 6750409 - DNA, 14 bp, Homo sapiens
ttaaaagtgtattt

SEQ ID NO: 6750410 - DNA, 22 bp, Homo sapiens
ttaaaagttagcattgtttcta

SEQ ID NO: 6750411 - DNA, 17 bp, Homo sapiens
ttaaaagttgaattttt

SEQ ID NO: 6750412 - DNA, 19 bp, Homo sapiens
ttaaaagtttcaatgtgat

SEQ ID NO: 6750413 - DNA, 13 bp, Homo sapiens
ttaaaagtttcta

SEQ ID NO: 6750414 - DNA, 13 bp, Homo sapiens
ttaaaagttttat

SEQ ID NO: 6750415 - DNA, 18 bp, Homo sapiens
ttaaaataaaaatatttt

SEQ ID NO: 6750416 - DNA, 16 bp, Homo sapiens
ttaaaataaaaattct

SEQ ID NO: 6750417 - DNA, 14 bp, Homo sapiens
ttaaaataaaacaa

SEQ ID NO: 6750418 - DNA, 18 bp, Homo sapiens
ttaaaataaaacaagcct

SEQ ID NO: 6750419 - DNA, 19 bp, Homo sapiens
ttaaaataaaacaagcctt

SEQ ID NO: 6750420 - DNA, 13 bp, Homo sapiens
ttaaaataaaacg

SEQ ID NO: 6750421 - DNA, 12 bp, Homo sapiens
ttaaaataaaat

SEQ ID NO: 6750422 - DNA, 15 bp, Homo sapiens
ttaaaataaaatgaa

SEQ ID NO: 6750423 - DNA, 17 bp, Homo sapiens
ttaaaataaaatgaaaa

SEQ ID NO: 6750424 - DNA, 21 bp, Homo sapiens
ttaaaataaaatgaaaattgt

SEQ ID NO: 6750425 - DNA, 13 bp, Homo sapiens
ttaaaataaattc

SEQ ID NO: 6750426 - DNA, 16 bp, Homo sapiens
ttaaaataaattctct

SEQ ID NO: 6750427 - DNA, 19 bp, Homo sapiens
ttaaaataaattctctcct

SEQ ID NO: 6750428 - DNA, 12 bp, Homo sapiens
ttaaaataacta

SEQ ID NO: 6750429 - DNA, 15 bp, Homo sapiens
ttaaaataactagtg

SEQ ID NO: 6750430 - DNA, 22 bp, Homo sapiens
ttaaaataagctttctcagaat

SEQ ID NO: 6750431 - DNA, 15 bp, Homo sapiens
ttaaaataaggattt

SEQ ID NO: 6750432 - DNA, 15 bp, Homo sapiens
ttaaaataagtctga

SEQ ID NO: 6750433 - DNA, 17 bp, Homo sapiens
ttaaaataagtctgatt

SEQ ID NO: 6750434 - DNA, 12 bp, Homo sapiens
ttaaaataagtg

SEQ ID NO: 6750435 - DNA, 15 bp, Homo sapiens
ttaaaataattatat

SEQ ID NO: 6750436 - DNA, 11 bp, Homo sapiens
ttaaaatacaa

SEQ ID NO: 6750437 - DNA, 13 bp, Homo sapiens
ttaaaatacaaga

SEQ ID NO: 6750438 - DNA, 16 bp, Homo sapiens
ttaaaatacataactt

SEQ ID NO: 6750439 - DNA, 13 bp, Homo sapiens
ttaaaatacattt

SEQ ID NO: 6750440 - DNA, 15 bp, Homo sapiens
ttaaaatacatttta

SEQ ID NO: 6750441 - DNA, 13 bp, Homo sapiens
ttaaaatactgta

SEQ ID NO: 6750442 - DNA, 18 bp, Homo sapiens
ttaaaatactgtagataa

SEQ ID NO: 6750443 - DNA, 20 bp, Homo sapiens
ttaaaatactgtagataatt

SEQ ID NO: 6750444 - DNA, 14 bp, Homo sapiens
ttaaaatactgttt

SEQ ID NO: 6750445 - DNA, 17 bp, Homo sapiens
ttaaaatagaaattttg

SEQ ID NO: 6750446 - DNA, 22 bp, Homo sapiens
ttaaaatagcaaaagaagaagt

SEQ ID NO: 6750447 - DNA, 18 bp, Homo sapiens
ttaaaatagcacatgatt

SEQ ID NO: 6750448 - DNA, 22 bp, Homo sapiens
ttaaaataggggatatttaagg

SEQ ID NO: 6750449 - DNA, 20 bp, Homo sapiens
ttaaaatagttacaagcatt

SEQ ID NO: 6750450 - DNA, 18 bp, Homo sapiens
ttaaaatagttttctaaa

SEQ ID NO: 6750451 - DNA, 20 bp, Homo sapiens
ttaaaatagttttctaaatg

SEQ ID NO: 6750452 - DNA, 23 bp, Homo sapiens
ttaaaatagttttctaaatgttt

SEQ ID NO: 6750453 - DNA, 18 bp, Homo sapiens
ttaaaatataaattaaga

SEQ ID NO: 6750454 - DNA, 17 bp, Homo sapiens
ttaaaatatagagacag

SEQ ID NO: 6750455 - DNA, 14 bp, Homo sapiens
ttaaaatatagtgt

SEQ ID NO: 6750456 - DNA, 23 bp, Homo sapiens
ttaaaatatagtgttgtgttaca

SEQ ID NO: 6750457 - DNA, 14 bp, Homo sapiens
ttaaaatatatagt

SEQ ID NO: 6750458 - DNA, 14 bp, Homo sapiens
ttaaaatatatata

SEQ ID NO: 6750459 - DNA, 16 bp, Homo sapiens
ttaaaatatatataaa

SEQ ID NO: 6750460 - DNA, 14 bp, Homo sapiens
ttaaaatatatgaa

SEQ ID NO: 6750461 - DNA, 20 bp, Homo sapiens
ttaaaatatatgtatttaaa

SEQ ID NO: 6750462 - DNA, 20 bp, Homo sapiens
ttaaaatatatgttctgcaa

SEQ ID NO: 6750463 - DNA, 23 bp, Homo sapiens
ttaaaatatatgttctgcaagaa

SEQ ID NO: 6750464 - DNA, 16 bp, Homo sapiens
ttaaaatatcctgtaa

SEQ ID NO: 6750465 - DNA, 19 bp, Homo sapiens
ttaaaatatcctgtaacta

SEQ ID NO: 6750466 - DNA, 19 bp, Homo sapiens
ttaaaatatctctaaaata

SEQ ID NO: 6750467 - DNA, 16 bp, Homo sapiens
ttaaaatatgcactaa

SEQ ID NO: 6750468 - DNA, 17 bp, Homo sapiens
ttaaaatatgtgaagtt

SEQ ID NO: 6750469 - DNA, 18 bp, Homo sapiens
ttaaaatatgtgaagttt

SEQ ID NO: 6750470 - DNA, 20 bp, Homo sapiens
ttaaaatatgtgaagttttc

SEQ ID NO: 6750471 - DNA, 19 bp, Homo sapiens
ttaaaatattggctgattt

SEQ ID NO: 6750472 - DNA, 22 bp, Homo sapiens
ttaaaatattgtgtaagaatca

SEQ ID NO: 6750473 - DNA, 14 bp, Homo sapiens
ttaaaatatttaac

SEQ ID NO: 6750474 - DNA, 16 bp, Homo sapiens
ttaaaatatttaactt

SEQ ID NO: 6750475 - DNA, 17 bp, Homo sapiens
ttaaaatatttaacttt

SEQ ID NO: 6750476 - DNA, 18 bp, Homo sapiens
ttaaaatatttgcctcca

SEQ ID NO: 6750477 - DNA, 12 bp, Homo sapiens
ttaaaatatttt

SEQ ID NO: 6750478 - DNA, 14 bp, Homo sapiens
ttaaaatattttat

SEQ ID NO: 6750479 - DNA, 17 bp, Homo sapiens
ttaaaatattttggatg

SEQ ID NO: 6750480 - DNA, 17 bp, Homo sapiens
ttaaaatcaaatgtaaa

SEQ ID NO: 6750481 - DNA, 23 bp, Homo sapiens
ttaaaatcacattttaagtgctt

SEQ ID NO: 6750482 - DNA, 12 bp, Homo sapiens
ttaaaatcacta

SEQ ID NO: 6750483 - DNA, 19 bp, Homo sapiens
ttaaaatcactaacattat

SEQ ID NO: 6750484 - DNA, 21 bp, Homo sapiens
ttaaaatcactaacattatat

SEQ ID NO: 6750485 - DNA, 20 bp, Homo sapiens
ttaaaatcactgtcaatatt

SEQ ID NO: 6750486 - DNA, 16 bp, Homo sapiens
ttaaaatcagctattt

SEQ ID NO: 6750487 - DNA, 23 bp, Homo sapiens
ttaaaatcaggattttagtgctt

SEQ ID NO: 6750488 - DNA, 17 bp, Homo sapiens
ttaaaatcattcaatat

SEQ ID NO: 6750489 - DNA, 15 bp, Homo sapiens
ttaaaatccagtatt

SEQ ID NO: 6750490 - DNA, 16 bp, Homo sapiens
ttaaaatccagtatta

SEQ ID NO: 6750491 - DNA, 14 bp, Homo sapiens
ttaaatgtctaatg

SEQ ID NO: 6750492 - DNA, 19 bp, Homo sapiens
ttaaatgtctaatgtattt

SEQ ID NO: 6750493 - DNA, 16 bp, Homo sapiens
ttaaatgtctataaat

SEQ ID NO: 6750494 - DNA, 22 bp, Homo sapiens
ttaaatgtctgacacattaatg

SEQ ID NO: 6750495 - DNA, 18 bp, Homo sapiens
ttaaatgtcttctgtatt

SEQ ID NO: 6750496 - DNA, 11 bp, Homo sapiens
ttaaatgtgaa

SEQ ID NO: 6750497 - DNA, 12 bp, Homo sapiens
ttaaatgtgaat

SEQ ID NO: 6750498 - DNA, 18 bp, Homo sapiens
ttaaatgtgtacaatgta

SEQ ID NO: 6750499 - DNA, 12 bp, Homo sapiens
ttaaatgtgtat

SEQ ID NO: 6750500 - DNA, 21 bp, Homo sapiens
ttaaatgtgtatttcttaaga

SEQ ID NO: 6750501 - DNA, 21 bp, Homo sapiens
ttaaatgtgtgagtgcatgta

SEQ ID NO: 6750502 - DNA, 15 bp, Homo sapiens
ttaaatgtgtgtaaa

SEQ ID NO: 6750503 - DNA, 16 bp, Homo sapiens
ttaaatgttaatgaga

SEQ ID NO: 6750504 - DNA, 20 bp, Homo sapiens
ttaaatgttatgactatgta

SEQ ID NO: 6750505 - DNA, 13 bp, Homo sapiens
ttaaatgttatgt

SEQ ID NO: 6750506 - DNA, 16 bp, Homo sapiens
ttaaatgttatgtata

SEQ ID NO: 6750507 - DNA, 13 bp, Homo sapiens
ttaaatgttatta

SEQ ID NO: 6750508 - DNA, 22 bp, Homo sapiens
ttaaatgttgcacatcattcat

SEQ ID NO: 6750509 - DNA, 17 bp, Homo sapiens
ttaaatgtttcaaaata

SEQ ID NO: 6750510 - DNA, 12 bp, Homo sapiens
ttaaatgtttct

SEQ ID NO: 6750511 - DNA, 11 bp, Homo sapiens
ttaaatgtttg

SEQ ID NO: 6750512 - DNA, 17 bp, Homo sapiens
ttaaatgttttcattgg

SEQ ID NO: 6750513 - DNA, 15 bp, Homo sapiens
ttaaatgttttgtaa

SEQ ID NO: 6750514 - DNA, 18 bp, Homo sapiens
ttaaatgttttgtaaact

SEQ ID NO: 6750515 - DNA, 20 bp, Homo sapiens
ttaaatgttttgtaaacttt

SEQ ID NO: 6750516 - DNA, 21 bp, Homo sapiens
ttaaatgttttgtaaactttg

SEQ ID NO: 6750517 - DNA, 14 bp, Homo sapiens
ttaaattaaaattt

SEQ ID NO: 6750518 - DNA, 18 bp, Homo sapiens
ttaaattaattgaatcta

SEQ ID NO: 6750519 - DNA, 12 bp, Homo sapiens
ttaaattacaat

SEQ ID NO: 6750520 - DNA, 15 bp, Homo sapiens
ttaaattacaatttt

SEQ ID NO: 6750521 - DNA, 21 bp, Homo sapiens
ttaaattacacagttcacaaa

SEQ ID NO: 6750522 - DNA, 14 bp, Homo sapiens
ttaaattacagctt

SEQ ID NO: 6750523 - DNA, 16 bp, Homo sapiens
ttaaattacagctttt

SEQ ID NO: 6750524 - DNA, 17 bp, Homo sapiens
ttaaattacagctttta

SEQ ID NO: 6750525 - DNA, 19 bp, Homo sapiens
ttaaattacagcttttatg

SEQ ID NO: 6750526 - DNA, 11 bp, Homo sapiens
ttaaattacct

SEQ ID NO: 6750527 - DNA, 20 bp, Homo sapiens
ttaaattataaggactgcat

SEQ ID NO: 6750528 - DNA, 14 bp, Homo sapiens
ttaaattatatgat

SEQ ID NO: 6750529 - DNA, 15 bp, Homo sapiens
ttaaattatatgata

SEQ ID NO: 6750530 - DNA, 23 bp, Homo sapiens
ttaaattatcattgtttgtcctt

SEQ ID NO: 6750531 - DNA, 24 bp, Homo sapiens
ttaaattatgaatgagttttacaa

SEQ ID NO: 6750532 - DNA, 16 bp, Homo sapiens
ttaaattatgttttta

SEQ ID NO: 6750533 - DNA, 21 bp, Homo sapiens
ttaaattattatcttcttaac

SEQ ID NO: 6750534 - DNA, 19 bp, Homo sapiens
ttaaattccactgaaaatt

SEQ ID NO: 6750535 - DNA, 21 bp, Homo sapiens
ttaaattccactgaaaattta

SEQ ID NO: 6750536 - DNA, 23 bp, Homo sapiens
ttaaattctccagttttttgtta

SEQ ID NO: 6750537 - DNA, 23 bp, Homo sapiens
ttaaattctctctaacataacaa

SEQ ID NO: 6750538 - DNA, 23 bp, Homo sapiens
ttaaattctctctcttgcaggaa

SEQ ID NO: 6750539 - DNA, 12 bp, Homo sapiens
ttaaattctgag

SEQ ID NO: 6750540 - DNA, 18 bp, Homo sapiens
ttaaattctgagacatgt

SEQ ID NO: 6750541 - DNA, 17 bp, Homo sapiens
ttaaattctgctcctga

SEQ ID NO: 6750542 - DNA, 14 bp, Homo sapiens
ttaaattctgggtg

SEQ ID NO: 6750543 - DNA, 19 bp, Homo sapiens
ttaaattcttactctggag

SEQ ID NO: 6750544 - DNA, 13 bp, Homo sapiens
ttaaattcttgca

SEQ ID NO: 6750545 - DNA, 16 bp, Homo sapiens
ttaaattctttttcaa

SEQ ID NO: 6750546 - DNA, 20 bp, Homo sapiens
ttaaattcttttttaaattt

SEQ ID NO: 6750547 - DNA, 19 bp, Homo sapiens
ttaaattgattattttgtg

SEQ ID NO: 6750548 - DNA, 20 bp, Homo sapiens
ttaaattgcaatatataaga

SEQ ID NO: 6750549 - DNA, 16 bp, Homo sapiens
ttaaattgcatttcta

SEQ ID NO: 6750550 - DNA, 19 bp, Homo sapiens
ttaaattgcttttgttgtg

SEQ ID NO: 6750551 - DNA, 16 bp, Homo sapiens
ttaaattgtgtacact

SEQ ID NO: 6750552 - DNA, 19 bp, Homo sapiens
ttaaatttaaaacaatgaa

SEQ ID NO: 6750553 - DNA, 20 bp, Homo sapiens
ttaaatttaaaacaatgaat

SEQ ID NO: 6750554 - DNA, 21 bp, Homo sapiens
ttaaatttaatatactgcata

SEQ ID NO: 6750555 - DNA, 14 bp, Homo sapiens
ttaaatttattaaa

SEQ ID NO: 6750556 - DNA, 15 bp, Homo sapiens
ttaaatttattaaat

SEQ ID NO: 6750557 - DNA, 12 bp, Homo sapiens
ttaaatttcaga

SEQ ID NO: 6750558 - DNA, 15 bp, Homo sapiens
ttaaatttctaccgc

SEQ ID NO: 6750559 - DNA, 21 bp, Homo sapiens
ttaaatttctgccctgagccc

SEQ ID NO: 6750560 - DNA, 14 bp, Homo sapiens
ttaaatttcttaac

SEQ ID NO: 6750561 - DNA, 15 bp, Homo sapiens
ttaaatttgaatctg

SEQ ID NO: 6750562 - DNA, 19 bp, Homo sapiens
ttaaatttgccagttttat

SEQ ID NO: 6750563 - DNA, 22 bp, Homo sapiens
ttaaatttgggttgcaaagcta

SEQ ID NO: 6750564 - DNA, 20 bp, Homo sapiens
ttaaatttggtttgttaatt

SEQ ID NO: 6750565 - DNA, 14 bp, Homo sapiens
ttaaatttgtaagt

SEQ ID NO: 6750566 - DNA, 21 bp, Homo sapiens
ttaaatttgtaagtttcaggt

SEQ ID NO: 6750567 - DNA, 19 bp, Homo sapiens
ttaaatttgttgacaaaat

SEQ ID NO: 6750568 - DNA, 18 bp, Homo sapiens
ttaaattttaatgtaaaa

SEQ ID NO: 6750569 - DNA, 16 bp, Homo sapiens
ttaaattttaatttat

SEQ ID NO: 6750570 - DNA, 23 bp, Homo sapiens
ttaaattttaccctttagactgt

SEQ ID NO: 6750571 - DNA, 19 bp, Homo sapiens
ttaaattttagtacatttt

SEQ ID NO: 6750572 - DNA, 16 bp, Homo sapiens
ttaaattttcacctgt

SEQ ID NO: 6750573 - DNA, 12 bp, Homo sapiens
ttaaattttcca

SEQ ID NO: 6750574 - DNA, 13 bp, Homo sapiens
ttaaattttccat

SEQ ID NO: 6750575 - DNA, 12 bp, Homo sapiens
ttaaattttcta

SEQ ID NO: 6750576 - DNA, 16 bp, Homo sapiens
ttaaattttctccagt

SEQ ID NO: 6750577 - DNA, 21 bp, Homo sapiens
ttaaattttctccagtccctg

SEQ ID NO: 6750578 - DNA, 15 bp, Homo sapiens
ttaaattttgtaatg

SEQ ID NO: 6750579 - DNA, 16 bp, Homo sapiens
ttaaattttgtaatga

SEQ ID NO: 6750580 - DNA, 14 bp, Homo sapiens
ttaaattttgtgtc

SEQ ID NO: 6750581 - DNA, 22 bp, Homo sapiens
ttaaattttgttttctttttct

SEQ ID NO: 6750582 - DNA, 16 bp, Homo sapiens
ttaaatttttgtcatt

SEQ ID NO: 6750583 - DNA, 21 bp, Homo sapiens
ttaaatttttttgtatgaaaa

SEQ ID NO: 6750584 - DNA, 23 bp, Homo sapiens
ttaaatttttttgtatgaaaaca

SEQ ID NO: 6750585 - DNA, 16 bp, Homo sapiens
ttaaattttttttaca

SEQ ID NO: 6750586 - DNA, 17 bp, Homo sapiens
ttaaattttttttacat

SEQ ID NO: 6750587 - DNA, 20 bp, Homo sapiens
ttaaattttttttacatttt

SEQ ID NO: 6750588 - DNA, 22 bp, Homo sapiens
ttaacaaaaaacagattctata

SEQ ID NO: 6750589 - DNA, 14 bp, Homo sapiens
ttaacaaaaaatgt

SEQ ID NO: 6750590 - DNA, 19 bp, Homo sapiens
ttaacaaaaagtgcttcat

SEQ ID NO: 6750591 - DNA, 19 bp, Homo sapiens
ttaacaaaacaagaaagaa

SEQ ID NO: 6750592 - DNA, 18 bp, Homo sapiens
ttaacaaaagattctgta

SEQ ID NO: 6750593 - DNA, 11 bp, Homo sapiens
ttaacaaaagt

SEQ ID NO: 6750594 - DNA, 20 bp, Homo sapiens
ttaacaaacgcattaagagg

SEQ ID NO: 6750595 - DNA, 21 bp, Homo sapiens
ttaacaaacgtaatttgttat

SEQ ID NO: 6750596 - DNA, 14 bp, Homo sapiens
ttaacaaatacatt

SEQ ID NO: 6750597 - DNA, 18 bp, Homo sapiens
ttaacaaatatgctaatt

SEQ ID NO: 6750598 - DNA, 14 bp, Homo sapiens
ttaacaaatctaat

SEQ ID NO: 6750599 - DNA, 11 bp, Homo sapiens
ttaacaaatga

SEQ ID NO: 6750600 - DNA, 13 bp, Homo sapiens
ttaacaaatgcta

SEQ ID NO: 6750601 - DNA, 22 bp, Homo sapiens
ttaacaaatgctctgtcttcaa

SEQ ID NO: 6750602 - DNA, 13 bp, Homo sapiens
ttaacaacatggc

SEQ ID NO: 6750603 - DNA, 22 bp, Homo sapiens
ttaacaacatgtttccagcatt

SEQ ID NO: 6750604 - DNA, 15 bp, Homo sapiens
ttaacaactcattct

SEQ ID NO: 6750605 - DNA, 21 bp, Homo sapiens
ttaacaactgtagcaagaact

SEQ ID NO: 6750606 - DNA, 20 bp, Homo sapiens
ttaacaagaagatgaatggc

SEQ ID NO: 6750607 - DNA, 12 bp, Homo sapiens
ttaacaagaagc

SEQ ID NO: 6750608 - DNA, 21 bp, Homo sapiens
ttaacaagatatttatatgtt

SEQ ID NO: 6750609 - DNA, 13 bp, Homo sapiens
ttaacaagatgtt

SEQ ID NO: 6750610 - DNA, 16 bp, Homo sapiens
ttaacaagatgtttca

SEQ ID NO: 6750611 - DNA, 12 bp, Homo sapiens
ttaacaaggaat

SEQ ID NO: 6750612 - DNA, 21 bp, Homo sapiens
ttaacaagtatttattcccat

SEQ ID NO: 6750613 - DNA, 12 bp, Homo sapiens
ttaacaataata

SEQ ID NO: 6750614 - DNA, 17 bp, Homo sapiens
ttaacaatgatatatgg

SEQ ID NO: 6750615 - DNA, 23 bp, Homo sapiens
ttaacaatgcaacttttaattac

SEQ ID NO: 6750616 - DNA, 20 bp, Homo sapiens
ttaacaattaattttctatg

SEQ ID NO: 6750617 - DNA, 16 bp, Homo sapiens
ttaacaattccaaagg

SEQ ID NO: 6750618 - DNA, 17 bp, Homo sapiens
ttaacaattgtcttaaa

SEQ ID NO: 6750619 - DNA, 16 bp, Homo sapiens
ttaacacaatgtgaat

SEQ ID NO: 6750620 - DNA, 12 bp, Homo sapiens
ttaacacactac

SEQ ID NO: 6750621 - DNA, 20 bp, Homo sapiens
ttaacacagtacctaagact

SEQ ID NO: 6750622 - DNA, 13 bp, Homo sapiens
ttaacacatcaaa

SEQ ID NO: 6750623 - DNA, 19 bp, Homo sapiens
ttaacacatgaatttctgc

SEQ ID NO: 6750624 - DNA, 17 bp, Homo sapiens
ttaacacattttgtata

SEQ ID NO: 6750625 - DNA, 22 bp, Homo sapiens
ttaacacattttgtataattgt

SEQ ID NO: 6750626 - DNA, 16 bp, Homo sapiens
ttaacaccttcatcca

SEQ ID NO: 6750627 - DNA, 15 bp, Homo sapiens
ttaacactactcaaa

SEQ ID NO: 6750628 - DNA, 14 bp, Homo sapiens
ttaacactgagatc

SEQ ID NO: 6750629 - DNA, 13 bp, Homo sapiens
ttaacactgagct

SEQ ID NO: 6750630 - DNA, 16 bp, Homo sapiens
ttaacactgagtgaaa

SEQ ID NO: 6750631 - DNA, 20 bp, Homo sapiens
ttaacactgagtgaaatatt

SEQ ID NO: 6750632 - DNA, 19 bp, Homo sapiens
ttaacactgcttgtgtttt

SEQ ID NO: 6750633 - DNA, 17 bp, Homo sapiens
ttaacactgtaatatct

SEQ ID NO: 6750634 - DNA, 20 bp, Homo sapiens
ttaacactgtaatatcttta

SEQ ID NO: 6750635 - DNA, 21 bp, Homo sapiens
ttaacactgtaatatctttaa

SEQ ID NO: 6750636 - DNA, 19 bp, Homo sapiens
ttaacacttaaatttcttg

SEQ ID NO: 6750637 - DNA, 15 bp, Homo sapiens
ttaacacttctgtat

SEQ ID NO: 6750638 - DNA, 20 bp, Homo sapiens
ttaacacttctgtatgcatc

SEQ ID NO: 6750639 - DNA, 14 bp, Homo sapiens
ttaacactttgtat

SEQ ID NO: 6750640 - DNA, 15 bp, Homo sapiens
ttaacactttgtatt

SEQ ID NO: 6750641 - DNA, 17 bp, Homo sapiens
ttaacactttgtattac

SEQ ID NO: 6750642 - DNA, 19 bp, Homo sapiens
ttaacagaaatgtacagca

SEQ ID NO: 6750643 - DNA, 19 bp, Homo sapiens
ttaacagaaatgtttctgt

SEQ ID NO: 6750644 - DNA, 19 bp, Homo sapiens
ttaacagaaattgtatatt

SEQ ID NO: 6750645 - DNA, 21 bp, Homo sapiens
ttaacagaaattgtatattgt

SEQ ID NO: 6750646 - DNA, 16 bp, Homo sapiens
ttaacagaagttgtga

SEQ ID NO: 6750647 - DNA, 22 bp, Homo sapiens
ttaacagaagttgtgaaactaa

SEQ ID NO: 6750648 - DNA, 20 bp, Homo sapiens
ttaacagacactgtaaaata

SEQ ID NO: 6750649 - DNA, 23 bp, Homo sapiens
ttaacagagtttgatatgggctt

SEQ ID NO: 6750650 - DNA, 21 bp, Homo sapiens
ttaacagatgatccatttgaa

SEQ ID NO: 6750651 - DNA, 22 bp, Homo sapiens
ttaacagcaggtgtgaccctga

SEQ ID NO: 6750652 - DNA, 18 bp, Homo sapiens
ttaacagcatgacaaaaa

SEQ ID NO: 6750653 - DNA, 19 bp, Homo sapiens
ttaacagctttctccagaa

SEQ ID NO: 6750654 - DNA, 12 bp, Homo sapiens
ttaacaggacag

SEQ ID NO: 6750655 - DNA, 17 bp, Homo sapiens
ttaacaggcaaacattt

SEQ ID NO: 6750656 - DNA, 13 bp, Homo sapiens
ttaacaggtattt

SEQ ID NO: 6750657 - DNA, 22 bp, Homo sapiens
ttaacaggttttcttctaatca

SEQ ID NO: 6750658 - DNA, 14 bp, Homo sapiens
ttaacagtacctgt

SEQ ID NO: 6750659 - DNA, 15 bp, Homo sapiens
ttaacagtcatttaa

SEQ ID NO: 6750660 - DNA, 16 bp, Homo sapiens
ttaacagtcatttaaa

SEQ ID NO: 6750661 - DNA, 23 bp, Homo sapiens
ttaacagtggttcaaatttcctt

SEQ ID NO: 6750662 - DNA, 18 bp, Homo sapiens
ttaacagttcctttcaaa

SEQ ID NO: 6750663 - DNA, 15 bp, Homo sapiens
ttaacagttgtattt

SEQ ID NO: 6750664 - DNA, 19 bp, Homo sapiens
ttaacataaaagagtggaa

SEQ ID NO: 6750665 - DNA, 11 bp, Homo sapiens
ttaacataaag

SEQ ID NO: 6750666 - DNA, 13 bp, Homo sapiens
ttaacataatggt

SEQ ID NO: 6750667 - DNA, 18 bp, Homo sapiens
ttaacataatggttgtga

SEQ ID NO: 6750668 - DNA, 22 bp, Homo sapiens
ttaacatacctaagaagtacat

SEQ ID NO: 6750669 - DNA, 14 bp, Homo sapiens
ttaagttcccagat

SEQ ID NO: 6750670 - DNA, 17 bp, Homo sapiens
ttaagttcctgctgcct

SEQ ID NO: 6750671 - DNA, 20 bp, Homo sapiens
ttaagttctatcagtgactt

SEQ ID NO: 6750672 - DNA, 23 bp, Homo sapiens
ttaagttgagatagttttcatcc

SEQ ID NO: 6750673 - DNA, 16 bp, Homo sapiens
ttaagttggctagagc

SEQ ID NO: 6750674 - DNA, 22 bp, Homo sapiens
ttaagttggctagagcttctgt

SEQ ID NO: 6750675 - DNA, 17 bp, Homo sapiens
ttaagttggcttctgtt

SEQ ID NO: 6750676 - DNA, 23 bp, Homo sapiens
ttaagttggcttctgtttctagt

SEQ ID NO: 6750677 - DNA, 14 bp, Homo sapiens
ttaagttgtaaacg

SEQ ID NO: 6750678 - DNA, 16 bp, Homo sapiens
ttaagttgtaaacgtc

SEQ ID NO: 6750679 - DNA, 14 bp, Homo sapiens
ttaagttgttgaaa

SEQ ID NO: 6750680 - DNA, 16 bp, Homo sapiens
ttaagttgtttgcatg

SEQ ID NO: 6750681 - DNA, 19 bp, Homo sapiens
ttaagttgtttgcatgtga

SEQ ID NO: 6750682 - DNA, 15 bp, Homo sapiens
ttaagtttcaaactt

SEQ ID NO: 6750683 - DNA, 15 bp, Homo sapiens
ttaagtttcaggata

SEQ ID NO: 6750684 - DNA, 12 bp, Homo sapiens
ttaagtttctca

SEQ ID NO: 6750685 - DNA, 17 bp, Homo sapiens
ttaagtttctctgcaga

SEQ ID NO: 6750686 - DNA, 17 bp, Homo sapiens
ttaagtttctcttcacc

SEQ ID NO: 6750687 - DNA, 14 bp, Homo sapiens
ttaagtttgaagag

SEQ ID NO: 6750688 - DNA, 13 bp, Homo sapiens
ttaagtttgtagt

SEQ ID NO: 6750689 - DNA, 19 bp, Homo sapiens
ttaagttttaaataaacct

SEQ ID NO: 6750690 - DNA, 15 bp, Homo sapiens
ttaagttttagtctt

SEQ ID NO: 6750691 - DNA, 23 bp, Homo sapiens
ttaagttttgattaatgtttctt

SEQ ID NO: 6750692 - DNA, 16 bp, Homo sapiens
ttaagtttttaatctg

SEQ ID NO: 6750693 - DNA, 11 bp, Homo sapiens
ttaataaaaag

SEQ ID NO: 6750694 - DNA, 13 bp, Homo sapiens
ttaataaaaagac

SEQ ID NO: 6750695 - DNA, 13 bp, Homo sapiens
ttaataaaaagga

SEQ ID NO: 6750696 - DNA, 14 bp, Homo sapiens
ttaataaaaataat

SEQ ID NO: 6750697 - DNA, 15 bp, Homo sapiens
ttaataaaaatgaca

SEQ ID NO: 6750698 - DNA, 16 bp, Homo sapiens
ttaataaaacactatt

SEQ ID NO: 6750699 - DNA, 14 bp, Homo sapiens
ttaataaaacctgt

SEQ ID NO: 6750700 - DNA, 21 bp, Homo sapiens
ttaataaaactcactcactgt

SEQ ID NO: 6750701 - DNA, 22 bp, Homo sapiens
ttaataaaactgcacagtgctg

SEQ ID NO: 6750702 - DNA, 21 bp, Homo sapiens
ttaataaaactgcgaggacat

SEQ ID NO: 6750703 - DNA, 23 bp, Homo sapiens
ttaataaaactgcgaggacatca

SEQ ID NO: 6750704 - DNA, 13 bp, Homo sapiens
ttaataaaactgt

SEQ ID NO: 6750705 - DNA, 12 bp, Homo sapiens
ttaataaaagaa

SEQ ID NO: 6750706 - DNA, 16 bp, Homo sapiens
ttaataaaagtacatg

SEQ ID NO: 6750707 - DNA, 18 bp, Homo sapiens
ttaataaaataaactaga

SEQ ID NO: 6750708 - DNA, 18 bp, Homo sapiens
ttaataaaataattctca

SEQ ID NO: 6750709 - DNA, 15 bp, Homo sapiens
ttaataaaatatcta

SEQ ID NO: 6750710 - DNA, 17 bp, Homo sapiens
ttaataaacgaagataa

SEQ ID NO: 6750711 - DNA, 14 bp, Homo sapiens
ttaataaactactc

SEQ ID NO: 6750712 - DNA, 18 bp, Homo sapiens
ttaataaactgcaaatgt

SEQ ID NO: 6750713 - DNA, 18 bp, Homo sapiens
ttaataaactttgaataa

SEQ ID NO: 6750714 - DNA, 15 bp, Homo sapiens
ttaataaagaaaaag

SEQ ID NO: 6750715 - DNA, 16 bp, Homo sapiens
ttaataaagaaaaaga

SEQ ID NO: 6750716 - DNA, 22 bp, Homo sapiens
ttaataaagaaatatttaccta

SEQ ID NO: 6750717 - DNA, 21 bp, Homo sapiens
ttaataaagaattaacagaga

SEQ ID NO: 6750718 - DNA, 18 bp, Homo sapiens
ttaataaagatgattgaa

SEQ ID NO: 6750719 - DNA, 18 bp, Homo sapiens
ttaataaagattccatgg

SEQ ID NO: 6750720 - DNA, 11 bp, Homo sapiens
ttaataaagca

SEQ ID NO: 6750721 - DNA, 15 bp, Homo sapiens
ttaataaagctttat

SEQ ID NO: 6750722 - DNA, 22 bp, Homo sapiens
ttaataaaggtttaaagctgaa

SEQ ID NO: 6750723 - DNA, 22 bp, Homo sapiens
ttaataaaggtttcgttgcatg

SEQ ID NO: 6750724 - DNA, 15 bp, Homo sapiens
ttaataaagtagtta

SEQ ID NO: 6750725 - DNA, 15 bp, Homo sapiens
ttaataaagtatgaa

SEQ ID NO: 6750726 - DNA, 15 bp, Homo sapiens
ttaataaatattgta

SEQ ID NO: 6750727 - DNA, 22 bp, Homo sapiens
ttaataaatattgtattttaga

SEQ ID NO: 6750728 - DNA, 19 bp, Homo sapiens
ttaataaatttaataaata

SEQ ID NO: 6750729 - DNA, 23 bp, Homo sapiens
ttaataacacttcaccttctgta

SEQ ID NO: 6750730 - DNA, 15 bp, Homo sapiens
ttaataacagaaata

SEQ ID NO: 6750731 - DNA, 14 bp, Homo sapiens
ttaataacagctcc

SEQ ID NO: 6750732 - DNA, 18 bp, Homo sapiens
ttaataacataacaaata

SEQ ID NO: 6750733 - DNA, 17 bp, Homo sapiens
ttaataacatacaatga

SEQ ID NO: 6750734 - DNA, 21 bp, Homo sapiens
ttaataacattaccttactgt

SEQ ID NO: 6750735 - DNA, 15 bp, Homo sapiens
ttaataactgaataa

SEQ ID NO: 6750736 - DNA, 16 bp, Homo sapiens
ttaataactttgctgg

SEQ ID NO: 6750737 - DNA, 13 bp, Homo sapiens
ttaataagaacag

SEQ ID NO: 6750738 - DNA, 17 bp, Homo sapiens
ttaataagaacagatca

SEQ ID NO: 6750739 - DNA, 16 bp, Homo sapiens
ttaataagaacttgaa

SEQ ID NO: 6750740 - DNA, 13 bp, Homo sapiens
ttaataagatttt

SEQ ID NO: 6750741 - DNA, 19 bp, Homo sapiens
ttaataagatttttcaaaa

SEQ ID NO: 6750742 - DNA, 22 bp, Homo sapiens
ttaataagctactagcaaaata

SEQ ID NO: 6750743 - DNA, 13 bp, Homo sapiens
ttaataaggaaaa

SEQ ID NO: 6750744 - DNA, 20 bp, Homo sapiens
ttaataaggaaaaaataata

SEQ ID NO: 6750745 - DNA, 21 bp, Homo sapiens
ttaataaggaaaaaataatat

SEQ ID NO: 6750746 - DNA, 13 bp, Homo sapiens
ttaataagtatat

SEQ ID NO: 6750747 - DNA, 17 bp, Homo sapiens
ttaataagttgatgttt

SEQ ID NO: 6750748 - DNA, 13 bp, Homo sapiens
ttaataataaaaa

SEQ ID NO: 6750749 - DNA, 22 bp, Homo sapiens
ttaataataccaagactaagca

SEQ ID NO: 6750750 - DNA, 22 bp, Homo sapiens
ttaataatagattgtgaataat

SEQ ID NO: 6750751 - DNA, 22 bp, Homo sapiens
ttaataatagtgtgtcaagatt

SEQ ID NO: 6750752 - DNA, 14 bp, Homo sapiens
ttaataatatactt

SEQ ID NO: 6750753 - DNA, 15 bp, Homo sapiens
ttaataatatgtaca

SEQ ID NO: 6750754 - DNA, 17 bp, Homo sapiens
ttaataatatgtacaaa

SEQ ID NO: 6750755 - DNA, 24 bp, Homo sapiens
ttaataatcagcaagaatttgatc

SEQ ID NO: 6750756 - DNA, 13 bp, Homo sapiens
ttaataatgtatt

SEQ ID NO: 6750757 - DNA, 14 bp, Homo sapiens
ttaataatgtattg

SEQ ID NO: 6750758 - DNA, 18 bp, Homo sapiens
ttaataattatatgctat

SEQ ID NO: 6750759 - DNA, 23 bp, Homo sapiens
ttaataattatatgctatttcta

SEQ ID NO: 6750760 - DNA, 19 bp, Homo sapiens
ttaataatttagacttcaa

SEQ ID NO: 6750761 - DNA, 19 bp, Homo sapiens
ttaataatttttgctgaat

SEQ ID NO: 6750762 - DNA, 13 bp, Homo sapiens
ttaatacaaggta

SEQ ID NO: 6750763 - DNA, 23 bp, Homo sapiens
ttaatacaaggtataataaaatt

SEQ ID NO: 6750764 - DNA, 18 bp, Homo sapiens
ttaatacaattaatatta

SEQ ID NO: 6750765 - DNA, 16 bp, Homo sapiens
ttaatacacagtactt

SEQ ID NO: 6750766 - DNA, 12 bp, Homo sapiens
ttaatacagatg

SEQ ID NO: 6750767 - DNA, 17 bp, Homo sapiens
ttaatacaggaaattga

SEQ ID NO: 6750768 - DNA, 15 bp, Homo sapiens
ttaatacataagtta

SEQ ID NO: 6750769 - DNA, 15 bp, Homo sapiens
ttaatacatcacatc

SEQ ID NO: 6750770 - DNA, 15 bp, Homo sapiens
ttaataccaaatatt

SEQ ID NO: 6750771 - DNA, 21 bp, Homo sapiens
ttaataccaccaacaaatata

SEQ ID NO: 6750772 - DNA, 21 bp, Homo sapiens
ttaataccctgcaatgtaatt

SEQ ID NO: 6750773 - DNA, 16 bp, Homo sapiens
ttaatacctttaaata

SEQ ID NO: 6750774 - DNA, 19 bp, Homo sapiens
ttaatacctttaaatatca

SEQ ID NO: 6750775 - DNA, 21 bp, Homo sapiens
ttaatacgcaggcatctgatt

SEQ ID NO: 6750776 - DNA, 17 bp, Homo sapiens
ttaatactattaagcaa

SEQ ID NO: 6750777 - DNA, 21 bp, Homo sapiens
ttaatactcatccttgtataa

SEQ ID NO: 6750778 - DNA, 14 bp, Homo sapiens
ttaatactgaattt

SEQ ID NO: 6750779 - DNA, 17 bp, Homo sapiens
ttaatactgaatttctt

SEQ ID NO: 6750780 - DNA, 17 bp, Homo sapiens
ttaatactgagaaaaag

SEQ ID NO: 6750781 - DNA, 14 bp, Homo sapiens
ttaatactgttatt

SEQ ID NO: 6750782 - DNA, 21 bp, Homo sapiens
ttaatactgttattctttgca

SEQ ID NO: 6750783 - DNA, 15 bp, Homo sapiens
ttaatacttccttat

SEQ ID NO: 6750784 - DNA, 12 bp, Homo sapiens
ttaatacttgaa

SEQ ID NO: 6750785 - DNA, 15 bp, Homo sapiens
ttaatacttttccac

SEQ ID NO: 6750786 - DNA, 22 bp, Homo sapiens
ttaatactttttacccaaatat

SEQ ID NO: 6750787 - DNA, 20 bp, Homo sapiens
ttaatagaaaattaaaataa

SEQ ID NO: 6750788 - DNA, 19 bp, Homo sapiens
ttaatagaatataattatc

SEQ ID NO: 6750789 - DNA, 14 bp, Homo sapiens
ttaatagaatgata

SEQ ID NO: 6750790 - DNA, 16 bp, Homo sapiens
ttaatagaatgataaa

SEQ ID NO: 6750791 - DNA, 15 bp, Homo sapiens
ttaatagacttctct

SEQ ID NO: 6750792 - DNA, 17 bp, Homo sapiens
ttaatagagaagtaaaa

SEQ ID NO: 6750793 - DNA, 17 bp, Homo sapiens
ttaatagagttggagtt

SEQ ID NO: 6750794 - DNA, 23 bp, Homo sapiens
ttaatagatttaccctttataga

SEQ ID NO: 6750795 - DNA, 16 bp, Homo sapiens
ttaatagcaaagaatt

SEQ ID NO: 6750796 - DNA, 18 bp, Homo sapiens
ttaatagcaaagaattga

SEQ ID NO: 6750797 - DNA, 13 bp, Homo sapiens
ttaatagcaacag

SEQ ID NO: 6750798 - DNA, 15 bp, Homo sapiens
ttaatagcagccttt

SEQ ID NO: 6750799 - DNA, 20 bp, Homo sapiens
ttaatagccatttgaagaag

SEQ ID NO: 6750800 - DNA, 16 bp, Homo sapiens
ttaatagcccatttct

SEQ ID NO: 6750801 - DNA, 15 bp, Homo sapiens
ttaatagctgtgatc

SEQ ID NO: 6750802 - DNA, 21 bp, Homo sapiens
ttaatagctgtgatcagtgat

SEQ ID NO: 6750803 - DNA, 18 bp, Homo sapiens
ttaatagtactattaaca

SEQ ID NO: 6750804 - DNA, 15 bp, Homo sapiens
ttaatagtgttaatc

SEQ ID NO: 6750805 - DNA, 17 bp, Homo sapiens
ttaatagtgttaatcaa

SEQ ID NO: 6750806 - DNA, 18 bp, Homo sapiens
ttaatagtgttaatcaat

SEQ ID NO: 6750807 - DNA, 17 bp, Homo sapiens
ttaatagtttgaagtgc

SEQ ID NO: 6750808 - DNA, 15 bp, Homo sapiens
ttaatataaatgcaa

SEQ ID NO: 6750809 - DNA, 17 bp, Homo sapiens
ttaatataaatgcaaat

SEQ ID NO: 6750810 - DNA, 14 bp, Homo sapiens
ttaatataaatgtt

SEQ ID NO: 6750811 - DNA, 15 bp, Homo sapiens
ttaatataactgcct

SEQ ID NO: 6750812 - DNA, 23 bp, Homo sapiens
ttaatataactgccttaaaactt

SEQ ID NO: 6750813 - DNA, 13 bp, Homo sapiens
ttaatatacccca

SEQ ID NO: 6750814 - DNA, 22 bp, Homo sapiens
ttaatataccccaaattgtgta

SEQ ID NO: 6750815 - DNA, 18 bp, Homo sapiens
ttaatatactaaccattt

SEQ ID NO: 6750816 - DNA, 14 bp, Homo sapiens
ttaatatactgcat

SEQ ID NO: 6750817 - DNA, 20 bp, Homo sapiens
ttaatatactgcatatcctg

SEQ ID NO: 6750818 - DNA, 17 bp, Homo sapiens
ttaatatatacattttt

SEQ ID NO: 6750819 - DNA, 21 bp, Homo sapiens
ttaatatatagtccagacact

SEQ ID NO: 6750820 - DNA, 20 bp, Homo sapiens
ttaatatatcccagaaatta

SEQ ID NO: 6750821 - DNA, 13 bp, Homo sapiens
ttaatatattaaa

SEQ ID NO: 6750822 - DNA, 18 bp, Homo sapiens
ttaatatcaatgaagatt

SEQ ID NO: 6750823 - DNA, 15 bp, Homo sapiens
ttaatatcactcatt

SEQ ID NO: 6750824 - DNA, 16 bp, Homo sapiens
ttaatatcactcatta

SEQ ID NO: 6750825 - DNA, 18 bp, Homo sapiens
ttaatatcactcattaat

SEQ ID NO: 6750826 - DNA, 20 bp, Homo sapiens
ttaatatcactcattaatta

SEQ ID NO: 6750827 - DNA, 14 bp, Homo sapiens
ttaatatcctaaac

SEQ ID NO: 6750828 - DNA, 17 bp, Homo sapiens
ttaatatcctaaacatc

SEQ ID NO: 6750829 - DNA, 16 bp, Homo sapiens
ttaatatctggcactg

SEQ ID NO: 6750830 - DNA, 18 bp, Homo sapiens
ttaatatctggcactgtt

SEQ ID NO: 6750831 - DNA, 23 bp, Homo sapiens
ttaatatgaaattttttttcatg

SEQ ID NO: 6750832 - DNA, 21 bp, Homo sapiens
ttaatatgagcttcaatataa

SEQ ID NO: 6750833 - DNA, 20 bp, Homo sapiens
ttaatatgcatctttgagaa

SEQ ID NO: 6750834 - DNA, 20 bp, Homo sapiens
ttaatatgctgcaacaaaat

SEQ ID NO: 6750835 - DNA, 17 bp, Homo sapiens
ttaatatgtacttttcc

SEQ ID NO: 6750836 - DNA, 14 bp, Homo sapiens
ttaatatgtatttg

SEQ ID NO: 6750837 - DNA, 19 bp, Homo sapiens
ttaatatgtatttgttgaa

SEQ ID NO: 6750838 - DNA, 20 bp, Homo sapiens
ttaatatgtatttgttgaaa

SEQ ID NO: 6750839 - DNA, 22 bp, Homo sapiens
ttaatatgtattttatgtatgt

SEQ ID NO: 6750840 - DNA, 23 bp, Homo sapiens
ttaatatgtattttatgtatgtt

SEQ ID NO: 6750841 - DNA, 16 bp, Homo sapiens
ttaatatgttgacttt

SEQ ID NO: 6750842 - DNA, 18 bp, Homo sapiens
ttaatattaaagccatgt

SEQ ID NO: 6750843 - DNA, 20 bp, Homo sapiens
ttaatattaaagccatgttt

SEQ ID NO: 6750844 - DNA, 14 bp, Homo sapiens
ttaatattacagat

SEQ ID NO: 6750845 - DNA, 21 bp, Homo sapiens
ttaatattacctaatgaaagt

SEQ ID NO: 6750846 - DNA, 19 bp, Homo sapiens
ttaatattactgtctttat

SEQ ID NO: 6750847 - DNA, 20 bp, Homo sapiens
ttacaatgatttgtaaagga

SEQ ID NO: 6750848 - DNA, 16 bp, Homo sapiens
ttacaatgcagaattt

SEQ ID NO: 6750849 - DNA, 16 bp, Homo sapiens
ttacaatggccagccc

SEQ ID NO: 6750850 - DNA, 15 bp, Homo sapiens
ttacaatgtaacttt

SEQ ID NO: 6750851 - DNA, 16 bp, Homo sapiens
ttacaatgtaattatt

SEQ ID NO: 6750852 - DNA, 15 bp, Homo sapiens
ttacaatgtgcactg

SEQ ID NO: 6750853 - DNA, 16 bp, Homo sapiens
ttacaatgttcatccc

SEQ ID NO: 6750854 - DNA, 15 bp, Homo sapiens
ttacaattacatctc

SEQ ID NO: 6750855 - DNA, 15 bp, Homo sapiens
ttacaatttcaaaag

SEQ ID NO: 6750856 - DNA, 13 bp, Homo sapiens
ttacaatttgcac

SEQ ID NO: 6750857 - DNA, 18 bp, Homo sapiens
ttacaatttgcacaatat

SEQ ID NO: 6750858 - DNA, 18 bp, Homo sapiens
ttacaatttggagcataa

SEQ ID NO: 6750859 - DNA, 15 bp, Homo sapiens
ttacaattttctgta

SEQ ID NO: 6750860 - DNA, 19 bp, Homo sapiens
ttacaatttttaataaatt

SEQ ID NO: 6750861 - DNA, 18 bp, Homo sapiens
ttacaattttttatcatg

SEQ ID NO: 6750862 - DNA, 17 bp, Homo sapiens
ttacaattttttgctct

SEQ ID NO: 6750863 - DNA, 23 bp, Homo sapiens
ttacaatttttttaattttgtat

SEQ ID NO: 6750864 - DNA, 21 bp, Homo sapiens
ttacacaaaacaaatgccaca

SEQ ID NO: 6750865 - DNA, 22 bp, Homo sapiens
ttacacaaagaacttgctgctg

SEQ ID NO: 6750866 - DNA, 18 bp, Homo sapiens
ttacacaaatgtgatttt

SEQ ID NO: 6750867 - DNA, 23 bp, Homo sapiens
ttacacaaatgtgatttttgtaa

SEQ ID NO: 6750868 - DNA, 18 bp, Homo sapiens
ttacacaatggtttttaa

SEQ ID NO: 6750869 - DNA, 20 bp, Homo sapiens
ttacacaatggtttttaaat

SEQ ID NO: 6750870 - DNA, 13 bp, Homo sapiens
ttacacagaaaca

SEQ ID NO: 6750871 - DNA, 19 bp, Homo sapiens
ttacacagaaacactgcct

SEQ ID NO: 6750872 - DNA, 17 bp, Homo sapiens
ttacacagcaattttgt

SEQ ID NO: 6750873 - DNA, 20 bp, Homo sapiens
ttacacagcaattttgtatc

SEQ ID NO: 6750874 - DNA, 22 bp, Homo sapiens
ttacacaggtttagttgactaa

SEQ ID NO: 6750875 - DNA, 16 bp, Homo sapiens
ttacacagtcaaattt

SEQ ID NO: 6750876 - DNA, 21 bp, Homo sapiens
ttacacagtgagactgtacat

SEQ ID NO: 6750877 - DNA, 17 bp, Homo sapiens
ttacacagtgtgaataa

SEQ ID NO: 6750878 - DNA, 14 bp, Homo sapiens
ttacacatacagtt

SEQ ID NO: 6750879 - DNA, 14 bp, Homo sapiens
ttacacatcttaaa

SEQ ID NO: 6750880 - DNA, 15 bp, Homo sapiens
ttacacattaaagta

SEQ ID NO: 6750881 - DNA, 23 bp, Homo sapiens
ttacacattaaagtaaagtacaa

SEQ ID NO: 6750882 - DNA, 17 bp, Homo sapiens
ttacacattaagcaaat

SEQ ID NO: 6750883 - DNA, 17 bp, Homo sapiens
ttacacattatgttaga

SEQ ID NO: 6750884 - DNA, 16 bp, Homo sapiens
ttacacatttgtacag

SEQ ID NO: 6750885 - DNA, 16 bp, Homo sapiens
ttacaccaactcctaa

SEQ ID NO: 6750886 - DNA, 20 bp, Homo sapiens
ttacaccacaagtatctaaa

SEQ ID NO: 6750887 - DNA, 18 bp, Homo sapiens
ttacaccacactttcaaa

SEQ ID NO: 6750888 - DNA, 13 bp, Homo sapiens
ttacacccttgtc

SEQ ID NO: 6750889 - DNA, 20 bp, Homo sapiens
ttacaccctttcttgacaaa

SEQ ID NO: 6750890 - DNA, 15 bp, Homo sapiens
ttacacgaagaaata

SEQ ID NO: 6750891 - DNA, 20 bp, Homo sapiens
ttacacggggttacactgtt

SEQ ID NO: 6750892 - DNA, 23 bp, Homo sapiens
ttacacgtggaggaatgctcccc

SEQ ID NO: 6750893 - DNA, 18 bp, Homo sapiens
ttacactctctgtacaaa

SEQ ID NO: 6750894 - DNA, 22 bp, Homo sapiens
ttacactctgtattgaaaatgg

SEQ ID NO: 6750895 - DNA, 17 bp, Homo sapiens
ttacactgaaatccaaa

SEQ ID NO: 6750896 - DNA, 17 bp, Homo sapiens
ttacactgattggtgtt

SEQ ID NO: 6750897 - DNA, 21 bp, Homo sapiens
ttacactggaggagagaagaa

SEQ ID NO: 6750898 - DNA, 21 bp, Homo sapiens
ttacactggatgaaaatgttc

SEQ ID NO: 6750899 - DNA, 22 bp, Homo sapiens
ttacactggcaatggtagtttc

SEQ ID NO: 6750900 - DNA, 23 bp, Homo sapiens
ttacactggcaatggtagtttct

SEQ ID NO: 6750901 - DNA, 12 bp, Homo sapiens
ttacactggtct

SEQ ID NO: 6750902 - DNA, 23 bp, Homo sapiens
ttacacttctcaaatgctactca

SEQ ID NO: 6750903 - DNA, 20 bp, Homo sapiens
ttacactttatgcacaaaat

SEQ ID NO: 6750904 - DNA, 17 bp, Homo sapiens
ttacactttatggtaag

SEQ ID NO: 6750905 - DNA, 16 bp, Homo sapiens
ttacactttttggaag

SEQ ID NO: 6750906 - DNA, 15 bp, Homo sapiens
ttacagaaaaatctt

SEQ ID NO: 6750907 - DNA, 12 bp, Homo sapiens
ttacagaaaata

SEQ ID NO: 6750908 - DNA, 13 bp, Homo sapiens
ttacagaaaattg

SEQ ID NO: 6750909 - DNA, 19 bp, Homo sapiens
ttacagaaaattgttgtgc

SEQ ID NO: 6750910 - DNA, 13 bp, Homo sapiens
ttacagaaactga

SEQ ID NO: 6750911 - DNA, 15 bp, Homo sapiens
ttacagaaactgatg

SEQ ID NO: 6750912 - DNA, 14 bp, Homo sapiens
ttacagaaagtggt

SEQ ID NO: 6750913 - DNA, 21 bp, Homo sapiens
ttacagaaagtggtgctcagt

SEQ ID NO: 6750914 - DNA, 11 bp, Homo sapiens
ttacagaactg

SEQ ID NO: 6750915 - DNA, 19 bp, Homo sapiens
ttacagaagagtttcttaa

SEQ ID NO: 6750916 - DNA, 15 bp, Homo sapiens
ttacagaatgcatta

SEQ ID NO: 6750917 - DNA, 19 bp, Homo sapiens
ttacagaatgcattaaaaa

SEQ ID NO: 6750918 - DNA, 20 bp, Homo sapiens
ttacagacaaggcaggcctg

SEQ ID NO: 6750919 - DNA, 19 bp, Homo sapiens
ttacagacgctgctgtcac

SEQ ID NO: 6750920 - DNA, 21 bp, Homo sapiens
ttacagagaatctgaagctat

SEQ ID NO: 6750921 - DNA, 22 bp, Homo sapiens
ttacagagaatctgaagctatt

SEQ ID NO: 6750922 - DNA, 17 bp, Homo sapiens
ttacagagactctccct

SEQ ID NO: 6750923 - DNA, 17 bp, Homo sapiens
ttacagagaggagaaac

SEQ ID NO: 6750924 - DNA, 18 bp, Homo sapiens
ttacagagaggagaaaca

SEQ ID NO: 6750925 - DNA, 21 bp, Homo sapiens
ttacagagaggatacatttaa

SEQ ID NO: 6750926 - DNA, 19 bp, Homo sapiens
ttacagataaggaaactga

SEQ ID NO: 6750927 - DNA, 23 bp, Homo sapiens
ttacagatagtatctagcaatca

SEQ ID NO: 6750928 - DNA, 18 bp, Homo sapiens
ttacagatatttgtcatg

SEQ ID NO: 6750929 - DNA, 19 bp, Homo sapiens
ttacagatgagattccctc

SEQ ID NO: 6750930 - DNA, 16 bp, Homo sapiens
ttacagattgcctcct

SEQ ID NO: 6750931 - DNA, 19 bp, Homo sapiens
ttacagattgcctccttat

SEQ ID NO: 6750932 - DNA, 11 bp, Homo sapiens
ttacagatttc

SEQ ID NO: 6750933 - DNA, 20 bp, Homo sapiens
ttacagcaagtagataaata

SEQ ID NO: 6750934 - DNA, 14 bp, Homo sapiens
ttacagcagcaata

SEQ ID NO: 6750935 - DNA, 15 bp, Homo sapiens
ttacagcattgtctt

SEQ ID NO: 6750936 - DNA, 19 bp, Homo sapiens
ttacagcattgtctttgct

SEQ ID NO: 6750937 - DNA, 20 bp, Homo sapiens
ttacagcattgtctttgctg

SEQ ID NO: 6750938 - DNA, 12 bp, Homo sapiens
ttacagccaggt

SEQ ID NO: 6750939 - DNA, 12 bp, Homo sapiens
ttacagcccttg

SEQ ID NO: 6750940 - DNA, 17 bp, Homo sapiens
ttacagcctcacttgaa

SEQ ID NO: 6750941 - DNA, 14 bp, Homo sapiens
ttacagcctctgac

SEQ ID NO: 6750942 - DNA, 15 bp, Homo sapiens
ttacagcctctgact

SEQ ID NO: 6750943 - DNA, 20 bp, Homo sapiens
ttacagcctgggcaataaag

SEQ ID NO: 6750944 - DNA, 21 bp, Homo sapiens
ttacagcgagaggcagagaaa

SEQ ID NO: 6750945 - DNA, 15 bp, Homo sapiens
ttacagctactttaa

SEQ ID NO: 6750946 - DNA, 15 bp, Homo sapiens
ttacagctctgtagt

SEQ ID NO: 6750947 - DNA, 11 bp, Homo sapiens
ttacagctgtg

SEQ ID NO: 6750948 - DNA, 13 bp, Homo sapiens
ttacagctgttta

SEQ ID NO: 6750949 - DNA, 22 bp, Homo sapiens
ttacagctttacacacacagat

SEQ ID NO: 6750950 - DNA, 13 bp, Homo sapiens
ttacagctttgtt

SEQ ID NO: 6750951 - DNA, 11 bp, Homo sapiens
ttacagctttt

SEQ ID NO: 6750952 - DNA, 16 bp, Homo sapiens
ttacagcttttatgga

SEQ ID NO: 6750953 - DNA, 19 bp, Homo sapiens
ttacagcttttatggatga

SEQ ID NO: 6750954 - DNA, 14 bp, Homo sapiens
ttacagcttttctc

SEQ ID NO: 6750955 - DNA, 15 bp, Homo sapiens
ttacagcttttctct

SEQ ID NO: 6750956 - DNA, 18 bp, Homo sapiens
ttacaggaaagatgcatt

SEQ ID NO: 6750957 - DNA, 19 bp, Homo sapiens
ttacaggaaattgcaaaga

SEQ ID NO: 6750958 - DNA, 18 bp, Homo sapiens
ttacaggaacccagccag

SEQ ID NO: 6750959 - DNA, 14 bp, Homo sapiens
ttacaggaagcttt

SEQ ID NO: 6750960 - DNA, 14 bp, Homo sapiens
ttacaggaagtact

SEQ ID NO: 6750961 - DNA, 16 bp, Homo sapiens
ttacaggaagtactgg

SEQ ID NO: 6750962 - DNA, 18 bp, Homo sapiens
ttacaggaagtactggag

SEQ ID NO: 6750963 - DNA, 19 bp, Homo sapiens
ttacaggaatgaagaactg

SEQ ID NO: 6750964 - DNA, 15 bp, Homo sapiens
ttacaggacttctct

SEQ ID NO: 6750965 - DNA, 17 bp, Homo sapiens
ttacaggagccagcctg

SEQ ID NO: 6750966 - DNA, 18 bp, Homo sapiens
ttacaggagggaacattt

SEQ ID NO: 6750967 - DNA, 20 bp, Homo sapiens
ttacaggagggaacatttcc

SEQ ID NO: 6750968 - DNA, 15 bp, Homo sapiens
ttacaggatattcca

SEQ ID NO: 6750969 - DNA, 19 bp, Homo sapiens
ttacaggatattccaaaat

SEQ ID NO: 6750970 - DNA, 15 bp, Homo sapiens
ttacaggcaccgaga

SEQ ID NO: 6750971 - DNA, 18 bp, Homo sapiens
ttacaggcaccgagaatg

SEQ ID NO: 6750972 - DNA, 24 bp, Homo sapiens
ttacaggcaccgagaatgttgtat

SEQ ID NO: 6750973 - DNA, 16 bp, Homo sapiens
ttacaggcactaaagt

SEQ ID NO: 6750974 - DNA, 17 bp, Homo sapiens
ttacaggccctgctcct

SEQ ID NO: 6750975 - DNA, 22 bp, Homo sapiens
ttacaggccctgctcctgcagc

SEQ ID NO: 6750976 - DNA, 23 bp, Homo sapiens
ttacaggcctacagaaattgaaa

SEQ ID NO: 6750977 - DNA, 23 bp, Homo sapiens
ttacaggcgtgtgccactacact

SEQ ID NO: 6750978 - DNA, 18 bp, Homo sapiens
ttacaggctcctgccacc

SEQ ID NO: 6750979 - DNA, 16 bp, Homo sapiens
ttacagggaagaaatc

SEQ ID NO: 6750980 - DNA, 16 bp, Homo sapiens
ttacagggagcctcct

SEQ ID NO: 6750981 - DNA, 18 bp, Homo sapiens
ttacagggagcctcctgc

SEQ ID NO: 6750982 - DNA, 20 bp, Homo sapiens
ttacagggagcctcctgccc

SEQ ID NO: 6750983 - DNA, 18 bp, Homo sapiens
ttacagggagctgggaca

SEQ ID NO: 6750984 - DNA, 17 bp, Homo sapiens
ttacagggcccaggtga

SEQ ID NO: 6750985 - DNA, 22 bp, Homo sapiens
ttacaggggcagtgcctttgta

SEQ ID NO: 6750986 - DNA, 20 bp, Homo sapiens
ttacaggtgattaacttgga

SEQ ID NO: 6750987 - DNA, 15 bp, Homo sapiens
ttacaggtgtactat

SEQ ID NO: 6750988 - DNA, 14 bp, Homo sapiens
ttacaggtgtgaac

SEQ ID NO: 6750989 - DNA, 19 bp, Homo sapiens
ttacaggtgtgagccacag

SEQ ID NO: 6750990 - DNA, 23 bp, Homo sapiens
ttacagtaaaattaagtgtgtat

SEQ ID NO: 6750991 - DNA, 22 bp, Homo sapiens
ttacagtaaagtatagaaatat

SEQ ID NO: 6750992 - DNA, 13 bp, Homo sapiens
ttacagtaaataa

SEQ ID NO: 6750993 - DNA, 22 bp, Homo sapiens
ttacagtaaataaattgtttga

SEQ ID NO: 6750994 - DNA, 14 bp, Homo sapiens
ttacagtaaatgtt

SEQ ID NO: 6750995 - DNA, 17 bp, Homo sapiens
ttacagtaggagcccag

SEQ ID NO: 6750996 - DNA, 22 bp, Homo sapiens
ttacagtaggagtgagaaattt

SEQ ID NO: 6750997 - DNA, 16 bp, Homo sapiens
ttacagtataattaac

SEQ ID NO: 6750998 - DNA, 18 bp, Homo sapiens
ttacagtatcttcaaaaa

SEQ ID NO: 6750999 - DNA, 19 bp, Homo sapiens
ttacagtatcttcaaaaat

SEQ ID NO: 6751000 - DNA, 17 bp, Homo sapiens
ttacagtatgatgaaaa

SEQ ID NO: 6751001 - DNA, 17 bp, Homo sapiens
ttacagtcaattttaca

SEQ ID NO: 6751002 - DNA, 17 bp, Homo sapiens
ttacagtctctgttgta

SEQ ID NO: 6751003 - DNA, 17 bp, Homo sapiens
ttacagtgaaaatgtaa

SEQ ID NO: 6751004 - DNA, 17 bp, Homo sapiens
ttacagtgaatttctga

SEQ ID NO: 6751005 - DNA, 18 bp, Homo sapiens
ttacagtgaatttctgat

SEQ ID NO: 6751006 - DNA, 21 bp, Homo sapiens
ttacagtgaccttttcttcat

SEQ ID NO: 6751007 - DNA, 14 bp, Homo sapiens
ttacagtgatagaa

SEQ ID NO: 6751008 - DNA, 16 bp, Homo sapiens
ttacagtgcagacagg

SEQ ID NO: 6751009 - DNA, 17 bp, Homo sapiens
ttacagtgcctaaaata

SEQ ID NO: 6751010 - DNA, 17 bp, Homo sapiens
ttacagtggattgctca

SEQ ID NO: 6751011 - DNA, 17 bp, Homo sapiens
ttacagtgtagcttgcc

SEQ ID NO: 6751012 - DNA, 17 bp, Homo sapiens
ttacagtgtatttaaga

SEQ ID NO: 6751013 - DNA, 18 bp, Homo sapiens
ttacagtgtctgtgtgtg

SEQ ID NO: 6751014 - DNA, 11 bp, Homo sapiens
ttacagtgttg

SEQ ID NO: 6751015 - DNA, 21 bp, Homo sapiens
ttacagttacaattgttacag

SEQ ID NO: 6751016 - DNA, 19 bp, Homo sapiens
ttacagttacttttccttg

SEQ ID NO: 6751017 - DNA, 22 bp, Homo sapiens
ttacagttagggttttgcaata

SEQ ID NO: 6751018 - DNA, 16 bp, Homo sapiens
ttacagttatagaaag

SEQ ID NO: 6751019 - DNA, 17 bp, Homo sapiens
ttacagttatcctgcaa

SEQ ID NO: 6751020 - DNA, 22 bp, Homo sapiens
ttacagttctgtggtttcatgt

SEQ ID NO: 6751021 - DNA, 14 bp, Homo sapiens
ttacagttctttcc

SEQ ID NO: 6751022 - DNA, 15 bp, Homo sapiens
ttacagttctttcct

SEQ ID NO: 6751023 - DNA, 16 bp, Homo sapiens
ttacagttctttcctc

SEQ ID NO: 6751024 - DNA, 15 bp, Homo sapiens
ttactgacagaaatg

SEQ ID NO: 6751025 - DNA, 20 bp, Homo sapiens
ttactgacatggtgctgtgt

SEQ ID NO: 6751026 - DNA, 12 bp, Homo sapiens
ttactgaccatg

SEQ ID NO: 6751027 - DNA, 19 bp, Homo sapiens
ttactgaccctggggctgg

SEQ ID NO: 6751028 - DNA, 20 bp, Homo sapiens
ttactgacctcacctaggaa

SEQ ID NO: 6751029 - DNA, 16 bp, Homo sapiens
ttactgactcctcagt

SEQ ID NO: 6751030 - DNA, 12 bp, Homo sapiens
ttactgacttgg

SEQ ID NO: 6751031 - DNA, 14 bp, Homo sapiens
ttactgagagaagg

SEQ ID NO: 6751032 - DNA, 12 bp, Homo sapiens
ttactgagatgt

SEQ ID NO: 6751033 - DNA, 20 bp, Homo sapiens
ttactgagatgttttaccat

SEQ ID NO: 6751034 - DNA, 14 bp, Homo sapiens
ttactgagcttctc

SEQ ID NO: 6751035 - DNA, 16 bp, Homo sapiens
ttactgagcttctctg

SEQ ID NO: 6751036 - DNA, 19 bp, Homo sapiens
ttactgaggaaagggagga

SEQ ID NO: 6751037 - DNA, 20 bp, Homo sapiens
ttactgaggggattctctac

SEQ ID NO: 6751038 - DNA, 21 bp, Homo sapiens
ttactgataaaaatgatattg

SEQ ID NO: 6751039 - DNA, 23 bp, Homo sapiens
ttactgatatggttcttattcac

SEQ ID NO: 6751040 - DNA, 16 bp, Homo sapiens
ttactgatcatgcatt

SEQ ID NO: 6751041 - DNA, 20 bp, Homo sapiens
ttactgatgtgatattctgt

SEQ ID NO: 6751042 - DNA, 13 bp, Homo sapiens
ttactgattattt

SEQ ID NO: 6751043 - DNA, 21 bp, Homo sapiens
ttactgcaaattgattgtctt

SEQ ID NO: 6751044 - DNA, 13 bp, Homo sapiens
ttactgcaatgtc

SEQ ID NO: 6751045 - DNA, 12 bp, Homo sapiens
ttactgcagttg

SEQ ID NO: 6751046 - DNA, 16 bp, Homo sapiens
ttactgccaaaaccaa

SEQ ID NO: 6751047 - DNA, 20 bp, Homo sapiens
ttactgccaaaaccaaattg

SEQ ID NO: 6751048 - DNA, 12 bp, Homo sapiens
ttactgcctgta

SEQ ID NO: 6751049 - DNA, 23 bp, Homo sapiens
ttactgcctgtagcaatggccag

SEQ ID NO: 6751050 - DNA, 17 bp, Homo sapiens
ttactgctaagtatttc

SEQ ID NO: 6751051 - DNA, 20 bp, Homo sapiens
ttactgctaagtatttccca

SEQ ID NO: 6751052 - DNA, 14 bp, Homo sapiens
ttactgctctgaga

SEQ ID NO: 6751053 - DNA, 11 bp, Homo sapiens
ttactgctgtc

SEQ ID NO: 6751054 - DNA, 20 bp, Homo sapiens
ttactgcttaattcaaataa

SEQ ID NO: 6751055 - DNA, 13 bp, Homo sapiens
ttactgcttcatt

SEQ ID NO: 6751056 - DNA, 16 bp, Homo sapiens
ttactgcttcattttt

SEQ ID NO: 6751057 - DNA, 13 bp, Homo sapiens
ttactgcttttca

SEQ ID NO: 6751058 - DNA, 15 bp, Homo sapiens
ttactgcttttcatt

SEQ ID NO: 6751059 - DNA, 23 bp, Homo sapiens
ttactggaagacgaagtgtaaac

SEQ ID NO: 6751060 - DNA, 15 bp, Homo sapiens
ttactggaccccgcc

SEQ ID NO: 6751061 - DNA, 16 bp, Homo sapiens
ttactggactgtctga

SEQ ID NO: 6751062 - DNA, 17 bp, Homo sapiens
ttactggccttttcact

SEQ ID NO: 6751063 - DNA, 15 bp, Homo sapiens
ttactggcgtggatt

SEQ ID NO: 6751064 - DNA, 21 bp, Homo sapiens
ttactgggttggaagaaatat

SEQ ID NO: 6751065 - DNA, 23 bp, Homo sapiens
ttactgggtttgtttttcaaagc

SEQ ID NO: 6751066 - DNA, 24 bp, Homo sapiens
ttactggtaggaacttgagaactt

SEQ ID NO: 6751067 - DNA, 18 bp, Homo sapiens
ttactggtgatttctgag

SEQ ID NO: 6751068 - DNA, 12 bp, Homo sapiens
ttactggtttca

SEQ ID NO: 6751069 - DNA, 15 bp, Homo sapiens
ttactggtttcccca

SEQ ID NO: 6751070 - DNA, 13 bp, Homo sapiens
ttactgtaaattt

SEQ ID NO: 6751071 - DNA, 24 bp, Homo sapiens
ttactgtaattggtgacaatgtca

SEQ ID NO: 6751072 - DNA, 23 bp, Homo sapiens
ttactgtacagacagaaaaaact

SEQ ID NO: 6751073 - DNA, 16 bp, Homo sapiens
ttactgtagcctcaga

SEQ ID NO: 6751074 - DNA, 13 bp, Homo sapiens
ttactgtatactg

SEQ ID NO: 6751075 - DNA, 21 bp, Homo sapiens
ttactgtatcaatttctaatg

SEQ ID NO: 6751076 - DNA, 17 bp, Homo sapiens
ttactgtatttaagaaa

SEQ ID NO: 6751077 - DNA, 12 bp, Homo sapiens
ttactgtatttt

SEQ ID NO: 6751078 - DNA, 23 bp, Homo sapiens
ttactgtcaaggctgcttagaat

SEQ ID NO: 6751079 - DNA, 16 bp, Homo sapiens
ttactgtcagattaaa

SEQ ID NO: 6751080 - DNA, 17 bp, Homo sapiens
ttactgtcagattaaat

SEQ ID NO: 6751081 - DNA, 18 bp, Homo sapiens
ttactgtcctgttttcta

SEQ ID NO: 6751082 - DNA, 23 bp, Homo sapiens
ttactgtcgtatttttgaaaaat

SEQ ID NO: 6751083 - DNA, 17 bp, Homo sapiens
ttactgtctatatatat

SEQ ID NO: 6751084 - DNA, 22 bp, Homo sapiens
ttactgtctggttttaacaatt

SEQ ID NO: 6751085 - DNA, 18 bp, Homo sapiens
ttactgtctgtaagagaa

SEQ ID NO: 6751086 - DNA, 20 bp, Homo sapiens
ttactgtcttaaatcagttt

SEQ ID NO: 6751087 - DNA, 15 bp, Homo sapiens
ttactgtcttaatta

SEQ ID NO: 6751088 - DNA, 18 bp, Homo sapiens
ttactgtcttaattaagt

SEQ ID NO: 6751089 - DNA, 19 bp, Homo sapiens
ttactgtcttaattaagta

SEQ ID NO: 6751090 - DNA, 16 bp, Homo sapiens
ttactgtcttttctat

SEQ ID NO: 6751091 - DNA, 19 bp, Homo sapiens
ttactgtgagaactgtgaa

SEQ ID NO: 6751092 - DNA, 21 bp, Homo sapiens
ttactgtgcattgggatttta

SEQ ID NO: 6751093 - DNA, 20 bp, Homo sapiens
ttactgtggaggaaggattg

SEQ ID NO: 6751094 - DNA, 23 bp, Homo sapiens
ttactgtggaggaaggattgtaa

SEQ ID NO: 6751095 - DNA, 16 bp, Homo sapiens
ttactgtgtatctcaa

SEQ ID NO: 6751096 - DNA, 15 bp, Homo sapiens
ttactgttaaaactg

SEQ ID NO: 6751097 - DNA, 23 bp, Homo sapiens
ttactgttaactgtcttgagaga

SEQ ID NO: 6751098 - DNA, 23 bp, Homo sapiens
ttactgttacctgatcaatgaca

SEQ ID NO: 6751099 - DNA, 18 bp, Homo sapiens
ttactgttagtcatttgc

SEQ ID NO: 6751100 - DNA, 19 bp, Homo sapiens
ttactgttcttgctgctag

SEQ ID NO: 6751101 - DNA, 20 bp, Homo sapiens
ttactgttcttgctgctaga

SEQ ID NO: 6751102 - DNA, 24 bp, Homo sapiens
ttactgttgtacaatcatgttctg

SEQ ID NO: 6751103 - DNA, 16 bp, Homo sapiens
ttactgtttatttctg

SEQ ID NO: 6751104 - DNA, 14 bp, Homo sapiens
ttactgtttgaaaa

SEQ ID NO: 6751105 - DNA, 14 bp, Homo sapiens
ttactgtttgaaac

SEQ ID NO: 6751106 - DNA, 15 bp, Homo sapiens
ttactgtttgttatg

SEQ ID NO: 6751107 - DNA, 18 bp, Homo sapiens
ttactgttttatgttgat

SEQ ID NO: 6751108 - DNA, 23 bp, Homo sapiens
ttactgttttgaaatcaatgcaa

SEQ ID NO: 6751109 - DNA, 17 bp, Homo sapiens
ttactgttttgaggaat

SEQ ID NO: 6751110 - DNA, 13 bp, Homo sapiens
ttactgtttttga

SEQ ID NO: 6751111 - DNA, 14 bp, Homo sapiens
ttacttaaatagca

SEQ ID NO: 6751112 - DNA, 20 bp, Homo sapiens
ttacttaaattttaaagcct

SEQ ID NO: 6751113 - DNA, 14 bp, Homo sapiens
ttacttaacagttg

SEQ ID NO: 6751114 - DNA, 20 bp, Homo sapiens
ttacttaacatatctgatat

SEQ ID NO: 6751115 - DNA, 22 bp, Homo sapiens
ttacttaagacttaatgagact

SEQ ID NO: 6751116 - DNA, 13 bp, Homo sapiens
ttacttaagattc

SEQ ID NO: 6751117 - DNA, 19 bp, Homo sapiens
ttacttaagtgttcatttt

SEQ ID NO: 6751118 - DNA, 13 bp, Homo sapiens
ttacttaatgtgg

SEQ ID NO: 6751119 - DNA, 14 bp, Homo sapiens
ttacttacaaaaat

SEQ ID NO: 6751120 - DNA, 14 bp, Homo sapiens
ttacttacacacct

SEQ ID NO: 6751121 - DNA, 13 bp, Homo sapiens
ttacttacctaaa

SEQ ID NO: 6751122 - DNA, 14 bp, Homo sapiens
ttacttagaatgcc

SEQ ID NO: 6751123 - DNA, 14 bp, Homo sapiens
ttacttagagatgc

SEQ ID NO: 6751124 - DNA, 15 bp, Homo sapiens
ttacttagcttatca

SEQ ID NO: 6751125 - DNA, 17 bp, Homo sapiens
ttacttaggttattttg

SEQ ID NO: 6751126 - DNA, 20 bp, Homo sapiens
ttacttaggttattttgctt

SEQ ID NO: 6751127 - DNA, 12 bp, Homo sapiens
ttacttatatat

SEQ ID NO: 6751128 - DNA, 23 bp, Homo sapiens
ttacttatcatccacattgtttt

SEQ ID NO: 6751129 - DNA, 18 bp, Homo sapiens
ttacttattatcttcagg

SEQ ID NO: 6751130 - DNA, 14 bp, Homo sapiens
ttacttattcttcc

SEQ ID NO: 6751131 - DNA, 14 bp, Homo sapiens
ttacttattttctg

SEQ ID NO: 6751132 - DNA, 19 bp, Homo sapiens
ttacttcacccggctgggc

SEQ ID NO: 6751133 - DNA, 12 bp, Homo sapiens
ttacttcacttt

SEQ ID NO: 6751134 - DNA, 22 bp, Homo sapiens
ttacttcaggggaagagaagac

SEQ ID NO: 6751135 - DNA, 21 bp, Homo sapiens
ttacttccagcaaaatccaaa

SEQ ID NO: 6751136 - DNA, 18 bp, Homo sapiens
ttacttccagcaagcaaa

SEQ ID NO: 6751137 - DNA, 15 bp, Homo sapiens
ttacttccatgaatt

SEQ ID NO: 6751138 - DNA, 16 bp, Homo sapiens
ttacttccatgatact

SEQ ID NO: 6751139 - DNA, 17 bp, Homo sapiens
ttacttccatgatactt

SEQ ID NO: 6751140 - DNA, 19 bp, Homo sapiens
ttacttccatgatacttta

SEQ ID NO: 6751141 - DNA, 16 bp, Homo sapiens
ttacttccattataca

SEQ ID NO: 6751142 - DNA, 17 bp, Homo sapiens
ttacttccattgcaaaa

SEQ ID NO: 6751143 - DNA, 21 bp, Homo sapiens
ttacttcccagtataagattt

SEQ ID NO: 6751144 - DNA, 15 bp, Homo sapiens
ttacttcccccaccc

SEQ ID NO: 6751145 - DNA, 15 bp, Homo sapiens
ttacttcctaaattt

SEQ ID NO: 6751146 - DNA, 18 bp, Homo sapiens
ttacttcctggcctcttc

SEQ ID NO: 6751147 - DNA, 23 bp, Homo sapiens
ttacttctcccctgggtcctcca

SEQ ID NO: 6751148 - DNA, 24 bp, Homo sapiens
ttacttctctataaaaaatatgta

SEQ ID NO: 6751149 - DNA, 11 bp, Homo sapiens
ttacttctgct

SEQ ID NO: 6751150 - DNA, 20 bp, Homo sapiens
ttacttgaaaaaatgttcta

SEQ ID NO: 6751151 - DNA, 13 bp, Homo sapiens
ttacttgaaataa

SEQ ID NO: 6751152 - DNA, 17 bp, Homo sapiens
ttacttgaaataagttg

SEQ ID NO: 6751153 - DNA, 13 bp, Homo sapiens
ttacttgaagtaa

SEQ ID NO: 6751154 - DNA, 19 bp, Homo sapiens
ttacttgaagtaactataa

SEQ ID NO: 6751155 - DNA, 17 bp, Homo sapiens
ttacttgataagggact

SEQ ID NO: 6751156 - DNA, 15 bp, Homo sapiens
ttacttgatagactt

SEQ ID NO: 6751157 - DNA, 21 bp, Homo sapiens
ttacttgatagacttactaat

SEQ ID NO: 6751158 - DNA, 15 bp, Homo sapiens
ttacttgattaagga

SEQ ID NO: 6751159 - DNA, 16 bp, Homo sapiens
ttacttgcacaagctt

SEQ ID NO: 6751160 - DNA, 19 bp, Homo sapiens
ttacttgcactgttactct

SEQ ID NO: 6751161 - DNA, 18 bp, Homo sapiens
ttacttgcctatctgact

SEQ ID NO: 6751162 - DNA, 15 bp, Homo sapiens
ttacttgcttcagtg

SEQ ID NO: 6751163 - DNA, 13 bp, Homo sapiens
ttacttgcttctc

SEQ ID NO: 6751164 - DNA, 15 bp, Homo sapiens
ttacttgctttcaat

SEQ ID NO: 6751165 - DNA, 16 bp, Homo sapiens
ttacttggaaataata

SEQ ID NO: 6751166 - DNA, 19 bp, Homo sapiens
ttacttggaaataataaat

SEQ ID NO: 6751167 - DNA, 20 bp, Homo sapiens
ttacttgggaaatttttaat

SEQ ID NO: 6751168 - DNA, 18 bp, Homo sapiens
ttacttgtaaataaagtc

SEQ ID NO: 6751169 - DNA, 20 bp, Homo sapiens
ttacttgtaaataaagtcta

SEQ ID NO: 6751170 - DNA, 23 bp, Homo sapiens
ttacttgtaaatataaagacgtt

SEQ ID NO: 6751171 - DNA, 15 bp, Homo sapiens
ttacttgtagaaatc

SEQ ID NO: 6751172 - DNA, 18 bp, Homo sapiens
ttacttgtagaaatctgt

SEQ ID NO: 6751173 - DNA, 20 bp, Homo sapiens
ttacttgtagaaatctgtaa

SEQ ID NO: 6751174 - DNA, 16 bp, Homo sapiens
ttacttgtctgaggcc

SEQ ID NO: 6751175 - DNA, 15 bp, Homo sapiens
ttacttgtctgtaca

SEQ ID NO: 6751176 - DNA, 18 bp, Homo sapiens
ttacttgtctgtcaaatg

SEQ ID NO: 6751177 - DNA, 21 bp, Homo sapiens
ttacttgtctttctggggttt

SEQ ID NO: 6751178 - DNA, 17 bp, Homo sapiens
ttacttgttcatttctg

SEQ ID NO: 6751179 - DNA, 15 bp, Homo sapiens
ttacttgttttggat

SEQ ID NO: 6751180 - DNA, 18 bp, Homo sapiens
ttactttaaaataaaaaa

SEQ ID NO: 6751181 - DNA, 17 bp, Homo sapiens
ttactttaaccctttct

SEQ ID NO: 6751182 - DNA, 14 bp, Homo sapiens
ttactttaatgcga

SEQ ID NO: 6751183 - DNA, 19 bp, Homo sapiens
ttactttaattactggaat

SEQ ID NO: 6751184 - DNA, 15 bp, Homo sapiens
ttactttatcacttt

SEQ ID NO: 6751185 - DNA, 19 bp, Homo sapiens
ttactttatccaatcctca

SEQ ID NO: 6751186 - DNA, 16 bp, Homo sapiens
ttactttatgttacta

SEQ ID NO: 6751187 - DNA, 11 bp, Homo sapiens
ttactttcagc

SEQ ID NO: 6751188 - DNA, 19 bp, Homo sapiens
ttactttccaattctcctt

SEQ ID NO: 6751189 - DNA, 23 bp, Homo sapiens
ttactttcccttgcttttccctc

SEQ ID NO: 6751190 - DNA, 18 bp, Homo sapiens
ttactttctgttgccaca

SEQ ID NO: 6751191 - DNA, 19 bp, Homo sapiens
ttactttcttcaccaagtg

SEQ ID NO: 6751192 - DNA, 13 bp, Homo sapiens
ttactttgcccat

SEQ ID NO: 6751193 - DNA, 20 bp, Homo sapiens
ttactttgctgccttaatga

SEQ ID NO: 6751194 - DNA, 19 bp, Homo sapiens
ttactttggcaatttcctg

SEQ ID NO: 6751195 - DNA, 13 bp, Homo sapiens
ttactttggttta

SEQ ID NO: 6751196 - DNA, 12 bp, Homo sapiens
ttactttgtaat

SEQ ID NO: 6751197 - DNA, 19 bp, Homo sapiens
ttactttgtacttgtgttt

SEQ ID NO: 6751198 - DNA, 11 bp, Homo sapiens
ttactttgtat

SEQ ID NO: 6751199 - DNA, 13 bp, Homo sapiens
ttactttgtgaat

SEQ ID NO: 6751200 - DNA, 14 bp, Homo sapiens
ttactttgttaatt

SEQ ID NO: 6751201 - DNA, 19 bp, Homo sapiens
ttactttgttaatttatct

SEQ ID NO: 6751202 - DNA, 22 bp, Homo sapiens
ttactttgtttttattctgtta

SEQ ID NO: 6751203 - DNA, 20 bp, Homo sapiens
ttaggaggctgcatgctctg

SEQ ID NO: 6751204 - DNA, 14 bp, Homo sapiens
ttaggagtactttc

SEQ ID NO: 6751205 - DNA, 22 bp, Homo sapiens
ttaggagtgggtgacaagagcc

SEQ ID NO: 6751206 - DNA, 14 bp, Homo sapiens
ttaggataactaaa

SEQ ID NO: 6751207 - DNA, 18 bp, Homo sapiens
ttaggataactaaaattc

SEQ ID NO: 6751208 - DNA, 16 bp, Homo sapiens
ttaggatactcttaat

SEQ ID NO: 6751209 - DNA, 22 bp, Homo sapiens
ttaggatacttaacaaatacat

SEQ ID NO: 6751210 - DNA, 20 bp, Homo sapiens
ttaggatattgatttaaaat

SEQ ID NO: 6751211 - DNA, 16 bp, Homo sapiens
ttaggatctatgcaat

SEQ ID NO: 6751212 - DNA, 17 bp, Homo sapiens
ttaggatctatgcaatt

SEQ ID NO: 6751213 - DNA, 18 bp, Homo sapiens
ttaggatctcgcctggaa

SEQ ID NO: 6751214 - DNA, 19 bp, Homo sapiens
ttaggatgcggctttctct

SEQ ID NO: 6751215 - DNA, 21 bp, Homo sapiens
ttaggatttaacagtcattta

SEQ ID NO: 6751216 - DNA, 16 bp, Homo sapiens
ttaggattttcacatt

SEQ ID NO: 6751217 - DNA, 20 bp, Homo sapiens
ttaggcaaggctatgtgatt

SEQ ID NO: 6751218 - DNA, 19 bp, Homo sapiens
ttaggcacatcaattaatt

SEQ ID NO: 6751219 - DNA, 21 bp, Homo sapiens
ttaggcacccctttccccagc

SEQ ID NO: 6751220 - DNA, 16 bp, Homo sapiens
ttaggcagactcttta

SEQ ID NO: 6751221 - DNA, 20 bp, Homo sapiens
ttaggcagcaacagcagagc

SEQ ID NO: 6751222 - DNA, 13 bp, Homo sapiens
ttaggcagcctgc

SEQ ID NO: 6751223 - DNA, 14 bp, Homo sapiens
ttaggcagggaagt

SEQ ID NO: 6751224 - DNA, 15 bp, Homo sapiens
ttaggcatgcctaat

SEQ ID NO: 6751225 - DNA, 19 bp, Homo sapiens
ttaggcatgtcccacccac

SEQ ID NO: 6751226 - DNA, 17 bp, Homo sapiens
ttaggcattatttaatg

SEQ ID NO: 6751227 - DNA, 19 bp, Homo sapiens
ttaggcattatttaatgtt

SEQ ID NO: 6751228 - DNA, 17 bp, Homo sapiens
ttaggcatttcctgctg

SEQ ID NO: 6751229 - DNA, 16 bp, Homo sapiens
ttaggccaactgcctc

SEQ ID NO: 6751230 - DNA, 14 bp, Homo sapiens
ttaggccacgctcc

SEQ ID NO: 6751231 - DNA, 17 bp, Homo sapiens
ttaggccagcaacgctt

SEQ ID NO: 6751232 - DNA, 12 bp, Homo sapiens
ttaggccaggcc

SEQ ID NO: 6751233 - DNA, 16 bp, Homo sapiens
ttaggccccagcaaca

SEQ ID NO: 6751234 - DNA, 10 bp, Homo sapiens
ttaggccccg

SEQ ID NO: 6751235 - DNA, 16 bp, Homo sapiens
ttaggcctctctgcct

SEQ ID NO: 6751236 - DNA, 19 bp, Homo sapiens
ttaggcctggagttgggct

SEQ ID NO: 6751237 - DNA, 21 bp, Homo sapiens
ttaggcctggagttgggctgg

SEQ ID NO: 6751238 - DNA, 23 bp, Homo sapiens
ttaggcgtgggctgaccaggctt

SEQ ID NO: 6751239 - DNA, 20 bp, Homo sapiens
ttaggctatttgtaaatctg

SEQ ID NO: 6751240 - DNA, 12 bp, Homo sapiens
ttaggctgggcc

SEQ ID NO: 6751241 - DNA, 22 bp, Homo sapiens
ttaggctgttccttgtactctt

SEQ ID NO: 6751242 - DNA, 15 bp, Homo sapiens
ttaggctgttggttc

SEQ ID NO: 6751243 - DNA, 15 bp, Homo sapiens
ttaggcttaaaaact

SEQ ID NO: 6751244 - DNA, 17 bp, Homo sapiens
ttaggcttacaatgtgc

SEQ ID NO: 6751245 - DNA, 19 bp, Homo sapiens
ttaggcttggctgccctgt

SEQ ID NO: 6751246 - DNA, 14 bp, Homo sapiens
ttaggctttcagct

SEQ ID NO: 6751247 - DNA, 16 bp, Homo sapiens
ttaggcttttaagaaa

SEQ ID NO: 6751248 - DNA, 22 bp, Homo sapiens
ttaggcttttccaaatcaagga

SEQ ID NO: 6751249 - DNA, 13 bp, Homo sapiens
ttagggaagaaaa

SEQ ID NO: 6751250 - DNA, 20 bp, Homo sapiens
ttagggaaggatacaaaagc

SEQ ID NO: 6751251 - DNA, 21 bp, Homo sapiens
ttagggaagttgtctccttcc

SEQ ID NO: 6751252 - DNA, 14 bp, Homo sapiens
ttagggaatgagag

SEQ ID NO: 6751253 - DNA, 22 bp, Homo sapiens
ttagggacaggaccccagctct

SEQ ID NO: 6751254 - DNA, 20 bp, Homo sapiens
ttagggacatttccaagctg

SEQ ID NO: 6751255 - DNA, 17 bp, Homo sapiens
ttagggagaaaattcaa

SEQ ID NO: 6751256 - DNA, 15 bp, Homo sapiens
ttagggagagaagat

SEQ ID NO: 6751257 - DNA, 21 bp, Homo sapiens
ttagggagatgagttgcagtt

SEQ ID NO: 6751258 - DNA, 22 bp, Homo sapiens
ttagggagcagatgactgagaa

SEQ ID NO: 6751259 - DNA, 19 bp, Homo sapiens
ttagggagctcttgacaga

SEQ ID NO: 6751260 - DNA, 14 bp, Homo sapiens
ttagggagtattct

SEQ ID NO: 6751261 - DNA, 19 bp, Homo sapiens
ttagggattccttccaata

SEQ ID NO: 6751262 - DNA, 14 bp, Homo sapiens
ttagggatttattt

SEQ ID NO: 6751263 - DNA, 14 bp, Homo sapiens
ttagggcagatttt

SEQ ID NO: 6751264 - DNA, 16 bp, Homo sapiens
ttagggcatttttctt

SEQ ID NO: 6751265 - DNA, 18 bp, Homo sapiens
ttagggcatttttcttgg

SEQ ID NO: 6751266 - DNA, 14 bp, Homo sapiens
ttagggcttttatt

SEQ ID NO: 6751267 - DNA, 16 bp, Homo sapiens
ttaggggaaaatagta

SEQ ID NO: 6751268 - DNA, 17 bp, Homo sapiens
ttaggggaaaatagtag

SEQ ID NO: 6751269 - DNA, 15 bp, Homo sapiens
ttaggggaactgggt

SEQ ID NO: 6751270 - DNA, 19 bp, Homo sapiens
ttaggggaaggagaagtaa

SEQ ID NO: 6751271 - DNA, 14 bp, Homo sapiens
ttaggggcaaacat

SEQ ID NO: 6751272 - DNA, 16 bp, Homo sapiens
ttaggggtgaaggagg

SEQ ID NO: 6751273 - DNA, 19 bp, Homo sapiens
ttagggtacagcccaggcg

SEQ ID NO: 6751274 - DNA, 15 bp, Homo sapiens
ttagggtacatttat

SEQ ID NO: 6751275 - DNA, 14 bp, Homo sapiens
ttagggtataagtt

SEQ ID NO: 6751276 - DNA, 13 bp, Homo sapiens
ttagggtcagcca

SEQ ID NO: 6751277 - DNA, 23 bp, Homo sapiens
ttagggtcagccatttttaatga

SEQ ID NO: 6751278 - DNA, 15 bp, Homo sapiens
ttagggtgaaccact

SEQ ID NO: 6751279 - DNA, 21 bp, Homo sapiens
ttagggtgaaccacttcattc

SEQ ID NO: 6751280 - DNA, 22 bp, Homo sapiens
ttaggtaaccttatatttacaa

SEQ ID NO: 6751281 - DNA, 23 bp, Homo sapiens
ttaggtaaccttatatttacaat

SEQ ID NO: 6751282 - DNA, 21 bp, Homo sapiens
ttaggtaatggatatgaaaga

SEQ ID NO: 6751283 - DNA, 13 bp, Homo sapiens
ttaggtactattc

SEQ ID NO: 6751284 - DNA, 16 bp, Homo sapiens
ttaggtagactttgct

SEQ ID NO: 6751285 - DNA, 17 bp, Homo sapiens
ttaggtagcaacaacag

SEQ ID NO: 6751286 - DNA, 21 bp, Homo sapiens
ttaggtagtaggaagaattac

SEQ ID NO: 6751287 - DNA, 19 bp, Homo sapiens
ttaggtcaaagttcataga

SEQ ID NO: 6751288 - DNA, 19 bp, Homo sapiens
ttaggtcccagaatggaaa

SEQ ID NO: 6751289 - DNA, 20 bp, Homo sapiens
ttaggtcgttttccaaagag

SEQ ID NO: 6751290 - DNA, 21 bp, Homo sapiens
ttaggtctgcattttctcagg

SEQ ID NO: 6751291 - DNA, 12 bp, Homo sapiens
ttaggtctggtt

SEQ ID NO: 6751292 - DNA, 16 bp, Homo sapiens
ttaggtcttcctgtgg

SEQ ID NO: 6751293 - DNA, 21 bp, Homo sapiens
ttaggtcttcctgtggctccc

SEQ ID NO: 6751294 - DNA, 23 bp, Homo sapiens
ttaggtcttcctgtggctccctc

SEQ ID NO: 6751295 - DNA, 14 bp, Homo sapiens
ttaggtcttgctgg

SEQ ID NO: 6751296 - DNA, 18 bp, Homo sapiens
ttaggtcttgctggaaga

SEQ ID NO: 6751297 - DNA, 22 bp, Homo sapiens
ttaggtgcaatttcaaggttct

SEQ ID NO: 6751298 - DNA, 13 bp, Homo sapiens
ttaggtgcctcct

SEQ ID NO: 6751299 - DNA, 18 bp, Homo sapiens
ttaggtggcaagctgtga

SEQ ID NO: 6751300 - DNA, 21 bp, Homo sapiens
ttaggtggccgctcctccctg

SEQ ID NO: 6751301 - DNA, 18 bp, Homo sapiens
ttaggtggttctcttcat

SEQ ID NO: 6751302 - DNA, 21 bp, Homo sapiens
ttaggttaaacgtagcatgtg

SEQ ID NO: 6751303 - DNA, 15 bp, Homo sapiens
ttaggttaacaatat

SEQ ID NO: 6751304 - DNA, 13 bp, Homo sapiens
ttaggttaactat

SEQ ID NO: 6751305 - DNA, 19 bp, Homo sapiens
ttaggttaactatgtacaa

SEQ ID NO: 6751306 - DNA, 16 bp, Homo sapiens
ttaggttataagaaac

SEQ ID NO: 6751307 - DNA, 15 bp, Homo sapiens
ttaggttatgctatt

SEQ ID NO: 6751308 - DNA, 18 bp, Homo sapiens
ttaggttattttgctttg

SEQ ID NO: 6751309 - DNA, 20 bp, Homo sapiens
ttaggttattttgctttggt

SEQ ID NO: 6751310 - DNA, 22 bp, Homo sapiens
ttaggttccatcctttacgtgt

SEQ ID NO: 6751311 - DNA, 13 bp, Homo sapiens
ttaggttctaaag

SEQ ID NO: 6751312 - DNA, 14 bp, Homo sapiens
ttaggttgaaacat

SEQ ID NO: 6751313 - DNA, 16 bp, Homo sapiens
ttaggttgaaacatat

SEQ ID NO: 6751314 - DNA, 12 bp, Homo sapiens
ttaggttgtgaa

SEQ ID NO: 6751315 - DNA, 13 bp, Homo sapiens
ttaggttgtgaat

SEQ ID NO: 6751316 - DNA, 14 bp, Homo sapiens
ttaggtttaacata

SEQ ID NO: 6751317 - DNA, 17 bp, Homo sapiens
ttaggtttactgtgaag

SEQ ID NO: 6751318 - DNA, 20 bp, Homo sapiens
ttaggtttactgtgaagaga

SEQ ID NO: 6751319 - DNA, 21 bp, Homo sapiens
ttaggtttctttgaagaagga

SEQ ID NO: 6751320 - DNA, 19 bp, Homo sapiens
ttaggtttttttgtatagt

SEQ ID NO: 6751321 - DNA, 20 bp, Homo sapiens
ttagtaaaattatctgttct

SEQ ID NO: 6751322 - DNA, 22 bp, Homo sapiens
ttagtaaaattatctgttctat

SEQ ID NO: 6751323 - DNA, 18 bp, Homo sapiens
ttagtaaagtcaaggaga

SEQ ID NO: 6751324 - DNA, 20 bp, Homo sapiens
ttagtaaatacatcactgta

SEQ ID NO: 6751325 - DNA, 16 bp, Homo sapiens
ttagtaaatccttatt

SEQ ID NO: 6751326 - DNA, 23 bp, Homo sapiens
ttagtaaatccttatttatatat

SEQ ID NO: 6751327 - DNA, 19 bp, Homo sapiens
ttagtaaatgtctttgtaa

SEQ ID NO: 6751328 - DNA, 16 bp, Homo sapiens
ttagtaaattaagagc

SEQ ID NO: 6751329 - DNA, 15 bp, Homo sapiens
ttagtaaattcctaa

SEQ ID NO: 6751330 - DNA, 18 bp, Homo sapiens
ttagtaaatttctgtgat

SEQ ID NO: 6751331 - DNA, 22 bp, Homo sapiens
ttagtaacataataaattaaaa

SEQ ID NO: 6751332 - DNA, 16 bp, Homo sapiens
ttagtaacatcatttt

SEQ ID NO: 6751333 - DNA, 22 bp, Homo sapiens
ttagtaacctttaaaaatgtat

SEQ ID NO: 6751334 - DNA, 20 bp, Homo sapiens
ttagtaacttttagtggttc

SEQ ID NO: 6751335 - DNA, 18 bp, Homo sapiens
ttagtaagaaatttgcag

SEQ ID NO: 6751336 - DNA, 13 bp, Homo sapiens
ttagtaagtcttg

SEQ ID NO: 6751337 - DNA, 21 bp, Homo sapiens
ttagtaataaaacccagcatg

SEQ ID NO: 6751338 - DNA, 14 bp, Homo sapiens
ttagtaatacctct

SEQ ID NO: 6751339 - DNA, 12 bp, Homo sapiens
ttagtaatagat

SEQ ID NO: 6751340 - DNA, 19 bp, Homo sapiens
ttagtaatagtccaatatt

SEQ ID NO: 6751341 - DNA, 15 bp, Homo sapiens
ttagtaatctgtaca

SEQ ID NO: 6751342 - DNA, 17 bp, Homo sapiens
ttagtaatctgtacatt

SEQ ID NO: 6751343 - DNA, 14 bp, Homo sapiens
ttagtaatctgtat

SEQ ID NO: 6751344 - DNA, 23 bp, Homo sapiens
ttagtacaaactaactaataaaa

SEQ ID NO: 6751345 - DNA, 22 bp, Homo sapiens
ttagtacaatagtatacatttt

SEQ ID NO: 6751346 - DNA, 16 bp, Homo sapiens
ttagtaccttcaaata

SEQ ID NO: 6751347 - DNA, 15 bp, Homo sapiens
ttagtactatatctg

SEQ ID NO: 6751348 - DNA, 18 bp, Homo sapiens
ttagtactatatctgttt

SEQ ID NO: 6751349 - DNA, 16 bp, Homo sapiens
ttagtactcaatgttt

SEQ ID NO: 6751350 - DNA, 22 bp, Homo sapiens
ttagtactttagactaattgtg

SEQ ID NO: 6751351 - DNA, 16 bp, Homo sapiens
ttagtactttatagaa

SEQ ID NO: 6751352 - DNA, 21 bp, Homo sapiens
ttagtactttatagaagaatg

SEQ ID NO: 6751353 - DNA, 14 bp, Homo sapiens
ttagtagaaaatac

SEQ ID NO: 6751354 - DNA, 20 bp, Homo sapiens
ttagtagaaacggggtttca

SEQ ID NO: 6751355 - DNA, 23 bp, Homo sapiens
ttagtagaaacggggtttcacca

SEQ ID NO: 6751356 - DNA, 22 bp, Homo sapiens
ttagtagaaatagtgataagtt

SEQ ID NO: 6751357 - DNA, 23 bp, Homo sapiens
ttagtagaaatgccagaaacagt

SEQ ID NO: 6751358 - DNA, 13 bp, Homo sapiens
ttagtagagacag

SEQ ID NO: 6751359 - DNA, 17 bp, Homo sapiens
ttagtagagacagagtt

SEQ ID NO: 6751360 - DNA, 14 bp, Homo sapiens
ttagtagagacagg

SEQ ID NO: 6751361 - DNA, 20 bp, Homo sapiens
ttagtagagacggggtttca

SEQ ID NO: 6751362 - DNA, 22 bp, Homo sapiens
ttagtagaggtacacttgtgaa

SEQ ID NO: 6751363 - DNA, 12 bp, Homo sapiens
ttagtagcatgt

SEQ ID NO: 6751364 - DNA, 13 bp, Homo sapiens
ttagtagcatgtt

SEQ ID NO: 6751365 - DNA, 19 bp, Homo sapiens
ttagtagcccttcagtctt

SEQ ID NO: 6751366 - DNA, 13 bp, Homo sapiens
ttagtagctgata

SEQ ID NO: 6751367 - DNA, 15 bp, Homo sapiens
ttagtaggtcctcaa

SEQ ID NO: 6751368 - DNA, 15 bp, Homo sapiens
ttagtagttatttgt

SEQ ID NO: 6751369 - DNA, 15 bp, Homo sapiens
ttagtataagctttt

SEQ ID NO: 6751370 - DNA, 20 bp, Homo sapiens
ttagtataatatttcttaat

SEQ ID NO: 6751371 - DNA, 21 bp, Homo sapiens
ttagtataatatttcttaatt

SEQ ID NO: 6751372 - DNA, 15 bp, Homo sapiens
ttagtatagtagaaa

SEQ ID NO: 6751373 - DNA, 19 bp, Homo sapiens
ttagtatcagtgttttaaa

SEQ ID NO: 6751374 - DNA, 15 bp, Homo sapiens
ttagtatctaacatg

SEQ ID NO: 6751375 - DNA, 13 bp, Homo sapiens
ttagtatcttttg

SEQ ID NO: 6751376 - DNA, 16 bp, Homo sapiens
ttagtattaaaatcta

SEQ ID NO: 6751377 - DNA, 22 bp, Homo sapiens
ttagtattatacctgaaatatt

SEQ ID NO: 6751378 - DNA, 14 bp, Homo sapiens
ttagtattcttgag

SEQ ID NO: 6751379 - DNA, 15 bp, Homo sapiens
ttagtattgattcaa

SEQ ID NO: 6751380 - DNA, 17 bp, Homo sapiens
ttatcacattttattaa

SEQ ID NO: 6751381 - DNA, 19 bp, Homo sapiens
ttatcaccaggatttatac

SEQ ID NO: 6751382 - DNA, 18 bp, Homo sapiens
ttatcacccagaagaaaa

SEQ ID NO: 6751383 - DNA, 19 bp, Homo sapiens
ttatcacccagaagaaaat

SEQ ID NO: 6751384 - DNA, 18 bp, Homo sapiens
ttatcaccgtgggctccc

SEQ ID NO: 6751385 - DNA, 21 bp, Homo sapiens
ttatcaccgtgggctccctga

SEQ ID NO: 6751386 - DNA, 18 bp, Homo sapiens
ttatcacctggcttgttt

SEQ ID NO: 6751387 - DNA, 18 bp, Homo sapiens
ttatcactgacacaaaaa

SEQ ID NO: 6751388 - DNA, 22 bp, Homo sapiens
ttatcactgtctgttctgcaca

SEQ ID NO: 6751389 - DNA, 15 bp, Homo sapiens
ttatcacttttctgt

SEQ ID NO: 6751390 - DNA, 20 bp, Homo sapiens
ttatcactttttgaactaag

SEQ ID NO: 6751391 - DNA, 21 bp, Homo sapiens
ttatcactttttgaactaaga

SEQ ID NO: 6751392 - DNA, 15 bp, Homo sapiens
ttatcagaactatgt

SEQ ID NO: 6751393 - DNA, 21 bp, Homo sapiens
ttatcagaactcctttctaag

SEQ ID NO: 6751394 - DNA, 20 bp, Homo sapiens
ttatcagagtaacgagaaga

SEQ ID NO: 6751395 - DNA, 16 bp, Homo sapiens
ttatcagatattttca

SEQ ID NO: 6751396 - DNA, 14 bp, Homo sapiens
ttatcagcaaaaaa

SEQ ID NO: 6751397 - DNA, 14 bp, Homo sapiens
ttatcagcaaagaa

SEQ ID NO: 6751398 - DNA, 12 bp, Homo sapiens
ttatcaggagaa

SEQ ID NO: 6751399 - DNA, 17 bp, Homo sapiens
ttatcaggctttccttg

SEQ ID NO: 6751400 - DNA, 21 bp, Homo sapiens
ttatcaggctttccttgtttt

SEQ ID NO: 6751401 - DNA, 22 bp, Homo sapiens
ttatcagggcccaaataacagt

SEQ ID NO: 6751402 - DNA, 19 bp, Homo sapiens
ttatcaggggaatttcagg

SEQ ID NO: 6751403 - DNA, 20 bp, Homo sapiens
ttatcagtaagaaaaagaag

SEQ ID NO: 6751404 - DNA, 21 bp, Homo sapiens
ttatcagtaagaaaaagaaga

SEQ ID NO: 6751405 - DNA, 21 bp, Homo sapiens
ttatcagtaatgctaaatgtg

SEQ ID NO: 6751406 - DNA, 23 bp, Homo sapiens
ttatcagtcaatatttttagata

SEQ ID NO: 6751407 - DNA, 18 bp, Homo sapiens
ttatcagtcatgaggaaa

SEQ ID NO: 6751408 - DNA, 14 bp, Homo sapiens
ttatcagtgaatat

SEQ ID NO: 6751409 - DNA, 19 bp, Homo sapiens
ttatcagtgaatataaatg

SEQ ID NO: 6751410 - DNA, 23 bp, Homo sapiens
ttatcagtgaatataaatgtact

SEQ ID NO: 6751411 - DNA, 21 bp, Homo sapiens
ttatcatctcgaccacttttc

SEQ ID NO: 6751412 - DNA, 12 bp, Homo sapiens
ttatcatgaagc

SEQ ID NO: 6751413 - DNA, 13 bp, Homo sapiens
ttatcatgctgtc

SEQ ID NO: 6751414 - DNA, 16 bp, Homo sapiens
ttatcatgctgtcttt

SEQ ID NO: 6751415 - DNA, 13 bp, Homo sapiens
ttatcatggtcct

SEQ ID NO: 6751416 - DNA, 16 bp, Homo sapiens
ttatcatgtaaatgta

SEQ ID NO: 6751417 - DNA, 20 bp, Homo sapiens
ttatcatgtgaaatcattca

SEQ ID NO: 6751418 - DNA, 12 bp, Homo sapiens
ttatcatgtgta

SEQ ID NO: 6751419 - DNA, 14 bp, Homo sapiens
ttatcatgtgtaat

SEQ ID NO: 6751420 - DNA, 18 bp, Homo sapiens
ttatcatgtgtaatcaat

SEQ ID NO: 6751421 - DNA, 23 bp, Homo sapiens
ttatcatgttagtaatacctcta

SEQ ID NO: 6751422 - DNA, 16 bp, Homo sapiens
ttatcattaaaaatta

SEQ ID NO: 6751423 - DNA, 16 bp, Homo sapiens
ttatcattcctttcca

SEQ ID NO: 6751424 - DNA, 14 bp, Homo sapiens
ttatcattgaaaca

SEQ ID NO: 6751425 - DNA, 18 bp, Homo sapiens
ttatcattgggagaagcc

SEQ ID NO: 6751426 - DNA, 12 bp, Homo sapiens
ttatcatttcta

SEQ ID NO: 6751427 - DNA, 12 bp, Homo sapiens
ttatcattttca

SEQ ID NO: 6751428 - DNA, 16 bp, Homo sapiens
ttatcattttcaaaat

SEQ ID NO: 6751429 - DNA, 17 bp, Homo sapiens
ttatcatttttgtataa

SEQ ID NO: 6751430 - DNA, 20 bp, Homo sapiens
ttatcatttttgtataaaaa

SEQ ID NO: 6751431 - DNA, 19 bp, Homo sapiens
ttatcattttttcctgttt

SEQ ID NO: 6751432 - DNA, 23 bp, Homo sapiens
ttatccaaatcttgaatttctgc

SEQ ID NO: 6751433 - DNA, 22 bp, Homo sapiens
ttatccaaggtgtaactctaat

SEQ ID NO: 6751434 - DNA, 15 bp, Homo sapiens
ttatccaataaaaaa

SEQ ID NO: 6751435 - DNA, 17 bp, Homo sapiens
ttatccaatcctcagga

SEQ ID NO: 6751436 - DNA, 14 bp, Homo sapiens
ttatccaatcttgt

SEQ ID NO: 6751437 - DNA, 20 bp, Homo sapiens
ttatccaattcaaaaataaa

SEQ ID NO: 6751438 - DNA, 21 bp, Homo sapiens
ttatccacaattattggcaaa

SEQ ID NO: 6751439 - DNA, 19 bp, Homo sapiens
ttatccacagaaacatttt

SEQ ID NO: 6751440 - DNA, 13 bp, Homo sapiens
ttatccacattgt

SEQ ID NO: 6751441 - DNA, 16 bp, Homo sapiens
ttatccacctccatct

SEQ ID NO: 6751442 - DNA, 23 bp, Homo sapiens
ttatccagaagtattgtttacat

SEQ ID NO: 6751443 - DNA, 19 bp, Homo sapiens
ttatccagctagtgccaaa

SEQ ID NO: 6751444 - DNA, 21 bp, Homo sapiens
ttatccaggaattgatacgtt

SEQ ID NO: 6751445 - DNA, 17 bp, Homo sapiens
ttatccatattgagtca

SEQ ID NO: 6751446 - DNA, 19 bp, Homo sapiens
ttatccatattgagtcaaa

SEQ ID NO: 6751447 - DNA, 22 bp, Homo sapiens
ttatccatgtactttccctgtg

SEQ ID NO: 6751448 - DNA, 13 bp, Homo sapiens
ttatccatttctt

SEQ ID NO: 6751449 - DNA, 17 bp, Homo sapiens
ttatcccaagaatgcaa

SEQ ID NO: 6751450 - DNA, 20 bp, Homo sapiens
ttatcccaagaccctgcccc

SEQ ID NO: 6751451 - DNA, 23 bp, Homo sapiens
ttatcccaagaccctgccccctg

SEQ ID NO: 6751452 - DNA, 13 bp, Homo sapiens
ttatcccagctgc

SEQ ID NO: 6751453 - DNA, 15 bp, Homo sapiens
ttatcccagctgcct

SEQ ID NO: 6751454 - DNA, 15 bp, Homo sapiens
ttatccctctcttcc

SEQ ID NO: 6751455 - DNA, 23 bp, Homo sapiens
ttatccctctggggggtggggac

SEQ ID NO: 6751456 - DNA, 14 bp, Homo sapiens
ttatccctgaggtc

SEQ ID NO: 6751457 - DNA, 13 bp, Homo sapiens
ttatccctgctta

SEQ ID NO: 6751458 - DNA, 18 bp, Homo sapiens
ttatccctgcttatctga

SEQ ID NO: 6751459 - DNA, 17 bp, Homo sapiens
ttatcccttcctgtctg

SEQ ID NO: 6751460 - DNA, 19 bp, Homo sapiens
ttatcccttcctgtctgaa

SEQ ID NO: 6751461 - DNA, 15 bp, Homo sapiens
ttatcccttggtaat

SEQ ID NO: 6751462 - DNA, 19 bp, Homo sapiens
ttatccctttacaatgtga

SEQ ID NO: 6751463 - DNA, 14 bp, Homo sapiens
ttatccctttcctg

SEQ ID NO: 6751464 - DNA, 18 bp, Homo sapiens
ttatcctacagtacaatc

SEQ ID NO: 6751465 - DNA, 20 bp, Homo sapiens
ttatcctagcacatgcttca

SEQ ID NO: 6751466 - DNA, 13 bp, Homo sapiens
ttatcctagcctt

SEQ ID NO: 6751467 - DNA, 21 bp, Homo sapiens
ttatcctagttccattcttgg

SEQ ID NO: 6751468 - DNA, 13 bp, Homo sapiens
ttatcctatttca

SEQ ID NO: 6751469 - DNA, 20 bp, Homo sapiens
ttatcctcctgttctgaaac

SEQ ID NO: 6751470 - DNA, 12 bp, Homo sapiens
ttatcctctctc

SEQ ID NO: 6751471 - DNA, 16 bp, Homo sapiens
ttatcctctgatctcc

SEQ ID NO: 6751472 - DNA, 20 bp, Homo sapiens
ttatcctctgatctccatgg

SEQ ID NO: 6751473 - DNA, 16 bp, Homo sapiens
ttatcctctggtttaa

SEQ ID NO: 6751474 - DNA, 17 bp, Homo sapiens
ttatcctctttagagtt

SEQ ID NO: 6751475 - DNA, 13 bp, Homo sapiens
ttatcctctttgt

SEQ ID NO: 6751476 - DNA, 12 bp, Homo sapiens
ttatcctgcaag

SEQ ID NO: 6751477 - DNA, 13 bp, Homo sapiens
ttatcctgcattg

SEQ ID NO: 6751478 - DNA, 17 bp, Homo sapiens
ttatcctggcatgtgct

SEQ ID NO: 6751479 - DNA, 16 bp, Homo sapiens
ttatcctgtttgaaga

SEQ ID NO: 6751480 - DNA, 20 bp, Homo sapiens
ttatccttaggaaaatgctt

SEQ ID NO: 6751481 - DNA, 18 bp, Homo sapiens
ttatccttcacaatttca

SEQ ID NO: 6751482 - DNA, 19 bp, Homo sapiens
ttatcctttattttattga

SEQ ID NO: 6751483 - DNA, 15 bp, Homo sapiens
ttatcctttcatata

SEQ ID NO: 6751484 - DNA, 20 bp, Homo sapiens
ttatcctttcattaggcaaa

SEQ ID NO: 6751485 - DNA, 21 bp, Homo sapiens
ttatcctttcattaggcaaag

SEQ ID NO: 6751486 - DNA, 22 bp, Homo sapiens
ttatcctttcattaggcaaagt

SEQ ID NO: 6751487 - DNA, 13 bp, Homo sapiens
ttatcctttgtga

SEQ ID NO: 6751488 - DNA, 14 bp, Homo sapiens
ttatcgaaataaca

SEQ ID NO: 6751489 - DNA, 22 bp, Homo sapiens
ttatcgaaataacaatgttaag

SEQ ID NO: 6751490 - DNA, 18 bp, Homo sapiens
ttatcgaacgtggtctga

SEQ ID NO: 6751491 - DNA, 14 bp, Homo sapiens
ttatcgcatacaga

SEQ ID NO: 6751492 - DNA, 14 bp, Homo sapiens
ttatcgctttatgt

SEQ ID NO: 6751493 - DNA, 14 bp, Homo sapiens
ttatcggaagcagt

SEQ ID NO: 6751494 - DNA, 24 bp, Homo sapiens
ttatcggcccatagctaataagta

SEQ ID NO: 6751495 - DNA, 14 bp, Homo sapiens
ttatcgggaacagt

SEQ ID NO: 6751496 - DNA, 19 bp, Homo sapiens
ttatcgggagcagtgtctt

SEQ ID NO: 6751497 - DNA, 18 bp, Homo sapiens
ttatcgttttcttaaagt

SEQ ID NO: 6751498 - DNA, 14 bp, Homo sapiens
ttatctaaaagaat

SEQ ID NO: 6751499 - DNA, 20 bp, Homo sapiens
ttatctaactatatgtacag

SEQ ID NO: 6751500 - DNA, 19 bp, Homo sapiens
ttatctaagaatacagctt

SEQ ID NO: 6751501 - DNA, 23 bp, Homo sapiens
ttatctaaggtccccagcagaat

SEQ ID NO: 6751502 - DNA, 22 bp, Homo sapiens
ttatctaatacaaaattataaa

SEQ ID NO: 6751503 - DNA, 20 bp, Homo sapiens
ttatctaatacctctgtgtg

SEQ ID NO: 6751504 - DNA, 21 bp, Homo sapiens
ttatctacccaagggcagaaa

SEQ ID NO: 6751505 - DNA, 17 bp, Homo sapiens
ttatctactgactgaaa

SEQ ID NO: 6751506 - DNA, 23 bp, Homo sapiens
ttatctagaaagaaaagaccctg

SEQ ID NO: 6751507 - DNA, 14 bp, Homo sapiens
ttatctagatactg

SEQ ID NO: 6751508 - DNA, 14 bp, Homo sapiens
ttatctagatgtaa

SEQ ID NO: 6751509 - DNA, 15 bp, Homo sapiens
ttatctagatgtaaa

SEQ ID NO: 6751510 - DNA, 16 bp, Homo sapiens
ttatctagatgtaaat

SEQ ID NO: 6751511 - DNA, 17 bp, Homo sapiens
ttatctagcaagaagat

SEQ ID NO: 6751512 - DNA, 14 bp, Homo sapiens
ttatctagctaagc

SEQ ID NO: 6751513 - DNA, 23 bp, Homo sapiens
ttatctagtaggtctgcacacat

SEQ ID NO: 6751514 - DNA, 14 bp, Homo sapiens
ttatctataaaagg

SEQ ID NO: 6751515 - DNA, 16 bp, Homo sapiens
ttatctatataaaata

SEQ ID NO: 6751516 - DNA, 20 bp, Homo sapiens
ttatctatcggaagaacatg

SEQ ID NO: 6751517 - DNA, 16 bp, Homo sapiens
ttatctatgcagcatg

SEQ ID NO: 6751518 - DNA, 19 bp, Homo sapiens
ttatctattagataatcaa

SEQ ID NO: 6751519 - DNA, 18 bp, Homo sapiens
ttatctattgtaagataa

SEQ ID NO: 6751520 - DNA, 11 bp, Homo sapiens
ttatctcaaaa

SEQ ID NO: 6751521 - DNA, 14 bp, Homo sapiens
ttatctcaacggaa

SEQ ID NO: 6751522 - DNA, 22 bp, Homo sapiens
ttatctcaagtaaaacaaatga

SEQ ID NO: 6751523 - DNA, 14 bp, Homo sapiens
ttatctcactgttt

SEQ ID NO: 6751524 - DNA, 22 bp, Homo sapiens
ttatctcagatgttaaaataaa

SEQ ID NO: 6751525 - DNA, 20 bp, Homo sapiens
ttatctcagtcatgcataaa

SEQ ID NO: 6751526 - DNA, 16 bp, Homo sapiens
ttatctcatttctcaa

SEQ ID NO: 6751527 - DNA, 13 bp, Homo sapiens
ttatctccagcca

SEQ ID NO: 6751528 - DNA, 16 bp, Homo sapiens
ttatctccatactttg

SEQ ID NO: 6751529 - DNA, 17 bp, Homo sapiens
ttatctccatactttgg

SEQ ID NO: 6751530 - DNA, 12 bp, Homo sapiens
ttatctcctggg

SEQ ID NO: 6751531 - DNA, 13 bp, Homo sapiens
ttatctcctgtga

SEQ ID NO: 6751532 - DNA, 20 bp, Homo sapiens
ttatctcgaatttgaagaga

SEQ ID NO: 6751533 - DNA, 19 bp, Homo sapiens
ttatctctatttaatattt

SEQ ID NO: 6751534 - DNA, 11 bp, Homo sapiens
ttatctctgta

SEQ ID NO: 6751535 - DNA, 14 bp, Homo sapiens
ttatctctttccac

SEQ ID NO: 6751536 - DNA, 23 bp, Homo sapiens
ttatctgaaacttcccaacttcc

SEQ ID NO: 6751537 - DNA, 23 bp, Homo sapiens
ttatctgaactggactagtgaaa

SEQ ID NO: 6751538 - DNA, 17 bp, Homo sapiens
ttatctgaagtcagatc

SEQ ID NO: 6751539 - DNA, 20 bp, Homo sapiens
ttatctgaatataggaagca

SEQ ID NO: 6751540 - DNA, 18 bp, Homo sapiens
ttatctgaatattagatg

SEQ ID NO: 6751541 - DNA, 21 bp, Homo sapiens
ttatctgaatttttaaacaag

SEQ ID NO: 6751542 - DNA, 19 bp, Homo sapiens
ttatctgacacaagtgtat

SEQ ID NO: 6751543 - DNA, 16 bp, Homo sapiens
ttatctgagtcacttg

SEQ ID NO: 6751544 - DNA, 23 bp, Homo sapiens
ttatctgatcgggataacaaaat

SEQ ID NO: 6751545 - DNA, 20 bp, Homo sapiens
ttatctgcccctcccccact

SEQ ID NO: 6751546 - DNA, 21 bp, Homo sapiens
ttatctgcctctcttgtaatt

SEQ ID NO: 6751547 - DNA, 14 bp, Homo sapiens
ttatctgcctggcc

SEQ ID NO: 6751548 - DNA, 19 bp, Homo sapiens
ttatctggaacaacttgta

SEQ ID NO: 6751549 - DNA, 22 bp, Homo sapiens
ttatctggaacaacttgtagca

SEQ ID NO: 6751550 - DNA, 18 bp, Homo sapiens
ttatctgggttctcttca

SEQ ID NO: 6751551 - DNA, 20 bp, Homo sapiens
ttatctgggttttagaaatt

SEQ ID NO: 6751552 - DNA, 22 bp, Homo sapiens
ttatctgtaattgtaattccaa

SEQ ID NO: 6751553 - DNA, 13 bp, Homo sapiens
ttatctgtataag

SEQ ID NO: 6751554 - DNA, 20 bp, Homo sapiens
ttatctgtattttttacagt

SEQ ID NO: 6751555 - DNA, 12 bp, Homo sapiens
ttatctgtcaca

SEQ ID NO: 6751556 - DNA, 20 bp, Homo sapiens
ttatctgtctttatgatttc

SEQ ID NO: 6751557 - DNA, 16 bp, Homo sapiens
ttattattgaaattgt

SEQ ID NO: 6751558 - DNA, 12 bp, Homo sapiens
ttattatttatt

SEQ ID NO: 6751559 - DNA, 13 bp, Homo sapiens
ttattatttctaa

SEQ ID NO: 6751560 - DNA, 14 bp, Homo sapiens
ttattattttcaaa

SEQ ID NO: 6751561 - DNA, 15 bp, Homo sapiens
ttattattttcaaag

SEQ ID NO: 6751562 - DNA, 20 bp, Homo sapiens
ttattattttcccatttgct

SEQ ID NO: 6751563 - DNA, 12 bp, Homo sapiens
ttattcaaaata

SEQ ID NO: 6751564 - DNA, 13 bp, Homo sapiens
ttattcaaaatat

SEQ ID NO: 6751565 - DNA, 19 bp, Homo sapiens
ttattcaaactacctatat

SEQ ID NO: 6751566 - DNA, 23 bp, Homo sapiens
ttattcaaactacctatattcct

SEQ ID NO: 6751567 - DNA, 20 bp, Homo sapiens
ttattcaaagagaaaacatc

SEQ ID NO: 6751568 - DNA, 14 bp, Homo sapiens
ttattcaaatccat

SEQ ID NO: 6751569 - DNA, 14 bp, Homo sapiens
ttattcaaatttga

SEQ ID NO: 6751570 - DNA, 23 bp, Homo sapiens
ttattcaaatttgatgatgttaa

SEQ ID NO: 6751571 - DNA, 13 bp, Homo sapiens
ttattcaacacat

SEQ ID NO: 6751572 - DNA, 23 bp, Homo sapiens
ttattcaagaaagatatctatga

SEQ ID NO: 6751573 - DNA, 17 bp, Homo sapiens
ttattcaagaatgaaaa

SEQ ID NO: 6751574 - DNA, 15 bp, Homo sapiens
ttattcaaggtaaaa

SEQ ID NO: 6751575 - DNA, 12 bp, Homo sapiens
ttattcaataaa

SEQ ID NO: 6751576 - DNA, 16 bp, Homo sapiens
ttattcaattctgtat

SEQ ID NO: 6751577 - DNA, 18 bp, Homo sapiens
ttattcaatttatttgaa

SEQ ID NO: 6751578 - DNA, 14 bp, Homo sapiens
ttattcacaaaaat

SEQ ID NO: 6751579 - DNA, 13 bp, Homo sapiens
ttattcacaaaac

SEQ ID NO: 6751580 - DNA, 20 bp, Homo sapiens
ttattcaccatgtaaaacaa

SEQ ID NO: 6751581 - DNA, 17 bp, Homo sapiens
ttattcacttgtgtttg

SEQ ID NO: 6751582 - DNA, 21 bp, Homo sapiens
ttattcacttgtgtttgtata

SEQ ID NO: 6751583 - DNA, 11 bp, Homo sapiens
ttattcacttt

SEQ ID NO: 6751584 - DNA, 16 bp, Homo sapiens
ttattcacttttgtaa

SEQ ID NO: 6751585 - DNA, 12 bp, Homo sapiens
ttattcagaaat

SEQ ID NO: 6751586 - DNA, 19 bp, Homo sapiens
ttattcagaactatttaaa

SEQ ID NO: 6751587 - DNA, 21 bp, Homo sapiens
ttattcagaactatttaaaat

SEQ ID NO: 6751588 - DNA, 14 bp, Homo sapiens
ttattcagaacttt

SEQ ID NO: 6751589 - DNA, 12 bp, Homo sapiens
ttattcagcctt

SEQ ID NO: 6751590 - DNA, 17 bp, Homo sapiens
ttattcagctagaattt

SEQ ID NO: 6751591 - DNA, 19 bp, Homo sapiens
ttattcagctagaatttct

SEQ ID NO: 6751592 - DNA, 13 bp, Homo sapiens
ttattcagtaaac

SEQ ID NO: 6751593 - DNA, 22 bp, Homo sapiens
ttattcagtaaacaaattcttt

SEQ ID NO: 6751594 - DNA, 17 bp, Homo sapiens
ttattcagtaaacaact

SEQ ID NO: 6751595 - DNA, 14 bp, Homo sapiens
ttattcagtgtcac

SEQ ID NO: 6751596 - DNA, 12 bp, Homo sapiens
ttattcataaag

SEQ ID NO: 6751597 - DNA, 23 bp, Homo sapiens
ttattcataagccaatttttctg

SEQ ID NO: 6751598 - DNA, 22 bp, Homo sapiens
ttattcataatgaattataaca

SEQ ID NO: 6751599 - DNA, 12 bp, Homo sapiens
ttattcataatt

SEQ ID NO: 6751600 - DNA, 16 bp, Homo sapiens
ttattcatacaaataa

SEQ ID NO: 6751601 - DNA, 16 bp, Homo sapiens
ttattcatagttttat

SEQ ID NO: 6751602 - DNA, 15 bp, Homo sapiens
ttattcatgtgaagt

SEQ ID NO: 6751603 - DNA, 16 bp, Homo sapiens
ttattcattagctgtg

SEQ ID NO: 6751604 - DNA, 18 bp, Homo sapiens
ttattcattagttttgaa

SEQ ID NO: 6751605 - DNA, 16 bp, Homo sapiens
ttattcattattcctc

SEQ ID NO: 6751606 - DNA, 15 bp, Homo sapiens
ttattcattatttgt

SEQ ID NO: 6751607 - DNA, 18 bp, Homo sapiens
ttattcattatttgtcaa

SEQ ID NO: 6751608 - DNA, 19 bp, Homo sapiens
ttattcattatttgtcaaa

SEQ ID NO: 6751609 - DNA, 12 bp, Homo sapiens
ttattcattcag

SEQ ID NO: 6751610 - DNA, 11 bp, Homo sapiens
ttattcattgg

SEQ ID NO: 6751611 - DNA, 16 bp, Homo sapiens
ttattcatttaaaatg

SEQ ID NO: 6751612 - DNA, 18 bp, Homo sapiens
ttattcatttaaaatgat

SEQ ID NO: 6751613 - DNA, 20 bp, Homo sapiens
ttattcatttaaaatgatta

SEQ ID NO: 6751614 - DNA, 11 bp, Homo sapiens
ttattcatttt

SEQ ID NO: 6751615 - DNA, 18 bp, Homo sapiens
ttattccaaagagtgtgg

SEQ ID NO: 6751616 - DNA, 13 bp, Homo sapiens
ttattccacatct

SEQ ID NO: 6751617 - DNA, 20 bp, Homo sapiens
ttattccagaatgctgtaca

SEQ ID NO: 6751618 - DNA, 20 bp, Homo sapiens
ttattccatattagaaaact

SEQ ID NO: 6751619 - DNA, 18 bp, Homo sapiens
ttattccatcaataaatg

SEQ ID NO: 6751620 - DNA, 21 bp, Homo sapiens
ttattcccaagtatgccttaa

SEQ ID NO: 6751621 - DNA, 21 bp, Homo sapiens
ttattccccagtgactccagg

SEQ ID NO: 6751622 - DNA, 18 bp, Homo sapiens
ttattccccatcttccaa

SEQ ID NO: 6751623 - DNA, 17 bp, Homo sapiens
ttattcccccctaagct

SEQ ID NO: 6751624 - DNA, 21 bp, Homo sapiens
ttattcccccctaagcttcta

SEQ ID NO: 6751625 - DNA, 16 bp, Homo sapiens
ttattccctgtacaat

SEQ ID NO: 6751626 - DNA, 17 bp, Homo sapiens
ttattccgagcattcca

SEQ ID NO: 6751627 - DNA, 17 bp, Homo sapiens
ttattcctaattcctgt

SEQ ID NO: 6751628 - DNA, 14 bp, Homo sapiens
ttattcctagttgg

SEQ ID NO: 6751629 - DNA, 22 bp, Homo sapiens
ttattcctatatagtttattga

SEQ ID NO: 6751630 - DNA, 21 bp, Homo sapiens
ttattcctcagattgctgaat

SEQ ID NO: 6751631 - DNA, 16 bp, Homo sapiens
ttattcctcctgctca

SEQ ID NO: 6751632 - DNA, 22 bp, Homo sapiens
ttattcctctcaccccactcct

SEQ ID NO: 6751633 - DNA, 16 bp, Homo sapiens
ttattcctcttattgg

SEQ ID NO: 6751634 - DNA, 17 bp, Homo sapiens
ttattcctgataataat

SEQ ID NO: 6751635 - DNA, 21 bp, Homo sapiens
ttattcctgataataattgat

SEQ ID NO: 6751636 - DNA, 22 bp, Homo sapiens
ttattccttccatctagcagct

SEQ ID NO: 6751637 - DNA, 14 bp, Homo sapiens
ttattccttttaaa

SEQ ID NO: 6751638 - DNA, 19 bp, Homo sapiens
ttattctaaacagactcat

SEQ ID NO: 6751639 - DNA, 15 bp, Homo sapiens
ttattctaataaata

SEQ ID NO: 6751640 - DNA, 22 bp, Homo sapiens
ttattctagggtttcttaaata

SEQ ID NO: 6751641 - DNA, 13 bp, Homo sapiens
ttattctagttaa

SEQ ID NO: 6751642 - DNA, 12 bp, Homo sapiens
ttattctcagaa

SEQ ID NO: 6751643 - DNA, 17 bp, Homo sapiens
ttattctgctgaagatt

SEQ ID NO: 6751644 - DNA, 17 bp, Homo sapiens
ttattctgtattaaata

SEQ ID NO: 6751645 - DNA, 16 bp, Homo sapiens
ttattctgtggttcta

SEQ ID NO: 6751646 - DNA, 19 bp, Homo sapiens
ttattctgtggttctataa

SEQ ID NO: 6751647 - DNA, 13 bp, Homo sapiens
ttattctgttccc

SEQ ID NO: 6751648 - DNA, 16 bp, Homo sapiens
ttattctgttttgcac

SEQ ID NO: 6751649 - DNA, 16 bp, Homo sapiens
ttattcttattactat

SEQ ID NO: 6751650 - DNA, 17 bp, Homo sapiens
ttattcttattactatt

SEQ ID NO: 6751651 - DNA, 15 bp, Homo sapiens
ttattcttccagaat

SEQ ID NO: 6751652 - DNA, 18 bp, Homo sapiens
ttattcttccagaatgct

SEQ ID NO: 6751653 - DNA, 15 bp, Homo sapiens
ttattcttctcataa

SEQ ID NO: 6751654 - DNA, 14 bp, Homo sapiens
ttattcttgagttt

SEQ ID NO: 6751655 - DNA, 15 bp, Homo sapiens
ttattcttgatgaaa

SEQ ID NO: 6751656 - DNA, 18 bp, Homo sapiens
ttattctttgcaaataaa

SEQ ID NO: 6751657 - DNA, 15 bp, Homo sapiens
ttattcttttccaga

SEQ ID NO: 6751658 - DNA, 13 bp, Homo sapiens
ttattctttttaa

SEQ ID NO: 6751659 - DNA, 16 bp, Homo sapiens
ttattctttttaaagt

SEQ ID NO: 6751660 - DNA, 24 bp, Homo sapiens
ttattgaaaaaaaaaatgttgaga

SEQ ID NO: 6751661 - DNA, 14 bp, Homo sapiens
ttattgaaatagtt

SEQ ID NO: 6751662 - DNA, 13 bp, Homo sapiens
ttattgaagcaga

SEQ ID NO: 6751663 - DNA, 15 bp, Homo sapiens
ttattgaagcagagt

SEQ ID NO: 6751664 - DNA, 16 bp, Homo sapiens
ttattgaagcagagtg

SEQ ID NO: 6751665 - DNA, 22 bp, Homo sapiens
ttattgaagtcttcttatctaa

SEQ ID NO: 6751666 - DNA, 23 bp, Homo sapiens
ttattgaagtcttcttatctaaa

SEQ ID NO: 6751667 - DNA, 18 bp, Homo sapiens
ttattgaagtgaattcct

SEQ ID NO: 6751668 - DNA, 18 bp, Homo sapiens
ttattgaatctatttaag

SEQ ID NO: 6751669 - DNA, 20 bp, Homo sapiens
ttattgaatctatttaagta

SEQ ID NO: 6751670 - DNA, 12 bp, Homo sapiens
ttattgaatgtt

SEQ ID NO: 6751671 - DNA, 16 bp, Homo sapiens
ttattgaattagaaaa

SEQ ID NO: 6751672 - DNA, 14 bp, Homo sapiens
ttattgaatttgtt

SEQ ID NO: 6751673 - DNA, 12 bp, Homo sapiens
ttattgacactg

SEQ ID NO: 6751674 - DNA, 13 bp, Homo sapiens
ttattgacactga

SEQ ID NO: 6751675 - DNA, 15 bp, Homo sapiens
ttattgacactgaac

SEQ ID NO: 6751676 - DNA, 18 bp, Homo sapiens
ttattgacagttgtgcag

SEQ ID NO: 6751677 - DNA, 14 bp, Homo sapiens
ttattgacatcagt

SEQ ID NO: 6751678 - DNA, 23 bp, Homo sapiens
ttattgacgaactggctacagta

SEQ ID NO: 6751679 - DNA, 16 bp, Homo sapiens
ttattgactctgggtc

SEQ ID NO: 6751680 - DNA, 16 bp, Homo sapiens
ttattgactcttgagt

SEQ ID NO: 6751681 - DNA, 23 bp, Homo sapiens
ttattgagattgtcctcatttct

SEQ ID NO: 6751682 - DNA, 19 bp, Homo sapiens
ttattgaggaaaaatatgt

SEQ ID NO: 6751683 - DNA, 23 bp, Homo sapiens
ttattgagtaatattacatttca

SEQ ID NO: 6751684 - DNA, 23 bp, Homo sapiens
ttattgagtctgtccagataagt

SEQ ID NO: 6751685 - DNA, 18 bp, Homo sapiens
ttattgagttctgaaggt

SEQ ID NO: 6751686 - DNA, 15 bp, Homo sapiens
ttattgataagttca

SEQ ID NO: 6751687 - DNA, 19 bp, Homo sapiens
ttattgataagttcataca

SEQ ID NO: 6751688 - DNA, 14 bp, Homo sapiens
ttattgatatatat

SEQ ID NO: 6751689 - DNA, 14 bp, Homo sapiens
ttattgatgaaaat

SEQ ID NO: 6751690 - DNA, 17 bp, Homo sapiens
ttattgatgtgaaatta

SEQ ID NO: 6751691 - DNA, 15 bp, Homo sapiens
ttattgatgttttca

SEQ ID NO: 6751692 - DNA, 18 bp, Homo sapiens
ttattgatttttgtaata

SEQ ID NO: 6751693 - DNA, 21 bp, Homo sapiens
ttattgcaaaatagcatttgt

SEQ ID NO: 6751694 - DNA, 19 bp, Homo sapiens
ttattgcactagagaaaat

SEQ ID NO: 6751695 - DNA, 21 bp, Homo sapiens
ttattgcagtttatcattcaa

SEQ ID NO: 6751696 - DNA, 22 bp, Homo sapiens
ttattgcagtttatcattcaag

SEQ ID NO: 6751697 - DNA, 15 bp, Homo sapiens
ttattgcatatagat

SEQ ID NO: 6751698 - DNA, 17 bp, Homo sapiens
ttattgcatttgctgtt

SEQ ID NO: 6751699 - DNA, 20 bp, Homo sapiens
ttattgccaaaacccagctg

SEQ ID NO: 6751700 - DNA, 22 bp, Homo sapiens
ttattgccaaaacccagctgca

SEQ ID NO: 6751701 - DNA, 15 bp, Homo sapiens
ttattgcccacgctg

SEQ ID NO: 6751702 - DNA, 14 bp, Homo sapiens
ttattgcctctgtc

SEQ ID NO: 6751703 - DNA, 15 bp, Homo sapiens
ttattgcctctgtct

SEQ ID NO: 6751704 - DNA, 18 bp, Homo sapiens
ttattgcctgggcagtgc

SEQ ID NO: 6751705 - DNA, 19 bp, Homo sapiens
ttattgcctgggcagtgcc

SEQ ID NO: 6751706 - DNA, 23 bp, Homo sapiens
ttattgccttctcaccagctgca

SEQ ID NO: 6751707 - DNA, 13 bp, Homo sapiens
ttattgcctttag

SEQ ID NO: 6751708 - DNA, 19 bp, Homo sapiens
ttattgctagtatttgaat

SEQ ID NO: 6751709 - DNA, 20 bp, Homo sapiens
ttattgctagtatttgaatt

SEQ ID NO: 6751710 - DNA, 13 bp, Homo sapiens
ttattgctatatt

SEQ ID NO: 6751711 - DNA, 13 bp, Homo sapiens
ttattgctgccaa

SEQ ID NO: 6751712 - DNA, 14 bp, Homo sapiens
ttattgctgccaaa

SEQ ID NO: 6751713 - DNA, 21 bp, Homo sapiens
ttattgctgccaaaaccacat

SEQ ID NO: 6751714 - DNA, 22 bp, Homo sapiens
ttattgctgccaaaaccacatg

SEQ ID NO: 6751715 - DNA, 14 bp, Homo sapiens
ttattgcttaatcc

SEQ ID NO: 6751716 - DNA, 15 bp, Homo sapiens
ttattgcttaatccc

SEQ ID NO: 6751717 - DNA, 15 bp, Homo sapiens
ttattgcttagtaaa

SEQ ID NO: 6751718 - DNA, 17 bp, Homo sapiens
ttattgcttattgctta

SEQ ID NO: 6751719 - DNA, 20 bp, Homo sapiens
ttattgcttattgcttagta

SEQ ID NO: 6751720 - DNA, 14 bp, Homo sapiens
ttattggaaatgtg

SEQ ID NO: 6751721 - DNA, 13 bp, Homo sapiens
ttattggaattaa

SEQ ID NO: 6751722 - DNA, 14 bp, Homo sapiens
ttattggaattttc

SEQ ID NO: 6751723 - DNA, 19 bp, Homo sapiens
ttattggaattttctttca

SEQ ID NO: 6751724 - DNA, 14 bp, Homo sapiens
ttattggaccagaa

SEQ ID NO: 6751725 - DNA, 20 bp, Homo sapiens
ttattggactccaggcctga

SEQ ID NO: 6751726 - DNA, 19 bp, Homo sapiens
ttattggatgatacagtgt

SEQ ID NO: 6751727 - DNA, 20 bp, Homo sapiens
ttattggatgatacagtgtt

SEQ ID NO: 6751728 - DNA, 13 bp, Homo sapiens
ttattggcaaagt

SEQ ID NO: 6751729 - DNA, 18 bp, Homo sapiens
ttattggcagccaaggaa

SEQ ID NO: 6751730 - DNA, 15 bp, Homo sapiens
ttattggctgagata

SEQ ID NO: 6751731 - DNA, 12 bp, Homo sapiens
ttattggctgct

SEQ ID NO: 6751732 - DNA, 12 bp, Homo sapiens
ttattggctttt

SEQ ID NO: 6751733 - DNA, 21 bp, Homo sapiens
ttattgggatatcattttaaa

SEQ ID NO: 6751734 - DNA, 17 bp, Homo sapiens
ttattgggctcttttag

SEQ ID NO: 6751735 - DNA, 17 bp, Homo sapiens
ttattggtatatttgta

SEQ ID NO: 6751736 - DNA, 20 bp, Homo sapiens
ttattggtatatttgtagat

SEQ ID NO: 6751737 - DNA, 13 bp, Homo sapiens
ttcaactctgtga

SEQ ID NO: 6751738 - DNA, 14 bp, Homo sapiens
ttcaactgaaaaga

SEQ ID NO: 6751739 - DNA, 21 bp, Homo sapiens
ttcaactgccaaaatgctcta

SEQ ID NO: 6751740 - DNA, 17 bp, Homo sapiens
ttcaactgctgtaaaat

SEQ ID NO: 6751741 - DNA, 12 bp, Homo sapiens
ttcaactggctg

SEQ ID NO: 6751742 - DNA, 22 bp, Homo sapiens
ttcaactgtataccgtgtgctc

SEQ ID NO: 6751743 - DNA, 13 bp, Homo sapiens
ttcaactgtttca

SEQ ID NO: 6751744 - DNA, 17 bp, Homo sapiens
ttcaacttaaatcactg

SEQ ID NO: 6751745 - DNA, 16 bp, Homo sapiens
ttcaacttatttcata

SEQ ID NO: 6751746 - DNA, 18 bp, Homo sapiens
ttcaacttatttcataat

SEQ ID NO: 6751747 - DNA, 20 bp, Homo sapiens
ttcaacttcttctatatcca

SEQ ID NO: 6751748 - DNA, 13 bp, Homo sapiens
ttcaactttgaat

SEQ ID NO: 6751749 - DNA, 15 bp, Homo sapiens
ttcaactttgaataa

SEQ ID NO: 6751750 - DNA, 19 bp, Homo sapiens
ttcaactttgaataaagaa

SEQ ID NO: 6751751 - DNA, 22 bp, Homo sapiens
ttcaagaaaacaacttcaatat

SEQ ID NO: 6751752 - DNA, 16 bp, Homo sapiens
ttcaagaaaactggaa

SEQ ID NO: 6751753 - DNA, 17 bp, Homo sapiens
ttcaagaaaactggaaa

SEQ ID NO: 6751754 - DNA, 15 bp, Homo sapiens
ttcaagaaaatcttt

SEQ ID NO: 6751755 - DNA, 22 bp, Homo sapiens
ttcaagaaaatctttgttgaag

SEQ ID NO: 6751756 - DNA, 21 bp, Homo sapiens
ttcaagaaaattttgcagaag

SEQ ID NO: 6751757 - DNA, 22 bp, Homo sapiens
ttcaagaaagcttcaaactgca

SEQ ID NO: 6751758 - DNA, 19 bp, Homo sapiens
ttcaagaaatgaagagctg

SEQ ID NO: 6751759 - DNA, 14 bp, Homo sapiens
ttcaagaaatgaca

SEQ ID NO: 6751760 - DNA, 15 bp, Homo sapiens
ttcaagaagtaatca

SEQ ID NO: 6751761 - DNA, 23 bp, Homo sapiens
ttcaagaatgcagtactaacatt

SEQ ID NO: 6751762 - DNA, 16 bp, Homo sapiens
ttcaagaatgtttcag

SEQ ID NO: 6751763 - DNA, 18 bp, Homo sapiens
ttcaagaatgtttcagtt

SEQ ID NO: 6751764 - DNA, 17 bp, Homo sapiens
ttcaagacaagagctgt

SEQ ID NO: 6751765 - DNA, 21 bp, Homo sapiens
ttcaagacatcaccatcagca

SEQ ID NO: 6751766 - DNA, 14 bp, Homo sapiens
ttcaagaccagcct

SEQ ID NO: 6751767 - DNA, 21 bp, Homo sapiens
ttcaagaccagcctggccaac

SEQ ID NO: 6751768 - DNA, 13 bp, Homo sapiens
ttcaagactgaaa

SEQ ID NO: 6751769 - DNA, 18 bp, Homo sapiens
ttcaagactgaaatggct

SEQ ID NO: 6751770 - DNA, 23 bp, Homo sapiens
ttcaagagctagaaaaataaaat

SEQ ID NO: 6751771 - DNA, 22 bp, Homo sapiens
ttcaagaggaaaggcgcccccg

SEQ ID NO: 6751772 - DNA, 23 bp, Homo sapiens
ttcaagaggagcccccaccctgt

SEQ ID NO: 6751773 - DNA, 21 bp, Homo sapiens
ttcaagagtgcagttgattct

SEQ ID NO: 6751774 - DNA, 19 bp, Homo sapiens
ttcaagagtggggggagga

SEQ ID NO: 6751775 - DNA, 20 bp, Homo sapiens
ttcaagatacatttcatctg

SEQ ID NO: 6751776 - DNA, 20 bp, Homo sapiens
ttcaagatcctcttgccaca

SEQ ID NO: 6751777 - DNA, 14 bp, Homo sapiens
ttcaagatcttcaa

SEQ ID NO: 6751778 - DNA, 16 bp, Homo sapiens
ttcaagatgcctcttc

SEQ ID NO: 6751779 - DNA, 22 bp, Homo sapiens
ttcaagatgttatattaaagaa

SEQ ID NO: 6751780 - DNA, 11 bp, Homo sapiens
ttcaagattcc

SEQ ID NO: 6751781 - DNA, 13 bp, Homo sapiens
ttcaagattctaa

SEQ ID NO: 6751782 - DNA, 17 bp, Homo sapiens
ttcaagattctaaagct

SEQ ID NO: 6751783 - DNA, 12 bp, Homo sapiens
ttcaagcaaaca

SEQ ID NO: 6751784 - DNA, 15 bp, Homo sapiens
ttcaagcaaacatca

SEQ ID NO: 6751785 - DNA, 20 bp, Homo sapiens
ttcaagcaaagacagtttct

SEQ ID NO: 6751786 - DNA, 21 bp, Homo sapiens
ttcaagcaaagacagtttctt

SEQ ID NO: 6751787 - DNA, 11 bp, Homo sapiens
ttcaagcaaat

SEQ ID NO: 6751788 - DNA, 12 bp, Homo sapiens
ttcaagcaaata

SEQ ID NO: 6751789 - DNA, 14 bp, Homo sapiens
ttcaagcaacagca

SEQ ID NO: 6751790 - DNA, 14 bp, Homo sapiens
ttcaagcaatcctc

SEQ ID NO: 6751791 - DNA, 19 bp, Homo sapiens
ttcaagcaatcctcctacc

SEQ ID NO: 6751792 - DNA, 17 bp, Homo sapiens
ttcaagcacactggaat

SEQ ID NO: 6751793 - DNA, 22 bp, Homo sapiens
ttcaagcagtcgtgcctgtgtc

SEQ ID NO: 6751794 - DNA, 12 bp, Homo sapiens
ttcaagccatgg

SEQ ID NO: 6751795 - DNA, 18 bp, Homo sapiens
ttcaagccattctgcctc

SEQ ID NO: 6751796 - DNA, 15 bp, Homo sapiens
ttcaagcccaggctt

SEQ ID NO: 6751797 - DNA, 15 bp, Homo sapiens
ttcaagcctctaaac

SEQ ID NO: 6751798 - DNA, 11 bp, Homo sapiens
ttcaagcctgg

SEQ ID NO: 6751799 - DNA, 17 bp, Homo sapiens
ttcaagcgattctcctg

SEQ ID NO: 6751800 - DNA, 18 bp, Homo sapiens
ttcaagcgattctcctgc

SEQ ID NO: 6751801 - DNA, 22 bp, Homo sapiens
ttcaagctattctcatgcctca

SEQ ID NO: 6751802 - DNA, 10 bp, Homo sapiens
ttcaagctga

SEQ ID NO: 6751803 - DNA, 17 bp, Homo sapiens
ttcaagctgctttttgt

SEQ ID NO: 6751804 - DNA, 16 bp, Homo sapiens
ttcaagcttttccttt

SEQ ID NO: 6751805 - DNA, 16 bp, Homo sapiens
ttcaaggaaaaatgct

SEQ ID NO: 6751806 - DNA, 15 bp, Homo sapiens
ttcaaggaaaataag

SEQ ID NO: 6751807 - DNA, 17 bp, Homo sapiens
ttcaaggaaaataagtg

SEQ ID NO: 6751808 - DNA, 20 bp, Homo sapiens
ttcaaggaacttgaaaaata

SEQ ID NO: 6751809 - DNA, 11 bp, Homo sapiens
ttcaaggaagg

SEQ ID NO: 6751810 - DNA, 22 bp, Homo sapiens
ttcaaggaatagagttttcctc

SEQ ID NO: 6751811 - DNA, 12 bp, Homo sapiens
ttcaaggaatca

SEQ ID NO: 6751812 - DNA, 16 bp, Homo sapiens
ttcaaggaatttctta

SEQ ID NO: 6751813 - DNA, 17 bp, Homo sapiens
ttcaaggaatttcttaa

SEQ ID NO: 6751814 - DNA, 18 bp, Homo sapiens
ttcaaggagaatatgata

SEQ ID NO: 6751815 - DNA, 19 bp, Homo sapiens
ttcaaggagatataaaatc

SEQ ID NO: 6751816 - DNA, 23 bp, Homo sapiens
ttcaaggaggcccactgtgtcta

SEQ ID NO: 6751817 - DNA, 15 bp, Homo sapiens
ttcaaggatcctgag

SEQ ID NO: 6751818 - DNA, 21 bp, Homo sapiens
ttcaaggatcctgagccagat

SEQ ID NO: 6751819 - DNA, 20 bp, Homo sapiens
ttcaaggcacattgaaatac

SEQ ID NO: 6751820 - DNA, 22 bp, Homo sapiens
ttcaaggcacattgaaatactt

SEQ ID NO: 6751821 - DNA, 11 bp, Homo sapiens
ttcaaggcatt

SEQ ID NO: 6751822 - DNA, 11 bp, Homo sapiens
ttcaaggccaa

SEQ ID NO: 6751823 - DNA, 18 bp, Homo sapiens
ttcaaggccacaaaaaca

SEQ ID NO: 6751824 - DNA, 16 bp, Homo sapiens
ttcaaggccatatttt

SEQ ID NO: 6751825 - DNA, 13 bp, Homo sapiens
ttcaaggcctccc

SEQ ID NO: 6751826 - DNA, 20 bp, Homo sapiens
ttcaaggccttcagtttatt

SEQ ID NO: 6751827 - DNA, 19 bp, Homo sapiens
ttcaaggctcttcttcctc

SEQ ID NO: 6751828 - DNA, 13 bp, Homo sapiens
ttcaaggctgggg

SEQ ID NO: 6751829 - DNA, 15 bp, Homo sapiens
ttcaagggaagaaac

SEQ ID NO: 6751830 - DNA, 17 bp, Homo sapiens
ttcaagggacaagtatt

SEQ ID NO: 6751831 - DNA, 16 bp, Homo sapiens
ttcaagggctgcttca

SEQ ID NO: 6751832 - DNA, 19 bp, Homo sapiens
ttcaagggttgcttctgag

SEQ ID NO: 6751833 - DNA, 17 bp, Homo sapiens
ttcaaggtcatttactt

SEQ ID NO: 6751834 - DNA, 23 bp, Homo sapiens
ttcaaggtccgagctctgtcctc

SEQ ID NO: 6751835 - DNA, 18 bp, Homo sapiens
ttcaaggtggccaaatta

SEQ ID NO: 6751836 - DNA, 20 bp, Homo sapiens
ttcaaggtggccaaattatt

SEQ ID NO: 6751837 - DNA, 22 bp, Homo sapiens
ttcaaggtggccaaattatttg

SEQ ID NO: 6751838 - DNA, 14 bp, Homo sapiens
ttcaaggtgtaaaa

SEQ ID NO: 6751839 - DNA, 19 bp, Homo sapiens
ttcaagtaataaaacaatg

SEQ ID NO: 6751840 - DNA, 18 bp, Homo sapiens
ttcaagtaattctgctgt

SEQ ID NO: 6751841 - DNA, 14 bp, Homo sapiens
ttcaagtaattttc

SEQ ID NO: 6751842 - DNA, 21 bp, Homo sapiens
ttcaagtaattttcatattaa

SEQ ID NO: 6751843 - DNA, 21 bp, Homo sapiens
ttcaagtattaggggtaatat

SEQ ID NO: 6751844 - DNA, 16 bp, Homo sapiens
ttcaagtcacctcctt

SEQ ID NO: 6751845 - DNA, 20 bp, Homo sapiens
ttcaagtctgtgcctggagc

SEQ ID NO: 6751846 - DNA, 18 bp, Homo sapiens
ttcaagtgatatatgtat

SEQ ID NO: 6751847 - DNA, 19 bp, Homo sapiens
ttcaagtgatatatgtatt

SEQ ID NO: 6751848 - DNA, 18 bp, Homo sapiens
ttcaagtgatctttcaat

SEQ ID NO: 6751849 - DNA, 20 bp, Homo sapiens
ttcaagtgatggtcattcat

SEQ ID NO: 6751850 - DNA, 16 bp, Homo sapiens
ttcaagtgcaatccat

SEQ ID NO: 6751851 - DNA, 22 bp, Homo sapiens
ttcaagtgcatgctctctgcag

SEQ ID NO: 6751852 - DNA, 12 bp, Homo sapiens
ttcaagtgccaa

SEQ ID NO: 6751853 - DNA, 15 bp, Homo sapiens
ttcaagtgcctagac

SEQ ID NO: 6751854 - DNA, 17 bp, Homo sapiens
ttcaagtgcctcttgtt

SEQ ID NO: 6751855 - DNA, 21 bp, Homo sapiens
ttcaagtgcctttctgcagtt

SEQ ID NO: 6751856 - DNA, 18 bp, Homo sapiens
ttcaagtgcttctccagc

SEQ ID NO: 6751857 - DNA, 22 bp, Homo sapiens
ttcaagtggggctcgccatgcc

SEQ ID NO: 6751858 - DNA, 17 bp, Homo sapiens
ttcaagttaaattttat

SEQ ID NO: 6751859 - DNA, 16 bp, Homo sapiens
ttcaagttagctcagg

SEQ ID NO: 6751860 - DNA, 17 bp, Homo sapiens
ttcaagttagctcagga

SEQ ID NO: 6751861 - DNA, 17 bp, Homo sapiens
ttcaagttattcaaatt

SEQ ID NO: 6751862 - DNA, 16 bp, Homo sapiens
ttcaagttattcagaa

SEQ ID NO: 6751863 - DNA, 20 bp, Homo sapiens
ttcaagttattcagaaatat

SEQ ID NO: 6751864 - DNA, 17 bp, Homo sapiens
ttcaagttattgtacag

SEQ ID NO: 6751865 - DNA, 23 bp, Homo sapiens
ttcaagttccaagttgctaatac

SEQ ID NO: 6751866 - DNA, 14 bp, Homo sapiens
ttcaagttgcattc

SEQ ID NO: 6751867 - DNA, 19 bp, Homo sapiens
ttcaagttgtaaaaatgaa

SEQ ID NO: 6751868 - DNA, 16 bp, Homo sapiens
ttcaagttgtgtctga

SEQ ID NO: 6751869 - DNA, 13 bp, Homo sapiens
ttcaagtttacac

SEQ ID NO: 6751870 - DNA, 19 bp, Homo sapiens
ttcaagtttagtgcatgca

SEQ ID NO: 6751871 - DNA, 20 bp, Homo sapiens
ttcaagttttgggtatgttt

SEQ ID NO: 6751872 - DNA, 24 bp, Homo sapiens
ttcaagtttttcatactgtacaca

SEQ ID NO: 6751873 - DNA, 17 bp, Homo sapiens
ttcaataaaatgcactg

SEQ ID NO: 6751874 - DNA, 21 bp, Homo sapiens
ttcaataaaatgcactgacca

SEQ ID NO: 6751875 - DNA, 13 bp, Homo sapiens
ttcaataaaccac

SEQ ID NO: 6751876 - DNA, 21 bp, Homo sapiens
ttcaataaaccacaagcatct

SEQ ID NO: 6751877 - DNA, 21 bp, Homo sapiens
ttcaataaagaaaaaaatagt

SEQ ID NO: 6751878 - DNA, 19 bp, Homo sapiens
ttcaataaagcactgagca

SEQ ID NO: 6751879 - DNA, 17 bp, Homo sapiens
ttcaataaagcagttaa

SEQ ID NO: 6751880 - DNA, 20 bp, Homo sapiens
ttcaataaagcatttataaa

SEQ ID NO: 6751881 - DNA, 12 bp, Homo sapiens
ttcaataaagta

SEQ ID NO: 6751882 - DNA, 14 bp, Homo sapiens
ttcaataaagtatc

SEQ ID NO: 6751883 - DNA, 19 bp, Homo sapiens
ttcaataaagtatctacat

SEQ ID NO: 6751884 - DNA, 18 bp, Homo sapiens
ttcaataaagttgttgca

SEQ ID NO: 6751885 - DNA, 21 bp, Homo sapiens
ttcaataaagttgttgcattc

SEQ ID NO: 6751886 - DNA, 14 bp, Homo sapiens
ttcaataaagtttg

SEQ ID NO: 6751887 - DNA, 16 bp, Homo sapiens
ttcaataaagtttgat

SEQ ID NO: 6751888 - DNA, 21 bp, Homo sapiens
ttcaataaagtttgatcttcc

SEQ ID NO: 6751889 - DNA, 16 bp, Homo sapiens
ttcaataaagtttgta

SEQ ID NO: 6751890 - DNA, 19 bp, Homo sapiens
ttcaataaatctttggaaa

SEQ ID NO: 6751891 - DNA, 12 bp, Homo sapiens
ttcaataactgg

SEQ ID NO: 6751892 - DNA, 15 bp, Homo sapiens
ttcaataagagatta

SEQ ID NO: 6751893 - DNA, 20 bp, Homo sapiens
ttcaataagcatcaaactct

SEQ ID NO: 6751894 - DNA, 19 bp, Homo sapiens
ttcaataagtgttgtacca

SEQ ID NO: 6751895 - DNA, 16 bp, Homo sapiens
ttcaataataaatatt

SEQ ID NO: 6751896 - DNA, 16 bp, Homo sapiens
ttcaatacaaaaagcc

SEQ ID NO: 6751897 - DNA, 13 bp, Homo sapiens
ttcaatacaaaca

SEQ ID NO: 6751898 - DNA, 22 bp, Homo sapiens
ttcaatacaaacaatctcttaa

SEQ ID NO: 6751899 - DNA, 14 bp, Homo sapiens
ttcaatacagatat

SEQ ID NO: 6751900 - DNA, 18 bp, Homo sapiens
ttcaatacagatatattt

SEQ ID NO: 6751901 - DNA, 21 bp, Homo sapiens
ttcaatacagtgaaggtcttt

SEQ ID NO: 6751902 - DNA, 15 bp, Homo sapiens
ttcaataccgctcag

SEQ ID NO: 6751903 - DNA, 17 bp, Homo sapiens
ttcaataccgctcagta

SEQ ID NO: 6751904 - DNA, 18 bp, Homo sapiens
ttcaatactcttgaaatg

SEQ ID NO: 6751905 - DNA, 22 bp, Homo sapiens
ttcaatactgtatgccttctgt

SEQ ID NO: 6751906 - DNA, 14 bp, Homo sapiens
ttcaatagaactgt

SEQ ID NO: 6751907 - DNA, 17 bp, Homo sapiens
ttcaatagcacatatgg

SEQ ID NO: 6751908 - DNA, 15 bp, Homo sapiens
ttcaatagccactaa

SEQ ID NO: 6751909 - DNA, 23 bp, Homo sapiens
ttcaatagccactaaccttgcct

SEQ ID NO: 6751910 - DNA, 18 bp, Homo sapiens
ttcaatagtaatataata

SEQ ID NO: 6751911 - DNA, 16 bp, Homo sapiens
ttcaatataagaagca

SEQ ID NO: 6751912 - DNA, 16 bp, Homo sapiens
ttcaatatatttgtat

SEQ ID NO: 6751913 - DNA, 16 bp, Homo sapiens
ttcaatatcattacta

SEQ ID NO: 6751914 - DNA, 15 bp, Homo sapiens
ttcaatatcctttgc

SEQ ID NO: 6751915 - DNA, 20 bp, Homo sapiens
ttcagagactgcccttctca

SEQ ID NO: 6751916 - DNA, 21 bp, Homo sapiens
ttcagagactgcccttctcac

SEQ ID NO: 6751917 - DNA, 21 bp, Homo sapiens
ttcagagagcagtgcttttgg

SEQ ID NO: 6751918 - DNA, 19 bp, Homo sapiens
ttcagagagctaaattaca

SEQ ID NO: 6751919 - DNA, 13 bp, Homo sapiens
ttcagagagctgg

SEQ ID NO: 6751920 - DNA, 14 bp, Homo sapiens
ttcagagagctggt

SEQ ID NO: 6751921 - DNA, 20 bp, Homo sapiens
ttcagagagggcagaggggt

SEQ ID NO: 6751922 - DNA, 17 bp, Homo sapiens
ttcagagagtcaatgtc

SEQ ID NO: 6751923 - DNA, 23 bp, Homo sapiens
ttcagagagtcaatgtcattaca

SEQ ID NO: 6751924 - DNA, 23 bp, Homo sapiens
ttcagagatttatataaatgtaa

SEQ ID NO: 6751925 - DNA, 16 bp, Homo sapiens
ttcagagcaagttcct

SEQ ID NO: 6751926 - DNA, 17 bp, Homo sapiens
ttcagagcaggaggccg

SEQ ID NO: 6751927 - DNA, 22 bp, Homo sapiens
ttcagagccaagccttaaactg

SEQ ID NO: 6751928 - DNA, 23 bp, Homo sapiens
ttcagagccaagccttaaactgt

SEQ ID NO: 6751929 - DNA, 13 bp, Homo sapiens
ttcagagccctcg

SEQ ID NO: 6751930 - DNA, 23 bp, Homo sapiens
ttcagagcctagccacctcccac

SEQ ID NO: 6751931 - DNA, 22 bp, Homo sapiens
ttcagagctgccctctcctggg

SEQ ID NO: 6751932 - DNA, 23 bp, Homo sapiens
ttcagagctgccctctcctgggc

SEQ ID NO: 6751933 - DNA, 16 bp, Homo sapiens
ttcagaggaagcacat

SEQ ID NO: 6751934 - DNA, 20 bp, Homo sapiens
ttcagaggagcatcagctgt

SEQ ID NO: 6751935 - DNA, 19 bp, Homo sapiens
ttcagaggagccagaagta

SEQ ID NO: 6751936 - DNA, 22 bp, Homo sapiens
ttcagaggctcagattgtaata

SEQ ID NO: 6751937 - DNA, 17 bp, Homo sapiens
ttcagaggctcatctaa

SEQ ID NO: 6751938 - DNA, 13 bp, Homo sapiens
ttcagaggtcact

SEQ ID NO: 6751939 - DNA, 22 bp, Homo sapiens
ttcagagtacgtcctgcctggc

SEQ ID NO: 6751940 - DNA, 23 bp, Homo sapiens
ttcagagtacgtcctgcctggca

SEQ ID NO: 6751941 - DNA, 13 bp, Homo sapiens
ttcagagtggctc

SEQ ID NO: 6751942 - DNA, 21 bp, Homo sapiens
ttcagagttctttttgaagta

SEQ ID NO: 6751943 - DNA, 23 bp, Homo sapiens
ttcagagttctttttgaagtatt

SEQ ID NO: 6751944 - DNA, 21 bp, Homo sapiens
ttcagagttgatggttgtaca

SEQ ID NO: 6751945 - DNA, 16 bp, Homo sapiens
ttcagagtttgtgtgt

SEQ ID NO: 6751946 - DNA, 17 bp, Homo sapiens
ttcagagtttgtgtgta

SEQ ID NO: 6751947 - DNA, 14 bp, Homo sapiens
ttcagagttttcta

SEQ ID NO: 6751948 - DNA, 16 bp, Homo sapiens
ttcagataaatcatgg

SEQ ID NO: 6751949 - DNA, 18 bp, Homo sapiens
ttcagataaatcatgggc

SEQ ID NO: 6751950 - DNA, 17 bp, Homo sapiens
ttcagataatgatggaa

SEQ ID NO: 6751951 - DNA, 18 bp, Homo sapiens
ttcagatacttgtgaaca

SEQ ID NO: 6751952 - DNA, 20 bp, Homo sapiens
ttcagatacttgtgaacatg

SEQ ID NO: 6751953 - DNA, 14 bp, Homo sapiens
ttcagatataaata

SEQ ID NO: 6751954 - DNA, 14 bp, Homo sapiens
ttcagatatcaaaa

SEQ ID NO: 6751955 - DNA, 19 bp, Homo sapiens
ttcagatatcaaaattcta

SEQ ID NO: 6751956 - DNA, 18 bp, Homo sapiens
ttcagatatgattcaaat

SEQ ID NO: 6751957 - DNA, 18 bp, Homo sapiens
ttcagatattattgcttt

SEQ ID NO: 6751958 - DNA, 15 bp, Homo sapiens
ttcagatcactgaat

SEQ ID NO: 6751959 - DNA, 12 bp, Homo sapiens
ttcagatcctac

SEQ ID NO: 6751960 - DNA, 14 bp, Homo sapiens
ttcagatcctaccc

SEQ ID NO: 6751961 - DNA, 13 bp, Homo sapiens
ttcagatcgtatt

SEQ ID NO: 6751962 - DNA, 11 bp, Homo sapiens
ttcagatgagg

SEQ ID NO: 6751963 - DNA, 21 bp, Homo sapiens
ttcagatgggaggaaagagag

SEQ ID NO: 6751964 - DNA, 15 bp, Homo sapiens
ttcagatgtaatgtt

SEQ ID NO: 6751965 - DNA, 18 bp, Homo sapiens
ttcagatgtaatgttttc

SEQ ID NO: 6751966 - DNA, 21 bp, Homo sapiens
ttcagatgtacacccacccac

SEQ ID NO: 6751967 - DNA, 17 bp, Homo sapiens
ttcagatgtcttctgcc

SEQ ID NO: 6751968 - DNA, 14 bp, Homo sapiens
ttcagatgtgcaat

SEQ ID NO: 6751969 - DNA, 18 bp, Homo sapiens
ttcagatgtgcaataatt

SEQ ID NO: 6751970 - DNA, 23 bp, Homo sapiens
ttcagatgtgcaataatttgtac

SEQ ID NO: 6751971 - DNA, 15 bp, Homo sapiens
ttcagatgtgcattt

SEQ ID NO: 6751972 - DNA, 22 bp, Homo sapiens
ttcagatgtttcatcaatgcag

SEQ ID NO: 6751973 - DNA, 13 bp, Homo sapiens
ttcagatgtttcc

SEQ ID NO: 6751974 - DNA, 14 bp, Homo sapiens
ttcagatgtttcca

SEQ ID NO: 6751975 - DNA, 15 bp, Homo sapiens
ttcagattaaaaaaa

SEQ ID NO: 6751976 - DNA, 18 bp, Homo sapiens
ttcagattaggacacagt

SEQ ID NO: 6751977 - DNA, 14 bp, Homo sapiens
ttcagattcccaga

SEQ ID NO: 6751978 - DNA, 22 bp, Homo sapiens
ttcagattcccagagcaaaata

SEQ ID NO: 6751979 - DNA, 14 bp, Homo sapiens
ttcagattgtaaag

SEQ ID NO: 6751980 - DNA, 12 bp, Homo sapiens
ttcagattgtat

SEQ ID NO: 6751981 - DNA, 23 bp, Homo sapiens
ttcagattgtatctgaactcaca

SEQ ID NO: 6751982 - DNA, 20 bp, Homo sapiens
ttcagatttaccataatgtt

SEQ ID NO: 6751983 - DNA, 15 bp, Homo sapiens
ttcagatttcaaatt

SEQ ID NO: 6751984 - DNA, 16 bp, Homo sapiens
ttcagatttgcacaaa

SEQ ID NO: 6751985 - DNA, 18 bp, Homo sapiens
ttcagatttgcacaaaaa

SEQ ID NO: 6751986 - DNA, 19 bp, Homo sapiens
ttcagattttaaaaagggt

SEQ ID NO: 6751987 - DNA, 14 bp, Homo sapiens
ttcagattttactg

SEQ ID NO: 6751988 - DNA, 21 bp, Homo sapiens
ttcagattttactgtctatgg

SEQ ID NO: 6751989 - DNA, 19 bp, Homo sapiens
ttcagcaaactaaccagca

SEQ ID NO: 6751990 - DNA, 15 bp, Homo sapiens
ttcagcaaacttgtt

SEQ ID NO: 6751991 - DNA, 22 bp, Homo sapiens
ttcagcaaacttgttgaattta

SEQ ID NO: 6751992 - DNA, 19 bp, Homo sapiens
ttcagcaaagtggttccct

SEQ ID NO: 6751993 - DNA, 21 bp, Homo sapiens
ttcagcaaccctacagtatat

SEQ ID NO: 6751994 - DNA, 23 bp, Homo sapiens
ttcagcaaccctacagtatataa

SEQ ID NO: 6751995 - DNA, 13 bp, Homo sapiens
ttcagcaagacaa

SEQ ID NO: 6751996 - DNA, 21 bp, Homo sapiens
ttcagcaaggcgctaacttgc

SEQ ID NO: 6751997 - DNA, 20 bp, Homo sapiens
ttcagcaagtagagcagagt

SEQ ID NO: 6751998 - DNA, 19 bp, Homo sapiens
ttcagcaagttagaactag

SEQ ID NO: 6751999 - DNA, 18 bp, Homo sapiens
ttcagcaatatttaagga

SEQ ID NO: 6752000 - DNA, 19 bp, Homo sapiens
ttcagcaattaaagacatt

SEQ ID NO: 6752001 - DNA, 10 bp, Homo sapiens
ttcagcacac

SEQ ID NO: 6752002 - DNA, 18 bp, Homo sapiens
ttcagcacaccccaaggg

SEQ ID NO: 6752003 - DNA, 21 bp, Homo sapiens
ttcagcacaccccaagggaca

SEQ ID NO: 6752004 - DNA, 22 bp, Homo sapiens
ttcagcaccaagcatgtcccag

SEQ ID NO: 6752005 - DNA, 17 bp, Homo sapiens
ttcagcactagccaaac

SEQ ID NO: 6752006 - DNA, 15 bp, Homo sapiens
ttcagcactcagaaa

SEQ ID NO: 6752007 - DNA, 15 bp, Homo sapiens
ttcagcactgtccct

SEQ ID NO: 6752008 - DNA, 16 bp, Homo sapiens
ttcagcactgtccctt

SEQ ID NO: 6752009 - DNA, 20 bp, Homo sapiens
ttcagcactgtcccttgcct

SEQ ID NO: 6752010 - DNA, 19 bp, Homo sapiens
ttcagcacttaactacttt

SEQ ID NO: 6752011 - DNA, 15 bp, Homo sapiens
ttcagcacttgtctc

SEQ ID NO: 6752012 - DNA, 23 bp, Homo sapiens
ttcagcactttagaatatgcctt

SEQ ID NO: 6752013 - DNA, 19 bp, Homo sapiens
ttcagcagaatgactctgg

SEQ ID NO: 6752014 - DNA, 13 bp, Homo sapiens
ttcagcagactgg

SEQ ID NO: 6752015 - DNA, 20 bp, Homo sapiens
ttcagcagcaaattttcagc

SEQ ID NO: 6752016 - DNA, 17 bp, Homo sapiens
ttcagcaggcccaagta

SEQ ID NO: 6752017 - DNA, 19 bp, Homo sapiens
ttcagcaggctagacagaa

SEQ ID NO: 6752018 - DNA, 16 bp, Homo sapiens
ttcagcagtcaataca

SEQ ID NO: 6752019 - DNA, 19 bp, Homo sapiens
ttcagcagtcagtccccca

SEQ ID NO: 6752020 - DNA, 16 bp, Homo sapiens
ttcagcagtctaaatt

SEQ ID NO: 6752021 - DNA, 20 bp, Homo sapiens
ttcagcatagaaggaagtgt

SEQ ID NO: 6752022 - DNA, 16 bp, Homo sapiens
ttcagcatatttatag

SEQ ID NO: 6752023 - DNA, 16 bp, Homo sapiens
ttcagcatcaaacatg

SEQ ID NO: 6752024 - DNA, 23 bp, Homo sapiens
ttcagcatccgcaggtgctggtc

SEQ ID NO: 6752025 - DNA, 20 bp, Homo sapiens
ttcagcatcgtgtgggtccc

SEQ ID NO: 6752026 - DNA, 21 bp, Homo sapiens
ttcagcatctgacctctacct

SEQ ID NO: 6752027 - DNA, 16 bp, Homo sapiens
ttcagcattaggcttt

SEQ ID NO: 6752028 - DNA, 18 bp, Homo sapiens
ttcagcattaggctttta

SEQ ID NO: 6752029 - DNA, 16 bp, Homo sapiens
ttcagcattccctccc

SEQ ID NO: 6752030 - DNA, 22 bp, Homo sapiens
ttcagcatttgatttccatggg

SEQ ID NO: 6752031 - DNA, 10 bp, Homo sapiens
ttcagccaag

SEQ ID NO: 6752032 - DNA, 14 bp, Homo sapiens
ttcagccaagaatt

SEQ ID NO: 6752033 - DNA, 19 bp, Homo sapiens
ttcagccaatctggacact

SEQ ID NO: 6752034 - DNA, 14 bp, Homo sapiens
ttcagccaatttgt

SEQ ID NO: 6752035 - DNA, 18 bp, Homo sapiens
ttcagccaatttgtctcc

SEQ ID NO: 6752036 - DNA, 15 bp, Homo sapiens
ttcagccacatgccc

SEQ ID NO: 6752037 - DNA, 23 bp, Homo sapiens
ttcagccacatgccccaggctct

SEQ ID NO: 6752038 - DNA, 18 bp, Homo sapiens
ttcagccaccagcccctg

SEQ ID NO: 6752039 - DNA, 16 bp, Homo sapiens
ttcagccactaagaac

SEQ ID NO: 6752040 - DNA, 13 bp, Homo sapiens
ttcagccaggagc

SEQ ID NO: 6752041 - DNA, 17 bp, Homo sapiens
ttcagccaggagctggg

SEQ ID NO: 6752042 - DNA, 11 bp, Homo sapiens
ttcagccaggt

SEQ ID NO: 6752043 - DNA, 14 bp, Homo sapiens
ttcagccaggtctg

SEQ ID NO: 6752044 - DNA, 20 bp, Homo sapiens
ttcagccaggtctgactcca

SEQ ID NO: 6752045 - DNA, 12 bp, Homo sapiens
ttcagcccacca

SEQ ID NO: 6752046 - DNA, 20 bp, Homo sapiens
ttcagcccaccagccacctc

SEQ ID NO: 6752047 - DNA, 13 bp, Homo sapiens
ttcagcccccagc

SEQ ID NO: 6752048 - DNA, 22 bp, Homo sapiens
ttcagcccccatcacccaagcc

SEQ ID NO: 6752049 - DNA, 17 bp, Homo sapiens
ttcagcccctcctctgc

SEQ ID NO: 6752050 - DNA, 20 bp, Homo sapiens
ttcagcccctcctctgccac

SEQ ID NO: 6752051 - DNA, 11 bp, Homo sapiens
ttcagcccctg

SEQ ID NO: 6752052 - DNA, 17 bp, Homo sapiens
ttcagcccctgatctct

SEQ ID NO: 6752053 - DNA, 20 bp, Homo sapiens
ttcagcccctgatctctgac

SEQ ID NO: 6752054 - DNA, 11 bp, Homo sapiens
ttcagcccctt

SEQ ID NO: 6752055 - DNA, 16 bp, Homo sapiens
ttcagccctcacccct

SEQ ID NO: 6752056 - DNA, 11 bp, Homo sapiens
ttcagccctgg

SEQ ID NO: 6752057 - DNA, 13 bp, Homo sapiens
ttcagccctggcc

SEQ ID NO: 6752058 - DNA, 20 bp, Homo sapiens
ttcagcctactgcctcggat

SEQ ID NO: 6752059 - DNA, 20 bp, Homo sapiens
ttcagcctagccgacctcag

SEQ ID NO: 6752060 - DNA, 22 bp, Homo sapiens
ttcagcctagccgacctcagcc

SEQ ID NO: 6752061 - DNA, 13 bp, Homo sapiens
ttcagcctcctgt

SEQ ID NO: 6752062 - DNA, 14 bp, Homo sapiens
ttcagcctgccttc

SEQ ID NO: 6752063 - DNA, 19 bp, Homo sapiens
ttcagcctggccatcccca

SEQ ID NO: 6752064 - DNA, 13 bp, Homo sapiens
ttcagcctggcct

SEQ ID NO: 6752065 - DNA, 14 bp, Homo sapiens
ttcagcctggcctg

SEQ ID NO: 6752066 - DNA, 13 bp, Homo sapiens
ttcagccttcaat

SEQ ID NO: 6752067 - DNA, 13 bp, Homo sapiens
ttcagccttggga

SEQ ID NO: 6752068 - DNA, 21 bp, Homo sapiens
ttcagcgcccccaggcctgcc

SEQ ID NO: 6752069 - DNA, 20 bp, Homo sapiens
ttcagctagcttttaggaaa

SEQ ID NO: 6752070 - DNA, 14 bp, Homo sapiens
ttcagctaggaaca

SEQ ID NO: 6752071 - DNA, 17 bp, Homo sapiens
ttcagctatacctgcac

SEQ ID NO: 6752072 - DNA, 22 bp, Homo sapiens
ttcagctcaactcacagcttct

SEQ ID NO: 6752073 - DNA, 14 bp, Homo sapiens
ttcagctcacgctt

SEQ ID NO: 6752074 - DNA, 14 bp, Homo sapiens
ttcagctcactgca

SEQ ID NO: 6752075 - DNA, 19 bp, Homo sapiens
ttcagctcattatgaaaaa

SEQ ID NO: 6752076 - DNA, 21 bp, Homo sapiens
ttcagctcatttaatcccagg

SEQ ID NO: 6752077 - DNA, 23 bp, Homo sapiens
ttcagctccagctcaccagcccc

SEQ ID NO: 6752078 - DNA, 12 bp, Homo sapiens
ttcagctcctga

SEQ ID NO: 6752079 - DNA, 13 bp, Homo sapiens
ttcagctcctgac

SEQ ID NO: 6752080 - DNA, 23 bp, Homo sapiens
ttcagctcctgagtagctgggcc

SEQ ID NO: 6752081 - DNA, 15 bp, Homo sapiens
ttcagctctctgtat

SEQ ID NO: 6752082 - DNA, 24 bp, Homo sapiens
ttcagctctgcaagaattgaagca

SEQ ID NO: 6752083 - DNA, 18 bp, Homo sapiens
ttcagctctttccaaatt

SEQ ID NO: 6752084 - DNA, 15 bp, Homo sapiens
ttcagctgagccctg

SEQ ID NO: 6752085 - DNA, 16 bp, Homo sapiens
ttcagctgagccctgg

SEQ ID NO: 6752086 - DNA, 19 bp, Homo sapiens
ttcagctgagccctgggga

SEQ ID NO: 6752087 - DNA, 14 bp, Homo sapiens
ttcagctgcagttg

SEQ ID NO: 6752088 - DNA, 18 bp, Homo sapiens
ttcagctgcagttgaaga

SEQ ID NO: 6752089 - DNA, 12 bp, Homo sapiens
ttcagctgcccc

SEQ ID NO: 6752090 - DNA, 13 bp, Homo sapiens
ttcagctgcccca

SEQ ID NO: 6752091 - DNA, 18 bp, Homo sapiens
ttcagctgcctgaaacag

SEQ ID NO: 6752092 - DNA, 17 bp, Homo sapiens
ttcagctgctcagaatt

SEQ ID NO: 6752093 - DNA, 18 bp, Homo sapiens
ttcatgagtggatggatg

SEQ ID NO: 6752094 - DNA, 12 bp, Homo sapiens
ttcatgataatg

SEQ ID NO: 6752095 - DNA, 21 bp, Homo sapiens
ttcatgatagaaagaataaaa

SEQ ID NO: 6752096 - DNA, 18 bp, Homo sapiens
ttcatgatgaattacttc

SEQ ID NO: 6752097 - DNA, 13 bp, Homo sapiens
ttcatgatgcagt

SEQ ID NO: 6752098 - DNA, 15 bp, Homo sapiens
ttcatgatgctagtt

SEQ ID NO: 6752099 - DNA, 20 bp, Homo sapiens
ttcatgatgctagttcttac

SEQ ID NO: 6752100 - DNA, 16 bp, Homo sapiens
ttcatgatgtgtgagt

SEQ ID NO: 6752101 - DNA, 15 bp, Homo sapiens
ttcatgattagacaa

SEQ ID NO: 6752102 - DNA, 16 bp, Homo sapiens
ttcatgattatagcaa

SEQ ID NO: 6752103 - DNA, 22 bp, Homo sapiens
ttcatgattatagcaactaatg

SEQ ID NO: 6752104 - DNA, 23 bp, Homo sapiens
ttcatgattatagcaactaatgt

SEQ ID NO: 6752105 - DNA, 13 bp, Homo sapiens
ttcatgattggct

SEQ ID NO: 6752106 - DNA, 15 bp, Homo sapiens
ttcatgattttgaaa

SEQ ID NO: 6752107 - DNA, 22 bp, Homo sapiens
ttcatgcaagagtttcttgtaa

SEQ ID NO: 6752108 - DNA, 14 bp, Homo sapiens
ttcatgcaagtatt

SEQ ID NO: 6752109 - DNA, 15 bp, Homo sapiens
ttcatgcaatgacat

SEQ ID NO: 6752110 - DNA, 21 bp, Homo sapiens
ttcatgcaatgacatcttcaa

SEQ ID NO: 6752111 - DNA, 13 bp, Homo sapiens
ttcatgcagctgt

SEQ ID NO: 6752112 - DNA, 19 bp, Homo sapiens
ttcatgcataggtttagca

SEQ ID NO: 6752113 - DNA, 15 bp, Homo sapiens
ttcatgcatggaaat

SEQ ID NO: 6752114 - DNA, 16 bp, Homo sapiens
ttcatgcatggaaatt

SEQ ID NO: 6752115 - DNA, 19 bp, Homo sapiens
ttcatgccaccatggccag

SEQ ID NO: 6752116 - DNA, 14 bp, Homo sapiens
ttcatgccatttta

SEQ ID NO: 6752117 - DNA, 15 bp, Homo sapiens
ttcatgccccggctg

SEQ ID NO: 6752118 - DNA, 23 bp, Homo sapiens
ttcatgcccttctgattcccctc

SEQ ID NO: 6752119 - DNA, 23 bp, Homo sapiens
ttcatgccgtggtaagtaccaca

SEQ ID NO: 6752120 - DNA, 13 bp, Homo sapiens
ttcatgcctcagt

SEQ ID NO: 6752121 - DNA, 14 bp, Homo sapiens
ttcatgcctcagtt

SEQ ID NO: 6752122 - DNA, 15 bp, Homo sapiens
ttcatgcctcagttt

SEQ ID NO: 6752123 - DNA, 13 bp, Homo sapiens
ttcatgcctgggg

SEQ ID NO: 6752124 - DNA, 17 bp, Homo sapiens
ttcatgcctttgtaagt

SEQ ID NO: 6752125 - DNA, 18 bp, Homo sapiens
ttcatgcctttgtaagtt

SEQ ID NO: 6752126 - DNA, 21 bp, Homo sapiens
ttcatgcgatgacacttgtac

SEQ ID NO: 6752127 - DNA, 14 bp, Homo sapiens
ttcatgctacagaa

SEQ ID NO: 6752128 - DNA, 14 bp, Homo sapiens
ttcatgctcagccc

SEQ ID NO: 6752129 - DNA, 17 bp, Homo sapiens
ttcatgctcagccctga

SEQ ID NO: 6752130 - DNA, 18 bp, Homo sapiens
ttcatgctgaatccacct

SEQ ID NO: 6752131 - DNA, 20 bp, Homo sapiens
ttcatgctgaatccacctcg

SEQ ID NO: 6752132 - DNA, 23 bp, Homo sapiens
ttcatgctgaatccacctcggag

SEQ ID NO: 6752133 - DNA, 23 bp, Homo sapiens
ttcatgctgcctgccatgtgtga

SEQ ID NO: 6752134 - DNA, 20 bp, Homo sapiens
ttcatgctgttcatgaaaga

SEQ ID NO: 6752135 - DNA, 13 bp, Homo sapiens
ttcatgcttgaca

SEQ ID NO: 6752136 - DNA, 14 bp, Homo sapiens
ttcatgcttgacat

SEQ ID NO: 6752137 - DNA, 16 bp, Homo sapiens
ttcatgcttgacatac

SEQ ID NO: 6752138 - DNA, 14 bp, Homo sapiens
ttcatgcttgccat

SEQ ID NO: 6752139 - DNA, 19 bp, Homo sapiens
ttcatggaacgcgttgaaa

SEQ ID NO: 6752140 - DNA, 16 bp, Homo sapiens
ttcatggaactagctc

SEQ ID NO: 6752141 - DNA, 19 bp, Homo sapiens
ttcatggaatggacatcct

SEQ ID NO: 6752142 - DNA, 20 bp, Homo sapiens
ttcatggaattggtttaaac

SEQ ID NO: 6752143 - DNA, 15 bp, Homo sapiens
ttcatggacactttg

SEQ ID NO: 6752144 - DNA, 21 bp, Homo sapiens
ttcatggacactttgaaatgt

SEQ ID NO: 6752145 - DNA, 20 bp, Homo sapiens
ttcatggcaagtggggctgg

SEQ ID NO: 6752146 - DNA, 23 bp, Homo sapiens
ttcatggcagatgtaggagggac

SEQ ID NO: 6752147 - DNA, 21 bp, Homo sapiens
ttcatggcatcttcaatatga

SEQ ID NO: 6752148 - DNA, 21 bp, Homo sapiens
ttcatggcatgcttaaatttt

SEQ ID NO: 6752149 - DNA, 21 bp, Homo sapiens
ttcatggcctttgataaatgt

SEQ ID NO: 6752150 - DNA, 14 bp, Homo sapiens
ttcatggttcaagt

SEQ ID NO: 6752151 - DNA, 22 bp, Homo sapiens
ttcatggtttgcatttaaacat

SEQ ID NO: 6752152 - DNA, 20 bp, Homo sapiens
ttcatggttttaaagctaaa

SEQ ID NO: 6752153 - DNA, 14 bp, Homo sapiens
ttcatgtaaactgt

SEQ ID NO: 6752154 - DNA, 13 bp, Homo sapiens
ttcatgtaacagt

SEQ ID NO: 6752155 - DNA, 21 bp, Homo sapiens
ttcatgtaacagttgtgtcat

SEQ ID NO: 6752156 - DNA, 17 bp, Homo sapiens
ttcatgtaactctccag

SEQ ID NO: 6752157 - DNA, 18 bp, Homo sapiens
ttcatgtaactctccagc

SEQ ID NO: 6752158 - DNA, 18 bp, Homo sapiens
ttcatgtaataaacaggt

SEQ ID NO: 6752159 - DNA, 18 bp, Homo sapiens
ttcatgtaataaatctga

SEQ ID NO: 6752160 - DNA, 23 bp, Homo sapiens
ttcatgtaataaatctgagccta

SEQ ID NO: 6752161 - DNA, 21 bp, Homo sapiens
ttcatgtaattttattttaaa

SEQ ID NO: 6752162 - DNA, 14 bp, Homo sapiens
ttcatgtacaatga

SEQ ID NO: 6752163 - DNA, 20 bp, Homo sapiens
ttcatgtagagaaaagcaca

SEQ ID NO: 6752164 - DNA, 23 bp, Homo sapiens
ttcatgtattttacacaaatgtg

SEQ ID NO: 6752165 - DNA, 22 bp, Homo sapiens
ttcatgtcaacttctggctcct

SEQ ID NO: 6752166 - DNA, 20 bp, Homo sapiens
ttcatgtcctgtgtcagttt

SEQ ID NO: 6752167 - DNA, 15 bp, Homo sapiens
ttcatgtctaagaac

SEQ ID NO: 6752168 - DNA, 19 bp, Homo sapiens
ttcatgtctgaaacagaga

SEQ ID NO: 6752169 - DNA, 16 bp, Homo sapiens
ttcatgtgagaaagct

SEQ ID NO: 6752170 - DNA, 14 bp, Homo sapiens
ttcatgtgatctat

SEQ ID NO: 6752171 - DNA, 17 bp, Homo sapiens
ttcatgtgatgtcatga

SEQ ID NO: 6752172 - DNA, 23 bp, Homo sapiens
ttcatgtgctatagacattagag

SEQ ID NO: 6752173 - DNA, 20 bp, Homo sapiens
ttcatgtgggatcccatctt

SEQ ID NO: 6752174 - DNA, 15 bp, Homo sapiens
ttcatgtgtcccaga

SEQ ID NO: 6752175 - DNA, 21 bp, Homo sapiens
ttcatgtgtgccaaggctgat

SEQ ID NO: 6752176 - DNA, 19 bp, Homo sapiens
ttcatgtgtggaaatggga

SEQ ID NO: 6752177 - DNA, 16 bp, Homo sapiens
ttcatgttatgcctgt

SEQ ID NO: 6752178 - DNA, 15 bp, Homo sapiens
ttcatgttcactgtg

SEQ ID NO: 6752179 - DNA, 16 bp, Homo sapiens
ttcatgttcactgtga

SEQ ID NO: 6752180 - DNA, 14 bp, Homo sapiens
ttcatgttcatcaa

SEQ ID NO: 6752181 - DNA, 17 bp, Homo sapiens
ttcatgttcccacttca

SEQ ID NO: 6752182 - DNA, 13 bp, Homo sapiens
ttcatgtttctta

SEQ ID NO: 6752183 - DNA, 19 bp, Homo sapiens
ttcatgtttggtgcataga

SEQ ID NO: 6752184 - DNA, 15 bp, Homo sapiens
ttcatgtttgtaaat

SEQ ID NO: 6752185 - DNA, 17 bp, Homo sapiens
ttcatgtttgtaaatta

SEQ ID NO: 6752186 - DNA, 18 bp, Homo sapiens
ttcatgttttaacaaaaa

SEQ ID NO: 6752187 - DNA, 16 bp, Homo sapiens
ttcatgttttaactta

SEQ ID NO: 6752188 - DNA, 18 bp, Homo sapiens
ttcatgttttaacttatt

SEQ ID NO: 6752189 - DNA, 13 bp, Homo sapiens
ttcatgttttgct

SEQ ID NO: 6752190 - DNA, 15 bp, Homo sapiens
ttcatgttttgctaa

SEQ ID NO: 6752191 - DNA, 16 bp, Homo sapiens
ttcatgttttgtgact

SEQ ID NO: 6752192 - DNA, 17 bp, Homo sapiens
ttcatgttttgtgacta

SEQ ID NO: 6752193 - DNA, 13 bp, Homo sapiens
ttcattaaaacaa

SEQ ID NO: 6752194 - DNA, 16 bp, Homo sapiens
ttcattaaaaggaaaa

SEQ ID NO: 6752195 - DNA, 17 bp, Homo sapiens
ttcattaaacaaacaga

SEQ ID NO: 6752196 - DNA, 14 bp, Homo sapiens
ttcattaaacttga

SEQ ID NO: 6752197 - DNA, 15 bp, Homo sapiens
ttcattaaacttgaa

SEQ ID NO: 6752198 - DNA, 15 bp, Homo sapiens
ttcattaaagcattt

SEQ ID NO: 6752199 - DNA, 12 bp, Homo sapiens
ttcattaaataa

SEQ ID NO: 6752200 - DNA, 13 bp, Homo sapiens
ttcattaaataaa

SEQ ID NO: 6752201 - DNA, 14 bp, Homo sapiens
ttcattaaataaat

SEQ ID NO: 6752202 - DNA, 15 bp, Homo sapiens
ttcattaaatgtttg

SEQ ID NO: 6752203 - DNA, 15 bp, Homo sapiens
ttcattaaattttct

SEQ ID NO: 6752204 - DNA, 16 bp, Homo sapiens
ttcattaaattttcta

SEQ ID NO: 6752205 - DNA, 16 bp, Homo sapiens
ttcattaaccaaagaa

SEQ ID NO: 6752206 - DNA, 19 bp, Homo sapiens
ttcattaagccctcttcca

SEQ ID NO: 6752207 - DNA, 22 bp, Homo sapiens
ttcattaagttgtaaaatgtca

SEQ ID NO: 6752208 - DNA, 21 bp, Homo sapiens
ttcattaataataaattccct

SEQ ID NO: 6752209 - DNA, 13 bp, Homo sapiens
ttcattaatgttt

SEQ ID NO: 6752210 - DNA, 23 bp, Homo sapiens
ttcattaattagttccagtttct

SEQ ID NO: 6752211 - DNA, 16 bp, Homo sapiens
ttcattaattctataa

SEQ ID NO: 6752212 - DNA, 18 bp, Homo sapiens
ttcattacagcttaatca

SEQ ID NO: 6752213 - DNA, 19 bp, Homo sapiens
ttcattacatcctctgctt

SEQ ID NO: 6752214 - DNA, 16 bp, Homo sapiens
ttcattacatttctga

SEQ ID NO: 6752215 - DNA, 19 bp, Homo sapiens
ttcattaccctacagacag

SEQ ID NO: 6752216 - DNA, 16 bp, Homo sapiens
ttcattacctgtagct

SEQ ID NO: 6752217 - DNA, 18 bp, Homo sapiens
ttcattacctgtagcttt

SEQ ID NO: 6752218 - DNA, 17 bp, Homo sapiens
ttcattacttgaatgta

SEQ ID NO: 6752219 - DNA, 22 bp, Homo sapiens
ttcattacttttaaaaatgtag

SEQ ID NO: 6752220 - DNA, 13 bp, Homo sapiens
ttcattagcagtt

SEQ ID NO: 6752221 - DNA, 20 bp, Homo sapiens
ttcattagcagttgctcaca

SEQ ID NO: 6752222 - DNA, 23 bp, Homo sapiens
ttcattagcagttgctcacatgt

SEQ ID NO: 6752223 - DNA, 14 bp, Homo sapiens
ttcattagccatgc

SEQ ID NO: 6752224 - DNA, 15 bp, Homo sapiens
ttcattagtcatgtt

SEQ ID NO: 6752225 - DNA, 14 bp, Homo sapiens
ttcattagttttga

SEQ ID NO: 6752226 - DNA, 19 bp, Homo sapiens
ttcattagttttgaagatt

SEQ ID NO: 6752227 - DNA, 19 bp, Homo sapiens
ttcattatctgagttgcat

SEQ ID NO: 6752228 - DNA, 19 bp, Homo sapiens
ttcattatctgtactgaaa

SEQ ID NO: 6752229 - DNA, 22 bp, Homo sapiens
ttcattatggtagaatcatttt

SEQ ID NO: 6752230 - DNA, 18 bp, Homo sapiens
ttcattatgttcatgtaa

SEQ ID NO: 6752231 - DNA, 22 bp, Homo sapiens
ttcattattagtactgctcttg

SEQ ID NO: 6752232 - DNA, 14 bp, Homo sapiens
ttcattattcaaga

SEQ ID NO: 6752233 - DNA, 12 bp, Homo sapiens
ttcattattctc

SEQ ID NO: 6752234 - DNA, 17 bp, Homo sapiens
ttcattattggaattaa

SEQ ID NO: 6752235 - DNA, 18 bp, Homo sapiens
ttcattattggaattaac

SEQ ID NO: 6752236 - DNA, 15 bp, Homo sapiens
ttcattatttggaaa

SEQ ID NO: 6752237 - DNA, 18 bp, Homo sapiens
ttcattattttaaaaata

SEQ ID NO: 6752238 - DNA, 14 bp, Homo sapiens
ttcattattttccc

SEQ ID NO: 6752239 - DNA, 14 bp, Homo sapiens
ttcattatttttca

SEQ ID NO: 6752240 - DNA, 19 bp, Homo sapiens
ttcattcaaaatgtccagc

SEQ ID NO: 6752241 - DNA, 19 bp, Homo sapiens
ttcattcaaatcagtgatc

SEQ ID NO: 6752242 - DNA, 24 bp, Homo sapiens
ttcattcaatcaacctgcacttca

SEQ ID NO: 6752243 - DNA, 11 bp, Homo sapiens
ttcattcacaa

SEQ ID NO: 6752244 - DNA, 9 bp, Homo sapiens
ttcattcag

SEQ ID NO: 6752245 - DNA, 17 bp, Homo sapiens
ttcattcatacttaaaa

SEQ ID NO: 6752246 - DNA, 13 bp, Homo sapiens
ttcattcatcctg

SEQ ID NO: 6752247 - DNA, 23 bp, Homo sapiens
ttcattcatgaatattttcaagt

SEQ ID NO: 6752248 - DNA, 22 bp, Homo sapiens
ttcattcatgtcatgtgtacaa

SEQ ID NO: 6752249 - DNA, 14 bp, Homo sapiens
ttcattcattcact

SEQ ID NO: 6752250 - DNA, 19 bp, Homo sapiens
ttcattccaaatgctttca

SEQ ID NO: 6752251 - DNA, 12 bp, Homo sapiens
ttcattccacag

SEQ ID NO: 6752252 - DNA, 13 bp, Homo sapiens
ttcattccagcag

SEQ ID NO: 6752253 - DNA, 14 bp, Homo sapiens
ttcattccagcagc

SEQ ID NO: 6752254 - DNA, 16 bp, Homo sapiens
ttcattccagcagctg

SEQ ID NO: 6752255 - DNA, 16 bp, Homo sapiens
ttcattccattctgga

SEQ ID NO: 6752256 - DNA, 21 bp, Homo sapiens
ttcattcccccttcctagtga

SEQ ID NO: 6752257 - DNA, 22 bp, Homo sapiens
ttcattccggactggcagaagc

SEQ ID NO: 6752258 - DNA, 12 bp, Homo sapiens
ttcattccgtta

SEQ ID NO: 6752259 - DNA, 14 bp, Homo sapiens
ttcattcctcacaa

SEQ ID NO: 6752260 - DNA, 12 bp, Homo sapiens
ttcattcctcca

SEQ ID NO: 6752261 - DNA, 13 bp, Homo sapiens
ttcattcctccag

SEQ ID NO: 6752262 - DNA, 22 bp, Homo sapiens
ttcattcggtgtgaacttttct

SEQ ID NO: 6752263 - DNA, 18 bp, Homo sapiens
ttcattctaccaagctgt

SEQ ID NO: 6752264 - DNA, 20 bp, Homo sapiens
ttcattctaccaagctgtca

SEQ ID NO: 6752265 - DNA, 20 bp, Homo sapiens
ttcattctcccgcttcctgg

SEQ ID NO: 6752266 - DNA, 18 bp, Homo sapiens
ttcattctccctttcact

SEQ ID NO: 6752267 - DNA, 19 bp, Homo sapiens
ttcattctccgttgtcatt

SEQ ID NO: 6752268 - DNA, 20 bp, Homo sapiens
ttcattctcctcctcctccc

SEQ ID NO: 6752269 - DNA, 13 bp, Homo sapiens
ttcattctgcaag

SEQ ID NO: 6752270 - DNA, 15 bp, Homo sapiens
ttcattctgcagggt

SEQ ID NO: 6752271 - DNA, 22 bp, Homo sapiens
ttcattctgcattgagaaggaa

SEQ ID NO: 6752272 - DNA, 16 bp, Homo sapiens
ttccagggctggggtg

SEQ ID NO: 6752273 - DNA, 14 bp, Homo sapiens
ttccaggggaacct

SEQ ID NO: 6752274 - DNA, 20 bp, Homo sapiens
ttccagggtccctctgtgta

SEQ ID NO: 6752275 - DNA, 18 bp, Homo sapiens
ttccagggtctttactgg

SEQ ID NO: 6752276 - DNA, 20 bp, Homo sapiens
ttccaggtaacaggtgtgta

SEQ ID NO: 6752277 - DNA, 18 bp, Homo sapiens
ttccaggtattaaaggtt

SEQ ID NO: 6752278 - DNA, 14 bp, Homo sapiens
ttccaggtctgcct

SEQ ID NO: 6752279 - DNA, 16 bp, Homo sapiens
ttccaggtctgcctgg

SEQ ID NO: 6752280 - DNA, 16 bp, Homo sapiens
ttccaggtggcaggat

SEQ ID NO: 6752281 - DNA, 21 bp, Homo sapiens
ttccaggtgtgcacagaaaac

SEQ ID NO: 6752282 - DNA, 19 bp, Homo sapiens
ttccaggttccatccacca

SEQ ID NO: 6752283 - DNA, 21 bp, Homo sapiens
ttccaggttccatccaccacc

SEQ ID NO: 6752284 - DNA, 23 bp, Homo sapiens
ttccaggttctggttagctcagc

SEQ ID NO: 6752285 - DNA, 17 bp, Homo sapiens
ttccaggtttaagctgt

SEQ ID NO: 6752286 - DNA, 15 bp, Homo sapiens
ttccaggtttaagta

SEQ ID NO: 6752287 - DNA, 21 bp, Homo sapiens
ttccagtaaggaatgatattg

SEQ ID NO: 6752288 - DNA, 14 bp, Homo sapiens
ttccagtaaggatt

SEQ ID NO: 6752289 - DNA, 22 bp, Homo sapiens
ttccagtaaggatttttatgta

SEQ ID NO: 6752290 - DNA, 19 bp, Homo sapiens
ttccagtacctttgtcaca

SEQ ID NO: 6752291 - DNA, 17 bp, Homo sapiens
ttccagtatcctgaaac

SEQ ID NO: 6752292 - DNA, 11 bp, Homo sapiens
ttccagtattt

SEQ ID NO: 6752293 - DNA, 14 bp, Homo sapiens
ttccagtattttag

SEQ ID NO: 6752294 - DNA, 13 bp, Homo sapiens
ttccagtcatggc

SEQ ID NO: 6752295 - DNA, 15 bp, Homo sapiens
ttccagtcatggcca

SEQ ID NO: 6752296 - DNA, 15 bp, Homo sapiens
ttccagtccaatctc

SEQ ID NO: 6752297 - DNA, 17 bp, Homo sapiens
ttccagtcccctttctc

SEQ ID NO: 6752298 - DNA, 18 bp, Homo sapiens
ttccagtcctaactttct

SEQ ID NO: 6752299 - DNA, 21 bp, Homo sapiens
ttccagtcctaactttctgaa

SEQ ID NO: 6752300 - DNA, 14 bp, Homo sapiens
ttccagtctcaaaa

SEQ ID NO: 6752301 - DNA, 11 bp, Homo sapiens
ttccagtctcc

SEQ ID NO: 6752302 - DNA, 11 bp, Homo sapiens
ttccagtctgg

SEQ ID NO: 6752303 - DNA, 21 bp, Homo sapiens
ttccagtgagcttatcatgct

SEQ ID NO: 6752304 - DNA, 19 bp, Homo sapiens
ttccagtgaggaaccctga

SEQ ID NO: 6752305 - DNA, 20 bp, Homo sapiens
ttccagtgaggctctgccct

SEQ ID NO: 6752306 - DNA, 21 bp, Homo sapiens
ttccagtgaggctctgccctt

SEQ ID NO: 6752307 - DNA, 14 bp, Homo sapiens
ttccagtgagtgta

SEQ ID NO: 6752308 - DNA, 18 bp, Homo sapiens
ttccagtgatgttgaaat

SEQ ID NO: 6752309 - DNA, 16 bp, Homo sapiens
ttccagtgcaacaaaa

SEQ ID NO: 6752310 - DNA, 15 bp, Homo sapiens
ttccagtgcaacact

SEQ ID NO: 6752311 - DNA, 21 bp, Homo sapiens
ttccagtgcaacactgaagct

SEQ ID NO: 6752312 - DNA, 13 bp, Homo sapiens
ttccagtgcagag

SEQ ID NO: 6752313 - DNA, 19 bp, Homo sapiens
ttccagtgcagtagtgcca

SEQ ID NO: 6752314 - DNA, 16 bp, Homo sapiens
ttccagtggcctggct

SEQ ID NO: 6752315 - DNA, 22 bp, Homo sapiens
ttccagtggcctggctccgctg

SEQ ID NO: 6752316 - DNA, 21 bp, Homo sapiens
ttccagtggtcatgctcagcc

SEQ ID NO: 6752317 - DNA, 15 bp, Homo sapiens
ttccagtgtattttc

SEQ ID NO: 6752318 - DNA, 19 bp, Homo sapiens
ttccagtgtattttctgtg

SEQ ID NO: 6752319 - DNA, 21 bp, Homo sapiens
ttccagttaacctattttgtg

SEQ ID NO: 6752320 - DNA, 21 bp, Homo sapiens
ttccagttcatctatggcagt

SEQ ID NO: 6752321 - DNA, 11 bp, Homo sapiens
ttccagttccc

SEQ ID NO: 6752322 - DNA, 19 bp, Homo sapiens
ttccagttctgacacacgt

SEQ ID NO: 6752323 - DNA, 17 bp, Homo sapiens
ttccagttcttcgactg

SEQ ID NO: 6752324 - DNA, 18 bp, Homo sapiens
ttccagttggactgtggc

SEQ ID NO: 6752325 - DNA, 20 bp, Homo sapiens
ttccagtttattccagagct

SEQ ID NO: 6752326 - DNA, 14 bp, Homo sapiens
ttccagtttctcct

SEQ ID NO: 6752327 - DNA, 12 bp, Homo sapiens
ttccagtttttt

SEQ ID NO: 6752328 - DNA, 18 bp, Homo sapiens
ttccagttttttgccact

SEQ ID NO: 6752329 - DNA, 22 bp, Homo sapiens
ttccataaagaagatgtttaac

SEQ ID NO: 6752330 - DNA, 14 bp, Homo sapiens
ttccataaccccag

SEQ ID NO: 6752331 - DNA, 19 bp, Homo sapiens
ttccataaggaatgtagct

SEQ ID NO: 6752332 - DNA, 16 bp, Homo sapiens
ttccataatgtataaa

SEQ ID NO: 6752333 - DNA, 16 bp, Homo sapiens
ttccataattatgaca

SEQ ID NO: 6752334 - DNA, 15 bp, Homo sapiens
ttccataattcagat

SEQ ID NO: 6752335 - DNA, 15 bp, Homo sapiens
ttccatacagctcta

SEQ ID NO: 6752336 - DNA, 23 bp, Homo sapiens
ttccatacagggtctcttccttc

SEQ ID NO: 6752337 - DNA, 14 bp, Homo sapiens
ttccatacttctct

SEQ ID NO: 6752338 - DNA, 18 bp, Homo sapiens
ttccatacttctctcaga

SEQ ID NO: 6752339 - DNA, 13 bp, Homo sapiens
ttccatagcaaca

SEQ ID NO: 6752340 - DNA, 17 bp, Homo sapiens
ttccatagcaacaggaa

SEQ ID NO: 6752341 - DNA, 22 bp, Homo sapiens
ttccatagctcttcacttcctc

SEQ ID NO: 6752342 - DNA, 22 bp, Homo sapiens
ttccataggacaaatgataagt

SEQ ID NO: 6752343 - DNA, 18 bp, Homo sapiens
ttccataggacatactgc

SEQ ID NO: 6752344 - DNA, 23 bp, Homo sapiens
ttccataggacatactgcatgta

SEQ ID NO: 6752345 - DNA, 22 bp, Homo sapiens
ttccatagtatattaaaaatgg

SEQ ID NO: 6752346 - DNA, 15 bp, Homo sapiens
ttccatagtcaatga

SEQ ID NO: 6752347 - DNA, 22 bp, Homo sapiens
ttccatagtttaggtactcaaa

SEQ ID NO: 6752348 - DNA, 13 bp, Homo sapiens
ttccatagttttg

SEQ ID NO: 6752349 - DNA, 23 bp, Homo sapiens
ttccatagttttgatgactggca

SEQ ID NO: 6752350 - DNA, 17 bp, Homo sapiens
ttccatatagtttgttt

SEQ ID NO: 6752351 - DNA, 21 bp, Homo sapiens
ttccatatagtttgttttctt

SEQ ID NO: 6752352 - DNA, 15 bp, Homo sapiens
ttccatatatccttt

SEQ ID NO: 6752353 - DNA, 18 bp, Homo sapiens
ttccatatatccttttct

SEQ ID NO: 6752354 - DNA, 18 bp, Homo sapiens
ttccatatattagcattt

SEQ ID NO: 6752355 - DNA, 14 bp, Homo sapiens
ttccatatattggc

SEQ ID NO: 6752356 - DNA, 15 bp, Homo sapiens
ttccatatattggca

SEQ ID NO: 6752357 - DNA, 23 bp, Homo sapiens
ttccatatcaaaagttgatttct

SEQ ID NO: 6752358 - DNA, 15 bp, Homo sapiens
ttccatatccctctt

SEQ ID NO: 6752359 - DNA, 15 bp, Homo sapiens
ttccatatccctgcc

SEQ ID NO: 6752360 - DNA, 16 bp, Homo sapiens
ttccatatccctgccc

SEQ ID NO: 6752361 - DNA, 17 bp, Homo sapiens
ttccatatccctgccca

SEQ ID NO: 6752362 - DNA, 19 bp, Homo sapiens
ttccatatccgggtgctca

SEQ ID NO: 6752363 - DNA, 15 bp, Homo sapiens
ttccatatcttgcga

SEQ ID NO: 6752364 - DNA, 17 bp, Homo sapiens
ttccatatgctccagga

SEQ ID NO: 6752365 - DNA, 22 bp, Homo sapiens
ttccatatggagcatttttcag

SEQ ID NO: 6752366 - DNA, 15 bp, Homo sapiens
ttccatatggatttt

SEQ ID NO: 6752367 - DNA, 20 bp, Homo sapiens
ttccatatggattttctatt

SEQ ID NO: 6752368 - DNA, 16 bp, Homo sapiens
ttccatattagaaaac

SEQ ID NO: 6752369 - DNA, 17 bp, Homo sapiens
ttccatattagaaaact

SEQ ID NO: 6752370 - DNA, 13 bp, Homo sapiens
ttccatcacagcc

SEQ ID NO: 6752371 - DNA, 16 bp, Homo sapiens
ttccatcacagccagc

SEQ ID NO: 6752372 - DNA, 18 bp, Homo sapiens
ttccatcacagccagccc

SEQ ID NO: 6752373 - DNA, 21 bp, Homo sapiens
ttccatcacagccagcccagc

SEQ ID NO: 6752374 - DNA, 20 bp, Homo sapiens
ttccatcataattctaatct

SEQ ID NO: 6752375 - DNA, 22 bp, Homo sapiens
ttccatcatcactgtaaagaca

SEQ ID NO: 6752376 - DNA, 12 bp, Homo sapiens
ttccatcatgtc

SEQ ID NO: 6752377 - DNA, 14 bp, Homo sapiens
ttccatcatgtccc

SEQ ID NO: 6752378 - DNA, 18 bp, Homo sapiens
ttccatcatgtctgtata

SEQ ID NO: 6752379 - DNA, 14 bp, Homo sapiens
ttccatcatttctg

SEQ ID NO: 6752380 - DNA, 15 bp, Homo sapiens
ttccatcatttctgt

SEQ ID NO: 6752381 - DNA, 17 bp, Homo sapiens
ttccatcattttacagt

SEQ ID NO: 6752382 - DNA, 18 bp, Homo sapiens
ttccatccaaacctacct

SEQ ID NO: 6752383 - DNA, 14 bp, Homo sapiens
ttccatccaccacc

SEQ ID NO: 6752384 - DNA, 19 bp, Homo sapiens
ttccatccacccctgcgtc

SEQ ID NO: 6752385 - DNA, 21 bp, Homo sapiens
ttccatccatctttccatcca

SEQ ID NO: 6752386 - DNA, 21 bp, Homo sapiens
ttccatcctagtcactacctt

SEQ ID NO: 6752387 - DNA, 23 bp, Homo sapiens
ttccatcctgaggtgcctcccag

SEQ ID NO: 6752388 - DNA, 18 bp, Homo sapiens
ttccatcctttgcatttc

SEQ ID NO: 6752389 - DNA, 20 bp, Homo sapiens
ttccatcctttgcatttctc

SEQ ID NO: 6752390 - DNA, 18 bp, Homo sapiens
ttccatctagcagctggc

SEQ ID NO: 6752391 - DNA, 19 bp, Homo sapiens
ttccatctcccttggttgt

SEQ ID NO: 6752392 - DNA, 14 bp, Homo sapiens
ttccatctcttcct

SEQ ID NO: 6752393 - DNA, 12 bp, Homo sapiens
ttccatctgaaa

SEQ ID NO: 6752394 - DNA, 17 bp, Homo sapiens
ttccatctgattccagc

SEQ ID NO: 6752395 - DNA, 11 bp, Homo sapiens
ttccatctgtg

SEQ ID NO: 6752396 - DNA, 13 bp, Homo sapiens
ttccatcttgcta

SEQ ID NO: 6752397 - DNA, 13 bp, Homo sapiens
ttccatctttaca

SEQ ID NO: 6752398 - DNA, 15 bp, Homo sapiens
ttccatgaatgtatc

SEQ ID NO: 6752399 - DNA, 16 bp, Homo sapiens
ttccatgacagtagca

SEQ ID NO: 6752400 - DNA, 18 bp, Homo sapiens
ttccatgacagtagcata

SEQ ID NO: 6752401 - DNA, 16 bp, Homo sapiens
ttccatgacctcccct

SEQ ID NO: 6752402 - DNA, 16 bp, Homo sapiens
ttccatgacgcaggag

SEQ ID NO: 6752403 - DNA, 17 bp, Homo sapiens
ttccatgactctgccta

SEQ ID NO: 6752404 - DNA, 19 bp, Homo sapiens
ttccatgactgcttgccct

SEQ ID NO: 6752405 - DNA, 10 bp, Homo sapiens
ttccatgagc

SEQ ID NO: 6752406 - DNA, 17 bp, Homo sapiens
ttccatgagtcccctgt

SEQ ID NO: 6752407 - DNA, 13 bp, Homo sapiens
ttccatgatgctg

SEQ ID NO: 6752408 - DNA, 18 bp, Homo sapiens
ttccatgatgctgggatt

SEQ ID NO: 6752409 - DNA, 21 bp, Homo sapiens
ttccatgatgttacattagga

SEQ ID NO: 6752410 - DNA, 18 bp, Homo sapiens
ttccatgatttagcaagc

SEQ ID NO: 6752411 - DNA, 15 bp, Homo sapiens
ttccatgattttaca

SEQ ID NO: 6752412 - DNA, 21 bp, Homo sapiens
ttccatgattttacagagaat

SEQ ID NO: 6752413 - DNA, 14 bp, Homo sapiens
ttccatgcagttat

SEQ ID NO: 6752414 - DNA, 24 bp, Homo sapiens
ttccatgcagttattagaacttag

SEQ ID NO: 6752415 - DNA, 15 bp, Homo sapiens
ttccatgcctgaggg

SEQ ID NO: 6752416 - DNA, 16 bp, Homo sapiens
ttccatgcctgagggt

SEQ ID NO: 6752417 - DNA, 22 bp, Homo sapiens
ttccatgcctgctctcgaggca

SEQ ID NO: 6752418 - DNA, 23 bp, Homo sapiens
ttccatgcctgtagctttcctgg

SEQ ID NO: 6752419 - DNA, 20 bp, Homo sapiens
ttccatggaaccatggagga

SEQ ID NO: 6752420 - DNA, 11 bp, Homo sapiens
ttccatggcaa

SEQ ID NO: 6752421 - DNA, 16 bp, Homo sapiens
ttccatggcaaatggg

SEQ ID NO: 6752422 - DNA, 12 bp, Homo sapiens
ttccatgggaat

SEQ ID NO: 6752423 - DNA, 17 bp, Homo sapiens
ttccatgggatgttaag

SEQ ID NO: 6752424 - DNA, 16 bp, Homo sapiens
ttccatggtgtatatg

SEQ ID NO: 6752425 - DNA, 14 bp, Homo sapiens
ttccatgtatgcat

SEQ ID NO: 6752426 - DNA, 16 bp, Homo sapiens
ttccatgtcgcctctg

SEQ ID NO: 6752427 - DNA, 15 bp, Homo sapiens
ttccatgtgaacagc

SEQ ID NO: 6752428 - DNA, 15 bp, Homo sapiens
ttccatgtgcccagt

SEQ ID NO: 6752429 - DNA, 16 bp, Homo sapiens
ttccatgtgcccagtt

SEQ ID NO: 6752430 - DNA, 14 bp, Homo sapiens
ttccatgtgccttt

SEQ ID NO: 6752431 - DNA, 15 bp, Homo sapiens
ttccatgtgcctttc

SEQ ID NO: 6752432 - DNA, 17 bp, Homo sapiens
ttccatgtgcctttctt

SEQ ID NO: 6752433 - DNA, 12 bp, Homo sapiens
ttccatgtgttt

SEQ ID NO: 6752434 - DNA, 17 bp, Homo sapiens
ttccatgtgttttgctt

SEQ ID NO: 6752435 - DNA, 20 bp, Homo sapiens
ttccatgtgttttgctttta

SEQ ID NO: 6752436 - DNA, 16 bp, Homo sapiens
ttccatgttgctgcca

SEQ ID NO: 6752437 - DNA, 11 bp, Homo sapiens
ttccatgtttt

SEQ ID NO: 6752438 - DNA, 20 bp, Homo sapiens
ttccatgttttttcttcaaa

SEQ ID NO: 6752439 - DNA, 22 bp, Homo sapiens
ttccatgttttttcttcaaatg

SEQ ID NO: 6752440 - DNA, 23 bp, Homo sapiens
ttccattaactatttttttcaaa

SEQ ID NO: 6752441 - DNA, 12 bp, Homo sapiens
ttccattaattt

SEQ ID NO: 6752442 - DNA, 13 bp, Homo sapiens
ttccattacaagt

SEQ ID NO: 6752443 - DNA, 16 bp, Homo sapiens
ttccattacaccacag

SEQ ID NO: 6752444 - DNA, 21 bp, Homo sapiens
ttccattagaatgctacaagt

SEQ ID NO: 6752445 - DNA, 14 bp, Homo sapiens
ttccattatcttat

SEQ ID NO: 6752446 - DNA, 13 bp, Homo sapiens
ttccattatgaaa

SEQ ID NO: 6752447 - DNA, 20 bp, Homo sapiens
ttccattatgaaaatcttat

SEQ ID NO: 6752448 - DNA, 14 bp, Homo sapiens
ttccattccacaca

SEQ ID NO: 6752449 - DNA, 13 bp, Homo sapiens
ttccattccagaa

SEQ ID NO: 6752450 - DNA, 20 bp, Homo sapiens
ttccattcccttcggccaaa

SEQ ID NO: 6752451 - DNA, 19 bp, Homo sapiens
ttcctaagtctgtcatcct

SEQ ID NO: 6752452 - DNA, 13 bp, Homo sapiens
ttcctaagtgatt

SEQ ID NO: 6752453 - DNA, 18 bp, Homo sapiens
ttcctaagttcccttcta

SEQ ID NO: 6752454 - DNA, 13 bp, Homo sapiens
ttcctaataaact

SEQ ID NO: 6752455 - DNA, 17 bp, Homo sapiens
ttcctaatcaaaaaggt

SEQ ID NO: 6752456 - DNA, 17 bp, Homo sapiens
ttcctaatcagaaattt

SEQ ID NO: 6752457 - DNA, 20 bp, Homo sapiens
ttcctaatcagaaattttta

SEQ ID NO: 6752458 - DNA, 21 bp, Homo sapiens
ttcctaatggctatttttgaa

SEQ ID NO: 6752459 - DNA, 17 bp, Homo sapiens
ttcctacaactaaaaat

SEQ ID NO: 6752460 - DNA, 19 bp, Homo sapiens
ttcctacaactaaaaataa

SEQ ID NO: 6752461 - DNA, 20 bp, Homo sapiens
ttcctacaacttaatggaaa

SEQ ID NO: 6752462 - DNA, 15 bp, Homo sapiens
ttcctacacaggaca

SEQ ID NO: 6752463 - DNA, 14 bp, Homo sapiens
ttcctacacatggt

SEQ ID NO: 6752464 - DNA, 22 bp, Homo sapiens
ttcctacagagccaaaatgcca

SEQ ID NO: 6752465 - DNA, 17 bp, Homo sapiens
ttcctacagcactactg

SEQ ID NO: 6752466 - DNA, 21 bp, Homo sapiens
ttcctacagcactactgggtg

SEQ ID NO: 6752467 - DNA, 14 bp, Homo sapiens
ttcctacagcccct

SEQ ID NO: 6752468 - DNA, 18 bp, Homo sapiens
ttcctacagccccttttt

SEQ ID NO: 6752469 - DNA, 14 bp, Homo sapiens
ttcctacaggagat

SEQ ID NO: 6752470 - DNA, 13 bp, Homo sapiens
ttcctacaggcag

SEQ ID NO: 6752471 - DNA, 20 bp, Homo sapiens
ttcctacaggcagtctctct

SEQ ID NO: 6752472 - DNA, 15 bp, Homo sapiens
ttcctacagtaaagg

SEQ ID NO: 6752473 - DNA, 19 bp, Homo sapiens
ttcctaccaagtcaaactt

SEQ ID NO: 6752474 - DNA, 23 bp, Homo sapiens
ttcctaccattatggctttgtgc

SEQ ID NO: 6752475 - DNA, 21 bp, Homo sapiens
ttcctacccacacctctgcca

SEQ ID NO: 6752476 - DNA, 15 bp, Homo sapiens
ttcctacccctcttc

SEQ ID NO: 6752477 - DNA, 19 bp, Homo sapiens
ttcctaccgtactccctgc

SEQ ID NO: 6752478 - DNA, 18 bp, Homo sapiens
ttcctactccctcttcca

SEQ ID NO: 6752479 - DNA, 20 bp, Homo sapiens
ttcctactccgttcctggca

SEQ ID NO: 6752480 - DNA, 16 bp, Homo sapiens
ttcctactctgggaag

SEQ ID NO: 6752481 - DNA, 15 bp, Homo sapiens
ttcctactcttctct

SEQ ID NO: 6752482 - DNA, 15 bp, Homo sapiens
ttcctactggtctct

SEQ ID NO: 6752483 - DNA, 16 bp, Homo sapiens
ttcctactgtcctcag

SEQ ID NO: 6752484 - DNA, 18 bp, Homo sapiens
ttcctactgtcctcagag

SEQ ID NO: 6752485 - DNA, 16 bp, Homo sapiens
ttcctactgtcctgga

SEQ ID NO: 6752486 - DNA, 22 bp, Homo sapiens
ttcctacttaaacaaaaacttt

SEQ ID NO: 6752487 - DNA, 15 bp, Homo sapiens
ttcctactttgtata

SEQ ID NO: 6752488 - DNA, 18 bp, Homo sapiens
ttcctacttttccttccc

SEQ ID NO: 6752489 - DNA, 16 bp, Homo sapiens
ttcctagaagcccctg

SEQ ID NO: 6752490 - DNA, 23 bp, Homo sapiens
ttcctagactaattaaaatctgg

SEQ ID NO: 6752491 - DNA, 14 bp, Homo sapiens
ttcctagagaactg

SEQ ID NO: 6752492 - DNA, 19 bp, Homo sapiens
ttcctagatggcagtcact

SEQ ID NO: 6752493 - DNA, 23 bp, Homo sapiens
ttcctagattacatctgccttaa

SEQ ID NO: 6752494 - DNA, 13 bp, Homo sapiens
ttcctagcactgc

SEQ ID NO: 6752495 - DNA, 15 bp, Homo sapiens
ttcctagccaccgcc

SEQ ID NO: 6752496 - DNA, 21 bp, Homo sapiens
ttcctagctaggagcaggctt

SEQ ID NO: 6752497 - DNA, 17 bp, Homo sapiens
ttcctagctgtaaatat

SEQ ID NO: 6752498 - DNA, 18 bp, Homo sapiens
ttcctagctgtgtgaata

SEQ ID NO: 6752499 - DNA, 19 bp, Homo sapiens
ttcctagctgttctaatta

SEQ ID NO: 6752500 - DNA, 23 bp, Homo sapiens
ttcctagcttatctccctgcttc

SEQ ID NO: 6752501 - DNA, 21 bp, Homo sapiens
ttcctaggaaaaaaggaataa

SEQ ID NO: 6752502 - DNA, 22 bp, Homo sapiens
ttcctaggaggaaaattccatt

SEQ ID NO: 6752503 - DNA, 17 bp, Homo sapiens
ttcctagggatctgaaa

SEQ ID NO: 6752504 - DNA, 19 bp, Homo sapiens
ttcctagggatctgaaatc

SEQ ID NO: 6752505 - DNA, 22 bp, Homo sapiens
ttcctagggatctgaaatccat

SEQ ID NO: 6752506 - DNA, 17 bp, Homo sapiens
ttcctagtaagtcagga

SEQ ID NO: 6752507 - DNA, 20 bp, Homo sapiens
ttcctagtatacccactgca

SEQ ID NO: 6752508 - DNA, 12 bp, Homo sapiens
ttcctagtgaaa

SEQ ID NO: 6752509 - DNA, 15 bp, Homo sapiens
ttcctagtgaggaaa

SEQ ID NO: 6752510 - DNA, 15 bp, Homo sapiens
ttcctagtggtgtca

SEQ ID NO: 6752511 - DNA, 21 bp, Homo sapiens
ttcctagttcatcccttctct

SEQ ID NO: 6752512 - DNA, 22 bp, Homo sapiens
ttcctagttcatcccttctctt

SEQ ID NO: 6752513 - DNA, 13 bp, Homo sapiens
ttcctagttctta

SEQ ID NO: 6752514 - DNA, 22 bp, Homo sapiens
ttcctagttggtgagaaacctg

SEQ ID NO: 6752515 - DNA, 18 bp, Homo sapiens
ttcctagttttatgtttc

SEQ ID NO: 6752516 - DNA, 12 bp, Homo sapiens
ttcctagttttt

SEQ ID NO: 6752517 - DNA, 15 bp, Homo sapiens
ttcctagtttttcta

SEQ ID NO: 6752518 - DNA, 22 bp, Homo sapiens
ttcctataacttcttcctgctg

SEQ ID NO: 6752519 - DNA, 20 bp, Homo sapiens
ttcctataacttgatgcatg

SEQ ID NO: 6752520 - DNA, 11 bp, Homo sapiens
ttcctataagg

SEQ ID NO: 6752521 - DNA, 19 bp, Homo sapiens
ttcctatacgcagcgtgct

SEQ ID NO: 6752522 - DNA, 20 bp, Homo sapiens
ttcctatagctacatgttct

SEQ ID NO: 6752523 - DNA, 14 bp, Homo sapiens
ttcctatatcctgt

SEQ ID NO: 6752524 - DNA, 22 bp, Homo sapiens
ttcctatcacctcgagaagtaa

SEQ ID NO: 6752525 - DNA, 14 bp, Homo sapiens
ttcctatcccatcc

SEQ ID NO: 6752526 - DNA, 16 bp, Homo sapiens
ttcctatcccatccca

SEQ ID NO: 6752527 - DNA, 17 bp, Homo sapiens
ttcctatcccatcccat

SEQ ID NO: 6752528 - DNA, 18 bp, Homo sapiens
ttcctatcccatcccatc

SEQ ID NO: 6752529 - DNA, 20 bp, Homo sapiens
ttcctatgaagttggcacat

SEQ ID NO: 6752530 - DNA, 21 bp, Homo sapiens
ttcctatgaagttggcacatt

SEQ ID NO: 6752531 - DNA, 20 bp, Homo sapiens
ttcctatgactcaaagatga

SEQ ID NO: 6752532 - DNA, 22 bp, Homo sapiens
ttcctatgcccaggtaccaccc

SEQ ID NO: 6752533 - DNA, 13 bp, Homo sapiens
ttcctatggaaac

SEQ ID NO: 6752534 - DNA, 17 bp, Homo sapiens
ttcctatggaaacattt

SEQ ID NO: 6752535 - DNA, 20 bp, Homo sapiens
ttcctatggctggccactgc

SEQ ID NO: 6752536 - DNA, 15 bp, Homo sapiens
ttcctatgtattctg

SEQ ID NO: 6752537 - DNA, 13 bp, Homo sapiens
ttcctattctcct

SEQ ID NO: 6752538 - DNA, 14 bp, Homo sapiens
ttcctattgtgatt

SEQ ID NO: 6752539 - DNA, 15 bp, Homo sapiens
ttcctatttcagaag

SEQ ID NO: 6752540 - DNA, 16 bp, Homo sapiens
ttcctatttcagaagt

SEQ ID NO: 6752541 - DNA, 12 bp, Homo sapiens
ttcctatttccc

SEQ ID NO: 6752542 - DNA, 18 bp, Homo sapiens
ttcctatttgccatgggc

SEQ ID NO: 6752543 - DNA, 20 bp, Homo sapiens
ttcctatttgccatgggctt

SEQ ID NO: 6752544 - DNA, 15 bp, Homo sapiens
ttcctattttaaaac

SEQ ID NO: 6752545 - DNA, 21 bp, Homo sapiens
ttcctattttaaaaccatgca

SEQ ID NO: 6752546 - DNA, 19 bp, Homo sapiens
ttcctattttctatccccc

SEQ ID NO: 6752547 - DNA, 20 bp, Homo sapiens
ttcctattttctatccccct

SEQ ID NO: 6752548 - DNA, 16 bp, Homo sapiens
ttcctcaaaaagcaga

SEQ ID NO: 6752549 - DNA, 21 bp, Homo sapiens
ttcctcaaatcaaaaacaggc

SEQ ID NO: 6752550 - DNA, 18 bp, Homo sapiens
ttcctcaagtatcttcta

SEQ ID NO: 6752551 - DNA, 19 bp, Homo sapiens
ttcctcacacccacctgct

SEQ ID NO: 6752552 - DNA, 20 bp, Homo sapiens
ttcctcacacccacctgctg

SEQ ID NO: 6752553 - DNA, 19 bp, Homo sapiens
ttcctcacactgctgtcct

SEQ ID NO: 6752554 - DNA, 14 bp, Homo sapiens
ttcctcacagtccc

SEQ ID NO: 6752555 - DNA, 13 bp, Homo sapiens
ttcctcaccaata

SEQ ID NO: 6752556 - DNA, 23 bp, Homo sapiens
ttcctcaccagtcccatgctggc

SEQ ID NO: 6752557 - DNA, 23 bp, Homo sapiens
ttcctcactgcctggtaaaatta

SEQ ID NO: 6752558 - DNA, 13 bp, Homo sapiens
ttcctcacttcca

SEQ ID NO: 6752559 - DNA, 17 bp, Homo sapiens
ttcctcagattgctgaa

SEQ ID NO: 6752560 - DNA, 15 bp, Homo sapiens
ttcctcagcctccaa

SEQ ID NO: 6752561 - DNA, 14 bp, Homo sapiens
ttcctcagcctggg

SEQ ID NO: 6752562 - DNA, 15 bp, Homo sapiens
ttcctcagcctgggg

SEQ ID NO: 6752563 - DNA, 19 bp, Homo sapiens
ttcctcagctcagctgggc

SEQ ID NO: 6752564 - DNA, 20 bp, Homo sapiens
ttcctcagctcagctgggcc

SEQ ID NO: 6752565 - DNA, 21 bp, Homo sapiens
ttcctcagctcagctgggcca

SEQ ID NO: 6752566 - DNA, 12 bp, Homo sapiens
ttcctcagctct

SEQ ID NO: 6752567 - DNA, 15 bp, Homo sapiens
ttcctcagctctagg

SEQ ID NO: 6752568 - DNA, 22 bp, Homo sapiens
ttcctcagctggttactcaggg

SEQ ID NO: 6752569 - DNA, 23 bp, Homo sapiens
ttcctcagctggttactcagggt

SEQ ID NO: 6752570 - DNA, 12 bp, Homo sapiens
ttcctcagctta

SEQ ID NO: 6752571 - DNA, 19 bp, Homo sapiens
ttcctcagcttatctcttt

SEQ ID NO: 6752572 - DNA, 22 bp, Homo sapiens
ttcctcaggcaaggtctggcct

SEQ ID NO: 6752573 - DNA, 22 bp, Homo sapiens
ttcctcagttgatataaaactc

SEQ ID NO: 6752574 - DNA, 23 bp, Homo sapiens
ttcctcagtttaatccttctagt

SEQ ID NO: 6752575 - DNA, 23 bp, Homo sapiens
ttcctcatagtatggtggctggg

SEQ ID NO: 6752576 - DNA, 19 bp, Homo sapiens
ttcctcatccaccccatcc

SEQ ID NO: 6752577 - DNA, 14 bp, Homo sapiens
ttcctcatcctcag

SEQ ID NO: 6752578 - DNA, 19 bp, Homo sapiens
ttcctcatcctgcttctct

SEQ ID NO: 6752579 - DNA, 20 bp, Homo sapiens
ttcctcatcctgcttctctt

SEQ ID NO: 6752580 - DNA, 16 bp, Homo sapiens
ttcctcatcctttccc

SEQ ID NO: 6752581 - DNA, 20 bp, Homo sapiens
ttcctcatctatggttctaa

SEQ ID NO: 6752582 - DNA, 15 bp, Homo sapiens
ttcctcatctgtcca

SEQ ID NO: 6752583 - DNA, 18 bp, Homo sapiens
ttcctcatctgtgcctgt

SEQ ID NO: 6752584 - DNA, 14 bp, Homo sapiens
ttcctcatgaatgt

SEQ ID NO: 6752585 - DNA, 22 bp, Homo sapiens
ttcctcatgaatgtaaatttgt

SEQ ID NO: 6752586 - DNA, 14 bp, Homo sapiens
ttcctcatgtaaca

SEQ ID NO: 6752587 - DNA, 22 bp, Homo sapiens
ttcctcatgtaacattggtgaa

SEQ ID NO: 6752588 - DNA, 17 bp, Homo sapiens
ttcctcattaaattacc

SEQ ID NO: 6752589 - DNA, 23 bp, Homo sapiens
ttcctcattaatagctgccttca

SEQ ID NO: 6752590 - DNA, 15 bp, Homo sapiens
ttcctcattccttgt

SEQ ID NO: 6752591 - DNA, 22 bp, Homo sapiens
ttcctcatttcttgaggcttct

SEQ ID NO: 6752592 - DNA, 12 bp, Homo sapiens
ttcctcatttgt

SEQ ID NO: 6752593 - DNA, 16 bp, Homo sapiens
ttcctccaaactcctg

SEQ ID NO: 6752594 - DNA, 16 bp, Homo sapiens
ttcctccaatccccac

SEQ ID NO: 6752595 - DNA, 14 bp, Homo sapiens
ttcctccacatcct

SEQ ID NO: 6752596 - DNA, 17 bp, Homo sapiens
ttcctccacatcctttc

SEQ ID NO: 6752597 - DNA, 16 bp, Homo sapiens
ttcctccactctgtat

SEQ ID NO: 6752598 - DNA, 16 bp, Homo sapiens
ttcctccactgcgctt

SEQ ID NO: 6752599 - DNA, 15 bp, Homo sapiens
ttcctccagaagcct

SEQ ID NO: 6752600 - DNA, 14 bp, Homo sapiens
ttcctccagagaca

SEQ ID NO: 6752601 - DNA, 17 bp, Homo sapiens
ttcctccagagacactg

SEQ ID NO: 6752602 - DNA, 14 bp, Homo sapiens
ttcctccagccacc

SEQ ID NO: 6752603 - DNA, 22 bp, Homo sapiens
ttcctccagcccagtcttacat

SEQ ID NO: 6752604 - DNA, 16 bp, Homo sapiens
ttcctccagcctcccc

SEQ ID NO: 6752605 - DNA, 19 bp, Homo sapiens
ttcctccagcctcccctcc

SEQ ID NO: 6752606 - DNA, 21 bp, Homo sapiens
ttcctccagcctcccctcccc

SEQ ID NO: 6752607 - DNA, 17 bp, Homo sapiens
ttcctccagctgcacca

SEQ ID NO: 6752608 - DNA, 13 bp, Homo sapiens
ttcctccagctgg

SEQ ID NO: 6752609 - DNA, 12 bp, Homo sapiens
ttcctccagtct

SEQ ID NO: 6752610 - DNA, 17 bp, Homo sapiens
ttcctccagtctgttct

SEQ ID NO: 6752611 - DNA, 21 bp, Homo sapiens
ttcctccagtctgttctcaca

SEQ ID NO: 6752612 - DNA, 18 bp, Homo sapiens
ttcctccagtgcatactg

SEQ ID NO: 6752613 - DNA, 23 bp, Homo sapiens
ttcctccatctccaagaatgctg

SEQ ID NO: 6752614 - DNA, 17 bp, Homo sapiens
ttcctccatttgagaaa

SEQ ID NO: 6752615 - DNA, 16 bp, Homo sapiens
ttcctccattttctta

SEQ ID NO: 6752616 - DNA, 22 bp, Homo sapiens
ttcctcccaccccaagcaaatc

SEQ ID NO: 6752617 - DNA, 15 bp, Homo sapiens
ttcctcccagcattg

SEQ ID NO: 6752618 - DNA, 22 bp, Homo sapiens
ttcctcccaggaggtgcttgag

SEQ ID NO: 6752619 - DNA, 19 bp, Homo sapiens
ttcctcccattttagaaaa

SEQ ID NO: 6752620 - DNA, 10 bp, Homo sapiens
ttcctcccca

SEQ ID NO: 6752621 - DNA, 14 bp, Homo sapiens
ttcctccccaccct

SEQ ID NO: 6752622 - DNA, 19 bp, Homo sapiens
ttcctccccaccctgtccc

SEQ ID NO: 6752623 - DNA, 22 bp, Homo sapiens
ttcctccccaccctgtcccagg

SEQ ID NO: 6752624 - DNA, 19 bp, Homo sapiens
ttcctccccaccttcccca

SEQ ID NO: 6752625 - DNA, 16 bp, Homo sapiens
ttcctccccatacaca

SEQ ID NO: 6752626 - DNA, 20 bp, Homo sapiens
ttcctccccatacacacaca

SEQ ID NO: 6752627 - DNA, 13 bp, Homo sapiens
ttcctcccccagc

SEQ ID NO: 6752628 - DNA, 22 bp, Homo sapiens
ttcctttactttcccttgcttt

SEQ ID NO: 6752629 - DNA, 17 bp, Homo sapiens
ttcctttataattcttt

SEQ ID NO: 6752630 - DNA, 20 bp, Homo sapiens
ttcctttatatttgctcccc

SEQ ID NO: 6752631 - DNA, 19 bp, Homo sapiens
ttcctttattttgctgctt

SEQ ID NO: 6752632 - DNA, 15 bp, Homo sapiens
ttcctttcaataaag

SEQ ID NO: 6752633 - DNA, 17 bp, Homo sapiens
ttcctttcaataaagtt

SEQ ID NO: 6752634 - DNA, 18 bp, Homo sapiens
ttcctttcaataaagttg

SEQ ID NO: 6752635 - DNA, 19 bp, Homo sapiens
ttcctttcagccctgtcta

SEQ ID NO: 6752636 - DNA, 23 bp, Homo sapiens
ttcctttcatctctctacctcca

SEQ ID NO: 6752637 - DNA, 20 bp, Homo sapiens
ttcctttcatttactgtggc

SEQ ID NO: 6752638 - DNA, 18 bp, Homo sapiens
ttcctttccaggtatttt

SEQ ID NO: 6752639 - DNA, 17 bp, Homo sapiens
ttcctttccctggagct

SEQ ID NO: 6752640 - DNA, 17 bp, Homo sapiens
ttcctttcccttcctct

SEQ ID NO: 6752641 - DNA, 18 bp, Homo sapiens
ttcctttccctttagcac

SEQ ID NO: 6752642 - DNA, 10 bp, Homo sapiens
ttcctttcct

SEQ ID NO: 6752643 - DNA, 11 bp, Homo sapiens
ttcctttcctc

SEQ ID NO: 6752644 - DNA, 12 bp, Homo sapiens
ttcctttctcag

SEQ ID NO: 6752645 - DNA, 17 bp, Homo sapiens
ttcctttctcatttctt

SEQ ID NO: 6752646 - DNA, 14 bp, Homo sapiens
ttcctttctccagg

SEQ ID NO: 6752647 - DNA, 14 bp, Homo sapiens
ttcctttctcccct

SEQ ID NO: 6752648 - DNA, 13 bp, Homo sapiens
ttcctttctcctg

SEQ ID NO: 6752649 - DNA, 15 bp, Homo sapiens
ttcctttctcctgcc

SEQ ID NO: 6752650 - DNA, 15 bp, Homo sapiens
ttcctttctctcctg

SEQ ID NO: 6752651 - DNA, 13 bp, Homo sapiens
ttcctttctcttt

SEQ ID NO: 6752652 - DNA, 13 bp, Homo sapiens
ttcctttctggaa

SEQ ID NO: 6752653 - DNA, 14 bp, Homo sapiens
ttcctttcttacca

SEQ ID NO: 6752654 - DNA, 20 bp, Homo sapiens
ttcctttcttggttcataaa

SEQ ID NO: 6752655 - DNA, 20 bp, Homo sapiens
ttcctttcttgtctttcctc

SEQ ID NO: 6752656 - DNA, 14 bp, Homo sapiens
ttcctttgaagagg

SEQ ID NO: 6752657 - DNA, 23 bp, Homo sapiens
ttcctttgaagctttaggcagag

SEQ ID NO: 6752658 - DNA, 16 bp, Homo sapiens
ttcctttgacctctca

SEQ ID NO: 6752659 - DNA, 16 bp, Homo sapiens
ttcctttgactttctg

SEQ ID NO: 6752660 - DNA, 17 bp, Homo sapiens
ttcctttgactttctgt

SEQ ID NO: 6752661 - DNA, 14 bp, Homo sapiens
ttcctttgatctcg

SEQ ID NO: 6752662 - DNA, 14 bp, Homo sapiens
ttcctttgcatatt

SEQ ID NO: 6752663 - DNA, 13 bp, Homo sapiens
ttcctttgccctt

SEQ ID NO: 6752664 - DNA, 12 bp, Homo sapiens
ttcctttgctag

SEQ ID NO: 6752665 - DNA, 14 bp, Homo sapiens
ttcctttgctctgg

SEQ ID NO: 6752666 - DNA, 22 bp, Homo sapiens
ttcctttggaacaagacagcct

SEQ ID NO: 6752667 - DNA, 14 bp, Homo sapiens
ttcctttggactgt

SEQ ID NO: 6752668 - DNA, 20 bp, Homo sapiens
ttcctttggccactgtattt

SEQ ID NO: 6752669 - DNA, 21 bp, Homo sapiens
ttcctttggccactgtatttg

SEQ ID NO: 6752670 - DNA, 15 bp, Homo sapiens
ttcctttggtgcctc

SEQ ID NO: 6752671 - DNA, 19 bp, Homo sapiens
ttcctttgtaatcactccc

SEQ ID NO: 6752672 - DNA, 20 bp, Homo sapiens
ttcctttgtaatcactccca

SEQ ID NO: 6752673 - DNA, 22 bp, Homo sapiens
ttcctttgtaatcactcccatt

SEQ ID NO: 6752674 - DNA, 19 bp, Homo sapiens
ttcctttgtaattgacact

SEQ ID NO: 6752675 - DNA, 20 bp, Homo sapiens
ttcctttgtggttttatgga

SEQ ID NO: 6752676 - DNA, 23 bp, Homo sapiens
ttccttttaaaaggccctgtggt

SEQ ID NO: 6752677 - DNA, 19 bp, Homo sapiens
ttccttttaaagaagcttt

SEQ ID NO: 6752678 - DNA, 12 bp, Homo sapiens
ttccttttactt

SEQ ID NO: 6752679 - DNA, 18 bp, Homo sapiens
ttccttttacttttcttc

SEQ ID NO: 6752680 - DNA, 20 bp, Homo sapiens
ttccttttatttcttcacca

SEQ ID NO: 6752681 - DNA, 21 bp, Homo sapiens
ttccttttcaggagatgggga

SEQ ID NO: 6752682 - DNA, 23 bp, Homo sapiens
ttccttttcccaggaaagaagca

SEQ ID NO: 6752683 - DNA, 16 bp, Homo sapiens
ttccttttccctgctt

SEQ ID NO: 6752684 - DNA, 18 bp, Homo sapiens
ttccttttctaactctcc

SEQ ID NO: 6752685 - DNA, 21 bp, Homo sapiens
ttccttttctattccttctgg

SEQ ID NO: 6752686 - DNA, 12 bp, Homo sapiens
ttccttttctct

SEQ ID NO: 6752687 - DNA, 16 bp, Homo sapiens
ttccttttctctcctg

SEQ ID NO: 6752688 - DNA, 18 bp, Homo sapiens
ttccttttctctcctgtg

SEQ ID NO: 6752689 - DNA, 16 bp, Homo sapiens
ttccttttctctgctt

SEQ ID NO: 6752690 - DNA, 14 bp, Homo sapiens
ttccttttcttaaa

SEQ ID NO: 6752691 - DNA, 15 bp, Homo sapiens
ttccttttcttaaaa

SEQ ID NO: 6752692 - DNA, 19 bp, Homo sapiens
ttccttttcttgtctctga

SEQ ID NO: 6752693 - DNA, 14 bp, Homo sapiens
ttccttttcttgtt

SEQ ID NO: 6752694 - DNA, 20 bp, Homo sapiens
ttccttttgaacgccccccc

SEQ ID NO: 6752695 - DNA, 23 bp, Homo sapiens
ttccttttgaacgccccccccca

SEQ ID NO: 6752696 - DNA, 15 bp, Homo sapiens
ttccttttgctgtgt

SEQ ID NO: 6752697 - DNA, 17 bp, Homo sapiens
ttccttttggaacattt

SEQ ID NO: 6752698 - DNA, 18 bp, Homo sapiens
ttccttttggaacatttc

SEQ ID NO: 6752699 - DNA, 20 bp, Homo sapiens
ttccttttggaacatttctt

SEQ ID NO: 6752700 - DNA, 17 bp, Homo sapiens
ttccttttgtaaagtaa

SEQ ID NO: 6752701 - DNA, 18 bp, Homo sapiens
ttcctttttaaatgtgaa

SEQ ID NO: 6752702 - DNA, 19 bp, Homo sapiens
ttcctttttaaatgtgaat

SEQ ID NO: 6752703 - DNA, 22 bp, Homo sapiens
ttcctttttaaatgtgaatttt

SEQ ID NO: 6752704 - DNA, 20 bp, Homo sapiens
ttcctttttatttatatgta

SEQ ID NO: 6752705 - DNA, 21 bp, Homo sapiens
ttcctttttcaaaaaccagcc

SEQ ID NO: 6752706 - DNA, 14 bp, Homo sapiens
ttcctttttcagat

SEQ ID NO: 6752707 - DNA, 14 bp, Homo sapiens
ttcctttttcatgt

SEQ ID NO: 6752708 - DNA, 22 bp, Homo sapiens
ttcctttttctagtttggcaca

SEQ ID NO: 6752709 - DNA, 13 bp, Homo sapiens
ttcctttttctat

SEQ ID NO: 6752710 - DNA, 15 bp, Homo sapiens
ttcctttttctatga

SEQ ID NO: 6752711 - DNA, 16 bp, Homo sapiens
ttcctttttctatgaa

SEQ ID NO: 6752712 - DNA, 17 bp, Homo sapiens
ttcctttttctatttta

SEQ ID NO: 6752713 - DNA, 17 bp, Homo sapiens
ttcctttttcttcgctg

SEQ ID NO: 6752714 - DNA, 18 bp, Homo sapiens
ttcctttttgacactgaa

SEQ ID NO: 6752715 - DNA, 15 bp, Homo sapiens
ttcctttttggggag

SEQ ID NO: 6752716 - DNA, 18 bp, Homo sapiens
ttccttttttaaaataaa

SEQ ID NO: 6752717 - DNA, 15 bp, Homo sapiens
ttccttttttataca

SEQ ID NO: 6752718 - DNA, 15 bp, Homo sapiens
ttccttttttcaata

SEQ ID NO: 6752719 - DNA, 23 bp, Homo sapiens
ttccttttttcaatatgcaagca

SEQ ID NO: 6752720 - DNA, 15 bp, Homo sapiens
ttccttttttgtcta

SEQ ID NO: 6752721 - DNA, 18 bp, Homo sapiens
ttccttttttgtctatga

SEQ ID NO: 6752722 - DNA, 17 bp, Homo sapiens
ttcctttttttaaattt

SEQ ID NO: 6752723 - DNA, 15 bp, Homo sapiens
ttcgaaaacagatga

SEQ ID NO: 6752724 - DNA, 13 bp, Homo sapiens
ttcgaaaagaaat

SEQ ID NO: 6752725 - DNA, 15 bp, Homo sapiens
ttcgaaaagaaattg

SEQ ID NO: 6752726 - DNA, 20 bp, Homo sapiens
ttcgaaaagcactttgaaaa

SEQ ID NO: 6752727 - DNA, 13 bp, Homo sapiens
ttcgaaaatcaaa

SEQ ID NO: 6752728 - DNA, 22 bp, Homo sapiens
ttcgaaacctgtccataaagta

SEQ ID NO: 6752729 - DNA, 19 bp, Homo sapiens
ttcgaaacctgtgatttct

SEQ ID NO: 6752730 - DNA, 14 bp, Homo sapiens
ttcgaaactgccaa

SEQ ID NO: 6752731 - DNA, 18 bp, Homo sapiens
ttcgaactgtgctcccac

SEQ ID NO: 6752732 - DNA, 14 bp, Homo sapiens
ttcgaagctcagcc

SEQ ID NO: 6752733 - DNA, 22 bp, Homo sapiens
ttcgaagctcagcccacccccc

SEQ ID NO: 6752734 - DNA, 23 bp, Homo sapiens
ttcgaagctgttaatttttctta

SEQ ID NO: 6752735 - DNA, 20 bp, Homo sapiens
ttcgaagggtcttaaagaat

SEQ ID NO: 6752736 - DNA, 21 bp, Homo sapiens
ttcgaagggtcttaaagaatt

SEQ ID NO: 6752737 - DNA, 14 bp, Homo sapiens
ttcgaagtcattaa

SEQ ID NO: 6752738 - DNA, 15 bp, Homo sapiens
ttcgaagtttgcaac

SEQ ID NO: 6752739 - DNA, 19 bp, Homo sapiens
ttcgaatatatctgtaaag

SEQ ID NO: 6752740 - DNA, 18 bp, Homo sapiens
ttcgaatggggtagaaac

SEQ ID NO: 6752741 - DNA, 15 bp, Homo sapiens
ttcgacatatttcct

SEQ ID NO: 6752742 - DNA, 22 bp, Homo sapiens
ttcgacatccgtcattgctgct

SEQ ID NO: 6752743 - DNA, 14 bp, Homo sapiens
ttcgacatgctgcc

SEQ ID NO: 6752744 - DNA, 15 bp, Homo sapiens
ttcgaccctggggcg

SEQ ID NO: 6752745 - DNA, 18 bp, Homo sapiens
ttcgacctgatttacagt

SEQ ID NO: 6752746 - DNA, 16 bp, Homo sapiens
ttcgactactgctcct

SEQ ID NO: 6752747 - DNA, 12 bp, Homo sapiens
ttcgactggtcc

SEQ ID NO: 6752748 - DNA, 18 bp, Homo sapiens
ttcgactggtccagctct

SEQ ID NO: 6752749 - DNA, 16 bp, Homo sapiens
ttcgactgttgttatc

SEQ ID NO: 6752750 - DNA, 17 bp, Homo sapiens
ttcgacttatttcttaa

SEQ ID NO: 6752751 - DNA, 20 bp, Homo sapiens
ttcgagaagctgctctggaa

SEQ ID NO: 6752752 - DNA, 21 bp, Homo sapiens
ttcgagaagctgctctggaat

SEQ ID NO: 6752753 - DNA, 18 bp, Homo sapiens
ttcgagaccaacctgacc

SEQ ID NO: 6752754 - DNA, 15 bp, Homo sapiens
ttcgagaccagccca

SEQ ID NO: 6752755 - DNA, 20 bp, Homo sapiens
ttcgagacccaaacccccaa

SEQ ID NO: 6752756 - DNA, 17 bp, Homo sapiens
ttcgagagcagcctggc

SEQ ID NO: 6752757 - DNA, 17 bp, Homo sapiens
ttcgagcaaacaacttt

SEQ ID NO: 6752758 - DNA, 22 bp, Homo sapiens
ttcgagctatatttaagtattc

SEQ ID NO: 6752759 - DNA, 19 bp, Homo sapiens
ttcgaggcggtttccagga

SEQ ID NO: 6752760 - DNA, 20 bp, Homo sapiens
ttcgaggtcctcctggcctg

SEQ ID NO: 6752761 - DNA, 15 bp, Homo sapiens
ttcgaggtgtcaccc

SEQ ID NO: 6752762 - DNA, 19 bp, Homo sapiens
ttcgaggttgccccttccc

SEQ ID NO: 6752763 - DNA, 20 bp, Homo sapiens
ttcgaggttgccccttcccc

SEQ ID NO: 6752764 - DNA, 18 bp, Homo sapiens
ttcgagtagagaggcccg

SEQ ID NO: 6752765 - DNA, 20 bp, Homo sapiens
ttcgataaacaacaaggtgg

SEQ ID NO: 6752766 - DNA, 20 bp, Homo sapiens
ttcgatacaccgggcctgga

SEQ ID NO: 6752767 - DNA, 23 bp, Homo sapiens
ttcgatcgtttcacatctgtata

SEQ ID NO: 6752768 - DNA, 20 bp, Homo sapiens
ttcgatggtacgtgaccctc

SEQ ID NO: 6752769 - DNA, 23 bp, Homo sapiens
ttcgatggtacgtgaccctctgc

SEQ ID NO: 6752770 - DNA, 12 bp, Homo sapiens
ttcgatgtacag

SEQ ID NO: 6752771 - DNA, 22 bp, Homo sapiens
ttcgatgtacagtctcaatttt

SEQ ID NO: 6752772 - DNA, 20 bp, Homo sapiens
ttcgatgtgcccaggggagc

SEQ ID NO: 6752773 - DNA, 21 bp, Homo sapiens
ttcgcacaatctacactgcct

SEQ ID NO: 6752774 - DNA, 22 bp, Homo sapiens
ttcgcacaatctacactgcctt

SEQ ID NO: 6752775 - DNA, 15 bp, Homo sapiens
ttcgcacacacccat

SEQ ID NO: 6752776 - DNA, 16 bp, Homo sapiens
ttcgcacactgtgatt

SEQ ID NO: 6752777 - DNA, 14 bp, Homo sapiens
ttcgcacagcagtt

SEQ ID NO: 6752778 - DNA, 20 bp, Homo sapiens
ttcgcagagcttttcagatt

SEQ ID NO: 6752779 - DNA, 23 bp, Homo sapiens
ttcgcagcacagagtcgctggca

SEQ ID NO: 6752780 - DNA, 22 bp, Homo sapiens
ttcgcagcagctccgcctggca

SEQ ID NO: 6752781 - DNA, 13 bp, Homo sapiens
ttcgcagccaccc

SEQ ID NO: 6752782 - DNA, 16 bp, Homo sapiens
ttcgcagccaccctga

SEQ ID NO: 6752783 - DNA, 23 bp, Homo sapiens
ttcgcagctcatcttttcctgct

SEQ ID NO: 6752784 - DNA, 21 bp, Homo sapiens
ttcgcaggattcttcctccct

SEQ ID NO: 6752785 - DNA, 14 bp, Homo sapiens
ttcgcataaagaag

SEQ ID NO: 6752786 - DNA, 19 bp, Homo sapiens
ttcgcatggtcacacactg

SEQ ID NO: 6752787 - DNA, 14 bp, Homo sapiens
ttcgcatgtttaat

SEQ ID NO: 6752788 - DNA, 18 bp, Homo sapiens
ttcgcatgtttaatgtga

SEQ ID NO: 6752789 - DNA, 21 bp, Homo sapiens
ttcgcatgtttaatgtgaact

SEQ ID NO: 6752790 - DNA, 17 bp, Homo sapiens
ttcgcattaagcacaca

SEQ ID NO: 6752791 - DNA, 20 bp, Homo sapiens
ttcgcccgagctgtttatgt

SEQ ID NO: 6752792 - DNA, 19 bp, Homo sapiens
ttcgccctctgaaattaaa

SEQ ID NO: 6752793 - DNA, 20 bp, Homo sapiens
ttcgccgtggctgcggcacc

SEQ ID NO: 6752794 - DNA, 21 bp, Homo sapiens
ttcgccgtggctgcggcaccc

SEQ ID NO: 6752795 - DNA, 21 bp, Homo sapiens
ttcgcctcctccagctcctgc

SEQ ID NO: 6752796 - DNA, 22 bp, Homo sapiens
ttcgcctcctccagctcctgcc

SEQ ID NO: 6752797 - DNA, 12 bp, Homo sapiens
ttcgcctgtggg

SEQ ID NO: 6752798 - DNA, 16 bp, Homo sapiens
ttcgcctgtgggaaga

SEQ ID NO: 6752799 - DNA, 13 bp, Homo sapiens
ttcgccttaaact

SEQ ID NO: 6752800 - DNA, 16 bp, Homo sapiens
ttcgcctttgtcttgt

SEQ ID NO: 6752801 - DNA, 19 bp, Homo sapiens
ttcgcgggtaactggggtt

SEQ ID NO: 6752802 - DNA, 20 bp, Homo sapiens
ttcgctatgggaggcagccg

SEQ ID NO: 6752803 - DNA, 14 bp, Homo sapiens
ttcgctattcccag

SEQ ID NO: 6752804 - DNA, 17 bp, Homo sapiens
ttcgctattcccaggca

SEQ ID NO: 6752805 - DNA, 12 bp, Homo sapiens
ttctatgatcag

SEQ ID NO: 6752806 - DNA, 14 bp, Homo sapiens
ttctatgcagtggc

SEQ ID NO: 6752807 - DNA, 22 bp, Homo sapiens
ttctatgcataaaaaaatgatg

SEQ ID NO: 6752808 - DNA, 20 bp, Homo sapiens
ttctatgccatttttagttt

SEQ ID NO: 6752809 - DNA, 16 bp, Homo sapiens
ttctatgctaaactgt

SEQ ID NO: 6752810 - DNA, 16 bp, Homo sapiens
ttctatgctgcttcca

SEQ ID NO: 6752811 - DNA, 16 bp, Homo sapiens
ttctatgctgctttta

SEQ ID NO: 6752812 - DNA, 23 bp, Homo sapiens
ttctatgctgcttttatatctgt

SEQ ID NO: 6752813 - DNA, 18 bp, Homo sapiens
ttctatggaatagttctg

SEQ ID NO: 6752814 - DNA, 15 bp, Homo sapiens
ttctatggagacttt

SEQ ID NO: 6752815 - DNA, 20 bp, Homo sapiens
ttctatggattcacttctat

SEQ ID NO: 6752816 - DNA, 22 bp, Homo sapiens
ttctatggattcacttctattt

SEQ ID NO: 6752817 - DNA, 13 bp, Homo sapiens
ttctatggcatat

SEQ ID NO: 6752818 - DNA, 15 bp, Homo sapiens
ttctatggctttcaa

SEQ ID NO: 6752819 - DNA, 22 bp, Homo sapiens
ttctatgtaaattattgtaaac

SEQ ID NO: 6752820 - DNA, 14 bp, Homo sapiens
ttctatgtaacttg

SEQ ID NO: 6752821 - DNA, 15 bp, Homo sapiens
ttctatgtaacttgt

SEQ ID NO: 6752822 - DNA, 17 bp, Homo sapiens
ttctatgtaacttgttg

SEQ ID NO: 6752823 - DNA, 16 bp, Homo sapiens
ttctatgtcattttta

SEQ ID NO: 6752824 - DNA, 22 bp, Homo sapiens
ttctatgtgacaattttgtaca

SEQ ID NO: 6752825 - DNA, 17 bp, Homo sapiens
ttctatgttcataaaaa

SEQ ID NO: 6752826 - DNA, 13 bp, Homo sapiens
ttctatgtttact

SEQ ID NO: 6752827 - DNA, 21 bp, Homo sapiens
ttctatgtttttttaattaaa

SEQ ID NO: 6752828 - DNA, 16 bp, Homo sapiens
ttctattaaaagactc

SEQ ID NO: 6752829 - DNA, 19 bp, Homo sapiens
ttctattaaaagactcatc

SEQ ID NO: 6752830 - DNA, 12 bp, Homo sapiens
ttctattaaagt

SEQ ID NO: 6752831 - DNA, 15 bp, Homo sapiens
ttctattaaagtgct

SEQ ID NO: 6752832 - DNA, 16 bp, Homo sapiens
ttctattaatatttat

SEQ ID NO: 6752833 - DNA, 21 bp, Homo sapiens
ttctattaatatttatgtgtt

SEQ ID NO: 6752834 - DNA, 17 bp, Homo sapiens
ttctattaatcaagaga

SEQ ID NO: 6752835 - DNA, 15 bp, Homo sapiens
ttctattacacaagt

SEQ ID NO: 6752836 - DNA, 20 bp, Homo sapiens
ttctattacacaagtttaaa

SEQ ID NO: 6752837 - DNA, 17 bp, Homo sapiens
ttctattacccctcatt

SEQ ID NO: 6752838 - DNA, 12 bp, Homo sapiens
ttctattagttt

SEQ ID NO: 6752839 - DNA, 14 bp, Homo sapiens
ttctattatatatt

SEQ ID NO: 6752840 - DNA, 13 bp, Homo sapiens
ttctattcattat

SEQ ID NO: 6752841 - DNA, 14 bp, Homo sapiens
ttctattccttctg

SEQ ID NO: 6752842 - DNA, 15 bp, Homo sapiens
ttctattctccagac

SEQ ID NO: 6752843 - DNA, 16 bp, Homo sapiens
ttctattctccagaca

SEQ ID NO: 6752844 - DNA, 15 bp, Homo sapiens
ttctattgaaaacag

SEQ ID NO: 6752845 - DNA, 20 bp, Homo sapiens
ttctattgactttcttaaaa

SEQ ID NO: 6752846 - DNA, 14 bp, Homo sapiens
ttctattgcctctg

SEQ ID NO: 6752847 - DNA, 12 bp, Homo sapiens
ttctattgcctt

SEQ ID NO: 6752848 - DNA, 14 bp, Homo sapiens
ttctattgtacaga

SEQ ID NO: 6752849 - DNA, 17 bp, Homo sapiens
ttctattgtattatttg

SEQ ID NO: 6752850 - DNA, 18 bp, Homo sapiens
ttctattgtattatttgg

SEQ ID NO: 6752851 - DNA, 14 bp, Homo sapiens
ttctattgttactc

SEQ ID NO: 6752852 - DNA, 17 bp, Homo sapiens
ttctattgttactctgg

SEQ ID NO: 6752853 - DNA, 19 bp, Homo sapiens
ttctattgttactctggtt

SEQ ID NO: 6752854 - DNA, 22 bp, Homo sapiens
ttctattgttactctggttctt

SEQ ID NO: 6752855 - DNA, 15 bp, Homo sapiens
ttctattgtttacta

SEQ ID NO: 6752856 - DNA, 17 bp, Homo sapiens
ttctattgtttattctt

SEQ ID NO: 6752857 - DNA, 18 bp, Homo sapiens
ttctatttaattgaaact

SEQ ID NO: 6752858 - DNA, 12 bp, Homo sapiens
ttctatttagtt

SEQ ID NO: 6752859 - DNA, 18 bp, Homo sapiens
ttctatttatatgtacat

SEQ ID NO: 6752860 - DNA, 17 bp, Homo sapiens
ttctatttattcctgtt

SEQ ID NO: 6752861 - DNA, 21 bp, Homo sapiens
ttctatttatttatttattca

SEQ ID NO: 6752862 - DNA, 14 bp, Homo sapiens
ttctatttatttgt

SEQ ID NO: 6752863 - DNA, 20 bp, Homo sapiens
ttctatttcactaatcatga

SEQ ID NO: 6752864 - DNA, 14 bp, Homo sapiens
ttctatttccataa

SEQ ID NO: 6752865 - DNA, 16 bp, Homo sapiens
ttctatttctatctgc

SEQ ID NO: 6752866 - DNA, 21 bp, Homo sapiens
ttctatttctctgtgtattta

SEQ ID NO: 6752867 - DNA, 15 bp, Homo sapiens
ttctatttgctgggc

SEQ ID NO: 6752868 - DNA, 16 bp, Homo sapiens
ttctatttgctgggct

SEQ ID NO: 6752869 - DNA, 17 bp, Homo sapiens
ttctatttgctgggctt

SEQ ID NO: 6752870 - DNA, 18 bp, Homo sapiens
ttctatttggggcttgat

SEQ ID NO: 6752871 - DNA, 19 bp, Homo sapiens
ttctattttattatgaaga

SEQ ID NO: 6752872 - DNA, 20 bp, Homo sapiens
ttctattttattatgaagaa

SEQ ID NO: 6752873 - DNA, 14 bp, Homo sapiens
ttctattttcacaa

SEQ ID NO: 6752874 - DNA, 13 bp, Homo sapiens
ttctattttctat

SEQ ID NO: 6752875 - DNA, 21 bp, Homo sapiens
ttctatttttatgatgacaat

SEQ ID NO: 6752876 - DNA, 18 bp, Homo sapiens
ttctatttttcttctaaa

SEQ ID NO: 6752877 - DNA, 22 bp, Homo sapiens
ttctattttttataaatatcat

SEQ ID NO: 6752878 - DNA, 15 bp, Homo sapiens
ttctcaaaatacgtg

SEQ ID NO: 6752879 - DNA, 21 bp, Homo sapiens
ttctcaaaatacgtgttcaaa

SEQ ID NO: 6752880 - DNA, 13 bp, Homo sapiens
ttctcaaacacag

SEQ ID NO: 6752881 - DNA, 15 bp, Homo sapiens
ttctcaaacctccaa

SEQ ID NO: 6752882 - DNA, 13 bp, Homo sapiens
ttctcaaagaaat

SEQ ID NO: 6752883 - DNA, 18 bp, Homo sapiens
ttctcaaagatctgaatt

SEQ ID NO: 6752884 - DNA, 12 bp, Homo sapiens
ttctcaaagcag

SEQ ID NO: 6752885 - DNA, 18 bp, Homo sapiens
ttctcaaaggccctcagt

SEQ ID NO: 6752886 - DNA, 19 bp, Homo sapiens
ttctcaaaggccctcagtg

SEQ ID NO: 6752887 - DNA, 14 bp, Homo sapiens
ttctcaaagttaat

SEQ ID NO: 6752888 - DNA, 18 bp, Homo sapiens
ttctcaaagttaattcac

SEQ ID NO: 6752889 - DNA, 19 bp, Homo sapiens
ttctcaaagttttattata

SEQ ID NO: 6752890 - DNA, 17 bp, Homo sapiens
ttctcaaagttttgaaa

SEQ ID NO: 6752891 - DNA, 23 bp, Homo sapiens
ttctcaaagtttttacagtgtat

SEQ ID NO: 6752892 - DNA, 15 bp, Homo sapiens
ttctcaaatctgctt

SEQ ID NO: 6752893 - DNA, 18 bp, Homo sapiens
ttctcaaatgctaaatgc

SEQ ID NO: 6752894 - DNA, 16 bp, Homo sapiens
ttctcaaatgctactc

SEQ ID NO: 6752895 - DNA, 20 bp, Homo sapiens
ttctcaaatgctactcagta

SEQ ID NO: 6752896 - DNA, 13 bp, Homo sapiens
ttctcaaatgtgt

SEQ ID NO: 6752897 - DNA, 21 bp, Homo sapiens
ttctcaacaaagcacagtgtt

SEQ ID NO: 6752898 - DNA, 15 bp, Homo sapiens
ttctcaacagttcat

SEQ ID NO: 6752899 - DNA, 16 bp, Homo sapiens
ttctcaacatactgta

SEQ ID NO: 6752900 - DNA, 17 bp, Homo sapiens
ttctcaacgcagtaatt

SEQ ID NO: 6752901 - DNA, 18 bp, Homo sapiens
ttctcaactccaaactga

SEQ ID NO: 6752902 - DNA, 11 bp, Homo sapiens
ttctcaagaat

SEQ ID NO: 6752903 - DNA, 20 bp, Homo sapiens
ttctcaagacctgagtattt

SEQ ID NO: 6752904 - DNA, 17 bp, Homo sapiens
ttctcaagactttagct

SEQ ID NO: 6752905 - DNA, 18 bp, Homo sapiens
ttctcaagcactgacact

SEQ ID NO: 6752906 - DNA, 22 bp, Homo sapiens
ttctcaagcgctatccacagaa

SEQ ID NO: 6752907 - DNA, 17 bp, Homo sapiens
ttctcaagttctaagat

SEQ ID NO: 6752908 - DNA, 18 bp, Homo sapiens
ttctcaagttctaagatt

SEQ ID NO: 6752909 - DNA, 22 bp, Homo sapiens
ttctcaatacttgaatatggaa

SEQ ID NO: 6752910 - DNA, 16 bp, Homo sapiens
ttctcaatagttctta

SEQ ID NO: 6752911 - DNA, 19 bp, Homo sapiens
ttctcaatcactgctcccc

SEQ ID NO: 6752912 - DNA, 12 bp, Homo sapiens
ttctcaatcatt

SEQ ID NO: 6752913 - DNA, 14 bp, Homo sapiens
ttctcaatcattgt

SEQ ID NO: 6752914 - DNA, 20 bp, Homo sapiens
ttctcaatcattgtcagaga

SEQ ID NO: 6752915 - DNA, 13 bp, Homo sapiens
ttctcaatgaaaa

SEQ ID NO: 6752916 - DNA, 14 bp, Homo sapiens
ttctcaatgaaaaa

SEQ ID NO: 6752917 - DNA, 14 bp, Homo sapiens
ttctcaattccaac

SEQ ID NO: 6752918 - DNA, 20 bp, Homo sapiens
ttctcaattccaacagttta

SEQ ID NO: 6752919 - DNA, 23 bp, Homo sapiens
ttctcaattgtatagttatattt

SEQ ID NO: 6752920 - DNA, 13 bp, Homo sapiens
ttctcaatttatt

SEQ ID NO: 6752921 - DNA, 12 bp, Homo sapiens
ttctcacaaaaa

SEQ ID NO: 6752922 - DNA, 11 bp, Homo sapiens
ttctcacaatt

SEQ ID NO: 6752923 - DNA, 18 bp, Homo sapiens
ttctcacaattgtaaagt

SEQ ID NO: 6752924 - DNA, 15 bp, Homo sapiens
ttctcacacccaccg

SEQ ID NO: 6752925 - DNA, 22 bp, Homo sapiens
ttctcacacccaccgtccgccc

SEQ ID NO: 6752926 - DNA, 22 bp, Homo sapiens
ttctcacactctaactgtatat

SEQ ID NO: 6752927 - DNA, 21 bp, Homo sapiens
ttctcacactggtctgctgtc

SEQ ID NO: 6752928 - DNA, 21 bp, Homo sapiens
ttctcacagtgggagccaggg

SEQ ID NO: 6752929 - DNA, 18 bp, Homo sapiens
ttctcacatctgtccaga

SEQ ID NO: 6752930 - DNA, 21 bp, Homo sapiens
ttctcacatgtggctccccct

SEQ ID NO: 6752931 - DNA, 22 bp, Homo sapiens
ttctcacatgtggctccccctg

SEQ ID NO: 6752932 - DNA, 15 bp, Homo sapiens
ttctcacattgctgt

SEQ ID NO: 6752933 - DNA, 14 bp, Homo sapiens
ttctcaccagctgt

SEQ ID NO: 6752934 - DNA, 19 bp, Homo sapiens
ttctcaccctctgtccttc

SEQ ID NO: 6752935 - DNA, 14 bp, Homo sapiens
ttctcacctgcctt

SEQ ID NO: 6752936 - DNA, 23 bp, Homo sapiens
ttctcacctttcccacctctctc

SEQ ID NO: 6752937 - DNA, 15 bp, Homo sapiens
ttctcacgctttgtt

SEQ ID NO: 6752938 - DNA, 21 bp, Homo sapiens
ttctcacgctttgtttactct

SEQ ID NO: 6752939 - DNA, 18 bp, Homo sapiens
ttctcactctgctttgca

SEQ ID NO: 6752940 - DNA, 14 bp, Homo sapiens
ttctcactgaactc

SEQ ID NO: 6752941 - DNA, 21 bp, Homo sapiens
ttctcactgccatgccagctt

SEQ ID NO: 6752942 - DNA, 21 bp, Homo sapiens
ttctcagaacaccaagtaaat

SEQ ID NO: 6752943 - DNA, 17 bp, Homo sapiens
ttctcagaaccatttca

SEQ ID NO: 6752944 - DNA, 19 bp, Homo sapiens
ttctcagaaggcaaatgac

SEQ ID NO: 6752945 - DNA, 15 bp, Homo sapiens
ttctcagaagtgaaa

SEQ ID NO: 6752946 - DNA, 21 bp, Homo sapiens
ttctcagaagtgaaaaagact

SEQ ID NO: 6752947 - DNA, 22 bp, Homo sapiens
ttctcagactctttcttcacta

SEQ ID NO: 6752948 - DNA, 15 bp, Homo sapiens
ttctcagactggtct

SEQ ID NO: 6752949 - DNA, 13 bp, Homo sapiens
ttctcagagcagc

SEQ ID NO: 6752950 - DNA, 16 bp, Homo sapiens
ttctcagagcatgtgt

SEQ ID NO: 6752951 - DNA, 17 bp, Homo sapiens
ttctcagagcatgtgtc

SEQ ID NO: 6752952 - DNA, 21 bp, Homo sapiens
ttctcagagctccacagaaga

SEQ ID NO: 6752953 - DNA, 18 bp, Homo sapiens
ttctcagaggggccagct

SEQ ID NO: 6752954 - DNA, 19 bp, Homo sapiens
ttctcagagtggtggggga

SEQ ID NO: 6752955 - DNA, 14 bp, Homo sapiens
ttctcagatattta

SEQ ID NO: 6752956 - DNA, 15 bp, Homo sapiens
ttctcagatatttat

SEQ ID NO: 6752957 - DNA, 16 bp, Homo sapiens
ttctcagatttctgag

SEQ ID NO: 6752958 - DNA, 20 bp, Homo sapiens
ttctcagcaagtgtacagta

SEQ ID NO: 6752959 - DNA, 13 bp, Homo sapiens
ttctcagcagagt

SEQ ID NO: 6752960 - DNA, 13 bp, Homo sapiens
ttctcagcccctt

SEQ ID NO: 6752961 - DNA, 15 bp, Homo sapiens
ttctcagcctccgga

SEQ ID NO: 6752962 - DNA, 19 bp, Homo sapiens
ttctcagccttggttcctg

SEQ ID NO: 6752963 - DNA, 14 bp, Homo sapiens
ttctcagctccccc

SEQ ID NO: 6752964 - DNA, 12 bp, Homo sapiens
ttctcagctccg

SEQ ID NO: 6752965 - DNA, 14 bp, Homo sapiens
ttctcagctgtgcc

SEQ ID NO: 6752966 - DNA, 12 bp, Homo sapiens
ttctcaggaaat

SEQ ID NO: 6752967 - DNA, 18 bp, Homo sapiens
ttctcaggaaatggcttt

SEQ ID NO: 6752968 - DNA, 23 bp, Homo sapiens
ttctcaggacagcatcccttccc

SEQ ID NO: 6752969 - DNA, 15 bp, Homo sapiens
ttctcaggacgacga

SEQ ID NO: 6752970 - DNA, 19 bp, Homo sapiens
ttctcaggaggtgtctcct

SEQ ID NO: 6752971 - DNA, 21 bp, Homo sapiens
ttctcaggcacttgaggcttt

SEQ ID NO: 6752972 - DNA, 17 bp, Homo sapiens
ttctcaggcatgaacat

SEQ ID NO: 6752973 - DNA, 12 bp, Homo sapiens
ttctcagggctc

SEQ ID NO: 6752974 - DNA, 15 bp, Homo sapiens
ttctcagggctcctg

SEQ ID NO: 6752975 - DNA, 18 bp, Homo sapiens
ttctcagggctcctgcct

SEQ ID NO: 6752976 - DNA, 18 bp, Homo sapiens
ttctcagggtcactgtcc

SEQ ID NO: 6752977 - DNA, 16 bp, Homo sapiens
ttctcaggtgttgcca

SEQ ID NO: 6752978 - DNA, 21 bp, Homo sapiens
ttctcagtgccaactgtggct

SEQ ID NO: 6752979 - DNA, 12 bp, Homo sapiens
ttctcagtgccg

SEQ ID NO: 6752980 - DNA, 22 bp, Homo sapiens
ttctcagtggtcaccttcctca

SEQ ID NO: 6752981 - DNA, 12 bp, Homo sapiens
ttctcagtgtgt

SEQ ID NO: 6752982 - DNA, 21 bp, Homo sapiens
ttctcagttgcagaaaatgaa

SEQ ID NO: 6752983 - DNA, 16 bp, Homo sapiens
ttctcagtttctgcct

SEQ ID NO: 6752984 - DNA, 21 bp, Homo sapiens
ttctctgcaattttactgtga

SEQ ID NO: 6752985 - DNA, 11 bp, Homo sapiens
ttctctgcaga

SEQ ID NO: 6752986 - DNA, 14 bp, Homo sapiens
ttctctgcagtaaa

SEQ ID NO: 6752987 - DNA, 15 bp, Homo sapiens
ttctctgcccacagt

SEQ ID NO: 6752988 - DNA, 12 bp, Homo sapiens
ttctctgcccag

SEQ ID NO: 6752989 - DNA, 14 bp, Homo sapiens
ttctctgcccagcc

SEQ ID NO: 6752990 - DNA, 18 bp, Homo sapiens
ttctctgcccagcttttc

SEQ ID NO: 6752991 - DNA, 21 bp, Homo sapiens
ttctctgcccagcttttcatt

SEQ ID NO: 6752992 - DNA, 21 bp, Homo sapiens
ttctctgcccattccccagcc

SEQ ID NO: 6752993 - DNA, 12 bp, Homo sapiens
ttctctgccctc

SEQ ID NO: 6752994 - DNA, 17 bp, Homo sapiens
ttctctgccctccaaga

SEQ ID NO: 6752995 - DNA, 18 bp, Homo sapiens
ttctctgccctgccctgg

SEQ ID NO: 6752996 - DNA, 20 bp, Homo sapiens
ttctctgccggtggggccag

SEQ ID NO: 6752997 - DNA, 11 bp, Homo sapiens
ttctctgcctc

SEQ ID NO: 6752998 - DNA, 14 bp, Homo sapiens
ttctctgcctcacc

SEQ ID NO: 6752999 - DNA, 14 bp, Homo sapiens
ttctctgcctcctc

SEQ ID NO: 6753000 - DNA, 12 bp, Homo sapiens
ttctctgcctct

SEQ ID NO: 6753001 - DNA, 15 bp, Homo sapiens
ttctctgcctctggg

SEQ ID NO: 6753002 - DNA, 16 bp, Homo sapiens
ttctctgcctctgggc

SEQ ID NO: 6753003 - DNA, 13 bp, Homo sapiens
ttctctgcctggc

SEQ ID NO: 6753004 - DNA, 15 bp, Homo sapiens
ttctctgcctggcaa

SEQ ID NO: 6753005 - DNA, 20 bp, Homo sapiens
ttctctgcctttgacattta

SEQ ID NO: 6753006 - DNA, 19 bp, Homo sapiens
ttctctgctagatttctac

SEQ ID NO: 6753007 - DNA, 15 bp, Homo sapiens
ttctctgctccacca

SEQ ID NO: 6753008 - DNA, 14 bp, Homo sapiens
ttctctgctcttgt

SEQ ID NO: 6753009 - DNA, 10 bp, Homo sapiens
ttctctgctg

SEQ ID NO: 6753010 - DNA, 11 bp, Homo sapiens
ttctctgctga

SEQ ID NO: 6753011 - DNA, 19 bp, Homo sapiens
ttctctgctgcctctgtgg

SEQ ID NO: 6753012 - DNA, 16 bp, Homo sapiens
ttctctgctgtcctaa

SEQ ID NO: 6753013 - DNA, 12 bp, Homo sapiens
ttctctgcttca

SEQ ID NO: 6753014 - DNA, 19 bp, Homo sapiens
ttctctgcttcagcttgct

SEQ ID NO: 6753015 - DNA, 22 bp, Homo sapiens
ttctctggaaaggggggagctg

SEQ ID NO: 6753016 - DNA, 24 bp, Homo sapiens
ttctctggacactgccactctccc

SEQ ID NO: 6753017 - DNA, 17 bp, Homo sapiens
ttctctggcaaactttt

SEQ ID NO: 6753018 - DNA, 15 bp, Homo sapiens
ttctctggctccaga

SEQ ID NO: 6753019 - DNA, 12 bp, Homo sapiens
ttctctgggacc

SEQ ID NO: 6753020 - DNA, 19 bp, Homo sapiens
ttctctgggagaaaatcat

SEQ ID NO: 6753021 - DNA, 17 bp, Homo sapiens
ttctctgggctgaatgt

SEQ ID NO: 6753022 - DNA, 21 bp, Homo sapiens
ttctctgggtaggtgttgaaa

SEQ ID NO: 6753023 - DNA, 16 bp, Homo sapiens
ttctctgggtgagaat

SEQ ID NO: 6753024 - DNA, 19 bp, Homo sapiens
ttctctggtggtcttcctt

SEQ ID NO: 6753025 - DNA, 13 bp, Homo sapiens
ttctctgtaatta

SEQ ID NO: 6753026 - DNA, 15 bp, Homo sapiens
ttctctgtaattaca

SEQ ID NO: 6753027 - DNA, 17 bp, Homo sapiens
ttctctgtaattacaac

SEQ ID NO: 6753028 - DNA, 14 bp, Homo sapiens
ttctctgtactttt

SEQ ID NO: 6753029 - DNA, 15 bp, Homo sapiens
ttctctgtagttcct

SEQ ID NO: 6753030 - DNA, 12 bp, Homo sapiens
ttctctgtatat

SEQ ID NO: 6753031 - DNA, 16 bp, Homo sapiens
ttctctgtatgaatgt

SEQ ID NO: 6753032 - DNA, 20 bp, Homo sapiens
ttctctgtcctctgctttgc

SEQ ID NO: 6753033 - DNA, 12 bp, Homo sapiens
ttctctgtctca

SEQ ID NO: 6753034 - DNA, 22 bp, Homo sapiens
ttctctgtctcagacttttgta

SEQ ID NO: 6753035 - DNA, 13 bp, Homo sapiens
ttctctgtctcat

SEQ ID NO: 6753036 - DNA, 22 bp, Homo sapiens
ttctctgtgaaagctttggaaa

SEQ ID NO: 6753037 - DNA, 12 bp, Homo sapiens
ttctctgtgaat

SEQ ID NO: 6753038 - DNA, 19 bp, Homo sapiens
ttctctgtgacccacttct

SEQ ID NO: 6753039 - DNA, 18 bp, Homo sapiens
ttctctgtgcccctgtaa

SEQ ID NO: 6753040 - DNA, 17 bp, Homo sapiens
ttctctgtgtctaagat

SEQ ID NO: 6753041 - DNA, 22 bp, Homo sapiens
ttctctgtgtctaagattctag

SEQ ID NO: 6753042 - DNA, 23 bp, Homo sapiens
ttctctgtgtctaagattctaga

SEQ ID NO: 6753043 - DNA, 19 bp, Homo sapiens
ttctctgtgtttgttccta

SEQ ID NO: 6753044 - DNA, 14 bp, Homo sapiens
ttctctgttaacct

SEQ ID NO: 6753045 - DNA, 23 bp, Homo sapiens
ttctctgttctacccgttccaaa

SEQ ID NO: 6753046 - DNA, 20 bp, Homo sapiens
ttctctgttgtcgtaaagat

SEQ ID NO: 6753047 - DNA, 14 bp, Homo sapiens
ttctctgtttgctt

SEQ ID NO: 6753048 - DNA, 17 bp, Homo sapiens
ttctcttaaatattctg

SEQ ID NO: 6753049 - DNA, 19 bp, Homo sapiens
ttctcttaagattaatttt

SEQ ID NO: 6753050 - DNA, 15 bp, Homo sapiens
ttctcttaatttaat

SEQ ID NO: 6753051 - DNA, 16 bp, Homo sapiens
ttctcttacctgttat

SEQ ID NO: 6753052 - DNA, 18 bp, Homo sapiens
ttctcttacgctctctgt

SEQ ID NO: 6753053 - DNA, 19 bp, Homo sapiens
ttctcttactttttgtaaa

SEQ ID NO: 6753054 - DNA, 14 bp, Homo sapiens
ttctcttagagatt

SEQ ID NO: 6753055 - DNA, 20 bp, Homo sapiens
ttctcttagagattttcatt

SEQ ID NO: 6753056 - DNA, 18 bp, Homo sapiens
ttctcttagctactgtat

SEQ ID NO: 6753057 - DNA, 22 bp, Homo sapiens
ttctcttaggtggctctgggaa

SEQ ID NO: 6753058 - DNA, 19 bp, Homo sapiens
ttctcttatcctctctctc

SEQ ID NO: 6753059 - DNA, 16 bp, Homo sapiens
ttctcttcccaggcct

SEQ ID NO: 6753060 - DNA, 21 bp, Homo sapiens
ttctcttccccttagaaacac

SEQ ID NO: 6753061 - DNA, 17 bp, Homo sapiens
ttctcttccccttcctg

SEQ ID NO: 6753062 - DNA, 16 bp, Homo sapiens
ttctcttcccttccca

SEQ ID NO: 6753063 - DNA, 13 bp, Homo sapiens
ttctcttcctaaa

SEQ ID NO: 6753064 - DNA, 16 bp, Homo sapiens
ttctcttcctagatct

SEQ ID NO: 6753065 - DNA, 12 bp, Homo sapiens
ttctcttcctgt

SEQ ID NO: 6753066 - DNA, 20 bp, Homo sapiens
ttctcttccttttatcagta

SEQ ID NO: 6753067 - DNA, 13 bp, Homo sapiens
ttctcttctaaca

SEQ ID NO: 6753068 - DNA, 18 bp, Homo sapiens
ttctcttctacttcttgt

SEQ ID NO: 6753069 - DNA, 17 bp, Homo sapiens
ttctcttctatcctgca

SEQ ID NO: 6753070 - DNA, 13 bp, Homo sapiens
ttctcttctcaga

SEQ ID NO: 6753071 - DNA, 20 bp, Homo sapiens
ttctcttctccccttccatt

SEQ ID NO: 6753072 - DNA, 21 bp, Homo sapiens
ttctcttctccccttccattt

SEQ ID NO: 6753073 - DNA, 14 bp, Homo sapiens
ttctcttctcctgt

SEQ ID NO: 6753074 - DNA, 13 bp, Homo sapiens
ttctcttctctgc

SEQ ID NO: 6753075 - DNA, 16 bp, Homo sapiens
ttctcttctctgcaat

SEQ ID NO: 6753076 - DNA, 15 bp, Homo sapiens
ttctcttctgtccat

SEQ ID NO: 6753077 - DNA, 22 bp, Homo sapiens
ttctcttgaaggtgctgccacc

SEQ ID NO: 6753078 - DNA, 13 bp, Homo sapiens
ttctcttgaatta

SEQ ID NO: 6753079 - DNA, 15 bp, Homo sapiens
ttctcttgagctggc

SEQ ID NO: 6753080 - DNA, 18 bp, Homo sapiens
ttctcttgagtcacactg

SEQ ID NO: 6753081 - DNA, 13 bp, Homo sapiens
ttctcttgcattg

SEQ ID NO: 6753082 - DNA, 14 bp, Homo sapiens
ttctcttgcctcag

SEQ ID NO: 6753083 - DNA, 18 bp, Homo sapiens
ttctcttgccttaaatat

SEQ ID NO: 6753084 - DNA, 16 bp, Homo sapiens
ttctcttggctggctt

SEQ ID NO: 6753085 - DNA, 15 bp, Homo sapiens
ttctcttgggcaggc

SEQ ID NO: 6753086 - DNA, 14 bp, Homo sapiens
ttctcttgggtggg

SEQ ID NO: 6753087 - DNA, 23 bp, Homo sapiens
ttctcttgggtgggacagggctt

SEQ ID NO: 6753088 - DNA, 15 bp, Homo sapiens
ttctcttgtaaaaag

SEQ ID NO: 6753089 - DNA, 13 bp, Homo sapiens
ttctcttgtttaa

SEQ ID NO: 6753090 - DNA, 17 bp, Homo sapiens
ttctctttaactcagga

SEQ ID NO: 6753091 - DNA, 16 bp, Homo sapiens
ttctctttaatctcat

SEQ ID NO: 6753092 - DNA, 17 bp, Homo sapiens
ttctctttaccttctaa

SEQ ID NO: 6753093 - DNA, 12 bp, Homo sapiens
ttctctttagga

SEQ ID NO: 6753094 - DNA, 13 bp, Homo sapiens
ttctctttcaaag

SEQ ID NO: 6753095 - DNA, 19 bp, Homo sapiens
ttctctttcaattctgtga

SEQ ID NO: 6753096 - DNA, 16 bp, Homo sapiens
ttctctttccatgaca

SEQ ID NO: 6753097 - DNA, 14 bp, Homo sapiens
ttctctttcctcat

SEQ ID NO: 6753098 - DNA, 20 bp, Homo sapiens
ttctctttcctctaactcat

SEQ ID NO: 6753099 - DNA, 14 bp, Homo sapiens
ttctctttctctcc

SEQ ID NO: 6753100 - DNA, 17 bp, Homo sapiens
ttctctttctctctcac

SEQ ID NO: 6753101 - DNA, 12 bp, Homo sapiens
ttctctttctgt

SEQ ID NO: 6753102 - DNA, 16 bp, Homo sapiens
ttctctttctgtttcc

SEQ ID NO: 6753103 - DNA, 17 bp, Homo sapiens
ttctctttctgtttcct

SEQ ID NO: 6753104 - DNA, 11 bp, Homo sapiens
ttctctttctt

SEQ ID NO: 6753105 - DNA, 23 bp, Homo sapiens
ttctctttcttattttgtaataa

SEQ ID NO: 6753106 - DNA, 12 bp, Homo sapiens
ttctctttgaaa

SEQ ID NO: 6753107 - DNA, 12 bp, Homo sapiens
ttctctttgcca

SEQ ID NO: 6753108 - DNA, 16 bp, Homo sapiens
ttctctttgccttgat

SEQ ID NO: 6753109 - DNA, 15 bp, Homo sapiens
ttctctttgctgaca

SEQ ID NO: 6753110 - DNA, 12 bp, Homo sapiens
ttctctttgggt

SEQ ID NO: 6753111 - DNA, 17 bp, Homo sapiens
ttctctttggtgtacaa

SEQ ID NO: 6753112 - DNA, 21 bp, Homo sapiens
ttctctttgtctgccttccca

SEQ ID NO: 6753113 - DNA, 22 bp, Homo sapiens
ttctctttgtggggcttggcgt

SEQ ID NO: 6753114 - DNA, 19 bp, Homo sapiens
ttctctttgtggtttcttg

SEQ ID NO: 6753115 - DNA, 16 bp, Homo sapiens
ttctcttttcaaaaca

SEQ ID NO: 6753116 - DNA, 21 bp, Homo sapiens
ttctcttttcaagaagttctt

SEQ ID NO: 6753117 - DNA, 21 bp, Homo sapiens
ttctcttttcccctttcctgt

SEQ ID NO: 6753118 - DNA, 22 bp, Homo sapiens
ttctcttttcccctttcctgtc

SEQ ID NO: 6753119 - DNA, 15 bp, Homo sapiens
ttctcttttcctttg

SEQ ID NO: 6753120 - DNA, 22 bp, Homo sapiens
ttctcttttctagtttgctcat

SEQ ID NO: 6753121 - DNA, 17 bp, Homo sapiens
ttctcttttctttctgt

SEQ ID NO: 6753122 - DNA, 22 bp, Homo sapiens
ttctcttttggtttctgcttct

SEQ ID NO: 6753123 - DNA, 15 bp, Homo sapiens
ttctctttttccaga

SEQ ID NO: 6753124 - DNA, 19 bp, Homo sapiens
ttctctttttcttgtaaac

SEQ ID NO: 6753125 - DNA, 17 bp, Homo sapiens
ttctgaaaaagacataa

SEQ ID NO: 6753126 - DNA, 22 bp, Homo sapiens
ttctgaaaaagacataaaacag

SEQ ID NO: 6753127 - DNA, 22 bp, Homo sapiens
ttctgaaaacacttgatgatgt

SEQ ID NO: 6753128 - DNA, 19 bp, Homo sapiens
ttctgaaaacctaccagcc

SEQ ID NO: 6753129 - DNA, 13 bp, Homo sapiens
ttctgaaaactga

SEQ ID NO: 6753130 - DNA, 14 bp, Homo sapiens
ttctgaaaactgtt

SEQ ID NO: 6753131 - DNA, 17 bp, Homo sapiens
ttctgaaaactgtttat

SEQ ID NO: 6753132 - DNA, 13 bp, Homo sapiens
ttctgaaaagaaa

SEQ ID NO: 6753133 - DNA, 23 bp, Homo sapiens
ttctgaaaaggaggtatctagca

SEQ ID NO: 6753134 - DNA, 19 bp, Homo sapiens
ttctgaaaattaacactgc

SEQ ID NO: 6753135 - DNA, 14 bp, Homo sapiens
ttctgaaaatttat

SEQ ID NO: 6753136 - DNA, 18 bp, Homo sapiens
ttctgaaaatttatataa

SEQ ID NO: 6753137 - DNA, 13 bp, Homo sapiens
ttctgaaactaat

SEQ ID NO: 6753138 - DNA, 18 bp, Homo sapiens
ttctgaaactaatgaaag

SEQ ID NO: 6753139 - DNA, 20 bp, Homo sapiens
ttctgaaactcccttgtgtt

SEQ ID NO: 6753140 - DNA, 23 bp, Homo sapiens
ttctgaaaggagacattgctcta

SEQ ID NO: 6753141 - DNA, 22 bp, Homo sapiens
ttctgaaaggtgctttctccat

SEQ ID NO: 6753142 - DNA, 12 bp, Homo sapiens
ttctgaaagtgt

SEQ ID NO: 6753143 - DNA, 14 bp, Homo sapiens
ttctgaaatacttt

SEQ ID NO: 6753144 - DNA, 14 bp, Homo sapiens
ttctgaaatatttt

SEQ ID NO: 6753145 - DNA, 20 bp, Homo sapiens
ttctgaaatgacagaatgct

SEQ ID NO: 6753146 - DNA, 15 bp, Homo sapiens
ttctgaaatgttctt

SEQ ID NO: 6753147 - DNA, 13 bp, Homo sapiens
ttctgaaatgttt

SEQ ID NO: 6753148 - DNA, 22 bp, Homo sapiens
ttctgaaattcacagaagccta

SEQ ID NO: 6753149 - DNA, 13 bp, Homo sapiens
ttctgaacagctg

SEQ ID NO: 6753150 - DNA, 23 bp, Homo sapiens
ttctgaacagctggtgtagctac

SEQ ID NO: 6753151 - DNA, 22 bp, Homo sapiens
ttctgaaccctccaaaggaact

SEQ ID NO: 6753152 - DNA, 16 bp, Homo sapiens
ttctgaacctgtcttt

SEQ ID NO: 6753153 - DNA, 13 bp, Homo sapiens
ttctgaactaaag

SEQ ID NO: 6753154 - DNA, 22 bp, Homo sapiens
ttctgaactaaagtgctgcact

SEQ ID NO: 6753155 - DNA, 23 bp, Homo sapiens
ttctgaactatcagggcaagctc

SEQ ID NO: 6753156 - DNA, 19 bp, Homo sapiens
ttctgaactcaagctgcgt

SEQ ID NO: 6753157 - DNA, 13 bp, Homo sapiens
ttctgaactccat

SEQ ID NO: 6753158 - DNA, 14 bp, Homo sapiens
ttctgaactgttac

SEQ ID NO: 6753159 - DNA, 22 bp, Homo sapiens
ttctgaactgttacaacttgta

SEQ ID NO: 6753160 - DNA, 23 bp, Homo sapiens
ttctgaacttggcgctgcccctg

SEQ ID NO: 6753161 - DNA, 23 bp, Homo sapiens
ttctgaacttttgtggagtttga

SEQ ID NO: 6753162 - DNA, 18 bp, Homo sapiens
ttctgaagaaaaattact

SEQ ID NO: 6753163 - DNA, 12 bp, Homo sapiens
ttctgaagaaga

SEQ ID NO: 6753164 - DNA, 14 bp, Homo sapiens
ttctgtttgaaaaa

SEQ ID NO: 6753165 - DNA, 15 bp, Homo sapiens
ttctgtttgattctt

SEQ ID NO: 6753166 - DNA, 13 bp, Homo sapiens
ttctgtttgctgt

SEQ ID NO: 6753167 - DNA, 16 bp, Homo sapiens
ttctgtttggaggagc

SEQ ID NO: 6753168 - DNA, 14 bp, Homo sapiens
ttctgtttggcact

SEQ ID NO: 6753169 - DNA, 19 bp, Homo sapiens
ttctgtttggcacttgtat

SEQ ID NO: 6753170 - DNA, 13 bp, Homo sapiens
ttctgtttgtaaa

SEQ ID NO: 6753171 - DNA, 18 bp, Homo sapiens
ttctgtttgtaaattatt

SEQ ID NO: 6753172 - DNA, 23 bp, Homo sapiens
ttctgtttgtaaattatttgcta

SEQ ID NO: 6753173 - DNA, 17 bp, Homo sapiens
ttctgttttataatttt

SEQ ID NO: 6753174 - DNA, 12 bp, Homo sapiens
ttctgttttcaa

SEQ ID NO: 6753175 - DNA, 18 bp, Homo sapiens
ttctgttttcccccagca

SEQ ID NO: 6753176 - DNA, 14 bp, Homo sapiens
ttctgttttctgtt

SEQ ID NO: 6753177 - DNA, 16 bp, Homo sapiens
ttctgttttgcctgaa

SEQ ID NO: 6753178 - DNA, 21 bp, Homo sapiens
ttctgttttgcctgaagttgg

SEQ ID NO: 6753179 - DNA, 12 bp, Homo sapiens
ttctgttttgtt

SEQ ID NO: 6753180 - DNA, 14 bp, Homo sapiens
ttctgttttgttaa

SEQ ID NO: 6753181 - DNA, 17 bp, Homo sapiens
ttctgttttgtttcgct

SEQ ID NO: 6753182 - DNA, 18 bp, Homo sapiens
ttctgtttttacagtgga

SEQ ID NO: 6753183 - DNA, 20 bp, Homo sapiens
ttctgtttttctaggcctgg

SEQ ID NO: 6753184 - DNA, 14 bp, Homo sapiens
ttctgtttttctca

SEQ ID NO: 6753185 - DNA, 19 bp, Homo sapiens
ttctgtttttctcaaataa

SEQ ID NO: 6753186 - DNA, 20 bp, Homo sapiens
ttctgtttttctcaaataaa

SEQ ID NO: 6753187 - DNA, 20 bp, Homo sapiens
ttctgttttttttttttgta

SEQ ID NO: 6753188 - DNA, 23 bp, Homo sapiens
ttcttaaaaaaataaaatatttt

SEQ ID NO: 6753189 - DNA, 18 bp, Homo sapiens
ttcttaaaaacagctgta

SEQ ID NO: 6753190 - DNA, 13 bp, Homo sapiens
ttcttaaaaactg

SEQ ID NO: 6753191 - DNA, 14 bp, Homo sapiens
ttcttaaaaactgt

SEQ ID NO: 6753192 - DNA, 15 bp, Homo sapiens
ttcttaaaaactgtg

SEQ ID NO: 6753193 - DNA, 22 bp, Homo sapiens
ttcttaaaaactgtgtatcatt

SEQ ID NO: 6753194 - DNA, 14 bp, Homo sapiens
ttcttaaaaaggaa

SEQ ID NO: 6753195 - DNA, 13 bp, Homo sapiens
ttcttaaaaagta

SEQ ID NO: 6753196 - DNA, 18 bp, Homo sapiens
ttcttaaaaatgcattta

SEQ ID NO: 6753197 - DNA, 19 bp, Homo sapiens
ttcttaaaaatgcatttaa

SEQ ID NO: 6753198 - DNA, 14 bp, Homo sapiens
ttcttaaaacacat

SEQ ID NO: 6753199 - DNA, 18 bp, Homo sapiens
ttcttaaaacacatgata

SEQ ID NO: 6753200 - DNA, 12 bp, Homo sapiens
ttcttaaaactt

SEQ ID NO: 6753201 - DNA, 20 bp, Homo sapiens
ttcttaaaagaaatcttgct

SEQ ID NO: 6753202 - DNA, 15 bp, Homo sapiens
ttcttaaaagtactt

SEQ ID NO: 6753203 - DNA, 17 bp, Homo sapiens
ttcttaaaagtacttta

SEQ ID NO: 6753204 - DNA, 16 bp, Homo sapiens
ttcttaaaatgcaata

SEQ ID NO: 6753205 - DNA, 18 bp, Homo sapiens
ttcttaaaatgcaatatt

SEQ ID NO: 6753206 - DNA, 20 bp, Homo sapiens
ttcttaaaatgtcctatgta

SEQ ID NO: 6753207 - DNA, 14 bp, Homo sapiens
ttcttaaaattcaa

SEQ ID NO: 6753208 - DNA, 15 bp, Homo sapiens
ttcttaaaattcagt

SEQ ID NO: 6753209 - DNA, 16 bp, Homo sapiens
ttcttaaacacttgca

SEQ ID NO: 6753210 - DNA, 17 bp, Homo sapiens
ttcttaaacacttgcaa

SEQ ID NO: 6753211 - DNA, 21 bp, Homo sapiens
ttcttaaaccaacctttaaaa

SEQ ID NO: 6753212 - DNA, 22 bp, Homo sapiens
ttcttaaaccatttttgctgaa

SEQ ID NO: 6753213 - DNA, 15 bp, Homo sapiens
ttcttaaagcaaact

SEQ ID NO: 6753214 - DNA, 19 bp, Homo sapiens
ttcttaaagcaaagtcact

SEQ ID NO: 6753215 - DNA, 20 bp, Homo sapiens
ttcttaaagtgccagtattt

SEQ ID NO: 6753216 - DNA, 15 bp, Homo sapiens
ttcttaaataataaa

SEQ ID NO: 6753217 - DNA, 12 bp, Homo sapiens
ttcttaaatatg

SEQ ID NO: 6753218 - DNA, 13 bp, Homo sapiens
ttcttaaatcttt

SEQ ID NO: 6753219 - DNA, 20 bp, Homo sapiens
ttcttaaatggaattatttt

SEQ ID NO: 6753220 - DNA, 21 bp, Homo sapiens
ttcttaaatgggctactttgt

SEQ ID NO: 6753221 - DNA, 14 bp, Homo sapiens
ttcttaaatgtttt

SEQ ID NO: 6753222 - DNA, 15 bp, Homo sapiens
ttcttaaatgttttc

SEQ ID NO: 6753223 - DNA, 20 bp, Homo sapiens
ttcttaaatgttttcattgg

SEQ ID NO: 6753224 - DNA, 12 bp, Homo sapiens
ttcttaaattat

SEQ ID NO: 6753225 - DNA, 15 bp, Homo sapiens
ttcttaaattatttt

SEQ ID NO: 6753226 - DNA, 13 bp, Homo sapiens
ttcttaacaaccg

SEQ ID NO: 6753227 - DNA, 14 bp, Homo sapiens
ttcttaacaagata

SEQ ID NO: 6753228 - DNA, 15 bp, Homo sapiens
ttcttaacaagatat

SEQ ID NO: 6753229 - DNA, 21 bp, Homo sapiens
ttcttaacacagccttccttc

SEQ ID NO: 6753230 - DNA, 22 bp, Homo sapiens
ttcttaaccagatcattgtgaa

SEQ ID NO: 6753231 - DNA, 23 bp, Homo sapiens
ttcttaaccagatcattgtgaaa

SEQ ID NO: 6753232 - DNA, 18 bp, Homo sapiens
ttcttaaccagatggttg

SEQ ID NO: 6753233 - DNA, 13 bp, Homo sapiens
ttcttaaccatct

SEQ ID NO: 6753234 - DNA, 20 bp, Homo sapiens
ttcttaaccctttccagagt

SEQ ID NO: 6753235 - DNA, 19 bp, Homo sapiens
ttcttaacctttgctatgt

SEQ ID NO: 6753236 - DNA, 16 bp, Homo sapiens
ttcttaacttcttgct

SEQ ID NO: 6753237 - DNA, 17 bp, Homo sapiens
ttcttaacttcttgctt

SEQ ID NO: 6753238 - DNA, 16 bp, Homo sapiens
ttcttaagaaatgcca

SEQ ID NO: 6753239 - DNA, 18 bp, Homo sapiens
ttcttaagaattcaaatt

SEQ ID NO: 6753240 - DNA, 19 bp, Homo sapiens
ttcttaagatttctcctga

SEQ ID NO: 6753241 - DNA, 14 bp, Homo sapiens
ttcttaagcacttt

SEQ ID NO: 6753242 - DNA, 23 bp, Homo sapiens
ttcttaaggacagtgttcaaatt

SEQ ID NO: 6753243 - DNA, 19 bp, Homo sapiens
ttcttaaggcaataaaact

SEQ ID NO: 6753244 - DNA, 14 bp, Homo sapiens
ttcttaaggttttg

SEQ ID NO: 6753245 - DNA, 20 bp, Homo sapiens
ttcttaaggttttgttgcta

SEQ ID NO: 6753246 - DNA, 17 bp, Homo sapiens
ttcttaagtataaacct

SEQ ID NO: 6753247 - DNA, 19 bp, Homo sapiens
ttcttaagtataaacctta

SEQ ID NO: 6753248 - DNA, 13 bp, Homo sapiens
ttcttaagtcttt

SEQ ID NO: 6753249 - DNA, 23 bp, Homo sapiens
ttcttaataaaactcactcactg

SEQ ID NO: 6753250 - DNA, 20 bp, Homo sapiens
ttcttaatatcactttggtc

SEQ ID NO: 6753251 - DNA, 14 bp, Homo sapiens
ttcttaatcatttt

SEQ ID NO: 6753252 - DNA, 19 bp, Homo sapiens
ttcttaatcttttcacaaa

SEQ ID NO: 6753253 - DNA, 23 bp, Homo sapiens
ttcttaatcttttcacaaataaa

SEQ ID NO: 6753254 - DNA, 15 bp, Homo sapiens
ttcttaatgtacata

SEQ ID NO: 6753255 - DNA, 17 bp, Homo sapiens
ttcttaatgttcacata

SEQ ID NO: 6753256 - DNA, 13 bp, Homo sapiens
ttcttaattctta

SEQ ID NO: 6753257 - DNA, 14 bp, Homo sapiens
ttcttaattgcact

SEQ ID NO: 6753258 - DNA, 14 bp, Homo sapiens
ttcttaatttatgt

SEQ ID NO: 6753259 - DNA, 20 bp, Homo sapiens
ttcttaatttggaaactaat

SEQ ID NO: 6753260 - DNA, 23 bp, Homo sapiens
ttcttaatttggaaactaataaa

SEQ ID NO: 6753261 - DNA, 15 bp, Homo sapiens
ttcttacaaacatgt

SEQ ID NO: 6753262 - DNA, 13 bp, Homo sapiens
ttcttacaaacca

SEQ ID NO: 6753263 - DNA, 14 bp, Homo sapiens
ttcttacaaaccat

SEQ ID NO: 6753264 - DNA, 19 bp, Homo sapiens
ttcttacaagcttaaagct

SEQ ID NO: 6753265 - DNA, 21 bp, Homo sapiens
ttcttacaataaaccctcctt

SEQ ID NO: 6753266 - DNA, 21 bp, Homo sapiens
ttcttacaattgcactgctgt

SEQ ID NO: 6753267 - DNA, 18 bp, Homo sapiens
ttcttacacactgtctgt

SEQ ID NO: 6753268 - DNA, 16 bp, Homo sapiens
ttcttacacatacagt

SEQ ID NO: 6753269 - DNA, 21 bp, Homo sapiens
ttcttacaccgtgaggccaag

SEQ ID NO: 6753270 - DNA, 18 bp, Homo sapiens
ttcttacactgcctgtat

SEQ ID NO: 6753271 - DNA, 13 bp, Homo sapiens
ttcttacacttct

SEQ ID NO: 6753272 - DNA, 18 bp, Homo sapiens
ttcttacaggcctacaga

SEQ ID NO: 6753273 - DNA, 21 bp, Homo sapiens
ttcttacagttaagaagccct

SEQ ID NO: 6753274 - DNA, 16 bp, Homo sapiens
ttcttacatgcatttg

SEQ ID NO: 6753275 - DNA, 14 bp, Homo sapiens
ttcttacatgtttt

SEQ ID NO: 6753276 - DNA, 17 bp, Homo sapiens
ttcttacccaaagcaca

SEQ ID NO: 6753277 - DNA, 17 bp, Homo sapiens
ttcttacccaatttccc

SEQ ID NO: 6753278 - DNA, 19 bp, Homo sapiens
ttcttaccctagttctctt

SEQ ID NO: 6753279 - DNA, 22 bp, Homo sapiens
ttcttaccctgtacatatgtaa

SEQ ID NO: 6753280 - DNA, 15 bp, Homo sapiens
ttcttacctcatttg

SEQ ID NO: 6753281 - DNA, 15 bp, Homo sapiens
ttcttacctgtatgt

SEQ ID NO: 6753282 - DNA, 16 bp, Homo sapiens
ttcttacgcaatgctt

SEQ ID NO: 6753283 - DNA, 22 bp, Homo sapiens
ttcttactattaagcagtaaaa

SEQ ID NO: 6753284 - DNA, 21 bp, Homo sapiens
ttcttactcattactgcaaat

SEQ ID NO: 6753285 - DNA, 12 bp, Homo sapiens
ttcttactctgg

SEQ ID NO: 6753286 - DNA, 12 bp, Homo sapiens
ttcttactgaca

SEQ ID NO: 6753287 - DNA, 20 bp, Homo sapiens
ttcttactgataattttgct

SEQ ID NO: 6753288 - DNA, 14 bp, Homo sapiens
ttcttactgcttgg

SEQ ID NO: 6753289 - DNA, 14 bp, Homo sapiens
ttcttactgttctg

SEQ ID NO: 6753290 - DNA, 13 bp, Homo sapiens
ttcttacttgagt

SEQ ID NO: 6753291 - DNA, 14 bp, Homo sapiens
ttcttacttttatt

SEQ ID NO: 6753292 - DNA, 16 bp, Homo sapiens
ttcttagaaaattaaa

SEQ ID NO: 6753293 - DNA, 13 bp, Homo sapiens
ttcttagaaattt

SEQ ID NO: 6753294 - DNA, 22 bp, Homo sapiens
ttcttagaaatttatttcctag

SEQ ID NO: 6753295 - DNA, 20 bp, Homo sapiens
ttcttagaacagtggaaact

SEQ ID NO: 6753296 - DNA, 23 bp, Homo sapiens
ttcttagacctcttcctggaata

SEQ ID NO: 6753297 - DNA, 23 bp, Homo sapiens
ttcttagactagttgaacatctc

SEQ ID NO: 6753298 - DNA, 19 bp, Homo sapiens
ttcttagagtgtagctgta

SEQ ID NO: 6753299 - DNA, 23 bp, Homo sapiens
ttcttagagttttattcctttcc

SEQ ID NO: 6753300 - DNA, 18 bp, Homo sapiens
ttcttagatatcttttta

SEQ ID NO: 6753301 - DNA, 17 bp, Homo sapiens
ttcttagcaataaatgc

SEQ ID NO: 6753302 - DNA, 12 bp, Homo sapiens
ttcttagctcaa

SEQ ID NO: 6753303 - DNA, 19 bp, Homo sapiens
ttcttagctgtaacttaac

SEQ ID NO: 6753304 - DNA, 19 bp, Homo sapiens
ttcttagctttttaattgt

SEQ ID NO: 6753305 - DNA, 23 bp, Homo sapiens
ttcttagggattaaatatagatg

SEQ ID NO: 6753306 - DNA, 16 bp, Homo sapiens
ttcttaggtttactgt

SEQ ID NO: 6753307 - DNA, 19 bp, Homo sapiens
ttcttaggtttactgtgaa

SEQ ID NO: 6753308 - DNA, 13 bp, Homo sapiens
ttcttagtaaaaa

SEQ ID NO: 6753309 - DNA, 14 bp, Homo sapiens
ttcttagtaaaatg

SEQ ID NO: 6753310 - DNA, 20 bp, Homo sapiens
ttcttagtatgtgcatttaa

SEQ ID NO: 6753311 - DNA, 18 bp, Homo sapiens
ttcttagtgacacacact

SEQ ID NO: 6753312 - DNA, 13 bp, Homo sapiens
ttcttagtgactt

SEQ ID NO: 6753313 - DNA, 22 bp, Homo sapiens
ttcttagttaatctttgaaaac

SEQ ID NO: 6753314 - DNA, 13 bp, Homo sapiens
ttcttagttctca

SEQ ID NO: 6753315 - DNA, 18 bp, Homo sapiens
ttcttagttgacaaccta

SEQ ID NO: 6753316 - DNA, 21 bp, Homo sapiens
ttcttagtttcagaagtactg

SEQ ID NO: 6753317 - DNA, 15 bp, Homo sapiens
ttcttataaatatga

SEQ ID NO: 6753318 - DNA, 16 bp, Homo sapiens
ttcttataacttgtaa

SEQ ID NO: 6753319 - DNA, 17 bp, Homo sapiens
ttcttataatactctgt

SEQ ID NO: 6753320 - DNA, 19 bp, Homo sapiens
ttcttataatactctgttg

SEQ ID NO: 6753321 - DNA, 17 bp, Homo sapiens
ttcttatacagataaaa

SEQ ID NO: 6753322 - DNA, 19 bp, Homo sapiens
ttcttataccttctgacag

SEQ ID NO: 6753323 - DNA, 17 bp, Homo sapiens
ttcttatacgcttttct

SEQ ID NO: 6753324 - DNA, 19 bp, Homo sapiens
ttcttatacgtctagccta

SEQ ID NO: 6753325 - DNA, 15 bp, Homo sapiens
ttcttatagaataaa

SEQ ID NO: 6753326 - DNA, 16 bp, Homo sapiens
ttcttatagaataaaa

SEQ ID NO: 6753327 - DNA, 23 bp, Homo sapiens
ttcttataggctagacttagatt

SEQ ID NO: 6753328 - DNA, 13 bp, Homo sapiens
ttcttatataaga

SEQ ID NO: 6753329 - DNA, 18 bp, Homo sapiens
ttcttatcacacttgcaa

SEQ ID NO: 6753330 - DNA, 14 bp, Homo sapiens
ttcttatcacataa

SEQ ID NO: 6753331 - DNA, 16 bp, Homo sapiens
ttcttatcttctgcaa

SEQ ID NO: 6753332 - DNA, 16 bp, Homo sapiens
ttcttatgcaaaatgg

SEQ ID NO: 6753333 - DNA, 18 bp, Homo sapiens
ttcttatgcaaaatggaa

SEQ ID NO: 6753334 - DNA, 21 bp, Homo sapiens
ttcttatgtatgtgaaagtta

SEQ ID NO: 6753335 - DNA, 13 bp, Homo sapiens
ttcttatgtgaca

SEQ ID NO: 6753336 - DNA, 20 bp, Homo sapiens
ttcttatgtgacattaacaa

SEQ ID NO: 6753337 - DNA, 21 bp, Homo sapiens
ttcttattaattcttcacctg

SEQ ID NO: 6753338 - DNA, 20 bp, Homo sapiens
ttcttattaatttcagtctt

SEQ ID NO: 6753339 - DNA, 17 bp, Homo sapiens
ttcttattactagactg

SEQ ID NO: 6753340 - DNA, 13 bp, Homo sapiens
ttcttattcagtg

SEQ ID NO: 6753341 - DNA, 17 bp, Homo sapiens
ttcttattccatattag

SEQ ID NO: 6753342 - DNA, 19 bp, Homo sapiens
ttcttattgcgctgctacc

SEQ ID NO: 6753343 - DNA, 15 bp, Homo sapiens
ttctttaggagattt

SEQ ID NO: 6753344 - DNA, 22 bp, Homo sapiens
ttctttaggagattttaggtgt

SEQ ID NO: 6753345 - DNA, 18 bp, Homo sapiens
ttctttaggtgcctcctg

SEQ ID NO: 6753346 - DNA, 23 bp, Homo sapiens
ttctttaggtgcctcctgtctta

SEQ ID NO: 6753347 - DNA, 15 bp, Homo sapiens
ttctttagtactcaa

SEQ ID NO: 6753348 - DNA, 14 bp, Homo sapiens
ttctttagtatagc

SEQ ID NO: 6753349 - DNA, 22 bp, Homo sapiens
ttctttagtatagccacaaatg

SEQ ID NO: 6753350 - DNA, 15 bp, Homo sapiens
ttctttataaaatgt

SEQ ID NO: 6753351 - DNA, 13 bp, Homo sapiens
ttctttataaact

SEQ ID NO: 6753352 - DNA, 13 bp, Homo sapiens
ttctttataacca

SEQ ID NO: 6753353 - DNA, 14 bp, Homo sapiens
ttctttataagaaa

SEQ ID NO: 6753354 - DNA, 13 bp, Homo sapiens
ttctttataatgg

SEQ ID NO: 6753355 - DNA, 18 bp, Homo sapiens
ttctttataatggctctg

SEQ ID NO: 6753356 - DNA, 22 bp, Homo sapiens
ttctttatacaacagtgctaaa

SEQ ID NO: 6753357 - DNA, 23 bp, Homo sapiens
ttctttatatacaataatggaaa

SEQ ID NO: 6753358 - DNA, 15 bp, Homo sapiens
ttctttattctgtgt

SEQ ID NO: 6753359 - DNA, 16 bp, Homo sapiens
ttctttattgcactag

SEQ ID NO: 6753360 - DNA, 16 bp, Homo sapiens
ttctttattgcccctt

SEQ ID NO: 6753361 - DNA, 14 bp, Homo sapiens
ttctttcaaagtgt

SEQ ID NO: 6753362 - DNA, 10 bp, Homo sapiens
ttctttcaag

SEQ ID NO: 6753363 - DNA, 20 bp, Homo sapiens
ttctttcaagtgaatctaaa

SEQ ID NO: 6753364 - DNA, 18 bp, Homo sapiens
ttctttcaatacagatat

SEQ ID NO: 6753365 - DNA, 22 bp, Homo sapiens
ttctttcacttgatgtttgtta

SEQ ID NO: 6753366 - DNA, 12 bp, Homo sapiens
ttctttcagaaa

SEQ ID NO: 6753367 - DNA, 18 bp, Homo sapiens
ttctttcagctatcagta

SEQ ID NO: 6753368 - DNA, 13 bp, Homo sapiens
ttctttcatgtaa

SEQ ID NO: 6753369 - DNA, 19 bp, Homo sapiens
ttctttccaaaatcaggct

SEQ ID NO: 6753370 - DNA, 13 bp, Homo sapiens
ttctttccacctt

SEQ ID NO: 6753371 - DNA, 22 bp, Homo sapiens
ttctttccagtatggaaggatt

SEQ ID NO: 6753372 - DNA, 14 bp, Homo sapiens
ttctttccattatg

SEQ ID NO: 6753373 - DNA, 17 bp, Homo sapiens
ttctttccattatgatt

SEQ ID NO: 6753374 - DNA, 12 bp, Homo sapiens
ttctttcccaaa

SEQ ID NO: 6753375 - DNA, 16 bp, Homo sapiens
ttctttcccagtctgt

SEQ ID NO: 6753376 - DNA, 22 bp, Homo sapiens
ttctttccccagaggctcccaa

SEQ ID NO: 6753377 - DNA, 24 bp, Homo sapiens
ttctttccccagaggctcccaatc

SEQ ID NO: 6753378 - DNA, 21 bp, Homo sapiens
ttctttccctgcttaatgaaa

SEQ ID NO: 6753379 - DNA, 13 bp, Homo sapiens
ttctttccctgga

SEQ ID NO: 6753380 - DNA, 16 bp, Homo sapiens
ttctttccggccaagg

SEQ ID NO: 6753381 - DNA, 13 bp, Homo sapiens
ttctttcctacct

SEQ ID NO: 6753382 - DNA, 21 bp, Homo sapiens
ttctttcctctccaattgtaa

SEQ ID NO: 6753383 - DNA, 13 bp, Homo sapiens
ttctttcctgccc

SEQ ID NO: 6753384 - DNA, 15 bp, Homo sapiens
ttctttcctgccctg

SEQ ID NO: 6753385 - DNA, 15 bp, Homo sapiens
ttctttccttcccaa

SEQ ID NO: 6753386 - DNA, 15 bp, Homo sapiens
ttctttccttccttt

SEQ ID NO: 6753387 - DNA, 13 bp, Homo sapiens
ttctttcctttaa

SEQ ID NO: 6753388 - DNA, 14 bp, Homo sapiens
ttctttcctttaaa

SEQ ID NO: 6753389 - DNA, 14 bp, Homo sapiens
ttctttcctttccc

SEQ ID NO: 6753390 - DNA, 13 bp, Homo sapiens
ttctttccttttc

SEQ ID NO: 6753391 - DNA, 14 bp, Homo sapiens
ttctttccttttca

SEQ ID NO: 6753392 - DNA, 16 bp, Homo sapiens
ttctttctatttgact

SEQ ID NO: 6753393 - DNA, 18 bp, Homo sapiens
ttctttctcacccaggca

SEQ ID NO: 6753394 - DNA, 15 bp, Homo sapiens
ttctttctcactaaa

SEQ ID NO: 6753395 - DNA, 20 bp, Homo sapiens
ttctttctcataaaactgtg

SEQ ID NO: 6753396 - DNA, 12 bp, Homo sapiens
ttctttctccat

SEQ ID NO: 6753397 - DNA, 13 bp, Homo sapiens
ttctttctctcag

SEQ ID NO: 6753398 - DNA, 14 bp, Homo sapiens
ttctttctgaagat

SEQ ID NO: 6753399 - DNA, 15 bp, Homo sapiens
ttctttctggactgg

SEQ ID NO: 6753400 - DNA, 20 bp, Homo sapiens
ttctttctggctatgcattt

SEQ ID NO: 6753401 - DNA, 9 bp, Homo sapiens
ttctttctt

SEQ ID NO: 6753402 - DNA, 13 bp, Homo sapiens
ttctttcttagaa

SEQ ID NO: 6753403 - DNA, 20 bp, Homo sapiens
ttctttcttagaaatttatt

SEQ ID NO: 6753404 - DNA, 11 bp, Homo sapiens
ttctttcttcc

SEQ ID NO: 6753405 - DNA, 19 bp, Homo sapiens
ttctttcttccacccacaa

SEQ ID NO: 6753406 - DNA, 13 bp, Homo sapiens
ttctttcttggtg

SEQ ID NO: 6753407 - DNA, 13 bp, Homo sapiens
ttctttctttaaa

SEQ ID NO: 6753408 - DNA, 12 bp, Homo sapiens
ttctttctttct

SEQ ID NO: 6753409 - DNA, 11 bp, Homo sapiens
ttctttgaaaa

SEQ ID NO: 6753410 - DNA, 22 bp, Homo sapiens
ttctttgaaaatagttattcag

SEQ ID NO: 6753411 - DNA, 20 bp, Homo sapiens
ttctttgaaatgctaaactt

SEQ ID NO: 6753412 - DNA, 21 bp, Homo sapiens
ttctttgaaatgctaaacttg

SEQ ID NO: 6753413 - DNA, 15 bp, Homo sapiens
ttctttgaaattgtt

SEQ ID NO: 6753414 - DNA, 12 bp, Homo sapiens
ttctttgaagag

SEQ ID NO: 6753415 - DNA, 13 bp, Homo sapiens
ttctttgaataaa

SEQ ID NO: 6753416 - DNA, 19 bp, Homo sapiens
ttctttgaataaatgtcac

SEQ ID NO: 6753417 - DNA, 14 bp, Homo sapiens
ttctttgaatgtat

SEQ ID NO: 6753418 - DNA, 15 bp, Homo sapiens
ttctttgaatgtatt

SEQ ID NO: 6753419 - DNA, 13 bp, Homo sapiens
ttctttgaattta

SEQ ID NO: 6753420 - DNA, 22 bp, Homo sapiens
ttctttgaccagatctttctct

SEQ ID NO: 6753421 - DNA, 23 bp, Homo sapiens
ttctttgactctgtcacactaaa

SEQ ID NO: 6753422 - DNA, 22 bp, Homo sapiens
ttctttgagggactgcctctgc

SEQ ID NO: 6753423 - DNA, 17 bp, Homo sapiens
ttctttgagtaatgtga

SEQ ID NO: 6753424 - DNA, 13 bp, Homo sapiens
ttctttgataaga

SEQ ID NO: 6753425 - DNA, 18 bp, Homo sapiens
ttctttgataatgttaaa

SEQ ID NO: 6753426 - DNA, 20 bp, Homo sapiens
ttctttgatagtgtaaacaa

SEQ ID NO: 6753427 - DNA, 16 bp, Homo sapiens
ttctttgatcatgaat

SEQ ID NO: 6753428 - DNA, 13 bp, Homo sapiens
ttctttgatgtta

SEQ ID NO: 6753429 - DNA, 20 bp, Homo sapiens
ttctttgatgttaacacatt

SEQ ID NO: 6753430 - DNA, 22 bp, Homo sapiens
ttctttgatgttaacacatttt

SEQ ID NO: 6753431 - DNA, 12 bp, Homo sapiens
ttctttgattat

SEQ ID NO: 6753432 - DNA, 14 bp, Homo sapiens
ttctttgattctgt

SEQ ID NO: 6753433 - DNA, 15 bp, Homo sapiens
ttctttgatttgtac

SEQ ID NO: 6753434 - DNA, 16 bp, Homo sapiens
ttctttgatttgtacc

SEQ ID NO: 6753435 - DNA, 13 bp, Homo sapiens
ttctttgattttc

SEQ ID NO: 6753436 - DNA, 16 bp, Homo sapiens
ttctttgcaaaaatcc

SEQ ID NO: 6753437 - DNA, 16 bp, Homo sapiens
ttctttgcaccaaaga

SEQ ID NO: 6753438 - DNA, 21 bp, Homo sapiens
ttctttgcaccaaagacatca

SEQ ID NO: 6753439 - DNA, 20 bp, Homo sapiens
ttctttgcacttaaaaatta

SEQ ID NO: 6753440 - DNA, 14 bp, Homo sapiens
ttctttgcccttta

SEQ ID NO: 6753441 - DNA, 14 bp, Homo sapiens
ttctttgctgtaag

SEQ ID NO: 6753442 - DNA, 14 bp, Homo sapiens
ttctttgctgtgcc

SEQ ID NO: 6753443 - DNA, 21 bp, Homo sapiens
ttctttgcttgaacacagtat

SEQ ID NO: 6753444 - DNA, 13 bp, Homo sapiens
ttctttgctttct

SEQ ID NO: 6753445 - DNA, 16 bp, Homo sapiens
ttctttggaaagtaca

SEQ ID NO: 6753446 - DNA, 20 bp, Homo sapiens
ttctttggaaagtacactct

SEQ ID NO: 6753447 - DNA, 23 bp, Homo sapiens
ttctttggaatgaaattcctcct

SEQ ID NO: 6753448 - DNA, 12 bp, Homo sapiens
ttctttggctgc

SEQ ID NO: 6753449 - DNA, 13 bp, Homo sapiens
ttctttggctgca

SEQ ID NO: 6753450 - DNA, 23 bp, Homo sapiens
ttctttgggggtggaaaaggaaa

SEQ ID NO: 6753451 - DNA, 14 bp, Homo sapiens
ttctttggtgcctt

SEQ ID NO: 6753452 - DNA, 15 bp, Homo sapiens
ttctttggtgccttt

SEQ ID NO: 6753453 - DNA, 21 bp, Homo sapiens
ttctttggtgcctttcctgtt

SEQ ID NO: 6753454 - DNA, 17 bp, Homo sapiens
ttctttgtaccatctgt

SEQ ID NO: 6753455 - DNA, 20 bp, Homo sapiens
ttctttgtagaataaatggt

SEQ ID NO: 6753456 - DNA, 16 bp, Homo sapiens
ttctttgtatcttaaa

SEQ ID NO: 6753457 - DNA, 21 bp, Homo sapiens
ttctttgtatcttaaatctgt

SEQ ID NO: 6753458 - DNA, 12 bp, Homo sapiens
ttctttgtcttt

SEQ ID NO: 6753459 - DNA, 10 bp, Homo sapiens
ttctttgtgt

SEQ ID NO: 6753460 - DNA, 11 bp, Homo sapiens
ttctttgtgta

SEQ ID NO: 6753461 - DNA, 12 bp, Homo sapiens
ttctttgtgtag

SEQ ID NO: 6753462 - DNA, 23 bp, Homo sapiens
ttctttgttaatttggaccattt

SEQ ID NO: 6753463 - DNA, 12 bp, Homo sapiens
ttctttgttcct

SEQ ID NO: 6753464 - DNA, 11 bp, Homo sapiens
ttctttgttct

SEQ ID NO: 6753465 - DNA, 12 bp, Homo sapiens
ttctttgtttcc

SEQ ID NO: 6753466 - DNA, 15 bp, Homo sapiens
ttctttgttttgggt

SEQ ID NO: 6753467 - DNA, 18 bp, Homo sapiens
ttcttttaaagatttgtt

SEQ ID NO: 6753468 - DNA, 21 bp, Homo sapiens
ttcttttaaaggggcagaaaa

SEQ ID NO: 6753469 - DNA, 20 bp, Homo sapiens
ttcttttaaatatttgtgac

SEQ ID NO: 6753470 - DNA, 15 bp, Homo sapiens
ttcttttaaatgggt

SEQ ID NO: 6753471 - DNA, 19 bp, Homo sapiens
ttcttttaacttctttcta

SEQ ID NO: 6753472 - DNA, 20 bp, Homo sapiens
ttcttttaacttctttctat

SEQ ID NO: 6753473 - DNA, 21 bp, Homo sapiens
ttcttttaacttctttctatt

SEQ ID NO: 6753474 - DNA, 12 bp, Homo sapiens
ttcttttaagaa

SEQ ID NO: 6753475 - DNA, 16 bp, Homo sapiens
ttcttttacagactag

SEQ ID NO: 6753476 - DNA, 13 bp, Homo sapiens
ttcttttactgta

SEQ ID NO: 6753477 - DNA, 12 bp, Homo sapiens
ttcttttacttg

SEQ ID NO: 6753478 - DNA, 22 bp, Homo sapiens
ttcttttagtcagaaatgattc

SEQ ID NO: 6753479 - DNA, 17 bp, Homo sapiens
ttcttttatatataaaa

SEQ ID NO: 6753480 - DNA, 21 bp, Homo sapiens
ttcttttatatataaaataaa

SEQ ID NO: 6753481 - DNA, 15 bp, Homo sapiens
ttcttttatatctgt

SEQ ID NO: 6753482 - DNA, 16 bp, Homo sapiens
ttcttttatatctgta

SEQ ID NO: 6753483 - DNA, 19 bp, Homo sapiens
ttcttttatatctgtaaat

SEQ ID NO: 6753484 - DNA, 12 bp, Homo sapiens
ttcttttatcac

SEQ ID NO: 6753485 - DNA, 14 bp, Homo sapiens
ttcttttatgtggt

SEQ ID NO: 6753486 - DNA, 15 bp, Homo sapiens
ttcttttattatcag

SEQ ID NO: 6753487 - DNA, 15 bp, Homo sapiens
ttcttttatttgtta

SEQ ID NO: 6753488 - DNA, 17 bp, Homo sapiens
ttcttttcaatgcaatg

SEQ ID NO: 6753489 - DNA, 15 bp, Homo sapiens
ttcttttcacattct

SEQ ID NO: 6753490 - DNA, 14 bp, Homo sapiens
ttcttttcatcaaa

SEQ ID NO: 6753491 - DNA, 23 bp, Homo sapiens
ttcttttcgccgtggctgcggca

SEQ ID NO: 6753492 - DNA, 15 bp, Homo sapiens
ttcttttctaacttt

SEQ ID NO: 6753493 - DNA, 15 bp, Homo sapiens
ttcttttctattttt

SEQ ID NO: 6753494 - DNA, 15 bp, Homo sapiens
ttcttttctctatga

SEQ ID NO: 6753495 - DNA, 17 bp, Homo sapiens
ttcttttctcttctaca

SEQ ID NO: 6753496 - DNA, 14 bp, Homo sapiens
ttcttttctggaaa

SEQ ID NO: 6753497 - DNA, 20 bp, Homo sapiens
ttcttttcttcactcaaatt

SEQ ID NO: 6753498 - DNA, 15 bp, Homo sapiens
ttcttttctttgtat

SEQ ID NO: 6753499 - DNA, 15 bp, Homo sapiens
ttcttttgaactgtt

SEQ ID NO: 6753500 - DNA, 22 bp, Homo sapiens
ttcttttgaactgttagatgct

SEQ ID NO: 6753501 - DNA, 15 bp, Homo sapiens
ttcttttgaattgtt

SEQ ID NO: 6753502 - DNA, 18 bp, Homo sapiens
ttcttttgaccccttcct

SEQ ID NO: 6753503 - DNA, 19 bp, Homo sapiens
ttcttttgaccccttcctg

SEQ ID NO: 6753504 - DNA, 12 bp, Homo sapiens
ttcttttgatac

SEQ ID NO: 6753505 - DNA, 13 bp, Homo sapiens
ttcttttgataca

SEQ ID NO: 6753506 - DNA, 13 bp, Homo sapiens
ttcttttgcaatt

SEQ ID NO: 6753507 - DNA, 22 bp, Homo sapiens
ttcttttgcaggagtttgtggt

SEQ ID NO: 6753508 - DNA, 12 bp, Homo sapiens
ttcttttgcatt

SEQ ID NO: 6753509 - DNA, 12 bp, Homo sapiens
ttcttttgctta

SEQ ID NO: 6753510 - DNA, 22 bp, Homo sapiens
ttcttttggtaaagactggctt

SEQ ID NO: 6753511 - DNA, 23 bp, Homo sapiens
ttcttttggtaaagactggcttt

SEQ ID NO: 6753512 - DNA, 12 bp, Homo sapiens
ttcttttgtaaa

SEQ ID NO: 6753513 - DNA, 16 bp, Homo sapiens
ttcttttgtaattgtg

SEQ ID NO: 6753514 - DNA, 18 bp, Homo sapiens
ttcttttgtatgtaaatg

SEQ ID NO: 6753515 - DNA, 14 bp, Homo sapiens
ttcttttgtctccc

SEQ ID NO: 6753516 - DNA, 14 bp, Homo sapiens
ttcttttgtgcata

SEQ ID NO: 6753517 - DNA, 16 bp, Homo sapiens
ttcttttgtgcccctg

SEQ ID NO: 6753518 - DNA, 12 bp, Homo sapiens
ttcttttgttac

SEQ ID NO: 6753519 - DNA, 13 bp, Homo sapiens
ttcttttgttact

SEQ ID NO: 6753520 - DNA, 14 bp, Homo sapiens
ttcttttgttactg

SEQ ID NO: 6753521 - DNA, 18 bp, Homo sapiens
ttcttttgttactgttct

SEQ ID NO: 6753522 - DNA, 16 bp, Homo sapiens
ttcttttgttattaaa

SEQ ID NO: 6753523 - DNA, 19 bp, Homo sapiens
ttcttttgttttcttcatt

SEQ ID NO: 6753524 - DNA, 22 bp, Homo sapiens
ttcttttgttttttgaagtgtt

SEQ ID NO: 6753525 - DNA, 22 bp, Homo sapiens
ttctttttaaagtttgttcact

SEQ ID NO: 6753526 - DNA, 20 bp, Homo sapiens
ttgaatggcaatgttttgct

SEQ ID NO: 6753527 - DNA, 18 bp, Homo sapiens
ttgaatggcctgccttga

SEQ ID NO: 6753528 - DNA, 16 bp, Homo sapiens
ttgaatggctatgttt

SEQ ID NO: 6753529 - DNA, 23 bp, Homo sapiens
ttgaatggtcagcgttgcatgtc

SEQ ID NO: 6753530 - DNA, 23 bp, Homo sapiens
ttgaatggtttttcttttcttta

SEQ ID NO: 6753531 - DNA, 15 bp, Homo sapiens
ttgaatgtacaaaga

SEQ ID NO: 6753532 - DNA, 16 bp, Homo sapiens
ttgaatgtaccttatt

SEQ ID NO: 6753533 - DNA, 12 bp, Homo sapiens
ttgaatgtcaca

SEQ ID NO: 6753534 - DNA, 18 bp, Homo sapiens
ttgaatgtcacaaattga

SEQ ID NO: 6753535 - DNA, 23 bp, Homo sapiens
ttgaatgtcacaaattgatcaag

SEQ ID NO: 6753536 - DNA, 17 bp, Homo sapiens
ttgaatgtccaaaattt

SEQ ID NO: 6753537 - DNA, 17 bp, Homo sapiens
ttgaatgtcttttgaat

SEQ ID NO: 6753538 - DNA, 16 bp, Homo sapiens
ttgaatgtgatcatct

SEQ ID NO: 6753539 - DNA, 21 bp, Homo sapiens
ttgaatgtgatcatctttgct

SEQ ID NO: 6753540 - DNA, 19 bp, Homo sapiens
ttgaatgtggcttgagaaa

SEQ ID NO: 6753541 - DNA, 21 bp, Homo sapiens
ttgaatgtggcttgagaaata

SEQ ID NO: 6753542 - DNA, 20 bp, Homo sapiens
ttgaatgtgtgaattcaata

SEQ ID NO: 6753543 - DNA, 14 bp, Homo sapiens
ttgaatgttaaagg

SEQ ID NO: 6753544 - DNA, 13 bp, Homo sapiens
ttgaatgttaaat

SEQ ID NO: 6753545 - DNA, 10 bp, Homo sapiens
ttgaatgttt

SEQ ID NO: 6753546 - DNA, 14 bp, Homo sapiens
ttgaattaaaaaaa

SEQ ID NO: 6753547 - DNA, 21 bp, Homo sapiens
ttgaattaaaaaaaaaaacta

SEQ ID NO: 6753548 - DNA, 14 bp, Homo sapiens
ttgaattaaaactt

SEQ ID NO: 6753549 - DNA, 17 bp, Homo sapiens
ttgaattaaaacttctt

SEQ ID NO: 6753550 - DNA, 19 bp, Homo sapiens
ttgaattaaatgttcatct

SEQ ID NO: 6753551 - DNA, 23 bp, Homo sapiens
ttgaattaatatccctacatgta

SEQ ID NO: 6753552 - DNA, 17 bp, Homo sapiens
ttgaattaatctagaaa

SEQ ID NO: 6753553 - DNA, 16 bp, Homo sapiens
ttgaattagaagaaaa

SEQ ID NO: 6753554 - DNA, 15 bp, Homo sapiens
ttgaattagattatt

SEQ ID NO: 6753555 - DNA, 17 bp, Homo sapiens
ttgaattagtatttcag

SEQ ID NO: 6753556 - DNA, 20 bp, Homo sapiens
ttgaattatcagcaaagaaa

SEQ ID NO: 6753557 - DNA, 16 bp, Homo sapiens
ttgaattcatttcact

SEQ ID NO: 6753558 - DNA, 19 bp, Homo sapiens
ttgaattccaagtgtattt

SEQ ID NO: 6753559 - DNA, 13 bp, Homo sapiens
ttgaattcctctc

SEQ ID NO: 6753560 - DNA, 13 bp, Homo sapiens
ttgaattctggag

SEQ ID NO: 6753561 - DNA, 19 bp, Homo sapiens
ttgaattcttgatctctaa

SEQ ID NO: 6753562 - DNA, 18 bp, Homo sapiens
ttgaattctttagatttt

SEQ ID NO: 6753563 - DNA, 20 bp, Homo sapiens
ttgaattgaggggattaata

SEQ ID NO: 6753564 - DNA, 23 bp, Homo sapiens
ttgaattgcattttttaaaacaa

SEQ ID NO: 6753565 - DNA, 15 bp, Homo sapiens
ttgaattgtaactgt

SEQ ID NO: 6753566 - DNA, 13 bp, Homo sapiens
ttgaattgtctag

SEQ ID NO: 6753567 - DNA, 16 bp, Homo sapiens
ttgaattgttatgaaa

SEQ ID NO: 6753568 - DNA, 17 bp, Homo sapiens
ttgaattgttatgaaaa

SEQ ID NO: 6753569 - DNA, 15 bp, Homo sapiens
ttgaatttaaataaa

SEQ ID NO: 6753570 - DNA, 17 bp, Homo sapiens
ttgaatttaaataaagt

SEQ ID NO: 6753571 - DNA, 13 bp, Homo sapiens
ttgaatttaacaa

SEQ ID NO: 6753572 - DNA, 18 bp, Homo sapiens
ttgaatttattggctttt

SEQ ID NO: 6753573 - DNA, 22 bp, Homo sapiens
ttgaatttattggcttttctga

SEQ ID NO: 6753574 - DNA, 23 bp, Homo sapiens
ttgaatttatttttaagaaagaa

SEQ ID NO: 6753575 - DNA, 24 bp, Homo sapiens
ttgaatttatttttaagaaagaaa

SEQ ID NO: 6753576 - DNA, 15 bp, Homo sapiens
ttgaatttctggaag

SEQ ID NO: 6753577 - DNA, 23 bp, Homo sapiens
ttgaatttgcacggtttgtgaga

SEQ ID NO: 6753578 - DNA, 13 bp, Homo sapiens
ttgaatttgcatg

SEQ ID NO: 6753579 - DNA, 22 bp, Homo sapiens
ttgaatttgttagactagttct

SEQ ID NO: 6753580 - DNA, 16 bp, Homo sapiens
ttgaattttaaatcta

SEQ ID NO: 6753581 - DNA, 12 bp, Homo sapiens
ttgaattttaca

SEQ ID NO: 6753582 - DNA, 19 bp, Homo sapiens
ttgaattttcaagcatctc

SEQ ID NO: 6753583 - DNA, 22 bp, Homo sapiens
ttgaattttcaagcatctcctg

SEQ ID NO: 6753584 - DNA, 23 bp, Homo sapiens
ttgaattttcattttacagttac

SEQ ID NO: 6753585 - DNA, 17 bp, Homo sapiens
ttgaattttcccactgc

SEQ ID NO: 6753586 - DNA, 17 bp, Homo sapiens
ttgaattttgtgttaga

SEQ ID NO: 6753587 - DNA, 22 bp, Homo sapiens
ttgaattttgttctctgggaga

SEQ ID NO: 6753588 - DNA, 17 bp, Homo sapiens
ttgaattttttgaaatg

SEQ ID NO: 6753589 - DNA, 18 bp, Homo sapiens
ttgaatttttttctgcac

SEQ ID NO: 6753590 - DNA, 22 bp, Homo sapiens
ttgaatttttttctgcacagct

SEQ ID NO: 6753591 - DNA, 19 bp, Homo sapiens
ttgacaaaatgttatttcc

SEQ ID NO: 6753592 - DNA, 20 bp, Homo sapiens
ttgacaaaatgttatttccc

SEQ ID NO: 6753593 - DNA, 13 bp, Homo sapiens
ttgacaaactctc

SEQ ID NO: 6753594 - DNA, 14 bp, Homo sapiens
ttgacaaatctgtg

SEQ ID NO: 6753595 - DNA, 23 bp, Homo sapiens
ttgacaaatctgtgtatattatt

SEQ ID NO: 6753596 - DNA, 22 bp, Homo sapiens
ttgacaaatgacagatcttttt

SEQ ID NO: 6753597 - DNA, 14 bp, Homo sapiens
ttgacaacagactg

SEQ ID NO: 6753598 - DNA, 15 bp, Homo sapiens
ttgacaacagactga

SEQ ID NO: 6753599 - DNA, 17 bp, Homo sapiens
ttgacaactaaaattag

SEQ ID NO: 6753600 - DNA, 21 bp, Homo sapiens
ttgacaactgaaagaaaaagt

SEQ ID NO: 6753601 - DNA, 16 bp, Homo sapiens
ttgacaactgtgactg

SEQ ID NO: 6753602 - DNA, 14 bp, Homo sapiens
ttgacaagctgact

SEQ ID NO: 6753603 - DNA, 15 bp, Homo sapiens
ttgacaagctggctt

SEQ ID NO: 6753604 - DNA, 14 bp, Homo sapiens
ttgacaaggaaaat

SEQ ID NO: 6753605 - DNA, 17 bp, Homo sapiens
ttgacaaggaaaatcta

SEQ ID NO: 6753606 - DNA, 21 bp, Homo sapiens
ttgacaaggtgtttctctgta

SEQ ID NO: 6753607 - DNA, 13 bp, Homo sapiens
ttgacaataaaat

SEQ ID NO: 6753608 - DNA, 14 bp, Homo sapiens
ttgacaataaaata

SEQ ID NO: 6753609 - DNA, 18 bp, Homo sapiens
ttgacaataagaaacagt

SEQ ID NO: 6753610 - DNA, 23 bp, Homo sapiens
ttgacaataagaaacagtttaac

SEQ ID NO: 6753611 - DNA, 19 bp, Homo sapiens
ttgacaatcaaagaaaaga

SEQ ID NO: 6753612 - DNA, 19 bp, Homo sapiens
ttgacaatcatctccaatg

SEQ ID NO: 6753613 - DNA, 18 bp, Homo sapiens
ttgacaattactcaggtt

SEQ ID NO: 6753614 - DNA, 19 bp, Homo sapiens
ttgacaattcctagataaa

SEQ ID NO: 6753615 - DNA, 14 bp, Homo sapiens
ttgacaattctgca

SEQ ID NO: 6753616 - DNA, 17 bp, Homo sapiens
ttgacaattctgcatgt

SEQ ID NO: 6753617 - DNA, 16 bp, Homo sapiens
ttgacaattctgggtg

SEQ ID NO: 6753618 - DNA, 20 bp, Homo sapiens
ttgacaattttgtcttaagt

SEQ ID NO: 6753619 - DNA, 22 bp, Homo sapiens
ttgacacaaagcttctaaagca

SEQ ID NO: 6753620 - DNA, 16 bp, Homo sapiens
ttgacacaattggaat

SEQ ID NO: 6753621 - DNA, 17 bp, Homo sapiens
ttgacacacagaaatgt

SEQ ID NO: 6753622 - DNA, 19 bp, Homo sapiens
ttgacacacagaaatgtgt

SEQ ID NO: 6753623 - DNA, 14 bp, Homo sapiens
ttgacacacagcac

SEQ ID NO: 6753624 - DNA, 15 bp, Homo sapiens
ttgacacagtcagca

SEQ ID NO: 6753625 - DNA, 19 bp, Homo sapiens
ttgacacagtcagcatgct

SEQ ID NO: 6753626 - DNA, 18 bp, Homo sapiens
ttgacacataaaagtaat

SEQ ID NO: 6753627 - DNA, 11 bp, Homo sapiens
ttgacacatag

SEQ ID NO: 6753628 - DNA, 18 bp, Homo sapiens
ttgacacatccgcctttt

SEQ ID NO: 6753629 - DNA, 21 bp, Homo sapiens
ttgacacatccgccttttgta

SEQ ID NO: 6753630 - DNA, 16 bp, Homo sapiens
ttgacaccaaaatgaa

SEQ ID NO: 6753631 - DNA, 19 bp, Homo sapiens
ttgacaccaaatattttca

SEQ ID NO: 6753632 - DNA, 18 bp, Homo sapiens
ttgacaccacttagattt

SEQ ID NO: 6753633 - DNA, 20 bp, Homo sapiens
ttgacaccagaaagccctct

SEQ ID NO: 6753634 - DNA, 16 bp, Homo sapiens
ttgacaccagggccag

SEQ ID NO: 6753635 - DNA, 12 bp, Homo sapiens
ttgacacctgct

SEQ ID NO: 6753636 - DNA, 13 bp, Homo sapiens
ttgacacctgtct

SEQ ID NO: 6753637 - DNA, 15 bp, Homo sapiens
ttgacaccttagaga

SEQ ID NO: 6753638 - DNA, 14 bp, Homo sapiens
ttgacacctttgaa

SEQ ID NO: 6753639 - DNA, 15 bp, Homo sapiens
ttgacacctttgaat

SEQ ID NO: 6753640 - DNA, 14 bp, Homo sapiens
ttgacacggtgaaa

SEQ ID NO: 6753641 - DNA, 19 bp, Homo sapiens
ttgacactatatctgtata

SEQ ID NO: 6753642 - DNA, 14 bp, Homo sapiens
ttgacactctgcag

SEQ ID NO: 6753643 - DNA, 11 bp, Homo sapiens
ttgacactgaa

SEQ ID NO: 6753644 - DNA, 15 bp, Homo sapiens
ttgacactgaactta

SEQ ID NO: 6753645 - DNA, 14 bp, Homo sapiens
ttgacactgctcta

SEQ ID NO: 6753646 - DNA, 16 bp, Homo sapiens
ttgacactgttttcct

SEQ ID NO: 6753647 - DNA, 14 bp, Homo sapiens
ttgacacttccatt

SEQ ID NO: 6753648 - DNA, 20 bp, Homo sapiens
ttgacacttccattgtttaa

SEQ ID NO: 6753649 - DNA, 21 bp, Homo sapiens
ttgacacttttaaaaaacaaa

SEQ ID NO: 6753650 - DNA, 19 bp, Homo sapiens
ttgacactttttgtatttt

SEQ ID NO: 6753651 - DNA, 20 bp, Homo sapiens
ttgacactttttgtattttt

SEQ ID NO: 6753652 - DNA, 14 bp, Homo sapiens
ttgacagaacactg

SEQ ID NO: 6753653 - DNA, 16 bp, Homo sapiens
ttgacagaacactgtc

SEQ ID NO: 6753654 - DNA, 14 bp, Homo sapiens
ttgacagaagctat

SEQ ID NO: 6753655 - DNA, 20 bp, Homo sapiens
ttgacagaatatgtttcaaa

SEQ ID NO: 6753656 - DNA, 14 bp, Homo sapiens
ttgacagactattt

SEQ ID NO: 6753657 - DNA, 17 bp, Homo sapiens
ttgacagagcctgcccc

SEQ ID NO: 6753658 - DNA, 23 bp, Homo sapiens
ttgacagagcctgccccagcgct

SEQ ID NO: 6753659 - DNA, 21 bp, Homo sapiens
ttgacagagttggtgttcata

SEQ ID NO: 6753660 - DNA, 19 bp, Homo sapiens
ttgacagcatatagaatat

SEQ ID NO: 6753661 - DNA, 23 bp, Homo sapiens
ttgacagcatatagaatatatta

SEQ ID NO: 6753662 - DNA, 12 bp, Homo sapiens
ttgacaggaggt

SEQ ID NO: 6753663 - DNA, 17 bp, Homo sapiens
ttgacaggttttccaaa

SEQ ID NO: 6753664 - DNA, 18 bp, Homo sapiens
ttgacaggttttccaaaa

SEQ ID NO: 6753665 - DNA, 16 bp, Homo sapiens
ttgacagtaacttggt

SEQ ID NO: 6753666 - DNA, 13 bp, Homo sapiens
ttgacagtgaaac

SEQ ID NO: 6753667 - DNA, 15 bp, Homo sapiens
ttgacagtgaaacaa

SEQ ID NO: 6753668 - DNA, 23 bp, Homo sapiens
ttgacagtgagaggatattgagg

SEQ ID NO: 6753669 - DNA, 15 bp, Homo sapiens
ttgacagttctgaag

SEQ ID NO: 6753670 - DNA, 20 bp, Homo sapiens
ttgacataacactataaagg

SEQ ID NO: 6753671 - DNA, 13 bp, Homo sapiens
ttgacatagcctt

SEQ ID NO: 6753672 - DNA, 18 bp, Homo sapiens
ttgacatagcctttgtgc

SEQ ID NO: 6753673 - DNA, 22 bp, Homo sapiens
ttgacataggtcataaagcatt

SEQ ID NO: 6753674 - DNA, 18 bp, Homo sapiens
ttgacatcagttcctttg

SEQ ID NO: 6753675 - DNA, 22 bp, Homo sapiens
ttgacatcagttcctttgtgtg

SEQ ID NO: 6753676 - DNA, 22 bp, Homo sapiens
ttgacatgagtctccagataga

SEQ ID NO: 6753677 - DNA, 13 bp, Homo sapiens
ttgacatggaaat

SEQ ID NO: 6753678 - DNA, 15 bp, Homo sapiens
ttgacatgggtgggg

SEQ ID NO: 6753679 - DNA, 13 bp, Homo sapiens
ttgacattcaaaa

SEQ ID NO: 6753680 - DNA, 15 bp, Homo sapiens
ttgacattctgaatg

SEQ ID NO: 6753681 - DNA, 18 bp, Homo sapiens
ttgacattcttcactgtc

SEQ ID NO: 6753682 - DNA, 22 bp, Homo sapiens
ttgacattgtatgtatctattt

SEQ ID NO: 6753683 - DNA, 15 bp, Homo sapiens
ttgacattgtcagaa

SEQ ID NO: 6753684 - DNA, 13 bp, Homo sapiens
ttgacatttaatt

SEQ ID NO: 6753685 - DNA, 24 bp, Homo sapiens
ttgacatttatattaaataacatg

SEQ ID NO: 6753686 - DNA, 22 bp, Homo sapiens
ttgacatttcattagccatgca

SEQ ID NO: 6753687 - DNA, 12 bp, Homo sapiens
ttgacattttct

SEQ ID NO: 6753688 - DNA, 21 bp, Homo sapiens
ttgacatttttgccaaaatac

SEQ ID NO: 6753689 - DNA, 17 bp, Homo sapiens
ttgaccaaactgtgggt

SEQ ID NO: 6753690 - DNA, 19 bp, Homo sapiens
ttgaccaaactgtgggtat

SEQ ID NO: 6753691 - DNA, 19 bp, Homo sapiens
ttgaccaacagaaaccttt

SEQ ID NO: 6753692 - DNA, 17 bp, Homo sapiens
ttgaccaagaactgcat

SEQ ID NO: 6753693 - DNA, 22 bp, Homo sapiens
ttgaccaagcaggaagctcaga

SEQ ID NO: 6753694 - DNA, 18 bp, Homo sapiens
ttgaccaaggtgcttttc

SEQ ID NO: 6753695 - DNA, 14 bp, Homo sapiens
ttgaccaatgaaat

SEQ ID NO: 6753696 - DNA, 22 bp, Homo sapiens
ttgaccaccagttaacgtatta

SEQ ID NO: 6753697 - DNA, 17 bp, Homo sapiens
ttgaccacggctgttcc

SEQ ID NO: 6753698 - DNA, 13 bp, Homo sapiens
ttgaccactgaca

SEQ ID NO: 6753699 - DNA, 19 bp, Homo sapiens
ttgaccactgtctttttct

SEQ ID NO: 6753700 - DNA, 20 bp, Homo sapiens
ttgaccagaactttttcctc

SEQ ID NO: 6753701 - DNA, 14 bp, Homo sapiens
ttgaccagacctag

SEQ ID NO: 6753702 - DNA, 18 bp, Homo sapiens
ttgaccagataaatagaa

SEQ ID NO: 6753703 - DNA, 19 bp, Homo sapiens
ttgaccagctctcttcctg

SEQ ID NO: 6753704 - DNA, 21 bp, Homo sapiens
ttgattagaagccaagacagt

SEQ ID NO: 6753705 - DNA, 13 bp, Homo sapiens
ttgattaggtatg

SEQ ID NO: 6753706 - DNA, 14 bp, Homo sapiens
ttgattagtataat

SEQ ID NO: 6753707 - DNA, 16 bp, Homo sapiens
ttgattagttttcttg

SEQ ID NO: 6753708 - DNA, 13 bp, Homo sapiens
ttgattataaagt

SEQ ID NO: 6753709 - DNA, 15 bp, Homo sapiens
ttgattataaatgtt

SEQ ID NO: 6753710 - DNA, 21 bp, Homo sapiens
ttgattatccatattgagtca

SEQ ID NO: 6753711 - DNA, 12 bp, Homo sapiens
ttgattatgggt

SEQ ID NO: 6753712 - DNA, 16 bp, Homo sapiens
ttgattattcaacaca

SEQ ID NO: 6753713 - DNA, 12 bp, Homo sapiens
ttgattatttgc

SEQ ID NO: 6753714 - DNA, 20 bp, Homo sapiens
ttgattatttgcatgttatg

SEQ ID NO: 6753715 - DNA, 16 bp, Homo sapiens
ttgattatttgtttta

SEQ ID NO: 6753716 - DNA, 23 bp, Homo sapiens
ttgattattttttttttcttctt

SEQ ID NO: 6753717 - DNA, 19 bp, Homo sapiens
ttgattcacatgttttcaa

SEQ ID NO: 6753718 - DNA, 20 bp, Homo sapiens
ttgattcacatgttttcaaa

SEQ ID NO: 6753719 - DNA, 23 bp, Homo sapiens
ttgattcacatgttttcaaatgg

SEQ ID NO: 6753720 - DNA, 14 bp, Homo sapiens
ttgattcagacagc

SEQ ID NO: 6753721 - DNA, 21 bp, Homo sapiens
ttgattcagacagctgcctgg

SEQ ID NO: 6753722 - DNA, 18 bp, Homo sapiens
ttgattcagccctcagaa

SEQ ID NO: 6753723 - DNA, 14 bp, Homo sapiens
ttgattcagcctgt

SEQ ID NO: 6753724 - DNA, 13 bp, Homo sapiens
ttgattcagctca

SEQ ID NO: 6753725 - DNA, 16 bp, Homo sapiens
ttgattcagtatctta

SEQ ID NO: 6753726 - DNA, 14 bp, Homo sapiens
ttgattcagtcttc

SEQ ID NO: 6753727 - DNA, 20 bp, Homo sapiens
ttgattcatattgcatcata

SEQ ID NO: 6753728 - DNA, 15 bp, Homo sapiens
ttgattcatctctgg

SEQ ID NO: 6753729 - DNA, 21 bp, Homo sapiens
ttgattcatgtgcttgtgcct

SEQ ID NO: 6753730 - DNA, 17 bp, Homo sapiens
ttgattcattttcctgt

SEQ ID NO: 6753731 - DNA, 23 bp, Homo sapiens
ttgattccactgaaacctctgtt

SEQ ID NO: 6753732 - DNA, 14 bp, Homo sapiens
ttgattccatctcc

SEQ ID NO: 6753733 - DNA, 22 bp, Homo sapiens
ttgattcctcgcgacatcttct

SEQ ID NO: 6753734 - DNA, 18 bp, Homo sapiens
ttgattcctggtttgact

SEQ ID NO: 6753735 - DNA, 23 bp, Homo sapiens
ttgattcggtatccccccatctt

SEQ ID NO: 6753736 - DNA, 22 bp, Homo sapiens
ttgattcgtctgcgattttatc

SEQ ID NO: 6753737 - DNA, 12 bp, Homo sapiens
ttgattctcctt

SEQ ID NO: 6753738 - DNA, 17 bp, Homo sapiens
ttgattctccttcagcc

SEQ ID NO: 6753739 - DNA, 20 bp, Homo sapiens
ttgattctccttcagccctc

SEQ ID NO: 6753740 - DNA, 18 bp, Homo sapiens
ttgattctcgactgcttt

SEQ ID NO: 6753741 - DNA, 11 bp, Homo sapiens
ttgattctgat

SEQ ID NO: 6753742 - DNA, 17 bp, Homo sapiens
ttgattcttatttgatg

SEQ ID NO: 6753743 - DNA, 15 bp, Homo sapiens
ttgattgagaaagat

SEQ ID NO: 6753744 - DNA, 19 bp, Homo sapiens
ttgattgaggagctgcact

SEQ ID NO: 6753745 - DNA, 14 bp, Homo sapiens
ttgattgatttgaa

SEQ ID NO: 6753746 - DNA, 17 bp, Homo sapiens
ttgattgatttttaaag

SEQ ID NO: 6753747 - DNA, 22 bp, Homo sapiens
ttgattgatttttaaagtttaa

SEQ ID NO: 6753748 - DNA, 17 bp, Homo sapiens
ttgattgcatattttgt

SEQ ID NO: 6753749 - DNA, 13 bp, Homo sapiens
ttgattgctttgc

SEQ ID NO: 6753750 - DNA, 19 bp, Homo sapiens
ttgattgctttgctgcaca

SEQ ID NO: 6753751 - DNA, 13 bp, Homo sapiens
ttgattgcttttt

SEQ ID NO: 6753752 - DNA, 21 bp, Homo sapiens
ttgattgtacgtagccacagg

SEQ ID NO: 6753753 - DNA, 13 bp, Homo sapiens
ttgattgtgcatg

SEQ ID NO: 6753754 - DNA, 12 bp, Homo sapiens
ttgattgtttac

SEQ ID NO: 6753755 - DNA, 13 bp, Homo sapiens
ttgattgtttaca

SEQ ID NO: 6753756 - DNA, 23 bp, Homo sapiens
ttgattgtttacaggatattcca

SEQ ID NO: 6753757 - DNA, 17 bp, Homo sapiens
ttgatttaaacacacag

SEQ ID NO: 6753758 - DNA, 18 bp, Homo sapiens
ttgatttagaagatagaa

SEQ ID NO: 6753759 - DNA, 15 bp, Homo sapiens
ttgatttataaataa

SEQ ID NO: 6753760 - DNA, 20 bp, Homo sapiens
ttgatttattaacttaataa

SEQ ID NO: 6753761 - DNA, 12 bp, Homo sapiens
ttgatttcaagt

SEQ ID NO: 6753762 - DNA, 14 bp, Homo sapiens
ttgatttccatctt

SEQ ID NO: 6753763 - DNA, 19 bp, Homo sapiens
ttgatttccatcttaatgt

SEQ ID NO: 6753764 - DNA, 17 bp, Homo sapiens
ttgatttcgatgtacag

SEQ ID NO: 6753765 - DNA, 14 bp, Homo sapiens
ttgatttctagtat

SEQ ID NO: 6753766 - DNA, 18 bp, Homo sapiens
ttgatttgaagaacatgt

SEQ ID NO: 6753767 - DNA, 20 bp, Homo sapiens
ttgatttgatctttgtttaa

SEQ ID NO: 6753768 - DNA, 18 bp, Homo sapiens
ttgatttgatgtgacttt

SEQ ID NO: 6753769 - DNA, 13 bp, Homo sapiens
ttgatttgcatgg

SEQ ID NO: 6753770 - DNA, 16 bp, Homo sapiens
ttgatttgcatggatt

SEQ ID NO: 6753771 - DNA, 17 bp, Homo sapiens
ttgatttgcattgaaca

SEQ ID NO: 6753772 - DNA, 19 bp, Homo sapiens
ttgatttgcattgaacaca

SEQ ID NO: 6753773 - DNA, 19 bp, Homo sapiens
ttgatttggtggatgtgat

SEQ ID NO: 6753774 - DNA, 13 bp, Homo sapiens
ttgatttgtacca

SEQ ID NO: 6753775 - DNA, 13 bp, Homo sapiens
ttgatttgttcat

SEQ ID NO: 6753776 - DNA, 20 bp, Homo sapiens
ttgatttgttttagaatgat

SEQ ID NO: 6753777 - DNA, 18 bp, Homo sapiens
ttgattttaaaatgtaca

SEQ ID NO: 6753778 - DNA, 22 bp, Homo sapiens
ttgattttaaaatgtacatgta

SEQ ID NO: 6753779 - DNA, 14 bp, Homo sapiens
ttgattttaaatat

SEQ ID NO: 6753780 - DNA, 23 bp, Homo sapiens
ttgattttaatacattgatcagg

SEQ ID NO: 6753781 - DNA, 17 bp, Homo sapiens
ttgattttaattcaggt

SEQ ID NO: 6753782 - DNA, 23 bp, Homo sapiens
ttgattttacaattgaaatgact

SEQ ID NO: 6753783 - DNA, 14 bp, Homo sapiens
ttgattttcaagct

SEQ ID NO: 6753784 - DNA, 17 bp, Homo sapiens
ttgattttcacagcttt

SEQ ID NO: 6753785 - DNA, 13 bp, Homo sapiens
ttgattttcatat

SEQ ID NO: 6753786 - DNA, 22 bp, Homo sapiens
ttgattttccatctaaaaatat

SEQ ID NO: 6753787 - DNA, 14 bp, Homo sapiens
ttgattttctgttg

SEQ ID NO: 6753788 - DNA, 14 bp, Homo sapiens
ttgattttctttct

SEQ ID NO: 6753789 - DNA, 15 bp, Homo sapiens
ttgattttgaacttt

SEQ ID NO: 6753790 - DNA, 15 bp, Homo sapiens
ttgatttttaaagtt

SEQ ID NO: 6753791 - DNA, 15 bp, Homo sapiens
ttgatttttaagaaa

SEQ ID NO: 6753792 - DNA, 16 bp, Homo sapiens
ttgatttttactgtgt

SEQ ID NO: 6753793 - DNA, 20 bp, Homo sapiens
ttgatttttatccatttctt

SEQ ID NO: 6753794 - DNA, 14 bp, Homo sapiens
ttgatttttctctt

SEQ ID NO: 6753795 - DNA, 20 bp, Homo sapiens
ttgatttttctcttcatttt

SEQ ID NO: 6753796 - DNA, 20 bp, Homo sapiens
ttgatttttgcctcttccag

SEQ ID NO: 6753797 - DNA, 19 bp, Homo sapiens
ttgatttttttaaagtagt

SEQ ID NO: 6753798 - DNA, 16 bp, Homo sapiens
ttgattttttttctct

SEQ ID NO: 6753799 - DNA, 22 bp, Homo sapiens
ttgcaaaaaaaaaaaaaaagtg

SEQ ID NO: 6753800 - DNA, 19 bp, Homo sapiens
ttgcaaaaactacaaccaa

SEQ ID NO: 6753801 - DNA, 20 bp, Homo sapiens
ttgcaaaaactacaaccaat

SEQ ID NO: 6753802 - DNA, 15 bp, Homo sapiens
ttgcaaaactgtgct

SEQ ID NO: 6753803 - DNA, 17 bp, Homo sapiens
ttgcaaaagactaattt

SEQ ID NO: 6753804 - DNA, 13 bp, Homo sapiens
ttgcaaaaggtta

SEQ ID NO: 6753805 - DNA, 16 bp, Homo sapiens
ttgcaaaataagtttt

SEQ ID NO: 6753806 - DNA, 13 bp, Homo sapiens
ttgcaaaatacat

SEQ ID NO: 6753807 - DNA, 19 bp, Homo sapiens
ttgcaaaatagaagaagag

SEQ ID NO: 6753808 - DNA, 21 bp, Homo sapiens
ttgcaaaatcagttttcctct

SEQ ID NO: 6753809 - DNA, 15 bp, Homo sapiens
ttgcaaaatgagttg

SEQ ID NO: 6753810 - DNA, 16 bp, Homo sapiens
ttgcaaaatttccagt

SEQ ID NO: 6753811 - DNA, 22 bp, Homo sapiens
ttgcaaaatttccagtaccttt

SEQ ID NO: 6753812 - DNA, 23 bp, Homo sapiens
ttgcaaaatttccagtacctttg

SEQ ID NO: 6753813 - DNA, 14 bp, Homo sapiens
ttgcaaaccctttg

SEQ ID NO: 6753814 - DNA, 16 bp, Homo sapiens
ttgcaaaccctttgta

SEQ ID NO: 6753815 - DNA, 17 bp, Homo sapiens
ttgcaaaccctttgtat

SEQ ID NO: 6753816 - DNA, 19 bp, Homo sapiens
ttgcaaaccctttgtatta

SEQ ID NO: 6753817 - DNA, 23 bp, Homo sapiens
ttgcaaacctgcagtttttaatt

SEQ ID NO: 6753818 - DNA, 24 bp, Homo sapiens
ttgcaaactctataaagaaacttt

SEQ ID NO: 6753819 - DNA, 12 bp, Homo sapiens
ttgcaaacttta

SEQ ID NO: 6753820 - DNA, 20 bp, Homo sapiens
ttgcaaagaaaattctcaag

SEQ ID NO: 6753821 - DNA, 12 bp, Homo sapiens
ttgcaaagaact

SEQ ID NO: 6753822 - DNA, 19 bp, Homo sapiens
ttgcaaagacctacctcca

SEQ ID NO: 6753823 - DNA, 19 bp, Homo sapiens
ttgcaaagagacatttcaa

SEQ ID NO: 6753824 - DNA, 16 bp, Homo sapiens
ttgcaaagcctttaaa

SEQ ID NO: 6753825 - DNA, 17 bp, Homo sapiens
ttgcaaagcgacagatt

SEQ ID NO: 6753826 - DNA, 15 bp, Homo sapiens
ttgcaaagtactgta

SEQ ID NO: 6753827 - DNA, 17 bp, Homo sapiens
ttgcaaagtattgtaaa

SEQ ID NO: 6753828 - DNA, 20 bp, Homo sapiens
ttgcaaagtattgtaaatta

SEQ ID NO: 6753829 - DNA, 17 bp, Homo sapiens
ttgcaaagttacagatg

SEQ ID NO: 6753830 - DNA, 21 bp, Homo sapiens
ttgcaaataaaacgctttccc

SEQ ID NO: 6753831 - DNA, 19 bp, Homo sapiens
ttgcaaataaaggctctgg

SEQ ID NO: 6753832 - DNA, 22 bp, Homo sapiens
ttgcaaataaaggctctggaag

SEQ ID NO: 6753833 - DNA, 21 bp, Homo sapiens
ttgcaaataacttacaagact

SEQ ID NO: 6753834 - DNA, 22 bp, Homo sapiens
ttgcaaataagtgtattttgaa

SEQ ID NO: 6753835 - DNA, 13 bp, Homo sapiens
ttgcaaatacctc

SEQ ID NO: 6753836 - DNA, 16 bp, Homo sapiens
ttgcaaatagccagtg

SEQ ID NO: 6753837 - DNA, 20 bp, Homo sapiens
ttgcaaatagccagtgctag

SEQ ID NO: 6753838 - DNA, 12 bp, Homo sapiens
ttgcaaatagtc

SEQ ID NO: 6753839 - DNA, 17 bp, Homo sapiens
ttgcaaatataaacatc

SEQ ID NO: 6753840 - DNA, 18 bp, Homo sapiens
ttgcaaatatactttact

SEQ ID NO: 6753841 - DNA, 16 bp, Homo sapiens
ttgcaaatcttgaaat

SEQ ID NO: 6753842 - DNA, 23 bp, Homo sapiens
ttgcaaatgcccttacacttact

SEQ ID NO: 6753843 - DNA, 18 bp, Homo sapiens
ttgcaaattattctagtc

SEQ ID NO: 6753844 - DNA, 19 bp, Homo sapiens
ttgcaaattattctagtca

SEQ ID NO: 6753845 - DNA, 20 bp, Homo sapiens
ttgcaaattatttattactt

SEQ ID NO: 6753846 - DNA, 15 bp, Homo sapiens
ttgcaacactgccaa

SEQ ID NO: 6753847 - DNA, 21 bp, Homo sapiens
ttgcaacagactgttgagtta

SEQ ID NO: 6753848 - DNA, 22 bp, Homo sapiens
ttgcaacagcaaattaatgtgt

SEQ ID NO: 6753849 - DNA, 12 bp, Homo sapiens
ttgcaacatata

SEQ ID NO: 6753850 - DNA, 18 bp, Homo sapiens
ttgcaacctcaccttcct

SEQ ID NO: 6753851 - DNA, 19 bp, Homo sapiens
ttgcaacctcaccttcctg

SEQ ID NO: 6753852 - DNA, 14 bp, Homo sapiens
ttgcaacctcgctg

SEQ ID NO: 6753853 - DNA, 18 bp, Homo sapiens
ttgcaacctctttgctca

SEQ ID NO: 6753854 - DNA, 14 bp, Homo sapiens
ttgcaactaaggac

SEQ ID NO: 6753855 - DNA, 22 bp, Homo sapiens
ttgcaactaaggacaaattagc

SEQ ID NO: 6753856 - DNA, 12 bp, Homo sapiens
ttgcaacttcat

SEQ ID NO: 6753857 - DNA, 22 bp, Homo sapiens
ttgcaacttcatgtcaacttct

SEQ ID NO: 6753858 - DNA, 16 bp, Homo sapiens
ttgcaactttagtttg

SEQ ID NO: 6753859 - DNA, 14 bp, Homo sapiens
ttgcaagaatcagt

SEQ ID NO: 6753860 - DNA, 22 bp, Homo sapiens
ttgcaagatgtgaattattgac

SEQ ID NO: 6753861 - DNA, 21 bp, Homo sapiens
ttgcaagcaacaagctatttt

SEQ ID NO: 6753862 - DNA, 20 bp, Homo sapiens
ttgcaagccataacgtgccc

SEQ ID NO: 6753863 - DNA, 16 bp, Homo sapiens
ttgcaagcctcctgat

SEQ ID NO: 6753864 - DNA, 23 bp, Homo sapiens
ttgcaaggatttttccatgtgtg

SEQ ID NO: 6753865 - DNA, 17 bp, Homo sapiens
ttgcaaggccgctgttc

SEQ ID NO: 6753866 - DNA, 22 bp, Homo sapiens
ttgcaagggccagatctgttaa

SEQ ID NO: 6753867 - DNA, 23 bp, Homo sapiens
ttgcaagggcggcctttcccact

SEQ ID NO: 6753868 - DNA, 18 bp, Homo sapiens
ttgcaaggtaaaatttta

SEQ ID NO: 6753869 - DNA, 17 bp, Homo sapiens
ttgcaaggttccacaga

SEQ ID NO: 6753870 - DNA, 16 bp, Homo sapiens
ttgcaagtgctggagt

SEQ ID NO: 6753871 - DNA, 18 bp, Homo sapiens
ttgcaagttatattagtg

SEQ ID NO: 6753872 - DNA, 16 bp, Homo sapiens
ttgcaataaaatagta

SEQ ID NO: 6753873 - DNA, 17 bp, Homo sapiens
ttgcaataacagctgca

SEQ ID NO: 6753874 - DNA, 20 bp, Homo sapiens
ttgcaataacagctgcaatt

SEQ ID NO: 6753875 - DNA, 13 bp, Homo sapiens
ttgcaataacttc

SEQ ID NO: 6753876 - DNA, 18 bp, Homo sapiens
ttgcaataacttctatat

SEQ ID NO: 6753877 - DNA, 19 bp, Homo sapiens
ttgcaataataataaatta

SEQ ID NO: 6753878 - DNA, 17 bp, Homo sapiens
ttgcaataatgcagtat

SEQ ID NO: 6753879 - DNA, 18 bp, Homo sapiens
ttgcaatacattgttcag

SEQ ID NO: 6753880 - DNA, 15 bp, Homo sapiens
ttgcaatagaaatcc

SEQ ID NO: 6753881 - DNA, 22 bp, Homo sapiens
ttgcaatagaaatccaattgga

SEQ ID NO: 6753882 - DNA, 15 bp, Homo sapiens
ttgcccatccatctg

SEQ ID NO: 6753883 - DNA, 12 bp, Homo sapiens
ttgcccatcctc

SEQ ID NO: 6753884 - DNA, 14 bp, Homo sapiens
ttgcccatcctgac

SEQ ID NO: 6753885 - DNA, 16 bp, Homo sapiens
ttgcccatcctgactg

SEQ ID NO: 6753886 - DNA, 12 bp, Homo sapiens
ttgcccatggca

SEQ ID NO: 6753887 - DNA, 16 bp, Homo sapiens
ttgccccaacccccag

SEQ ID NO: 6753888 - DNA, 17 bp, Homo sapiens
ttgccccaacccccagc

SEQ ID NO: 6753889 - DNA, 18 bp, Homo sapiens
ttgccccaacccttcttc

SEQ ID NO: 6753890 - DNA, 11 bp, Homo sapiens
ttgccccaaga

SEQ ID NO: 6753891 - DNA, 21 bp, Homo sapiens
ttgccccaaggctgctcagag

SEQ ID NO: 6753892 - DNA, 14 bp, Homo sapiens
ttgccccactcctc

SEQ ID NO: 6753893 - DNA, 20 bp, Homo sapiens
ttgccccactctgcctgcct

SEQ ID NO: 6753894 - DNA, 16 bp, Homo sapiens
ttgccccactgggaga

SEQ ID NO: 6753895 - DNA, 20 bp, Homo sapiens
ttgccccaggactctggcac

SEQ ID NO: 6753896 - DNA, 14 bp, Homo sapiens
ttgccccagtcctg

SEQ ID NO: 6753897 - DNA, 15 bp, Homo sapiens
ttgccccagtcctgg

SEQ ID NO: 6753898 - DNA, 14 bp, Homo sapiens
ttgccccagtgtgg

SEQ ID NO: 6753899 - DNA, 23 bp, Homo sapiens
ttgcccccacctctggtccacac

SEQ ID NO: 6753900 - DNA, 13 bp, Homo sapiens
ttgcccccagtgc

SEQ ID NO: 6753901 - DNA, 15 bp, Homo sapiens
ttgcccccagtgcct

SEQ ID NO: 6753902 - DNA, 14 bp, Homo sapiens
ttgcccccatccct

SEQ ID NO: 6753903 - DNA, 15 bp, Homo sapiens
ttgcccccatccctc

SEQ ID NO: 6753904 - DNA, 16 bp, Homo sapiens
ttgcccccattcccag

SEQ ID NO: 6753905 - DNA, 19 bp, Homo sapiens
ttgcccccattcccagcct

SEQ ID NO: 6753906 - DNA, 14 bp, Homo sapiens
ttgcccccctggcc

SEQ ID NO: 6753907 - DNA, 19 bp, Homo sapiens
ttgcccccgacggctgtga

SEQ ID NO: 6753908 - DNA, 21 bp, Homo sapiens
ttgcccccgtgagccaatccc

SEQ ID NO: 6753909 - DNA, 20 bp, Homo sapiens
ttgcccccgtggggctcccg

SEQ ID NO: 6753910 - DNA, 14 bp, Homo sapiens
ttgccccctctcac

SEQ ID NO: 6753911 - DNA, 16 bp, Homo sapiens
ttgccccctctcactt

SEQ ID NO: 6753912 - DNA, 22 bp, Homo sapiens
ttgccccggccccggccccagc

SEQ ID NO: 6753913 - DNA, 17 bp, Homo sapiens
ttgccccggcttgcctg

SEQ ID NO: 6753914 - DNA, 18 bp, Homo sapiens
ttgcccctccagagacag

SEQ ID NO: 6753915 - DNA, 23 bp, Homo sapiens
ttgcccctccgatgctgaggcca

SEQ ID NO: 6753916 - DNA, 22 bp, Homo sapiens
ttgcccctgctctgtagccacc

SEQ ID NO: 6753917 - DNA, 18 bp, Homo sapiens
ttgcccctggctttgcct

SEQ ID NO: 6753918 - DNA, 19 bp, Homo sapiens
ttgccccttgggcctcccc

SEQ ID NO: 6753919 - DNA, 15 bp, Homo sapiens
ttgcccgccagcctc

SEQ ID NO: 6753920 - DNA, 16 bp, Homo sapiens
ttgcccgccagcctca

SEQ ID NO: 6753921 - DNA, 22 bp, Homo sapiens
ttgcccgccagcctcagtgcca

SEQ ID NO: 6753922 - DNA, 14 bp, Homo sapiens
ttgcccgcgctctt

SEQ ID NO: 6753923 - DNA, 16 bp, Homo sapiens
ttgcccgcgctctttc

SEQ ID NO: 6753924 - DNA, 17 bp, Homo sapiens
ttgcccgcgctctttct

SEQ ID NO: 6753925 - DNA, 23 bp, Homo sapiens
ttgcccgctcccacagcttcctg

SEQ ID NO: 6753926 - DNA, 19 bp, Homo sapiens
ttgcccggattctgggagg

SEQ ID NO: 6753927 - DNA, 17 bp, Homo sapiens
ttgcccgtcggccctgc

SEQ ID NO: 6753928 - DNA, 20 bp, Homo sapiens
ttgcccgtcggccctgcgtc

SEQ ID NO: 6753929 - DNA, 19 bp, Homo sapiens
ttgccctaagcagaaagtg

SEQ ID NO: 6753930 - DNA, 16 bp, Homo sapiens
ttgccctagatagttt

SEQ ID NO: 6753931 - DNA, 15 bp, Homo sapiens
ttgccctagatgagc

SEQ ID NO: 6753932 - DNA, 22 bp, Homo sapiens
ttgccctattataattgtcatg

SEQ ID NO: 6753933 - DNA, 13 bp, Homo sapiens
ttgccctccaaat

SEQ ID NO: 6753934 - DNA, 18 bp, Homo sapiens
ttgccctccaaatgtcct

SEQ ID NO: 6753935 - DNA, 12 bp, Homo sapiens
ttgccctcccat

SEQ ID NO: 6753936 - DNA, 12 bp, Homo sapiens
ttgccctcctgc

SEQ ID NO: 6753937 - DNA, 21 bp, Homo sapiens
ttgccctcctgggccctgggc

SEQ ID NO: 6753938 - DNA, 15 bp, Homo sapiens
ttgccctgacctccc

SEQ ID NO: 6753939 - DNA, 20 bp, Homo sapiens
ttgccctgagctttccgggg

SEQ ID NO: 6753940 - DNA, 12 bp, Homo sapiens
ttgccctgaggg

SEQ ID NO: 6753941 - DNA, 16 bp, Homo sapiens
ttgccctgaggggcct

SEQ ID NO: 6753942 - DNA, 15 bp, Homo sapiens
ttgccctgccaggct

SEQ ID NO: 6753943 - DNA, 16 bp, Homo sapiens
ttgccctgctgccctc

SEQ ID NO: 6753944 - DNA, 21 bp, Homo sapiens
ttgccctgggccagcccagga

SEQ ID NO: 6753945 - DNA, 18 bp, Homo sapiens
ttgccctgggctgcctcc

SEQ ID NO: 6753946 - DNA, 16 bp, Homo sapiens
ttgccctggggatcaa

SEQ ID NO: 6753947 - DNA, 17 bp, Homo sapiens
ttgccctgttcaaagta

SEQ ID NO: 6753948 - DNA, 18 bp, Homo sapiens
ttgccctgtttcctgctg

SEQ ID NO: 6753949 - DNA, 16 bp, Homo sapiens
ttgcccttcacagtgt

SEQ ID NO: 6753950 - DNA, 17 bp, Homo sapiens
ttgcccttcacagtgtt

SEQ ID NO: 6753951 - DNA, 18 bp, Homo sapiens
ttgcccttcacagtgttt

SEQ ID NO: 6753952 - DNA, 11 bp, Homo sapiens
ttgcccttccc

SEQ ID NO: 6753953 - DNA, 15 bp, Homo sapiens
ttgcccttcctcctg

SEQ ID NO: 6753954 - DNA, 18 bp, Homo sapiens
ttgcccttcctcctgcct

SEQ ID NO: 6753955 - DNA, 14 bp, Homo sapiens
ttgcccttgccctg

SEQ ID NO: 6753956 - DNA, 18 bp, Homo sapiens
ttgcccttgccctgacct

SEQ ID NO: 6753957 - DNA, 22 bp, Homo sapiens
ttgccctttagggctgttgcta

SEQ ID NO: 6753958 - DNA, 17 bp, Homo sapiens
ttgccgaagtccagctt

SEQ ID NO: 6753959 - DNA, 22 bp, Homo sapiens
ttgccgcagcggtgggaaggaa

SEQ ID NO: 6753960 - DNA, 22 bp, Homo sapiens
ttgccgcgtcgccctcccaggc

SEQ ID NO: 6753961 - DNA, 15 bp, Homo sapiens
ttgccgctgggagag

SEQ ID NO: 6753962 - DNA, 14 bp, Homo sapiens
ttgccgggcctgga

SEQ ID NO: 6753963 - DNA, 23 bp, Homo sapiens
ttgccgggcctggactgtcctag

SEQ ID NO: 6753964 - DNA, 16 bp, Homo sapiens
ttgccgggcctgggcc

SEQ ID NO: 6753965 - DNA, 17 bp, Homo sapiens
ttgccgggcctgggcct

SEQ ID NO: 6753966 - DNA, 23 bp, Homo sapiens
ttgccgtcactattcatcaatga

SEQ ID NO: 6753967 - DNA, 19 bp, Homo sapiens
ttgccgtctacctgagggg

SEQ ID NO: 6753968 - DNA, 21 bp, Homo sapiens
ttgccgtctcatcttctctca

SEQ ID NO: 6753969 - DNA, 17 bp, Homo sapiens
ttgccgtgttggatttc

SEQ ID NO: 6753970 - DNA, 20 bp, Homo sapiens
ttgcctaaaatataattttt

SEQ ID NO: 6753971 - DNA, 22 bp, Homo sapiens
ttgcctaaatttaatgctgcct

SEQ ID NO: 6753972 - DNA, 23 bp, Homo sapiens
ttgcctaagaataaacatttgtt

SEQ ID NO: 6753973 - DNA, 20 bp, Homo sapiens
ttgcctaaggccagccattt

SEQ ID NO: 6753974 - DNA, 19 bp, Homo sapiens
ttgcctaataaacatcctt

SEQ ID NO: 6753975 - DNA, 18 bp, Homo sapiens
ttgcctaatacattaaag

SEQ ID NO: 6753976 - DNA, 19 bp, Homo sapiens
ttgcctaatacattaaagc

SEQ ID NO: 6753977 - DNA, 21 bp, Homo sapiens
ttgcctaatacattaaagcag

SEQ ID NO: 6753978 - DNA, 14 bp, Homo sapiens
ttgcctaccatttc

SEQ ID NO: 6753979 - DNA, 17 bp, Homo sapiens
ttgcctagaaatatctt

SEQ ID NO: 6753980 - DNA, 14 bp, Homo sapiens
ttgcctagacagct

SEQ ID NO: 6753981 - DNA, 21 bp, Homo sapiens
ttgcctaggctggaaatagga

SEQ ID NO: 6753982 - DNA, 18 bp, Homo sapiens
ttgcctatattttcctga

SEQ ID NO: 6753983 - DNA, 15 bp, Homo sapiens
ttgcctatcctgctg

SEQ ID NO: 6753984 - DNA, 20 bp, Homo sapiens
ttgcctatcctgctgttcta

SEQ ID NO: 6753985 - DNA, 19 bp, Homo sapiens
ttgcctatgcccagggaat

SEQ ID NO: 6753986 - DNA, 20 bp, Homo sapiens
ttgcctatgcccagggaata

SEQ ID NO: 6753987 - DNA, 20 bp, Homo sapiens
ttgcctatggatcaaagaaa

SEQ ID NO: 6753988 - DNA, 23 bp, Homo sapiens
ttgcctcaaataaaaagtgcttt

SEQ ID NO: 6753989 - DNA, 13 bp, Homo sapiens
ttgcctcaacagc

SEQ ID NO: 6753990 - DNA, 16 bp, Homo sapiens
ttgcctcaacagcagg

SEQ ID NO: 6753991 - DNA, 21 bp, Homo sapiens
ttgcctcagtcccccaacaga

SEQ ID NO: 6753992 - DNA, 15 bp, Homo sapiens
ttgcctcatgaacac

SEQ ID NO: 6753993 - DNA, 19 bp, Homo sapiens
ttgcctcattttgcttccc

SEQ ID NO: 6753994 - DNA, 11 bp, Homo sapiens
ttgcctccagg

SEQ ID NO: 6753995 - DNA, 18 bp, Homo sapiens
ttgcctccatggtgcctc

SEQ ID NO: 6753996 - DNA, 21 bp, Homo sapiens
ttgcctccccatttcccatct

SEQ ID NO: 6753997 - DNA, 12 bp, Homo sapiens
ttgcctcccttc

SEQ ID NO: 6753998 - DNA, 14 bp, Homo sapiens
ttgcctccgtgtca

SEQ ID NO: 6753999 - DNA, 19 bp, Homo sapiens
ttgcctcctctctccctgc

SEQ ID NO: 6754000 - DNA, 20 bp, Homo sapiens
ttgcctcctctctccctgcc

SEQ ID NO: 6754001 - DNA, 15 bp, Homo sapiens
ttgcctcctgtgtaa

SEQ ID NO: 6754002 - DNA, 19 bp, Homo sapiens
ttgcctcctgtgtactgtg

SEQ ID NO: 6754003 - DNA, 21 bp, Homo sapiens
ttgcctcctgtgtactgtgtc

SEQ ID NO: 6754004 - DNA, 20 bp, Homo sapiens
ttgcctcgaaagtgtcatca

SEQ ID NO: 6754005 - DNA, 17 bp, Homo sapiens
ttgcctcggctcctgct

SEQ ID NO: 6754006 - DNA, 20 bp, Homo sapiens
ttgcctctcggttgaaacct

SEQ ID NO: 6754007 - DNA, 19 bp, Homo sapiens
ttgcctctgagagcatcag

SEQ ID NO: 6754008 - DNA, 23 bp, Homo sapiens
ttgcctctgcacgtgcacacacc

SEQ ID NO: 6754009 - DNA, 13 bp, Homo sapiens
ttgcctctgccca

SEQ ID NO: 6754010 - DNA, 14 bp, Homo sapiens
ttgcctctgccctg

SEQ ID NO: 6754011 - DNA, 15 bp, Homo sapiens
ttgcctctgccctgg

SEQ ID NO: 6754012 - DNA, 17 bp, Homo sapiens
ttgcctctgcccttggg

SEQ ID NO: 6754013 - DNA, 18 bp, Homo sapiens
ttgcctctgtccccttct

SEQ ID NO: 6754014 - DNA, 13 bp, Homo sapiens
ttgcctctgtgct

SEQ ID NO: 6754015 - DNA, 17 bp, Homo sapiens
ttgcctcttccagtctt

SEQ ID NO: 6754016 - DNA, 20 bp, Homo sapiens
ttgcctcttttacctgctgc

SEQ ID NO: 6754017 - DNA, 21 bp, Homo sapiens
ttgcctcttttacctgctgct

SEQ ID NO: 6754018 - DNA, 15 bp, Homo sapiens
ttgcctcttttcaca

SEQ ID NO: 6754019 - DNA, 20 bp, Homo sapiens
ttgcctgaaacccatttact

SEQ ID NO: 6754020 - DNA, 19 bp, Homo sapiens
ttgcctgaacatccttcct

SEQ ID NO: 6754021 - DNA, 15 bp, Homo sapiens
ttgcctgaagaaaca

SEQ ID NO: 6754022 - DNA, 23 bp, Homo sapiens
ttgcctgactaaaatgtttcatt

SEQ ID NO: 6754023 - DNA, 21 bp, Homo sapiens
ttgcctgaggggaaagagaga

SEQ ID NO: 6754024 - DNA, 20 bp, Homo sapiens
ttgcctgatgacaataaagc

SEQ ID NO: 6754025 - DNA, 16 bp, Homo sapiens
ttgcctgcacccttcc

SEQ ID NO: 6754026 - DNA, 13 bp, Homo sapiens
ttgcctgcagaga

SEQ ID NO: 6754027 - DNA, 15 bp, Homo sapiens
ttgcctgcagagaga

SEQ ID NO: 6754028 - DNA, 20 bp, Homo sapiens
ttgcctgcagagagaagcct

SEQ ID NO: 6754029 - DNA, 12 bp, Homo sapiens
ttgcctgcaggc

SEQ ID NO: 6754030 - DNA, 19 bp, Homo sapiens
ttgcctgccactgtgtgaa

SEQ ID NO: 6754031 - DNA, 12 bp, Homo sapiens
ttgcctgccatg

SEQ ID NO: 6754032 - DNA, 17 bp, Homo sapiens
ttgcctgccatggctgt

SEQ ID NO: 6754033 - DNA, 17 bp, Homo sapiens
ttgcctgcctgggcctc

SEQ ID NO: 6754034 - DNA, 12 bp, Homo sapiens
ttgcctgccttt

SEQ ID NO: 6754035 - DNA, 14 bp, Homo sapiens
ttgcctgcctttcc

SEQ ID NO: 6754036 - DNA, 23 bp, Homo sapiens
ttgcctgctgcttggagtgcccc

SEQ ID NO: 6754037 - DNA, 14 bp, Homo sapiens
ttgcctgctgtatt

SEQ ID NO: 6754038 - DNA, 14 bp, Homo sapiens
ttgcctggaataaa

SEQ ID NO: 6754039 - DNA, 17 bp, Homo sapiens
ttgcctggaataaaata

SEQ ID NO: 6754040 - DNA, 13 bp, Homo sapiens
ttgcctggactga

SEQ ID NO: 6754041 - DNA, 14 bp, Homo sapiens
ttgcctggactgac

SEQ ID NO: 6754042 - DNA, 16 bp, Homo sapiens
ttgcctggactgacca

SEQ ID NO: 6754043 - DNA, 16 bp, Homo sapiens
ttgcctggctgtggag

SEQ ID NO: 6754044 - DNA, 20 bp, Homo sapiens
ttgcctggctgtggaggcct

SEQ ID NO: 6754045 - DNA, 20 bp, Homo sapiens
ttgcctgggatatcacttca

SEQ ID NO: 6754046 - DNA, 15 bp, Homo sapiens
ttgcctgggcagtgc

SEQ ID NO: 6754047 - DNA, 13 bp, Homo sapiens
ttgcctggtacag

SEQ ID NO: 6754048 - DNA, 16 bp, Homo sapiens
ttgcctgtagagccag

SEQ ID NO: 6754049 - DNA, 12 bp, Homo sapiens
ttgcctgtcaag

SEQ ID NO: 6754050 - DNA, 12 bp, Homo sapiens
ttgcctgtgcca

SEQ ID NO: 6754051 - DNA, 20 bp, Homo sapiens
ttgcctgtgtgagcatctct

SEQ ID NO: 6754052 - DNA, 15 bp, Homo sapiens
ttgcctgttaaatat

SEQ ID NO: 6754053 - DNA, 20 bp, Homo sapiens
ttgcctgttcagttacagaa

SEQ ID NO: 6754054 - DNA, 23 bp, Homo sapiens
ttgcctgttcagttacagaaagt

SEQ ID NO: 6754055 - DNA, 12 bp, Homo sapiens
ttgcctgttctg

SEQ ID NO: 6754056 - DNA, 15 bp, Homo sapiens
ttgcctgttctgctt

SEQ ID NO: 6754057 - DNA, 16 bp, Homo sapiens
ttgcctgttctgcttc

SEQ ID NO: 6754058 - DNA, 16 bp, Homo sapiens
ttgcctgttggctgct

SEQ ID NO: 6754059 - DNA, 18 bp, Homo sapiens
ttgcctgttggctgctgc

SEQ ID NO: 6754060 - DNA, 21 bp, Homo sapiens
ttgcctgtttctgatttgctg

SEQ ID NO: 6754061 - DNA, 21 bp, Homo sapiens
ttgctttaatataaatgcaaa

SEQ ID NO: 6754062 - DNA, 22 bp, Homo sapiens
ttgctttaatataaatgcaaat

SEQ ID NO: 6754063 - DNA, 23 bp, Homo sapiens
ttgctttaatataaatgcaaata

SEQ ID NO: 6754064 - DNA, 14 bp, Homo sapiens
ttgctttaatgaga

SEQ ID NO: 6754065 - DNA, 20 bp, Homo sapiens
ttgctttaattgctttaaat

SEQ ID NO: 6754066 - DNA, 19 bp, Homo sapiens
ttgctttactgtcaaaata

SEQ ID NO: 6754067 - DNA, 23 bp, Homo sapiens
ttgctttatgggggggagggagg

SEQ ID NO: 6754068 - DNA, 11 bp, Homo sapiens
ttgctttcact

SEQ ID NO: 6754069 - DNA, 16 bp, Homo sapiens
ttgctttcctgggcct

SEQ ID NO: 6754070 - DNA, 15 bp, Homo sapiens
ttgctttctgaaatt

SEQ ID NO: 6754071 - DNA, 15 bp, Homo sapiens
ttgctttctgctcag

SEQ ID NO: 6754072 - DNA, 18 bp, Homo sapiens
ttgctttcttcctgcata

SEQ ID NO: 6754073 - DNA, 15 bp, Homo sapiens
ttgctttcttttctc

SEQ ID NO: 6754074 - DNA, 17 bp, Homo sapiens
ttgctttgaaaaatctc

SEQ ID NO: 6754075 - DNA, 14 bp, Homo sapiens
ttgctttgaaaata

SEQ ID NO: 6754076 - DNA, 15 bp, Homo sapiens
ttgctttgaagcagt

SEQ ID NO: 6754077 - DNA, 22 bp, Homo sapiens
ttgctttgaccatggaaagaaa

SEQ ID NO: 6754078 - DNA, 22 bp, Homo sapiens
ttgctttgagactcctcagcac

SEQ ID NO: 6754079 - DNA, 19 bp, Homo sapiens
ttgctttgatttacagcaa

SEQ ID NO: 6754080 - DNA, 15 bp, Homo sapiens
ttgctttgccagagc

SEQ ID NO: 6754081 - DNA, 14 bp, Homo sapiens
ttgctttgcccagc

SEQ ID NO: 6754082 - DNA, 13 bp, Homo sapiens
ttgctttgccctg

SEQ ID NO: 6754083 - DNA, 17 bp, Homo sapiens
ttgctttggatacacac

SEQ ID NO: 6754084 - DNA, 23 bp, Homo sapiens
ttgctttgggctttgcaggctct

SEQ ID NO: 6754085 - DNA, 12 bp, Homo sapiens
ttgctttgtagg

SEQ ID NO: 6754086 - DNA, 14 bp, Homo sapiens
ttgctttgtctttc

SEQ ID NO: 6754087 - DNA, 16 bp, Homo sapiens
ttgctttgtgttcttt

SEQ ID NO: 6754088 - DNA, 13 bp, Homo sapiens
ttgctttgttaca

SEQ ID NO: 6754089 - DNA, 14 bp, Homo sapiens
ttgcttttaaaact

SEQ ID NO: 6754090 - DNA, 16 bp, Homo sapiens
ttgcttttaaaatcca

SEQ ID NO: 6754091 - DNA, 18 bp, Homo sapiens
ttgcttttaaaattttaa

SEQ ID NO: 6754092 - DNA, 12 bp, Homo sapiens
ttgcttttaatt

SEQ ID NO: 6754093 - DNA, 17 bp, Homo sapiens
ttgcttttatcagtgtt

SEQ ID NO: 6754094 - DNA, 17 bp, Homo sapiens
ttgcttttattttgaaa

SEQ ID NO: 6754095 - DNA, 15 bp, Homo sapiens
ttgcttttcacaaat

SEQ ID NO: 6754096 - DNA, 18 bp, Homo sapiens
ttgcttttcactggcata

SEQ ID NO: 6754097 - DNA, 16 bp, Homo sapiens
ttgcttttcatgtaga

SEQ ID NO: 6754098 - DNA, 21 bp, Homo sapiens
ttgcttttcatgtagaactca

SEQ ID NO: 6754099 - DNA, 23 bp, Homo sapiens
ttgcttttcatgtagaactcagc

SEQ ID NO: 6754100 - DNA, 19 bp, Homo sapiens
ttgcttttccactgcctgg

SEQ ID NO: 6754101 - DNA, 18 bp, Homo sapiens
ttgcttttgaaaagttga

SEQ ID NO: 6754102 - DNA, 19 bp, Homo sapiens
ttgcttttgaaaagttgaa

SEQ ID NO: 6754103 - DNA, 21 bp, Homo sapiens
ttgcttttgaacgtatgtgct

SEQ ID NO: 6754104 - DNA, 18 bp, Homo sapiens
ttgcttttgaaggaatac

SEQ ID NO: 6754105 - DNA, 20 bp, Homo sapiens
ttgcttttggcaaaactcta

SEQ ID NO: 6754106 - DNA, 15 bp, Homo sapiens
ttgcttttgtttttt

SEQ ID NO: 6754107 - DNA, 22 bp, Homo sapiens
ttgcttttgtttttttcctcat

SEQ ID NO: 6754108 - DNA, 17 bp, Homo sapiens
ttgctttttaaactgat

SEQ ID NO: 6754109 - DNA, 15 bp, Homo sapiens
ttgctttttcaccag

SEQ ID NO: 6754110 - DNA, 22 bp, Homo sapiens
ttgctttttccccattggaact

SEQ ID NO: 6754111 - DNA, 15 bp, Homo sapiens
ttgctttttctaatg

SEQ ID NO: 6754112 - DNA, 13 bp, Homo sapiens
ttgctttttctga

SEQ ID NO: 6754113 - DNA, 21 bp, Homo sapiens
ttgctttttgtgatatgcaca

SEQ ID NO: 6754114 - DNA, 15 bp, Homo sapiens
ttgcttttttaaata

SEQ ID NO: 6754115 - DNA, 21 bp, Homo sapiens
ttgcttttttagatttattgt

SEQ ID NO: 6754116 - DNA, 19 bp, Homo sapiens
ttggaaaacataaaaatca

SEQ ID NO: 6754117 - DNA, 20 bp, Homo sapiens
ttggaaaacatatgaaatat

SEQ ID NO: 6754118 - DNA, 15 bp, Homo sapiens
ttggaaaactacttt

SEQ ID NO: 6754119 - DNA, 15 bp, Homo sapiens
ttggaaaagaaacaa

SEQ ID NO: 6754120 - DNA, 19 bp, Homo sapiens
ttggaaaagaaatcaattt

SEQ ID NO: 6754121 - DNA, 14 bp, Homo sapiens
ttggaaaagaatac

SEQ ID NO: 6754122 - DNA, 19 bp, Homo sapiens
ttggaaaagaatacagaaa

SEQ ID NO: 6754123 - DNA, 22 bp, Homo sapiens
ttggaaaagaatacagaaagat

SEQ ID NO: 6754124 - DNA, 19 bp, Homo sapiens
ttggaaaagggcactcatt

SEQ ID NO: 6754125 - DNA, 17 bp, Homo sapiens
ttggaaaataataaaag

SEQ ID NO: 6754126 - DNA, 16 bp, Homo sapiens
ttggaaaatgacattt

SEQ ID NO: 6754127 - DNA, 14 bp, Homo sapiens
ttggaaacactaaa

SEQ ID NO: 6754128 - DNA, 20 bp, Homo sapiens
ttggaaacactaaatgttaa

SEQ ID NO: 6754129 - DNA, 16 bp, Homo sapiens
ttggaaacattttctt

SEQ ID NO: 6754130 - DNA, 22 bp, Homo sapiens
ttggaaacattttttaaaacaa

SEQ ID NO: 6754131 - DNA, 18 bp, Homo sapiens
ttggaaaccacagtcagt

SEQ ID NO: 6754132 - DNA, 17 bp, Homo sapiens
ttggaaaccaccttaaa

SEQ ID NO: 6754133 - DNA, 17 bp, Homo sapiens
ttggaaaccatgcacta

SEQ ID NO: 6754134 - DNA, 15 bp, Homo sapiens
ttggaaacctgccct

SEQ ID NO: 6754135 - DNA, 18 bp, Homo sapiens
ttggaaacctgccctgcc

SEQ ID NO: 6754136 - DNA, 21 bp, Homo sapiens
ttggaaacctgccctgcctga

SEQ ID NO: 6754137 - DNA, 15 bp, Homo sapiens
ttggaaactaataaa

SEQ ID NO: 6754138 - DNA, 18 bp, Homo sapiens
ttggaaactaataaaata

SEQ ID NO: 6754139 - DNA, 23 bp, Homo sapiens
ttggaaactaataaaatattttc

SEQ ID NO: 6754140 - DNA, 22 bp, Homo sapiens
ttggaaactgttggttgagata

SEQ ID NO: 6754141 - DNA, 22 bp, Homo sapiens
ttggaaagaacatttaaaatta

SEQ ID NO: 6754142 - DNA, 16 bp, Homo sapiens
ttggaaagaggttctg

SEQ ID NO: 6754143 - DNA, 11 bp, Homo sapiens
ttggaaagagt

SEQ ID NO: 6754144 - DNA, 21 bp, Homo sapiens
ttggaaagccattgaccaccc

SEQ ID NO: 6754145 - DNA, 16 bp, Homo sapiens
ttggaaagctgatgat

SEQ ID NO: 6754146 - DNA, 17 bp, Homo sapiens
ttggaaaggttctaagg

SEQ ID NO: 6754147 - DNA, 14 bp, Homo sapiens
ttggaaagtcagaa

SEQ ID NO: 6754148 - DNA, 19 bp, Homo sapiens
ttggaaagttactgtaaat

SEQ ID NO: 6754149 - DNA, 18 bp, Homo sapiens
ttggaaataaaagataaa

SEQ ID NO: 6754150 - DNA, 15 bp, Homo sapiens
ttggaaataaaccat

SEQ ID NO: 6754151 - DNA, 13 bp, Homo sapiens
ttggaaataaagt

SEQ ID NO: 6754152 - DNA, 22 bp, Homo sapiens
ttggaaatagaaagaagccata

SEQ ID NO: 6754153 - DNA, 19 bp, Homo sapiens
ttggaaatcaaatgtaaag

SEQ ID NO: 6754154 - DNA, 23 bp, Homo sapiens
ttggaaatcagtagaaagctaaa

SEQ ID NO: 6754155 - DNA, 16 bp, Homo sapiens
ttggaaatcagttgtg

SEQ ID NO: 6754156 - DNA, 22 bp, Homo sapiens
ttggaaatcagttgtgaataca

SEQ ID NO: 6754157 - DNA, 19 bp, Homo sapiens
ttggaaatcctagtttcct

SEQ ID NO: 6754158 - DNA, 15 bp, Homo sapiens
ttggaaatctttaaa

SEQ ID NO: 6754159 - DNA, 13 bp, Homo sapiens
ttggaaatgagaa

SEQ ID NO: 6754160 - DNA, 21 bp, Homo sapiens
ttggaaatggatgcaaagtac

SEQ ID NO: 6754161 - DNA, 17 bp, Homo sapiens
ttggaaatgtctgctgg

SEQ ID NO: 6754162 - DNA, 15 bp, Homo sapiens
ttggaaattgttgta

SEQ ID NO: 6754163 - DNA, 18 bp, Homo sapiens
ttggaaatttagcattgt

SEQ ID NO: 6754164 - DNA, 13 bp, Homo sapiens
ttggaaatttcac

SEQ ID NO: 6754165 - DNA, 18 bp, Homo sapiens
ttggaacactactcttac

SEQ ID NO: 6754166 - DNA, 13 bp, Homo sapiens
ttggaacagaatg

SEQ ID NO: 6754167 - DNA, 14 bp, Homo sapiens
ttggaacagaatgt

SEQ ID NO: 6754168 - DNA, 13 bp, Homo sapiens
ttggaacatttct

SEQ ID NO: 6754169 - DNA, 15 bp, Homo sapiens
ttggaacatttcttt

SEQ ID NO: 6754170 - DNA, 12 bp, Homo sapiens
ttggaaccaaag

SEQ ID NO: 6754171 - DNA, 15 bp, Homo sapiens
ttggaaccagactct

SEQ ID NO: 6754172 - DNA, 14 bp, Homo sapiens
ttggaaccagcccc

SEQ ID NO: 6754173 - DNA, 16 bp, Homo sapiens
ttggaaccagccccat

SEQ ID NO: 6754174 - DNA, 17 bp, Homo sapiens
ttggaaccatgccttcc

SEQ ID NO: 6754175 - DNA, 17 bp, Homo sapiens
ttggaacctaatgggaa

SEQ ID NO: 6754176 - DNA, 23 bp, Homo sapiens
ttggaacctaatgggaatcattc

SEQ ID NO: 6754177 - DNA, 17 bp, Homo sapiens
ttggaactagtcattaa

SEQ ID NO: 6754178 - DNA, 17 bp, Homo sapiens
ttggaactatgaagact

SEQ ID NO: 6754179 - DNA, 22 bp, Homo sapiens
ttggaactctactcaacccatt

SEQ ID NO: 6754180 - DNA, 18 bp, Homo sapiens
ttggaactctgtgcaggt

SEQ ID NO: 6754181 - DNA, 15 bp, Homo sapiens
ttggaactgcaatga

SEQ ID NO: 6754182 - DNA, 21 bp, Homo sapiens
ttggaactgcgataactgaga

SEQ ID NO: 6754183 - DNA, 14 bp, Homo sapiens
ttggaactggaggc

SEQ ID NO: 6754184 - DNA, 16 bp, Homo sapiens
ttggaactgtgtttca

SEQ ID NO: 6754185 - DNA, 20 bp, Homo sapiens
ttggaagacatatattatat

SEQ ID NO: 6754186 - DNA, 21 bp, Homo sapiens
ttggaagacatatattatata

SEQ ID NO: 6754187 - DNA, 22 bp, Homo sapiens
ttggaagacatatattatatat

SEQ ID NO: 6754188 - DNA, 20 bp, Homo sapiens
ttggaagaccccacccaagc

SEQ ID NO: 6754189 - DNA, 16 bp, Homo sapiens
ttggaagagaggcacc

SEQ ID NO: 6754190 - DNA, 23 bp, Homo sapiens
ttggaagagaggcacctgctgga

SEQ ID NO: 6754191 - DNA, 17 bp, Homo sapiens
ttggaagagcagcacct

SEQ ID NO: 6754192 - DNA, 20 bp, Homo sapiens
ttggaagagcagcacctcct

SEQ ID NO: 6754193 - DNA, 13 bp, Homo sapiens
ttggaagagcccg

SEQ ID NO: 6754194 - DNA, 23 bp, Homo sapiens
ttggaagagcccgccgtctgcag

SEQ ID NO: 6754195 - DNA, 15 bp, Homo sapiens
ttggaagagtgacct

SEQ ID NO: 6754196 - DNA, 16 bp, Homo sapiens
ttggaagcaacgtgtt

SEQ ID NO: 6754197 - DNA, 15 bp, Homo sapiens
ttggaagcctgagca

SEQ ID NO: 6754198 - DNA, 23 bp, Homo sapiens
ttggaagctagctcccctcctct

SEQ ID NO: 6754199 - DNA, 12 bp, Homo sapiens
ttggaagctgct

SEQ ID NO: 6754200 - DNA, 21 bp, Homo sapiens
ttggaagctttggttatgaaa

SEQ ID NO: 6754201 - DNA, 18 bp, Homo sapiens
ttggaaggaaaggaatat

SEQ ID NO: 6754202 - DNA, 11 bp, Homo sapiens
ttggaaggaac

SEQ ID NO: 6754203 - DNA, 19 bp, Homo sapiens
ttggaaggaacgtcccctg

SEQ ID NO: 6754204 - DNA, 18 bp, Homo sapiens
ttggaaggagacacagat

SEQ ID NO: 6754205 - DNA, 13 bp, Homo sapiens
ttggaaggagcag

SEQ ID NO: 6754206 - DNA, 17 bp, Homo sapiens
ttggaaggatctgctga

SEQ ID NO: 6754207 - DNA, 18 bp, Homo sapiens
ttggaagggaccccagat

SEQ ID NO: 6754208 - DNA, 21 bp, Homo sapiens
ttggaagggcgctgagggcag

SEQ ID NO: 6754209 - DNA, 23 bp, Homo sapiens
ttggaagggcgctgagggcaggg

SEQ ID NO: 6754210 - DNA, 20 bp, Homo sapiens
ttggaagggcttttcaaaat

SEQ ID NO: 6754211 - DNA, 17 bp, Homo sapiens
ttggaaggggccttgct

SEQ ID NO: 6754212 - DNA, 21 bp, Homo sapiens
ttggaagggtctctctccagg

SEQ ID NO: 6754213 - DNA, 14 bp, Homo sapiens
ttggaaggtgacac

SEQ ID NO: 6754214 - DNA, 14 bp, Homo sapiens
ttggaagtatagat

SEQ ID NO: 6754215 - DNA, 20 bp, Homo sapiens
ttggaagtcgtttcaggaca

SEQ ID NO: 6754216 - DNA, 22 bp, Homo sapiens
ttggaagtgcagtcagcagatg

SEQ ID NO: 6754217 - DNA, 16 bp, Homo sapiens
ttggaagttgcatggc

SEQ ID NO: 6754218 - DNA, 19 bp, Homo sapiens
ttggaagtttgtgttctgt

SEQ ID NO: 6754219 - DNA, 22 bp, Homo sapiens
ttggaagttttacttgattaag

SEQ ID NO: 6754220 - DNA, 16 bp, Homo sapiens
ttggaagttttcagga

SEQ ID NO: 6754221 - DNA, 19 bp, Homo sapiens
ttggaataataattttcct

SEQ ID NO: 6754222 - DNA, 16 bp, Homo sapiens
ttggaatagcagcctc

SEQ ID NO: 6754223 - DNA, 13 bp, Homo sapiens
ttggaatattaaa

SEQ ID NO: 6754224 - DNA, 16 bp, Homo sapiens
ttggaatattaaaaaa

SEQ ID NO: 6754225 - DNA, 14 bp, Homo sapiens
ttggaatatttgaa

SEQ ID NO: 6754226 - DNA, 19 bp, Homo sapiens
ttggaatattttatcctgt

SEQ ID NO: 6754227 - DNA, 14 bp, Homo sapiens
ttggaatctaagct

SEQ ID NO: 6754228 - DNA, 17 bp, Homo sapiens
ttggaatctagaagaaa

SEQ ID NO: 6754229 - DNA, 19 bp, Homo sapiens
ttggaatctagaagaaatg

SEQ ID NO: 6754230 - DNA, 22 bp, Homo sapiens
ttggaatctagaagaaatgaaa

SEQ ID NO: 6754231 - DNA, 23 bp, Homo sapiens
ttggaatctagaagaaatgaaat

SEQ ID NO: 6754232 - DNA, 22 bp, Homo sapiens
ttggaatctagccgatggaaaa

SEQ ID NO: 6754233 - DNA, 20 bp, Homo sapiens
ttggaatgaaattcctcctt

SEQ ID NO: 6754234 - DNA, 23 bp, Homo sapiens
ttggaatgcactcagactgtata

SEQ ID NO: 6754235 - DNA, 16 bp, Homo sapiens
ttggaatgctccaggc

SEQ ID NO: 6754236 - DNA, 19 bp, Homo sapiens
ttggaatggaactactgta

SEQ ID NO: 6754237 - DNA, 23 bp, Homo sapiens
ttggaatgggagaggcaataaat

SEQ ID NO: 6754238 - DNA, 20 bp, Homo sapiens
ttgggaaagcccagacttta

SEQ ID NO: 6754239 - DNA, 15 bp, Homo sapiens
ttgggaaaggcaggg

SEQ ID NO: 6754240 - DNA, 18 bp, Homo sapiens
ttgggaaaggcagggccc

SEQ ID NO: 6754241 - DNA, 20 bp, Homo sapiens
ttgggaaaggcagggccctg

SEQ ID NO: 6754242 - DNA, 15 bp, Homo sapiens
ttgggaaattcttgc

SEQ ID NO: 6754243 - DNA, 16 bp, Homo sapiens
ttgggaaattcttgca

SEQ ID NO: 6754244 - DNA, 21 bp, Homo sapiens
ttgggaaattcttgcactgta

SEQ ID NO: 6754245 - DNA, 18 bp, Homo sapiens
ttgggaacactggcctgg

SEQ ID NO: 6754246 - DNA, 22 bp, Homo sapiens
ttgggaacagcatggaggcaga

SEQ ID NO: 6754247 - DNA, 18 bp, Homo sapiens
ttgggaacagggttactg

SEQ ID NO: 6754248 - DNA, 19 bp, Homo sapiens
ttgggaacagggttactgt

SEQ ID NO: 6754249 - DNA, 15 bp, Homo sapiens
ttgggaactgaaatc

SEQ ID NO: 6754250 - DNA, 10 bp, Homo sapiens
ttgggaagaa

SEQ ID NO: 6754251 - DNA, 18 bp, Homo sapiens
ttgggaagaatccagtat

SEQ ID NO: 6754252 - DNA, 17 bp, Homo sapiens
ttgggaagagcttagaa

SEQ ID NO: 6754253 - DNA, 12 bp, Homo sapiens
ttgggaagcagt

SEQ ID NO: 6754254 - DNA, 19 bp, Homo sapiens
ttgggaagctatttccttt

SEQ ID NO: 6754255 - DNA, 17 bp, Homo sapiens
ttgggaaggaaatatat

SEQ ID NO: 6754256 - DNA, 15 bp, Homo sapiens
ttgggaaggacacag

SEQ ID NO: 6754257 - DNA, 22 bp, Homo sapiens
ttgggaaggacacagcagtatt

SEQ ID NO: 6754258 - DNA, 17 bp, Homo sapiens
ttgggaaggcacctgct

SEQ ID NO: 6754259 - DNA, 19 bp, Homo sapiens
ttgggaaggcacctgctcc

SEQ ID NO: 6754260 - DNA, 21 bp, Homo sapiens
ttgggaaggggtcctgcaggg

SEQ ID NO: 6754261 - DNA, 22 bp, Homo sapiens
ttgggaagttaaagggaagaaa

SEQ ID NO: 6754262 - DNA, 15 bp, Homo sapiens
ttgggaatatttgaa

SEQ ID NO: 6754263 - DNA, 23 bp, Homo sapiens
ttgggaatgaggaaaattcttaa

SEQ ID NO: 6754264 - DNA, 16 bp, Homo sapiens
ttgggaatgaggcttg

SEQ ID NO: 6754265 - DNA, 19 bp, Homo sapiens
ttgggaatgaggcttgctg

SEQ ID NO: 6754266 - DNA, 11 bp, Homo sapiens
ttgggaatgtt

SEQ ID NO: 6754267 - DNA, 14 bp, Homo sapiens
ttgggaatgtttgt

SEQ ID NO: 6754268 - DNA, 17 bp, Homo sapiens
ttgggacacctcagaaa

SEQ ID NO: 6754269 - DNA, 16 bp, Homo sapiens
ttgggacagccagagc

SEQ ID NO: 6754270 - DNA, 14 bp, Homo sapiens
ttgggaccaggcca

SEQ ID NO: 6754271 - DNA, 22 bp, Homo sapiens
ttgggacccaaaacacaggaag

SEQ ID NO: 6754272 - DNA, 20 bp, Homo sapiens
ttgggacccagtggcagggc

SEQ ID NO: 6754273 - DNA, 16 bp, Homo sapiens
ttgggacccctggtgg

SEQ ID NO: 6754274 - DNA, 22 bp, Homo sapiens
ttgggaccctgctttagagcta

SEQ ID NO: 6754275 - DNA, 22 bp, Homo sapiens
ttgggaccgccagatggggcct

SEQ ID NO: 6754276 - DNA, 22 bp, Homo sapiens
ttgggacctgcttcattcaagc

SEQ ID NO: 6754277 - DNA, 22 bp, Homo sapiens
ttgggacgtgtacagcacagaa

SEQ ID NO: 6754278 - DNA, 19 bp, Homo sapiens
ttgggactgtcttgagaaa

SEQ ID NO: 6754279 - DNA, 17 bp, Homo sapiens
ttgggagacatgtgaca

SEQ ID NO: 6754280 - DNA, 23 bp, Homo sapiens
ttgggagagacttgttttggatg

SEQ ID NO: 6754281 - DNA, 17 bp, Homo sapiens
ttgggagagcaggaatg

SEQ ID NO: 6754282 - DNA, 16 bp, Homo sapiens
ttgggagatatatttt

SEQ ID NO: 6754283 - DNA, 21 bp, Homo sapiens
ttgggagattatcagtagaaa

SEQ ID NO: 6754284 - DNA, 11 bp, Homo sapiens
ttgggagcact

SEQ ID NO: 6754285 - DNA, 15 bp, Homo sapiens
ttgggagccactgcc

SEQ ID NO: 6754286 - DNA, 11 bp, Homo sapiens
ttgggagccag

SEQ ID NO: 6754287 - DNA, 12 bp, Homo sapiens
ttgggagccagg

SEQ ID NO: 6754288 - DNA, 11 bp, Homo sapiens
ttgggagcctg

SEQ ID NO: 6754289 - DNA, 19 bp, Homo sapiens
ttgggagcctgaggcagga

SEQ ID NO: 6754290 - DNA, 13 bp, Homo sapiens
ttgggagcctgtg

SEQ ID NO: 6754291 - DNA, 20 bp, Homo sapiens
ttgggagctcatccctctca

SEQ ID NO: 6754292 - DNA, 14 bp, Homo sapiens
ttgggagctgctgg

SEQ ID NO: 6754293 - DNA, 13 bp, Homo sapiens
ttgggaggaagca

SEQ ID NO: 6754294 - DNA, 14 bp, Homo sapiens
ttgggaggaagcag

SEQ ID NO: 6754295 - DNA, 20 bp, Homo sapiens
ttgggaggaagcagaataaa

SEQ ID NO: 6754296 - DNA, 17 bp, Homo sapiens
ttgggaggccccactgg

SEQ ID NO: 6754297 - DNA, 16 bp, Homo sapiens
ttgggaggccgaggcg

SEQ ID NO: 6754298 - DNA, 16 bp, Homo sapiens
ttgggaggctgaggta

SEQ ID NO: 6754299 - DNA, 15 bp, Homo sapiens
ttgggagggacaggg

SEQ ID NO: 6754300 - DNA, 18 bp, Homo sapiens
ttgggaggtccaggcagg

SEQ ID NO: 6754301 - DNA, 19 bp, Homo sapiens
ttgggaggtgcgtgttcag

SEQ ID NO: 6754302 - DNA, 23 bp, Homo sapiens
ttgggagtatgttgtcataacat

SEQ ID NO: 6754303 - DNA, 15 bp, Homo sapiens
ttgggagtccaggca

SEQ ID NO: 6754304 - DNA, 20 bp, Homo sapiens
ttgggagtccaggcacagga

SEQ ID NO: 6754305 - DNA, 15 bp, Homo sapiens
ttgggagtgagatgc

SEQ ID NO: 6754306 - DNA, 17 bp, Homo sapiens
ttgggatattaaaacac

SEQ ID NO: 6754307 - DNA, 21 bp, Homo sapiens
ttgggatcccaccctggggac

SEQ ID NO: 6754308 - DNA, 20 bp, Homo sapiens
ttgggatccctcctccagcc

SEQ ID NO: 6754309 - DNA, 21 bp, Homo sapiens
ttgggatccttcagcacagga

SEQ ID NO: 6754310 - DNA, 22 bp, Homo sapiens
ttgggatcgcattgcatacctt

SEQ ID NO: 6754311 - DNA, 17 bp, Homo sapiens
ttgggatctaactgttg

SEQ ID NO: 6754312 - DNA, 17 bp, Homo sapiens
ttgggatctgtcttggc

SEQ ID NO: 6754313 - DNA, 22 bp, Homo sapiens
ttgggatgagaatgaaagctta

SEQ ID NO: 6754314 - DNA, 19 bp, Homo sapiens
ttgggatgtcttattttta

SEQ ID NO: 6754315 - DNA, 19 bp, Homo sapiens
ttgggatgtgagccccagg

SEQ ID NO: 6754316 - DNA, 22 bp, Homo sapiens
ttgggatgttccttttttcaat

SEQ ID NO: 6754317 - DNA, 21 bp, Homo sapiens
ttgggattgggggctggtgcc

SEQ ID NO: 6754318 - DNA, 22 bp, Homo sapiens
ttgggattgggggctggtgcca

SEQ ID NO: 6754319 - DNA, 23 bp, Homo sapiens
ttgggatttgcaaataaaggctc

SEQ ID NO: 6754320 - DNA, 13 bp, Homo sapiens
ttgggatttgctg

SEQ ID NO: 6754321 - DNA, 22 bp, Homo sapiens
ttgggcaatattctctgtacat

SEQ ID NO: 6754322 - DNA, 17 bp, Homo sapiens
ttgggcacccccagcct

SEQ ID NO: 6754323 - DNA, 19 bp, Homo sapiens
ttgggcacccccagcctgg

SEQ ID NO: 6754324 - DNA, 16 bp, Homo sapiens
ttgggcactatttatt

SEQ ID NO: 6754325 - DNA, 23 bp, Homo sapiens
ttgggcactatttatttacaaat

SEQ ID NO: 6754326 - DNA, 20 bp, Homo sapiens
ttgggcagaagggagaagga

SEQ ID NO: 6754327 - DNA, 19 bp, Homo sapiens
ttgggcagaatcctgggcc

SEQ ID NO: 6754328 - DNA, 20 bp, Homo sapiens
ttgggcagaatcctgggccc

SEQ ID NO: 6754329 - DNA, 17 bp, Homo sapiens
ttgggcagagctggaca

SEQ ID NO: 6754330 - DNA, 18 bp, Homo sapiens
ttgggcagcaatttaaat

SEQ ID NO: 6754331 - DNA, 17 bp, Homo sapiens
ttgggcagctggggggc

SEQ ID NO: 6754332 - DNA, 21 bp, Homo sapiens
ttgggcagggtctctgctcca

SEQ ID NO: 6754333 - DNA, 20 bp, Homo sapiens
ttgggcagtgccccagggag

SEQ ID NO: 6754334 - DNA, 23 bp, Homo sapiens
ttgggcagtggagaggggacttg

SEQ ID NO: 6754335 - DNA, 23 bp, Homo sapiens
ttgggcatccacccagtgctgcc

SEQ ID NO: 6754336 - DNA, 17 bp, Homo sapiens
ttgggcattagtgtccc

SEQ ID NO: 6754337 - DNA, 20 bp, Homo sapiens
ttgggccaatttactggcca

SEQ ID NO: 6754338 - DNA, 17 bp, Homo sapiens
ttgggccactgcactct

SEQ ID NO: 6754339 - DNA, 14 bp, Homo sapiens
ttgggccataatta

SEQ ID NO: 6754340 - DNA, 16 bp, Homo sapiens
ttgggccattacccca

SEQ ID NO: 6754341 - DNA, 19 bp, Homo sapiens
ttgggcccacacctccttc

SEQ ID NO: 6754342 - DNA, 22 bp, Homo sapiens
ttgggcccagctgggctctgcc

SEQ ID NO: 6754343 - DNA, 18 bp, Homo sapiens
ttgggccccagaggctgg

SEQ ID NO: 6754344 - DNA, 14 bp, Homo sapiens
ttgggccccagcct

SEQ ID NO: 6754345 - DNA, 18 bp, Homo sapiens
ttgggcccctcagagccc

SEQ ID NO: 6754346 - DNA, 16 bp, Homo sapiens
ttgggcccctgaggag

SEQ ID NO: 6754347 - DNA, 17 bp, Homo sapiens
ttgggcccctgaggagc

SEQ ID NO: 6754348 - DNA, 12 bp, Homo sapiens
ttgggccctgca

SEQ ID NO: 6754349 - DNA, 15 bp, Homo sapiens
ttgggccctgcacag

SEQ ID NO: 6754350 - DNA, 19 bp, Homo sapiens
ttgggccctgcattggcct

SEQ ID NO: 6754351 - DNA, 17 bp, Homo sapiens
ttgggcccttagaatgt

SEQ ID NO: 6754352 - DNA, 15 bp, Homo sapiens
ttgggccgaaagaga

SEQ ID NO: 6754353 - DNA, 21 bp, Homo sapiens
ttgggccgaatcccccaggga

SEQ ID NO: 6754354 - DNA, 24 bp, Homo sapiens
ttgggccggtgctgggggcacagc

SEQ ID NO: 6754355 - DNA, 14 bp, Homo sapiens
ttgggcctaaataa

SEQ ID NO: 6754356 - DNA, 15 bp, Homo sapiens
ttgggcctccatgcc

SEQ ID NO: 6754357 - DNA, 22 bp, Homo sapiens
ttgggcctccatgccccagctc

SEQ ID NO: 6754358 - DNA, 19 bp, Homo sapiens
ttgggcctcccactcccat

SEQ ID NO: 6754359 - DNA, 22 bp, Homo sapiens
ttgggcctggccagtcttcctc

SEQ ID NO: 6754360 - DNA, 18 bp, Homo sapiens
ttgggcgccgtgctgggc

SEQ ID NO: 6754361 - DNA, 16 bp, Homo sapiens
ttgggcgtctccccca

SEQ ID NO: 6754362 - DNA, 24 bp, Homo sapiens
ttgggctactggcagctcctctcc

SEQ ID NO: 6754363 - DNA, 18 bp, Homo sapiens
ttgggctccacgggcagg

SEQ ID NO: 6754364 - DNA, 19 bp, Homo sapiens
ttgggctccgctgtgcccg

SEQ ID NO: 6754365 - DNA, 20 bp, Homo sapiens
ttgggctccgctgtgcccgc

SEQ ID NO: 6754366 - DNA, 15 bp, Homo sapiens
ttgggctcctggctg

SEQ ID NO: 6754367 - DNA, 16 bp, Homo sapiens
ttgggctcctggctgc

SEQ ID NO: 6754368 - DNA, 17 bp, Homo sapiens
ttgggctcctggctgcc

SEQ ID NO: 6754369 - DNA, 13 bp, Homo sapiens
ttgggctctgatg

SEQ ID NO: 6754370 - DNA, 17 bp, Homo sapiens
ttgggctgaatgtatgt

SEQ ID NO: 6754371 - DNA, 22 bp, Homo sapiens
ttgggctgaatgtatgtaaata

SEQ ID NO: 6754372 - DNA, 14 bp, Homo sapiens
ttgggctgacccag

SEQ ID NO: 6754373 - DNA, 13 bp, Homo sapiens
ttgggctggggga

SEQ ID NO: 6754374 - DNA, 21 bp, Homo sapiens
ttgggcttagtatttctcagg

SEQ ID NO: 6754375 - DNA, 20 bp, Homo sapiens
ttgggcttatttagaaaaaa

SEQ ID NO: 6754376 - DNA, 19 bp, Homo sapiens
ttgggcttcaacagccaag

SEQ ID NO: 6754377 - DNA, 22 bp, Homo sapiens
ttgggcttcaacagccaagctg

SEQ ID NO: 6754378 - DNA, 14 bp, Homo sapiens
ttgggcttcagcct

SEQ ID NO: 6754379 - DNA, 19 bp, Homo sapiens
ttgggcttcagctgccagt

SEQ ID NO: 6754380 - DNA, 17 bp, Homo sapiens
ttgggcttgctattctg

SEQ ID NO: 6754381 - DNA, 23 bp, Homo sapiens
ttgggcttgctattctgtcccta

SEQ ID NO: 6754382 - DNA, 16 bp, Homo sapiens
ttgggcttttattttt

SEQ ID NO: 6754383 - DNA, 18 bp, Homo sapiens
ttggggaaaaaagcacat

SEQ ID NO: 6754384 - DNA, 20 bp, Homo sapiens
ttggggaaccccgagctggg

SEQ ID NO: 6754385 - DNA, 19 bp, Homo sapiens
ttggggaagaacgaagcca

SEQ ID NO: 6754386 - DNA, 22 bp, Homo sapiens
ttggggaagagagcctgcagga

SEQ ID NO: 6754387 - DNA, 19 bp, Homo sapiens
ttggggaaggggcctgggc

SEQ ID NO: 6754388 - DNA, 20 bp, Homo sapiens
ttggggaaggggcctgggct

SEQ ID NO: 6754389 - DNA, 21 bp, Homo sapiens
ttggggaaggggcctgggctg

SEQ ID NO: 6754390 - DNA, 22 bp, Homo sapiens
ttggggaaggggcctgggctgt

SEQ ID NO: 6754391 - DNA, 20 bp, Homo sapiens
ttggggaattaaatagtgtg

SEQ ID NO: 6754392 - DNA, 21 bp, Homo sapiens
ttggggacaccctcctgcccc

SEQ ID NO: 6754393 - DNA, 15 bp, Homo sapiens
ttggggaccccctca

SEQ ID NO: 6754394 - DNA, 20 bp, Homo sapiens
ttggggacctgatggagagt

SEQ ID NO: 6754395 - DNA, 23 bp, Homo sapiens
ttggggagcaggaggccaataaa

SEQ ID NO: 6754396 - DNA, 22 bp, Homo sapiens
ttggggaggagggggccgggcg

SEQ ID NO: 6754397 - DNA, 18 bp, Homo sapiens
ttggggatagtctggaaa

SEQ ID NO: 6754398 - DNA, 13 bp, Homo sapiens
ttggggattctta

SEQ ID NO: 6754399 - DNA, 19 bp, Homo sapiens
ttggggcaagactgcaaac

SEQ ID NO: 6754400 - DNA, 20 bp, Homo sapiens
ttggggcaagatccaggtgg

SEQ ID NO: 6754401 - DNA, 17 bp, Homo sapiens
ttggggcactgggcgtc

SEQ ID NO: 6754402 - DNA, 20 bp, Homo sapiens
ttggggcaggagtagctgag

SEQ ID NO: 6754403 - DNA, 12 bp, Homo sapiens
ttggggcagggg

SEQ ID NO: 6754404 - DNA, 23 bp, Homo sapiens
ttggggccaccaaagctgcccac

SEQ ID NO: 6754405 - DNA, 20 bp, Homo sapiens
ttggggccagcgcttctggt

SEQ ID NO: 6754406 - DNA, 15 bp, Homo sapiens
ttggggcccagtgca

SEQ ID NO: 6754407 - DNA, 13 bp, Homo sapiens
ttggggccctctt

SEQ ID NO: 6754408 - DNA, 15 bp, Homo sapiens
ttggggccctcttgc

SEQ ID NO: 6754409 - DNA, 19 bp, Homo sapiens
ttggggccctcttgccagc

SEQ ID NO: 6754410 - DNA, 20 bp, Homo sapiens
ttggggccctcttgccagcc

SEQ ID NO: 6754411 - DNA, 22 bp, Homo sapiens
ttggggccctcttgccagcctc

SEQ ID NO: 6754412 - DNA, 12 bp, Homo sapiens
ttggggcctggc

SEQ ID NO: 6754413 - DNA, 17 bp, Homo sapiens
ttgtagaactcactctg

SEQ ID NO: 6754414 - DNA, 20 bp, Homo sapiens
ttgtagaactcactctgggc

SEQ ID NO: 6754415 - DNA, 13 bp, Homo sapiens
ttgtagaacttta

SEQ ID NO: 6754416 - DNA, 12 bp, Homo sapiens
ttgtagaaggag

SEQ ID NO: 6754417 - DNA, 19 bp, Homo sapiens
ttgtagaataaatggtttc

SEQ ID NO: 6754418 - DNA, 14 bp, Homo sapiens
ttgtagaataataa

SEQ ID NO: 6754419 - DNA, 16 bp, Homo sapiens
ttgtagaatgtattgt

SEQ ID NO: 6754420 - DNA, 13 bp, Homo sapiens
ttgtagaattgtt

SEQ ID NO: 6754421 - DNA, 15 bp, Homo sapiens
ttgtagacacttact

SEQ ID NO: 6754422 - DNA, 17 bp, Homo sapiens
ttgtagacattttgaaa

SEQ ID NO: 6754423 - DNA, 14 bp, Homo sapiens
ttgtagactgatgt

SEQ ID NO: 6754424 - DNA, 21 bp, Homo sapiens
ttgtagactgatgttttagca

SEQ ID NO: 6754425 - DNA, 21 bp, Homo sapiens
ttgtagagaaaacatgcagaa

SEQ ID NO: 6754426 - DNA, 20 bp, Homo sapiens
ttgtagagagagctgtatta

SEQ ID NO: 6754427 - DNA, 14 bp, Homo sapiens
ttgtagatatatat

SEQ ID NO: 6754428 - DNA, 22 bp, Homo sapiens
ttgtagatatatatttccaaat

SEQ ID NO: 6754429 - DNA, 19 bp, Homo sapiens
ttgtagatgaaaaagcatg

SEQ ID NO: 6754430 - DNA, 21 bp, Homo sapiens
ttgtagatgaaaaagcatgta

SEQ ID NO: 6754431 - DNA, 19 bp, Homo sapiens
ttgtagatgaacttgagct

SEQ ID NO: 6754432 - DNA, 19 bp, Homo sapiens
ttgtagattgattgtattg

SEQ ID NO: 6754433 - DNA, 14 bp, Homo sapiens
ttgtagatttgatt

SEQ ID NO: 6754434 - DNA, 22 bp, Homo sapiens
ttgtagcactgacagatttcca

SEQ ID NO: 6754435 - DNA, 14 bp, Homo sapiens
ttgtagcactgagg

SEQ ID NO: 6754436 - DNA, 22 bp, Homo sapiens
ttgtagcagattgtttcctctt

SEQ ID NO: 6754437 - DNA, 22 bp, Homo sapiens
ttgtagcataactgtagctcaa

SEQ ID NO: 6754438 - DNA, 17 bp, Homo sapiens
ttgtagcatcctcttta

SEQ ID NO: 6754439 - DNA, 18 bp, Homo sapiens
ttgtagcatcctggaata

SEQ ID NO: 6754440 - DNA, 15 bp, Homo sapiens
ttgtagcatttggaa

SEQ ID NO: 6754441 - DNA, 19 bp, Homo sapiens
ttgtagcatttggaaatga

SEQ ID NO: 6754442 - DNA, 18 bp, Homo sapiens
ttgtagccaggtactgca

SEQ ID NO: 6754443 - DNA, 13 bp, Homo sapiens
ttgtagccctgga

SEQ ID NO: 6754444 - DNA, 14 bp, Homo sapiens
ttgtagccctggat

SEQ ID NO: 6754445 - DNA, 23 bp, Homo sapiens
ttgtagccctggatggcctctgg

SEQ ID NO: 6754446 - DNA, 20 bp, Homo sapiens
ttgtagcctaatattcatgc

SEQ ID NO: 6754447 - DNA, 16 bp, Homo sapiens
ttgtagccttcctcca

SEQ ID NO: 6754448 - DNA, 22 bp, Homo sapiens
ttgtagccttcctccacatcct

SEQ ID NO: 6754449 - DNA, 15 bp, Homo sapiens
ttgtagccttttgac

SEQ ID NO: 6754450 - DNA, 16 bp, Homo sapiens
ttgtagccttttgact

SEQ ID NO: 6754451 - DNA, 21 bp, Homo sapiens
ttgtagcggatgattcttcaa

SEQ ID NO: 6754452 - DNA, 15 bp, Homo sapiens
ttgtagctcctcccc

SEQ ID NO: 6754453 - DNA, 13 bp, Homo sapiens
ttgtagctgtaaa

SEQ ID NO: 6754454 - DNA, 16 bp, Homo sapiens
ttgtagctttcctgga

SEQ ID NO: 6754455 - DNA, 17 bp, Homo sapiens
ttgtagctttcctggaa

SEQ ID NO: 6754456 - DNA, 21 bp, Homo sapiens
ttgtaggaaggtctcattctt

SEQ ID NO: 6754457 - DNA, 13 bp, Homo sapiens
ttgtaggatactt

SEQ ID NO: 6754458 - DNA, 22 bp, Homo sapiens
ttgtaggatttttttcctcccc

SEQ ID NO: 6754459 - DNA, 15 bp, Homo sapiens
ttgtaggctgtgggg

SEQ ID NO: 6754460 - DNA, 23 bp, Homo sapiens
ttgtaggctgtggggtctggctg

SEQ ID NO: 6754461 - DNA, 21 bp, Homo sapiens
ttgtaggggaaatcaaggtga

SEQ ID NO: 6754462 - DNA, 17 bp, Homo sapiens
ttgtaggggtcaaagaa

SEQ ID NO: 6754463 - DNA, 15 bp, Homo sapiens
ttgtagggtgaggcg

SEQ ID NO: 6754464 - DNA, 13 bp, Homo sapiens
ttgtaggtaaaat

SEQ ID NO: 6754465 - DNA, 15 bp, Homo sapiens
ttgtaggtaaaatgt

SEQ ID NO: 6754466 - DNA, 18 bp, Homo sapiens
ttgtaggtacttttggaa

SEQ ID NO: 6754467 - DNA, 20 bp, Homo sapiens
ttgtaggtacttttggaatc

SEQ ID NO: 6754468 - DNA, 19 bp, Homo sapiens
ttgtaggtatgtctgtgcc

SEQ ID NO: 6754469 - DNA, 19 bp, Homo sapiens
ttgtaggtgcaagatggaa

SEQ ID NO: 6754470 - DNA, 16 bp, Homo sapiens
ttgtaggttattttat

SEQ ID NO: 6754471 - DNA, 21 bp, Homo sapiens
ttgtaggttattttatatttg

SEQ ID NO: 6754472 - DNA, 22 bp, Homo sapiens
ttgtagtaaaagtggtctctgc

SEQ ID NO: 6754473 - DNA, 17 bp, Homo sapiens
ttgtagtaaactattct

SEQ ID NO: 6754474 - DNA, 19 bp, Homo sapiens
ttgtagtaagaaacatcca

SEQ ID NO: 6754475 - DNA, 21 bp, Homo sapiens
ttgtagtagcgttttttaaat

SEQ ID NO: 6754476 - DNA, 23 bp, Homo sapiens
ttgtagtagcgttttttaaatgt

SEQ ID NO: 6754477 - DNA, 15 bp, Homo sapiens
ttgtagtcttatgaa

SEQ ID NO: 6754478 - DNA, 16 bp, Homo sapiens
ttgtagtcttatgaat

SEQ ID NO: 6754479 - DNA, 21 bp, Homo sapiens
ttgtagtcttatgaatagaca

SEQ ID NO: 6754480 - DNA, 22 bp, Homo sapiens
ttgtagtcttatgaatagacat

SEQ ID NO: 6754481 - DNA, 14 bp, Homo sapiens
ttgtagtcttgtct

SEQ ID NO: 6754482 - DNA, 17 bp, Homo sapiens
ttgtagtgcaaaatggt

SEQ ID NO: 6754483 - DNA, 23 bp, Homo sapiens
ttgtagtgttggagaagaactga

SEQ ID NO: 6754484 - DNA, 15 bp, Homo sapiens
ttgtagttaatataa

SEQ ID NO: 6754485 - DNA, 19 bp, Homo sapiens
ttgtagttacctactgagt

SEQ ID NO: 6754486 - DNA, 13 bp, Homo sapiens
ttgtagttccact

SEQ ID NO: 6754487 - DNA, 14 bp, Homo sapiens
ttgtagttcttagt

SEQ ID NO: 6754488 - DNA, 14 bp, Homo sapiens
ttgtagttgtttta

SEQ ID NO: 6754489 - DNA, 21 bp, Homo sapiens
ttgtagtttgaaagttgtaca

SEQ ID NO: 6754490 - DNA, 19 bp, Homo sapiens
ttgtagttttatttgtatt

SEQ ID NO: 6754491 - DNA, 18 bp, Homo sapiens
ttgtagtttttgctgaag

SEQ ID NO: 6754492 - DNA, 23 bp, Homo sapiens
ttgtataaaaacatgagttattc

SEQ ID NO: 6754493 - DNA, 13 bp, Homo sapiens
ttgtataaaaagg

SEQ ID NO: 6754494 - DNA, 15 bp, Homo sapiens
ttgtataaaaaggaa

SEQ ID NO: 6754495 - DNA, 20 bp, Homo sapiens
ttgtataaaaatagaagaat

SEQ ID NO: 6754496 - DNA, 17 bp, Homo sapiens
ttgtataaaacagtgtt

SEQ ID NO: 6754497 - DNA, 17 bp, Homo sapiens
ttgtataaaataatttt

SEQ ID NO: 6754498 - DNA, 19 bp, Homo sapiens
ttgtataaaataattttta

SEQ ID NO: 6754499 - DNA, 15 bp, Homo sapiens
ttgtataaaatccat

SEQ ID NO: 6754500 - DNA, 16 bp, Homo sapiens
ttgtataaactgtatt

SEQ ID NO: 6754501 - DNA, 21 bp, Homo sapiens
ttgtataaactgtattttgaa

SEQ ID NO: 6754502 - DNA, 20 bp, Homo sapiens
ttgtataaagcattactctt

SEQ ID NO: 6754503 - DNA, 21 bp, Homo sapiens
ttgtataaagcattactcttt

SEQ ID NO: 6754504 - DNA, 12 bp, Homo sapiens
ttgtataaataa

SEQ ID NO: 6754505 - DNA, 15 bp, Homo sapiens
ttgtataaattactt

SEQ ID NO: 6754506 - DNA, 14 bp, Homo sapiens
ttgtataaattttt

SEQ ID NO: 6754507 - DNA, 17 bp, Homo sapiens
ttgtataaatttttaag

SEQ ID NO: 6754508 - DNA, 13 bp, Homo sapiens
ttgtataacaggt

SEQ ID NO: 6754509 - DNA, 18 bp, Homo sapiens
ttgtataacttaaaataa

SEQ ID NO: 6754510 - DNA, 19 bp, Homo sapiens
ttgtataagtcaagcacat

SEQ ID NO: 6754511 - DNA, 15 bp, Homo sapiens
ttgtataattatgaa

SEQ ID NO: 6754512 - DNA, 21 bp, Homo sapiens
ttgtataattggatttcctaa

SEQ ID NO: 6754513 - DNA, 12 bp, Homo sapiens
ttgtataattgt

SEQ ID NO: 6754514 - DNA, 13 bp, Homo sapiens
ttgtataattgta

SEQ ID NO: 6754515 - DNA, 13 bp, Homo sapiens
ttgtatacaaata

SEQ ID NO: 6754516 - DNA, 16 bp, Homo sapiens
ttgtatacaaatatat

SEQ ID NO: 6754517 - DNA, 19 bp, Homo sapiens
ttgtatactttaaataatt

SEQ ID NO: 6754518 - DNA, 20 bp, Homo sapiens
ttgtatagcatgaaataaaa

SEQ ID NO: 6754519 - DNA, 22 bp, Homo sapiens
ttgtatagcatgaaataaaata

SEQ ID NO: 6754520 - DNA, 16 bp, Homo sapiens
ttgtatagcttttatc

SEQ ID NO: 6754521 - DNA, 17 bp, Homo sapiens
ttgtataggccatctgt

SEQ ID NO: 6754522 - DNA, 23 bp, Homo sapiens
ttgtataggccatctgtaaatat

SEQ ID NO: 6754523 - DNA, 18 bp, Homo sapiens
ttgtataggctaaatgtt

SEQ ID NO: 6754524 - DNA, 19 bp, Homo sapiens
ttgtataggtaactaggta

SEQ ID NO: 6754525 - DNA, 18 bp, Homo sapiens
ttgtataggtagatgttc

SEQ ID NO: 6754526 - DNA, 14 bp, Homo sapiens
ttgtatagtaaagt

SEQ ID NO: 6754527 - DNA, 14 bp, Homo sapiens
ttgtatagtgtaaa

SEQ ID NO: 6754528 - DNA, 16 bp, Homo sapiens
ttgtatagtgtaaaat

SEQ ID NO: 6754529 - DNA, 18 bp, Homo sapiens
ttgtatagttatatgtac

SEQ ID NO: 6754530 - DNA, 16 bp, Homo sapiens
ttgtatagttatgtaa

SEQ ID NO: 6754531 - DNA, 19 bp, Homo sapiens
ttgtatagttatgtaaata

SEQ ID NO: 6754532 - DNA, 20 bp, Homo sapiens
ttgtatagttatgtaaataa

SEQ ID NO: 6754533 - DNA, 21 bp, Homo sapiens
ttgtatagttatgtaaataat

SEQ ID NO: 6754534 - DNA, 20 bp, Homo sapiens
ttgtatagttgcttgcctga

SEQ ID NO: 6754535 - DNA, 12 bp, Homo sapiens
ttgtatatacat

SEQ ID NO: 6754536 - DNA, 15 bp, Homo sapiens
ttgtatatacatatt

SEQ ID NO: 6754537 - DNA, 18 bp, Homo sapiens
ttgtatatacatattata

SEQ ID NO: 6754538 - DNA, 18 bp, Homo sapiens
ttgtatatatatgtgaac

SEQ ID NO: 6754539 - DNA, 19 bp, Homo sapiens
ttgtatatatatgtgaact

SEQ ID NO: 6754540 - DNA, 19 bp, Homo sapiens
ttgtatatatctgcttcag

SEQ ID NO: 6754541 - DNA, 14 bp, Homo sapiens
ttgtatatatgtgt

SEQ ID NO: 6754542 - DNA, 19 bp, Homo sapiens
ttgtatatattattataat

SEQ ID NO: 6754543 - DNA, 17 bp, Homo sapiens
ttgtatatcactaaaag

SEQ ID NO: 6754544 - DNA, 19 bp, Homo sapiens
ttgtatatcactaaaagca

SEQ ID NO: 6754545 - DNA, 15 bp, Homo sapiens
ttgtatatcatgaaa

SEQ ID NO: 6754546 - DNA, 14 bp, Homo sapiens
ttgtatatgaaaac

SEQ ID NO: 6754547 - DNA, 14 bp, Homo sapiens
ttgtatatgctgca

SEQ ID NO: 6754548 - DNA, 20 bp, Homo sapiens
ttgtatattatgtttatttc

SEQ ID NO: 6754549 - DNA, 16 bp, Homo sapiens
ttgtatattatttcta

SEQ ID NO: 6754550 - DNA, 22 bp, Homo sapiens
ttgtatattccaccattcacat

SEQ ID NO: 6754551 - DNA, 19 bp, Homo sapiens
ttgtatattgggtgtagat

SEQ ID NO: 6754552 - DNA, 18 bp, Homo sapiens
ttgtatattgtaggaatc

SEQ ID NO: 6754553 - DNA, 17 bp, Homo sapiens
ttgtatattgtatttat

SEQ ID NO: 6754554 - DNA, 19 bp, Homo sapiens
ttgtatattgtcagatatt

SEQ ID NO: 6754555 - DNA, 13 bp, Homo sapiens
ttgtatattgtgt

SEQ ID NO: 6754556 - DNA, 15 bp, Homo sapiens
ttgtatatttgcaaa

SEQ ID NO: 6754557 - DNA, 14 bp, Homo sapiens
ttgtatcaaatgtt

SEQ ID NO: 6754558 - DNA, 18 bp, Homo sapiens
ttgtatcaaattattttt

SEQ ID NO: 6754559 - DNA, 21 bp, Homo sapiens
ttgtatcagaatcttgtccaa

SEQ ID NO: 6754560 - DNA, 15 bp, Homo sapiens
ttgtatcgtatagct

SEQ ID NO: 6754561 - DNA, 22 bp, Homo sapiens
ttgtatctaaagtcttcctatt

SEQ ID NO: 6754562 - DNA, 16 bp, Homo sapiens
ttgtatctacagtaat

SEQ ID NO: 6754563 - DNA, 18 bp, Homo sapiens
ttgtatctacattaaaat

SEQ ID NO: 6754564 - DNA, 14 bp, Homo sapiens
ttgtatctcttaaa

SEQ ID NO: 6754565 - DNA, 13 bp, Homo sapiens
ttgtatctctttt

SEQ ID NO: 6754566 - DNA, 17 bp, Homo sapiens
ttgtatctgaactcaca

SEQ ID NO: 6754567 - DNA, 14 bp, Homo sapiens
ttgtatctgtcttt

SEQ ID NO: 6754568 - DNA, 16 bp, Homo sapiens
ttgtatctgtctttcc

SEQ ID NO: 6754569 - DNA, 14 bp, Homo sapiens
ttgtatcttaaatc

SEQ ID NO: 6754570 - DNA, 13 bp, Homo sapiens
ttgtatcttcctt

SEQ ID NO: 6754571 - DNA, 17 bp, Homo sapiens
ttgtatcttcctttctt

SEQ ID NO: 6754572 - DNA, 22 bp, Homo sapiens
ttgtatcttggggcaagactgc

SEQ ID NO: 6754573 - DNA, 19 bp, Homo sapiens
ttgtatctttatgctgtat

SEQ ID NO: 6754574 - DNA, 22 bp, Homo sapiens
ttgtatcttttatcctgggagc

SEQ ID NO: 6754575 - DNA, 12 bp, Homo sapiens
ttgtatgaaaat

SEQ ID NO: 6754576 - DNA, 15 bp, Homo sapiens
ttgtatgaagtactt

SEQ ID NO: 6754577 - DNA, 19 bp, Homo sapiens
ttgtatgaagtacttttaa

SEQ ID NO: 6754578 - DNA, 19 bp, Homo sapiens
ttgtatgaggtcctcaggt

SEQ ID NO: 6754579 - DNA, 13 bp, Homo sapiens
ttgtatgatctgt

SEQ ID NO: 6754580 - DNA, 14 bp, Homo sapiens
ttgtatgatgtgtt

SEQ ID NO: 6754581 - DNA, 24 bp, Homo sapiens
ttgtatgcaagcagtttcaataaa

SEQ ID NO: 6754582 - DNA, 15 bp, Homo sapiens
ttgtatgcaatggat

SEQ ID NO: 6754583 - DNA, 15 bp, Homo sapiens
ttgtatgcagggagc

SEQ ID NO: 6754584 - DNA, 16 bp, Homo sapiens
ttgtatgtaaatacca

SEQ ID NO: 6754585 - DNA, 15 bp, Homo sapiens
ttgtatgtatctatt

SEQ ID NO: 6754586 - DNA, 12 bp, Homo sapiens
ttgtatgtatgt

SEQ ID NO: 6754587 - DNA, 13 bp, Homo sapiens
ttgtatgtatgtg

SEQ ID NO: 6754588 - DNA, 11 bp, Homo sapiens
ttgtatgtgaa

SEQ ID NO: 6754589 - DNA, 19 bp, Homo sapiens
ttgtatgtgtgtagactgt

SEQ ID NO: 6754590 - DNA, 20 bp, Homo sapiens
ttgtatgttaatagaaaata

SEQ ID NO: 6754591 - DNA, 14 bp, Homo sapiens
ttgtcttacaactg

SEQ ID NO: 6754592 - DNA, 16 bp, Homo sapiens
ttgtcttacaactgac

SEQ ID NO: 6754593 - DNA, 23 bp, Homo sapiens
ttgtcttagcatggtacctgctg

SEQ ID NO: 6754594 - DNA, 16 bp, Homo sapiens
ttgtcttagctctgga

SEQ ID NO: 6754595 - DNA, 21 bp, Homo sapiens
ttgtcttatgtgaaaaattaa

SEQ ID NO: 6754596 - DNA, 15 bp, Homo sapiens
ttgtcttattgacag

SEQ ID NO: 6754597 - DNA, 13 bp, Homo sapiens
ttgtcttattgca

SEQ ID NO: 6754598 - DNA, 15 bp, Homo sapiens
ttgtcttcacttaat

SEQ ID NO: 6754599 - DNA, 23 bp, Homo sapiens
ttgtcttcagcagtcaatacaaa

SEQ ID NO: 6754600 - DNA, 11 bp, Homo sapiens
ttgtcttccaa

SEQ ID NO: 6754601 - DNA, 11 bp, Homo sapiens
ttgtcttcccc

SEQ ID NO: 6754602 - DNA, 17 bp, Homo sapiens
ttgtcttcccccctctc

SEQ ID NO: 6754603 - DNA, 19 bp, Homo sapiens
ttgtcttcctatttcagaa

SEQ ID NO: 6754604 - DNA, 23 bp, Homo sapiens
ttgtcttcctatttcagaagttt

SEQ ID NO: 6754605 - DNA, 15 bp, Homo sapiens
ttgtcttctccccag

SEQ ID NO: 6754606 - DNA, 17 bp, Homo sapiens
ttgtcttgatcctcact

SEQ ID NO: 6754607 - DNA, 15 bp, Homo sapiens
ttgtcttgcattttt

SEQ ID NO: 6754608 - DNA, 20 bp, Homo sapiens
ttgtcttggaaccaccagtc

SEQ ID NO: 6754609 - DNA, 22 bp, Homo sapiens
ttgtcttggcttcccaccagct

SEQ ID NO: 6754610 - DNA, 17 bp, Homo sapiens
ttgtcttgtacttctgt

SEQ ID NO: 6754611 - DNA, 18 bp, Homo sapiens
ttgtcttgtacttctgtg

SEQ ID NO: 6754612 - DNA, 22 bp, Homo sapiens
ttgtcttgtacttctgtgttca

SEQ ID NO: 6754613 - DNA, 18 bp, Homo sapiens
ttgtcttgttatgtacaa

SEQ ID NO: 6754614 - DNA, 20 bp, Homo sapiens
ttgtcttgttatgtacaaac

SEQ ID NO: 6754615 - DNA, 14 bp, Homo sapiens
ttgtctttaaacag

SEQ ID NO: 6754616 - DNA, 14 bp, Homo sapiens
ttgtctttatatga

SEQ ID NO: 6754617 - DNA, 16 bp, Homo sapiens
ttgtctttatatgaac

SEQ ID NO: 6754618 - DNA, 19 bp, Homo sapiens
ttgtctttatatgaacata

SEQ ID NO: 6754619 - DNA, 21 bp, Homo sapiens
ttgtctttatttttatcccag

SEQ ID NO: 6754620 - DNA, 19 bp, Homo sapiens
ttgtctttcaatgcagttt

SEQ ID NO: 6754621 - DNA, 12 bp, Homo sapiens
ttgtctttcctc

SEQ ID NO: 6754622 - DNA, 16 bp, Homo sapiens
ttgtctttctttgctg

SEQ ID NO: 6754623 - DNA, 17 bp, Homo sapiens
ttgtctttctttgctgc

SEQ ID NO: 6754624 - DNA, 14 bp, Homo sapiens
ttgtctttgtaata

SEQ ID NO: 6754625 - DNA, 23 bp, Homo sapiens
ttgtctttgtaatgtcaccacct

SEQ ID NO: 6754626 - DNA, 20 bp, Homo sapiens
ttgtctttgttcttctacca

SEQ ID NO: 6754627 - DNA, 21 bp, Homo sapiens
ttgtcttttaatccatttcag

SEQ ID NO: 6754628 - DNA, 15 bp, Homo sapiens
ttgtcttttcccctc

SEQ ID NO: 6754629 - DNA, 15 bp, Homo sapiens
ttgtctttttccttt

SEQ ID NO: 6754630 - DNA, 18 bp, Homo sapiens
ttgtctttttctagactt

SEQ ID NO: 6754631 - DNA, 22 bp, Homo sapiens
ttgtctttttgtataaatgaca

SEQ ID NO: 6754632 - DNA, 22 bp, Homo sapiens
ttgtctttttttattactagtg

SEQ ID NO: 6754633 - DNA, 17 bp, Homo sapiens
ttgtcttttttttcatc

SEQ ID NO: 6754634 - DNA, 16 bp, Homo sapiens
ttgtcttttttttcct

SEQ ID NO: 6754635 - DNA, 20 bp, Homo sapiens
ttgtcttttttttcctttga

SEQ ID NO: 6754636 - DNA, 18 bp, Homo sapiens
ttgtgaaacacagctgtt

SEQ ID NO: 6754637 - DNA, 19 bp, Homo sapiens
ttgtgaaacagacttgtat

SEQ ID NO: 6754638 - DNA, 15 bp, Homo sapiens
ttgtgaaaccacagg

SEQ ID NO: 6754639 - DNA, 21 bp, Homo sapiens
ttgtgaaactaaaattttcta

SEQ ID NO: 6754640 - DNA, 22 bp, Homo sapiens
ttgtgaaactaaaattttctaa

SEQ ID NO: 6754641 - DNA, 22 bp, Homo sapiens
ttgtgaaagaaagctgagaaga

SEQ ID NO: 6754642 - DNA, 20 bp, Homo sapiens
ttgtgaaagctccatgttta

SEQ ID NO: 6754643 - DNA, 21 bp, Homo sapiens
ttgtgaaagtgccaaaataaa

SEQ ID NO: 6754644 - DNA, 19 bp, Homo sapiens
ttgtgaaagtggcaagctc

SEQ ID NO: 6754645 - DNA, 17 bp, Homo sapiens
ttgtgaaagtgtaatgt

SEQ ID NO: 6754646 - DNA, 20 bp, Homo sapiens
ttgtgaaagttttgagtaga

SEQ ID NO: 6754647 - DNA, 21 bp, Homo sapiens
ttgtgaaataaaactggcttt

SEQ ID NO: 6754648 - DNA, 21 bp, Homo sapiens
ttgtgaaataatttttaactt

SEQ ID NO: 6754649 - DNA, 17 bp, Homo sapiens
ttgtgaaatgaaaacat

SEQ ID NO: 6754650 - DNA, 19 bp, Homo sapiens
ttgtgaaatgtctgttcca

SEQ ID NO: 6754651 - DNA, 12 bp, Homo sapiens
ttgtgaaattgt

SEQ ID NO: 6754652 - DNA, 11 bp, Homo sapiens
ttgtgaaattt

SEQ ID NO: 6754653 - DNA, 18 bp, Homo sapiens
ttgtgaaatttcatgaaa

SEQ ID NO: 6754654 - DNA, 14 bp, Homo sapiens
ttgtgaaatttttc

SEQ ID NO: 6754655 - DNA, 23 bp, Homo sapiens
ttgtgaaatttttcatattttaa

SEQ ID NO: 6754656 - DNA, 14 bp, Homo sapiens
ttgtgaacactttt

SEQ ID NO: 6754657 - DNA, 20 bp, Homo sapiens
ttgtgaacagaagtccttaa

SEQ ID NO: 6754658 - DNA, 12 bp, Homo sapiens
ttgtgaacatca

SEQ ID NO: 6754659 - DNA, 12 bp, Homo sapiens
ttgtgaacatga

SEQ ID NO: 6754660 - DNA, 14 bp, Homo sapiens
ttgtgaacatgcct

SEQ ID NO: 6754661 - DNA, 17 bp, Homo sapiens
ttgtgaacatgccttat

SEQ ID NO: 6754662 - DNA, 18 bp, Homo sapiens
ttgtgaaccaactgcctt

SEQ ID NO: 6754663 - DNA, 19 bp, Homo sapiens
ttgtgaaccaactgcctta

SEQ ID NO: 6754664 - DNA, 23 bp, Homo sapiens
ttgtgaactatatcagtagtgta

SEQ ID NO: 6754665 - DNA, 19 bp, Homo sapiens
ttgtgaactcagccaagca

SEQ ID NO: 6754666 - DNA, 18 bp, Homo sapiens
ttgtgaactggaagaaag

SEQ ID NO: 6754667 - DNA, 21 bp, Homo sapiens
ttgtgaagaaacatttatctt

SEQ ID NO: 6754668 - DNA, 18 bp, Homo sapiens
ttgtgaagcaaaattttt

SEQ ID NO: 6754669 - DNA, 14 bp, Homo sapiens
ttgtgaagccctgt

SEQ ID NO: 6754670 - DNA, 14 bp, Homo sapiens
ttgtgaagctaatg

SEQ ID NO: 6754671 - DNA, 20 bp, Homo sapiens
ttgtgaagctaatgaccaac

SEQ ID NO: 6754672 - DNA, 17 bp, Homo sapiens
ttgtgaagctaatgtca

SEQ ID NO: 6754673 - DNA, 16 bp, Homo sapiens
ttgtgaataatgattt

SEQ ID NO: 6754674 - DNA, 15 bp, Homo sapiens
ttgtgaataattaca

SEQ ID NO: 6754675 - DNA, 15 bp, Homo sapiens
ttgtgaatacattct

SEQ ID NO: 6754676 - DNA, 23 bp, Homo sapiens
ttgtgaatatgtacataggcagc

SEQ ID NO: 6754677 - DNA, 20 bp, Homo sapiens
ttgtgaatattgtggctccc

SEQ ID NO: 6754678 - DNA, 22 bp, Homo sapiens
ttgtgaatattgtggctccctg

SEQ ID NO: 6754679 - DNA, 20 bp, Homo sapiens
ttgtgaatcaagggtcaggc

SEQ ID NO: 6754680 - DNA, 21 bp, Homo sapiens
ttgtgaatcaagggtcaggcc

SEQ ID NO: 6754681 - DNA, 17 bp, Homo sapiens
ttgtgaatcttaacatt

SEQ ID NO: 6754682 - DNA, 18 bp, Homo sapiens
ttgtgaatggtgtctttc

SEQ ID NO: 6754683 - DNA, 22 bp, Homo sapiens
ttgtgaatggttgcaaagtgtt

SEQ ID NO: 6754684 - DNA, 21 bp, Homo sapiens
ttgtgaatgtttagtgtgctg

SEQ ID NO: 6754685 - DNA, 23 bp, Homo sapiens
ttgtgaattaggctgtaactact

SEQ ID NO: 6754686 - DNA, 16 bp, Homo sapiens
ttgtgaattgcctgcc

SEQ ID NO: 6754687 - DNA, 23 bp, Homo sapiens
ttgtgaattgcctgccatggctg

SEQ ID NO: 6754688 - DNA, 16 bp, Homo sapiens
ttgtgacaaaaaatta

SEQ ID NO: 6754689 - DNA, 19 bp, Homo sapiens
ttgtgacagattatacaga

SEQ ID NO: 6754690 - DNA, 21 bp, Homo sapiens
ttgtgacaggaaagccctccc

SEQ ID NO: 6754691 - DNA, 23 bp, Homo sapiens
ttgtgacaggaaagccctccccc

SEQ ID NO: 6754692 - DNA, 12 bp, Homo sapiens
ttgtgacagtgc

SEQ ID NO: 6754693 - DNA, 21 bp, Homo sapiens
ttgtgacagtgcctcttccag

SEQ ID NO: 6754694 - DNA, 14 bp, Homo sapiens
ttgtgacattaaaa

SEQ ID NO: 6754695 - DNA, 15 bp, Homo sapiens
ttgtgacattcactc

SEQ ID NO: 6754696 - DNA, 15 bp, Homo sapiens
ttgtgacattcgtga

SEQ ID NO: 6754697 - DNA, 17 bp, Homo sapiens
ttgtgaccaatacattt

SEQ ID NO: 6754698 - DNA, 17 bp, Homo sapiens
ttgtgacccaattaagt

SEQ ID NO: 6754699 - DNA, 16 bp, Homo sapiens
ttgtgaccttagtgtt

SEQ ID NO: 6754700 - DNA, 19 bp, Homo sapiens
ttgtgaccttagtgtttct

SEQ ID NO: 6754701 - DNA, 20 bp, Homo sapiens
ttgtgaccttagtgtttctg

SEQ ID NO: 6754702 - DNA, 17 bp, Homo sapiens
ttgtgacgattatttat

SEQ ID NO: 6754703 - DNA, 16 bp, Homo sapiens
ttgtgactaagttgca

SEQ ID NO: 6754704 - DNA, 23 bp, Homo sapiens
ttgtgactaattgtataacaggt

SEQ ID NO: 6754705 - DNA, 13 bp, Homo sapiens
ttgtgactagtgc

SEQ ID NO: 6754706 - DNA, 17 bp, Homo sapiens
ttgtgactagtgctgaa

SEQ ID NO: 6754707 - DNA, 21 bp, Homo sapiens
ttgtgactattaaatgttgca

SEQ ID NO: 6754708 - DNA, 22 bp, Homo sapiens
ttgtgactctaggcttcaggtt

SEQ ID NO: 6754709 - DNA, 23 bp, Homo sapiens
ttgtgactgtatataaaggaaaa

SEQ ID NO: 6754710 - DNA, 23 bp, Homo sapiens
ttgtgacttacaatttgcacaat

SEQ ID NO: 6754711 - DNA, 14 bp, Homo sapiens
ttgtgacttcactg

SEQ ID NO: 6754712 - DNA, 19 bp, Homo sapiens
ttgtgacttcttcttcttt

SEQ ID NO: 6754713 - DNA, 19 bp, Homo sapiens
ttgtgagaatggcctggag

SEQ ID NO: 6754714 - DNA, 20 bp, Homo sapiens
ttgtgagaatggcctggagc

SEQ ID NO: 6754715 - DNA, 21 bp, Homo sapiens
ttgtgagaatggcctggagca

SEQ ID NO: 6754716 - DNA, 22 bp, Homo sapiens
ttgtgagacggctggaaattct

SEQ ID NO: 6754717 - DNA, 14 bp, Homo sapiens
ttgtgagagacttt

SEQ ID NO: 6754718 - DNA, 21 bp, Homo sapiens
ttgtgagatcctgtgattcct

SEQ ID NO: 6754719 - DNA, 14 bp, Homo sapiens
ttgtgagatgattt

SEQ ID NO: 6754720 - DNA, 16 bp, Homo sapiens
ttgtgagcactctact

SEQ ID NO: 6754721 - DNA, 16 bp, Homo sapiens
ttgtgagccaaagaga

SEQ ID NO: 6754722 - DNA, 12 bp, Homo sapiens
ttgtgagccctc

SEQ ID NO: 6754723 - DNA, 17 bp, Homo sapiens
ttgtgagcctctttgta

SEQ ID NO: 6754724 - DNA, 17 bp, Homo sapiens
ttgtgagccttgctgcc

SEQ ID NO: 6754725 - DNA, 12 bp, Homo sapiens
ttgtgagctgga

SEQ ID NO: 6754726 - DNA, 17 bp, Homo sapiens
ttgtgaggaaagtcatt

SEQ ID NO: 6754727 - DNA, 20 bp, Homo sapiens
ttgtgaggcccatggttgag

SEQ ID NO: 6754728 - DNA, 20 bp, Homo sapiens
ttgtgaggtttaacattaaa

SEQ ID NO: 6754729 - DNA, 16 bp, Homo sapiens
ttgtgagtatgtgtgg

SEQ ID NO: 6754730 - DNA, 15 bp, Homo sapiens
ttgtgagttaatttg

SEQ ID NO: 6754731 - DNA, 22 bp, Homo sapiens
ttgtgagtttagtaaggctgtg

SEQ ID NO: 6754732 - DNA, 14 bp, Homo sapiens
ttgtgagttttcta

SEQ ID NO: 6754733 - DNA, 18 bp, Homo sapiens
ttgtgatacaatgctgtg

SEQ ID NO: 6754734 - DNA, 21 bp, Homo sapiens
ttgtgatacagagtatatttc

SEQ ID NO: 6754735 - DNA, 18 bp, Homo sapiens
ttgtgatattaaatttca

SEQ ID NO: 6754736 - DNA, 21 bp, Homo sapiens
ttgtgatattgaccatgtgat

SEQ ID NO: 6754737 - DNA, 13 bp, Homo sapiens
ttgtgatcctaaa

SEQ ID NO: 6754738 - DNA, 20 bp, Homo sapiens
ttgtgatgaacatattcatg

SEQ ID NO: 6754739 - DNA, 21 bp, Homo sapiens
ttgtgatgaatcaatgaaaaa

SEQ ID NO: 6754740 - DNA, 17 bp, Homo sapiens
ttgtgatgatgctgtga

SEQ ID NO: 6754741 - DNA, 19 bp, Homo sapiens
ttgtgatgatgctgtgaca

SEQ ID NO: 6754742 - DNA, 17 bp, Homo sapiens
ttgtgatggagtgctgt

SEQ ID NO: 6754743 - DNA, 19 bp, Homo sapiens
ttgtgatgtaaggcactgt

SEQ ID NO: 6754744 - DNA, 20 bp, Homo sapiens
ttgtgatgtatattcctttg

SEQ ID NO: 6754745 - DNA, 20 bp, Homo sapiens
ttgtgatgtcatacagagaa

SEQ ID NO: 6754746 - DNA, 21 bp, Homo sapiens
ttgtgatgtcatacagagaag

SEQ ID NO: 6754747 - DNA, 18 bp, Homo sapiens
ttgtgattagacagaaca

SEQ ID NO: 6754748 - DNA, 22 bp, Homo sapiens
ttgtgattatttcactttagat

SEQ ID NO: 6754749 - DNA, 16 bp, Homo sapiens
ttgtgattctgtttat

SEQ ID NO: 6754750 - DNA, 11 bp, Homo sapiens
ttgtgatttga

SEQ ID NO: 6754751 - DNA, 22 bp, Homo sapiens
ttgtgatttgactgtttttacc

SEQ ID NO: 6754752 - DNA, 16 bp, Homo sapiens
ttgtgatttggttgca

SEQ ID NO: 6754753 - DNA, 15 bp, Homo sapiens
ttgtgattttgtaca

SEQ ID NO: 6754754 - DNA, 17 bp, Homo sapiens
ttgtgattttgtacaga

SEQ ID NO: 6754755 - DNA, 14 bp, Homo sapiens
ttgtgcaaaagcag

SEQ ID NO: 6754756 - DNA, 19 bp, Homo sapiens
ttgtgcaaaatgtgtttca

SEQ ID NO: 6754757 - DNA, 16 bp, Homo sapiens
ttgtgcaaacataata

SEQ ID NO: 6754758 - DNA, 22 bp, Homo sapiens
ttgtgcaaacatggagaaatct

SEQ ID NO: 6754759 - DNA, 17 bp, Homo sapiens
ttgtgcaatgtaaatat

SEQ ID NO: 6754760 - DNA, 23 bp, Homo sapiens
ttgtgcaatgtaaatattttaaa

SEQ ID NO: 6754761 - DNA, 20 bp, Homo sapiens
ttgtgcaatgtgtataaaca

SEQ ID NO: 6754762 - DNA, 18 bp, Homo sapiens
ttgtgcacatttaataat

SEQ ID NO: 6754763 - DNA, 14 bp, Homo sapiens
ttgtgcacatttct

SEQ ID NO: 6754764 - DNA, 19 bp, Homo sapiens
ttgtgcaccctctatccca

SEQ ID NO: 6754765 - DNA, 15 bp, Homo sapiens
ttgtgcagaatctct

SEQ ID NO: 6754766 - DNA, 13 bp, Homo sapiens
ttgtgcagggtgt

SEQ ID NO: 6754767 - DNA, 12 bp, Homo sapiens
ttgttgcactgc

SEQ ID NO: 6754768 - DNA, 14 bp, Homo sapiens
ttgttgcactgccc

SEQ ID NO: 6754769 - DNA, 14 bp, Homo sapiens
ttgttgcagtgatt

SEQ ID NO: 6754770 - DNA, 21 bp, Homo sapiens
ttgttgcatccctcaattgaa

SEQ ID NO: 6754771 - DNA, 12 bp, Homo sapiens
ttgttgcattcc

SEQ ID NO: 6754772 - DNA, 12 bp, Homo sapiens
ttgttgccaact

SEQ ID NO: 6754773 - DNA, 21 bp, Homo sapiens
ttgttgccaggttgcagctgc

SEQ ID NO: 6754774 - DNA, 20 bp, Homo sapiens
ttgttgccccattcctaaga

SEQ ID NO: 6754775 - DNA, 20 bp, Homo sapiens
ttgttgctcagcaaggggct

SEQ ID NO: 6754776 - DNA, 16 bp, Homo sapiens
ttgttgctgctgtttg

SEQ ID NO: 6754777 - DNA, 14 bp, Homo sapiens
ttgttgctgctttg

SEQ ID NO: 6754778 - DNA, 18 bp, Homo sapiens
ttgttgcttcttgtgaag

SEQ ID NO: 6754779 - DNA, 12 bp, Homo sapiens
ttgttgctttgt

SEQ ID NO: 6754780 - DNA, 18 bp, Homo sapiens
ttgttggagatgcagcct

SEQ ID NO: 6754781 - DNA, 15 bp, Homo sapiens
ttgttggagcctgca

SEQ ID NO: 6754782 - DNA, 15 bp, Homo sapiens
ttgttggagtattta

SEQ ID NO: 6754783 - DNA, 18 bp, Homo sapiens
ttgttggcctccggcctc

SEQ ID NO: 6754784 - DNA, 21 bp, Homo sapiens
ttgttggcctccggcctcccc

SEQ ID NO: 6754785 - DNA, 19 bp, Homo sapiens
ttgttggctatttgaaata

SEQ ID NO: 6754786 - DNA, 22 bp, Homo sapiens
ttgttgggattcctgacccagg

SEQ ID NO: 6754787 - DNA, 17 bp, Homo sapiens
ttgttggtacctttcta

SEQ ID NO: 6754788 - DNA, 22 bp, Homo sapiens
ttgttggtacctttctagcctt

SEQ ID NO: 6754789 - DNA, 15 bp, Homo sapiens
ttgttggtgcacagc

SEQ ID NO: 6754790 - DNA, 19 bp, Homo sapiens
ttgttggttgattgtttaa

SEQ ID NO: 6754791 - DNA, 20 bp, Homo sapiens
ttgttggttgattgtttaag

SEQ ID NO: 6754792 - DNA, 20 bp, Homo sapiens
ttgttggtttttaaagattt

SEQ ID NO: 6754793 - DNA, 13 bp, Homo sapiens
ttgttgtaaaaag

SEQ ID NO: 6754794 - DNA, 16 bp, Homo sapiens
ttgttgtaaaaagaaa

SEQ ID NO: 6754795 - DNA, 17 bp, Homo sapiens
ttgttgtaaaaagaaaa

SEQ ID NO: 6754796 - DNA, 21 bp, Homo sapiens
ttgttgtaaagcaataaaatt

SEQ ID NO: 6754797 - DNA, 18 bp, Homo sapiens
ttgttgtaacctgctgtg

SEQ ID NO: 6754798 - DNA, 13 bp, Homo sapiens
ttgttgtaattgc

SEQ ID NO: 6754799 - DNA, 14 bp, Homo sapiens
ttgttgtacttaaa

SEQ ID NO: 6754800 - DNA, 15 bp, Homo sapiens
ttgttgtcaagtata

SEQ ID NO: 6754801 - DNA, 19 bp, Homo sapiens
ttgttgtcaagtataaagt

SEQ ID NO: 6754802 - DNA, 16 bp, Homo sapiens
ttgttgtcattgtcca

SEQ ID NO: 6754803 - DNA, 14 bp, Homo sapiens
ttgttgtcctccca

SEQ ID NO: 6754804 - DNA, 20 bp, Homo sapiens
ttgttgtctatttgtctctt

SEQ ID NO: 6754805 - DNA, 15 bp, Homo sapiens
ttgttgtctgcaact

SEQ ID NO: 6754806 - DNA, 19 bp, Homo sapiens
ttgttgtgactttgacgct

SEQ ID NO: 6754807 - DNA, 21 bp, Homo sapiens
ttgttgtgagaatggcctgga

SEQ ID NO: 6754808 - DNA, 16 bp, Homo sapiens
ttgttgtgatgtcttt

SEQ ID NO: 6754809 - DNA, 14 bp, Homo sapiens
ttgttgtgtgcctc

SEQ ID NO: 6754810 - DNA, 14 bp, Homo sapiens
ttgttgtgtgtata

SEQ ID NO: 6754811 - DNA, 13 bp, Homo sapiens
ttgttgttcctct

SEQ ID NO: 6754812 - DNA, 15 bp, Homo sapiens
ttgttgttctgttaa

SEQ ID NO: 6754813 - DNA, 14 bp, Homo sapiens
ttgttgttgctgct

SEQ ID NO: 6754814 - DNA, 14 bp, Homo sapiens
ttgttgttgtttta

SEQ ID NO: 6754815 - DNA, 21 bp, Homo sapiens
ttgttgtttcttaatttggaa

SEQ ID NO: 6754816 - DNA, 15 bp, Homo sapiens
ttgttgtttcttgcc

SEQ ID NO: 6754817 - DNA, 21 bp, Homo sapiens
ttgttgtttgccatactttgt

SEQ ID NO: 6754818 - DNA, 23 bp, Homo sapiens
ttgttgttttacatcttttggga

SEQ ID NO: 6754819 - DNA, 14 bp, Homo sapiens
ttgttgttttccat

SEQ ID NO: 6754820 - DNA, 17 bp, Homo sapiens
ttgtttaaaaaaagaaa

SEQ ID NO: 6754821 - DNA, 18 bp, Homo sapiens
ttgtttaaaaaaagaaaa

SEQ ID NO: 6754822 - DNA, 21 bp, Homo sapiens
ttgtttaaaaaccgaataaat

SEQ ID NO: 6754823 - DNA, 19 bp, Homo sapiens
ttgtttaaaaatacacatg

SEQ ID NO: 6754824 - DNA, 13 bp, Homo sapiens
ttgtttaaaagca

SEQ ID NO: 6754825 - DNA, 19 bp, Homo sapiens
ttgtttaaaataaaagtac

SEQ ID NO: 6754826 - DNA, 18 bp, Homo sapiens
ttgtttaaaattcagttt

SEQ ID NO: 6754827 - DNA, 14 bp, Homo sapiens
ttgtttaaaattct

SEQ ID NO: 6754828 - DNA, 16 bp, Homo sapiens
ttgtttaaacccaagt

SEQ ID NO: 6754829 - DNA, 20 bp, Homo sapiens
ttgtttaaagaagctctcca

SEQ ID NO: 6754830 - DNA, 16 bp, Homo sapiens
ttgtttaaagaataaa

SEQ ID NO: 6754831 - DNA, 13 bp, Homo sapiens
ttgtttaaagcat

SEQ ID NO: 6754832 - DNA, 20 bp, Homo sapiens
ttgtttaaatataaatgttt

SEQ ID NO: 6754833 - DNA, 14 bp, Homo sapiens
ttgtttaagaatca

SEQ ID NO: 6754834 - DNA, 17 bp, Homo sapiens
ttgtttaatgtgaactt

SEQ ID NO: 6754835 - DNA, 13 bp, Homo sapiens
ttgtttaattgta

SEQ ID NO: 6754836 - DNA, 12 bp, Homo sapiens
ttgtttacaaac

SEQ ID NO: 6754837 - DNA, 12 bp, Homo sapiens
ttgtttacaata

SEQ ID NO: 6754838 - DNA, 23 bp, Homo sapiens
ttgtttacatgcttattccatga

SEQ ID NO: 6754839 - DNA, 21 bp, Homo sapiens
ttgtttactctcttcatccgt

SEQ ID NO: 6754840 - DNA, 16 bp, Homo sapiens
ttgtttacttaaagat

SEQ ID NO: 6754841 - DNA, 23 bp, Homo sapiens
ttgtttacttaaagatttatcaa

SEQ ID NO: 6754842 - DNA, 19 bp, Homo sapiens
ttgtttagaaacagaaata

SEQ ID NO: 6754843 - DNA, 20 bp, Homo sapiens
ttgtttagaaacagaaatag

SEQ ID NO: 6754844 - DNA, 21 bp, Homo sapiens
ttgtttagaaagaatattcat

SEQ ID NO: 6754845 - DNA, 15 bp, Homo sapiens
ttgtttagaagaagt

SEQ ID NO: 6754846 - DNA, 18 bp, Homo sapiens
ttgtttagaagaagtgtg

SEQ ID NO: 6754847 - DNA, 13 bp, Homo sapiens
ttgtttagagaat

SEQ ID NO: 6754848 - DNA, 14 bp, Homo sapiens
ttgtttagagccct

SEQ ID NO: 6754849 - DNA, 19 bp, Homo sapiens
ttgtttagattttgtgttt

SEQ ID NO: 6754850 - DNA, 11 bp, Homo sapiens
ttgtttagttt

SEQ ID NO: 6754851 - DNA, 18 bp, Homo sapiens
ttgtttatatcactgtct

SEQ ID NO: 6754852 - DNA, 19 bp, Homo sapiens
ttgtttatcagatacatca

SEQ ID NO: 6754853 - DNA, 21 bp, Homo sapiens
ttgtttatcagatacatcact

SEQ ID NO: 6754854 - DNA, 13 bp, Homo sapiens
ttgtttatcagca

SEQ ID NO: 6754855 - DNA, 17 bp, Homo sapiens
ttgtttatccttaagaa

SEQ ID NO: 6754856 - DNA, 20 bp, Homo sapiens
ttgtttatgtaaatgtttgt

SEQ ID NO: 6754857 - DNA, 20 bp, Homo sapiens
ttgtttatgtgttatgaaca

SEQ ID NO: 6754858 - DNA, 12 bp, Homo sapiens
ttgtttattcca

SEQ ID NO: 6754859 - DNA, 19 bp, Homo sapiens
ttgtttattgagtttgtag

SEQ ID NO: 6754860 - DNA, 20 bp, Homo sapiens
ttgtttatttatcagtgaca

SEQ ID NO: 6754861 - DNA, 15 bp, Homo sapiens
ttgtttatttgcaat

SEQ ID NO: 6754862 - DNA, 17 bp, Homo sapiens
ttgtttcaaacagcatc

SEQ ID NO: 6754863 - DNA, 20 bp, Homo sapiens
ttgtttcaagaacctggaaa

SEQ ID NO: 6754864 - DNA, 20 bp, Homo sapiens
ttgtttcagggctgtggcct

SEQ ID NO: 6754865 - DNA, 11 bp, Homo sapiens
ttgtttcagtg

SEQ ID NO: 6754866 - DNA, 20 bp, Homo sapiens
ttgtttcattgactatcaaa

SEQ ID NO: 6754867 - DNA, 16 bp, Homo sapiens
ttgtttccaacttgtc

SEQ ID NO: 6754868 - DNA, 12 bp, Homo sapiens
ttgtttccctgc

SEQ ID NO: 6754869 - DNA, 19 bp, Homo sapiens
ttgtttccctgctggccaa

SEQ ID NO: 6754870 - DNA, 23 bp, Homo sapiens
ttgtttcctcccctatctgtatt

SEQ ID NO: 6754871 - DNA, 14 bp, Homo sapiens
ttgtttcctgtgcc

SEQ ID NO: 6754872 - DNA, 17 bp, Homo sapiens
ttgtttccttttttccc

SEQ ID NO: 6754873 - DNA, 15 bp, Homo sapiens
ttgtttcgctctttg

SEQ ID NO: 6754874 - DNA, 14 bp, Homo sapiens
ttgtttctacctcc

SEQ ID NO: 6754875 - DNA, 15 bp, Homo sapiens
ttgtttctatacaaa

SEQ ID NO: 6754876 - DNA, 23 bp, Homo sapiens
ttgtttctcaaatcttggcaata

SEQ ID NO: 6754877 - DNA, 14 bp, Homo sapiens
ttgtttctccccca

SEQ ID NO: 6754878 - DNA, 17 bp, Homo sapiens
ttgtttctccccctggg

SEQ ID NO: 6754879 - DNA, 21 bp, Homo sapiens
ttgtttctcggcaccagtgcc

SEQ ID NO: 6754880 - DNA, 13 bp, Homo sapiens
ttgtttctctgag

SEQ ID NO: 6754881 - DNA, 17 bp, Homo sapiens
ttgtttctggtgactgc

SEQ ID NO: 6754882 - DNA, 13 bp, Homo sapiens
ttgtttctgtcaa

SEQ ID NO: 6754883 - DNA, 19 bp, Homo sapiens
ttgtttctgtcaagcatat

SEQ ID NO: 6754884 - DNA, 15 bp, Homo sapiens
ttgtttctgtgcccc

SEQ ID NO: 6754885 - DNA, 14 bp, Homo sapiens
ttgtttctgtgggc

SEQ ID NO: 6754886 - DNA, 15 bp, Homo sapiens
ttgtttctgttccaa

SEQ ID NO: 6754887 - DNA, 17 bp, Homo sapiens
ttgtttctgttccaaat

SEQ ID NO: 6754888 - DNA, 14 bp, Homo sapiens
ttgtttctgtttag

SEQ ID NO: 6754889 - DNA, 14 bp, Homo sapiens
ttgtttcttaaata

SEQ ID NO: 6754890 - DNA, 12 bp, Homo sapiens
ttgtttcttaag

SEQ ID NO: 6754891 - DNA, 17 bp, Homo sapiens
ttgtttcttaatttgga

SEQ ID NO: 6754892 - DNA, 15 bp, Homo sapiens
ttgtttcttatagat

SEQ ID NO: 6754893 - DNA, 15 bp, Homo sapiens
ttgtttcttccaaag

SEQ ID NO: 6754894 - DNA, 18 bp, Homo sapiens
ttgtttcttgtttattga

SEQ ID NO: 6754895 - DNA, 19 bp, Homo sapiens
ttgtttctttctctgagga

SEQ ID NO: 6754896 - DNA, 20 bp, Homo sapiens
ttgtttctttgaattttcat

SEQ ID NO: 6754897 - DNA, 15 bp, Homo sapiens
ttgtttgaatatttg

SEQ ID NO: 6754898 - DNA, 17 bp, Homo sapiens
ttgtttgagacagggtc

SEQ ID NO: 6754899 - DNA, 23 bp, Homo sapiens
ttgtttgatgcattaaaagaaaa

SEQ ID NO: 6754900 - DNA, 17 bp, Homo sapiens
ttgtttgattcagcaaa

SEQ ID NO: 6754901 - DNA, 13 bp, Homo sapiens
ttgtttgcacaga

SEQ ID NO: 6754902 - DNA, 12 bp, Homo sapiens
ttgtttgcactg

SEQ ID NO: 6754903 - DNA, 13 bp, Homo sapiens
ttgtttgcactgt

SEQ ID NO: 6754904 - DNA, 15 bp, Homo sapiens
ttgtttgcactgtgt

SEQ ID NO: 6754905 - DNA, 13 bp, Homo sapiens
ttgtttgccagga

SEQ ID NO: 6754906 - DNA, 15 bp, Homo sapiens
ttgtttgccatactt

SEQ ID NO: 6754907 - DNA, 16 bp, Homo sapiens
ttgtttgccatacttt

SEQ ID NO: 6754908 - DNA, 19 bp, Homo sapiens
ttgtttgctgaaatttacc

SEQ ID NO: 6754909 - DNA, 21 bp, Homo sapiens
ttgtttggacctgcatattta

SEQ ID NO: 6754910 - DNA, 20 bp, Homo sapiens
ttgtttggagggatcatttt

SEQ ID NO: 6754911 - DNA, 16 bp, Homo sapiens
ttgtttgggccactgc

SEQ ID NO: 6754912 - DNA, 21 bp, Homo sapiens
ttgtttgggtatcctgcccag

SEQ ID NO: 6754913 - DNA, 19 bp, Homo sapiens
ttgtttggtattgtattta

SEQ ID NO: 6754914 - DNA, 20 bp, Homo sapiens
ttgtttgtaaaagagctgtt

SEQ ID NO: 6754915 - DNA, 22 bp, Homo sapiens
ttgtttgtaaaagagctgttct

SEQ ID NO: 6754916 - DNA, 22 bp, Homo sapiens
ttgtttgtaaataagagatttg

SEQ ID NO: 6754917 - DNA, 22 bp, Homo sapiens
ttgtttgtaaatgcctcttaaa

SEQ ID NO: 6754918 - DNA, 21 bp, Homo sapiens
ttgtttgtacagtaatatgtt

SEQ ID NO: 6754919 - DNA, 14 bp, Homo sapiens
ttgtttgtattgta

SEQ ID NO: 6754920 - DNA, 14 bp, Homo sapiens
ttgtttgtcagcat

SEQ ID NO: 6754921 - DNA, 18 bp, Homo sapiens
ttgtttgtctctcctttt

SEQ ID NO: 6754922 - DNA, 12 bp, Homo sapiens
ttgtttgtctgt

SEQ ID NO: 6754923 - DNA, 14 bp, Homo sapiens
ttgtttgtgtgaaa

SEQ ID NO: 6754924 - DNA, 14 bp, Homo sapiens
ttgtttgttcacac

SEQ ID NO: 6754925 - DNA, 10 bp, Homo sapiens
ttgtttgttt

SEQ ID NO: 6754926 - DNA, 14 bp, Homo sapiens
ttgtttgtttagtc

SEQ ID NO: 6754927 - DNA, 13 bp, Homo sapiens
ttgtttgtttctt

SEQ ID NO: 6754928 - DNA, 12 bp, Homo sapiens
ttgtttgttttg

SEQ ID NO: 6754929 - DNA, 15 bp, Homo sapiens
ttgtttgtttttgct

SEQ ID NO: 6754930 - DNA, 14 bp, Homo sapiens
ttgttttaaaatgc

SEQ ID NO: 6754931 - DNA, 22 bp, Homo sapiens
ttgttttaaccagtacttctaa

SEQ ID NO: 6754932 - DNA, 14 bp, Homo sapiens
ttgttttaatctga

SEQ ID NO: 6754933 - DNA, 13 bp, Homo sapiens
ttgttttacaata

SEQ ID NO: 6754934 - DNA, 15 bp, Homo sapiens
ttgttttactgtctt

SEQ ID NO: 6754935 - DNA, 14 bp, Homo sapiens
ttgttttagcatta

SEQ ID NO: 6754936 - DNA, 16 bp, Homo sapiens
ttgttttataaatgga

SEQ ID NO: 6754937 - DNA, 17 bp, Homo sapiens
ttgttttatagaggttc

SEQ ID NO: 6754938 - DNA, 19 bp, Homo sapiens
ttgttttatcatgacatgt

SEQ ID NO: 6754939 - DNA, 16 bp, Homo sapiens
ttgttttatcttttaa

SEQ ID NO: 6754940 - DNA, 14 bp, Homo sapiens
ttgttttcattatc

SEQ ID NO: 6754941 - DNA, 17 bp, Homo sapiens
ttgttttcccgccaagc

SEQ ID NO: 6754942 - DNA, 14 bp, Homo sapiens
ttgttttcgatgag

SEQ ID NO: 6754943 - DNA, 15 bp, Homo sapiens
ttgttttcggcagcc

SEQ ID NO: 6754944 - DNA, 16 bp, Homo sapiens
ttgttttctgactaat

SEQ ID NO: 6754945 - DNA, 14 bp, Homo sapiens
ttgttttgaaaata

SEQ ID NO: 6754946 - DNA, 15 bp, Homo sapiens
ttgttttgaaaataa

SEQ ID NO: 6754947 - DNA, 15 bp, Homo sapiens
ttgttttgaaagttt

SEQ ID NO: 6754948 - DNA, 18 bp, Homo sapiens
tttaacctgttttgttaa

SEQ ID NO: 6754949 - DNA, 16 bp, Homo sapiens
tttaaccttgtataaa

SEQ ID NO: 6754950 - DNA, 13 bp, Homo sapiens
tttaacgctgcct

SEQ ID NO: 6754951 - DNA, 15 bp, Homo sapiens
tttaacggactgctt

SEQ ID NO: 6754952 - DNA, 14 bp, Homo sapiens
tttaacggcagtgt

SEQ ID NO: 6754953 - DNA, 23 bp, Homo sapiens
tttaactaatatttgtctgtgtg

SEQ ID NO: 6754954 - DNA, 18 bp, Homo sapiens
tttaactatcttctctat

SEQ ID NO: 6754955 - DNA, 16 bp, Homo sapiens
tttaactatgaactga

SEQ ID NO: 6754956 - DNA, 20 bp, Homo sapiens
tttaactatgaactgaaggc

SEQ ID NO: 6754957 - DNA, 11 bp, Homo sapiens
tttaactatgc

SEQ ID NO: 6754958 - DNA, 21 bp, Homo sapiens
tttaactcagatcactactgc

SEQ ID NO: 6754959 - DNA, 20 bp, Homo sapiens
tttaactccctttttacact

SEQ ID NO: 6754960 - DNA, 21 bp, Homo sapiens
tttaactccctttttacactt

SEQ ID NO: 6754961 - DNA, 18 bp, Homo sapiens
tttaactcctcaattcca

SEQ ID NO: 6754962 - DNA, 23 bp, Homo sapiens
tttaactcgagaccttttcaact

SEQ ID NO: 6754963 - DNA, 21 bp, Homo sapiens
tttaactctttgaaactgtat

SEQ ID NO: 6754964 - DNA, 18 bp, Homo sapiens
tttaactgaaaatgtaaa

SEQ ID NO: 6754965 - DNA, 23 bp, Homo sapiens
tttaactgactattcttgatgta

SEQ ID NO: 6754966 - DNA, 14 bp, Homo sapiens
tttaactgattaaa

SEQ ID NO: 6754967 - DNA, 21 bp, Homo sapiens
tttaactgattcttatgatta

SEQ ID NO: 6754968 - DNA, 14 bp, Homo sapiens
tttaactgccttgt

SEQ ID NO: 6754969 - DNA, 13 bp, Homo sapiens
tttaactgctgca

SEQ ID NO: 6754970 - DNA, 17 bp, Homo sapiens
tttaactggcatgtcat

SEQ ID NO: 6754971 - DNA, 15 bp, Homo sapiens
tttaactggtgaaga

SEQ ID NO: 6754972 - DNA, 19 bp, Homo sapiens
tttaactggtgcactttgt

SEQ ID NO: 6754973 - DNA, 16 bp, Homo sapiens
tttaactgtgcagtga

SEQ ID NO: 6754974 - DNA, 16 bp, Homo sapiens
tttaactgtgcatgtg

SEQ ID NO: 6754975 - DNA, 12 bp, Homo sapiens
tttaactgtgga

SEQ ID NO: 6754976 - DNA, 17 bp, Homo sapiens
tttaactgtggatattg

SEQ ID NO: 6754977 - DNA, 16 bp, Homo sapiens
tttaacttaaatttta

SEQ ID NO: 6754978 - DNA, 21 bp, Homo sapiens
tttaacttaatcaattaattt

SEQ ID NO: 6754979 - DNA, 15 bp, Homo sapiens
tttaacttaatggca

SEQ ID NO: 6754980 - DNA, 20 bp, Homo sapiens
tttaacttagttttgcatag

SEQ ID NO: 6754981 - DNA, 17 bp, Homo sapiens
tttaacttatttatatg

SEQ ID NO: 6754982 - DNA, 17 bp, Homo sapiens
tttaacttccactgtta

SEQ ID NO: 6754983 - DNA, 18 bp, Homo sapiens
tttaacttccactttgta

SEQ ID NO: 6754984 - DNA, 13 bp, Homo sapiens
tttaacttctgcc

SEQ ID NO: 6754985 - DNA, 14 bp, Homo sapiens
tttaacttctttct

SEQ ID NO: 6754986 - DNA, 12 bp, Homo sapiens
tttaacttgaaa

SEQ ID NO: 6754987 - DNA, 22 bp, Homo sapiens
tttaacttgaaaagattgcaaa

SEQ ID NO: 6754988 - DNA, 12 bp, Homo sapiens
tttaacttgagc

SEQ ID NO: 6754989 - DNA, 14 bp, Homo sapiens
tttaactttaagtt

SEQ ID NO: 6754990 - DNA, 18 bp, Homo sapiens
tttaactttaagtttcag

SEQ ID NO: 6754991 - DNA, 19 bp, Homo sapiens
tttaactttaccaaatgaa

SEQ ID NO: 6754992 - DNA, 21 bp, Homo sapiens
tttaactttgttttattttca

SEQ ID NO: 6754993 - DNA, 10 bp, Homo sapiens
tttaactttt

SEQ ID NO: 6754994 - DNA, 15 bp, Homo sapiens
tttaacttttctacc

SEQ ID NO: 6754995 - DNA, 22 bp, Homo sapiens
tttaacttttgaaaagaccaag

SEQ ID NO: 6754996 - DNA, 13 bp, Homo sapiens
tttaactttttat

SEQ ID NO: 6754997 - DNA, 23 bp, Homo sapiens
tttaactttttgtttttatttct

SEQ ID NO: 6754998 - DNA, 16 bp, Homo sapiens
tttaacttttttttat

SEQ ID NO: 6754999 - DNA, 12 bp, Homo sapiens
tttaagaaaaaa

SEQ ID NO: 6755000 - DNA, 18 bp, Homo sapiens
tttaagaaaaaataacac

SEQ ID NO: 6755001 - DNA, 19 bp, Homo sapiens
tttaagaaaaacatgtcat

SEQ ID NO: 6755002 - DNA, 20 bp, Homo sapiens
tttaagaaaacaccatggag

SEQ ID NO: 6755003 - DNA, 15 bp, Homo sapiens
tttaagaaaagcact

SEQ ID NO: 6755004 - DNA, 23 bp, Homo sapiens
tttaagaaaagcacttttgttat

SEQ ID NO: 6755005 - DNA, 15 bp, Homo sapiens
tttaagaaaagtatt

SEQ ID NO: 6755006 - DNA, 22 bp, Homo sapiens
tttaagaaaagtattttgaagt

SEQ ID NO: 6755007 - DNA, 12 bp, Homo sapiens
tttaagaaagaa

SEQ ID NO: 6755008 - DNA, 17 bp, Homo sapiens
tttaagaaaggaagcaa

SEQ ID NO: 6755009 - DNA, 17 bp, Homo sapiens
tttaagaaatgagaaat

SEQ ID NO: 6755010 - DNA, 23 bp, Homo sapiens
tttaagaaccttattttgataaa

SEQ ID NO: 6755011 - DNA, 16 bp, Homo sapiens
tttaagaagaaagatt

SEQ ID NO: 6755012 - DNA, 21 bp, Homo sapiens
tttaagaatatctgtaatggt

SEQ ID NO: 6755013 - DNA, 13 bp, Homo sapiens
tttaagaatcaca

SEQ ID NO: 6755014 - DNA, 16 bp, Homo sapiens
tttaagaatcatggat

SEQ ID NO: 6755015 - DNA, 17 bp, Homo sapiens
tttaagaatcatggatt

SEQ ID NO: 6755016 - DNA, 18 bp, Homo sapiens
tttaagaatcatggattt

SEQ ID NO: 6755017 - DNA, 15 bp, Homo sapiens
tttaagaatgacagg

SEQ ID NO: 6755018 - DNA, 20 bp, Homo sapiens
tttaagaatggtctcagtgt

SEQ ID NO: 6755019 - DNA, 15 bp, Homo sapiens
tttaagaattgagta

SEQ ID NO: 6755020 - DNA, 11 bp, Homo sapiens
tttaagaattt

SEQ ID NO: 6755021 - DNA, 21 bp, Homo sapiens
tttaagaatttaccagaaata

SEQ ID NO: 6755022 - DNA, 12 bp, Homo sapiens
tttaagacataa

SEQ ID NO: 6755023 - DNA, 13 bp, Homo sapiens
tttaagacataaa

SEQ ID NO: 6755024 - DNA, 20 bp, Homo sapiens
tttaagacataaacaaagac

SEQ ID NO: 6755025 - DNA, 19 bp, Homo sapiens
tttaagacatttttggaag

SEQ ID NO: 6755026 - DNA, 22 bp, Homo sapiens
tttaagactgataattttacaa

SEQ ID NO: 6755027 - DNA, 20 bp, Homo sapiens
tttaagacttaatctttgct

SEQ ID NO: 6755028 - DNA, 16 bp, Homo sapiens
tttaagactttggtta

SEQ ID NO: 6755029 - DNA, 17 bp, Homo sapiens
tttaagagacagtttcg

SEQ ID NO: 6755030 - DNA, 13 bp, Homo sapiens
tttaagagagaaa

SEQ ID NO: 6755031 - DNA, 15 bp, Homo sapiens
tttaagagattttat

SEQ ID NO: 6755032 - DNA, 20 bp, Homo sapiens
tttaagaggctttggcccaa

SEQ ID NO: 6755033 - DNA, 17 bp, Homo sapiens
tttaagatagaacacaa

SEQ ID NO: 6755034 - DNA, 17 bp, Homo sapiens
tttaagatccagaaata

SEQ ID NO: 6755035 - DNA, 14 bp, Homo sapiens
tttaagatgacact

SEQ ID NO: 6755036 - DNA, 19 bp, Homo sapiens
tttaagatgacacttttaa

SEQ ID NO: 6755037 - DNA, 13 bp, Homo sapiens
tttaagattccca

SEQ ID NO: 6755038 - DNA, 18 bp, Homo sapiens
tttaagattccttttctt

SEQ ID NO: 6755039 - DNA, 21 bp, Homo sapiens
tttaagattgtaattcagaaa

SEQ ID NO: 6755040 - DNA, 16 bp, Homo sapiens
tttaagatttctctaa

SEQ ID NO: 6755041 - DNA, 12 bp, Homo sapiens
tttaagcaaata

SEQ ID NO: 6755042 - DNA, 16 bp, Homo sapiens
tttaagcaaatgcatt

SEQ ID NO: 6755043 - DNA, 18 bp, Homo sapiens
tttaagcaacacttggaa

SEQ ID NO: 6755044 - DNA, 15 bp, Homo sapiens
tttaagcaacatctt

SEQ ID NO: 6755045 - DNA, 17 bp, Homo sapiens
tttaagcaacatctttt

SEQ ID NO: 6755046 - DNA, 14 bp, Homo sapiens
tttaagcaatgctt

SEQ ID NO: 6755047 - DNA, 15 bp, Homo sapiens
tttaagcactcttaa

SEQ ID NO: 6755048 - DNA, 17 bp, Homo sapiens
tttaagcagaattggaa

SEQ ID NO: 6755049 - DNA, 17 bp, Homo sapiens
tttaagcagactcagct

SEQ ID NO: 6755050 - DNA, 17 bp, Homo sapiens
tttaagcagctctaaaa

SEQ ID NO: 6755051 - DNA, 18 bp, Homo sapiens
tttaagcataatctgaaa

SEQ ID NO: 6755052 - DNA, 23 bp, Homo sapiens
tttaagcattactcttgtaagat

SEQ ID NO: 6755053 - DNA, 16 bp, Homo sapiens
tttaagcattcttaga

SEQ ID NO: 6755054 - DNA, 14 bp, Homo sapiens
tttaagcattgttt

SEQ ID NO: 6755055 - DNA, 23 bp, Homo sapiens
tttaagcattgtttgcttattgt

SEQ ID NO: 6755056 - DNA, 12 bp, Homo sapiens
tttaagccaaaa

SEQ ID NO: 6755057 - DNA, 18 bp, Homo sapiens
tttaagccaaaacaatgt

SEQ ID NO: 6755058 - DNA, 13 bp, Homo sapiens
tttaagccaagag

SEQ ID NO: 6755059 - DNA, 17 bp, Homo sapiens
tttaagccaataaataa

SEQ ID NO: 6755060 - DNA, 21 bp, Homo sapiens
tttaagccatctcagattctg

SEQ ID NO: 6755061 - DNA, 15 bp, Homo sapiens
tttaagccctgctct

SEQ ID NO: 6755062 - DNA, 21 bp, Homo sapiens
tttaagcctaaagattttgat

SEQ ID NO: 6755063 - DNA, 15 bp, Homo sapiens
tttaagccttacaaa

SEQ ID NO: 6755064 - DNA, 22 bp, Homo sapiens
tttaagccttataaaccaatct

SEQ ID NO: 6755065 - DNA, 20 bp, Homo sapiens
tttaagccttgacacactgt

SEQ ID NO: 6755066 - DNA, 16 bp, Homo sapiens
tttaagcctttgaagt

SEQ ID NO: 6755067 - DNA, 20 bp, Homo sapiens
tttaagcctttgaagtgcct

SEQ ID NO: 6755068 - DNA, 12 bp, Homo sapiens
tttaagcctttt

SEQ ID NO: 6755069 - DNA, 16 bp, Homo sapiens
tttaagctaaaatgtt

SEQ ID NO: 6755070 - DNA, 17 bp, Homo sapiens
tttaagctaaaatgtta

SEQ ID NO: 6755071 - DNA, 16 bp, Homo sapiens
tttaagctatcagcaa

SEQ ID NO: 6755072 - DNA, 13 bp, Homo sapiens
tttaagctctgag

SEQ ID NO: 6755073 - DNA, 17 bp, Homo sapiens
tttaagctctgagctgt

SEQ ID NO: 6755074 - DNA, 18 bp, Homo sapiens
tttaagctctgagctgtc

SEQ ID NO: 6755075 - DNA, 14 bp, Homo sapiens
tttaagctctgccc

SEQ ID NO: 6755076 - DNA, 13 bp, Homo sapiens
tttaagctgtaaa

SEQ ID NO: 6755077 - DNA, 22 bp, Homo sapiens
tttaagctgtggtcaaggctac

SEQ ID NO: 6755078 - DNA, 13 bp, Homo sapiens
tttaagctgtttc

SEQ ID NO: 6755079 - DNA, 18 bp, Homo sapiens
tttaagctgtttccatag

SEQ ID NO: 6755080 - DNA, 23 bp, Homo sapiens
tttaaggaaaaaagatttttaaa

SEQ ID NO: 6755081 - DNA, 15 bp, Homo sapiens
tttaaggaaactaga

SEQ ID NO: 6755082 - DNA, 22 bp, Homo sapiens
tttaaggaacttctgaagattt

SEQ ID NO: 6755083 - DNA, 18 bp, Homo sapiens
tttaaggaatcaaatctt

SEQ ID NO: 6755084 - DNA, 11 bp, Homo sapiens
tttaaggactc

SEQ ID NO: 6755085 - DNA, 18 bp, Homo sapiens
tttaaggactgactgagg

SEQ ID NO: 6755086 - DNA, 20 bp, Homo sapiens
tttaaggagatgtaagagct

SEQ ID NO: 6755087 - DNA, 21 bp, Homo sapiens
tttaaggagggacaagaatca

SEQ ID NO: 6755088 - DNA, 19 bp, Homo sapiens
tttaaggatgcttgtacat

SEQ ID NO: 6755089 - DNA, 13 bp, Homo sapiens
tttaaggatggat

SEQ ID NO: 6755090 - DNA, 17 bp, Homo sapiens
tttaaggatggatggca

SEQ ID NO: 6755091 - DNA, 18 bp, Homo sapiens
tttaaggattctgcagaa

SEQ ID NO: 6755092 - DNA, 18 bp, Homo sapiens
tttaaggctaaaacttaa

SEQ ID NO: 6755093 - DNA, 17 bp, Homo sapiens
tttaaggctgaggctgc

SEQ ID NO: 6755094 - DNA, 16 bp, Homo sapiens
tttaaggcttcaattt

SEQ ID NO: 6755095 - DNA, 20 bp, Homo sapiens
tttaagggccctttttcaat

SEQ ID NO: 6755096 - DNA, 16 bp, Homo sapiens
tttaagggttgtgagc

SEQ ID NO: 6755097 - DNA, 22 bp, Homo sapiens
tttaagggtttgtggaaaatga

SEQ ID NO: 6755098 - DNA, 12 bp, Homo sapiens
tttaaggtgcta

SEQ ID NO: 6755099 - DNA, 20 bp, Homo sapiens
tttaaggttatttatttaaa

SEQ ID NO: 6755100 - DNA, 16 bp, Homo sapiens
tttaaggtttcaacaa

SEQ ID NO: 6755101 - DNA, 21 bp, Homo sapiens
tttaagtaacttaaggacctt

SEQ ID NO: 6755102 - DNA, 15 bp, Homo sapiens
tttaagtaagacttt

SEQ ID NO: 6755103 - DNA, 23 bp, Homo sapiens
tttaagtaatgtggaagaaaatg

SEQ ID NO: 6755104 - DNA, 14 bp, Homo sapiens
tttaagtaattgcc

SEQ ID NO: 6755105 - DNA, 18 bp, Homo sapiens
tttaagtaattgcctaca

SEQ ID NO: 6755106 - DNA, 22 bp, Homo sapiens
tttaagtactatctttgtctaa

SEQ ID NO: 6755107 - DNA, 22 bp, Homo sapiens
tttaagtagtgggcatttcata

SEQ ID NO: 6755108 - DNA, 23 bp, Homo sapiens
tttaagtatacaggaggatgtga

SEQ ID NO: 6755109 - DNA, 13 bp, Homo sapiens
tttaagtatatag

SEQ ID NO: 6755110 - DNA, 17 bp, Homo sapiens
tttaagtatcttgtgct

SEQ ID NO: 6755111 - DNA, 21 bp, Homo sapiens
tttaagtatggaatattcatt

SEQ ID NO: 6755112 - DNA, 15 bp, Homo sapiens
tttaagtattaactt

SEQ ID NO: 6755113 - DNA, 13 bp, Homo sapiens
tttaagtatttag

SEQ ID NO: 6755114 - DNA, 18 bp, Homo sapiens
tttaagtatttaggtttt

SEQ ID NO: 6755115 - DNA, 21 bp, Homo sapiens
tttaagtcaacactatatatt

SEQ ID NO: 6755116 - DNA, 19 bp, Homo sapiens
tttaagtcattttcatgtg

SEQ ID NO: 6755117 - DNA, 16 bp, Homo sapiens
tttaagtcatttttta

SEQ ID NO: 6755118 - DNA, 10 bp, Homo sapiens
tttaagtcct

SEQ ID NO: 6755119 - DNA, 20 bp, Homo sapiens
tttaagtcgggaaattctgc

SEQ ID NO: 6755120 - DNA, 15 bp, Homo sapiens
tttaagtctctcgta

SEQ ID NO: 6755121 - DNA, 13 bp, Homo sapiens
tttaagtctctga

SEQ ID NO: 6755122 - DNA, 19 bp, Homo sapiens
tttaagtgaaagtgaggaa

SEQ ID NO: 6755123 - DNA, 15 bp, Homo sapiens
tttaagtgacacaga

SEQ ID NO: 6755124 - DNA, 20 bp, Homo sapiens
tttaagtgacacagacattt

SEQ ID NO: 6755125 - DNA, 12 bp, Homo sapiens
tttaagtgacat

SEQ ID NO: 6755126 - DNA, 14 bp, Homo sapiens
tttaagtgagtcct

SEQ ID NO: 6755127 - DNA, 17 bp, Homo sapiens
tttactgtcagattaaa

SEQ ID NO: 6755128 - DNA, 13 bp, Homo sapiens
tttactgtgaaaa

SEQ ID NO: 6755129 - DNA, 15 bp, Homo sapiens
tttactgtgatgttt

SEQ ID NO: 6755130 - DNA, 15 bp, Homo sapiens
tttactgtgctaatg

SEQ ID NO: 6755131 - DNA, 18 bp, Homo sapiens
tttactgtggctgtctgg

SEQ ID NO: 6755132 - DNA, 21 bp, Homo sapiens
tttactgtgtatctcaataaa

SEQ ID NO: 6755133 - DNA, 14 bp, Homo sapiens
tttactgttagaat

SEQ ID NO: 6755134 - DNA, 15 bp, Homo sapiens
tttactgttgaactt

SEQ ID NO: 6755135 - DNA, 16 bp, Homo sapiens
tttactgttgaactta

SEQ ID NO: 6755136 - DNA, 22 bp, Homo sapiens
tttactgtttgatataccaaat

SEQ ID NO: 6755137 - DNA, 20 bp, Homo sapiens
tttactgttttgaaatcaat

SEQ ID NO: 6755138 - DNA, 20 bp, Homo sapiens
tttacttaaagatttatcaa

SEQ ID NO: 6755139 - DNA, 17 bp, Homo sapiens
tttacttatatatttga

SEQ ID NO: 6755140 - DNA, 21 bp, Homo sapiens
tttacttatctctcaaaacaa

SEQ ID NO: 6755141 - DNA, 22 bp, Homo sapiens
tttacttatctctcaaaacaat

SEQ ID NO: 6755142 - DNA, 17 bp, Homo sapiens
tttacttatcttatgcc

SEQ ID NO: 6755143 - DNA, 13 bp, Homo sapiens
tttacttcctttc

SEQ ID NO: 6755144 - DNA, 22 bp, Homo sapiens
tttacttcttatacatttgata

SEQ ID NO: 6755145 - DNA, 16 bp, Homo sapiens
tttacttctttggaat

SEQ ID NO: 6755146 - DNA, 20 bp, Homo sapiens
tttacttgatcattctcagt

SEQ ID NO: 6755147 - DNA, 14 bp, Homo sapiens
tttacttgtagaaa

SEQ ID NO: 6755148 - DNA, 15 bp, Homo sapiens
tttacttgtagaaat

SEQ ID NO: 6755149 - DNA, 15 bp, Homo sapiens
tttacttgtctttga

SEQ ID NO: 6755150 - DNA, 17 bp, Homo sapiens
tttacttgtggtgtgac

SEQ ID NO: 6755151 - DNA, 15 bp, Homo sapiens
tttacttgttttgga

SEQ ID NO: 6755152 - DNA, 14 bp, Homo sapiens
tttactttaaacta

SEQ ID NO: 6755153 - DNA, 18 bp, Homo sapiens
tttactttaaacttgtct

SEQ ID NO: 6755154 - DNA, 12 bp, Homo sapiens
tttactttgaac

SEQ ID NO: 6755155 - DNA, 17 bp, Homo sapiens
tttactttgcatttctt

SEQ ID NO: 6755156 - DNA, 14 bp, Homo sapiens
tttactttgtgcaa

SEQ ID NO: 6755157 - DNA, 20 bp, Homo sapiens
tttactttgtgcaatatgag

SEQ ID NO: 6755158 - DNA, 15 bp, Homo sapiens
tttactttgtgttca

SEQ ID NO: 6755159 - DNA, 16 bp, Homo sapiens
tttactttgtttttat

SEQ ID NO: 6755160 - DNA, 15 bp, Homo sapiens
tttacttttaaacag

SEQ ID NO: 6755161 - DNA, 16 bp, Homo sapiens
tttacttttaactatt

SEQ ID NO: 6755162 - DNA, 13 bp, Homo sapiens
tttacttttcaca

SEQ ID NO: 6755163 - DNA, 22 bp, Homo sapiens
tttacttttctgccaaaataaa

SEQ ID NO: 6755164 - DNA, 15 bp, Homo sapiens
tttactttttaaaca

SEQ ID NO: 6755165 - DNA, 17 bp, Homo sapiens
tttactttttatttcta

SEQ ID NO: 6755166 - DNA, 23 bp, Homo sapiens
tttactttttggaaaagaataaa

SEQ ID NO: 6755167 - DNA, 14 bp, Homo sapiens
tttacttttttaaa

SEQ ID NO: 6755168 - DNA, 21 bp, Homo sapiens
tttactttttttctgatgttt

SEQ ID NO: 6755169 - DNA, 22 bp, Homo sapiens
tttactttttttttattttatt

SEQ ID NO: 6755170 - DNA, 19 bp, Homo sapiens
tttacttttttttttttct

SEQ ID NO: 6755171 - DNA, 18 bp, Homo sapiens
tttagaaaaaaacatgaa

SEQ ID NO: 6755172 - DNA, 23 bp, Homo sapiens
tttagaaaaaagtttacaacata

SEQ ID NO: 6755173 - DNA, 22 bp, Homo sapiens
tttagaaaaagaacatgcagtt

SEQ ID NO: 6755174 - DNA, 12 bp, Homo sapiens
tttagaaaacat

SEQ ID NO: 6755175 - DNA, 18 bp, Homo sapiens
tttagaaaacccaagttt

SEQ ID NO: 6755176 - DNA, 14 bp, Homo sapiens
tttagaaaacttta

SEQ ID NO: 6755177 - DNA, 16 bp, Homo sapiens
tttagaaaatgtttgg

SEQ ID NO: 6755178 - DNA, 18 bp, Homo sapiens
tttagaaaatttactaat

SEQ ID NO: 6755179 - DNA, 16 bp, Homo sapiens
tttagaaacagaaata

SEQ ID NO: 6755180 - DNA, 21 bp, Homo sapiens
tttagaaacagaaatagactt

SEQ ID NO: 6755181 - DNA, 18 bp, Homo sapiens
tttagaaactgaaaaata

SEQ ID NO: 6755182 - DNA, 18 bp, Homo sapiens
tttagaaagaaaattata

SEQ ID NO: 6755183 - DNA, 15 bp, Homo sapiens
tttagaaagataatt

SEQ ID NO: 6755184 - DNA, 21 bp, Homo sapiens
tttagaaagataattcactgt

SEQ ID NO: 6755185 - DNA, 18 bp, Homo sapiens
tttagaaagcatttgaat

SEQ ID NO: 6755186 - DNA, 19 bp, Homo sapiens
tttagaaagcatttgaatg

SEQ ID NO: 6755187 - DNA, 11 bp, Homo sapiens
tttagaaataa

SEQ ID NO: 6755188 - DNA, 16 bp, Homo sapiens
tttagaaatcattttg

SEQ ID NO: 6755189 - DNA, 13 bp, Homo sapiens
tttagaaatgcat

SEQ ID NO: 6755190 - DNA, 22 bp, Homo sapiens
tttagaaatgtgaagaggtctg

SEQ ID NO: 6755191 - DNA, 13 bp, Homo sapiens
tttagaaatgttt

SEQ ID NO: 6755192 - DNA, 13 bp, Homo sapiens
tttagaaattaca

SEQ ID NO: 6755193 - DNA, 19 bp, Homo sapiens
tttagaaattacaagtttc

SEQ ID NO: 6755194 - DNA, 18 bp, Homo sapiens
tttagaacaacataaaat

SEQ ID NO: 6755195 - DNA, 20 bp, Homo sapiens
tttagaacaacataaaatta

SEQ ID NO: 6755196 - DNA, 17 bp, Homo sapiens
tttagaacaattttctt

SEQ ID NO: 6755197 - DNA, 19 bp, Homo sapiens
tttagaacaattttcttgt

SEQ ID NO: 6755198 - DNA, 20 bp, Homo sapiens
tttagaacagggtttctcag

SEQ ID NO: 6755199 - DNA, 19 bp, Homo sapiens
tttagaacctacaaaagct

SEQ ID NO: 6755200 - DNA, 19 bp, Homo sapiens
tttagaacctgcatttaag

SEQ ID NO: 6755201 - DNA, 16 bp, Homo sapiens
tttagaagaaaagtta

SEQ ID NO: 6755202 - DNA, 19 bp, Homo sapiens
tttagaagatattatttgt

SEQ ID NO: 6755203 - DNA, 17 bp, Homo sapiens
tttagaagattctatgt

SEQ ID NO: 6755204 - DNA, 21 bp, Homo sapiens
tttagaagattctatgttaat

SEQ ID NO: 6755205 - DNA, 22 bp, Homo sapiens
tttagaagccaactatgattat

SEQ ID NO: 6755206 - DNA, 15 bp, Homo sapiens
tttagaagtgcattt

SEQ ID NO: 6755207 - DNA, 14 bp, Homo sapiens
tttagaagtgtcat

SEQ ID NO: 6755208 - DNA, 12 bp, Homo sapiens
tttagaatatct

SEQ ID NO: 6755209 - DNA, 21 bp, Homo sapiens
tttagaatatcttttcaagtt

SEQ ID NO: 6755210 - DNA, 15 bp, Homo sapiens
tttagaatcagaata

SEQ ID NO: 6755211 - DNA, 19 bp, Homo sapiens
tttagaatcccagccccct

SEQ ID NO: 6755212 - DNA, 18 bp, Homo sapiens
tttagaatcgctttcctt

SEQ ID NO: 6755213 - DNA, 17 bp, Homo sapiens
tttagaatctagaaatg

SEQ ID NO: 6755214 - DNA, 19 bp, Homo sapiens
tttagaatcttttaaatac

SEQ ID NO: 6755215 - DNA, 15 bp, Homo sapiens
tttagaatgaatatt

SEQ ID NO: 6755216 - DNA, 18 bp, Homo sapiens
tttagaatgacaggaacc

SEQ ID NO: 6755217 - DNA, 22 bp, Homo sapiens
tttagaatggaggaagaacaac

SEQ ID NO: 6755218 - DNA, 20 bp, Homo sapiens
tttagaatggtgattttaaa

SEQ ID NO: 6755219 - DNA, 18 bp, Homo sapiens
tttagaatggttgagtta

SEQ ID NO: 6755220 - DNA, 17 bp, Homo sapiens
tttagaattgaaggttt

SEQ ID NO: 6755221 - DNA, 18 bp, Homo sapiens
tttagaattgaaggtttt

SEQ ID NO: 6755222 - DNA, 21 bp, Homo sapiens
tttagaattgaaggtttttga

SEQ ID NO: 6755223 - DNA, 22 bp, Homo sapiens
tttagacaaatactcatgtgta

SEQ ID NO: 6755224 - DNA, 16 bp, Homo sapiens
tttagacaaatctaag

SEQ ID NO: 6755225 - DNA, 21 bp, Homo sapiens
tttagacaaatctaagggaaa

SEQ ID NO: 6755226 - DNA, 16 bp, Homo sapiens
tttagacactgggaga

SEQ ID NO: 6755227 - DNA, 15 bp, Homo sapiens
tttagacagtggtaa

SEQ ID NO: 6755228 - DNA, 11 bp, Homo sapiens
tttagaccaag

SEQ ID NO: 6755229 - DNA, 13 bp, Homo sapiens
tttagaccaagga

SEQ ID NO: 6755230 - DNA, 14 bp, Homo sapiens
tttagaccaaggaa

SEQ ID NO: 6755231 - DNA, 18 bp, Homo sapiens
tttagacgatcacagaaa

SEQ ID NO: 6755232 - DNA, 20 bp, Homo sapiens
tttagacttaatagaaacat

SEQ ID NO: 6755233 - DNA, 18 bp, Homo sapiens
tttagacttcctctcatt

SEQ ID NO: 6755234 - DNA, 14 bp, Homo sapiens
tttagacttgaaaa

SEQ ID NO: 6755235 - DNA, 15 bp, Homo sapiens
tttagacttgaaaag

SEQ ID NO: 6755236 - DNA, 20 bp, Homo sapiens
tttagacttgaaaagagaca

SEQ ID NO: 6755237 - DNA, 23 bp, Homo sapiens
tttagacttgaaaagagacaggc

SEQ ID NO: 6755238 - DNA, 13 bp, Homo sapiens
tttagactttaaa

SEQ ID NO: 6755239 - DNA, 21 bp, Homo sapiens
tttagagaaaataaatttaac

SEQ ID NO: 6755240 - DNA, 18 bp, Homo sapiens
tttagagaactgaaaaga

SEQ ID NO: 6755241 - DNA, 13 bp, Homo sapiens
tttagagaagcca

SEQ ID NO: 6755242 - DNA, 15 bp, Homo sapiens
tttagagaggaaaag

SEQ ID NO: 6755243 - DNA, 16 bp, Homo sapiens
tttagagataattgct

SEQ ID NO: 6755244 - DNA, 18 bp, Homo sapiens
tttagagataggaaactg

SEQ ID NO: 6755245 - DNA, 19 bp, Homo sapiens
tttagagatattttccatt

SEQ ID NO: 6755246 - DNA, 14 bp, Homo sapiens
tttagagcaatgca

SEQ ID NO: 6755247 - DNA, 12 bp, Homo sapiens
tttagagcatta

SEQ ID NO: 6755248 - DNA, 20 bp, Homo sapiens
tttagagccagaagtaactt

SEQ ID NO: 6755249 - DNA, 16 bp, Homo sapiens
tttagaggatgtggct

SEQ ID NO: 6755250 - DNA, 15 bp, Homo sapiens
tttagaggcattgtt

SEQ ID NO: 6755251 - DNA, 18 bp, Homo sapiens
tttagaggcattgttagt

SEQ ID NO: 6755252 - DNA, 20 bp, Homo sapiens
tttagaggggcaaaaatatt

SEQ ID NO: 6755253 - DNA, 15 bp, Homo sapiens
tttagaggtgagttt

SEQ ID NO: 6755254 - DNA, 15 bp, Homo sapiens
tttagagtaaactat

SEQ ID NO: 6755255 - DNA, 19 bp, Homo sapiens
tttagagtaaataaactgt

SEQ ID NO: 6755256 - DNA, 20 bp, Homo sapiens
tttagagtaaataaactgtt

SEQ ID NO: 6755257 - DNA, 22 bp, Homo sapiens
tttagagtaagaaatttcaggt

SEQ ID NO: 6755258 - DNA, 18 bp, Homo sapiens
tttagagtagcatgagag

SEQ ID NO: 6755259 - DNA, 23 bp, Homo sapiens
tttagagtatgcaagaagaatat

SEQ ID NO: 6755260 - DNA, 21 bp, Homo sapiens
tttagataaaattgaagtact

SEQ ID NO: 6755261 - DNA, 14 bp, Homo sapiens
tttagatagccctg

SEQ ID NO: 6755262 - DNA, 20 bp, Homo sapiens
tttagatagccctgtcctgg

SEQ ID NO: 6755263 - DNA, 14 bp, Homo sapiens
tttagatatttgcc

SEQ ID NO: 6755264 - DNA, 20 bp, Homo sapiens
tttagatcaaggcaaaaata

SEQ ID NO: 6755265 - DNA, 18 bp, Homo sapiens
tttagatcttatattggt

SEQ ID NO: 6755266 - DNA, 21 bp, Homo sapiens
tttagatgataaagagacagt

SEQ ID NO: 6755267 - DNA, 19 bp, Homo sapiens
tttagatgatgactcaaga

SEQ ID NO: 6755268 - DNA, 14 bp, Homo sapiens
tttagatggttaca

SEQ ID NO: 6755269 - DNA, 22 bp, Homo sapiens
tttagatgtagatatttgaaat

SEQ ID NO: 6755270 - DNA, 21 bp, Homo sapiens
tttagatgtgtatacagaaaa

SEQ ID NO: 6755271 - DNA, 20 bp, Homo sapiens
tttagattaaagattgcttt

SEQ ID NO: 6755272 - DNA, 17 bp, Homo sapiens
tttagattattttatct

SEQ ID NO: 6755273 - DNA, 22 bp, Homo sapiens
tttagattgaaaacttttctca

SEQ ID NO: 6755274 - DNA, 13 bp, Homo sapiens
tttagattgaaat

SEQ ID NO: 6755275 - DNA, 18 bp, Homo sapiens
tttagattgagaaatgtg

SEQ ID NO: 6755276 - DNA, 18 bp, Homo sapiens
tttagattggttctgttt

SEQ ID NO: 6755277 - DNA, 16 bp, Homo sapiens
tttagatttattgtcc

SEQ ID NO: 6755278 - DNA, 19 bp, Homo sapiens
tttagattttcttttgcct

SEQ ID NO: 6755279 - DNA, 17 bp, Homo sapiens
tttagatttttaaaagg

SEQ ID NO: 6755280 - DNA, 20 bp, Homo sapiens
tttagcaaactgatgctgag

SEQ ID NO: 6755281 - DNA, 22 bp, Homo sapiens
tttagcaatagctagctatata

SEQ ID NO: 6755282 - DNA, 14 bp, Homo sapiens
tttagcacaaaaaa

SEQ ID NO: 6755283 - DNA, 17 bp, Homo sapiens
tttagcaggtagaagaa

SEQ ID NO: 6755284 - DNA, 18 bp, Homo sapiens
tttagcagttctgcaaat

SEQ ID NO: 6755285 - DNA, 17 bp, Homo sapiens
tttagcataaaagaata

SEQ ID NO: 6755286 - DNA, 19 bp, Homo sapiens
tttagcataaaagaatatt

SEQ ID NO: 6755287 - DNA, 16 bp, Homo sapiens
tttagcataaaatttt

SEQ ID NO: 6755288 - DNA, 14 bp, Homo sapiens
tttagcataaattt

SEQ ID NO: 6755289 - DNA, 20 bp, Homo sapiens
tttagcatgacaagccccag

SEQ ID NO: 6755290 - DNA, 17 bp, Homo sapiens
tttagcatgagttctgc

SEQ ID NO: 6755291 - DNA, 12 bp, Homo sapiens
tttagcatgtgt

SEQ ID NO: 6755292 - DNA, 14 bp, Homo sapiens
tttagcattaccta

SEQ ID NO: 6755293 - DNA, 12 bp, Homo sapiens
tttagcattgta

SEQ ID NO: 6755294 - DNA, 19 bp, Homo sapiens
tttagcattgtcttgttct

SEQ ID NO: 6755295 - DNA, 21 bp, Homo sapiens
tttagcattgtcttgttctgt

SEQ ID NO: 6755296 - DNA, 19 bp, Homo sapiens
tttagcatttttatgcaga

SEQ ID NO: 6755297 - DNA, 15 bp, Homo sapiens
tttagccaaaccctt

SEQ ID NO: 6755298 - DNA, 15 bp, Homo sapiens
tttagccagaatgtt

SEQ ID NO: 6755299 - DNA, 16 bp, Homo sapiens
tttagccagaatgttt

SEQ ID NO: 6755300 - DNA, 20 bp, Homo sapiens
tttagccagaatgtttcctg

SEQ ID NO: 6755301 - DNA, 18 bp, Homo sapiens
tttagccagcgtttattg

SEQ ID NO: 6755302 - DNA, 11 bp, Homo sapiens
tttagccagtg

SEQ ID NO: 6755303 - DNA, 20 bp, Homo sapiens
tttagccattgtcgtttcat

SEQ ID NO: 6755304 - DNA, 14 bp, Homo sapiens
tttagcccagtgtt

SEQ ID NO: 6755305 - DNA, 23 bp, Homo sapiens
tttatgactagcaaacaaaaata

SEQ ID NO: 6755306 - DNA, 17 bp, Homo sapiens
tttatgagacttcctat

SEQ ID NO: 6755307 - DNA, 16 bp, Homo sapiens
tttatgagatcactga

SEQ ID NO: 6755308 - DNA, 23 bp, Homo sapiens
tttatgagatcactgaacttttc

SEQ ID NO: 6755309 - DNA, 20 bp, Homo sapiens
tttatgagctcatgtagcaa

SEQ ID NO: 6755310 - DNA, 22 bp, Homo sapiens
tttatgatacttgaaaattaac

SEQ ID NO: 6755311 - DNA, 20 bp, Homo sapiens
tttatgatcaaggaaaagat

SEQ ID NO: 6755312 - DNA, 13 bp, Homo sapiens
tttatgatccagc

SEQ ID NO: 6755313 - DNA, 18 bp, Homo sapiens
tttatgatcttttcagtg

SEQ ID NO: 6755314 - DNA, 16 bp, Homo sapiens
tttatgatgacaatca

SEQ ID NO: 6755315 - DNA, 15 bp, Homo sapiens
tttatgatgatacag

SEQ ID NO: 6755316 - DNA, 22 bp, Homo sapiens
tttatgatgatacagtgttaaa

SEQ ID NO: 6755317 - DNA, 14 bp, Homo sapiens
tttatgatgatgaa

SEQ ID NO: 6755318 - DNA, 14 bp, Homo sapiens
tttatgatgcaaat

SEQ ID NO: 6755319 - DNA, 15 bp, Homo sapiens
tttatgatgctaagc

SEQ ID NO: 6755320 - DNA, 23 bp, Homo sapiens
tttatgatgttattttgtacgtg

SEQ ID NO: 6755321 - DNA, 12 bp, Homo sapiens
tttatgatttaa

SEQ ID NO: 6755322 - DNA, 19 bp, Homo sapiens
tttatgatttaaaaaataa

SEQ ID NO: 6755323 - DNA, 14 bp, Homo sapiens
tttatgatttaata

SEQ ID NO: 6755324 - DNA, 19 bp, Homo sapiens
tttatgatttactcattat

SEQ ID NO: 6755325 - DNA, 12 bp, Homo sapiens
tttatgatttct

SEQ ID NO: 6755326 - DNA, 21 bp, Homo sapiens
tttatgatttctccagaaatt

SEQ ID NO: 6755327 - DNA, 13 bp, Homo sapiens
tttatgatttctt

SEQ ID NO: 6755328 - DNA, 12 bp, Homo sapiens
tttatgcaaata

SEQ ID NO: 6755329 - DNA, 23 bp, Homo sapiens
tttatgcaactaactgtttacat

SEQ ID NO: 6755330 - DNA, 15 bp, Homo sapiens
tttatgcaaggaagg

SEQ ID NO: 6755331 - DNA, 12 bp, Homo sapiens
tttatgcacagc

SEQ ID NO: 6755332 - DNA, 23 bp, Homo sapiens
tttatgcagaagcatattttgct

SEQ ID NO: 6755333 - DNA, 15 bp, Homo sapiens
tttatgcagagacag

SEQ ID NO: 6755334 - DNA, 14 bp, Homo sapiens
tttatgcagataga

SEQ ID NO: 6755335 - DNA, 21 bp, Homo sapiens
tttatgcaggcagattaataa

SEQ ID NO: 6755336 - DNA, 20 bp, Homo sapiens
tttatgcatatgtagataca

SEQ ID NO: 6755337 - DNA, 21 bp, Homo sapiens
tttatgcatgagaactaaata

SEQ ID NO: 6755338 - DNA, 15 bp, Homo sapiens
tttatgcattgcctt

SEQ ID NO: 6755339 - DNA, 15 bp, Homo sapiens
tttatgcatttatgc

SEQ ID NO: 6755340 - DNA, 19 bp, Homo sapiens
tttatgcatttatgcatga

SEQ ID NO: 6755341 - DNA, 14 bp, Homo sapiens
tttatgcatttcaa

SEQ ID NO: 6755342 - DNA, 14 bp, Homo sapiens
tttatgcatttcat

SEQ ID NO: 6755343 - DNA, 16 bp, Homo sapiens
tttatgcatttcattc

SEQ ID NO: 6755344 - DNA, 20 bp, Homo sapiens
tttatgccaagaacagaaaa

SEQ ID NO: 6755345 - DNA, 21 bp, Homo sapiens
tttatgccggatgtgcttttc

SEQ ID NO: 6755346 - DNA, 16 bp, Homo sapiens
tttatgcgcaaataca

SEQ ID NO: 6755347 - DNA, 22 bp, Homo sapiens
tttatgctaatatttttaacaa

SEQ ID NO: 6755348 - DNA, 16 bp, Homo sapiens
tttatgctcaatccat

SEQ ID NO: 6755349 - DNA, 17 bp, Homo sapiens
tttatgctcacctgaca

SEQ ID NO: 6755350 - DNA, 21 bp, Homo sapiens
tttatgctgaaacagaatact

SEQ ID NO: 6755351 - DNA, 14 bp, Homo sapiens
tttatgctgtattt

SEQ ID NO: 6755352 - DNA, 12 bp, Homo sapiens
tttatgctttaa

SEQ ID NO: 6755353 - DNA, 17 bp, Homo sapiens
tttatggaaataccagg

SEQ ID NO: 6755354 - DNA, 17 bp, Homo sapiens
tttatggaatctaccaa

SEQ ID NO: 6755355 - DNA, 17 bp, Homo sapiens
tttatggatatgctgct

SEQ ID NO: 6755356 - DNA, 18 bp, Homo sapiens
tttatggatatgctgctt

SEQ ID NO: 6755357 - DNA, 17 bp, Homo sapiens
tttatggcactagtatt

SEQ ID NO: 6755358 - DNA, 21 bp, Homo sapiens
tttatggcagacattgtgcta

SEQ ID NO: 6755359 - DNA, 21 bp, Homo sapiens
tttatggcatgatttatatat

SEQ ID NO: 6755360 - DNA, 23 bp, Homo sapiens
tttatggcatgatttatatatgg

SEQ ID NO: 6755361 - DNA, 18 bp, Homo sapiens
tttatggccttgaagtgt

SEQ ID NO: 6755362 - DNA, 12 bp, Homo sapiens
tttatgggagaa

SEQ ID NO: 6755363 - DNA, 18 bp, Homo sapiens
tttatgggcattgacaaa

SEQ ID NO: 6755364 - DNA, 19 bp, Homo sapiens
tttatgggtacttttagat

SEQ ID NO: 6755365 - DNA, 22 bp, Homo sapiens
tttatgggtcagagttccgact

SEQ ID NO: 6755366 - DNA, 23 bp, Homo sapiens
tttatggtaactgctttctgttc

SEQ ID NO: 6755367 - DNA, 23 bp, Homo sapiens
tttatggtcctaaaagcaaaata

SEQ ID NO: 6755368 - DNA, 20 bp, Homo sapiens
tttatggtgatgtcactcac

SEQ ID NO: 6755369 - DNA, 19 bp, Homo sapiens
tttatggtgtgttcctaac

SEQ ID NO: 6755370 - DNA, 21 bp, Homo sapiens
tttatggtttcccccttctac

SEQ ID NO: 6755371 - DNA, 11 bp, Homo sapiens
tttatgtaaaa

SEQ ID NO: 6755372 - DNA, 19 bp, Homo sapiens
tttatgtaaaattttgcct

SEQ ID NO: 6755373 - DNA, 14 bp, Homo sapiens
tttatgtaaatttt

SEQ ID NO: 6755374 - DNA, 20 bp, Homo sapiens
tttatgtaatgaagtaaagc

SEQ ID NO: 6755375 - DNA, 22 bp, Homo sapiens
tttatgtaatgaagtaaagcca

SEQ ID NO: 6755376 - DNA, 16 bp, Homo sapiens
tttatgtacaaccctg

SEQ ID NO: 6755377 - DNA, 17 bp, Homo sapiens
tttatgtacaaccctga

SEQ ID NO: 6755378 - DNA, 12 bp, Homo sapiens
tttatgtacttt

SEQ ID NO: 6755379 - DNA, 18 bp, Homo sapiens
tttatgtagagaaaagga

SEQ ID NO: 6755380 - DNA, 18 bp, Homo sapiens
tttatgtagcttgacaat

SEQ ID NO: 6755381 - DNA, 22 bp, Homo sapiens
tttatgtatcagctctctgctg

SEQ ID NO: 6755382 - DNA, 23 bp, Homo sapiens
tttatgtatctaatttcattcaa

SEQ ID NO: 6755383 - DNA, 12 bp, Homo sapiens
tttatgtatctt

SEQ ID NO: 6755384 - DNA, 22 bp, Homo sapiens
tttatgtatgtttacactgtca

SEQ ID NO: 6755385 - DNA, 18 bp, Homo sapiens
tttatgtattttaaaata

SEQ ID NO: 6755386 - DNA, 14 bp, Homo sapiens
tttatgtctaaaga

SEQ ID NO: 6755387 - DNA, 18 bp, Homo sapiens
tttatgtctatttaagcc

SEQ ID NO: 6755388 - DNA, 11 bp, Homo sapiens
tttatgtctgg

SEQ ID NO: 6755389 - DNA, 10 bp, Homo sapiens
tttatgtgaa

SEQ ID NO: 6755390 - DNA, 14 bp, Homo sapiens
tttatgtgaaagag

SEQ ID NO: 6755391 - DNA, 20 bp, Homo sapiens
tttatgtgaaatgctttctg

SEQ ID NO: 6755392 - DNA, 13 bp, Homo sapiens
tttatgtgaattt

SEQ ID NO: 6755393 - DNA, 15 bp, Homo sapiens
tttatgtgaattttt

SEQ ID NO: 6755394 - DNA, 14 bp, Homo sapiens
tttatgtgagattt

SEQ ID NO: 6755395 - DNA, 21 bp, Homo sapiens
tttatgtgatgccaaagatgt

SEQ ID NO: 6755396 - DNA, 16 bp, Homo sapiens
tttatgtgcagcgacc

SEQ ID NO: 6755397 - DNA, 18 bp, Homo sapiens
tttatgtgcagcgaccct

SEQ ID NO: 6755398 - DNA, 16 bp, Homo sapiens
tttatgtgctatgcaa

SEQ ID NO: 6755399 - DNA, 16 bp, Homo sapiens
tttatgtgctattaat

SEQ ID NO: 6755400 - DNA, 21 bp, Homo sapiens
tttatgtgctctcatcagaaa

SEQ ID NO: 6755401 - DNA, 15 bp, Homo sapiens
tttatgtgcttgaag

SEQ ID NO: 6755402 - DNA, 18 bp, Homo sapiens
tttatgtgtatatttgta

SEQ ID NO: 6755403 - DNA, 20 bp, Homo sapiens
tttatgtgtatatttgtaga

SEQ ID NO: 6755404 - DNA, 13 bp, Homo sapiens
tttatgtgtgtgt

SEQ ID NO: 6755405 - DNA, 14 bp, Homo sapiens
tttatgtgttatag

SEQ ID NO: 6755406 - DNA, 16 bp, Homo sapiens
tttatgtgttatgaac

SEQ ID NO: 6755407 - DNA, 17 bp, Homo sapiens
tttatgtgttatgaaca

SEQ ID NO: 6755408 - DNA, 15 bp, Homo sapiens
tttatgttaaaagat

SEQ ID NO: 6755409 - DNA, 22 bp, Homo sapiens
tttatgttaattttaatttctg

SEQ ID NO: 6755410 - DNA, 14 bp, Homo sapiens
tttatgttatatat

SEQ ID NO: 6755411 - DNA, 22 bp, Homo sapiens
tttatgttatatataaatatat

SEQ ID NO: 6755412 - DNA, 22 bp, Homo sapiens
tttatgttcagcttataatgaa

SEQ ID NO: 6755413 - DNA, 11 bp, Homo sapiens
tttatgttgac

SEQ ID NO: 6755414 - DNA, 14 bp, Homo sapiens
tttatgttgtatga

SEQ ID NO: 6755415 - DNA, 13 bp, Homo sapiens
tttatgtttaagt

SEQ ID NO: 6755416 - DNA, 13 bp, Homo sapiens
tttatgttttggt

SEQ ID NO: 6755417 - DNA, 14 bp, Homo sapiens
tttatgttttggtc

SEQ ID NO: 6755418 - DNA, 18 bp, Homo sapiens
tttatgttttgtttctga

SEQ ID NO: 6755419 - DNA, 18 bp, Homo sapiens
tttattaaaaatgttctc

SEQ ID NO: 6755420 - DNA, 13 bp, Homo sapiens
tttattaaaacat

SEQ ID NO: 6755421 - DNA, 15 bp, Homo sapiens
tttattaaaatctta

SEQ ID NO: 6755422 - DNA, 21 bp, Homo sapiens
tttattaaaatgattgtaaaa

SEQ ID NO: 6755423 - DNA, 17 bp, Homo sapiens
tttattaaacaattttg

SEQ ID NO: 6755424 - DNA, 15 bp, Homo sapiens
tttattaaacatttt

SEQ ID NO: 6755425 - DNA, 11 bp, Homo sapiens
tttattaaaga

SEQ ID NO: 6755426 - DNA, 16 bp, Homo sapiens
tttattaaagaaaaaa

SEQ ID NO: 6755427 - DNA, 14 bp, Homo sapiens
tttattaaagcaac

SEQ ID NO: 6755428 - DNA, 11 bp, Homo sapiens
tttattaaata

SEQ ID NO: 6755429 - DNA, 19 bp, Homo sapiens
tttattaaataaaatcaat

SEQ ID NO: 6755430 - DNA, 15 bp, Homo sapiens
tttattaaatacaaa

SEQ ID NO: 6755431 - DNA, 19 bp, Homo sapiens
tttattaaatagttaatat

SEQ ID NO: 6755432 - DNA, 12 bp, Homo sapiens
tttattaaatgt

SEQ ID NO: 6755433 - DNA, 22 bp, Homo sapiens
tttattaaattaattgaatcta

SEQ ID NO: 6755434 - DNA, 14 bp, Homo sapiens
tttattaaatttat

SEQ ID NO: 6755435 - DNA, 21 bp, Homo sapiens
tttattaaatttgttgacaaa

SEQ ID NO: 6755436 - DNA, 12 bp, Homo sapiens
tttattaacaaa

SEQ ID NO: 6755437 - DNA, 22 bp, Homo sapiens
tttattaacatatattgttatt

SEQ ID NO: 6755438 - DNA, 17 bp, Homo sapiens
tttattaacttaataat

SEQ ID NO: 6755439 - DNA, 12 bp, Homo sapiens
tttattaagatg

SEQ ID NO: 6755440 - DNA, 14 bp, Homo sapiens
tttattaagattat

SEQ ID NO: 6755441 - DNA, 16 bp, Homo sapiens
tttattaagtagatga

SEQ ID NO: 6755442 - DNA, 14 bp, Homo sapiens
tttattaagtctgg

SEQ ID NO: 6755443 - DNA, 22 bp, Homo sapiens
tttattaataaaacaaaatgtt

SEQ ID NO: 6755444 - DNA, 19 bp, Homo sapiens
tttattaatatatattatc

SEQ ID NO: 6755445 - DNA, 16 bp, Homo sapiens
tttattaatatttgtg

SEQ ID NO: 6755446 - DNA, 15 bp, Homo sapiens
tttattaatcactgt

SEQ ID NO: 6755447 - DNA, 19 bp, Homo sapiens
tttattaatcactgtgtat

SEQ ID NO: 6755448 - DNA, 17 bp, Homo sapiens
tttattaatgcactttc

SEQ ID NO: 6755449 - DNA, 16 bp, Homo sapiens
tttattaatttatttg

SEQ ID NO: 6755450 - DNA, 12 bp, Homo sapiens
tttattaatttg

SEQ ID NO: 6755451 - DNA, 13 bp, Homo sapiens
tttattacaaatg

SEQ ID NO: 6755452 - DNA, 19 bp, Homo sapiens
tttattacaaatgcaaatt

SEQ ID NO: 6755453 - DNA, 20 bp, Homo sapiens
tttattacaaattttcactg

SEQ ID NO: 6755454 - DNA, 11 bp, Homo sapiens
tttattacaat

SEQ ID NO: 6755455 - DNA, 21 bp, Homo sapiens
tttattacacctcagaaattg

SEQ ID NO: 6755456 - DNA, 14 bp, Homo sapiens
tttattacagtata

SEQ ID NO: 6755457 - DNA, 22 bp, Homo sapiens
tttattacagtataattaacat

SEQ ID NO: 6755458 - DNA, 13 bp, Homo sapiens
tttattacattag

SEQ ID NO: 6755459 - DNA, 12 bp, Homo sapiens
tttattaccccc

SEQ ID NO: 6755460 - DNA, 15 bp, Homo sapiens
tttattacccttctt

SEQ ID NO: 6755461 - DNA, 18 bp, Homo sapiens
tttattacgtatgtctgg

SEQ ID NO: 6755462 - DNA, 21 bp, Homo sapiens
tttattactgtccctatctat

SEQ ID NO: 6755463 - DNA, 18 bp, Homo sapiens
tttattactgtttctaaa

SEQ ID NO: 6755464 - DNA, 10 bp, Homo sapiens
tttattactt

SEQ ID NO: 6755465 - DNA, 14 bp, Homo sapiens
tttattacttattt

SEQ ID NO: 6755466 - DNA, 20 bp, Homo sapiens
tttattacttgtgcacttag

SEQ ID NO: 6755467 - DNA, 22 bp, Homo sapiens
tttattagaataatttcatact

SEQ ID NO: 6755468 - DNA, 22 bp, Homo sapiens
tttattagacattctcttactt

SEQ ID NO: 6755469 - DNA, 14 bp, Homo sapiens
tttattagatgaat

SEQ ID NO: 6755470 - DNA, 20 bp, Homo sapiens
tttattagcattttcaagaa

SEQ ID NO: 6755471 - DNA, 22 bp, Homo sapiens
tttattagccagtgaaacactt

SEQ ID NO: 6755472 - DNA, 20 bp, Homo sapiens
tttattaggaaaagatattt

SEQ ID NO: 6755473 - DNA, 19 bp, Homo sapiens
tttattaggttaagtctca

SEQ ID NO: 6755474 - DNA, 15 bp, Homo sapiens
tttattagtaacatc

SEQ ID NO: 6755475 - DNA, 17 bp, Homo sapiens
tttattagtaacatcat

SEQ ID NO: 6755476 - DNA, 18 bp, Homo sapiens
tttattataaagcttaaa

SEQ ID NO: 6755477 - DNA, 13 bp, Homo sapiens
tttattatacacc

SEQ ID NO: 6755478 - DNA, 17 bp, Homo sapiens
tttattatgcataactg

SEQ ID NO: 6755479 - DNA, 18 bp, Homo sapiens
tttattatgctgtatttt

SEQ ID NO: 6755480 - DNA, 16 bp, Homo sapiens
tttattatgtaaatcc

SEQ ID NO: 6755481 - DNA, 17 bp, Homo sapiens
tttattatgtaaatccc

SEQ ID NO: 6755482 - DNA, 15 bp, Homo sapiens
tttattattaaatca

SEQ ID NO: 6755483 - DNA, 16 bp, Homo sapiens
tttattattactgttt

SEQ ID NO: 6755484 - DNA, 13 bp, Homo sapiens
tttcaatcttcaa

SEQ ID NO: 6755485 - DNA, 21 bp, Homo sapiens
tttcaatgaaacaaagaaaga

SEQ ID NO: 6755486 - DNA, 20 bp, Homo sapiens
tttcaatgaattaagaaaga

SEQ ID NO: 6755487 - DNA, 12 bp, Homo sapiens
tttcaatgcaat

SEQ ID NO: 6755488 - DNA, 16 bp, Homo sapiens
tttcaatgcaatgcat

SEQ ID NO: 6755489 - DNA, 21 bp, Homo sapiens
tttcaatgcaatgcatctgaa

SEQ ID NO: 6755490 - DNA, 23 bp, Homo sapiens
tttcaatggttgggacaatggca

SEQ ID NO: 6755491 - DNA, 21 bp, Homo sapiens
tttcaatggtttgcaaggaag

SEQ ID NO: 6755492 - DNA, 15 bp, Homo sapiens
tttcaatgtaattaa

SEQ ID NO: 6755493 - DNA, 13 bp, Homo sapiens
tttcaatgtgatt

SEQ ID NO: 6755494 - DNA, 20 bp, Homo sapiens
tttcaatgtgattctaatgt

SEQ ID NO: 6755495 - DNA, 19 bp, Homo sapiens
tttcaatgtgtataaattg

SEQ ID NO: 6755496 - DNA, 23 bp, Homo sapiens
tttcaatgtgttgatacattccc

SEQ ID NO: 6755497 - DNA, 14 bp, Homo sapiens
tttcaattaaacgg

SEQ ID NO: 6755498 - DNA, 22 bp, Homo sapiens
tttcaattagatttaaaataaa

SEQ ID NO: 6755499 - DNA, 12 bp, Homo sapiens
tttcaattatgt

SEQ ID NO: 6755500 - DNA, 18 bp, Homo sapiens
tttcaattcaaaaatgta

SEQ ID NO: 6755501 - DNA, 12 bp, Homo sapiens
tttcaattcaga

SEQ ID NO: 6755502 - DNA, 21 bp, Homo sapiens
tttcaattcagattgtcttgc

SEQ ID NO: 6755503 - DNA, 23 bp, Homo sapiens
tttcaattcagattgtcttgcaa

SEQ ID NO: 6755504 - DNA, 14 bp, Homo sapiens
tttcaattctcaaa

SEQ ID NO: 6755505 - DNA, 19 bp, Homo sapiens
tttcaattctgtaattaca

SEQ ID NO: 6755506 - DNA, 22 bp, Homo sapiens
tttcaattgatggactactcta

SEQ ID NO: 6755507 - DNA, 18 bp, Homo sapiens
tttcaattgcagatgcca

SEQ ID NO: 6755508 - DNA, 17 bp, Homo sapiens
tttcaattgtattttat

SEQ ID NO: 6755509 - DNA, 18 bp, Homo sapiens
tttcaatttactttttaa

SEQ ID NO: 6755510 - DNA, 23 bp, Homo sapiens
tttcaatttactttttaaacagt

SEQ ID NO: 6755511 - DNA, 14 bp, Homo sapiens
tttcaatttccaag

SEQ ID NO: 6755512 - DNA, 22 bp, Homo sapiens
tttcaatttctaaatttgcagg

SEQ ID NO: 6755513 - DNA, 21 bp, Homo sapiens
tttcaatttggagcattaact

SEQ ID NO: 6755514 - DNA, 16 bp, Homo sapiens
tttcaatttgtcatgt

SEQ ID NO: 6755515 - DNA, 17 bp, Homo sapiens
tttcaattttgcatgct

SEQ ID NO: 6755516 - DNA, 15 bp, Homo sapiens
tttcacaaaatgtct

SEQ ID NO: 6755517 - DNA, 13 bp, Homo sapiens
tttcacaaataaa

SEQ ID NO: 6755518 - DNA, 20 bp, Homo sapiens
tttcacaaatattaaaaagt

SEQ ID NO: 6755519 - DNA, 17 bp, Homo sapiens
tttcacaacagatttct

SEQ ID NO: 6755520 - DNA, 13 bp, Homo sapiens
tttcacaacatat

SEQ ID NO: 6755521 - DNA, 13 bp, Homo sapiens
tttcacaacattt

SEQ ID NO: 6755522 - DNA, 22 bp, Homo sapiens
tttcacaaccttctgtggctca

SEQ ID NO: 6755523 - DNA, 14 bp, Homo sapiens
tttcacaaggtctt

SEQ ID NO: 6755524 - DNA, 21 bp, Homo sapiens
tttcacaatcttggggctgat

SEQ ID NO: 6755525 - DNA, 16 bp, Homo sapiens
tttcacaatgcctaga

SEQ ID NO: 6755526 - DNA, 21 bp, Homo sapiens
tttcacaatgtgaaactgaag

SEQ ID NO: 6755527 - DNA, 18 bp, Homo sapiens
tttcacacatctgggtgc

SEQ ID NO: 6755528 - DNA, 20 bp, Homo sapiens
tttcacaccggaaggttttt

SEQ ID NO: 6755529 - DNA, 23 bp, Homo sapiens
tttcacacctgaaaatgttagtg

SEQ ID NO: 6755530 - DNA, 17 bp, Homo sapiens
tttcacactgtcttccc

SEQ ID NO: 6755531 - DNA, 23 bp, Homo sapiens
tttcacagatggaagaagtttta

SEQ ID NO: 6755532 - DNA, 16 bp, Homo sapiens
tttcacagcaacattt

SEQ ID NO: 6755533 - DNA, 17 bp, Homo sapiens
tttcacagcaacatttt

SEQ ID NO: 6755534 - DNA, 22 bp, Homo sapiens
tttcacagcctttcgttctgct

SEQ ID NO: 6755535 - DNA, 17 bp, Homo sapiens
tttcacagctatgaaga

SEQ ID NO: 6755536 - DNA, 13 bp, Homo sapiens
tttcacagctcct

SEQ ID NO: 6755537 - DNA, 18 bp, Homo sapiens
tttcacaggctgtaaatt

SEQ ID NO: 6755538 - DNA, 20 bp, Homo sapiens
tttcacaggctgtaaattga

SEQ ID NO: 6755539 - DNA, 14 bp, Homo sapiens
tttcacagtgaagt

SEQ ID NO: 6755540 - DNA, 13 bp, Homo sapiens
tttcacagttctg

SEQ ID NO: 6755541 - DNA, 17 bp, Homo sapiens
tttcacagttggcactt

SEQ ID NO: 6755542 - DNA, 16 bp, Homo sapiens
tttcacagtttgaaat

SEQ ID NO: 6755543 - DNA, 18 bp, Homo sapiens
tttcacagtttgaaataa

SEQ ID NO: 6755544 - DNA, 13 bp, Homo sapiens
tttcacataaatg

SEQ ID NO: 6755545 - DNA, 15 bp, Homo sapiens
tttcacataaatgca

SEQ ID NO: 6755546 - DNA, 22 bp, Homo sapiens
tttcacatagcccacttacatt

SEQ ID NO: 6755547 - DNA, 15 bp, Homo sapiens
tttcacatatctagt

SEQ ID NO: 6755548 - DNA, 22 bp, Homo sapiens
tttcacatatctagtatgaaat

SEQ ID NO: 6755549 - DNA, 15 bp, Homo sapiens
tttcacatctctgta

SEQ ID NO: 6755550 - DNA, 14 bp, Homo sapiens
tttcacatgccttg

SEQ ID NO: 6755551 - DNA, 15 bp, Homo sapiens
tttcacatgccttgc

SEQ ID NO: 6755552 - DNA, 15 bp, Homo sapiens
tttcacattaatatt

SEQ ID NO: 6755553 - DNA, 20 bp, Homo sapiens
tttcacattaatggtctaaa

SEQ ID NO: 6755554 - DNA, 13 bp, Homo sapiens
tttcacattagat

SEQ ID NO: 6755555 - DNA, 14 bp, Homo sapiens
tttcacattcctga

SEQ ID NO: 6755556 - DNA, 19 bp, Homo sapiens
tttcacattcctgaccctc

SEQ ID NO: 6755557 - DNA, 15 bp, Homo sapiens
tttcacattcttata

SEQ ID NO: 6755558 - DNA, 21 bp, Homo sapiens
tttcacattcttataaatatg

SEQ ID NO: 6755559 - DNA, 19 bp, Homo sapiens
tttcacattggaaacaagt

SEQ ID NO: 6755560 - DNA, 15 bp, Homo sapiens
tttcacattgtttgc

SEQ ID NO: 6755561 - DNA, 19 bp, Homo sapiens
tttcacattgtttgctgct

SEQ ID NO: 6755562 - DNA, 18 bp, Homo sapiens
tttcacatttaaatggtt

SEQ ID NO: 6755563 - DNA, 15 bp, Homo sapiens
tttcacatttaagca

SEQ ID NO: 6755564 - DNA, 13 bp, Homo sapiens
tttcacattttcc

SEQ ID NO: 6755565 - DNA, 19 bp, Homo sapiens
tttcacatttttgtaatgc

SEQ ID NO: 6755566 - DNA, 20 bp, Homo sapiens
tttcaccaaaatttctacac

SEQ ID NO: 6755567 - DNA, 17 bp, Homo sapiens
tttcaccaagtaaattt

SEQ ID NO: 6755568 - DNA, 13 bp, Homo sapiens
tttcaccaatgag

SEQ ID NO: 6755569 - DNA, 18 bp, Homo sapiens
tttcaccatgttggccag

SEQ ID NO: 6755570 - DNA, 23 bp, Homo sapiens
tttcaccatgttggccaggctgt

SEQ ID NO: 6755571 - DNA, 22 bp, Homo sapiens
tttcaccatttgattatgtagc

SEQ ID NO: 6755572 - DNA, 19 bp, Homo sapiens
tttcacccacagaaagaga

SEQ ID NO: 6755573 - DNA, 14 bp, Homo sapiens
tttcacccctccct

SEQ ID NO: 6755574 - DNA, 17 bp, Homo sapiens
tttcacccctccctttc

SEQ ID NO: 6755575 - DNA, 18 bp, Homo sapiens
tttcaccctattttcaga

SEQ ID NO: 6755576 - DNA, 15 bp, Homo sapiens
tttcacccttctact

SEQ ID NO: 6755577 - DNA, 20 bp, Homo sapiens
tttcacctactttgtaagtg

SEQ ID NO: 6755578 - DNA, 17 bp, Homo sapiens
tttcacctccatgtcat

SEQ ID NO: 6755579 - DNA, 18 bp, Homo sapiens
tttcacctccatgtcatc

SEQ ID NO: 6755580 - DNA, 19 bp, Homo sapiens
tttcacctccatgtcatcc

SEQ ID NO: 6755581 - DNA, 17 bp, Homo sapiens
tttcacctccttcaatt

SEQ ID NO: 6755582 - DNA, 19 bp, Homo sapiens
tttcacctctttaaccact

SEQ ID NO: 6755583 - DNA, 17 bp, Homo sapiens
tttcacctctttgctcc

SEQ ID NO: 6755584 - DNA, 16 bp, Homo sapiens
tttcacctgaaacact

SEQ ID NO: 6755585 - DNA, 16 bp, Homo sapiens
tttcacctgaaatgcc

SEQ ID NO: 6755586 - DNA, 22 bp, Homo sapiens
tttcacctggaagcatttgttt

SEQ ID NO: 6755587 - DNA, 14 bp, Homo sapiens
tttcaccttccctc

SEQ ID NO: 6755588 - DNA, 16 bp, Homo sapiens
tttcaccttgggtttg

SEQ ID NO: 6755589 - DNA, 21 bp, Homo sapiens
tttcaccttttcaggaaaata

SEQ ID NO: 6755590 - DNA, 21 bp, Homo sapiens
tttcacgagtgttcctgtgct

SEQ ID NO: 6755591 - DNA, 15 bp, Homo sapiens
tttcacgattcattt

SEQ ID NO: 6755592 - DNA, 18 bp, Homo sapiens
tttcacggaagttttcaa

SEQ ID NO: 6755593 - DNA, 22 bp, Homo sapiens
tttcacggtgccaggttttctg

SEQ ID NO: 6755594 - DNA, 16 bp, Homo sapiens
tttcacgtaaatattc

SEQ ID NO: 6755595 - DNA, 15 bp, Homo sapiens
tttcactaaaagtgt

SEQ ID NO: 6755596 - DNA, 22 bp, Homo sapiens
tttcactaaatgtaaaatttgg

SEQ ID NO: 6755597 - DNA, 15 bp, Homo sapiens
tttcactagaaaagc

SEQ ID NO: 6755598 - DNA, 16 bp, Homo sapiens
tttcactagagacaaa

SEQ ID NO: 6755599 - DNA, 19 bp, Homo sapiens
tttcactatcttcttcaaa

SEQ ID NO: 6755600 - DNA, 17 bp, Homo sapiens
tttcactatgattttct

SEQ ID NO: 6755601 - DNA, 18 bp, Homo sapiens
tttcactatgattttcta

SEQ ID NO: 6755602 - DNA, 19 bp, Homo sapiens
tttcactatttttatttat

SEQ ID NO: 6755603 - DNA, 17 bp, Homo sapiens
tttcactccctcttggt

SEQ ID NO: 6755604 - DNA, 24 bp, Homo sapiens
tttcactctaaaaatcttggcaat

SEQ ID NO: 6755605 - DNA, 17 bp, Homo sapiens
tttcactctttccagat

SEQ ID NO: 6755606 - DNA, 22 bp, Homo sapiens
tttcactgacactgcgaactct

SEQ ID NO: 6755607 - DNA, 22 bp, Homo sapiens
tttcactgagagctgcctcctg

SEQ ID NO: 6755608 - DNA, 12 bp, Homo sapiens
tttcactgctgc

SEQ ID NO: 6755609 - DNA, 15 bp, Homo sapiens
tttcactgctgctcc

SEQ ID NO: 6755610 - DNA, 16 bp, Homo sapiens
tttcactgctgctcct

SEQ ID NO: 6755611 - DNA, 18 bp, Homo sapiens
tttcactgctggctgcct

SEQ ID NO: 6755612 - DNA, 17 bp, Homo sapiens
tttcactggaaaggaaa

SEQ ID NO: 6755613 - DNA, 23 bp, Homo sapiens
tttcactggaaaggaaagatgat

SEQ ID NO: 6755614 - DNA, 15 bp, Homo sapiens
tttcactggagcaca

SEQ ID NO: 6755615 - DNA, 17 bp, Homo sapiens
tttcactggagttacat

SEQ ID NO: 6755616 - DNA, 23 bp, Homo sapiens
tttcactggccacagttgtttga

SEQ ID NO: 6755617 - DNA, 24 bp, Homo sapiens
tttcactgtagaatgatttcatgc

SEQ ID NO: 6755618 - DNA, 15 bp, Homo sapiens
tttcactgtctgtct

SEQ ID NO: 6755619 - DNA, 19 bp, Homo sapiens
tttcacttaaactttgtca

SEQ ID NO: 6755620 - DNA, 21 bp, Homo sapiens
tttcacttaatgtttcttaga

SEQ ID NO: 6755621 - DNA, 23 bp, Homo sapiens
tttcacttagaacctttctgtgt

SEQ ID NO: 6755622 - DNA, 23 bp, Homo sapiens
tttcacttcaggagaaactgctg

SEQ ID NO: 6755623 - DNA, 14 bp, Homo sapiens
tttcacttcctctc

SEQ ID NO: 6755624 - DNA, 18 bp, Homo sapiens
tttcacttcctctccaca

SEQ ID NO: 6755625 - DNA, 23 bp, Homo sapiens
tttcacttcctctccacaggagc

SEQ ID NO: 6755626 - DNA, 12 bp, Homo sapiens
tttcacttctgt

SEQ ID NO: 6755627 - DNA, 13 bp, Homo sapiens
tttcacttcttaa

SEQ ID NO: 6755628 - DNA, 15 bp, Homo sapiens
tttcacttgaaagat

SEQ ID NO: 6755629 - DNA, 18 bp, Homo sapiens
tttcacttgaaagatttt

SEQ ID NO: 6755630 - DNA, 14 bp, Homo sapiens
tttcacttgatgtt

SEQ ID NO: 6755631 - DNA, 20 bp, Homo sapiens
tttcacttgggtctctggat

SEQ ID NO: 6755632 - DNA, 12 bp, Homo sapiens
tttcacttgtat

SEQ ID NO: 6755633 - DNA, 13 bp, Homo sapiens
tttcacttgtatt

SEQ ID NO: 6755634 - DNA, 17 bp, Homo sapiens
tttcacttgtattgact

SEQ ID NO: 6755635 - DNA, 18 bp, Homo sapiens
tttcacttgtattgactt

SEQ ID NO: 6755636 - DNA, 13 bp, Homo sapiens
tttcacttgtctt

SEQ ID NO: 6755637 - DNA, 20 bp, Homo sapiens
tttcacttgtcttgctctta

SEQ ID NO: 6755638 - DNA, 12 bp, Homo sapiens
tttcactttaga

SEQ ID NO: 6755639 - DNA, 15 bp, Homo sapiens
tttcactttagcaaa

SEQ ID NO: 6755640 - DNA, 16 bp, Homo sapiens
tttcactttattgcta

SEQ ID NO: 6755641 - DNA, 16 bp, Homo sapiens
tttcactttctgtcta

SEQ ID NO: 6755642 - DNA, 17 bp, Homo sapiens
tttcactttctgtctag

SEQ ID NO: 6755643 - DNA, 14 bp, Homo sapiens
tttcactttgacat

SEQ ID NO: 6755644 - DNA, 22 bp, Homo sapiens
tttcactttgctctcaattaaa

SEQ ID NO: 6755645 - DNA, 20 bp, Homo sapiens
tttcactttgtgtattaaat

SEQ ID NO: 6755646 - DNA, 18 bp, Homo sapiens
tttcagaaacagggcagc

SEQ ID NO: 6755647 - DNA, 16 bp, Homo sapiens
tttcagaaagcctttc

SEQ ID NO: 6755648 - DNA, 21 bp, Homo sapiens
tttcagaaagcctttcatttt

SEQ ID NO: 6755649 - DNA, 20 bp, Homo sapiens
tttcagaaagggcagcccct

SEQ ID NO: 6755650 - DNA, 23 bp, Homo sapiens
tttcagaaagggcagcccctccc

SEQ ID NO: 6755651 - DNA, 22 bp, Homo sapiens
tttcagaaatacagataaatga

SEQ ID NO: 6755652 - DNA, 14 bp, Homo sapiens
tttcagaaatataa

SEQ ID NO: 6755653 - DNA, 20 bp, Homo sapiens
tttcagaaatataacacatt

SEQ ID NO: 6755654 - DNA, 21 bp, Homo sapiens
tttcagaaatataacacattt

SEQ ID NO: 6755655 - DNA, 22 bp, Homo sapiens
tttcagaaatataacacatttt

SEQ ID NO: 6755656 - DNA, 12 bp, Homo sapiens
tttcagaaatgt

SEQ ID NO: 6755657 - DNA, 13 bp, Homo sapiens
tttcagaaatgtg

SEQ ID NO: 6755658 - DNA, 17 bp, Homo sapiens
tttcagaaattctcaaa

SEQ ID NO: 6755659 - DNA, 18 bp, Homo sapiens
tttcagaacctcttcccc

SEQ ID NO: 6755660 - DNA, 14 bp, Homo sapiens
tttcagaactgcta

SEQ ID NO: 6755661 - DNA, 15 bp, Homo sapiens
tttccatttttgtca

SEQ ID NO: 6755662 - DNA, 16 bp, Homo sapiens
tttcccaaagcacttt

SEQ ID NO: 6755663 - DNA, 22 bp, Homo sapiens
tttcccaaagcatccctcttag

SEQ ID NO: 6755664 - DNA, 22 bp, Homo sapiens
tttcccaaagtcctctgctcca

SEQ ID NO: 6755665 - DNA, 14 bp, Homo sapiens
tttcccaaatgtat

SEQ ID NO: 6755666 - DNA, 15 bp, Homo sapiens
tttcccaaatgtatt

SEQ ID NO: 6755667 - DNA, 14 bp, Homo sapiens
tttcccaacagctc

SEQ ID NO: 6755668 - DNA, 23 bp, Homo sapiens
tttcccaacccccagcccccacc

SEQ ID NO: 6755669 - DNA, 12 bp, Homo sapiens
tttcccaagctg

SEQ ID NO: 6755670 - DNA, 19 bp, Homo sapiens
tttcccaatactagccccc

SEQ ID NO: 6755671 - DNA, 12 bp, Homo sapiens
tttcccaattca

SEQ ID NO: 6755672 - DNA, 15 bp, Homo sapiens
tttcccaattcacat

SEQ ID NO: 6755673 - DNA, 17 bp, Homo sapiens
tttcccacaattctttt

SEQ ID NO: 6755674 - DNA, 15 bp, Homo sapiens
tttcccacacatatt

SEQ ID NO: 6755675 - DNA, 16 bp, Homo sapiens
tttcccacacatattc

SEQ ID NO: 6755676 - DNA, 13 bp, Homo sapiens
tttcccacactgt

SEQ ID NO: 6755677 - DNA, 16 bp, Homo sapiens
tttcccacactgtgaa

SEQ ID NO: 6755678 - DNA, 11 bp, Homo sapiens
tttcccacagt

SEQ ID NO: 6755679 - DNA, 22 bp, Homo sapiens
tttcccaccaccttggactcct

SEQ ID NO: 6755680 - DNA, 20 bp, Homo sapiens
tttcccaccagcatgtcact

SEQ ID NO: 6755681 - DNA, 11 bp, Homo sapiens
tttcccaccct

SEQ ID NO: 6755682 - DNA, 19 bp, Homo sapiens
tttcccacctctctcccca

SEQ ID NO: 6755683 - DNA, 23 bp, Homo sapiens
tttcccactcattctgaattaat

SEQ ID NO: 6755684 - DNA, 15 bp, Homo sapiens
tttcccactcccttt

SEQ ID NO: 6755685 - DNA, 12 bp, Homo sapiens
tttcccactgca

SEQ ID NO: 6755686 - DNA, 19 bp, Homo sapiens
tttcccactttcttctacc

SEQ ID NO: 6755687 - DNA, 18 bp, Homo sapiens
tttcccagccctttccag

SEQ ID NO: 6755688 - DNA, 22 bp, Homo sapiens
tttcccagccctttccagggca

SEQ ID NO: 6755689 - DNA, 17 bp, Homo sapiens
tttcccagcctcttcca

SEQ ID NO: 6755690 - DNA, 11 bp, Homo sapiens
tttcccaggac

SEQ ID NO: 6755691 - DNA, 17 bp, Homo sapiens
tttcccaggagaccatt

SEQ ID NO: 6755692 - DNA, 17 bp, Homo sapiens
tttcccaggcaaataaa

SEQ ID NO: 6755693 - DNA, 16 bp, Homo sapiens
tttcccagttaaagat

SEQ ID NO: 6755694 - DNA, 12 bp, Homo sapiens
tttcccataatt

SEQ ID NO: 6755695 - DNA, 14 bp, Homo sapiens
tttcccataatttt

SEQ ID NO: 6755696 - DNA, 16 bp, Homo sapiens
tttcccatcaccagaa

SEQ ID NO: 6755697 - DNA, 20 bp, Homo sapiens
tttcccatcaccccttcccc

SEQ ID NO: 6755698 - DNA, 17 bp, Homo sapiens
tttcccatcatcctttg

SEQ ID NO: 6755699 - DNA, 17 bp, Homo sapiens
tttcccatgactcttgg

SEQ ID NO: 6755700 - DNA, 19 bp, Homo sapiens
tttcccatgctgaattatt

SEQ ID NO: 6755701 - DNA, 16 bp, Homo sapiens
tttcccatgtatttgt

SEQ ID NO: 6755702 - DNA, 21 bp, Homo sapiens
tttcccatttgttgctgctgc

SEQ ID NO: 6755703 - DNA, 14 bp, Homo sapiens
tttccccaaagtct

SEQ ID NO: 6755704 - DNA, 14 bp, Homo sapiens
tttccccaacagtg

SEQ ID NO: 6755705 - DNA, 18 bp, Homo sapiens
tttccccaacagtgtgaa

SEQ ID NO: 6755706 - DNA, 18 bp, Homo sapiens
tttccccaataaagcctt

SEQ ID NO: 6755707 - DNA, 12 bp, Homo sapiens
tttccccacctc

SEQ ID NO: 6755708 - DNA, 20 bp, Homo sapiens
tttccccacctcttccttcc

SEQ ID NO: 6755709 - DNA, 19 bp, Homo sapiens
tttccccactaataaagtg

SEQ ID NO: 6755710 - DNA, 13 bp, Homo sapiens
tttccccactgaa

SEQ ID NO: 6755711 - DNA, 20 bp, Homo sapiens
tttccccagaggctcccaat

SEQ ID NO: 6755712 - DNA, 11 bp, Homo sapiens
tttccccagcc

SEQ ID NO: 6755713 - DNA, 18 bp, Homo sapiens
tttccccagccacaggcc

SEQ ID NO: 6755714 - DNA, 19 bp, Homo sapiens
tttccccagccacaggcca

SEQ ID NO: 6755715 - DNA, 14 bp, Homo sapiens
tttccccagcctct

SEQ ID NO: 6755716 - DNA, 21 bp, Homo sapiens
tttccccagggaaggaaaaat

SEQ ID NO: 6755717 - DNA, 14 bp, Homo sapiens
tttccccagggcac

SEQ ID NO: 6755718 - DNA, 21 bp, Homo sapiens
tttccccaggggaaaatgaag

SEQ ID NO: 6755719 - DNA, 15 bp, Homo sapiens
tttccccatctctgt

SEQ ID NO: 6755720 - DNA, 18 bp, Homo sapiens
tttccccattcagtgaca

SEQ ID NO: 6755721 - DNA, 20 bp, Homo sapiens
tttcccccacagttttaata

SEQ ID NO: 6755722 - DNA, 12 bp, Homo sapiens
tttcccccaccc

SEQ ID NO: 6755723 - DNA, 20 bp, Homo sapiens
tttcccccaccccagagttg

SEQ ID NO: 6755724 - DNA, 12 bp, Homo sapiens
tttcccccaggc

SEQ ID NO: 6755725 - DNA, 23 bp, Homo sapiens
tttccccccactctccccacact

SEQ ID NO: 6755726 - DNA, 23 bp, Homo sapiens
tttcccccctccctccagtacca

SEQ ID NO: 6755727 - DNA, 19 bp, Homo sapiens
tttcccccttcatccatcc

SEQ ID NO: 6755728 - DNA, 21 bp, Homo sapiens
tttcccccttcatccatcctg

SEQ ID NO: 6755729 - DNA, 22 bp, Homo sapiens
tttcccccttcatccatcctga

SEQ ID NO: 6755730 - DNA, 14 bp, Homo sapiens
tttcccccttcccg

SEQ ID NO: 6755731 - DNA, 16 bp, Homo sapiens
tttcccccttctacat

SEQ ID NO: 6755732 - DNA, 22 bp, Homo sapiens
tttcccccttgaggattgtgga

SEQ ID NO: 6755733 - DNA, 14 bp, Homo sapiens
tttccccctttctt

SEQ ID NO: 6755734 - DNA, 21 bp, Homo sapiens
tttccccctttcttcctcatt

SEQ ID NO: 6755735 - DNA, 18 bp, Homo sapiens
tttcccctagcttactga

SEQ ID NO: 6755736 - DNA, 16 bp, Homo sapiens
tttcccctctaattat

SEQ ID NO: 6755737 - DNA, 13 bp, Homo sapiens
tttcccctctcgg

SEQ ID NO: 6755738 - DNA, 15 bp, Homo sapiens
tttcccctctggctt

SEQ ID NO: 6755739 - DNA, 14 bp, Homo sapiens
tttcccctgtcctg

SEQ ID NO: 6755740 - DNA, 18 bp, Homo sapiens
tttcccctgtggtttgtt

SEQ ID NO: 6755741 - DNA, 15 bp, Homo sapiens
tttcccctgttaaac

SEQ ID NO: 6755742 - DNA, 12 bp, Homo sapiens
tttccccttccc

SEQ ID NO: 6755743 - DNA, 19 bp, Homo sapiens
tttccccttcccctcccct

SEQ ID NO: 6755744 - DNA, 12 bp, Homo sapiens
tttccccttgga

SEQ ID NO: 6755745 - DNA, 12 bp, Homo sapiens
tttcccctttcc

SEQ ID NO: 6755746 - DNA, 14 bp, Homo sapiens
tttcccctttcctg

SEQ ID NO: 6755747 - DNA, 13 bp, Homo sapiens
tttcccctttctt

SEQ ID NO: 6755748 - DNA, 19 bp, Homo sapiens
tttcccggacttagaaaac

SEQ ID NO: 6755749 - DNA, 14 bp, Homo sapiens
tttcccggagccat

SEQ ID NO: 6755750 - DNA, 19 bp, Homo sapiens
tttcccggtgacacatcca

SEQ ID NO: 6755751 - DNA, 20 bp, Homo sapiens
tttcccggtgacacatccat

SEQ ID NO: 6755752 - DNA, 15 bp, Homo sapiens
tttcccgtggcccca

SEQ ID NO: 6755753 - DNA, 16 bp, Homo sapiens
tttccctaccctctag

SEQ ID NO: 6755754 - DNA, 22 bp, Homo sapiens
tttccctactaacatcccaata

SEQ ID NO: 6755755 - DNA, 23 bp, Homo sapiens
tttccctactgaagcccttgtga

SEQ ID NO: 6755756 - DNA, 17 bp, Homo sapiens
tttccctagaaagccat

SEQ ID NO: 6755757 - DNA, 15 bp, Homo sapiens
tttccctatccacag

SEQ ID NO: 6755758 - DNA, 13 bp, Homo sapiens
tttccctatttta

SEQ ID NO: 6755759 - DNA, 20 bp, Homo sapiens
tttccctattttaggctatt

SEQ ID NO: 6755760 - DNA, 19 bp, Homo sapiens
tttccctcaccccctccca

SEQ ID NO: 6755761 - DNA, 16 bp, Homo sapiens
tttccctcagaaaatg

SEQ ID NO: 6755762 - DNA, 19 bp, Homo sapiens
tttccctccactccttcct

SEQ ID NO: 6755763 - DNA, 18 bp, Homo sapiens
tttccctccccagagttc

SEQ ID NO: 6755764 - DNA, 14 bp, Homo sapiens
tttccctccttggt

SEQ ID NO: 6755765 - DNA, 16 bp, Homo sapiens
tttccctcctttcctt

SEQ ID NO: 6755766 - DNA, 17 bp, Homo sapiens
tttccctcctttccttt

SEQ ID NO: 6755767 - DNA, 22 bp, Homo sapiens
tttccctctcccagtccatttc

SEQ ID NO: 6755768 - DNA, 13 bp, Homo sapiens
tttccctctcctt

SEQ ID NO: 6755769 - DNA, 13 bp, Homo sapiens
tttccctctctag

SEQ ID NO: 6755770 - DNA, 12 bp, Homo sapiens
tttccctctttt

SEQ ID NO: 6755771 - DNA, 13 bp, Homo sapiens
tttccctgaagtt

SEQ ID NO: 6755772 - DNA, 13 bp, Homo sapiens
tttccctgacctc

SEQ ID NO: 6755773 - DNA, 15 bp, Homo sapiens
tttccctgcatccct

SEQ ID NO: 6755774 - DNA, 20 bp, Homo sapiens
tttccctgccacatccagct

SEQ ID NO: 6755775 - DNA, 17 bp, Homo sapiens
tttccctgcccctgtcc

SEQ ID NO: 6755776 - DNA, 13 bp, Homo sapiens
tttccctgcctct

SEQ ID NO: 6755777 - DNA, 16 bp, Homo sapiens
tttccctgcctctcat

SEQ ID NO: 6755778 - DNA, 21 bp, Homo sapiens
tttccctggaactcctggcct

SEQ ID NO: 6755779 - DNA, 22 bp, Homo sapiens
tttccctggaactcctggcctt

SEQ ID NO: 6755780 - DNA, 13 bp, Homo sapiens
tttccctggctca

SEQ ID NO: 6755781 - DNA, 13 bp, Homo sapiens
tttccctgtgtgg

SEQ ID NO: 6755782 - DNA, 19 bp, Homo sapiens
tttcccttacaaggtgggg

SEQ ID NO: 6755783 - DNA, 20 bp, Homo sapiens
tttcccttcagtaccctctc

SEQ ID NO: 6755784 - DNA, 16 bp, Homo sapiens
tttcccttcatgtttt

SEQ ID NO: 6755785 - DNA, 13 bp, Homo sapiens
tttcccttccagt

SEQ ID NO: 6755786 - DNA, 20 bp, Homo sapiens
tttcccttctggacactgag

SEQ ID NO: 6755787 - DNA, 20 bp, Homo sapiens
tttcccttgccctttccata

SEQ ID NO: 6755788 - DNA, 15 bp, Homo sapiens
tttcccttgccttat

SEQ ID NO: 6755789 - DNA, 15 bp, Homo sapiens
tttcccttgctgtac

SEQ ID NO: 6755790 - DNA, 17 bp, Homo sapiens
tttcccttgtagctcct

SEQ ID NO: 6755791 - DNA, 18 bp, Homo sapiens
tttcccttgtagctcctc

SEQ ID NO: 6755792 - DNA, 19 bp, Homo sapiens
tttccctttagctgtgtta

SEQ ID NO: 6755793 - DNA, 20 bp, Homo sapiens
tttcccttttcctctagaag

SEQ ID NO: 6755794 - DNA, 13 bp, Homo sapiens
tttcccttttctg

SEQ ID NO: 6755795 - DNA, 16 bp, Homo sapiens
tttcccttttctgtgt

SEQ ID NO: 6755796 - DNA, 19 bp, Homo sapiens
tttcccttttgtaagttga

SEQ ID NO: 6755797 - DNA, 21 bp, Homo sapiens
tttccgaaaggcaattatatc

SEQ ID NO: 6755798 - DNA, 15 bp, Homo sapiens
tttccgactgcccag

SEQ ID NO: 6755799 - DNA, 17 bp, Homo sapiens
tttccgccacatccctc

SEQ ID NO: 6755800 - DNA, 12 bp, Homo sapiens
tttccgcccaca

SEQ ID NO: 6755801 - DNA, 19 bp, Homo sapiens
tttccgcccactcctggga

SEQ ID NO: 6755802 - DNA, 17 bp, Homo sapiens
tttccggcacactgcca

SEQ ID NO: 6755803 - DNA, 15 bp, Homo sapiens
tttccggggctgctg

SEQ ID NO: 6755804 - DNA, 17 bp, Homo sapiens
tttccgtagcagttttg

SEQ ID NO: 6755805 - DNA, 23 bp, Homo sapiens
tttccgtagcagttttgaaacct

SEQ ID NO: 6755806 - DNA, 19 bp, Homo sapiens
tttccgtctccctaaaata

SEQ ID NO: 6755807 - DNA, 23 bp, Homo sapiens
tttccgtgaagggcaccgagaac

SEQ ID NO: 6755808 - DNA, 20 bp, Homo sapiens
tttccgtgagagtcatctca

SEQ ID NO: 6755809 - DNA, 22 bp, Homo sapiens
tttccgtggcaaccctcagctg

SEQ ID NO: 6755810 - DNA, 15 bp, Homo sapiens
tttccgtgtgtttat

SEQ ID NO: 6755811 - DNA, 16 bp, Homo sapiens
tttccgtttgcttttg

SEQ ID NO: 6755812 - DNA, 22 bp, Homo sapiens
tttcctaaaaataagctttatt

SEQ ID NO: 6755813 - DNA, 13 bp, Homo sapiens
tttcctaaacata

SEQ ID NO: 6755814 - DNA, 18 bp, Homo sapiens
tttcctaaacataattgt

SEQ ID NO: 6755815 - DNA, 22 bp, Homo sapiens
tttcctaaagccaaagtttctg

SEQ ID NO: 6755816 - DNA, 17 bp, Homo sapiens
tttcctaaatgcagtga

SEQ ID NO: 6755817 - DNA, 13 bp, Homo sapiens
tttcctaaatgtt

SEQ ID NO: 6755818 - DNA, 20 bp, Homo sapiens
tttcctaagacatttttcat

SEQ ID NO: 6755819 - DNA, 14 bp, Homo sapiens
tttcctaaggaaac

SEQ ID NO: 6755820 - DNA, 20 bp, Homo sapiens
tttcctaaggaaactgcttt

SEQ ID NO: 6755821 - DNA, 22 bp, Homo sapiens
tttcctaaggaaactgctttat

SEQ ID NO: 6755822 - DNA, 15 bp, Homo sapiens
tttcctaaggctgca

SEQ ID NO: 6755823 - DNA, 21 bp, Homo sapiens
tttcctaataaagttctgtac

SEQ ID NO: 6755824 - DNA, 15 bp, Homo sapiens
tttcctaatatcaaa

SEQ ID NO: 6755825 - DNA, 20 bp, Homo sapiens
tttcctaatgagatatatct

SEQ ID NO: 6755826 - DNA, 14 bp, Homo sapiens
tttcctacaaaatg

SEQ ID NO: 6755827 - DNA, 16 bp, Homo sapiens
tttcctacaagttaac

SEQ ID NO: 6755828 - DNA, 16 bp, Homo sapiens
tttcctacctatatta

SEQ ID NO: 6755829 - DNA, 20 bp, Homo sapiens
tttcctacttataaagtaga

SEQ ID NO: 6755830 - DNA, 21 bp, Homo sapiens
tttcctacttgcactcttcta

SEQ ID NO: 6755831 - DNA, 14 bp, Homo sapiens
tttcctagaggttc

SEQ ID NO: 6755832 - DNA, 23 bp, Homo sapiens
tttcctagatggcagtcactgaa

SEQ ID NO: 6755833 - DNA, 18 bp, Homo sapiens
tttcctagcacacacttt

SEQ ID NO: 6755834 - DNA, 23 bp, Homo sapiens
tttcctagccctctcacatttat

SEQ ID NO: 6755835 - DNA, 15 bp, Homo sapiens
tttcctagcctgttt

SEQ ID NO: 6755836 - DNA, 22 bp, Homo sapiens
tttcctagctaggagcaggctt

SEQ ID NO: 6755837 - DNA, 22 bp, Homo sapiens
tttcctagtggagttttataaa

SEQ ID NO: 6755838 - DNA, 14 bp, Homo sapiens
tttcctatccttat

SEQ ID NO: 6755839 - DNA, 15 bp, Homo sapiens
tttcctatctttaca

SEQ ID NO: 6755840 - DNA, 22 bp, Homo sapiens
tttctctccctctttttctctg

SEQ ID NO: 6755841 - DNA, 15 bp, Homo sapiens
tttctctcctggctc

SEQ ID NO: 6755842 - DNA, 18 bp, Homo sapiens
tttctctctacagtgcca

SEQ ID NO: 6755843 - DNA, 17 bp, Homo sapiens
tttctctctcactctct

SEQ ID NO: 6755844 - DNA, 14 bp, Homo sapiens
tttctctctccagt

SEQ ID NO: 6755845 - DNA, 15 bp, Homo sapiens
tttctctctcctggt

SEQ ID NO: 6755846 - DNA, 20 bp, Homo sapiens
tttctctctctctacctttt

SEQ ID NO: 6755847 - DNA, 21 bp, Homo sapiens
tttctctctctctacctttta

SEQ ID NO: 6755848 - DNA, 14 bp, Homo sapiens
tttctctctggatg

SEQ ID NO: 6755849 - DNA, 13 bp, Homo sapiens
tttctctctggct

SEQ ID NO: 6755850 - DNA, 11 bp, Homo sapiens
tttctctctgt

SEQ ID NO: 6755851 - DNA, 17 bp, Homo sapiens
tttctctctgtgtggca

SEQ ID NO: 6755852 - DNA, 14 bp, Homo sapiens
tttctctcttccct

SEQ ID NO: 6755853 - DNA, 12 bp, Homo sapiens
tttctctgaaaa

SEQ ID NO: 6755854 - DNA, 15 bp, Homo sapiens
tttctctgaaagtgt

SEQ ID NO: 6755855 - DNA, 23 bp, Homo sapiens
tttctctgagaaccaaaagatgc

SEQ ID NO: 6755856 - DNA, 16 bp, Homo sapiens
tttctctgagagagat

SEQ ID NO: 6755857 - DNA, 18 bp, Homo sapiens
tttctctgagagagatga

SEQ ID NO: 6755858 - DNA, 16 bp, Homo sapiens
tttctctgatacagaa

SEQ ID NO: 6755859 - DNA, 17 bp, Homo sapiens
tttctctgatacagaaa

SEQ ID NO: 6755860 - DNA, 18 bp, Homo sapiens
tttctctgatacagaaaa

SEQ ID NO: 6755861 - DNA, 13 bp, Homo sapiens
tttctctgcagaa

SEQ ID NO: 6755862 - DNA, 23 bp, Homo sapiens
tttctctgccgctacctccctcc

SEQ ID NO: 6755863 - DNA, 17 bp, Homo sapiens
tttctctgcctctgggc

SEQ ID NO: 6755864 - DNA, 23 bp, Homo sapiens
tttctctgcctctgggcagcctg

SEQ ID NO: 6755865 - DNA, 12 bp, Homo sapiens
tttctctgcctg

SEQ ID NO: 6755866 - DNA, 13 bp, Homo sapiens
tttctctgctctt

SEQ ID NO: 6755867 - DNA, 16 bp, Homo sapiens
tttctctgcttgccta

SEQ ID NO: 6755868 - DNA, 12 bp, Homo sapiens
tttctctgggct

SEQ ID NO: 6755869 - DNA, 16 bp, Homo sapiens
tttctctgtacttttc

SEQ ID NO: 6755870 - DNA, 18 bp, Homo sapiens
tttctctgtacttttcat

SEQ ID NO: 6755871 - DNA, 13 bp, Homo sapiens
tttctctgtagtt

SEQ ID NO: 6755872 - DNA, 17 bp, Homo sapiens
tttctctgtagttccta

SEQ ID NO: 6755873 - DNA, 17 bp, Homo sapiens
tttctctgtatagtact

SEQ ID NO: 6755874 - DNA, 11 bp, Homo sapiens
tttctctgtgg

SEQ ID NO: 6755875 - DNA, 20 bp, Homo sapiens
tttctctgtgtggttcagct

SEQ ID NO: 6755876 - DNA, 18 bp, Homo sapiens
tttctctgtgtttgttcc

SEQ ID NO: 6755877 - DNA, 19 bp, Homo sapiens
tttctcttactatatttat

SEQ ID NO: 6755878 - DNA, 12 bp, Homo sapiens
tttctcttagag

SEQ ID NO: 6755879 - DNA, 15 bp, Homo sapiens
tttctcttagagatt

SEQ ID NO: 6755880 - DNA, 21 bp, Homo sapiens
tttctcttcagtgtgttgact

SEQ ID NO: 6755881 - DNA, 11 bp, Homo sapiens
tttctcttcat

SEQ ID NO: 6755882 - DNA, 18 bp, Homo sapiens
tttctcttccccttcctg

SEQ ID NO: 6755883 - DNA, 12 bp, Homo sapiens
tttctcttccct

SEQ ID NO: 6755884 - DNA, 19 bp, Homo sapiens
tttctcttcccttcccaga

SEQ ID NO: 6755885 - DNA, 14 bp, Homo sapiens
tttctcttcctaaa

SEQ ID NO: 6755886 - DNA, 21 bp, Homo sapiens
tttctcttctacccttttcct

SEQ ID NO: 6755887 - DNA, 21 bp, Homo sapiens
tttctcttctcagctcttcca

SEQ ID NO: 6755888 - DNA, 20 bp, Homo sapiens
tttctcttctccccttccat

SEQ ID NO: 6755889 - DNA, 11 bp, Homo sapiens
tttctcttggg

SEQ ID NO: 6755890 - DNA, 12 bp, Homo sapiens
tttctcttgggc

SEQ ID NO: 6755891 - DNA, 21 bp, Homo sapiens
tttctcttgggctgagactgg

SEQ ID NO: 6755892 - DNA, 12 bp, Homo sapiens
tttctcttgtac

SEQ ID NO: 6755893 - DNA, 20 bp, Homo sapiens
tttctctttccctggtccct

SEQ ID NO: 6755894 - DNA, 12 bp, Homo sapiens
tttctctttctc

SEQ ID NO: 6755895 - DNA, 13 bp, Homo sapiens
tttctctttctct

SEQ ID NO: 6755896 - DNA, 16 bp, Homo sapiens
tttctctttctctcct

SEQ ID NO: 6755897 - DNA, 17 bp, Homo sapiens
tttctctttctctctca

SEQ ID NO: 6755898 - DNA, 20 bp, Homo sapiens
tttctctttcttcctttact

SEQ ID NO: 6755899 - DNA, 14 bp, Homo sapiens
tttctctttcttta

SEQ ID NO: 6755900 - DNA, 15 bp, Homo sapiens
tttctctttgaaaca

SEQ ID NO: 6755901 - DNA, 20 bp, Homo sapiens
tttctctttgaaacatgctt

SEQ ID NO: 6755902 - DNA, 15 bp, Homo sapiens
tttctctttgattat

SEQ ID NO: 6755903 - DNA, 21 bp, Homo sapiens
tttctctttgattatttgcat

SEQ ID NO: 6755904 - DNA, 22 bp, Homo sapiens
tttctctttgattatttgcatg

SEQ ID NO: 6755905 - DNA, 13 bp, Homo sapiens
tttctctttgcca

SEQ ID NO: 6755906 - DNA, 21 bp, Homo sapiens
tttctctttgggtttcttgtt

SEQ ID NO: 6755907 - DNA, 12 bp, Homo sapiens
tttctcttttaa

SEQ ID NO: 6755908 - DNA, 14 bp, Homo sapiens
tttctcttttcaca

SEQ ID NO: 6755909 - DNA, 17 bp, Homo sapiens
tttctcttttctagttt

SEQ ID NO: 6755910 - DNA, 20 bp, Homo sapiens
tttctcttttttaaaaacaa

SEQ ID NO: 6755911 - DNA, 12 bp, Homo sapiens
tttctgaaaaca

SEQ ID NO: 6755912 - DNA, 14 bp, Homo sapiens
tttctgaaaagaaa

SEQ ID NO: 6755913 - DNA, 20 bp, Homo sapiens
tttctgaaaattaacactgc

SEQ ID NO: 6755914 - DNA, 17 bp, Homo sapiens
tttctgaaactaatgaa

SEQ ID NO: 6755915 - DNA, 18 bp, Homo sapiens
tttctgaaactaatgaaa

SEQ ID NO: 6755916 - DNA, 20 bp, Homo sapiens
tttctgaaactcccttgtgt

SEQ ID NO: 6755917 - DNA, 23 bp, Homo sapiens
tttctgaaagatgagtaatttct

SEQ ID NO: 6755918 - DNA, 22 bp, Homo sapiens
tttctgaaagtattcacatcat

SEQ ID NO: 6755919 - DNA, 19 bp, Homo sapiens
tttctgaaatttcctggga

SEQ ID NO: 6755920 - DNA, 19 bp, Homo sapiens
tttctgaacagctggtgta

SEQ ID NO: 6755921 - DNA, 22 bp, Homo sapiens
tttctgaacagctggtgtagct

SEQ ID NO: 6755922 - DNA, 17 bp, Homo sapiens
tttctgaactctgacag

SEQ ID NO: 6755923 - DNA, 15 bp, Homo sapiens
tttctgaactgttac

SEQ ID NO: 6755924 - DNA, 16 bp, Homo sapiens
tttctgaactgttaca

SEQ ID NO: 6755925 - DNA, 23 bp, Homo sapiens
tttctgaagaagttaattcttaa

SEQ ID NO: 6755926 - DNA, 15 bp, Homo sapiens
tttctgaagctttac

SEQ ID NO: 6755927 - DNA, 18 bp, Homo sapiens
tttctgaagctttaccag

SEQ ID NO: 6755928 - DNA, 14 bp, Homo sapiens
tttctgaaggaaga

SEQ ID NO: 6755929 - DNA, 19 bp, Homo sapiens
tttctgaaggtagcattct

SEQ ID NO: 6755930 - DNA, 19 bp, Homo sapiens
tttctgaagtacttaaact

SEQ ID NO: 6755931 - DNA, 9 bp, Homo sapiens
tttctgaat

SEQ ID NO: 6755932 - DNA, 21 bp, Homo sapiens
tttctgaatattttaaatctt

SEQ ID NO: 6755933 - DNA, 23 bp, Homo sapiens
tttctgaatgtagacggaacagt

SEQ ID NO: 6755934 - DNA, 21 bp, Homo sapiens
tttctgaatgtttgtgtctgt

SEQ ID NO: 6755935 - DNA, 18 bp, Homo sapiens
tttctgaattcaaagctt

SEQ ID NO: 6755936 - DNA, 20 bp, Homo sapiens
tttctgaattcaaagcttgt

SEQ ID NO: 6755937 - DNA, 21 bp, Homo sapiens
tttctgaattcaaagcttgtg

SEQ ID NO: 6755938 - DNA, 22 bp, Homo sapiens
tttctgaattcataaaaataac

SEQ ID NO: 6755939 - DNA, 18 bp, Homo sapiens
tttctgaattggaaggga

SEQ ID NO: 6755940 - DNA, 19 bp, Homo sapiens
tttctgaatttcattctct

SEQ ID NO: 6755941 - DNA, 22 bp, Homo sapiens
tttctgaatttttttttaacat

SEQ ID NO: 6755942 - DNA, 16 bp, Homo sapiens
tttctgacatcagcac

SEQ ID NO: 6755943 - DNA, 13 bp, Homo sapiens
tttctgaccaaaa

SEQ ID NO: 6755944 - DNA, 19 bp, Homo sapiens
tttctgacccactgatctc

SEQ ID NO: 6755945 - DNA, 15 bp, Homo sapiens
tttctgactctaaaa

SEQ ID NO: 6755946 - DNA, 16 bp, Homo sapiens
tttctgactgtccctg

SEQ ID NO: 6755947 - DNA, 20 bp, Homo sapiens
tttctgacttctagctgtct

SEQ ID NO: 6755948 - DNA, 13 bp, Homo sapiens
tttctgagaaaga

SEQ ID NO: 6755949 - DNA, 15 bp, Homo sapiens
tttctgagaaagact

SEQ ID NO: 6755950 - DNA, 20 bp, Homo sapiens
tttctgagacagcttgtctg

SEQ ID NO: 6755951 - DNA, 11 bp, Homo sapiens
tttctgagacg

SEQ ID NO: 6755952 - DNA, 17 bp, Homo sapiens
tttctgagatgctcact

SEQ ID NO: 6755953 - DNA, 12 bp, Homo sapiens
tttctgagattt

SEQ ID NO: 6755954 - DNA, 18 bp, Homo sapiens
tttctgagattttagttc

SEQ ID NO: 6755955 - DNA, 18 bp, Homo sapiens
tttctgaggagaaacaaa

SEQ ID NO: 6755956 - DNA, 17 bp, Homo sapiens
tttctgaggctttatga

SEQ ID NO: 6755957 - DNA, 24 bp, Homo sapiens
tttctgataaagttccttaagcat

SEQ ID NO: 6755958 - DNA, 23 bp, Homo sapiens
tttctgataactagatggtgctg

SEQ ID NO: 6755959 - DNA, 20 bp, Homo sapiens
tttctgatacatctgtcagt

SEQ ID NO: 6755960 - DNA, 16 bp, Homo sapiens
tttctgatagtagtct

SEQ ID NO: 6755961 - DNA, 14 bp, Homo sapiens
tttctgatatagaa

SEQ ID NO: 6755962 - DNA, 13 bp, Homo sapiens
tttctgatccagt

SEQ ID NO: 6755963 - DNA, 16 bp, Homo sapiens
tttctgatccagtttt

SEQ ID NO: 6755964 - DNA, 20 bp, Homo sapiens
tttctgatccagttttgttt

SEQ ID NO: 6755965 - DNA, 11 bp, Homo sapiens
tttctgatctg

SEQ ID NO: 6755966 - DNA, 19 bp, Homo sapiens
tttctgatctgtactttgt

SEQ ID NO: 6755967 - DNA, 12 bp, Homo sapiens
tttctgatgatg

SEQ ID NO: 6755968 - DNA, 23 bp, Homo sapiens
tttctgatgatgtcggtcttgca

SEQ ID NO: 6755969 - DNA, 15 bp, Homo sapiens
tttctgatgttgcct

SEQ ID NO: 6755970 - DNA, 16 bp, Homo sapiens
tttctgatgttgcctt

SEQ ID NO: 6755971 - DNA, 16 bp, Homo sapiens
tttctgattagctttg

SEQ ID NO: 6755972 - DNA, 17 bp, Homo sapiens
tttctgattagctttgt

SEQ ID NO: 6755973 - DNA, 16 bp, Homo sapiens
tttctgattataagac

SEQ ID NO: 6755974 - DNA, 12 bp, Homo sapiens
tttctgattctt

SEQ ID NO: 6755975 - DNA, 23 bp, Homo sapiens
tttctgattgtaacgttgctgtg

SEQ ID NO: 6755976 - DNA, 15 bp, Homo sapiens
tttctgatttctgaa

SEQ ID NO: 6755977 - DNA, 19 bp, Homo sapiens
tttctgcaaacaaacacct

SEQ ID NO: 6755978 - DNA, 14 bp, Homo sapiens
tttctgcaaatgta

SEQ ID NO: 6755979 - DNA, 21 bp, Homo sapiens
tttctgcacagcttttccaaa

SEQ ID NO: 6755980 - DNA, 20 bp, Homo sapiens
tttctgcacaggtctctgtt

SEQ ID NO: 6755981 - DNA, 13 bp, Homo sapiens
tttctgcactgag

SEQ ID NO: 6755982 - DNA, 13 bp, Homo sapiens
tttctgcagaaaa

SEQ ID NO: 6755983 - DNA, 14 bp, Homo sapiens
tttctgcagaaatt

SEQ ID NO: 6755984 - DNA, 14 bp, Homo sapiens
tttctgcagccctt

SEQ ID NO: 6755985 - DNA, 18 bp, Homo sapiens
tttctgcagtattctgta

SEQ ID NO: 6755986 - DNA, 13 bp, Homo sapiens
tttctgcatatgt

SEQ ID NO: 6755987 - DNA, 15 bp, Homo sapiens
tttctgcatctccac

SEQ ID NO: 6755988 - DNA, 16 bp, Homo sapiens
tttctgcatgaccaaa

SEQ ID NO: 6755989 - DNA, 12 bp, Homo sapiens
tttctgcatttg

SEQ ID NO: 6755990 - DNA, 17 bp, Homo sapiens
tttctgccaataaattc

SEQ ID NO: 6755991 - DNA, 22 bp, Homo sapiens
tttctgccaataaattctaaat

SEQ ID NO: 6755992 - DNA, 24 bp, Homo sapiens
tttctgcccagccctctgtggcca

SEQ ID NO: 6755993 - DNA, 18 bp, Homo sapiens
tttctgccccccagggct

SEQ ID NO: 6755994 - DNA, 16 bp, Homo sapiens
tttctgccctgagccc

SEQ ID NO: 6755995 - DNA, 14 bp, Homo sapiens
tttctgccctggct

SEQ ID NO: 6755996 - DNA, 15 bp, Homo sapiens
tttctgcctccttta

SEQ ID NO: 6755997 - DNA, 13 bp, Homo sapiens
tttctgcctctca

SEQ ID NO: 6755998 - DNA, 14 bp, Homo sapiens
tttctgcctctcaa

SEQ ID NO: 6755999 - DNA, 14 bp, Homo sapiens
tttctgcctctcct

SEQ ID NO: 6756000 - DNA, 11 bp, Homo sapiens
tttctgcctga

SEQ ID NO: 6756001 - DNA, 13 bp, Homo sapiens
tttctgcctgaga

SEQ ID NO: 6756002 - DNA, 13 bp, Homo sapiens
tttctgccttcct

SEQ ID NO: 6756003 - DNA, 16 bp, Homo sapiens
tttctgccttttgttc

SEQ ID NO: 6756004 - DNA, 15 bp, Homo sapiens
tttctgcgtgcttta

SEQ ID NO: 6756005 - DNA, 18 bp, Homo sapiens
tttctgctaagttctccc

SEQ ID NO: 6756006 - DNA, 21 bp, Homo sapiens
tttctgctacctggttttcat

SEQ ID NO: 6756007 - DNA, 23 bp, Homo sapiens
tttctgctacctggttttcatta

SEQ ID NO: 6756008 - DNA, 19 bp, Homo sapiens
tttctgctcagcttctcct

SEQ ID NO: 6756009 - DNA, 22 bp, Homo sapiens
tttctgctccaaattttcaata

SEQ ID NO: 6756010 - DNA, 20 bp, Homo sapiens
tttctgctgaattttcacat

SEQ ID NO: 6756011 - DNA, 16 bp, Homo sapiens
tttctgctgtttacaa

SEQ ID NO: 6756012 - DNA, 19 bp, Homo sapiens
tttctgctgtttacaacat

SEQ ID NO: 6756013 - DNA, 14 bp, Homo sapiens
tttctgcttcctta

SEQ ID NO: 6756014 - DNA, 15 bp, Homo sapiens
tttctgcttctctct

SEQ ID NO: 6756015 - DNA, 19 bp, Homo sapiens
tttctgctttagacttgaa

SEQ ID NO: 6756016 - DNA, 14 bp, Homo sapiens
tttctggaaatgtt

SEQ ID NO: 6756017 - DNA, 23 bp, Homo sapiens
tttctggaaattcttccctgggg

SEQ ID NO: 6756018 - DNA, 13 bp, Homo sapiens
tttctggaagact

SEQ ID NO: 6756019 - DNA, 18 bp, Homo sapiens
tttctggaatacatgaaa

SEQ ID NO: 6756020 - DNA, 13 bp, Homo sapiens
tttgaatgcattt

SEQ ID NO: 6756021 - DNA, 18 bp, Homo sapiens
tttgaatgctgcaagtta

SEQ ID NO: 6756022 - DNA, 17 bp, Homo sapiens
tttgaatggattaaatg

SEQ ID NO: 6756023 - DNA, 19 bp, Homo sapiens
tttgaatgtaaaacaggaa

SEQ ID NO: 6756024 - DNA, 15 bp, Homo sapiens
tttgaatgtaaccaa

SEQ ID NO: 6756025 - DNA, 16 bp, Homo sapiens
tttgaatgtaaccaat

SEQ ID NO: 6756026 - DNA, 21 bp, Homo sapiens
tttgaatgtatttgatttata

SEQ ID NO: 6756027 - DNA, 23 bp, Homo sapiens
tttgaatgtcataaagaagagcc

SEQ ID NO: 6756028 - DNA, 11 bp, Homo sapiens
tttgaatgtta

SEQ ID NO: 6756029 - DNA, 21 bp, Homo sapiens
tttgaatgttaaataaattgt

SEQ ID NO: 6756030 - DNA, 23 bp, Homo sapiens
tttgaatgttaagaattgaccat

SEQ ID NO: 6756031 - DNA, 19 bp, Homo sapiens
tttgaatgttaattttttg

SEQ ID NO: 6756032 - DNA, 20 bp, Homo sapiens
tttgaatgttagatgcttag

SEQ ID NO: 6756033 - DNA, 20 bp, Homo sapiens
tttgaatgtttatgttctca

SEQ ID NO: 6756034 - DNA, 17 bp, Homo sapiens
tttgaattaatctagaa

SEQ ID NO: 6756035 - DNA, 16 bp, Homo sapiens
tttgaattatcagcaa

SEQ ID NO: 6756036 - DNA, 16 bp, Homo sapiens
tttgaattctgtgata

SEQ ID NO: 6756037 - DNA, 20 bp, Homo sapiens
tttgaattcttgatctctaa

SEQ ID NO: 6756038 - DNA, 16 bp, Homo sapiens
tttgaattgtgtctta

SEQ ID NO: 6756039 - DNA, 22 bp, Homo sapiens
tttgaattgtgtcttaatctct

SEQ ID NO: 6756040 - DNA, 14 bp, Homo sapiens
tttgaattgttaca

SEQ ID NO: 6756041 - DNA, 19 bp, Homo sapiens
tttgaatttaaataaagtt

SEQ ID NO: 6756042 - DNA, 19 bp, Homo sapiens
tttgaatttatataaagta

SEQ ID NO: 6756043 - DNA, 16 bp, Homo sapiens
tttgaatttttacatt

SEQ ID NO: 6756044 - DNA, 19 bp, Homo sapiens
tttgacaaaaatgtttgta

SEQ ID NO: 6756045 - DNA, 18 bp, Homo sapiens
tttgacaaaagtaaatgg

SEQ ID NO: 6756046 - DNA, 15 bp, Homo sapiens
tttgacaaagaaaaa

SEQ ID NO: 6756047 - DNA, 18 bp, Homo sapiens
tttgacaaaggtaaatca

SEQ ID NO: 6756048 - DNA, 17 bp, Homo sapiens
tttgacaacatggcttc

SEQ ID NO: 6756049 - DNA, 20 bp, Homo sapiens
tttgacaacgtttcagcgac

SEQ ID NO: 6756050 - DNA, 13 bp, Homo sapiens
tttgacaactaaa

SEQ ID NO: 6756051 - DNA, 17 bp, Homo sapiens
tttgacaaggaaaatct

SEQ ID NO: 6756052 - DNA, 16 bp, Homo sapiens
tttgacaattttgtct

SEQ ID NO: 6756053 - DNA, 22 bp, Homo sapiens
tttgacacaaagcttctaaagc

SEQ ID NO: 6756054 - DNA, 16 bp, Homo sapiens
tttgacacataaaagt

SEQ ID NO: 6756055 - DNA, 18 bp, Homo sapiens
tttgacacataaaagtaa

SEQ ID NO: 6756056 - DNA, 15 bp, Homo sapiens
tttgacaccttagag

SEQ ID NO: 6756057 - DNA, 19 bp, Homo sapiens
tttgacacttccattgttt

SEQ ID NO: 6756058 - DNA, 21 bp, Homo sapiens
tttgacacttccattgtttaa

SEQ ID NO: 6756059 - DNA, 15 bp, Homo sapiens
tttgacactttttgt

SEQ ID NO: 6756060 - DNA, 15 bp, Homo sapiens
tttgacagactattt

SEQ ID NO: 6756061 - DNA, 18 bp, Homo sapiens
tttgacagactatttgct

SEQ ID NO: 6756062 - DNA, 22 bp, Homo sapiens
tttgacagagttggtgttcata

SEQ ID NO: 6756063 - DNA, 17 bp, Homo sapiens
tttgacaggttttccaa

SEQ ID NO: 6756064 - DNA, 19 bp, Homo sapiens
tttgacagtgttgaaaatg

SEQ ID NO: 6756065 - DNA, 13 bp, Homo sapiens
tttgacagtgttt

SEQ ID NO: 6756066 - DNA, 23 bp, Homo sapiens
tttgacatcattcatgacaacat

SEQ ID NO: 6756067 - DNA, 23 bp, Homo sapiens
tttgacatgacgtggtaaaatgt

SEQ ID NO: 6756068 - DNA, 18 bp, Homo sapiens
tttgacatgagtctccag

SEQ ID NO: 6756069 - DNA, 13 bp, Homo sapiens
tttgacatgtgga

SEQ ID NO: 6756070 - DNA, 14 bp, Homo sapiens
tttgacattcttca

SEQ ID NO: 6756071 - DNA, 18 bp, Homo sapiens
tttgacattgatgtgttc

SEQ ID NO: 6756072 - DNA, 20 bp, Homo sapiens
tttgacattgcgtttgacct

SEQ ID NO: 6756073 - DNA, 12 bp, Homo sapiens
tttgacattgtc

SEQ ID NO: 6756074 - DNA, 19 bp, Homo sapiens
tttgacattgtcagaatgt

SEQ ID NO: 6756075 - DNA, 14 bp, Homo sapiens
tttgacatttaatt

SEQ ID NO: 6756076 - DNA, 16 bp, Homo sapiens
tttgacatttaattta

SEQ ID NO: 6756077 - DNA, 15 bp, Homo sapiens
tttgacatttatatt

SEQ ID NO: 6756078 - DNA, 20 bp, Homo sapiens
tttgacatttggtggtactt

SEQ ID NO: 6756079 - DNA, 15 bp, Homo sapiens
tttgacatttttgcc

SEQ ID NO: 6756080 - DNA, 20 bp, Homo sapiens
tttgacatttttgccaaaat

SEQ ID NO: 6756081 - DNA, 12 bp, Homo sapiens
tttgaccaaatc

SEQ ID NO: 6756082 - DNA, 14 bp, Homo sapiens
tttgaccactgaca

SEQ ID NO: 6756083 - DNA, 16 bp, Homo sapiens
tttgaccaggaaagca

SEQ ID NO: 6756084 - DNA, 22 bp, Homo sapiens
tttgaccatatagattttatta

SEQ ID NO: 6756085 - DNA, 14 bp, Homo sapiens
tttgaccccttcct

SEQ ID NO: 6756086 - DNA, 22 bp, Homo sapiens
tttgaccccttcctgtctggcc

SEQ ID NO: 6756087 - DNA, 18 bp, Homo sapiens
tttgacctcgactggttt

SEQ ID NO: 6756088 - DNA, 21 bp, Homo sapiens
tttgacctctcacttttttat

SEQ ID NO: 6756089 - DNA, 12 bp, Homo sapiens
tttgaccttccc

SEQ ID NO: 6756090 - DNA, 13 bp, Homo sapiens
tttgaccttcccc

SEQ ID NO: 6756091 - DNA, 13 bp, Homo sapiens
tttgaccttttat

SEQ ID NO: 6756092 - DNA, 16 bp, Homo sapiens
tttgacgaagaaacaa

SEQ ID NO: 6756093 - DNA, 13 bp, Homo sapiens
tttgacgccatcc

SEQ ID NO: 6756094 - DNA, 20 bp, Homo sapiens
tttgacgggaggcctcagtt

SEQ ID NO: 6756095 - DNA, 20 bp, Homo sapiens
tttgactaaagctatgttac

SEQ ID NO: 6756096 - DNA, 14 bp, Homo sapiens
tttgactaagaatt

SEQ ID NO: 6756097 - DNA, 19 bp, Homo sapiens
tttgactagatgatggatg

SEQ ID NO: 6756098 - DNA, 21 bp, Homo sapiens
tttgactcagttccaggcctg

SEQ ID NO: 6756099 - DNA, 19 bp, Homo sapiens
tttgactctggcaaagctt

SEQ ID NO: 6756100 - DNA, 20 bp, Homo sapiens
tttgactctggcaaagcttt

SEQ ID NO: 6756101 - DNA, 22 bp, Homo sapiens
tttgactctggggtgcagcttc

SEQ ID NO: 6756102 - DNA, 15 bp, Homo sapiens
tttgactctgtccaa

SEQ ID NO: 6756103 - DNA, 18 bp, Homo sapiens
tttgactcttgcaatcca

SEQ ID NO: 6756104 - DNA, 19 bp, Homo sapiens
tttgactgaagatgcagct

SEQ ID NO: 6756105 - DNA, 14 bp, Homo sapiens
tttgactgattgtt

SEQ ID NO: 6756106 - DNA, 15 bp, Homo sapiens
tttgactgtaatgta

SEQ ID NO: 6756107 - DNA, 12 bp, Homo sapiens
tttgactgtgct

SEQ ID NO: 6756108 - DNA, 19 bp, Homo sapiens
tttgactgtgctggagaat

SEQ ID NO: 6756109 - DNA, 16 bp, Homo sapiens
tttgactgtttttacc

SEQ ID NO: 6756110 - DNA, 19 bp, Homo sapiens
tttgactgtttttacccat

SEQ ID NO: 6756111 - DNA, 15 bp, Homo sapiens
tttgacttaagaaag

SEQ ID NO: 6756112 - DNA, 12 bp, Homo sapiens
tttgacttcagc

SEQ ID NO: 6756113 - DNA, 22 bp, Homo sapiens
tttgacttgaaccacaagtgaa

SEQ ID NO: 6756114 - DNA, 17 bp, Homo sapiens
tttgacttgcatgaaga

SEQ ID NO: 6756115 - DNA, 20 bp, Homo sapiens
tttgacttgccactgccata

SEQ ID NO: 6756116 - DNA, 14 bp, Homo sapiens
tttgacttggaaaa

SEQ ID NO: 6756117 - DNA, 17 bp, Homo sapiens
tttgacttgtttgtgca

SEQ ID NO: 6756118 - DNA, 18 bp, Homo sapiens
tttgactttctgtgtacc

SEQ ID NO: 6756119 - DNA, 17 bp, Homo sapiens
tttgactttcttctgaa

SEQ ID NO: 6756120 - DNA, 22 bp, Homo sapiens
tttgactttcttctgaatattt

SEQ ID NO: 6756121 - DNA, 12 bp, Homo sapiens
tttgacttttct

SEQ ID NO: 6756122 - DNA, 11 bp, Homo sapiens
tttgagaaaaa

SEQ ID NO: 6756123 - DNA, 16 bp, Homo sapiens
tttgagaaaataaagc

SEQ ID NO: 6756124 - DNA, 13 bp, Homo sapiens
tttgagaaaatat

SEQ ID NO: 6756125 - DNA, 17 bp, Homo sapiens
tttgagaaaatataata

SEQ ID NO: 6756126 - DNA, 22 bp, Homo sapiens
tttgagaaaatataataaaaga

SEQ ID NO: 6756127 - DNA, 13 bp, Homo sapiens
tttgagaaactgc

SEQ ID NO: 6756128 - DNA, 15 bp, Homo sapiens
tttgagaaagaaata

SEQ ID NO: 6756129 - DNA, 13 bp, Homo sapiens
tttgagaaatgca

SEQ ID NO: 6756130 - DNA, 18 bp, Homo sapiens
tttgagaacaaagatgac

SEQ ID NO: 6756131 - DNA, 19 bp, Homo sapiens
tttgagaactccagctggt

SEQ ID NO: 6756132 - DNA, 18 bp, Homo sapiens
tttgagaagaaaacatct

SEQ ID NO: 6756133 - DNA, 18 bp, Homo sapiens
tttgagaagttctcagaa

SEQ ID NO: 6756134 - DNA, 21 bp, Homo sapiens
tttgagaagttctcagaataa

SEQ ID NO: 6756135 - DNA, 15 bp, Homo sapiens
tttgagaatacataa

SEQ ID NO: 6756136 - DNA, 20 bp, Homo sapiens
tttgagaataggggattttt

SEQ ID NO: 6756137 - DNA, 18 bp, Homo sapiens
tttgagacaagccctggc

SEQ ID NO: 6756138 - DNA, 20 bp, Homo sapiens
tttgagacagagtcttcctc

SEQ ID NO: 6756139 - DNA, 13 bp, Homo sapiens
tttgagacaggag

SEQ ID NO: 6756140 - DNA, 21 bp, Homo sapiens
tttgagacagggtctcactct

SEQ ID NO: 6756141 - DNA, 19 bp, Homo sapiens
tttgagacaggtgcctggg

SEQ ID NO: 6756142 - DNA, 15 bp, Homo sapiens
tttgagacagtttct

SEQ ID NO: 6756143 - DNA, 16 bp, Homo sapiens
tttgagacagtttctt

SEQ ID NO: 6756144 - DNA, 17 bp, Homo sapiens
tttgagacagtttctta

SEQ ID NO: 6756145 - DNA, 18 bp, Homo sapiens
tttgagacagtttcttag

SEQ ID NO: 6756146 - DNA, 16 bp, Homo sapiens
tttgagaccagaagaa

SEQ ID NO: 6756147 - DNA, 17 bp, Homo sapiens
tttgagaccagaagaaa

SEQ ID NO: 6756148 - DNA, 16 bp, Homo sapiens
tttgagaccagcctgg

SEQ ID NO: 6756149 - DNA, 17 bp, Homo sapiens
tttgagaccagcctggg

SEQ ID NO: 6756150 - DNA, 19 bp, Homo sapiens
tttgagactgaaatttagt

SEQ ID NO: 6756151 - DNA, 18 bp, Homo sapiens
tttgagagaagccacgct

SEQ ID NO: 6756152 - DNA, 22 bp, Homo sapiens
tttgagagagagtcttactctg

SEQ ID NO: 6756153 - DNA, 12 bp, Homo sapiens
tttgagagaggg

SEQ ID NO: 6756154 - DNA, 23 bp, Homo sapiens
tttgagagcctttggtgaataac

SEQ ID NO: 6756155 - DNA, 22 bp, Homo sapiens
tttgagatactattttcatttt

SEQ ID NO: 6756156 - DNA, 22 bp, Homo sapiens
tttgagatattaatgcccagac

SEQ ID NO: 6756157 - DNA, 21 bp, Homo sapiens
tttgagatctaaaaataactg

SEQ ID NO: 6756158 - DNA, 20 bp, Homo sapiens
tttgagatggagtttctctc

SEQ ID NO: 6756159 - DNA, 17 bp, Homo sapiens
tttgagatgtttttaat

SEQ ID NO: 6756160 - DNA, 20 bp, Homo sapiens
tttgagattgccccaggtct

SEQ ID NO: 6756161 - DNA, 16 bp, Homo sapiens
tttgagatttcagcta

SEQ ID NO: 6756162 - DNA, 22 bp, Homo sapiens
tttgagatttttggttttttga

SEQ ID NO: 6756163 - DNA, 23 bp, Homo sapiens
tttgagcaaagaaacttgtgctt

SEQ ID NO: 6756164 - DNA, 21 bp, Homo sapiens
tttgagcaactaactaaccac

SEQ ID NO: 6756165 - DNA, 15 bp, Homo sapiens
tttgagcaactttct

SEQ ID NO: 6756166 - DNA, 23 bp, Homo sapiens
tttgagcaattcatttcacttta

SEQ ID NO: 6756167 - DNA, 17 bp, Homo sapiens
tttgagcacaatctgtt

SEQ ID NO: 6756168 - DNA, 19 bp, Homo sapiens
tttgagcagatcttggaat

SEQ ID NO: 6756169 - DNA, 21 bp, Homo sapiens
tttgagcccattcttctgggt

SEQ ID NO: 6756170 - DNA, 21 bp, Homo sapiens
tttgagcctcagaccccaggt

SEQ ID NO: 6756171 - DNA, 18 bp, Homo sapiens
tttgagccttattaaaat

SEQ ID NO: 6756172 - DNA, 17 bp, Homo sapiens
tttgagcctttattggt

SEQ ID NO: 6756173 - DNA, 18 bp, Homo sapiens
tttgagctactggattct

SEQ ID NO: 6756174 - DNA, 20 bp, Homo sapiens
tttgagctactggattctta

SEQ ID NO: 6756175 - DNA, 18 bp, Homo sapiens
tttgagctatttccttcc

SEQ ID NO: 6756176 - DNA, 10 bp, Homo sapiens
tttgagctcc

SEQ ID NO: 6756177 - DNA, 19 bp, Homo sapiens
tttgagctcccacttctgc

SEQ ID NO: 6756178 - DNA, 19 bp, Homo sapiens
tttgagctgaaatgctgca

SEQ ID NO: 6756179 - DNA, 21 bp, Homo sapiens
tttgagctgaaatgctgcatt

SEQ ID NO: 6756180 - DNA, 20 bp, Homo sapiens
tttgaggaagtggctgtccc

SEQ ID NO: 6756181 - DNA, 15 bp, Homo sapiens
tttgaggaagttttg

SEQ ID NO: 6756182 - DNA, 18 bp, Homo sapiens
tttgaggaagttttgtct

SEQ ID NO: 6756183 - DNA, 19 bp, Homo sapiens
tttgaggaagttttgtcta

SEQ ID NO: 6756184 - DNA, 17 bp, Homo sapiens
tttgaggaccctcccag

SEQ ID NO: 6756185 - DNA, 18 bp, Homo sapiens
tttgaggaccctcccagg

SEQ ID NO: 6756186 - DNA, 16 bp, Homo sapiens
tttgaggactgaagct

SEQ ID NO: 6756187 - DNA, 23 bp, Homo sapiens
tttgaggagaagggggtctctgt

SEQ ID NO: 6756188 - DNA, 20 bp, Homo sapiens
tttgaggagcagcttcagtt

SEQ ID NO: 6756189 - DNA, 15 bp, Homo sapiens
tttgaggaggaagca

SEQ ID NO: 6756190 - DNA, 15 bp, Homo sapiens
tttgaggataacttt

SEQ ID NO: 6756191 - DNA, 20 bp, Homo sapiens
tttgaggatatattttcact

SEQ ID NO: 6756192 - DNA, 14 bp, Homo sapiens
tttgaggcaaaaga

SEQ ID NO: 6756193 - DNA, 19 bp, Homo sapiens
tttgaggcaaattaactgt

SEQ ID NO: 6756194 - DNA, 21 bp, Homo sapiens
tttgaggctggcggggtctgc

SEQ ID NO: 6756195 - DNA, 22 bp, Homo sapiens
tttgaggggaggagatggaaac

SEQ ID NO: 6756196 - DNA, 21 bp, Homo sapiens
tttgaggggccaggggcaggc

SEQ ID NO: 6756197 - DNA, 24 bp, Homo sapiens
tttggaaacagtataatttgacaa

SEQ ID NO: 6756198 - DNA, 18 bp, Homo sapiens
tttggaaactaataaaat

SEQ ID NO: 6756199 - DNA, 19 bp, Homo sapiens
tttggaaactaataaaata

SEQ ID NO: 6756200 - DNA, 18 bp, Homo sapiens
tttggaaagacctgtgag

SEQ ID NO: 6756201 - DNA, 20 bp, Homo sapiens
tttggaaagcaaggtttcct

SEQ ID NO: 6756202 - DNA, 22 bp, Homo sapiens
tttggaaagtacactctgctgt

SEQ ID NO: 6756203 - DNA, 16 bp, Homo sapiens
tttggaaagtagaaaa

SEQ ID NO: 6756204 - DNA, 18 bp, Homo sapiens
tttggaaagttactgtaa

SEQ ID NO: 6756205 - DNA, 11 bp, Homo sapiens
tttggaaatcc

SEQ ID NO: 6756206 - DNA, 20 bp, Homo sapiens
tttggaaatggggagctggc

SEQ ID NO: 6756207 - DNA, 24 bp, Homo sapiens
tttggaaatggggagctggcctag

SEQ ID NO: 6756208 - DNA, 15 bp, Homo sapiens
tttggaaattttagt

SEQ ID NO: 6756209 - DNA, 16 bp, Homo sapiens
tttggaacagtgacaa

SEQ ID NO: 6756210 - DNA, 21 bp, Homo sapiens
tttggaacagtgctactgaaa

SEQ ID NO: 6756211 - DNA, 21 bp, Homo sapiens
tttggaaccagactcttgcct

SEQ ID NO: 6756212 - DNA, 21 bp, Homo sapiens
tttggaactgcgataactgag

SEQ ID NO: 6756213 - DNA, 18 bp, Homo sapiens
tttggaactgtgtttcaa

SEQ ID NO: 6756214 - DNA, 22 bp, Homo sapiens
tttggaagaaaaaaatcttctc

SEQ ID NO: 6756215 - DNA, 18 bp, Homo sapiens
tttggaagaagtttttta

SEQ ID NO: 6756216 - DNA, 19 bp, Homo sapiens
tttggaagacatatattat

SEQ ID NO: 6756217 - DNA, 23 bp, Homo sapiens
tttggaagagaggcacctgctgg

SEQ ID NO: 6756218 - DNA, 18 bp, Homo sapiens
tttggaagcaacgtgtta

SEQ ID NO: 6756219 - DNA, 19 bp, Homo sapiens
tttggaagcactttttctg

SEQ ID NO: 6756220 - DNA, 13 bp, Homo sapiens
tttggaagcagca

SEQ ID NO: 6756221 - DNA, 17 bp, Homo sapiens
tttggaagctctgttgc

SEQ ID NO: 6756222 - DNA, 15 bp, Homo sapiens
tttggaagctcttct

SEQ ID NO: 6756223 - DNA, 11 bp, Homo sapiens
tttggaaggag

SEQ ID NO: 6756224 - DNA, 21 bp, Homo sapiens
tttggaaggttttaacattga

SEQ ID NO: 6756225 - DNA, 13 bp, Homo sapiens
tttggaagttaaa

SEQ ID NO: 6756226 - DNA, 18 bp, Homo sapiens
tttggaagtttgtgttct

SEQ ID NO: 6756227 - DNA, 23 bp, Homo sapiens
tttggaatattccactatttgca

SEQ ID NO: 6756228 - DNA, 14 bp, Homo sapiens
tttggaatatttga

SEQ ID NO: 6756229 - DNA, 18 bp, Homo sapiens
tttggaatatttgaataa

SEQ ID NO: 6756230 - DNA, 19 bp, Homo sapiens
tttggaatatttgaataat

SEQ ID NO: 6756231 - DNA, 16 bp, Homo sapiens
tttggaatatttgctt

SEQ ID NO: 6756232 - DNA, 13 bp, Homo sapiens
tttggaatctaac

SEQ ID NO: 6756233 - DNA, 13 bp, Homo sapiens
tttggaatctaga

SEQ ID NO: 6756234 - DNA, 22 bp, Homo sapiens
tttggaatgaaattcctccttc

SEQ ID NO: 6756235 - DNA, 15 bp, Homo sapiens
tttggaatgaacaat

SEQ ID NO: 6756236 - DNA, 11 bp, Homo sapiens
tttggaatgtg

SEQ ID NO: 6756237 - DNA, 19 bp, Homo sapiens
tttggaattattgtagaca

SEQ ID NO: 6756238 - DNA, 15 bp, Homo sapiens
tttggaattgacatt

SEQ ID NO: 6756239 - DNA, 22 bp, Homo sapiens
tttggaatttttgcttgacttc

SEQ ID NO: 6756240 - DNA, 15 bp, Homo sapiens
tttggacaaaatgga

SEQ ID NO: 6756241 - DNA, 14 bp, Homo sapiens
tttggacaagagga

SEQ ID NO: 6756242 - DNA, 13 bp, Homo sapiens
tttggacagttta

SEQ ID NO: 6756243 - DNA, 18 bp, Homo sapiens
tttggaccaaaaaccagt

SEQ ID NO: 6756244 - DNA, 22 bp, Homo sapiens
tttggaccaaaaaccagtattg

SEQ ID NO: 6756245 - DNA, 20 bp, Homo sapiens
tttggaccaatagcccacag

SEQ ID NO: 6756246 - DNA, 15 bp, Homo sapiens
tttggacccagggcc

SEQ ID NO: 6756247 - DNA, 16 bp, Homo sapiens
tttggaccccagctgg

SEQ ID NO: 6756248 - DNA, 17 bp, Homo sapiens
tttggaccccagctggg

SEQ ID NO: 6756249 - DNA, 13 bp, Homo sapiens
tttggaccctgag

SEQ ID NO: 6756250 - DNA, 16 bp, Homo sapiens
tttggacctaatccaa

SEQ ID NO: 6756251 - DNA, 20 bp, Homo sapiens
tttggactcagcccacctgc

SEQ ID NO: 6756252 - DNA, 18 bp, Homo sapiens
tttggactccatctctca

SEQ ID NO: 6756253 - DNA, 14 bp, Homo sapiens
tttggactctgcct

SEQ ID NO: 6756254 - DNA, 19 bp, Homo sapiens
tttggactgagatttctta

SEQ ID NO: 6756255 - DNA, 12 bp, Homo sapiens
tttggactgagt

SEQ ID NO: 6756256 - DNA, 17 bp, Homo sapiens
tttggactgatttgtgg

SEQ ID NO: 6756257 - DNA, 15 bp, Homo sapiens
tttggactgttttca

SEQ ID NO: 6756258 - DNA, 16 bp, Homo sapiens
tttggactgttttgtt

SEQ ID NO: 6756259 - DNA, 21 bp, Homo sapiens
tttggactttgtatactttaa

SEQ ID NO: 6756260 - DNA, 14 bp, Homo sapiens
tttggagactttct

SEQ ID NO: 6756261 - DNA, 23 bp, Homo sapiens
tttggagagctcagtacagggca

SEQ ID NO: 6756262 - DNA, 21 bp, Homo sapiens
tttggagagggaaaatcttca

SEQ ID NO: 6756263 - DNA, 20 bp, Homo sapiens
tttggagagggggcctggga

SEQ ID NO: 6756264 - DNA, 22 bp, Homo sapiens
tttggagcattaactaaatgct

SEQ ID NO: 6756265 - DNA, 17 bp, Homo sapiens
tttggaggctgctgccc

SEQ ID NO: 6756266 - DNA, 16 bp, Homo sapiens
tttggagggatcattt

SEQ ID NO: 6756267 - DNA, 11 bp, Homo sapiens
tttggagggga

SEQ ID NO: 6756268 - DNA, 23 bp, Homo sapiens
tttggaggggaaatggggaaagc

SEQ ID NO: 6756269 - DNA, 20 bp, Homo sapiens
tttggagtcagacagatgtg

SEQ ID NO: 6756270 - DNA, 20 bp, Homo sapiens
tttggagtcccctcacctcc

SEQ ID NO: 6756271 - DNA, 13 bp, Homo sapiens
tttggataataaa

SEQ ID NO: 6756272 - DNA, 16 bp, Homo sapiens
tttggataataaggaa

SEQ ID NO: 6756273 - DNA, 20 bp, Homo sapiens
tttggatatattattgtaag

SEQ ID NO: 6756274 - DNA, 19 bp, Homo sapiens
tttggatatgtaaaacatt

SEQ ID NO: 6756275 - DNA, 21 bp, Homo sapiens
tttggatatttttgtacttga

SEQ ID NO: 6756276 - DNA, 15 bp, Homo sapiens
tttggatcttgaatg

SEQ ID NO: 6756277 - DNA, 10 bp, Homo sapiens
tttggatgcc

SEQ ID NO: 6756278 - DNA, 19 bp, Homo sapiens
tttggatgggagtgagaca

SEQ ID NO: 6756279 - DNA, 21 bp, Homo sapiens
tttggatgggagtgagacaga

SEQ ID NO: 6756280 - DNA, 23 bp, Homo sapiens
tttggatggggctggcatgtttt

SEQ ID NO: 6756281 - DNA, 22 bp, Homo sapiens
tttggatgtcctcaaagaagtg

SEQ ID NO: 6756282 - DNA, 18 bp, Homo sapiens
tttggatgtctgtagcat

SEQ ID NO: 6756283 - DNA, 11 bp, Homo sapiens
tttggatgtgt

SEQ ID NO: 6756284 - DNA, 20 bp, Homo sapiens
tttggatgttgctatagtga

SEQ ID NO: 6756285 - DNA, 21 bp, Homo sapiens
tttggatgttgctatagtgac

SEQ ID NO: 6756286 - DNA, 18 bp, Homo sapiens
tttggattattctttctc

SEQ ID NO: 6756287 - DNA, 15 bp, Homo sapiens
tttggattcctcaca

SEQ ID NO: 6756288 - DNA, 14 bp, Homo sapiens
tttggattgtatat

SEQ ID NO: 6756289 - DNA, 17 bp, Homo sapiens
tttggatttcctttata

SEQ ID NO: 6756290 - DNA, 14 bp, Homo sapiens
tttggatttgacat

SEQ ID NO: 6756291 - DNA, 16 bp, Homo sapiens
tttggatttgacattg

SEQ ID NO: 6756292 - DNA, 16 bp, Homo sapiens
tttggattttaacttt

SEQ ID NO: 6756293 - DNA, 21 bp, Homo sapiens
tttggcaaaatgtcttaacaa

SEQ ID NO: 6756294 - DNA, 18 bp, Homo sapiens
tttggcaagaacttgttt

SEQ ID NO: 6756295 - DNA, 21 bp, Homo sapiens
tttggcaagaacttgtttaca

SEQ ID NO: 6756296 - DNA, 23 bp, Homo sapiens
tttggcaagaacttgtttacaac

SEQ ID NO: 6756297 - DNA, 22 bp, Homo sapiens
tttggcaagaagactgtatttt

SEQ ID NO: 6756298 - DNA, 16 bp, Homo sapiens
tttggcaattttgtgg

SEQ ID NO: 6756299 - DNA, 18 bp, Homo sapiens
tttggcacatgcaggtag

SEQ ID NO: 6756300 - DNA, 17 bp, Homo sapiens
tttggcactctctgcca

SEQ ID NO: 6756301 - DNA, 15 bp, Homo sapiens
tttggcactctgact

SEQ ID NO: 6756302 - DNA, 11 bp, Homo sapiens
tttggcactgg

SEQ ID NO: 6756303 - DNA, 22 bp, Homo sapiens
tttggcaggggcagaaaactct

SEQ ID NO: 6756304 - DNA, 13 bp, Homo sapiens
tttggcaggtgca

SEQ ID NO: 6756305 - DNA, 20 bp, Homo sapiens
tttggcataacataaatctg

SEQ ID NO: 6756306 - DNA, 16 bp, Homo sapiens
tttggcatccctgggc

SEQ ID NO: 6756307 - DNA, 18 bp, Homo sapiens
tttggcatccctgggcct

SEQ ID NO: 6756308 - DNA, 21 bp, Homo sapiens
tttggcatctaattcttattt

SEQ ID NO: 6756309 - DNA, 17 bp, Homo sapiens
tttggcatgatttaaag

SEQ ID NO: 6756310 - DNA, 22 bp, Homo sapiens
tttggcattatctctttctctc

SEQ ID NO: 6756311 - DNA, 13 bp, Homo sapiens
tttggcattcctc

SEQ ID NO: 6756312 - DNA, 13 bp, Homo sapiens
tttggcatttctc

SEQ ID NO: 6756313 - DNA, 15 bp, Homo sapiens
tttggcattttggct

SEQ ID NO: 6756314 - DNA, 16 bp, Homo sapiens
tttggcattttggctc

SEQ ID NO: 6756315 - DNA, 15 bp, Homo sapiens
tttggccagggaggc

SEQ ID NO: 6756316 - DNA, 12 bp, Homo sapiens
tttggcccaaga

SEQ ID NO: 6756317 - DNA, 13 bp, Homo sapiens
tttggccccactt

SEQ ID NO: 6756318 - DNA, 21 bp, Homo sapiens
tttggcccttctccttttgaa

SEQ ID NO: 6756319 - DNA, 21 bp, Homo sapiens
tttggcctcatctctgcctga

SEQ ID NO: 6756320 - DNA, 22 bp, Homo sapiens
tttggcctgatgaccaatttta

SEQ ID NO: 6756321 - DNA, 17 bp, Homo sapiens
tttggcctgcactaatt

SEQ ID NO: 6756322 - DNA, 15 bp, Homo sapiens
tttggcctgggggag

SEQ ID NO: 6756323 - DNA, 21 bp, Homo sapiens
tttggcctggggtgcatctcc

SEQ ID NO: 6756324 - DNA, 22 bp, Homo sapiens
tttggcctgtgagccattgtcc

SEQ ID NO: 6756325 - DNA, 19 bp, Homo sapiens
tttggcctgtttgatgtat

SEQ ID NO: 6756326 - DNA, 22 bp, Homo sapiens
tttggcctgtttgatgtatgtg

SEQ ID NO: 6756327 - DNA, 12 bp, Homo sapiens
tttggccttaag

SEQ ID NO: 6756328 - DNA, 14 bp, Homo sapiens
tttggccttaagaa

SEQ ID NO: 6756329 - DNA, 15 bp, Homo sapiens
tttggccttaagaac

SEQ ID NO: 6756330 - DNA, 19 bp, Homo sapiens
tttggccttaagaactgtg

SEQ ID NO: 6756331 - DNA, 14 bp, Homo sapiens
tttggcctttgtaa

SEQ ID NO: 6756332 - DNA, 19 bp, Homo sapiens
tttggctaatttttttaat

SEQ ID NO: 6756333 - DNA, 13 bp, Homo sapiens
tttggctagagtt

SEQ ID NO: 6756334 - DNA, 22 bp, Homo sapiens
tttggctagttctcttaacact

SEQ ID NO: 6756335 - DNA, 22 bp, Homo sapiens
tttggctattaaaaaagtggtg

SEQ ID NO: 6756336 - DNA, 24 bp, Homo sapiens
tttggctattgtccttgtgtatcc

SEQ ID NO: 6756337 - DNA, 18 bp, Homo sapiens
tttggctcaaataaaatt

SEQ ID NO: 6756338 - DNA, 14 bp, Homo sapiens
tttggctcctgccc

SEQ ID NO: 6756339 - DNA, 12 bp, Homo sapiens
tttggctcgctg

SEQ ID NO: 6756340 - DNA, 15 bp, Homo sapiens
tttggctcgctgtgg

SEQ ID NO: 6756341 - DNA, 19 bp, Homo sapiens
tttggctcgctgtggtttc

SEQ ID NO: 6756342 - DNA, 15 bp, Homo sapiens
tttggctctcccacc

SEQ ID NO: 6756343 - DNA, 15 bp, Homo sapiens
tttggctctttcaga

SEQ ID NO: 6756344 - DNA, 21 bp, Homo sapiens
tttggctgagtactggaataa

SEQ ID NO: 6756345 - DNA, 21 bp, Homo sapiens
tttggctgcacgtcaccctcc

SEQ ID NO: 6756346 - DNA, 19 bp, Homo sapiens
tttggctgctctccatctc

SEQ ID NO: 6756347 - DNA, 12 bp, Homo sapiens
tttggctgctga

SEQ ID NO: 6756348 - DNA, 22 bp, Homo sapiens
tttggctggagcggagatgagg

SEQ ID NO: 6756349 - DNA, 19 bp, Homo sapiens
tttggctggtagcagcagg

SEQ ID NO: 6756350 - DNA, 15 bp, Homo sapiens
tttggctgtgtctaa

SEQ ID NO: 6756351 - DNA, 17 bp, Homo sapiens
tttggctgtgtctaaac

SEQ ID NO: 6756352 - DNA, 19 bp, Homo sapiens
tttggctgtgtctaaactg

SEQ ID NO: 6756353 - DNA, 16 bp, Homo sapiens
tttggcttaaatatag

SEQ ID NO: 6756354 - DNA, 16 bp, Homo sapiens
tttggcttacatttga

SEQ ID NO: 6756355 - DNA, 21 bp, Homo sapiens
tttggcttcaaggatggagat

SEQ ID NO: 6756356 - DNA, 14 bp, Homo sapiens
tttggcttccatga

SEQ ID NO: 6756357 - DNA, 18 bp, Homo sapiens
tttggcttcctctgctgc

SEQ ID NO: 6756358 - DNA, 19 bp, Homo sapiens
tttggcttcctctgctgca

SEQ ID NO: 6756359 - DNA, 17 bp, Homo sapiens
tttggcttctcctgtga

SEQ ID NO: 6756360 - DNA, 13 bp, Homo sapiens
tttggctttcagg

SEQ ID NO: 6756361 - DNA, 17 bp, Homo sapiens
tttgggaaaaattattt

SEQ ID NO: 6756362 - DNA, 22 bp, Homo sapiens
tttgggaaaagaagctgtcaga

SEQ ID NO: 6756363 - DNA, 17 bp, Homo sapiens
tttgggaaccaagctat

SEQ ID NO: 6756364 - DNA, 11 bp, Homo sapiens
tttgggaagac

SEQ ID NO: 6756365 - DNA, 22 bp, Homo sapiens
tttgggaagtgaagactggaag

SEQ ID NO: 6756366 - DNA, 20 bp, Homo sapiens
tttgggaccctgctttagag

SEQ ID NO: 6756367 - DNA, 16 bp, Homo sapiens
tttgggactgtcttga

SEQ ID NO: 6756368 - DNA, 16 bp, Homo sapiens
tttgggagacatgtga

SEQ ID NO: 6756369 - DNA, 21 bp, Homo sapiens
tttgggagacatgtgacattt

SEQ ID NO: 6756370 - DNA, 21 bp, Homo sapiens
tttgggagccaggactcccag

SEQ ID NO: 6756371 - DNA, 15 bp, Homo sapiens
tttgggagctctgct

SEQ ID NO: 6756372 - DNA, 17 bp, Homo sapiens
tttgggaggctgaggcg

SEQ ID NO: 6756373 - DNA, 20 bp, Homo sapiens
tttgggaggggatggcagac

SEQ ID NO: 6756374 - DNA, 14 bp, Homo sapiens
tttgtggagtactg

SEQ ID NO: 6756375 - DNA, 21 bp, Homo sapiens
tttgtggagtttgacacctta

SEQ ID NO: 6756376 - DNA, 15 bp, Homo sapiens
tttgtggataagaaa

SEQ ID NO: 6756377 - DNA, 18 bp, Homo sapiens
tttgtggataagaaaaat

SEQ ID NO: 6756378 - DNA, 17 bp, Homo sapiens
tttgtggatgtcttcct

SEQ ID NO: 6756379 - DNA, 18 bp, Homo sapiens
tttgtggattaaaccttt

SEQ ID NO: 6756380 - DNA, 15 bp, Homo sapiens
tttgtggcagtgctg

SEQ ID NO: 6756381 - DNA, 18 bp, Homo sapiens
tttgtggcagtggccagg

SEQ ID NO: 6756382 - DNA, 23 bp, Homo sapiens
tttgtggcatacaacctgagcct

SEQ ID NO: 6756383 - DNA, 18 bp, Homo sapiens
tttgtggccaaggagctg

SEQ ID NO: 6756384 - DNA, 12 bp, Homo sapiens
tttgtggctggg

SEQ ID NO: 6756385 - DNA, 20 bp, Homo sapiens
tttgtggggacctcagcctg

SEQ ID NO: 6756386 - DNA, 17 bp, Homo sapiens
tttgtgggggactgtaa

SEQ ID NO: 6756387 - DNA, 18 bp, Homo sapiens
tttgtgggggactgtaag

SEQ ID NO: 6756388 - DNA, 20 bp, Homo sapiens
tttgtgggtttttatttcct

SEQ ID NO: 6756389 - DNA, 14 bp, Homo sapiens
tttgtggtcacagc

SEQ ID NO: 6756390 - DNA, 19 bp, Homo sapiens
tttgtggtctttttcctga

SEQ ID NO: 6756391 - DNA, 13 bp, Homo sapiens
tttgtggtgattt

SEQ ID NO: 6756392 - DNA, 21 bp, Homo sapiens
tttgtggtgggcgctggggaa

SEQ ID NO: 6756393 - DNA, 14 bp, Homo sapiens
tttgtggtgtcttc

SEQ ID NO: 6756394 - DNA, 15 bp, Homo sapiens
tttgtggttgcatgt

SEQ ID NO: 6756395 - DNA, 16 bp, Homo sapiens
tttgtggttgtagaag

SEQ ID NO: 6756396 - DNA, 16 bp, Homo sapiens
tttgtggtttggaata

SEQ ID NO: 6756397 - DNA, 12 bp, Homo sapiens
tttgtgtaaatt

SEQ ID NO: 6756398 - DNA, 13 bp, Homo sapiens
tttgtgtaactga

SEQ ID NO: 6756399 - DNA, 17 bp, Homo sapiens
tttgtgtaataaaaatt

SEQ ID NO: 6756400 - DNA, 15 bp, Homo sapiens
tttgtgtaataaagt

SEQ ID NO: 6756401 - DNA, 14 bp, Homo sapiens
tttgtgtacagtgt

SEQ ID NO: 6756402 - DNA, 15 bp, Homo sapiens
tttgtgtataatgtg

SEQ ID NO: 6756403 - DNA, 20 bp, Homo sapiens
tttgtgtatattggtgtata

SEQ ID NO: 6756404 - DNA, 20 bp, Homo sapiens
tttgtgtatctcatttaatt

SEQ ID NO: 6756405 - DNA, 11 bp, Homo sapiens
tttgtgtatgg

SEQ ID NO: 6756406 - DNA, 12 bp, Homo sapiens
tttgtgtattct

SEQ ID NO: 6756407 - DNA, 16 bp, Homo sapiens
tttgtgtcactgtaca

SEQ ID NO: 6756408 - DNA, 20 bp, Homo sapiens
tttgtgtccataagagaaat

SEQ ID NO: 6756409 - DNA, 21 bp, Homo sapiens
tttgtgtccataagagaaatg

SEQ ID NO: 6756410 - DNA, 17 bp, Homo sapiens
tttgtgtccgctaaata

SEQ ID NO: 6756411 - DNA, 18 bp, Homo sapiens
tttgtgtccgctaaatat

SEQ ID NO: 6756412 - DNA, 11 bp, Homo sapiens
tttgtgtcctc

SEQ ID NO: 6756413 - DNA, 12 bp, Homo sapiens
tttgtgtcctcc

SEQ ID NO: 6756414 - DNA, 16 bp, Homo sapiens
tttgtgtcctccagga

SEQ ID NO: 6756415 - DNA, 18 bp, Homo sapiens
tttgtgtcctccaggagc

SEQ ID NO: 6756416 - DNA, 12 bp, Homo sapiens
tttgtgtctctt

SEQ ID NO: 6756417 - DNA, 16 bp, Homo sapiens
tttgtgtctgtgttta

SEQ ID NO: 6756418 - DNA, 11 bp, Homo sapiens
tttgtgtcttt

SEQ ID NO: 6756419 - DNA, 21 bp, Homo sapiens
tttgtgtgaccaactgtgttg

SEQ ID NO: 6756420 - DNA, 15 bp, Homo sapiens
tttgtgtgagactta

SEQ ID NO: 6756421 - DNA, 14 bp, Homo sapiens
tttgtgtgagagac

SEQ ID NO: 6756422 - DNA, 21 bp, Homo sapiens
tttgtgtgatgcgccttgctg

SEQ ID NO: 6756423 - DNA, 22 bp, Homo sapiens
tttgtgtgatttcctaaacata

SEQ ID NO: 6756424 - DNA, 18 bp, Homo sapiens
tttgtgtgctaaacgtgt

SEQ ID NO: 6756425 - DNA, 14 bp, Homo sapiens
tttgtgtgctctcc

SEQ ID NO: 6756426 - DNA, 12 bp, Homo sapiens
tttgtgtgctgt

SEQ ID NO: 6756427 - DNA, 14 bp, Homo sapiens
tttgtgtgctgtgg

SEQ ID NO: 6756428 - DNA, 18 bp, Homo sapiens
tttgtgtggtatgtcact

SEQ ID NO: 6756429 - DNA, 19 bp, Homo sapiens
tttgtgtgttatattccaa

SEQ ID NO: 6756430 - DNA, 19 bp, Homo sapiens
tttgtgtgttcactaaact

SEQ ID NO: 6756431 - DNA, 22 bp, Homo sapiens
tttgtgtgttggctttgcagct

SEQ ID NO: 6756432 - DNA, 17 bp, Homo sapiens
tttgtgtgttgtcttga

SEQ ID NO: 6756433 - DNA, 12 bp, Homo sapiens
tttgtgttagag

SEQ ID NO: 6756434 - DNA, 13 bp, Homo sapiens
tttgtgttcctat

SEQ ID NO: 6756435 - DNA, 13 bp, Homo sapiens
tttgtgttctttg

SEQ ID NO: 6756436 - DNA, 12 bp, Homo sapiens
tttgtgttgcta

SEQ ID NO: 6756437 - DNA, 14 bp, Homo sapiens
tttgtgttgctaaa

SEQ ID NO: 6756438 - DNA, 14 bp, Homo sapiens
tttgtgttggggga

SEQ ID NO: 6756439 - DNA, 14 bp, Homo sapiens
tttgtgttgtaatt

SEQ ID NO: 6756440 - DNA, 20 bp, Homo sapiens
tttgtgttgttgttgctgct

SEQ ID NO: 6756441 - DNA, 15 bp, Homo sapiens
tttgtgtttatgaaa

SEQ ID NO: 6756442 - DNA, 12 bp, Homo sapiens
tttgtgtttatt

SEQ ID NO: 6756443 - DNA, 12 bp, Homo sapiens
tttgtgtttcag

SEQ ID NO: 6756444 - DNA, 13 bp, Homo sapiens
tttgtgtttgctt

SEQ ID NO: 6756445 - DNA, 20 bp, Homo sapiens
tttgtgttttaaaaaaactg

SEQ ID NO: 6756446 - DNA, 14 bp, Homo sapiens
tttgtgttttcttg

SEQ ID NO: 6756447 - DNA, 19 bp, Homo sapiens
tttgtgttttcttgtaaat

SEQ ID NO: 6756448 - DNA, 21 bp, Homo sapiens
tttgttaaagctggaacattt

SEQ ID NO: 6756449 - DNA, 22 bp, Homo sapiens
tttgttaaagctggaacatttg

SEQ ID NO: 6756450 - DNA, 17 bp, Homo sapiens
tttgttaaatatttaca

SEQ ID NO: 6756451 - DNA, 18 bp, Homo sapiens
tttgttaaatatttacat

SEQ ID NO: 6756452 - DNA, 19 bp, Homo sapiens
tttgttaacagacactgta

SEQ ID NO: 6756453 - DNA, 22 bp, Homo sapiens
tttgttaacagacactgtaaaa

SEQ ID NO: 6756454 - DNA, 15 bp, Homo sapiens
tttgttaacatggaa

SEQ ID NO: 6756455 - DNA, 16 bp, Homo sapiens
tttgttaactttgggt

SEQ ID NO: 6756456 - DNA, 13 bp, Homo sapiens
tttgttaatatat

SEQ ID NO: 6756457 - DNA, 16 bp, Homo sapiens
tttgttaatatcactc

SEQ ID NO: 6756458 - DNA, 13 bp, Homo sapiens
tttgttaatatta

SEQ ID NO: 6756459 - DNA, 22 bp, Homo sapiens
tttgttaattgattaaactgta

SEQ ID NO: 6756460 - DNA, 12 bp, Homo sapiens
tttgttaattta

SEQ ID NO: 6756461 - DNA, 22 bp, Homo sapiens
tttgttaatttagaaaacttta

SEQ ID NO: 6756462 - DNA, 14 bp, Homo sapiens
tttgttaatttctt

SEQ ID NO: 6756463 - DNA, 20 bp, Homo sapiens
tttgttaatttggaccattt

SEQ ID NO: 6756464 - DNA, 13 bp, Homo sapiens
tttgttaccttta

SEQ ID NO: 6756465 - DNA, 16 bp, Homo sapiens
tttgttactcttggga

SEQ ID NO: 6756466 - DNA, 16 bp, Homo sapiens
tttgttactgattcaa

SEQ ID NO: 6756467 - DNA, 14 bp, Homo sapiens
tttgttactgtatt

SEQ ID NO: 6756468 - DNA, 16 bp, Homo sapiens
tttgttactgtatttt

SEQ ID NO: 6756469 - DNA, 19 bp, Homo sapiens
tttgttactgtcattccca

SEQ ID NO: 6756470 - DNA, 12 bp, Homo sapiens
tttgttactgtt

SEQ ID NO: 6756471 - DNA, 13 bp, Homo sapiens
tttgttactgttc

SEQ ID NO: 6756472 - DNA, 14 bp, Homo sapiens
tttgttactgttct

SEQ ID NO: 6756473 - DNA, 22 bp, Homo sapiens
tttgttactgttcttgctgcta

SEQ ID NO: 6756474 - DNA, 21 bp, Homo sapiens
tttgttactttaggtttgttc

SEQ ID NO: 6756475 - DNA, 14 bp, Homo sapiens
tttgttactttgaa

SEQ ID NO: 6756476 - DNA, 15 bp, Homo sapiens
tttgttagatagctg

SEQ ID NO: 6756477 - DNA, 21 bp, Homo sapiens
tttgttagatagctgcatgtg

SEQ ID NO: 6756478 - DNA, 15 bp, Homo sapiens
tttgttagcaaagat

SEQ ID NO: 6756479 - DNA, 20 bp, Homo sapiens
tttgttagcaaagattaaat

SEQ ID NO: 6756480 - DNA, 22 bp, Homo sapiens
tttgttaggattttcacattct

SEQ ID NO: 6756481 - DNA, 15 bp, Homo sapiens
tttgttagggctgct

SEQ ID NO: 6756482 - DNA, 17 bp, Homo sapiens
tttgttaggttttctat

SEQ ID NO: 6756483 - DNA, 21 bp, Homo sapiens
tttgttagttcctgtatgaaa

SEQ ID NO: 6756484 - DNA, 20 bp, Homo sapiens
tttgttagtttacaatatta

SEQ ID NO: 6756485 - DNA, 17 bp, Homo sapiens
tttgttatagaatactt

SEQ ID NO: 6756486 - DNA, 23 bp, Homo sapiens
tttgttatagatttagctattta

SEQ ID NO: 6756487 - DNA, 13 bp, Homo sapiens
tttgttatagttc

SEQ ID NO: 6756488 - DNA, 15 bp, Homo sapiens
tttgttatagttcat

SEQ ID NO: 6756489 - DNA, 15 bp, Homo sapiens
tttgttatagttgaa

SEQ ID NO: 6756490 - DNA, 19 bp, Homo sapiens
tttgttatatataataaat

SEQ ID NO: 6756491 - DNA, 20 bp, Homo sapiens
tttgttatatataataaata

SEQ ID NO: 6756492 - DNA, 15 bp, Homo sapiens
tttgttatgcaaatg

SEQ ID NO: 6756493 - DNA, 22 bp, Homo sapiens
tttgttatgtgtctggaagaag

SEQ ID NO: 6756494 - DNA, 18 bp, Homo sapiens
tttgttattaaaaaaaca

SEQ ID NO: 6756495 - DNA, 15 bp, Homo sapiens
tttgttattaatcca

SEQ ID NO: 6756496 - DNA, 16 bp, Homo sapiens
tttgttattccatcaa

SEQ ID NO: 6756497 - DNA, 21 bp, Homo sapiens
tttgttattccatcaataaat

SEQ ID NO: 6756498 - DNA, 12 bp, Homo sapiens
tttgttattcct

SEQ ID NO: 6756499 - DNA, 18 bp, Homo sapiens
tttgttatttacactggt

SEQ ID NO: 6756500 - DNA, 12 bp, Homo sapiens
tttgttatttgt

SEQ ID NO: 6756501 - DNA, 18 bp, Homo sapiens
tttgttatttgtacagtt

SEQ ID NO: 6756502 - DNA, 16 bp, Homo sapiens
tttgttattttgcaac

SEQ ID NO: 6756503 - DNA, 15 bp, Homo sapiens
tttgttcaaagttgt

SEQ ID NO: 6756504 - DNA, 17 bp, Homo sapiens
tttgttcaagttttggg

SEQ ID NO: 6756505 - DNA, 18 bp, Homo sapiens
tttgttcaatgttccatt

SEQ ID NO: 6756506 - DNA, 19 bp, Homo sapiens
tttgttcataataaaagtg

SEQ ID NO: 6756507 - DNA, 13 bp, Homo sapiens
tttgttcatctgt

SEQ ID NO: 6756508 - DNA, 21 bp, Homo sapiens
tttgttccacttgtttgcact

SEQ ID NO: 6756509 - DNA, 15 bp, Homo sapiens
tttgttcccaagagc

SEQ ID NO: 6756510 - DNA, 23 bp, Homo sapiens
tttgttcccaaggacttccacat

SEQ ID NO: 6756511 - DNA, 23 bp, Homo sapiens
tttgttcccatcctcttctttta

SEQ ID NO: 6756512 - DNA, 21 bp, Homo sapiens
tttgttccccattccttaatt

SEQ ID NO: 6756513 - DNA, 19 bp, Homo sapiens
tttgttcccctcctccact

SEQ ID NO: 6756514 - DNA, 12 bp, Homo sapiens
tttgttccctca

SEQ ID NO: 6756515 - DNA, 16 bp, Homo sapiens
tttgttcctgtttatt

SEQ ID NO: 6756516 - DNA, 17 bp, Homo sapiens
tttgttcctttgaagaa

SEQ ID NO: 6756517 - DNA, 20 bp, Homo sapiens
tttgttcgcatggtcacaca

SEQ ID NO: 6756518 - DNA, 10 bp, Homo sapiens
tttgttctac

SEQ ID NO: 6756519 - DNA, 21 bp, Homo sapiens
tttgttctagacttccccatc

SEQ ID NO: 6756520 - DNA, 16 bp, Homo sapiens
tttgttctagttttca

SEQ ID NO: 6756521 - DNA, 21 bp, Homo sapiens
tttgttctctgaattttcaga

SEQ ID NO: 6756522 - DNA, 12 bp, Homo sapiens
tttgttctctgt

SEQ ID NO: 6756523 - DNA, 14 bp, Homo sapiens
tttgttctgtattt

SEQ ID NO: 6756524 - DNA, 15 bp, Homo sapiens
tttgttcttacacat

SEQ ID NO: 6756525 - DNA, 18 bp, Homo sapiens
tttgttcttcagagatca

SEQ ID NO: 6756526 - DNA, 16 bp, Homo sapiens
tttgttgaaagaaagt

SEQ ID NO: 6756527 - DNA, 23 bp, Homo sapiens
tttgttgaaagtaaaagttatat

SEQ ID NO: 6756528 - DNA, 15 bp, Homo sapiens
tttgttgaaattatg

SEQ ID NO: 6756529 - DNA, 23 bp, Homo sapiens
tttgttgaatctcaggtaaatga

SEQ ID NO: 6756530 - DNA, 21 bp, Homo sapiens
tttgttgacagcaaaatgttg

SEQ ID NO: 6756531 - DNA, 13 bp, Homo sapiens
tttgttgacatta

SEQ ID NO: 6756532 - DNA, 20 bp, Homo sapiens
tttgttgacattctgaatgc

SEQ ID NO: 6756533 - DNA, 16 bp, Homo sapiens
tttgttgcaagatgtg

SEQ ID NO: 6756534 - DNA, 10 bp, Homo sapiens
tttgttgcac

SEQ ID NO: 6756535 - DNA, 15 bp, Homo sapiens
tttgttgcactaaaa

SEQ ID NO: 6756536 - DNA, 22 bp, Homo sapiens
tttgttgcagtgtagttttcct

SEQ ID NO: 6756537 - DNA, 21 bp, Homo sapiens
tttgttgcagttaattcttgc

SEQ ID NO: 6756538 - DNA, 16 bp, Homo sapiens
tttgttgccttatctt

SEQ ID NO: 6756539 - DNA, 22 bp, Homo sapiens
tttgttgcgttcctttcttttc

SEQ ID NO: 6756540 - DNA, 15 bp, Homo sapiens
tttgttgctatcaat

SEQ ID NO: 6756541 - DNA, 17 bp, Homo sapiens
tttgttgctcagtgtgt

SEQ ID NO: 6756542 - DNA, 15 bp, Homo sapiens
tttgttgctgtcaag

SEQ ID NO: 6756543 - DNA, 14 bp, Homo sapiens
tttgttgctgtttt

SEQ ID NO: 6756544 - DNA, 13 bp, Homo sapiens
tttgttgcttttt

SEQ ID NO: 6756545 - DNA, 23 bp, Homo sapiens
tttgttggaaggtttggtgtgtg

SEQ ID NO: 6756546 - DNA, 20 bp, Homo sapiens
tttgttggagatgcagcctt

SEQ ID NO: 6756547 - DNA, 19 bp, Homo sapiens
tttgttggagtgtttctaa

SEQ ID NO: 6756548 - DNA, 23 bp, Homo sapiens
tttgttggatccgtttgaccaat

SEQ ID NO: 6756549 - DNA, 15 bp, Homo sapiens
tttgttggtcacatg

SEQ ID NO: 6756550 - DNA, 15 bp, Homo sapiens
tttgttggtctgaat

SEQ ID NO: 6756551 - DNA, 20 bp, Homo sapiens
tttgttggtttttaaagatt

SEQ ID NO: 6756552 - DNA, 15 bp, Homo sapiens
tttgttgtaaaacaa

SEQ ID NO: 6756553 - DNA, 14 bp, Homo sapiens
tttgttgtcatgtg

SEQ ID NO: 6756554 - DNA, 20 bp, Homo sapiens
ttttactcaggctttctatt

SEQ ID NO: 6756555 - DNA, 17 bp, Homo sapiens
ttttactcattgaaatg

SEQ ID NO: 6756556 - DNA, 23 bp, Homo sapiens
ttttactccaggttattgcaata

SEQ ID NO: 6756557 - DNA, 22 bp, Homo sapiens
ttttactctatgccccaaatat

SEQ ID NO: 6756558 - DNA, 15 bp, Homo sapiens
ttttactctgtgtaa

SEQ ID NO: 6756559 - DNA, 15 bp, Homo sapiens
ttttactctttgaaa

SEQ ID NO: 6756560 - DNA, 13 bp, Homo sapiens
ttttactgaacaa

SEQ ID NO: 6756561 - DNA, 14 bp, Homo sapiens
ttttactgaacaat

SEQ ID NO: 6756562 - DNA, 14 bp, Homo sapiens
ttttactgaatgat

SEQ ID NO: 6756563 - DNA, 17 bp, Homo sapiens
ttttactgaatgatcta

SEQ ID NO: 6756564 - DNA, 17 bp, Homo sapiens
ttttactggttgcatgg

SEQ ID NO: 6756565 - DNA, 20 bp, Homo sapiens
ttttactgtatgtttttact

SEQ ID NO: 6756566 - DNA, 15 bp, Homo sapiens
ttttactgtcagatt

SEQ ID NO: 6756567 - DNA, 18 bp, Homo sapiens
ttttactgtcagattaaa

SEQ ID NO: 6756568 - DNA, 13 bp, Homo sapiens
ttttactgtctat

SEQ ID NO: 6756569 - DNA, 12 bp, Homo sapiens
ttttactgtttt

SEQ ID NO: 6756570 - DNA, 11 bp, Homo sapiens
ttttacttaca

SEQ ID NO: 6756571 - DNA, 18 bp, Homo sapiens
ttttacttccattataca

SEQ ID NO: 6756572 - DNA, 12 bp, Homo sapiens
ttttacttgaat

SEQ ID NO: 6756573 - DNA, 14 bp, Homo sapiens
ttttacttgaatca

SEQ ID NO: 6756574 - DNA, 19 bp, Homo sapiens
ttttacttgaatttgtctc

SEQ ID NO: 6756575 - DNA, 18 bp, Homo sapiens
ttttacttgattaaggac

SEQ ID NO: 6756576 - DNA, 18 bp, Homo sapiens
ttttacttgttcatttct

SEQ ID NO: 6756577 - DNA, 14 bp, Homo sapiens
ttttactttaacag

SEQ ID NO: 6756578 - DNA, 13 bp, Homo sapiens
ttttactttgaac

SEQ ID NO: 6756579 - DNA, 14 bp, Homo sapiens
ttttactttgtttt

SEQ ID NO: 6756580 - DNA, 17 bp, Homo sapiens
ttttacttttaaactgt

SEQ ID NO: 6756581 - DNA, 15 bp, Homo sapiens
ttttacttttaaatg

SEQ ID NO: 6756582 - DNA, 21 bp, Homo sapiens
ttttacttttctgccaaaata

SEQ ID NO: 6756583 - DNA, 15 bp, Homo sapiens
ttttacttttgttct

SEQ ID NO: 6756584 - DNA, 18 bp, Homo sapiens
ttttacttttgttctgta

SEQ ID NO: 6756585 - DNA, 15 bp, Homo sapiens
ttttacttttttaac

SEQ ID NO: 6756586 - DNA, 17 bp, Homo sapiens
ttttagaaaatgtttgg

SEQ ID NO: 6756587 - DNA, 20 bp, Homo sapiens
ttttagaaaattttatgtat

SEQ ID NO: 6756588 - DNA, 22 bp, Homo sapiens
ttttagaaagaaaattatattc

SEQ ID NO: 6756589 - DNA, 14 bp, Homo sapiens
ttttagaaagcatt

SEQ ID NO: 6756590 - DNA, 19 bp, Homo sapiens
ttttagaaagcatttgaat

SEQ ID NO: 6756591 - DNA, 20 bp, Homo sapiens
ttttagaaagcatttgaatg

SEQ ID NO: 6756592 - DNA, 13 bp, Homo sapiens
ttttagaaagcta

SEQ ID NO: 6756593 - DNA, 19 bp, Homo sapiens
ttttagaaataataaaaag

SEQ ID NO: 6756594 - DNA, 14 bp, Homo sapiens
ttttagaaatgcat

SEQ ID NO: 6756595 - DNA, 22 bp, Homo sapiens
ttttagaaatgcatatttgcca

SEQ ID NO: 6756596 - DNA, 11 bp, Homo sapiens
ttttagaacaa

SEQ ID NO: 6756597 - DNA, 18 bp, Homo sapiens
ttttagaacagaaaacaa

SEQ ID NO: 6756598 - DNA, 15 bp, Homo sapiens
ttttagaacatgtaa

SEQ ID NO: 6756599 - DNA, 16 bp, Homo sapiens
ttttagaataagaatt

SEQ ID NO: 6756600 - DNA, 20 bp, Homo sapiens
ttttagaatgttgaaaagta

SEQ ID NO: 6756601 - DNA, 14 bp, Homo sapiens
ttttagaattaaaa

SEQ ID NO: 6756602 - DNA, 16 bp, Homo sapiens
ttttagaattaaaatt

SEQ ID NO: 6756603 - DNA, 20 bp, Homo sapiens
ttttagacaaatactcatgt

SEQ ID NO: 6756604 - DNA, 21 bp, Homo sapiens
ttttagagaatgtgtttcaaa

SEQ ID NO: 6756605 - DNA, 15 bp, Homo sapiens
ttttagagataaata

SEQ ID NO: 6756606 - DNA, 23 bp, Homo sapiens
ttttagagattaatttgtgtaga

SEQ ID NO: 6756607 - DNA, 15 bp, Homo sapiens
ttttagagcattaaa

SEQ ID NO: 6756608 - DNA, 22 bp, Homo sapiens
ttttagagccccccgtgtggct

SEQ ID NO: 6756609 - DNA, 17 bp, Homo sapiens
ttttagagcttccaaat

SEQ ID NO: 6756610 - DNA, 15 bp, Homo sapiens
ttttagagtaagaaa

SEQ ID NO: 6756611 - DNA, 23 bp, Homo sapiens
ttttagagttgatactacagttt

SEQ ID NO: 6756612 - DNA, 19 bp, Homo sapiens
ttttagataataactgtct

SEQ ID NO: 6756613 - DNA, 12 bp, Homo sapiens
ttttagatatct

SEQ ID NO: 6756614 - DNA, 17 bp, Homo sapiens
ttttagatcaaatactt

SEQ ID NO: 6756615 - DNA, 15 bp, Homo sapiens
ttttagatccaaatg

SEQ ID NO: 6756616 - DNA, 21 bp, Homo sapiens
ttttagatccaaatgtaaagg

SEQ ID NO: 6756617 - DNA, 18 bp, Homo sapiens
ttttagatgcaatgtgat

SEQ ID NO: 6756618 - DNA, 13 bp, Homo sapiens
ttttagattccta

SEQ ID NO: 6756619 - DNA, 22 bp, Homo sapiens
ttttagattttctggttctaac

SEQ ID NO: 6756620 - DNA, 23 bp, Homo sapiens
ttttagcaaagatatctcatctc

SEQ ID NO: 6756621 - DNA, 20 bp, Homo sapiens
ttttagcagttctgcaaata

SEQ ID NO: 6756622 - DNA, 22 bp, Homo sapiens
ttttagcatgatgaaactgtca

SEQ ID NO: 6756623 - DNA, 14 bp, Homo sapiens
ttttagcattacct

SEQ ID NO: 6756624 - DNA, 18 bp, Homo sapiens
ttttagccagagatgcaa

SEQ ID NO: 6756625 - DNA, 20 bp, Homo sapiens
ttttagcccagtgttttctt

SEQ ID NO: 6756626 - DNA, 20 bp, Homo sapiens
ttttagccttaaatttttgt

SEQ ID NO: 6756627 - DNA, 19 bp, Homo sapiens
ttttagctttgtgtttact

SEQ ID NO: 6756628 - DNA, 13 bp, Homo sapiens
ttttagcttttgt

SEQ ID NO: 6756629 - DNA, 20 bp, Homo sapiens
ttttaggaaaatcactttgt

SEQ ID NO: 6756630 - DNA, 13 bp, Homo sapiens
ttttaggaataat

SEQ ID NO: 6756631 - DNA, 15 bp, Homo sapiens
ttttaggacatctta

SEQ ID NO: 6756632 - DNA, 20 bp, Homo sapiens
ttttaggagctaaggctcta

SEQ ID NO: 6756633 - DNA, 15 bp, Homo sapiens
ttttaggcaagtttt

SEQ ID NO: 6756634 - DNA, 17 bp, Homo sapiens
ttttaggcactcttaaa

SEQ ID NO: 6756635 - DNA, 19 bp, Homo sapiens
ttttaggcactgttcaata

SEQ ID NO: 6756636 - DNA, 20 bp, Homo sapiens
ttttaggccaaaaaaatgta

SEQ ID NO: 6756637 - DNA, 20 bp, Homo sapiens
ttttaggctattataatata

SEQ ID NO: 6756638 - DNA, 18 bp, Homo sapiens
ttttaggctgttccttgt

SEQ ID NO: 6756639 - DNA, 17 bp, Homo sapiens
ttttagggagctggtct

SEQ ID NO: 6756640 - DNA, 14 bp, Homo sapiens
ttttaggtgcttta

SEQ ID NO: 6756641 - DNA, 18 bp, Homo sapiens
ttttagtaagttaatgta

SEQ ID NO: 6756642 - DNA, 16 bp, Homo sapiens
ttttagtaatctgtac

SEQ ID NO: 6756643 - DNA, 12 bp, Homo sapiens
ttttagtacatt

SEQ ID NO: 6756644 - DNA, 15 bp, Homo sapiens
ttttagtagagacag

SEQ ID NO: 6756645 - DNA, 14 bp, Homo sapiens
ttttagtcactttt

SEQ ID NO: 6756646 - DNA, 14 bp, Homo sapiens
ttttagtcagaaat

SEQ ID NO: 6756647 - DNA, 23 bp, Homo sapiens
ttttagtcagaaatgattcaggg

SEQ ID NO: 6756648 - DNA, 16 bp, Homo sapiens
ttttagtcattttgct

SEQ ID NO: 6756649 - DNA, 22 bp, Homo sapiens
ttttagtcttgctgtttcttga

SEQ ID NO: 6756650 - DNA, 21 bp, Homo sapiens
ttttagtcttttactcctttg

SEQ ID NO: 6756651 - DNA, 20 bp, Homo sapiens
ttttagtggaccctgaaatg

SEQ ID NO: 6756652 - DNA, 21 bp, Homo sapiens
ttttagtggaccctgaaatgt

SEQ ID NO: 6756653 - DNA, 13 bp, Homo sapiens
ttttagtgtgtaa

SEQ ID NO: 6756654 - DNA, 19 bp, Homo sapiens
ttttagtgtgtgcataata

SEQ ID NO: 6756655 - DNA, 13 bp, Homo sapiens
ttttagttcatat

SEQ ID NO: 6756656 - DNA, 18 bp, Homo sapiens
ttttagttcctgtgcaca

SEQ ID NO: 6756657 - DNA, 17 bp, Homo sapiens
ttttagttcctttattt

SEQ ID NO: 6756658 - DNA, 15 bp, Homo sapiens
ttttagttctgactt

SEQ ID NO: 6756659 - DNA, 19 bp, Homo sapiens
ttttagttctgactttgaa

SEQ ID NO: 6756660 - DNA, 12 bp, Homo sapiens
ttttagttgaat

SEQ ID NO: 6756661 - DNA, 17 bp, Homo sapiens
ttttagttgcatgaaat

SEQ ID NO: 6756662 - DNA, 18 bp, Homo sapiens
ttttagttgcatgaaatt

SEQ ID NO: 6756663 - DNA, 21 bp, Homo sapiens
ttttagtttaaaatcttgcat

SEQ ID NO: 6756664 - DNA, 13 bp, Homo sapiens
ttttagtttctga

SEQ ID NO: 6756665 - DNA, 15 bp, Homo sapiens
ttttagtttctgaac

SEQ ID NO: 6756666 - DNA, 22 bp, Homo sapiens
ttttagtttctgttctgtggaa

SEQ ID NO: 6756667 - DNA, 14 bp, Homo sapiens
ttttagtttgttct

SEQ ID NO: 6756668 - DNA, 13 bp, Homo sapiens
ttttagttttagt

SEQ ID NO: 6756669 - DNA, 19 bp, Homo sapiens
ttttataaaaaaaatgaaa

SEQ ID NO: 6756670 - DNA, 21 bp, Homo sapiens
ttttataaaaaaaatgaaatg

SEQ ID NO: 6756671 - DNA, 16 bp, Homo sapiens
ttttataaaaataaat

SEQ ID NO: 6756672 - DNA, 20 bp, Homo sapiens
ttttataaaattaaagaaaa

SEQ ID NO: 6756673 - DNA, 21 bp, Homo sapiens
ttttataaaattaaagaaaat

SEQ ID NO: 6756674 - DNA, 22 bp, Homo sapiens
ttttataaaattaaagaaaata

SEQ ID NO: 6756675 - DNA, 21 bp, Homo sapiens
ttttataaaccacttgagcct

SEQ ID NO: 6756676 - DNA, 19 bp, Homo sapiens
ttttataaacctctaattt

SEQ ID NO: 6756677 - DNA, 12 bp, Homo sapiens
ttttataaacta

SEQ ID NO: 6756678 - DNA, 15 bp, Homo sapiens
ttttataaagcatgt

SEQ ID NO: 6756679 - DNA, 17 bp, Homo sapiens
ttttataaagtctaagc

SEQ ID NO: 6756680 - DNA, 23 bp, Homo sapiens
ttttataaagtctaagcaagatg

SEQ ID NO: 6756681 - DNA, 18 bp, Homo sapiens
ttttataaatgatatcaa

SEQ ID NO: 6756682 - DNA, 19 bp, Homo sapiens
ttttataaatgatatcaaa

SEQ ID NO: 6756683 - DNA, 22 bp, Homo sapiens
ttttataacatgttaaaatgta

SEQ ID NO: 6756684 - DNA, 20 bp, Homo sapiens
ttttataactatataaatga

SEQ ID NO: 6756685 - DNA, 13 bp, Homo sapiens
ttttataactcat

SEQ ID NO: 6756686 - DNA, 13 bp, Homo sapiens
ttttataagaaaa

SEQ ID NO: 6756687 - DNA, 21 bp, Homo sapiens
ttttataagatttaattgtaa

SEQ ID NO: 6756688 - DNA, 20 bp, Homo sapiens
ttttataaggacttcctgat

SEQ ID NO: 6756689 - DNA, 19 bp, Homo sapiens
ttttataaggctgactctt

SEQ ID NO: 6756690 - DNA, 19 bp, Homo sapiens
ttttataagttcacaaaat

SEQ ID NO: 6756691 - DNA, 18 bp, Homo sapiens
ttttataatgatgaactt

SEQ ID NO: 6756692 - DNA, 14 bp, Homo sapiens
ttttataatgattc

SEQ ID NO: 6756693 - DNA, 17 bp, Homo sapiens
ttttataatgtggattt

SEQ ID NO: 6756694 - DNA, 14 bp, Homo sapiens
ttttatacaaaata

SEQ ID NO: 6756695 - DNA, 20 bp, Homo sapiens
ttttatacaagtaatttcct

SEQ ID NO: 6756696 - DNA, 13 bp, Homo sapiens
ttttatacaattt

SEQ ID NO: 6756697 - DNA, 19 bp, Homo sapiens
ttttatacacataattaaa

SEQ ID NO: 6756698 - DNA, 13 bp, Homo sapiens
ttttatacactgt

SEQ ID NO: 6756699 - DNA, 15 bp, Homo sapiens
ttttatacaggggaa

SEQ ID NO: 6756700 - DNA, 23 bp, Homo sapiens
ttttatacagtagtgagaagaat

SEQ ID NO: 6756701 - DNA, 13 bp, Homo sapiens
ttttatacataaa

SEQ ID NO: 6756702 - DNA, 21 bp, Homo sapiens
ttttatacataaacaagacca

SEQ ID NO: 6756703 - DNA, 10 bp, Homo sapiens
ttttatacca

SEQ ID NO: 6756704 - DNA, 16 bp, Homo sapiens
ttttatacctgtttaa

SEQ ID NO: 6756705 - DNA, 19 bp, Homo sapiens
ttttatactgcacagtggc

SEQ ID NO: 6756706 - DNA, 12 bp, Homo sapiens
ttttatactgta

SEQ ID NO: 6756707 - DNA, 12 bp, Homo sapiens
ttttatacttca

SEQ ID NO: 6756708 - DNA, 19 bp, Homo sapiens
ttttatacttcaaatgtca

SEQ ID NO: 6756709 - DNA, 13 bp, Homo sapiens
ttttatagaaaat

SEQ ID NO: 6756710 - DNA, 13 bp, Homo sapiens
ttttatagaggtt

SEQ ID NO: 6756711 - DNA, 22 bp, Homo sapiens
ttttatagatgggcaactggct

SEQ ID NO: 6756712 - DNA, 19 bp, Homo sapiens
ttttatagcttaactaatt

SEQ ID NO: 6756713 - DNA, 22 bp, Homo sapiens
ttttataggactgttctttgct

SEQ ID NO: 6756714 - DNA, 15 bp, Homo sapiens
ttttataggagagat

SEQ ID NO: 6756715 - DNA, 16 bp, Homo sapiens
ttttataggttgttct

SEQ ID NO: 6756716 - DNA, 13 bp, Homo sapiens
ttttatagtggaa

SEQ ID NO: 6756717 - DNA, 14 bp, Homo sapiens
ttttatagtggaaa

SEQ ID NO: 6756718 - DNA, 16 bp, Homo sapiens
ttttatagttgtattt

SEQ ID NO: 6756719 - DNA, 9 bp, Homo sapiens
ttttatata

SEQ ID NO: 6756720 - DNA, 14 bp, Homo sapiens
ttttatataaatat

SEQ ID NO: 6756721 - DNA, 13 bp, Homo sapiens
ttttatataacta

SEQ ID NO: 6756722 - DNA, 16 bp, Homo sapiens
ttttatataataaaag

SEQ ID NO: 6756723 - DNA, 22 bp, Homo sapiens
ttttatataatatctaaagtta

SEQ ID NO: 6756724 - DNA, 22 bp, Homo sapiens
ttttatatacagaggaaatctg

SEQ ID NO: 6756725 - DNA, 14 bp, Homo sapiens
ttttatatataaaa

SEQ ID NO: 6756726 - DNA, 16 bp, Homo sapiens
ttttatatatgaatat

SEQ ID NO: 6756727 - DNA, 21 bp, Homo sapiens
ttttatatatgaatattacat

SEQ ID NO: 6756728 - DNA, 12 bp, Homo sapiens
ttttatatatta

SEQ ID NO: 6756729 - DNA, 12 bp, Homo sapiens
ttttatatcatt

SEQ ID NO: 6756730 - DNA, 18 bp, Homo sapiens
ttttatatctgtatgtat

SEQ ID NO: 6756731 - DNA, 22 bp, Homo sapiens
ttttatatgaaatgtttcacta

SEQ ID NO: 6756732 - DNA, 22 bp, Homo sapiens
ttttatatgaagataagtgtat

SEQ ID NO: 6756733 - DNA, 22 bp, Homo sapiens
ttttctaaacgtaagcactgtt

SEQ ID NO: 6756734 - DNA, 23 bp, Homo sapiens
ttttctaaacgtaagcactgttt

SEQ ID NO: 6756735 - DNA, 22 bp, Homo sapiens
ttttctaaactgttttcatgtg

SEQ ID NO: 6756736 - DNA, 14 bp, Homo sapiens
ttttctaaatgttt

SEQ ID NO: 6756737 - DNA, 20 bp, Homo sapiens
ttttctaaattctttcatga

SEQ ID NO: 6756738 - DNA, 13 bp, Homo sapiens
ttttctaaccttg

SEQ ID NO: 6756739 - DNA, 20 bp, Homo sapiens
ttttctaactgtaaatcact

SEQ ID NO: 6756740 - DNA, 21 bp, Homo sapiens
ttttctaactgtaaatcactt

SEQ ID NO: 6756741 - DNA, 16 bp, Homo sapiens
ttttctaagaaacatt

SEQ ID NO: 6756742 - DNA, 17 bp, Homo sapiens
ttttctaagaaccaaaa

SEQ ID NO: 6756743 - DNA, 14 bp, Homo sapiens
ttttctaagacagt

SEQ ID NO: 6756744 - DNA, 13 bp, Homo sapiens
ttttctacaaata

SEQ ID NO: 6756745 - DNA, 16 bp, Homo sapiens
ttttctacagcaaatt

SEQ ID NO: 6756746 - DNA, 23 bp, Homo sapiens
ttttctagaatactaataaaata

SEQ ID NO: 6756747 - DNA, 15 bp, Homo sapiens
ttttctagaattatt

SEQ ID NO: 6756748 - DNA, 16 bp, Homo sapiens
ttttctagagacacat

SEQ ID NO: 6756749 - DNA, 19 bp, Homo sapiens
ttttctagatacaataaat

SEQ ID NO: 6756750 - DNA, 21 bp, Homo sapiens
ttttctagcccgaatacaaac

SEQ ID NO: 6756751 - DNA, 21 bp, Homo sapiens
ttttctaggccaaaaatggtg

SEQ ID NO: 6756752 - DNA, 13 bp, Homo sapiens
ttttctagtgtat

SEQ ID NO: 6756753 - DNA, 17 bp, Homo sapiens
ttttctagtgtatcaaa

SEQ ID NO: 6756754 - DNA, 20 bp, Homo sapiens
ttttctagtgtatcaaaatg

SEQ ID NO: 6756755 - DNA, 17 bp, Homo sapiens
ttttctagttgtaatgt

SEQ ID NO: 6756756 - DNA, 15 bp, Homo sapiens
ttttctagtttcagt

SEQ ID NO: 6756757 - DNA, 16 bp, Homo sapiens
ttttctagtttgctca

SEQ ID NO: 6756758 - DNA, 23 bp, Homo sapiens
ttttctagtttgctcatactaca

SEQ ID NO: 6756759 - DNA, 16 bp, Homo sapiens
ttttctagtttggcac

SEQ ID NO: 6756760 - DNA, 17 bp, Homo sapiens
ttttctataacctggat

SEQ ID NO: 6756761 - DNA, 14 bp, Homo sapiens
ttttctatatttgt

SEQ ID NO: 6756762 - DNA, 23 bp, Homo sapiens
ttttctatcccccttaaagaaaa

SEQ ID NO: 6756763 - DNA, 14 bp, Homo sapiens
ttttctatgtacta

SEQ ID NO: 6756764 - DNA, 12 bp, Homo sapiens
ttttctattaaa

SEQ ID NO: 6756765 - DNA, 19 bp, Homo sapiens
ttttctattaaaagactca

SEQ ID NO: 6756766 - DNA, 21 bp, Homo sapiens
ttttctattaaaagactcatc

SEQ ID NO: 6756767 - DNA, 19 bp, Homo sapiens
ttttctattccttctggcc

SEQ ID NO: 6756768 - DNA, 17 bp, Homo sapiens
ttttctatttacctcct

SEQ ID NO: 6756769 - DNA, 23 bp, Homo sapiens
ttttctatttcactggagcacaa

SEQ ID NO: 6756770 - DNA, 12 bp, Homo sapiens
ttttctatttct

SEQ ID NO: 6756771 - DNA, 16 bp, Homo sapiens
ttttctcaaaaagctg

SEQ ID NO: 6756772 - DNA, 17 bp, Homo sapiens
ttttctcaaaaagctgc

SEQ ID NO: 6756773 - DNA, 15 bp, Homo sapiens
ttttctcaaaagcat

SEQ ID NO: 6756774 - DNA, 15 bp, Homo sapiens
ttttctcaaagggca

SEQ ID NO: 6756775 - DNA, 15 bp, Homo sapiens
ttttctcaaagtttt

SEQ ID NO: 6756776 - DNA, 16 bp, Homo sapiens
ttttctcaatctcctc

SEQ ID NO: 6756777 - DNA, 21 bp, Homo sapiens
ttttctccaatatcagtgctc

SEQ ID NO: 6756778 - DNA, 14 bp, Homo sapiens
ttttctcccaagaa

SEQ ID NO: 6756779 - DNA, 20 bp, Homo sapiens
ttttctcccaagaaacctga

SEQ ID NO: 6756780 - DNA, 13 bp, Homo sapiens
ttttctcccagaa

SEQ ID NO: 6756781 - DNA, 11 bp, Homo sapiens
ttttctccctc

SEQ ID NO: 6756782 - DNA, 22 bp, Homo sapiens
ttttctccctggatttttacca

SEQ ID NO: 6756783 - DNA, 20 bp, Homo sapiens
ttttctccctttatgtatct

SEQ ID NO: 6756784 - DNA, 14 bp, Homo sapiens
ttttctcctcccag

SEQ ID NO: 6756785 - DNA, 19 bp, Homo sapiens
ttttctcctcccaggaact

SEQ ID NO: 6756786 - DNA, 21 bp, Homo sapiens
ttttctcctccgcctgtgtcc

SEQ ID NO: 6756787 - DNA, 17 bp, Homo sapiens
ttttctcctgcaaattt

SEQ ID NO: 6756788 - DNA, 18 bp, Homo sapiens
ttttctcctgcaaattta

SEQ ID NO: 6756789 - DNA, 17 bp, Homo sapiens
ttttctcctgcagaaag

SEQ ID NO: 6756790 - DNA, 22 bp, Homo sapiens
ttttctcgagtccaaaatcatt

SEQ ID NO: 6756791 - DNA, 21 bp, Homo sapiens
ttttctcgctgtcctttctag

SEQ ID NO: 6756792 - DNA, 14 bp, Homo sapiens
ttttctcggtgggg

SEQ ID NO: 6756793 - DNA, 23 bp, Homo sapiens
ttttctcgtccccctccctgccc

SEQ ID NO: 6756794 - DNA, 19 bp, Homo sapiens
ttttctctaaactgtttct

SEQ ID NO: 6756795 - DNA, 16 bp, Homo sapiens
ttttctctaggaaata

SEQ ID NO: 6756796 - DNA, 17 bp, Homo sapiens
ttttctctatgtacgat

SEQ ID NO: 6756797 - DNA, 15 bp, Homo sapiens
ttttctctcaacacc

SEQ ID NO: 6756798 - DNA, 10 bp, Homo sapiens
ttttctctct

SEQ ID NO: 6756799 - DNA, 12 bp, Homo sapiens
ttttctctctct

SEQ ID NO: 6756800 - DNA, 23 bp, Homo sapiens
ttttctctctctctttgttacat

SEQ ID NO: 6756801 - DNA, 12 bp, Homo sapiens
ttttctctcttt

SEQ ID NO: 6756802 - DNA, 14 bp, Homo sapiens
ttttctctgagatt

SEQ ID NO: 6756803 - DNA, 17 bp, Homo sapiens
ttttctctgatacagaa

SEQ ID NO: 6756804 - DNA, 22 bp, Homo sapiens
ttttctctgatacttttttgaa

SEQ ID NO: 6756805 - DNA, 14 bp, Homo sapiens
ttttctctgatcac

SEQ ID NO: 6756806 - DNA, 20 bp, Homo sapiens
ttttctctgatcacaacttt

SEQ ID NO: 6756807 - DNA, 14 bp, Homo sapiens
ttttctctgctctt

SEQ ID NO: 6756808 - DNA, 16 bp, Homo sapiens
ttttctctggtaatat

SEQ ID NO: 6756809 - DNA, 14 bp, Homo sapiens
ttttctctgtactt

SEQ ID NO: 6756810 - DNA, 15 bp, Homo sapiens
ttttctctgtatatt

SEQ ID NO: 6756811 - DNA, 21 bp, Homo sapiens
ttttctctgtatgaatgtgat

SEQ ID NO: 6756812 - DNA, 13 bp, Homo sapiens
ttttctcttccct

SEQ ID NO: 6756813 - DNA, 13 bp, Homo sapiens
ttttctcttctgt

SEQ ID NO: 6756814 - DNA, 13 bp, Homo sapiens
ttttctcttgtac

SEQ ID NO: 6756815 - DNA, 16 bp, Homo sapiens
ttttctcttgtaccat

SEQ ID NO: 6756816 - DNA, 12 bp, Homo sapiens
ttttctctttaa

SEQ ID NO: 6756817 - DNA, 17 bp, Homo sapiens
ttttctctttctctcct

SEQ ID NO: 6756818 - DNA, 22 bp, Homo sapiens
ttttctctttgtttctgtttct

SEQ ID NO: 6756819 - DNA, 14 bp, Homo sapiens
ttttctgaagttgt

SEQ ID NO: 6756820 - DNA, 11 bp, Homo sapiens
ttttctgaata

SEQ ID NO: 6756821 - DNA, 18 bp, Homo sapiens
ttttctgaataaaaaaga

SEQ ID NO: 6756822 - DNA, 22 bp, Homo sapiens
ttttctgaataaaaaagattct

SEQ ID NO: 6756823 - DNA, 16 bp, Homo sapiens
ttttctgaattcataa

SEQ ID NO: 6756824 - DNA, 23 bp, Homo sapiens
ttttctgaatttttttttaacat

SEQ ID NO: 6756825 - DNA, 16 bp, Homo sapiens
ttttctgacatgcatt

SEQ ID NO: 6756826 - DNA, 20 bp, Homo sapiens
ttttctgacatgcattgttg

SEQ ID NO: 6756827 - DNA, 11 bp, Homo sapiens
ttttctgacca

SEQ ID NO: 6756828 - DNA, 13 bp, Homo sapiens
ttttctgaccaaa

SEQ ID NO: 6756829 - DNA, 23 bp, Homo sapiens
ttttctgacttctagctgtctgt

SEQ ID NO: 6756830 - DNA, 15 bp, Homo sapiens
ttttctgagaaagac

SEQ ID NO: 6756831 - DNA, 10 bp, Homo sapiens
ttttctgagc

SEQ ID NO: 6756832 - DNA, 12 bp, Homo sapiens
ttttctgagccc

SEQ ID NO: 6756833 - DNA, 15 bp, Homo sapiens
ttttctgagcgatta

SEQ ID NO: 6756834 - DNA, 13 bp, Homo sapiens
ttttctgaggaat

SEQ ID NO: 6756835 - DNA, 23 bp, Homo sapiens
ttttctgaggatagtagttaaat

SEQ ID NO: 6756836 - DNA, 21 bp, Homo sapiens
ttttctgatgacataataaag

SEQ ID NO: 6756837 - DNA, 14 bp, Homo sapiens
ttttctgattgtaa

SEQ ID NO: 6756838 - DNA, 16 bp, Homo sapiens
ttttctgcaatgactg

SEQ ID NO: 6756839 - DNA, 13 bp, Homo sapiens
ttttctgcacagc

SEQ ID NO: 6756840 - DNA, 14 bp, Homo sapiens
ttttctgcacagct

SEQ ID NO: 6756841 - DNA, 12 bp, Homo sapiens
ttttctgcacta

SEQ ID NO: 6756842 - DNA, 13 bp, Homo sapiens
ttttctgcactat

SEQ ID NO: 6756843 - DNA, 20 bp, Homo sapiens
ttttctgcactgagcagagt

SEQ ID NO: 6756844 - DNA, 20 bp, Homo sapiens
ttttctgcagctgtttcaaa

SEQ ID NO: 6756845 - DNA, 21 bp, Homo sapiens
ttttctgcatcatctgtagat

SEQ ID NO: 6756846 - DNA, 12 bp, Homo sapiens
ttttctgccaaa

SEQ ID NO: 6756847 - DNA, 15 bp, Homo sapiens
ttttctgccctggct

SEQ ID NO: 6756848 - DNA, 16 bp, Homo sapiens
ttttctgcctgagatt

SEQ ID NO: 6756849 - DNA, 12 bp, Homo sapiens
ttttctgcttta

SEQ ID NO: 6756850 - DNA, 15 bp, Homo sapiens
ttttctgctttagac

SEQ ID NO: 6756851 - DNA, 17 bp, Homo sapiens
ttttctggaaaatgctt

SEQ ID NO: 6756852 - DNA, 19 bp, Homo sapiens
ttttctggaaaatgcttct

SEQ ID NO: 6756853 - DNA, 22 bp, Homo sapiens
ttttctggaaaatgcttcttgg

SEQ ID NO: 6756854 - DNA, 18 bp, Homo sapiens
ttttctggaatgtaatca

SEQ ID NO: 6756855 - DNA, 20 bp, Homo sapiens
ttttctggactctggacttt

SEQ ID NO: 6756856 - DNA, 22 bp, Homo sapiens
ttttctggactctggactttct

SEQ ID NO: 6756857 - DNA, 11 bp, Homo sapiens
ttttctggcac

SEQ ID NO: 6756858 - DNA, 19 bp, Homo sapiens
ttttctggccttgacttat

SEQ ID NO: 6756859 - DNA, 18 bp, Homo sapiens
ttttctgggggaaaaagc

SEQ ID NO: 6756860 - DNA, 21 bp, Homo sapiens
ttttctgggggaaaaagccat

SEQ ID NO: 6756861 - DNA, 16 bp, Homo sapiens
ttttctggtaattttg

SEQ ID NO: 6756862 - DNA, 14 bp, Homo sapiens
ttttctggttccaa

SEQ ID NO: 6756863 - DNA, 15 bp, Homo sapiens
ttttctggttctaac

SEQ ID NO: 6756864 - DNA, 20 bp, Homo sapiens
ttttctgtaaattcatattt

SEQ ID NO: 6756865 - DNA, 19 bp, Homo sapiens
ttttctgtaatgtaaataa

SEQ ID NO: 6756866 - DNA, 11 bp, Homo sapiens
ttttctgtact

SEQ ID NO: 6756867 - DNA, 16 bp, Homo sapiens
ttttctgtagtcattt

SEQ ID NO: 6756868 - DNA, 15 bp, Homo sapiens
ttttctgtatatgat

SEQ ID NO: 6756869 - DNA, 11 bp, Homo sapiens
ttttctgtatt

SEQ ID NO: 6756870 - DNA, 14 bp, Homo sapiens
ttttctgtcctggg

SEQ ID NO: 6756871 - DNA, 15 bp, Homo sapiens
ttttctgtctctgcc

SEQ ID NO: 6756872 - DNA, 17 bp, Homo sapiens
ttttctgtgcctgaata

SEQ ID NO: 6756873 - DNA, 17 bp, Homo sapiens
ttttctgtgtaaaatga

SEQ ID NO: 6756874 - DNA, 15 bp, Homo sapiens
ttttctgtgtaacca

SEQ ID NO: 6756875 - DNA, 23 bp, Homo sapiens
ttttctgtgtgtcagttttcata

SEQ ID NO: 6756876 - DNA, 17 bp, Homo sapiens
ttttctgtgtgttcctg

SEQ ID NO: 6756877 - DNA, 18 bp, Homo sapiens
ttttctgtgtgttcctgg

SEQ ID NO: 6756878 - DNA, 16 bp, Homo sapiens
ttttctgttccctgct

SEQ ID NO: 6756879 - DNA, 13 bp, Homo sapiens
ttttctgttgtaa

SEQ ID NO: 6756880 - DNA, 21 bp, Homo sapiens
ttttctgttgtacgtaaagct

SEQ ID NO: 6756881 - DNA, 21 bp, Homo sapiens
ttttctgtttataattgttta

SEQ ID NO: 6756882 - DNA, 14 bp, Homo sapiens
ttttctgtttctgt

SEQ ID NO: 6756883 - DNA, 13 bp, Homo sapiens
ttttcttaaaaag

SEQ ID NO: 6756884 - DNA, 20 bp, Homo sapiens
ttttcttaaaccaaccttta

SEQ ID NO: 6756885 - DNA, 22 bp, Homo sapiens
ttttcttaaagcaaagtcactt

SEQ ID NO: 6756886 - DNA, 13 bp, Homo sapiens
ttttcttaaagtg

SEQ ID NO: 6756887 - DNA, 23 bp, Homo sapiens
ttttcttaaataataaagatcat

SEQ ID NO: 6756888 - DNA, 17 bp, Homo sapiens
ttttcttaaccagttgt

SEQ ID NO: 6756889 - DNA, 17 bp, Homo sapiens
ttttcttaaccatcttt

SEQ ID NO: 6756890 - DNA, 22 bp, Homo sapiens
ttttcttaagtaatgatactgt

SEQ ID NO: 6756891 - DNA, 17 bp, Homo sapiens
ttttcttactcctcctc

SEQ ID NO: 6756892 - DNA, 16 bp, Homo sapiens
ttttcttatttatatc

SEQ ID NO: 6756893 - DNA, 13 bp, Homo sapiens
ttttcttatttca

SEQ ID NO: 6756894 - DNA, 17 bp, Homo sapiens
ttttcttcagcatttac

SEQ ID NO: 6756895 - DNA, 20 bp, Homo sapiens
ttttcttcatgcctgatgaa

SEQ ID NO: 6756896 - DNA, 16 bp, Homo sapiens
ttttcttcatttctct

SEQ ID NO: 6756897 - DNA, 19 bp, Homo sapiens
ttttcttccaacatgtgat

SEQ ID NO: 6756898 - DNA, 20 bp, Homo sapiens
ttttcttcccatttgtaatg

SEQ ID NO: 6756899 - DNA, 22 bp, Homo sapiens
ttttcttcccatttgtaatgta

SEQ ID NO: 6756900 - DNA, 15 bp, Homo sapiens
ttttcttcccctcct

SEQ ID NO: 6756901 - DNA, 14 bp, Homo sapiens
ttttcttcttccct

SEQ ID NO: 6756902 - DNA, 15 bp, Homo sapiens
ttttcttcttccctc

SEQ ID NO: 6756903 - DNA, 18 bp, Homo sapiens
ttttcttcttccctccct

SEQ ID NO: 6756904 - DNA, 15 bp, Homo sapiens
ttttcttcttttaaa

SEQ ID NO: 6756905 - DNA, 19 bp, Homo sapiens
ttttcttgataattttcct

SEQ ID NO: 6756906 - DNA, 20 bp, Homo sapiens
ttttcttgcaaaacaaacat

SEQ ID NO: 6756907 - DNA, 18 bp, Homo sapiens
ttttcttgcctctgtccc

SEQ ID NO: 6756908 - DNA, 20 bp, Homo sapiens
ttttcttgcttaccttgact

SEQ ID NO: 6756909 - DNA, 19 bp, Homo sapiens
ttttcttggcccagcactg

SEQ ID NO: 6756910 - DNA, 19 bp, Homo sapiens
ttttcttgggatgcttatt

SEQ ID NO: 6756911 - DNA, 22 bp, Homo sapiens
ttttcttggttcttttttcagt

SEQ ID NO: 6756912 - DNA, 19 bp, Homo sapiens
ttttgttcttcagagatca

SEQ ID NO: 6756913 - DNA, 16 bp, Homo sapiens
ttttgttcttgttgta

SEQ ID NO: 6756914 - DNA, 20 bp, Homo sapiens
ttttgttgacattctgaatg

SEQ ID NO: 6756915 - DNA, 13 bp, Homo sapiens
ttttgttgaccat

SEQ ID NO: 6756916 - DNA, 20 bp, Homo sapiens
ttttgttgaccattttgtta

SEQ ID NO: 6756917 - DNA, 15 bp, Homo sapiens
ttttgttgattaaaa

SEQ ID NO: 6756918 - DNA, 13 bp, Homo sapiens
ttttgttgctgtt

SEQ ID NO: 6756919 - DNA, 16 bp, Homo sapiens
ttttgttggtgctttg

SEQ ID NO: 6756920 - DNA, 15 bp, Homo sapiens
ttttgttgtaaaaag

SEQ ID NO: 6756921 - DNA, 16 bp, Homo sapiens
ttttgttgtaaaaaga

SEQ ID NO: 6756922 - DNA, 19 bp, Homo sapiens
ttttgttgtacttaaatgg

SEQ ID NO: 6756923 - DNA, 16 bp, Homo sapiens
ttttgttgtgttctgt

SEQ ID NO: 6756924 - DNA, 17 bp, Homo sapiens
ttttgttgtttttagag

SEQ ID NO: 6756925 - DNA, 11 bp, Homo sapiens
ttttgtttatg

SEQ ID NO: 6756926 - DNA, 17 bp, Homo sapiens
ttttgtttcactctttc

SEQ ID NO: 6756927 - DNA, 16 bp, Homo sapiens
ttttgtttccaggaaa

SEQ ID NO: 6756928 - DNA, 12 bp, Homo sapiens
ttttgtttctgt

SEQ ID NO: 6756929 - DNA, 13 bp, Homo sapiens
ttttgtttctgta

SEQ ID NO: 6756930 - DNA, 15 bp, Homo sapiens
ttttgtttcttggtg

SEQ ID NO: 6756931 - DNA, 14 bp, Homo sapiens
ttttgtttgatgca

SEQ ID NO: 6756932 - DNA, 20 bp, Homo sapiens
ttttgtttgatgcaggcact

SEQ ID NO: 6756933 - DNA, 15 bp, Homo sapiens
ttttgtttgccagga

SEQ ID NO: 6756934 - DNA, 22 bp, Homo sapiens
ttttgtttgctatcttaatttt

SEQ ID NO: 6756935 - DNA, 12 bp, Homo sapiens
ttttgtttggac

SEQ ID NO: 6756936 - DNA, 18 bp, Homo sapiens
ttttgtttggcaaggaaa

SEQ ID NO: 6756937 - DNA, 19 bp, Homo sapiens
ttttgtttggcaaggaaag

SEQ ID NO: 6756938 - DNA, 15 bp, Homo sapiens
ttttgtttggtaaat

SEQ ID NO: 6756939 - DNA, 16 bp, Homo sapiens
ttttgtttggtaaatg

SEQ ID NO: 6756940 - DNA, 14 bp, Homo sapiens
ttttgtttggtatt

SEQ ID NO: 6756941 - DNA, 14 bp, Homo sapiens
ttttgtttgtttct

SEQ ID NO: 6756942 - DNA, 19 bp, Homo sapiens
ttttgtttgtttcttcttt

SEQ ID NO: 6756943 - DNA, 19 bp, Homo sapiens
ttttgtttgtttgagacag

SEQ ID NO: 6756944 - DNA, 16 bp, Homo sapiens
ttttgttttaaaactg

SEQ ID NO: 6756945 - DNA, 21 bp, Homo sapiens
ttttgttttaaggaaaaaaga

SEQ ID NO: 6756946 - DNA, 16 bp, Homo sapiens
ttttgttttacaatgt

SEQ ID NO: 6756947 - DNA, 13 bp, Homo sapiens
ttttgttttcaat

SEQ ID NO: 6756948 - DNA, 13 bp, Homo sapiens
ttttgttttgaaa

SEQ ID NO: 6756949 - DNA, 18 bp, Homo sapiens
ttttgttttgaaagttta

SEQ ID NO: 6756950 - DNA, 17 bp, Homo sapiens
ttttgttttgtctatat

SEQ ID NO: 6756951 - DNA, 20 bp, Homo sapiens
ttttgtttttattaaaagga

SEQ ID NO: 6756952 - DNA, 18 bp, Homo sapiens
ttttgtttttctgcttta

SEQ ID NO: 6756953 - DNA, 16 bp, Homo sapiens
ttttgtttttgcatga

SEQ ID NO: 6756954 - DNA, 19 bp, Homo sapiens
ttttgtttttgtaatgcac

SEQ ID NO: 6756955 - DNA, 18 bp, Homo sapiens
ttttgttttttcaaaata

SEQ ID NO: 6756956 - DNA, 17 bp, Homo sapiens
ttttgtttttttgcaga

SEQ ID NO: 6756957 - DNA, 21 bp, Homo sapiens
tttttaaaaaaaaaaacaaag

SEQ ID NO: 6756958 - DNA, 16 bp, Homo sapiens
tttttaaaaaaaatgt

SEQ ID NO: 6756959 - DNA, 17 bp, Homo sapiens
tttttaaaaaaaatgtg

SEQ ID NO: 6756960 - DNA, 13 bp, Homo sapiens
tttttaaaaaact

SEQ ID NO: 6756961 - DNA, 18 bp, Homo sapiens
tttttaaaaaagaaacat

SEQ ID NO: 6756962 - DNA, 12 bp, Homo sapiens
tttttaaaaaat

SEQ ID NO: 6756963 - DNA, 17 bp, Homo sapiens
tttttaaaaaataccat

SEQ ID NO: 6756964 - DNA, 15 bp, Homo sapiens
tttttaaaaaatgca

SEQ ID NO: 6756965 - DNA, 13 bp, Homo sapiens
tttttaaaaacaa

SEQ ID NO: 6756966 - DNA, 18 bp, Homo sapiens
tttttaaaaagaaactat

SEQ ID NO: 6756967 - DNA, 16 bp, Homo sapiens
tttttaaaaaggcctt

SEQ ID NO: 6756968 - DNA, 20 bp, Homo sapiens
tttttaaaaaggtaaatggt

SEQ ID NO: 6756969 - DNA, 19 bp, Homo sapiens
tttttaaaaagttgcacat

SEQ ID NO: 6756970 - DNA, 21 bp, Homo sapiens
tttttaaaaataaatctaaat

SEQ ID NO: 6756971 - DNA, 20 bp, Homo sapiens
tttttaaaaatccatttacc

SEQ ID NO: 6756972 - DNA, 20 bp, Homo sapiens
tttttaaaaatgcaaatcct

SEQ ID NO: 6756973 - DNA, 21 bp, Homo sapiens
tttttaaaaatgtgtcaaaat

SEQ ID NO: 6756974 - DNA, 15 bp, Homo sapiens
tttttaaaacaaaag

SEQ ID NO: 6756975 - DNA, 16 bp, Homo sapiens
tttttaaaacaaaaga

SEQ ID NO: 6756976 - DNA, 14 bp, Homo sapiens
tttttaaaacacat

SEQ ID NO: 6756977 - DNA, 16 bp, Homo sapiens
tttttaaaacactaaa

SEQ ID NO: 6756978 - DNA, 22 bp, Homo sapiens
tttttaaaacactaaaagcagc

SEQ ID NO: 6756979 - DNA, 23 bp, Homo sapiens
tttttaaaaccactatgcaaaga

SEQ ID NO: 6756980 - DNA, 22 bp, Homo sapiens
tttttaaaactcagatttaaaa

SEQ ID NO: 6756981 - DNA, 15 bp, Homo sapiens
tttttaaaagagaca

SEQ ID NO: 6756982 - DNA, 12 bp, Homo sapiens
tttttaaaagat

SEQ ID NO: 6756983 - DNA, 13 bp, Homo sapiens
tttttaaaagcct

SEQ ID NO: 6756984 - DNA, 22 bp, Homo sapiens
tttttaaaagttgttaccaaat

SEQ ID NO: 6756985 - DNA, 20 bp, Homo sapiens
tttttaaaataaactgtaaa

SEQ ID NO: 6756986 - DNA, 21 bp, Homo sapiens
tttttaaaataaactgtaaac

SEQ ID NO: 6756987 - DNA, 22 bp, Homo sapiens
tttttaaaatagaatgatagaa

SEQ ID NO: 6756988 - DNA, 14 bp, Homo sapiens
tttttaaaatatat

SEQ ID NO: 6756989 - DNA, 21 bp, Homo sapiens
tttttaaaatatttaactttt

SEQ ID NO: 6756990 - DNA, 19 bp, Homo sapiens
tttttaaaatccagacttt

SEQ ID NO: 6756991 - DNA, 21 bp, Homo sapiens
tttttaaaatccagactttct

SEQ ID NO: 6756992 - DNA, 23 bp, Homo sapiens
tttttaaaatgaatcttatgcaa

SEQ ID NO: 6756993 - DNA, 17 bp, Homo sapiens
tttttaaaatggtgctt

SEQ ID NO: 6756994 - DNA, 13 bp, Homo sapiens
tttttaaaattga

SEQ ID NO: 6756995 - DNA, 15 bp, Homo sapiens
tttttaaaatttaga

SEQ ID NO: 6756996 - DNA, 17 bp, Homo sapiens
tttttaaaatttatttg

SEQ ID NO: 6756997 - DNA, 21 bp, Homo sapiens
tttttaaaatttatttgcaaa

SEQ ID NO: 6756998 - DNA, 14 bp, Homo sapiens
tttttaaaattttg

SEQ ID NO: 6756999 - DNA, 19 bp, Homo sapiens
tttttaaacaaacattgtg

SEQ ID NO: 6757000 - DNA, 16 bp, Homo sapiens
tttttaaacaagtatt

SEQ ID NO: 6757001 - DNA, 16 bp, Homo sapiens
tttttaaacaataaag

SEQ ID NO: 6757002 - DNA, 13 bp, Homo sapiens
tttttaaacatca

SEQ ID NO: 6757003 - DNA, 22 bp, Homo sapiens
tttttaaaccagggatgtctgt

SEQ ID NO: 6757004 - DNA, 16 bp, Homo sapiens
tttttaaactagtaat

SEQ ID NO: 6757005 - DNA, 21 bp, Homo sapiens
tttttaaactgatgtatagct

SEQ ID NO: 6757006 - DNA, 13 bp, Homo sapiens
tttttaaactgta

SEQ ID NO: 6757007 - DNA, 15 bp, Homo sapiens
tttttaaactgtaca

SEQ ID NO: 6757008 - DNA, 18 bp, Homo sapiens
tttttaaactgtacagtg

SEQ ID NO: 6757009 - DNA, 21 bp, Homo sapiens
tttttaaactgtacagtgtct

SEQ ID NO: 6757010 - DNA, 11 bp, Homo sapiens
tttttaaactt

SEQ ID NO: 6757011 - DNA, 18 bp, Homo sapiens
tttttaaagaagagtgac

SEQ ID NO: 6757012 - DNA, 14 bp, Homo sapiens
tttttaaagaatgt

SEQ ID NO: 6757013 - DNA, 12 bp, Homo sapiens
tttttaaagcaa

SEQ ID NO: 6757014 - DNA, 21 bp, Homo sapiens
tttttaaagcctggcttctta

SEQ ID NO: 6757015 - DNA, 13 bp, Homo sapiens
tttttaaagcctt

SEQ ID NO: 6757016 - DNA, 13 bp, Homo sapiens
tttttaaagctta

SEQ ID NO: 6757017 - DNA, 22 bp, Homo sapiens
tttttaaaggggtctgttctgc

SEQ ID NO: 6757018 - DNA, 16 bp, Homo sapiens
tttttaaagtaaactt

SEQ ID NO: 6757019 - DNA, 22 bp, Homo sapiens
tttttaaagtaaacttgtgtat

SEQ ID NO: 6757020 - DNA, 21 bp, Homo sapiens
tttttaaagtctaaactgtta

SEQ ID NO: 6757021 - DNA, 16 bp, Homo sapiens
tttttaaagtgtacat

SEQ ID NO: 6757022 - DNA, 16 bp, Homo sapiens
tttttaaagtttaaat

SEQ ID NO: 6757023 - DNA, 11 bp, Homo sapiens
tttttaaataa

SEQ ID NO: 6757024 - DNA, 23 bp, Homo sapiens
tttttaaataaaaattactgtgt

SEQ ID NO: 6757025 - DNA, 17 bp, Homo sapiens
tttttaaataaaagcac

SEQ ID NO: 6757026 - DNA, 19 bp, Homo sapiens
tttttaaataaaagcacaa

SEQ ID NO: 6757027 - DNA, 16 bp, Homo sapiens
tttttaaatattttct

SEQ ID NO: 6757028 - DNA, 18 bp, Homo sapiens
tttttaaatcaaaaactt

SEQ ID NO: 6757029 - DNA, 13 bp, Homo sapiens
tttttaaatcata

SEQ ID NO: 6757030 - DNA, 22 bp, Homo sapiens
tttttaaatcattcattcaata

SEQ ID NO: 6757031 - DNA, 20 bp, Homo sapiens
tttttaaatgaaaatgtaac

SEQ ID NO: 6757032 - DNA, 19 bp, Homo sapiens
tttttaaatgatcatgaaa

SEQ ID NO: 6757033 - DNA, 20 bp, Homo sapiens
tttttaaatgatgttgaata

SEQ ID NO: 6757034 - DNA, 11 bp, Homo sapiens
tttttaaatgc

SEQ ID NO: 6757035 - DNA, 23 bp, Homo sapiens
tttttaaatgtatactatagtac

SEQ ID NO: 6757036 - DNA, 14 bp, Homo sapiens
tttttaaatgtgaa

SEQ ID NO: 6757037 - DNA, 18 bp, Homo sapiens
tttttaaatgtgcttcat

SEQ ID NO: 6757038 - DNA, 14 bp, Homo sapiens
tttttaaatgtttc

SEQ ID NO: 6757039 - DNA, 23 bp, Homo sapiens
tttttaaattggagaaaagcact

SEQ ID NO: 6757040 - DNA, 24 bp, Homo sapiens
tttttaaattggagaaaagcactt

SEQ ID NO: 6757041 - DNA, 18 bp, Homo sapiens
tttttaaatttacagaat

SEQ ID NO: 6757042 - DNA, 15 bp, Homo sapiens
tttttaaatttcagt

SEQ ID NO: 6757043 - DNA, 15 bp, Homo sapiens
tttttaaatttgcca

SEQ ID NO: 6757044 - DNA, 14 bp, Homo sapiens
tttttaaattttct

SEQ ID NO: 6757045 - DNA, 16 bp, Homo sapiens
tttttaaattttgtaa

SEQ ID NO: 6757046 - DNA, 10 bp, Homo sapiens
tttttaacac

SEQ ID NO: 6757047 - DNA, 13 bp, Homo sapiens
tttttaacacata

SEQ ID NO: 6757048 - DNA, 15 bp, Homo sapiens
tttttaacatgtgtt

SEQ ID NO: 6757049 - DNA, 17 bp, Homo sapiens
tttttaacctctgttca

SEQ ID NO: 6757050 - DNA, 11 bp, Homo sapiens
tttttaactca

SEQ ID NO: 6757051 - DNA, 17 bp, Homo sapiens
tttttaactgaaaatgt

SEQ ID NO: 6757052 - DNA, 18 bp, Homo sapiens
tttttaactgaaaatgta

SEQ ID NO: 6757053 - DNA, 16 bp, Homo sapiens
tttttaactgattctt

SEQ ID NO: 6757054 - DNA, 15 bp, Homo sapiens
tttttaactggtgaa

SEQ ID NO: 6757055 - DNA, 16 bp, Homo sapiens
tttttaactggtgaag

SEQ ID NO: 6757056 - DNA, 12 bp, Homo sapiens
tttttaactgta

SEQ ID NO: 6757057 - DNA, 15 bp, Homo sapiens
tttttaactttgaaa

SEQ ID NO: 6757058 - DNA, 12 bp, Homo sapiens
tttttaactttt

SEQ ID NO: 6757059 - DNA, 23 bp, Homo sapiens
tttttaagaaaaaggatgcacag

SEQ ID NO: 6757060 - DNA, 15 bp, Homo sapiens
tttttaagaaagtaa

SEQ ID NO: 6757061 - DNA, 22 bp, Homo sapiens
tttttaagactgtgtctgtatt

SEQ ID NO: 6757062 - DNA, 21 bp, Homo sapiens
tttttaagacttttctttcct

SEQ ID NO: 6757063 - DNA, 18 bp, Homo sapiens
tttttaagagaattagac

SEQ ID NO: 6757064 - DNA, 12 bp, Homo sapiens
tttttaagagta

SEQ ID NO: 6757065 - DNA, 16 bp, Homo sapiens
tttttaagatagtgta

SEQ ID NO: 6757066 - DNA, 18 bp, Homo sapiens
tttttaagccttaaagga

SEQ ID NO: 6757067 - DNA, 18 bp, Homo sapiens
tttttaagcctttgaagt

SEQ ID NO: 6757068 - DNA, 18 bp, Homo sapiens
tttttaagctgtttccat

SEQ ID NO: 6757069 - DNA, 12 bp, Homo sapiens
tttttaaggact

SEQ ID NO: 6757070 - DNA, 20 bp, Homo sapiens
tttttaaggctctgtgcctt

SEQ ID NO: 6757071 - DNA, 22 bp, Homo sapiens
tttttaaggtagtggttaatta

SEQ ID NO: 6757072 - DNA, 16 bp, Homo sapiens
tttttaaggtgagttc

SEQ ID NO: 6757073 - DNA, 15 bp, Homo sapiens
tttttaagtacaaaa

SEQ ID NO: 6757074 - DNA, 16 bp, Homo sapiens
tttttaagtatttata

SEQ ID NO: 6757075 - DNA, 13 bp, Homo sapiens
tttttaagtgaaa

SEQ ID NO: 6757076 - DNA, 20 bp, Homo sapiens
tttttaagtgaaaatatagc

SEQ ID NO: 6757077 - DNA, 14 bp, Homo sapiens
tttttaagtgaaat

SEQ ID NO: 6757078 - DNA, 17 bp, Homo sapiens
tttttaagtgctgcatt

SEQ ID NO: 6757079 - DNA, 14 bp, Homo sapiens
tttttaagttcaat

SEQ ID NO: 6757080 - DNA, 15 bp, Homo sapiens
tttttaagttcccag

SEQ ID NO: 6757081 - DNA, 18 bp, Homo sapiens
tttttaataaaaaggcac

SEQ ID NO: 6757082 - DNA, 14 bp, Homo sapiens
tttttaataaaaat

SEQ ID NO: 6757083 - DNA, 12 bp, Homo sapiens
tttttaataaac

SEQ ID NO: 6757084 - DNA, 16 bp, Homo sapiens
tttttaataatttcat

SEQ ID NO: 6757085 - DNA, 13 bp, Homo sapiens
tttttaatagaat

SEQ ID NO: 6757086 - DNA, 16 bp, Homo sapiens
tttttaatagcactaa

SEQ ID NO: 6757087 - DNA, 21 bp, Homo sapiens
tttttaatagcactaaccaat

SEQ ID NO: 6757088 - DNA, 20 bp, Homo sapiens
tttttaatagtctagaatgt

SEQ ID NO: 6757089 - DNA, 21 bp, Homo sapiens
tttttaatatgtaaggaatgc

SEQ ID NO: 6757090 - DNA, 13 bp, Homo sapiens
tttttaatcagtt

SEQ ID NO: 6757091 - DNA, 13 bp, Homo sapiens
tttttaatctctt

SEQ ID NO: 6757092 - DNA, 12 bp, Homo sapiens
tttttgtatgtt

SEQ ID NO: 6757093 - DNA, 22 bp, Homo sapiens
tttttgtatttctctattttca

SEQ ID NO: 6757094 - DNA, 16 bp, Homo sapiens
tttttgtcaacattgt

SEQ ID NO: 6757095 - DNA, 23 bp, Homo sapiens
tttttgtcacctcaatatttact

SEQ ID NO: 6757096 - DNA, 13 bp, Homo sapiens
tttttgtcactat

SEQ ID NO: 6757097 - DNA, 12 bp, Homo sapiens
tttttgtccctg

SEQ ID NO: 6757098 - DNA, 22 bp, Homo sapiens
tttttgtccctgctcctcccaa

SEQ ID NO: 6757099 - DNA, 16 bp, Homo sapiens
tttttgtcttattgaa

SEQ ID NO: 6757100 - DNA, 20 bp, Homo sapiens
tttttgtgaaaatgtcaaag

SEQ ID NO: 6757101 - DNA, 13 bp, Homo sapiens
tttttgtgaagac

SEQ ID NO: 6757102 - DNA, 22 bp, Homo sapiens
tttttgtgccattatatttgca

SEQ ID NO: 6757103 - DNA, 18 bp, Homo sapiens
tttttgtgtatgtactta

SEQ ID NO: 6757104 - DNA, 21 bp, Homo sapiens
tttttgtgtccgctaaatatt

SEQ ID NO: 6757105 - DNA, 15 bp, Homo sapiens
tttttgtgtgtattt

SEQ ID NO: 6757106 - DNA, 17 bp, Homo sapiens
tttttgtgtgtatttgc

SEQ ID NO: 6757107 - DNA, 17 bp, Homo sapiens
tttttgtgtgtgctgga

SEQ ID NO: 6757108 - DNA, 22 bp, Homo sapiens
tttttgtgttttgttctttaaa

SEQ ID NO: 6757109 - DNA, 16 bp, Homo sapiens
tttttgttaagctcag

SEQ ID NO: 6757110 - DNA, 15 bp, Homo sapiens
tttttgttagcaaag

SEQ ID NO: 6757111 - DNA, 15 bp, Homo sapiens
tttttgttcttaaaa

SEQ ID NO: 6757112 - DNA, 20 bp, Homo sapiens
tttttgttcttaattgcact

SEQ ID NO: 6757113 - DNA, 15 bp, Homo sapiens
tttttgttgttttgt

SEQ ID NO: 6757114 - DNA, 13 bp, Homo sapiens
tttttgtttgatg

SEQ ID NO: 6757115 - DNA, 13 bp, Homo sapiens
tttttgtttgcat

SEQ ID NO: 6757116 - DNA, 11 bp, Homo sapiens
tttttgtttgg

SEQ ID NO: 6757117 - DNA, 17 bp, Homo sapiens
tttttgttttacaatgt

SEQ ID NO: 6757118 - DNA, 13 bp, Homo sapiens
tttttgttttcaa

SEQ ID NO: 6757119 - DNA, 15 bp, Homo sapiens
tttttgttttgaaag

SEQ ID NO: 6757120 - DNA, 16 bp, Homo sapiens
tttttgtttttctgct

SEQ ID NO: 6757121 - DNA, 16 bp, Homo sapiens
tttttgttttttgtaa

SEQ ID NO: 6757122 - DNA, 17 bp, Homo sapiens
ttttttaaaacaaaaga

SEQ ID NO: 6757123 - DNA, 18 bp, Homo sapiens
ttttttaaaaggccattt

SEQ ID NO: 6757124 - DNA, 14 bp, Homo sapiens
ttttttaaaataga

SEQ ID NO: 6757125 - DNA, 12 bp, Homo sapiens
ttttttaaagca

SEQ ID NO: 6757126 - DNA, 18 bp, Homo sapiens
ttttttaaataaaataga

SEQ ID NO: 6757127 - DNA, 11 bp, Homo sapiens
ttttttaacat

SEQ ID NO: 6757128 - DNA, 19 bp, Homo sapiens
ttttttaaccaaggagggg

SEQ ID NO: 6757129 - DNA, 20 bp, Homo sapiens
ttttttaaccccgtcaacaa

SEQ ID NO: 6757130 - DNA, 12 bp, Homo sapiens
ttttttaactgt

SEQ ID NO: 6757131 - DNA, 13 bp, Homo sapiens
ttttttaacttga

SEQ ID NO: 6757132 - DNA, 14 bp, Homo sapiens
ttttttaacttgaa

SEQ ID NO: 6757133 - DNA, 17 bp, Homo sapiens
ttttttaagtatttata

SEQ ID NO: 6757134 - DNA, 15 bp, Homo sapiens
ttttttaataaattt

SEQ ID NO: 6757135 - DNA, 15 bp, Homo sapiens
ttttttaatgtatct

SEQ ID NO: 6757136 - DNA, 14 bp, Homo sapiens
ttttttaatgtatt

SEQ ID NO: 6757137 - DNA, 12 bp, Homo sapiens
ttttttaatttc

SEQ ID NO: 6757138 - DNA, 16 bp, Homo sapiens
ttttttaatttctgaa

SEQ ID NO: 6757139 - DNA, 18 bp, Homo sapiens
ttttttaatttgttttgt

SEQ ID NO: 6757140 - DNA, 13 bp, Homo sapiens
ttttttacaaagg

SEQ ID NO: 6757141 - DNA, 23 bp, Homo sapiens
ttttttacaaagtttcaaaaact

SEQ ID NO: 6757142 - DNA, 17 bp, Homo sapiens
ttttttacaaattatgt

SEQ ID NO: 6757143 - DNA, 13 bp, Homo sapiens
ttttttacaacta

SEQ ID NO: 6757144 - DNA, 21 bp, Homo sapiens
ttttttacaactatgtaattt

SEQ ID NO: 6757145 - DNA, 11 bp, Homo sapiens
ttttttacatt

SEQ ID NO: 6757146 - DNA, 13 bp, Homo sapiens
ttttttacctgtt

SEQ ID NO: 6757147 - DNA, 13 bp, Homo sapiens
ttttttacggaat

SEQ ID NO: 6757148 - DNA, 12 bp, Homo sapiens
ttttttactaat

SEQ ID NO: 6757149 - DNA, 17 bp, Homo sapiens
ttttttactctttgaaa

SEQ ID NO: 6757150 - DNA, 12 bp, Homo sapiens
ttttttactttg

SEQ ID NO: 6757151 - DNA, 18 bp, Homo sapiens
ttttttagggtttctgat

SEQ ID NO: 6757152 - DNA, 19 bp, Homo sapiens
ttttttagtaaattaagag

SEQ ID NO: 6757153 - DNA, 13 bp, Homo sapiens
ttttttagttgaa

SEQ ID NO: 6757154 - DNA, 11 bp, Homo sapiens
ttttttataca

SEQ ID NO: 6757155 - DNA, 15 bp, Homo sapiens
ttttttatacacata

SEQ ID NO: 6757156 - DNA, 20 bp, Homo sapiens
ttttttatacaggatgatga

SEQ ID NO: 6757157 - DNA, 11 bp, Homo sapiens
ttttttatact

SEQ ID NO: 6757158 - DNA, 13 bp, Homo sapiens
ttttttatacttc

SEQ ID NO: 6757159 - DNA, 15 bp, Homo sapiens
ttttttatatatgtg

SEQ ID NO: 6757160 - DNA, 13 bp, Homo sapiens
ttttttatctttt

SEQ ID NO: 6757161 - DNA, 15 bp, Homo sapiens
ttttttatgttttgt

SEQ ID NO: 6757162 - DNA, 11 bp, Homo sapiens
ttttttattat

SEQ ID NO: 6757163 - DNA, 11 bp, Homo sapiens
ttttttattca

SEQ ID NO: 6757164 - DNA, 15 bp, Homo sapiens
ttttttattcagcag

SEQ ID NO: 6757165 - DNA, 14 bp, Homo sapiens
ttttttattcttgt

SEQ ID NO: 6757166 - DNA, 19 bp, Homo sapiens
ttttttattgctagtattt

SEQ ID NO: 6757167 - DNA, 17 bp, Homo sapiens
ttttttatttctactgt

SEQ ID NO: 6757168 - DNA, 21 bp, Homo sapiens
ttttttcaaaatgaagataca

SEQ ID NO: 6757169 - DNA, 12 bp, Homo sapiens
ttttttcaaata

SEQ ID NO: 6757170 - DNA, 14 bp, Homo sapiens
ttttttcaacactc

SEQ ID NO: 6757171 - DNA, 12 bp, Homo sapiens
ttttttcaatgt

SEQ ID NO: 6757172 - DNA, 18 bp, Homo sapiens
ttttttcagactgtgcaa

SEQ ID NO: 6757173 - DNA, 23 bp, Homo sapiens
ttttttcatccctgccaagaact

SEQ ID NO: 6757174 - DNA, 12 bp, Homo sapiens
ttttttccaaaa

SEQ ID NO: 6757175 - DNA, 16 bp, Homo sapiens
ttttttccagagttgt

SEQ ID NO: 6757176 - DNA, 12 bp, Homo sapiens
ttttttccccag

SEQ ID NO: 6757177 - DNA, 11 bp, Homo sapiens
ttttttcctaa

SEQ ID NO: 6757178 - DNA, 12 bp, Homo sapiens
ttttttcctaag

SEQ ID NO: 6757179 - DNA, 12 bp, Homo sapiens
ttttttcctctt

SEQ ID NO: 6757180 - DNA, 14 bp, Homo sapiens
ttttttcctgtcaa

SEQ ID NO: 6757181 - DNA, 15 bp, Homo sapiens
ttttttcctgtcata

SEQ ID NO: 6757182 - DNA, 12 bp, Homo sapiens
ttttttcctgtg

SEQ ID NO: 6757183 - DNA, 16 bp, Homo sapiens
ttttttccttttgctg

SEQ ID NO: 6757184 - DNA, 13 bp, Homo sapiens
ttttttccttttt

SEQ ID NO: 6757185 - DNA, 15 bp, Homo sapiens
ttttttctaagagaa

SEQ ID NO: 6757186 - DNA, 12 bp, Homo sapiens
ttttttctattt

SEQ ID NO: 6757187 - DNA, 11 bp, Homo sapiens
ttttttctgaa

SEQ ID NO: 6757188 - DNA, 17 bp, Homo sapiens
ttttttctgatttgtcc

SEQ ID NO: 6757189 - DNA, 18 bp, Homo sapiens
ttttttctgcacagcttt

SEQ ID NO: 6757190 - DNA, 13 bp, Homo sapiens
ttttttcttcccc

SEQ ID NO: 6757191 - DNA, 12 bp, Homo sapiens
ttttttcttggt

SEQ ID NO: 6757192 - DNA, 12 bp, Homo sapiens
ttttttcttgta

SEQ ID NO: 6757193 - DNA, 12 bp, Homo sapiens
ttttttctttca

SEQ ID NO: 6757194 - DNA, 9 bp, Homo sapiens
ttttttgaa

SEQ ID NO: 6757195 - DNA, 13 bp, Homo sapiens
ttttttgaaacag

SEQ ID NO: 6757196 - DNA, 13 bp, Homo sapiens
ttttttgaaagtg

SEQ ID NO: 6757197 - DNA, 13 bp, Homo sapiens
ttttttgaaatca

SEQ ID NO: 6757198 - DNA, 12 bp, Homo sapiens
ttttttgaaatg

SEQ ID NO: 6757199 - DNA, 19 bp, Homo sapiens
ttttttgaacctccaaatg

SEQ ID NO: 6757200 - DNA, 19 bp, Homo sapiens
ttttttgaactcttctcat

SEQ ID NO: 6757201 - DNA, 17 bp, Homo sapiens
ttttttgagagagagtc

SEQ ID NO: 6757202 - DNA, 13 bp, Homo sapiens
ttttttgatatat

SEQ ID NO: 6757203 - DNA, 15 bp, Homo sapiens
ttttttgcaagtgaa

SEQ ID NO: 6757204 - DNA, 13 bp, Homo sapiens
ttttttgcaataa

SEQ ID NO: 6757205 - DNA, 17 bp, Homo sapiens
ttttttgcagtaactgt

SEQ ID NO: 6757206 - DNA, 20 bp, Homo sapiens
ttttttgcattttcacaaat

SEQ ID NO: 6757207 - DNA, 16 bp, Homo sapiens
ttttttgctatggaag

SEQ ID NO: 6757208 - DNA, 22 bp, Homo sapiens
ttttttggtagcttgtatcaaa

SEQ ID NO: 6757209 - DNA, 11 bp, Homo sapiens
ttttttgtaac

SEQ ID NO: 6757210 - DNA, 12 bp, Homo sapiens
ttttttgtacaa

SEQ ID NO: 6757211 - DNA, 14 bp, Homo sapiens
ttttttgtaccatt

SEQ ID NO: 6757212 - DNA, 15 bp, Homo sapiens
ttttttgtagatgaa

SEQ ID NO: 6757213 - DNA, 12 bp, Homo sapiens
ttttttgtagtt

SEQ ID NO: 6757214 - DNA, 17 bp, Homo sapiens
ttttttgtcttattgaa

SEQ ID NO: 6757215 - DNA, 12 bp, Homo sapiens
ttttttgttcat

SEQ ID NO: 6757216 - DNA, 12 bp, Homo sapiens
ttttttgttgac

SEQ ID NO: 6757217 - DNA, 16 bp, Homo sapiens
ttttttgtttgtttgt

SEQ ID NO: 6757218 - DNA, 18 bp, Homo sapiens
ttttttgttttacaatgt

SEQ ID NO: 6757219 - DNA, 12 bp, Homo sapiens
tttttttaagca

SEQ ID NO: 6757220 - DNA, 12 bp, Homo sapiens
tttttttaatgt

SEQ ID NO: 6757221 - DNA, 18 bp, Homo sapiens
tttttttaccaattccaa

SEQ ID NO: 6757222 - DNA, 12 bp, Homo sapiens
tttttttattaa

SEQ ID NO: 6757223 - DNA, 13 bp, Homo sapiens
tttttttcaaatg

SEQ ID NO: 6757224 - DNA, 14 bp, Homo sapiens
tttttttcaatgtg

SEQ ID NO: 6757225 - DNA, 10 bp, Homo sapiens
tttttttccc

SEQ ID NO: 6757226 - DNA, 13 bp, Homo sapiens
tttttttcctttt

SEQ ID NO: 6757227 - DNA, 12 bp, Homo sapiens
tttttttctgat

SEQ ID NO: 6757228 - DNA, 12 bp, Homo sapiens
tttttttctggg

SEQ ID NO: 6757229 - DNA, 12 bp, Homo sapiens
tttttttgagat

SEQ ID NO: 6757230 - DNA, 11 bp, Homo sapiens
tttttttgcca

SEQ ID NO: 6757231 - DNA, 11 bp, Homo sapiens
tttttttggat

SEQ ID NO: 6757232 - DNA, 12 bp, Homo sapiens
tttttttggatg

SEQ ID NO: 6757233 - DNA, 10 bp, Homo sapiens
tttttttggc

SEQ ID NO: 6757234 - DNA, 14 bp, Homo sapiens
tttttttgtacgac

SEQ ID NO: 6757235 - DNA, 13 bp, Homo sapiens
tttttttgtagat

SEQ ID NO: 6757236 - DNA, 12 bp, Homo sapiens
tttttttgtagc

SEQ ID NO: 6757237 - DNA, 14 bp, Homo sapiens
tttttttgtatttc

SEQ ID NO: 6757238 - DNA, 14 bp, Homo sapiens
ttttttttaaacta

SEQ ID NO: 6757239 - DNA, 12 bp, Homo sapiens
ttttttttcagg

SEQ ID NO: 6757240 - DNA, 13 bp, Homo sapiens
ttttttttccctc

SEQ ID NO: 6757241 - DNA, 13 bp, Homo sapiens
ttttttttcctgt

SEQ ID NO: 6757242 - DNA, 12 bp, Homo sapiens
ttttttttcctt

SEQ ID NO: 6757243 - DNA, 13 bp, Homo sapiens
ttttttttgaaaa

SEQ ID NO: 6757244 - DNA, 11 bp, Homo sapiens
ttttttttgca

SEQ ID NO: 6757245 - DNA, 13 bp, Homo sapiens
tttttttttccaa

SEQ ID NO: 6757246 - DNA, 13 bp, Homo sapiens
ttttttttttcaa

SEQ ID NO: 6757247 - DNA, 13 bp, Homo sapiens
ttttttttttcct

SEQ ID NO: 6757248 - DNA, 55 bp, Homo sapiens
tgttaagtcctcacagtccttcacaaaaattgagtcctgttttgaggacttgaca

SEQ ID NO: 6757249 - DNA, 81 bp, Homo sapiens
atcagatgtattttttaaatgtagcatttgttattttactttttaaaataaagcatgcttgtttggagagcactacaggat

SEQ ID NO: 6757250 - DNA, 62 bp, Homo sapiens
gaggtgatggatatgtttatggcatagatttgatgatggtttcatgaatgtgttcttacctc

SEQ ID NO: 6757251 - DNA, 81 bp, Homo sapiens
ggggcaggaattagggagccatcataaggtctgtccaccttcagaattgtgcctggggtggctcctcctaacgttctcctc

SEQ ID NO: 6757252 - DNA, 71 bp, Homo sapiens
gtccttaaaagttccataaatgagttcaggctgccaaccctcagtttcatgtgtatggaacattttttgac

SEQ ID NO: 6757253 - DNA, 58 bp, Homo sapiens
tcaaaccagaattttaaaggctcttcttgtttctgaggttgccttcggtctgatttga

SEQ ID NO: 6757254 - DNA, 123 bp, Homo sapiens
gggcaaatatccccacttcctctacacaggcctccactccacgcagactcaaagagcatcccttgggcacttgtgtgcctggggcagtgtagggggcagttatccacatgggccatcttgtct

SEQ ID NO: 6757255 - DNA, 66 bp, Homo sapiens
ggtcgcctgctcagcccatgagcaaccactgtggacagggtattgcgtgtgtgctgaggggcgtcc

SEQ ID NO: 6757256 - DNA, 74 bp, Homo sapiens
ttccacacagtcaaacctgcaacagtgaacaccccatccacctctaactgtgccaatctgctgactgtctggaa

SEQ ID NO: 6757257 - DNA, 82 bp, Homo sapiens
ggtagaattgaagaagttacttagggacattttgaattttttgaattagagtttttgtaagtacaattgattctcatttgcc

SEQ ID NO: 6757258 - DNA, 58 bp, Homo sapiens
ttccatcctgacttacaaaggggtggcttagagcccctggagtactaaggggatggaa

SEQ ID NO: 6757259 - DNA, 65 bp, Homo sapiens
gttggcatagtcttttataattttcctcatccaatggtgatgattagagaaatactgctgctaat

SEQ ID NO: 6757260 - DNA, 97 bp, Homo sapiens
ggcctctgaactatactgctggttctcatgagtctccaacttgccgaaggtagattgtagatcatgagacttctcagcctccatagtctcaagagcc

SEQ ID NO: 6757261 - DNA, 57 bp, Homo sapiens
gaaagaagtgattatgctgttgaaatcgtgaagattttacaggtaacacttcctttc

SEQ ID NO: 6757262 - DNA, 94 bp, Homo sapiens
gggaggtgactgcctggtaccttttcctggggcttctggactctattacctactatagatttgtgaaactcagggaaaagtccctttacttccc

SEQ ID NO: 6757263 - DNA, 60 bp, Homo sapiens
ttagtagattgtgatcagtacttagcccatagaaggtgctgaataaataaagtctattga

SEQ ID NO: 6757264 - DNA, 73 bp, Homo sapiens
aaacatagaaggtgagccgaaaagggtcataagtttaccaaaagcattatgctcaggctcacacattctgttt

SEQ ID NO: 6757265 - DNA, 58 bp, Homo sapiens
gctttgagtgagaattacatcagctcaggcagagacctgggttgtctccctcagaagc

SEQ ID NO: 6757266 - DNA, 60 bp, Homo sapiens
gagatcttttttgtcttggtcactgctgcgtagccagtgtctggttcataaaaggggctc

SEQ ID NO: 6757267 - DNA, 58 bp, Homo sapiens
ggctaagcacagtgcctggctctgggtcagctttgcccatgtgcaggctgttatagcc

SEQ ID NO: 6757268 - DNA, 68 bp, Homo sapiens
acgccccttgcccggccagccctccacaccctccctgaggggatgcgctgtggcagggcaggatgcgt

SEQ ID NO: 6757269 - DNA, 77 bp, Homo sapiens
cacagtagctttggttgccatgatctgaggacagcagcactttaggtcacatcggtgaccaaagacatcagactttg

SEQ ID NO: 6757270 - DNA, 62 bp, Homo sapiens
gcttggccttggtcctctttgcaatcagatcagttggatgaaacagaacatcgaggctgagt

SEQ ID NO: 6757271 - DNA, 71 bp, Homo sapiens
gcattgtccatgtcaacaggcccagaaaataagaaatcaaaggtattttttgcatgttgcatggtgcatgc

SEQ ID NO: 6757272 - DNA, 74 bp, Homo sapiens
ctgcttggtaaataatgagacagcttatttaattgttcttatttagaccagctcatcttattaattacaagtgg

SEQ ID NO: 6757273 - DNA, 109 bp, Homo sapiens
gagcagcctgattggtagtatgattgcttccagagagccccgcctggccctggcatcccaccaggcagggagctgtttggcctcagctctgcgacgtcggggcctgttc

SEQ ID NO: 6757274 - DNA, 74 bp, Homo sapiens
ctgaagcaatagagacaagaccagaactagttttcctgactctcagactggtcttgtactatgttgcattacag

SEQ ID NO: 6757275 - DNA, 87 bp, Homo sapiens
tagctttacacagcatcagatgtgggactttggccaaggtatgtcagttcttggaggccaactttcctcatcttcactgtggagtta

SEQ ID NO: 6757276 - DNA, 60 bp, Homo sapiens
tagaagggttagagcaactcagtcaaattccaggtgagcagcttacatgtggcctatcta

SEQ ID NO: 6757277 - DNA, 91 bp, Homo sapiens
ggctggacctgaccgatgccctttcatcattgcactgcttcccagcggcctatagtagtgcaacagggaaagagtgtcgggcaggcctgcc

SEQ ID NO: 6757278 - DNA, 55 bp, Homo sapiens
aggactgatatggcccagcctctggctttacctgctctggccccttatcagtcct

SEQ ID NO: 6757279 - DNA, 56 bp, Homo sapiens
cctcccatgctttcccaacctctgagtctacaatgagcagctgggcaacatggagg

SEQ ID NO: 6757280 - DNA, 69 bp, Homo sapiens
caggttttataaagcatgtactgtgtgctagacactgttctaagcactttacttgttttaccttacttg

SEQ ID NO: 6757281 - DNA, 56 bp, Homo sapiens
actttacttctcaaaataaagcaggcttgcctagatctgcttgagtaaagtaaagt

SEQ ID NO: 6757282 - DNA, 105 bp, Homo sapiens
aggtactaatcactagaaagccctctgagaatatgagctctttgtttcataaataagaccagtatgcattttcacaggatttataatgctttggtaattagacct

SEQ ID NO: 6757283 - DNA, 58 bp, Homo sapiens
tcttctttgggcttcattcagagttggaacttctcacctctcccaggctcagggaaga

SEQ ID NO: 6757284 - DNA, 89 bp, Homo sapiens
ggtgctacaagtcatggtttatttctctgaaaggttatctgaaaattaaaaatcaatgaatcttagaataaatactgactttgagtatc

SEQ ID NO: 6757285 - DNA, 89 bp, Homo sapiens
acccttactgagtgtgacctcatcttaactggaacccatctgcaaagatcctatttccaaagaagttcacatttacgattactgggggt

SEQ ID NO: 6757286 - DNA, 61 bp, Homo sapiens
tcccaccctagttggttgtagaaggagaacgtgccagaacctccaccaggaagggtaggga

SEQ ID NO: 6757287 - DNA, 66 bp, Homo sapiens
tcattaaaatgcagattctgactcagtgaatctggagtgggacctgggaatctgcatttctaatga

SEQ ID NO: 6757288 - DNA, 58 bp, Homo sapiens
ctggtttctgccctcagagctcaccttaggtggtcagtggtggaagcagcaaacccag

SEQ ID NO: 6757289 - DNA, 72 bp, Homo sapiens
tccacttcttgtcactgcatccccagctcctggtacatcgtgggagtggggcggacaggaccaggaagtggg

SEQ ID NO: 6757290 - DNA, 78 bp, Homo sapiens
ccccctgctcattcgccaggcagccttgattggcatgacccctgcccaatggctgacccggcgctggggtcggagggg

SEQ ID NO: 6757291 - DNA, 56 bp, Homo sapiens
ttgccattcttttgcatgggtacactccttcctgggatgtgggcaagggatggcag

SEQ ID NO: 6757292 - DNA, 56 bp, Homo sapiens
cttgggcgctgtgctcctctttgtgcttctcttcgtaccttgcatccagctccaag

SEQ ID NO: 6757293 - DNA, 61 bp, Homo sapiens
tggtcagtcccatctcccaggtggctctccactgagtacctgggctttgctggatgatcca

SEQ ID NO: 6757294 - DNA, 75 bp, Homo sapiens
gatgtggagatggggcatgcaaacaggaagaaattagtaaacccattcctgcagcaagtaaccatcttcctgttc

SEQ ID NO: 6757295 - DNA, 79 bp, Homo sapiens
gtcggaggatctgaagtccgggtgttgagcagccatcaggggaagtggctgttctttcagcccagggcttgcctccggc

SEQ ID NO: 6757296 - DNA, 95 bp, Homo sapiens
gcttagcccacgttgttggaattaataggggatatacaggaaaagagcttcttaaactaatatatacctttgttaggaaatattgggttgcaagc

SEQ ID NO: 6757297 - DNA, 88 bp, Homo sapiens
agttactgtgggattattgctatcaaatacaaagggcataaggcttagctgagtgaattatgcttgtattttattcccttcactaatt

SEQ ID NO: 6757298 - DNA, 94 bp, Homo sapiens
tctacttggaagccctcagcgcggctcagcctggaaaccgttgctatgtgtggggaaggtttttccctaagcaggcgctgagaaggccagtgga

SEQ ID NO: 6757299 - DNA, 88 bp, Homo sapiens
agccagagataccattgctaaaattttgggcatatatcacatccttctagagttttgctatttgtatttttaaaaattaaagggggct

SEQ ID NO: 6757300 - DNA, 74 bp, Homo sapiens
ttataggaatctgcatgtgtgataaagtgcttagaatgagacacacgtgcgcacatggaggaccgttcttataa

SEQ ID NO: 6757301 - DNA, 69 bp, Homo sapiens
tcttcttctttcccagaagatatgtttaaattgcagagtaaaagcctttctctctgggaaggagagtga

SEQ ID NO: 6757302 - DNA, 79 bp, Homo sapiens
tgtgcgctaaattttcactgagaatacttgatctgaatctagatttcataaaattttcagttgaaaaagttggttcaca

SEQ ID NO: 6757303 - DNA, 101 bp, Homo sapiens
agctgtcttctaattttctgcatgatgttaggcaggatactaagcgtctctggactttgtgtcatgattagcaacatgaagattagttggattagatggtt

SEQ ID NO: 6757304 - DNA, 75 bp, Homo sapiens
cttcataatcaaggctaccctttcaccaaaaattgtattataaattttgaagagccagggtggtagaatgtaaag

SEQ ID NO: 6757305 - DNA, 58 bp, Homo sapiens
gaactgttatatgaattcacttgtgtccttattggttaagtgaatttaaataatattc

SEQ ID NO: 6757306 - DNA, 82 bp, Homo sapiens
cagaaactttagttaggggagcaactaggtatatatttgtttttaaccaagttctacctcagtttcccacttatggtttctg

SEQ ID NO: 6757307 - DNA, 69 bp, Homo sapiens
aaggaagtcagctggtgcctacctggagcgtgctgtccctccagggaaggctgctggctgtgtctcctt

SEQ ID NO: 6757308 - DNA, 87 bp, Homo sapiens
agtgctgagggatggagtttatatagagagtagagtagagagtgtggtcactattgaattaactattaaagtttatcttttgttact

SEQ ID NO: 6757309 - DNA, 84 bp, Homo sapiens
caggttatgctaaattttaatactgctattgtaggaaaaaatatatttttgttacagcagaattgaaagagaacctatgacttg

SEQ ID NO: 6757310 - DNA, 129 bp, Homo sapiens
tccactggcatgattgcattgtttaaacaaccaaatgaactcaacagctgacaaataacccagtggtttccattgtatttggagctgtgtgagctcaaatgatcagtgatgagatctgccaaagtgtga

SEQ ID NO: 6757311 - DNA, 75 bp, Homo sapiens
cgatggcacctttttaggtagtgagtacttgaatcaatgtgatcaaatgcttctactcctaagaagtgacaattg

SEQ ID NO: 6757312 - DNA, 72 bp, Homo sapiens
tatactagtcaagaatgtatgaggaaacagaattcattcttctgggcatttataacatttcttacctgtgta

SEQ ID NO: 6757313 - DNA, 98 bp, Homo sapiens
tcccttatggcatcttgagtgttcagtgattgtcaaccgtgagtaactcattgttttagagaccacatgaacaaaacatttttcaaagcatgaggtga

SEQ ID NO: 6757314 - DNA, 97 bp, Homo sapiens
tcaaagaaggtgaatgagtaagaccataatttttgtaacattaaacataagaagtcctagatctattatgtcttgcttatgtatcaattatctttga

SEQ ID NO: 6757315 - DNA, 79 bp, Homo sapiens
ctgctcagattctgccaggggcacttgcggctcaaagtacattcaagtctcaagggatgtctctatagggtagaggcag

SEQ ID NO: 6757316 - DNA, 83 bp, Homo sapiens
agtactgatccaaattcaactccctattcacttgtttcagagtcatctctatgaacacagggaatgggggtttccacagtact

SEQ ID NO: 6757317 - DNA, 74 bp, Homo sapiens
gctccaaattctgtgttcaaactcagtcctagtttctggctgagtttcatgaattcatgggacaaattggaagc

SEQ ID NO: 6757318 - DNA, 116 bp, Homo sapiens
ggcaatgcccggggatagctctcgggacccaggtaatcctgtgcttctcatcccttcctgtggagacagctctgggttccacactctagctgtcctgatctggccttcgctatgcc

SEQ ID NO: 6757319 - DNA, 68 bp, Homo sapiens
tggagggatgacaaggaaagcaaaccaaatgtaatcataaaattggttgggcttctgttctcccttta

SEQ ID NO: 6757320 - DNA, 63 bp, Homo sapiens
ctggctggagtctggaggtgtgccaagggctttggcattgacaactttcagttccactgccag

SEQ ID NO: 6757321 - DNA, 63 bp, Homo sapiens
ggtcctggctctgtgggacctggcctaggatggaaacttaggtctggaggcggagtcaggacc

SEQ ID NO: 6757322 - DNA, 81 bp, Homo sapiens
ggtggccttctgcaaaccaaggagggaggccacagaggacaccaacccttctggcttcttgatcttggacttgcaggctcc

SEQ ID NO: 6757323 - DNA, 64 bp, Homo sapiens
acccagagaactgaggcatgaataactctagccatggaacagttatgcttgcagatttaagggt

SEQ ID NO: 6757324 - DNA, 66 bp, Homo sapiens
gcactgtggttgggggctggggccctgaccttcaccaccccaggggccagtcccctaatccagggc

SEQ ID NO: 6757325 - DNA, 64 bp, Homo sapiens
ggttaacaagaattactctggaagtaatatttttatgtctatccagtagttatttttgcaaact

SEQ ID NO: 6757326 - DNA, 78 bp, Homo sapiens
gactgaagggaagttaatcgttcacttttgttgggtattaaactattgataacagtaccattaactttgattacagtc

SEQ ID NO: 6757327 - DNA, 61 bp, Homo sapiens
ggatggtcacttcacccatgagctcaaagccttcgtagcacatgaaggtgagggactctcc

SEQ ID NO: 6757328 - DNA, 58 bp, Homo sapiens
gggtttctggtctgtgtgatggagggcagcgtgaacccatcactggagaaggaaacct

SEQ ID NO: 6757329 - DNA, 64 bp, Homo sapiens
ctgctaagcagctatttcttccagagagtatttatattttaatagaagtagctgttaatatcag

SEQ ID NO: 6757330 - DNA, 68 bp, Homo sapiens
tgtttacttctttccatggcttgcaaacctcttctactgacaagtctactgggaaaggggggtgagca

SEQ ID NO: 6757331 - DNA, 70 bp, Homo sapiens
gtcttctctggagacctctcctgagagtgctgtctccatgtgcacttacacaagagtctccatctcaggc

SEQ ID NO: 6757332 - DNA, 82 bp, Homo sapiens
gccctaagcccaggtaggagagtcaacatgtcccccagccaattagggacatgttgactatcctacctaggcttagacaggt

SEQ ID NO: 6757333 - DNA, 75 bp, Homo sapiens
gtgacaggcacaagcctaggcaaatagagaagggttcctggacagcctctgacttgcctaggtcattgtgcacac

SEQ ID NO: 6757334 - DNA, 85 bp, Homo sapiens
gtcttgtcttggcctggatcatatccagtcaccactatgcaacaaatgatgtgcactgggcaaggatatgatgggttatgaaagc

SEQ ID NO: 6757335 - DNA, 60 bp, Homo sapiens
tctaccggaacaaccagtttagccaagaggagctggttattgtggagaagttccggaaga

SEQ ID NO: 6757336 - DNA, 57 bp, Homo sapiens
ggcttttttgtcagggccacagggacatctggtccaggctggctcttcaaaattgtc

SEQ ID NO: 6757337 - DNA, 62 bp, Homo sapiens
ctggcagagttgggtctcaaattcccagagtttgaggtggtgggactcactcttttggccag

SEQ ID NO: 6757338 - DNA, 77 bp, Homo sapiens
cctacataacactgccaaactgtacacttagagatggttaagatctctaagtgtacagtttggcagtgttatgtagg

SEQ ID NO: 6757339 - DNA, 65 bp, Homo sapiens
aggaggctccgccggctcccagcatcccagcatcctccgtgccatgtgggccgtgcgggtgtcct

SEQ ID NO: 6757340 - DNA, 58 bp, Homo sapiens
tgtactgaatactctgttatgtggggttttcctatgcattgtagaatgtttagcagca

SEQ ID NO: 6757341 - DNA, 55 bp, Homo sapiens
tagacagatgttttctggctgtgtcttcacatggccttcttcctttgtctgtctg

SEQ ID NO: 6757342 - DNA, 75 bp, Homo sapiens
tctcccccggatgcagctgagtcacccagccatgcctgctaggcaggtgggcaccaggcttgtggtgggggtgga

SEQ ID NO: 6757343 - DNA, 75 bp, Homo sapiens
atagaattacacagtgcagtaggcacgtggctgtgattgggtgatggctgttgcctgctgctagtgatgttctat

SEQ ID NO: 6757344 - DNA, 97 bp, Homo sapiens
tttcttcagggcctgtcaattacagtagaggttagagagccccagtgacaattcttccttgggggtcctcctctgcttaagacatctcttagggaga

SEQ ID NO: 6757345 - DNA, 61 bp, Homo sapiens
tagcaagagagagtgcgctcacagaagcattatgcaaaatgtcttttgtctctttttgctg

SEQ ID NO: 6757346 - DNA, 70 bp, Homo sapiens
ttgagcagtgctggggcgctgccggtgagctgtgatcccatcttctcagggagcgcccctgcctgtttga

SEQ ID NO: 6757347 - DNA, 79 bp, Homo sapiens
cccacttttcagaactgctgcttttgcgggagaacacctttttccaggtgttgtccttagggtagcagggaagactggg

SEQ ID NO: 6757348 - DNA, 65 bp, Homo sapiens
aacgtaccgacttttcacaacaatcatttatttagcccatgattctgtgaattagttgggtagtt

SEQ ID NO: 6757349 - DNA, 87 bp, Homo sapiens
ggggtggggccagtggtagaggggaggccgtgggaaaagagagactggctgcacgcccacagccccctgctgctctggcacagcccc

SEQ ID NO: 6757350 - DNA, 63 bp, Homo sapiens
aggcctttgccttggccccagctttctgggaacccaggctacgacccaactgggcaagggttt

SEQ ID NO: 6757351 - DNA, 61 bp, Homo sapiens
acagtcccccacattggtattatctccttaaattatagtctcagtgccaagggtggattgt

SEQ ID NO: 6757352 - DNA, 59 bp, Homo sapiens
gggaaggggtgctgggaggcctggctccttgcgggctggccacccatgcctccctgacc

SEQ ID NO: 6757353 - DNA, 75 bp, Homo sapiens
tgcccaggagctgcgggtcatcccctgtactcaccggtttcacaggaagtgcgtggacccctggctgctgcagca

SEQ ID NO: 6757354 - DNA, 84 bp, Homo sapiens
agaattgcttgaacacaggaggcggaggttgcagtgaactgagattgcaccactacactccagcctgggtgacaaagtgagact

SEQ ID NO: 6757355 - DNA, 78 bp, Homo sapiens
tttggactgaagagtttgcaattgttccattgtagtgaattcactagtgaagctaacctgctgatttttcgtctcaga

SEQ ID NO: 6757356 - DNA, 60 bp, Homo sapiens
gagatagtgacctcatgcttcccagagaacatcttcgctgggctgtcctgaggtcacctc

SEQ ID NO: 6757357 - DNA, 63 bp, Homo sapiens
tatgaaaacaatgttttatttcctattgagagaataggccaggcatgaagcattgtttttgta

SEQ ID NO: 6757358 - DNA, 67 bp, Homo sapiens
gtctctatgtagaggacatttgaatcccagccctgccagcactaggtgtgtgtcctttgcaagaaac

SEQ ID NO: 6757359 - DNA, 90 bp, Homo sapiens
gtggtgccgttgcctggagacccaggggcagggagaaagtgagatttcctgggctttctctctccctctgggaccagaaaacagctccac

SEQ ID NO: 6757360 - DNA, 62 bp, Homo sapiens
gctggtagaagctaagaagagagggtctgatggaagagtctagaaccctctggcttctgagc

SEQ ID NO: 6757361 - DNA, 55 bp, Homo sapiens
tcctcaggtgactaggtatcttgaggccccagggtatataaaagcaccttgagga

SEQ ID NO: 6757362 - DNA, 69 bp, Homo sapiens
tgtgatataatgacagagcactgaacttggggactttggctcaattcacagctctgctatttatgcaca

SEQ ID NO: 6757363 - DNA, 56 bp, Homo sapiens
ggccctgcaaggtacccaggcccacaaacaaaagcaatgggttctgcccacgggcc

SEQ ID NO: 6757364 - DNA, 60 bp, Homo sapiens
cagagctctgacagctacagccctgaactaaaggcccactcttcagctgcagagcccctg

SEQ ID NO: 6757365 - DNA, 64 bp, Homo sapiens
ggaggttttgcgttgagctccactttcaaaggatctaagagtccagagttcctgcaaggcctcc

SEQ ID NO: 6757366 - DNA, 65 bp, Homo sapiens
gcacctgctggaccacagggcagcccccagagaacaggacaagctccctgtgctccaggagatgc

SEQ ID NO: 6757367 - DNA, 76 bp, Homo sapiens
ttgctctgtcacccaggctggagtgcagtggcgcgatctcggctcactgcaacctccgcctcccgggttcaagcaa

SEQ ID NO: 6757368 - DNA, 86 bp, Homo sapiens
tagtgagagccggttgatgtttactactcttcagaacatcttatgttctagaaatccgtaagtgaatgctgctgctgctcttgctg

SEQ ID NO: 6757369 - DNA, 124 bp, Homo sapiens
ctgagcacagggccatcccaggagctaatcacgcctgggagtccacacctgctagtttcaaaaggaaattgtatagagccagctgtgggctcaggcggacgctgaagggagtggccaggcacag

SEQ ID NO: 6757370 - DNA, 55 bp, Homo sapiens
aagacagtgatctctgagagatggaaacaaccaagctgagaactatgactgtctt

SEQ ID NO: 6757371 - DNA, 59 bp, Homo sapiens
gtcacctggttaaaatggcacacaactttgaagctgcctgccattttaaccaagtgtgc

SEQ ID NO: 6757372 - DNA, 79 bp, Homo sapiens
gaaggaaggatggtaacagtttcatttgacagatgagcaagagaagtcaagtgattttcccaccatctacattgccttc

SEQ ID NO: 6757373 - DNA, 55 bp, Homo sapiens
gtctggtccccattccaggtgggagggtttcccagagttggtcaggggacccggc

SEQ ID NO: 6757374 - DNA, 69 bp, Homo sapiens
gtaggtgtcagtacaaatgtccattgcaccctacctttttagtgatgggctctgtaaagtgacacctgc

SEQ ID NO: 6757375 - DNA, 101 bp, Homo sapiens
gtcacagaaagggatggctgtaagaacccaacgcaggccaggctagaggcaggagtcaaggccggctgccgtagggctcaggatgtccatccgaccgtgac

SEQ ID NO: 6757376 - DNA, 70 bp, Homo sapiens
ccttctattcctgcatggattgaggctattgtggaccacatgcatggcccaggaatcaggctgtgggagg

SEQ ID NO: 6757377 - DNA, 69 bp, Homo sapiens
tggcaattgtgatctgggaattcccgagcattttcctgtattctctggagtcctgtatcactcctgcca

SEQ ID NO: 6757378 - DNA, 72 bp, Homo sapiens
ggctctgcccagatgaagaggacatacaaagggttggcaactcttaaagtttctctccatgggtaagagact

SEQ ID NO: 6757379 - DNA, 69 bp, Homo sapiens
accatttatcttggccctaaggcccacaagaaaacttaggctttaaagtgggcaaagcatatttgtggt

SEQ ID NO: 6757380 - DNA, 70 bp, Homo sapiens
tttgtatatattcttaaagatgtttttgctgaatcaaaagatatgcaactctctaaggatttgatgcaaa

SEQ ID NO: 6757381 - DNA, 106 bp, Homo sapiens
ggcgtactcgcccatctggttccccaggcggcccttggagttgatagtgaacaggtcctcccggggcaggtgtctgggggccaggaccacacgggctgagtatgcc

SEQ ID NO: 6757382 - DNA, 69 bp, Homo sapiens
gcatgaaattcagcaggtgagtacagggctgaaagatgctcctaatatttaccagtttggagattatgt

SEQ ID NO: 6757383 - DNA, 56 bp, Homo sapiens
gtaggtgagtgggagaagaggctgccgacccaggtatctgtcccctctgatcctgc

SEQ ID NO: 6757384 - DNA, 122 bp, Homo sapiens
ctaacatcctgggataaacatttcctgtgtggttgcaaagcctttctaatcgtcatttttagtgattgcattgagatgaagaattgttattgcataccctacctaatgtttcctgttgttgg

SEQ ID NO: 6757385 - DNA, 57 bp, Homo sapiens
ggctgcatgttcagatgacacttgtccccaagtgtttttcattttgaactgtcagct

SEQ ID NO: 6757386 - DNA, 64 bp, Homo sapiens
tccagaagagcgtgaaacagaggtcctgacctattttgggctttcaacacaggctttcctgaga

SEQ ID NO: 6757387 - DNA, 66 bp, Homo sapiens
gctaagggaacagtatctacaaagctcagaggtcagcaagagcttggagaagatgttctcaatggc

SEQ ID NO: 6757388 - DNA, 99 bp, Homo sapiens
gagactgaggcaggacaatcacttagaacccaggaagtggagtgagcagagatcacgctactgtgctccagcctaggtgatagagcgagtctcggtctc

SEQ ID NO: 6757389 - DNA, 55 bp, Homo sapiens
ttgtggaataaaaatcagttatgtgatttaactgggccaactatttgttctacaa

SEQ ID NO: 6757390 - DNA, 110 bp, Homo sapiens
gctccagtttcattgatcaaggctgccagcaaagttcatcttacctagattttatccaagtgactaagagaggggcagatggacctggcacagtgtcatttgtctggggc

SEQ ID NO: 6757391 - DNA, 61 bp, Homo sapiens
aactattagaggaaccaaggtggagctggcctctagggctcttcataggtcttctggagtt

SEQ ID NO: 6757392 - DNA, 57 bp, Homo sapiens
tctttcctctgagctcctgtagtgctgttgcctgcaccactggggctgaaggaaaga

SEQ ID NO: 6757393 - DNA, 130 bp, Homo sapiens
taaagcagccaattattttattttctcatacttgtgtgatgctactcattaagtttgtcatttatacaatgatctaaactgagagtgcatgcatagcattaataaaatgttttatccattttctgcttaa

SEQ ID NO: 6757394 - DNA, 67 bp, Homo sapiens
tgggaaatgtaagtatatgttctgtgtgcatagagtaaaagatctatgagtcatctgctacaaccca

SEQ ID NO: 6757395 - DNA, 71 bp, Homo sapiens
aggacagacctaggactggagctcaggttcctctgcctccaaagccccgctcctaaccactgggctgtcct

SEQ ID NO: 6757396 - DNA, 76 bp, Homo sapiens
gcagcggtgcaggagcggggtgctcggtggactctggacctgctcttggggctgctggcccccttcttgcccgtgt

SEQ ID NO: 6757397 - DNA, 130 bp, Homo sapiens
gttacattcaatatattctatttaagaacataaggatcatgtatatgtttaagaagacttctacttaatctagctaatacattatggttccagtgtttgacctttacttatatggaaatttaaaccaccc

SEQ ID NO: 6757398 - DNA, 126 bp, Homo sapiens
tatcttctgaggtcaccctgagtgaggctttgctcctacccagctctccaggggtgaatgaccacgcccaaggggtgttgatggaggaaaagattgaggtcacatgagggaggtttcagcaggatg

SEQ ID NO: 6757399 - DNA, 96 bp, Homo sapiens
ctggatccctggtgttcagacaggcagctgggctgggagatcactgcaccttcccatgcagcctgtctgagatggcatcttttcagggtgaaccag

SEQ ID NO: 6757400 - DNA, 113 bp, Homo sapiens
acaatcatttctttacctaactccttcaaagtggaattaagaactttcaaaatacttatcgtttttggttttagggagggaagggtattgacctgtatctctattttgattgt

SEQ ID NO: 6757401 - DNA, 56 bp, Homo sapiens
tctcctatagctgcacttaatcattcttaccactgagagttgcagcaaatggggga

SEQ ID NO: 6757402 - DNA, 56 bp, Homo sapiens
ttggtctgctctgatgttttctatctgacagagagaaggctgagcagacaggccaa

SEQ ID NO: 6757403 - DNA, 56 bp, Homo sapiens
tgccttcttaaattagttgaccaggcaggttctggtttggtcaagaaagtaaggca

SEQ ID NO: 6757404 - DNA, 58 bp, Homo sapiens
gaggtcagaaggcagttaaacaaactccaacaagcctttgtttttatcttctgatttc

SEQ ID NO: 6757405 - DNA, 83 bp, Homo sapiens
agattcatcaatggatcaaggattcctaacccagataatacttcttgttcctatgtttagactccttggtcttctgtgagcct

SEQ ID NO: 6757406 - DNA, 67 bp, Homo sapiens
cctcccttggcttaccttctgtgtggctgcctaccaacacggtcactgaatttcaagctagtggagg

SEQ ID NO: 6757407 - DNA, 108 bp, Homo sapiens
tgttgtttaagctgcccggtctgtggtactttgttatggcagcccaagtaaacaaatacagtcatctgctgctggaacaaatcaccccagcactgtggcttggcagca

SEQ ID NO: 6757408 - DNA, 57 bp, Homo sapiens
gtctggcattcttcctggagaataaactcttcactgggaaaatagagtgtccttgac

SEQ ID NO: 6757409 - DNA, 61 bp, Homo sapiens
catgtgtgtcctaatttggggaggaatatttaagtaatgttctcaacaaaaggaagcactg

SEQ ID NO: 6757410 - DNA, 57 bp, Homo sapiens
tcattcagcactgttatggatttgctcctgttagggcatttaaatatgtgttggaga

SEQ ID NO: 6757411 - DNA, 57 bp, Homo sapiens
accgggagaatttagcaaggcctgattgttcagattcttttctgtgttcctccctgt

SEQ ID NO: 6757412 - DNA, 108 bp, Homo sapiens
taaacagatgacaaatggaaaatagttcatcacaatgatcatcggggaaagcattttgagtagcttatcatttgaacagaatttgtttttctaacctgtttctgtttg

SEQ ID NO: 6757413 - DNA, 112 bp, Homo sapiens
gttttgcttaataaataaattacacagccaatgtattatacataatttgtgtcctcgtggatttgagtgatatataatgcatggtccaagtcatttatttattaagactaac

SEQ ID NO: 6757414 - DNA, 87 bp, Homo sapiens
acagttcccaaatgcagacaagtcgtgggatcttccgggagaacttggatcttcccacatctgtctgctactgggagaagttgctgt

SEQ ID NO: 6757415 - DNA, 83 bp, Homo sapiens
ctgcacttctaacaagcttccaggtgatgctgatgctgctggcctcaggaccacactttgaggagcaaaaagcaggagtgggg

SEQ ID NO: 6757416 - DNA, 57 bp, Homo sapiens
cggggcaggctgcaggatgcccagccgtgtccccaggatgccctgcacgctgtcctg

SEQ ID NO: 6757417 - DNA, 81 bp, Homo sapiens
tgtatccttgaagcacagctgctgaatgatacatggacatatttgatgtattcttaggcatttgtttgtttcagttttata

SEQ ID NO: 6757418 - DNA, 59 bp, Homo sapiens
catctgtctcatttctgtatttccggtgcccacgtagggatttacccaatggatagatg

SEQ ID NO: 6757419 - DNA, 74 bp, Homo sapiens
atgtttctgggaaaaaaattcattgtggaataacctgacattctgataacagtgatatttttactcaaatgcat

SEQ ID NO: 6757420 - DNA, 56 bp, Homo sapiens
ggcaacattctccagatcctttccagggtaggatgggctctggttgagtgtgggct

SEQ ID NO: 6757421 - DNA, 64 bp, Homo sapiens
cagtccagtgattaaaacatgacagccacaaataaattatttatgtggcttttaggtcacactg

SEQ ID NO: 6757422 - DNA, 58 bp, Homo sapiens
tcatgctgagtcctggctttgtaaaatgacttataaaggtccaaggatttagagatga

SEQ ID NO: 6757423 - DNA, 56 bp, Homo sapiens
agtcagtctgctagcctgtggagggaccttcatccagggcatgctcagactcagct

SEQ ID NO: 6757424 - DNA, 74 bp, Homo sapiens
agggtctctgtggtgagcaactgactgaagtttccagtggaaaagttcctgacgattgtttccgcagggacctt

SEQ ID NO: 6757425 - DNA, 58 bp, Homo sapiens
caggtgcaagtaattccagctactgaggaggctcaggcagtagaattgcttgaacctg

SEQ ID NO: 6757426 - DNA, 64 bp, Homo sapiens
gcacgagatgtgccctgctggaatgccctctcccaaatacctgcatggctcactctctccctgc

SEQ ID NO: 6757427 - DNA, 76 bp, Homo sapiens
caaggatgcccataaggtttgacctgatatttacatagttgcagaagaatttaaactaaccatatgggcatctttg

SEQ ID NO: 6757428 - DNA, 77 bp, Homo sapiens
tagttagttattttagtagtgactagctccctgaaaaaaatacttccagccacttcccattgcaaagtagcagactg

SEQ ID NO: 6757429 - DNA, 72 bp, Homo sapiens
gtccataaatatgcagtttagttttatttgtcaaataaaataacctgagattgagctgcctagctgaaagac

SEQ ID NO: 6757430 - DNA, 60 bp, Homo sapiens
caatgaggaacactgaactccagacactaggctgggcattgtgcatgtgttctcccattg

SEQ ID NO: 6757431 - DNA, 105 bp, Homo sapiens
gaagcagcgtgatagagccagtggaacagagccgtggggatgaaactgagttttgtgcccatgtttctctgtatccctactgaaaatttaacactcagccgtttc

SEQ ID NO: 6757432 - DNA, 57 bp, Homo sapiens
tcttcatccttcaccttggttctgagtgacagctccaagccagaagaaggctggaga

SEQ ID NO: 6757433 - DNA, 92 bp, Homo sapiens
tcactctctacaaagctgcttcacaactgaatcaaaccaaacaaacagggcagctggactggttttctggtggtggcagtgggtgggggtga

SEQ ID NO: 6757434 - DNA, 77 bp, Homo sapiens
gtttattgaggggacttaagcctgcctgtcctgccagtagccaggaagggctgggtctggttaacccttggtgtggc

SEQ ID NO: 6757435 - DNA, 84 bp, Homo sapiens
ctaatcaggaagcatgatgtcaccgtttaattgagtttttcacttcttcatgacagattaaatgatggcatgtcttatgattgg

SEQ ID NO: 6757436 - DNA, 130 bp, Homo sapiens
catacgccgaacttttagctatcaatgttgccttctgttttgtataattagaagtgcatccaaagccagtcactttactatctataaaataaggataacaaggatgctaagtccctctgagaagggtgtg

SEQ ID NO: 6757437 - DNA, 61 bp, Homo sapiens
tcttcagtgtcacaagagcaagcctgcccccaccagcgccacagtgaggtgacacagaaga

SEQ ID NO: 6757438 - DNA, 97 bp, Homo sapiens
ttctctctgtgtatgtgtgtgtgtgtgtgtgtgtgtgtgggtgtgggtgtgggtgtacacaaggacatgtatatttatgactatatggaggagggag

SEQ ID NO: 6757439 - DNA, 109 bp, Homo sapiens
ctgctgagcactcactggcccagccaggcctgttcccagaagcaatcacgtggctggattcctaaacaggccctaggaattgggccagtccttgccccgtgctcagcgg

SEQ ID NO: 6757440 - DNA, 58 bp, Homo sapiens
gggtgcccgggcgtgatgatatctgtgttgcgacagccaggtgtcatgcgtgtgaccc

SEQ ID NO: 6757441 - DNA, 74 bp, Homo sapiens
cccaaccccctccctgacctggttgggcagggtgtgcatgagctcatgggagccccaggcagggcagggcaggg

SEQ ID NO: 6757442 - DNA, 80 bp, Homo sapiens
tgcctcagttatcccaaatgcaaaatggagataataattgtacctctctcacagggttgttctgaggattcaatgaggca

SEQ ID NO: 6757443 - DNA, 74 bp, Homo sapiens
gattgggccttctcccaccctccatgagattacagtcagtgatcactacagggtgggtgggggctggctcactc

SEQ ID NO: 6757444 - DNA, 66 bp, Homo sapiens
cggttttctaatcttaacgttccgtggcttaacattcagcactgagaactgaggatttgaattctg

SEQ ID NO: 6757445 - DNA, 71 bp, Homo sapiens
cagtgggacctgctcttggaatgaggccgcccatgggaggccacatgcctgtgatgcctgggtgcccaatg

SEQ ID NO: 6757446 - DNA, 61 bp, Homo sapiens
atgttcctacctctggcccagacgcccacctgctgagggagccaaggaggctagagaacat

SEQ ID NO: 6757447 - DNA, 64 bp, Homo sapiens
gcaaaatcatacactcacataaacagatacgtgtgtgtgtgtgtgtgtgtgtgtgtgtgtgtgt

SEQ ID NO: 6757448 - DNA, 63 bp, Homo sapiens
gcaggacaggcgttggtccagtcgttcctttccttgcgttggtccagtcgttcctttccttgc

SEQ ID NO: 6757449 - DNA, 78 bp, Homo sapiens
ggaaaatgacaaatctacataaaacgaatacatagtcctgaaagggtctatgaattgcatttatagttgtccttttcc

SEQ ID NO: 6757450 - DNA, 91 bp, Homo sapiens
gggcgggcggaggacgtgcacgcacgctgggtggaggcgcaggggtcacaggttctggcagcactgcagcttgttgggcttctgtccgtcc

SEQ ID NO: 6757451 - DNA, 71 bp, Homo sapiens
ggccatcttggagccaggcggggcaggtttcctgagccaggatttatggcctgcctgccccattgactgcc

SEQ ID NO: 6757452 - DNA, 61 bp, Homo sapiens
gcctggtgcaccaagtaagggtggaaaagtcagtctttatactctcagcggagcatcatgc

SEQ ID NO: 6757453 - DNA, 82 bp, Homo sapiens
ttatcctcttctctcatgtaggagggaattgtgtaaataagactaaaaaccagttctttaaaatagtgagaaagaaggataa

SEQ ID NO: 6757454 - DNA, 65 bp, Homo sapiens
aaatgttcttgactttcctgcctggacatagaggttctatcaccaaacagaaagataaggcattt

SEQ ID NO: 6757455 - DNA, 130 bp, Homo sapiens
agagaggcagtagtttctaatgtaacctaggatatgcttgggactgatacagtggaaaagtggaatctagtgtatttctcttaggcattaaagtttggtgctgacataagaatgtaatttctgtagcttt

SEQ ID NO: 6757456 - DNA, 64 bp, Homo sapiens
actagaaagcaaaagccatttcagactgcagtttttggttgaaaatggaaaatgctgttttggt

SEQ ID NO: 6757457 - DNA, 66 bp, Homo sapiens
ctggtttctgaattcatgagatttgggttaggctaccctactctcctggattcaggaggcacccag

SEQ ID NO: 6757458 - DNA, 58 bp, Homo sapiens
gccctactgtgtgctctttatgagacacttacttcacattcaattacacagatagggt

SEQ ID NO: 6757459 - DNA, 86 bp, Homo sapiens
gctggtgagtctgacacctcaaagctcaaatgaggcttgtgaacctgtatgcaagatccttcatatgggttttggcagacatcagt

SEQ ID NO: 6757460 - DNA, 57 bp, Homo sapiens
gacccctctgcagccatggaggccacgctagccccacccgctggctgagagagggtt

SEQ ID NO: 6757461 - DNA, 91 bp, Homo sapiens
ctttaagttagatgtggctatatgatcgtgttttggctatagaaatataaaaccaactgtcatgtgcaatatctgaaaaatgtccttaaag

SEQ ID NO: 6757462 - DNA, 65 bp, Homo sapiens
tatttcacatgcagcagggaagtgaggagaaatctgagagttttacttgggctgacattgagatg

SEQ ID NO: 6757463 - DNA, 75 bp, Homo sapiens
tattgcatgtttctattcttcccccagctcatcgagattccctcctgtcaatggaagaagggagtgcgtgtaata

SEQ ID NO: 6757464 - DNA, 83 bp, Homo sapiens
gaagtctgtaagtgggggaagtaattataaaccaagggagatcattgtcctgtttacaagccacttgttaagccacagacttt

SEQ ID NO: 6757465 - DNA, 107 bp, Homo sapiens
gctcatttcggtcatgttgcggtgctttgctggaatcgaggaatgtgcttaattcgaaggtgtctttgtcggttacagcaacgctgctgctgaatgccctgagaagc

SEQ ID NO: 6757466 - DNA, 97 bp, Homo sapiens
ccttgcccacgcccaccggccatgccccaggcctcacctgcccacctagaacctctgagtaggatagggtggggcttttagcaggcaggttacaagg

SEQ ID NO: 6757467 - DNA, 64 bp, Homo sapiens
ctgatgagtgttagcagtaatgatatcagtttctacatgttaacatactgtttaatattcacag

SEQ ID NO: 6757468 - DNA, 73 bp, Homo sapiens
gaaattgttggggctgtactatgaatatcttgtttctaaagatacagtcagactttagccatttaacaatttc

SEQ ID NO: 6757469 - DNA, 68 bp, Homo sapiens
tgagagctgggcaaaatgtgaggttgctgcacagcaatgcagtgaagcctcacctgctcagtatctta

SEQ ID NO: 6757470 - DNA, 76 bp, Homo sapiens
agttccacagtcatcagagactcttgattccttctatctcggagtcatatattggtcctgcatggcttttggaact

SEQ ID NO: 6757471 - DNA, 98 bp, Homo sapiens
tctgtgccttccctgacctgtgagccctgtgaggaaagagggtgtgggaaccctctttgtgtctctgcagtctagttcaaggtctagaacgcagcaga

SEQ ID NO: 6757472 - DNA, 60 bp, Homo sapiens
ctctcttcgtcgcttcatttgctagcgtcaaaattggtgagctgaggtaaggcaagagag

SEQ ID NO: 6757473 - DNA, 66 bp, Homo sapiens
tggtcctggagctgaggaatagctttgattttggggaaaattagtgagtccacagttttctgatca

SEQ ID NO: 6757474 - DNA, 61 bp, Homo sapiens
ggtgtccatcaggctgtgcttctacgagctgtgtgatggagcattttctgatgttgacacc

SEQ ID NO: 6757475 - DNA, 119 bp, Homo sapiens
cttctgtttctcacgcatgattaccttgttgctgtacactgcctgtgtgtgcctgcagaaagtacataatagattttgcagataggaggtacaaagagggtgtagtgtgagaacaaagg

SEQ ID NO: 6757476 - DNA, 72 bp, Homo sapiens
gtatttcccaggtttttgctttcagcatcttttatgatgcaaagaaaacactgcaagacttttggtgaatac

SEQ ID NO: 6757477 - DNA, 75 bp, Homo sapiens
aggtattgagggctttacagaaagagaactctgggttacaggactcagtctcttcctgcagggatctcacgatct

SEQ ID NO: 6757478 - DNA, 55 bp, Homo sapiens
aagctggctaaataaaaggtcctttagtatccagagccccttatttgcccagctt

SEQ ID NO: 6757479 - DNA, 71 bp, Homo sapiens
gactggcatgcacccttcttgcttcaagtattaatattctctttgggtttgcagggtttgtgctgtgagtt

SEQ ID NO: 6757480 - DNA, 55 bp, Homo sapiens
cttcagtagccactggatgcactgggcctgccaggctccagggaacagactggag

SEQ ID NO: 6757481 - DNA, 69 bp, Homo sapiens
gctttcagctctgcactccactgtggcttattaagaaagaataaaactcacactggcagtgctgaaggc

SEQ ID NO: 6757482 - DNA, 97 bp, Homo sapiens
cttctgctgctaagtgtccacatttatcctggcacttcttaagggactctcatgagtgggcgccaggaagagcatgtgtggaaaaagtgcagagaag

SEQ ID NO: 6757483 - DNA, 66 bp, Homo sapiens
gactagagcaggaggcatgaagccaagagtccaactttcagtggcttcttgacttcttggctggtt

SEQ ID NO: 6757484 - DNA, 73 bp, Homo sapiens
gcatcctattgaatgtttgattgaaaattctagaccagggttcttcagttcaggctgttcattaggattgtgc

SEQ ID NO: 6757485 - DNA, 68 bp, Homo sapiens
ctccaaggattctggacccttggccatatttgcctctagctttaggtcaacagatttctaacatggag

SEQ ID NO: 6757486 - DNA, 89 bp, Homo sapiens
gcccttggctgccttgggacagcaaccatctgctacaccccatgtcaagggtgtagcctgagctggctggctccaggaagagcaagggt

SEQ ID NO: 6757487 - DNA, 65 bp, Homo sapiens
agcacagtgttcttgatattacagttatcaaactgtccataatattggtgaacttttgaactgct

SEQ ID NO: 6757488 - DNA, 98 bp, Homo sapiens
cccacttcccagctaaatgccttcaaacacttaaggcccctgtcatatcccgggtggtagtttccttagattgaacccatttagttccttggattggg

SEQ ID NO: 6757489 - DNA, 64 bp, Homo sapiens
gctgagcctggccagggtgcgatcgtggtggctctcgcagccgtaggtgccctggtcggccagt

SEQ ID NO: 6757490 - DNA, 115 bp, Homo sapiens
gggttccttttggccaacagcttgtggcagaccatgagtctaagaattagtagctactacaaaggctgatgggctgatggtgccacaaatttgaagacagtgggaaggaagaccc

SEQ ID NO: 6757491 - DNA, 74 bp, Homo sapiens
gtttaaaccactcatgaggaagtagttggcaattttttttgaaacttttaaacctcatgagtattcttttaaac

SEQ ID NO: 6757492 - DNA, 58 bp, Homo sapiens
atatcacaggaaaggaagatacacagataaattttggatttatcttttccagtggtat

SEQ ID NO: 6757493 - DNA, 71 bp, Homo sapiens
ccaggaattgcctttggaggaagaaagccgccttgcctgaggtgttgctctttccctagggcaatgactgg

SEQ ID NO: 6757494 - DNA, 60 bp, Homo sapiens
agctcaaacttcagctatgccttgaaaggcattaaggcataaggaagatttggataggct

SEQ ID NO: 6757495 - DNA, 83 bp, Homo sapiens
agtgcagaagacttttaaggcagtgaaactattctgtatgctagtacaatagtcaatgcacgtcattaatgtctttacgcatt

SEQ ID NO: 6757496 - DNA, 63 bp, Homo sapiens
gctgctgctgagagctcagcctgaaacctcgcgttcaggttcattactacttcagcagtttgc

SEQ ID NO: 6757497 - DNA, 85 bp, Homo sapiens
ggccatctccgaactgccatcagtgcggctttatggagcatccagccagggtgtactgaagagcactgtggccagttctgcagcc

SEQ ID NO: 6757498 - DNA, 57 bp, Homo sapiens
ctttctgttcaccgctcctgctttattatgctgtaaactggtatggtgagaagagag

SEQ ID NO: 6757499 - DNA, 79 bp, Homo sapiens
tcacatcaatgtcatatattttggcagtgatcacttattaatggtgtttgattaagttcaaaatatagaaactgagtgg

SEQ ID NO: 6757500 - DNA, 91 bp, Homo sapiens
ttctgagggggcaaaacatctacaggagaatgtcactggatcatttcaaaaatctatgtgtatttgattctaggactatgtctcttcagaa

SEQ ID NO: 6757501 - DNA, 64 bp, Homo sapiens
agtcagtgttctgggttgtaatctgtaaactattgtcttcacataactctcacagaagctgact

SEQ ID NO: 6757502 - DNA, 55 bp, Homo sapiens
gtgtgagagactgaagaaagccatgctagcaatgactgggctcagtcacttatgc

SEQ ID NO: 6757503 - DNA, 100 bp, Homo sapiens
agggtatgctgcaaagttcaggtatttactgttttttcttacactttggcaacaatttgttgagcttcaaaatatgtgaatcctgctttaagattgcctt

SEQ ID NO: 6757504 - DNA, 67 bp, Homo sapiens
gcttcatatctctgtagagttttacagtgtttattaccaaaagattctccctgagatatttagaagc

SEQ ID NO: 6757505 - DNA, 128 bp, Homo sapiens
aattgtgcaggaggcatgtatcttaaataaagaataaaagggcaaatggaatacaaaatttggaacaaagaatttgattccctgcacctgtttttcagaaaggttttaatatgtaaacataaacaatt

SEQ ID NO: 6757506 - DNA, 55 bp, Homo sapiens
atgtcaatttgttctctcgaagcagctgaaaaaaagtgtgagaataaatggacat

SEQ ID NO: 6757507 - DNA, 55 bp, Homo sapiens
ggggacagtctaatgggatagtttacactgtcttggctatctcaaatcttttccc

SEQ ID NO: 6757508 - DNA, 90 bp, Homo sapiens
actcaagaatgcttttcatccagcctcatcaggagctgctgagaatggtccctgagaagtgaaacttagatgggggtgggtaggcagagt

SEQ ID NO: 6757509 - DNA, 58 bp, Homo sapiens
gatgggaatcctgtaatctacccatgactgcggccgctgtactttgcaggctcccatt

SEQ ID NO: 6757510 - DNA, 125 bp, Homo sapiens
gatgtggaaactttaatggagatcacaaaactttgtgggagatgtggtttgcacacacacaggtacacaccccctacagccctgcgtcagattttgcacgaggttttgtgattttctcctgcatc

SEQ ID NO: 6757511 - DNA, 69 bp, Homo sapiens
atattggatccagcagctccaaagaatagccagaaaactgatactctaatgggctgctgcacacggtat

SEQ ID NO: 6757512 - DNA, 72 bp, Homo sapiens
ccagtggtccctgaggttgctgggtacacttaatcccactgtcaccacgcactcaccacaggggcacacagg

SEQ ID NO: 6757513 - DNA, 67 bp, Homo sapiens
gggtgtggtggctcatgcctgtatcccagcactttgggaggctgaggcaggcagatcacttgagttc

SEQ ID NO: 6757514 - DNA, 66 bp, Homo sapiens
gaggagagagcctgagtggcagctatgcaggagacagtaaagccagtggcccaggcttactagatc

SEQ ID NO: 6757515 - DNA, 102 bp, Homo sapiens
gactcagctccctgaaacagctgttattgctggggtaacgcccagaggctgcctgagggcagttctgggtgcaactctgttctggcagatgtatgctgaatc

SEQ ID NO: 6757516 - DNA, 77 bp, Homo sapiens
gttggttgctcatgtagtccgtagaaagccatctttgaataggtgacaaagtttgaaatgtctgcaagggaaccagc

SEQ ID NO: 6757517 - DNA, 60 bp, Homo sapiens
tgccagctagtacaatgggagagcaatgagacagtgcttttccatctctactgtcaggca

SEQ ID NO: 6757518 - DNA, 55 bp, Homo sapiens
tctagtcgtaaatatgactagacatataggccatgagtaaatatttatgactaga

SEQ ID NO: 6757519 - DNA, 58 bp, Homo sapiens
ctcctcctggacacaggctgtgtcaataccatgaattaacagctgtagttggagtgag

SEQ ID NO: 6757520 - DNA, 76 bp, Homo sapiens
ggggctgtggggatgctcagtgcctgtgtccaggaaccccctatcctggaaatcagcctggggcacctccagctcc

SEQ ID NO: 6757521 - DNA, 124 bp, Homo sapiens
caacactttatcattccacagacttgctccgggctgaacgtggactgggcctgggtctcagtactggggacaggggtccaggcgtggcccagatgaactcaggatgtgtggtttgggtgtgttg

SEQ ID NO: 6757522 - DNA, 74 bp, Homo sapiens
tattgacatttctttatttttatcagaagcactttgagctgcagtgcttcaaattcgaggagtagatgtcagta

SEQ ID NO: 6757523 - DNA, 66 bp, Homo sapiens
aggagaatgtggctacatatggaagaagctgtgttttgaccagatagatgatggtcccattcacct

SEQ ID NO: 6757524 - DNA, 62 bp, Homo sapiens
tgctggttgggacacatttaggtcaatcacagctaagtcaggtacttaaactgtccccagta

SEQ ID NO: 6757525 - DNA, 107 bp, Homo sapiens
cattatacagtgaccagcactatctttgtttccagccaaaatagatttcagaggaactatacataaaacatttgggtggaaacagttagtgggccatttcaaaaatg

SEQ ID NO: 6757526 - DNA, 82 bp, Homo sapiens
tctcatcctgcaaagaggtaaccatagcaaccacgagaggcatcggggagagaggagagagggttactgaggcagagtggga

SEQ ID NO: 6757527 - DNA, 59 bp, Homo sapiens
tctcttcctgacttgcagacagccaccttctagctgtgtctctgcatggcaggaagaga

SEQ ID NO: 6757528 - DNA, 56 bp, Homo sapiens
ctcctgggcaggagagagtctgccagtgacagctgaggcagctcaggcccagagag

SEQ ID NO: 6757529 - DNA, 82 bp, Homo sapiens
tccctttccttttatgttcttatgtttttattgtgtttacctgtcagtgaatccaaacattgagaaacattgggataaggga

SEQ ID NO: 6757530 - DNA, 67 bp, Homo sapiens
ggtagatgcatagagcacagcacatcaagtccaccagcatagatggtgccaggcccttgtgtttgcc

SEQ ID NO: 6757531 - DNA, 83 bp, Homo sapiens
catagctagaaggtagaaggaccagaatttatctttgatgttataatttaagcaatagatggaaggtcatgttttctactgtg

SEQ ID NO: 6757532 - DNA, 129 bp, Homo sapiens
tgatattactaaagtggaggcagctctaggagtggggactgtagacatcagcctgtagttgttggtaccaactgtaattgaaagtttgagtcatctgtttaaagaatgggcctttccttcatcatgtca

SEQ ID NO: 6757533 - DNA, 112 bp, Homo sapiens
cttaaagaatagaccaagagcagccagtgttgtttagaagcacctattggctggattgagaagctattaatttaatccaagtgttacattggctagaagttctttctttaag

SEQ ID NO: 6757534 - DNA, 80 bp, Homo sapiens
tttcatcagatggatttatactatttctggaatgctgcctttcatttactttgaggtggataaaacctaatcgtttgaaa

SEQ ID NO: 6757535 - DNA, 87 bp, Homo sapiens
gccctggagtatttgcccaccaattactgtctcctgctggtgttggcagacacaggaggaggatggtggtctgggggaacctagggc

SEQ ID NO: 6757536 - DNA, 90 bp, Homo sapiens
ttcagcagcacgcctggcctctcctggctgagtttcctgcagggcggaggcaggtgcgccagctcaaggggaggccggcagtgcctagaa

SEQ ID NO: 6757537 - DNA, 81 bp, Homo sapiens
ctcataagatgcattgagtattgtaaataaaacaaaccatttttgatttgtttaaattgctcgttacagttctcttgtggg

SEQ ID NO: 6757538 - DNA, 57 bp, Homo sapiens
tatgtctgtcactgagggctttatgaagacatccagcctcagccggtggcagaagtg

SEQ ID NO: 6757539 - DNA, 57 bp, Homo sapiens
gctctgtcttgtgttcctgaggtgccatctggcacaggactcgactgcagacagcgc

SEQ ID NO: 6757540 - DNA, 105 bp, Homo sapiens
tcccagatgaacttctcatcttctcagactagagaaatggggagagaattggggtgcggtcacttgacccttctctagcctgtgggagttgcaaagttcctggga

SEQ ID NO: 6757541 - DNA, 71 bp, Homo sapiens
gcatccccttcagctgttctcttgggcatgctggcaacggcagtgggacatgggcactgggcgtgggatgc

SEQ ID NO: 6757542 - DNA, 88 bp, Homo sapiens
ctggctagatggctagattgcaagaactccagctggcttcctcttcttgccactcacccacagttctagtactttctgcttctgtcag

SEQ ID NO: 6757543 - DNA, 105 bp, Homo sapiens
tgtcaggtaattaccagagtggccttcagagaagaacctatatgctgatgaattcttatgtgaaggtcagtgtagtggtttgggcgactctttctaattctggca

SEQ ID NO: 6757544 - DNA, 59 bp, Homo sapiens
tctcatatgtgcaaatgtgagtggcatgaaaatagcatgccagcatgtacacatgtgga

SEQ ID NO: 6757545 - DNA, 65 bp, Homo sapiens
atgtgcactgatgccagggacagaaaccactgcatccaccactgtcaccagcaccaatgccacat

SEQ ID NO: 6757546 - DNA, 73 bp, Homo sapiens
caaggtgacagaccactgcaactctgtgctggtacacctcatctctacacacagagacaatggtttcatcttg

SEQ ID NO: 6757547 - DNA, 69 bp, Homo sapiens
agctggtgttttataaacggtgtttggtggtctaagaaaccagtcaccatagaataaaacatatatgtt

SEQ ID NO: 6757548 - DNA, 71 bp, Homo sapiens
taagcttgttggggaatttagtgctgcttttagatgaacaaagtggattctgaaattctcgtattagttta

SEQ ID NO: 6757549 - DNA, 77 bp, Homo sapiens
agtgcccagcatttaagtgtttgataaatgttaactcccattttttaacatgccagcccatttaaatggtgaaaact

SEQ ID NO: 6757550 - DNA, 79 bp, Homo sapiens
ctaagctccttcctgcaagggctggaatatctcttagaaatttttctgacagtaattttagctttaggagaaagactag

SEQ ID NO: 6757551 - DNA, 67 bp, Homo sapiens
cttgtctgggcagcttgggagtcttttcaccattataaattggcatccactctgaggctgagacaag

SEQ ID NO: 6757552 - DNA, 61 bp, Homo sapiens
caaaagtcccaaagtcactctgcttgcatccacactgcattctcctgcctttggacttttg

SEQ ID NO: 6757553 - DNA, 69 bp, Homo sapiens
gcccgggtcaccatgaggactctccgcaggttgaagttcatgagttcgcccagcctcagtgacctgggc

SEQ ID NO: 6757554 - DNA, 80 bp, Homo sapiens
cagcctgcagtgcacaggacactcggcctcctggtcagcaaactgttaggcagcccaagatgtcagcggcaccacggttg

SEQ ID NO: 6757555 - DNA, 59 bp, Homo sapiens
tcaggaggcgtgctggggtacaccaggtgaatgtctgccctgccccagtccgctcttga

SEQ ID NO: 6757556 - DNA, 69 bp, Homo sapiens
gcacatgacactattttgttctatttttggtgatgttaacattggtctcttggttaaaatagtgtctgc

SEQ ID NO: 6757557 - DNA, 71 bp, Homo sapiens
gaaaattggtctgcacagccaggattcttcaaatccctaaagaagcacatctcctgtgcagaactgttctc

SEQ ID NO: 6757558 - DNA, 76 bp, Homo sapiens
gatataacagtgaaaataaggctggttcttgtttttatccactgaggcaaatactgagtttattttcaaaggtatt

SEQ ID NO: 6757559 - DNA, 75 bp, Homo sapiens
tttgagtaaggctgaattcaagggtaggctctcaggcaaaactggcctatttatggatcacctttctgattcaaa

SEQ ID NO: 6757560 - DNA, 73 bp, Homo sapiens
gggccagctttgagctgcaggaaggaagacgggagtgcaggattctagaggcgttctctgcagcaggcggccc

SEQ ID NO: 6757561 - DNA, 58 bp, Homo sapiens
aatctaggacgcctgccatgctaggaccccctacatctcttcttaaggctccaggatt

SEQ ID NO: 6757562 - DNA, 129 bp, Homo sapiens
atcttttacccctgttggctttcacttttattacaacatttttactaagattggcaaagttggcaaacagctattccagtgtgatctttgtagggaatggtgatataaatgataacagctgtaactgat

SEQ ID NO: 6757563 - DNA, 84 bp, Homo sapiens
gtcatgtccattcttttacgtattgtcgagggctgcttggtgctccactggcagaattgaatagttgtgaagagcccacatggc

SEQ ID NO: 6757564 - DNA, 55 bp, Homo sapiens
tagaaaccctgccttagtagctactccttgaagtggtctaggatggggctttctg

SEQ ID NO: 6757565 - DNA, 60 bp, Homo sapiens
acatttattttggcacggcacaattctattctcttgtgactatgtcagtatggtaagtgt

SEQ ID NO: 6757566 - DNA, 63 bp, Homo sapiens
ttaattgtacaaaggatttggaagagattctggtttctgttatcttcctttgtatactgttga

SEQ ID NO: 6757567 - DNA, 99 bp, Homo sapiens
catctgatatgagcagcaggacagagggttccaaaattgatgtgtctaagaaaaatgcattaataaaataccactttgttcattagtttgaatgagatg

SEQ ID NO: 6757568 - DNA, 80 bp, Homo sapiens
gtactcatttctggctgttggaaagttccttcttgcattaaatgggaatttttcttataaacatccactgaattgatcac

SEQ ID NO: 6757569 - DNA, 90 bp, Homo sapiens
aaggtccccaggaattacagagctcatttctaaggggctcaaaattagcaaagagacttttggagatgttttctgagctttagggatctt

SEQ ID NO: 6757570 - DNA, 74 bp, Homo sapiens
agtgcatttggtttagagatgtctatatgttatctgaaagttgtctgtatggcttgtctttataccaggaagct

SEQ ID NO: 6757571 - DNA, 126 bp, Homo sapiens
gtaattaatactaactgggattgttagtacactgctctgtacagggatactgttacaaattacaaacatcagtagacagatttcttgttagacattgttgccttcacagctaagagtattaaatac

SEQ ID NO: 6757572 - DNA, 79 bp, Homo sapiens
tcagaatctgcattttcatgagttcccaggtgatttgtgtgcacattcaagtaccagaagcactgaactcacagactga

SEQ ID NO: 6757573 - DNA, 63 bp, Homo sapiens
cccagtaatcggagagtacttaaataaggccaaaataggcccatggtttctttgatagctggg

SEQ ID NO: 6757574 - DNA, 59 bp, Homo sapiens
tcctctggaaagatcattaaatccaaattctgaatagggaaatggagactttccaagga

SEQ ID NO: 6757575 - DNA, 70 bp, Homo sapiens
caggaggaaggaaaactactatccataccaatgaccttgatattcctgtaggaattttcacttcctcttg

SEQ ID NO: 6757576 - DNA, 65 bp, Homo sapiens
gaagtcagaagccggcctaagggatcgagatgagtttcatttttcccagcaaggctgctgccttc

SEQ ID NO: 6757577 - DNA, 80 bp, Homo sapiens
cggagcagaaatgagagaagtccaaggtgaaagagaacacatagattattacgtggcttctaaagtttcttttagttctg

SEQ ID NO: 6757578 - DNA, 78 bp, Homo sapiens
ggaaggtcgagctgcatctggcccccacgaccttttccacatctgagtatttctgattccgcgacagcccgaccttcc

SEQ ID NO: 6757579 - DNA, 55 bp, Homo sapiens
ttgggctcttgttaccactgacatgaattgtccagtgctggaccagagcacccag

SEQ ID NO: 6757580 - DNA, 60 bp, Homo sapiens
ccctaagaagctaagactatctgggtaagtgtgtacccagtagcctaacctagctttggg

SEQ ID NO: 6757581 - DNA, 84 bp, Homo sapiens
aagattacactgagttttaccaggcacattcttcttgttgacatgcaagtacctgtggcttggtggactttttgtaggaatctt

SEQ ID NO: 6757582 - DNA, 58 bp, Homo sapiens
ggagactggcttctgcattcaacctatagtaatggagagttagcagatttctgtctcc

SEQ ID NO: 6757583 - DNA, 62 bp, Homo sapiens
ccaagtggatggtgttctctggggcctgtttacctgtcttcttggggttcacctgcctttgg

SEQ ID NO: 6757584 - DNA, 55 bp, Homo sapiens
acttgtcacaaaatcaccagtgacttttcatcacggtcacaggcaggtgataggt

SEQ ID NO: 6757585 - DNA, 60 bp, Homo sapiens
gtctcagggactgcttctgggggaactcaacctaagacagactgcaaagtcctccaagac

SEQ ID NO: 6757586 - DNA, 56 bp, Homo sapiens
ggcaaggcgcgcggggcatcagtggccggccttggccagtgcgcccctgcccagcc

SEQ ID NO: 6757587 - DNA, 80 bp, Homo sapiens
gtggccgccaactgtgccgtgggcaggggctctgcagcagagcggaatggccgtaatgaccctggcctggtggcggaaac

SEQ ID NO: 6757588 - DNA, 68 bp, Homo sapiens
aggtcctgggaagatgctcatgactcctcccctctcctcactgagtctgacctctatctcccaggcct

SEQ ID NO: 6757589 - DNA, 65 bp, Homo sapiens
ttgagaagattgggcagagtggagtttcaacaatgacttctgtcacccttccttagtcttttcag

SEQ ID NO: 6757590 - DNA, 59 bp, Homo sapiens
ctgcagtggattgtcattttttcttgaataataatttcaagatgatattttatctgtag

SEQ ID NO: 6757591 - DNA, 77 bp, Homo sapiens
ttcagtttagcttcatttggcgtgattgtgtactaaggatagggtcttctaatatgcaaatgaggctgtgttctgaa

SEQ ID NO: 6757592 - DNA, 79 bp, Homo sapiens
gttctacaatatttgggggcagtttgtttttccttattgccaggatttcatggactacagactgtattcaaagtaggac

SEQ ID NO: 6757593 - DNA, 80 bp, Homo sapiens
gctgcaaccgctgttgctcttgcacttgctgtggctgtaactgttgctgctggtgcattagctgcagttctggtttcagt

SEQ ID NO: 6757594 - DNA, 59 bp, Homo sapiens
gggtcgtggaatatggatgcttgtcatgaaatggctgagctccaagtattccattcccc

SEQ ID NO: 6757595 - DNA, 60 bp, Homo sapiens
aatggctgttctctgtgattgggcatagaaggtttgtaagttttagagactgcagctgtt

SEQ ID NO: 6757596 - DNA, 62 bp, Homo sapiens
gggtctctcagaaggctgcaatcaaggtgcagtgcatggtctgtggtctcatctgaaggctc

SEQ ID NO: 6757597 - DNA, 64 bp, Homo sapiens
aggaatgttaagaaggtctaccttgtagtatgagttcatgggaaagacctttataatacctcct

SEQ ID NO: 6757598 - DNA, 67 bp, Homo sapiens
ggaatgattggagaaaggagtgttataggggtcaagagcctctgagagtccatctccaagccatttt

SEQ ID NO: 6757599 - DNA, 68 bp, Homo sapiens
ttcaaagattagcatacgcaatgtgactattcaaatagcgagtcagtttggagtctataatctttgaa

SEQ ID NO: 6757600 - DNA, 63 bp, Homo sapiens
atggccagtgtttccctcagtttccatttttattcagaaattcacgtggtgaagcatggttat

SEQ ID NO: 6757601 - DNA, 64 bp, Homo sapiens
ctgggcaattggattcttagtaaatcttgttggatttgataaagactaattcttaattgcttag

SEQ ID NO: 6757602 - DNA, 62 bp, Homo sapiens
cgggcctgggccctgctttgacaggagtgctggtcaccatgtgaaggtgggtccaagggctg

SEQ ID NO: 6757603 - DNA, 100 bp, Homo sapiens
tcgatccaggggtgctgaagaacctgatgagctgtgtagcgctttttggggtctaccaccagcaaccggctcaccagatctttagcagctgttggaatga

SEQ ID NO: 6757604 - DNA, 55 bp, Homo sapiens
gctgccttcagttctgattcatgctctgactcagacgaaaacatgaacatgcagc

SEQ ID NO: 6757605 - DNA, 62 bp, Homo sapiens
aatgatatagactagcagcagaatttatcactgttgatagtattctgatgaagtttaacatt

SEQ ID NO: 6757606 - DNA, 76 bp, Homo sapiens
ggttttctctgactcatatttgtgccttccacatttttccagttgtaggggggctggagcagagtgggagaggact

SEQ ID NO: 6757607 - DNA, 58 bp, Homo sapiens
cacaaatgtgcagaaatgtgagggaggatatgctctcgcacacttcggcattttgatg

SEQ ID NO: 6757608 - DNA, 92 bp, Homo sapiens
gatgttggaggtacaagagcacaggcagaaattcacagagccttttcatgcctctgctggtgtctaacctggctcttctaccatctaacatc

SEQ ID NO: 6757609 - DNA, 61 bp, Homo sapiens
atcttaggagtaccatggatgcctagaatcttgtcaaaggctctccaggggctcccaggat

SEQ ID NO: 6757610 - DNA, 71 bp, Homo sapiens
gggaagaggactgtgccaggccggggcaggacagtgggtcctgtcctgcaaggtcctggtgaattcttcct

SEQ ID NO: 6757611 - DNA, 90 bp, Homo sapiens
acctggaatgtaagtagggatgcttcagttacttctccccaccccagaatgaagttgaccttcaagcaccatatttatccctttcctggt

SEQ ID NO: 6757612 - DNA, 55 bp, Homo sapiens
acttgctctcctgacctccactgatgttgcttcacagcaaggaagtcgagtaggt

SEQ ID NO: 6757613 - DNA, 88 bp, Homo sapiens
gtttttgacttccctgttcttttcagtttaatgccgagtgtttagtaggtactcagtgactgggtattaaatcagaggaagcagaaac

SEQ ID NO: 6757614 - DNA, 58 bp, Homo sapiens
agagactgtcctttcctcattatgtcttcttggcaagtatgtgaaagatcagttgtct

SEQ ID NO: 6757615 - DNA, 125 bp, Homo sapiens
gtgtaagtagacatgaacagagcttggcagagtctaatgaggactttatagagagagagaatcatctttgctattctgctccttatttccattctttcaattatttatgatattctaatatatac

SEQ ID NO: 6757616 - DNA, 65 bp, Homo sapiens
agtgtcctttctgttccagccacactgagctccttgtggttggttcccttagcaagccatgcact

SEQ ID NO: 6757617 - DNA, 58 bp, Homo sapiens
ccttcttcgtgatctcagttgatttttgcatctgcatttatctagattattgagaagg

SEQ ID NO: 6757618 - DNA, 129 bp, Homo sapiens
tcattgcctcctgctattaatgagtcatctgttgcttcagtcagtgctgcccagggctttatttgccatctctgtgtttgagctttgaaatgaggttatcgatttatgatcagtgtaactcctggctga

SEQ ID NO: 6757619 - DNA, 73 bp, Homo sapiens
tgaggaataattgtcgtagctggtatttattgaacaattactacatgctaggtacagatctaaattctcctca

SEQ ID NO: 6757620 - DNA, 60 bp, Homo sapiens
gtgaagggcccggctgtgggcagagcacagacagccctggtccccagccctgcctgacgc

SEQ ID NO: 6757621 - DNA, 84 bp, Homo sapiens
gcaaagtctgattgggccaaaccctgggaaatgtaaatatatttattcttattttactatttggcaaagtctcctgataattgt

SEQ ID NO: 6757622 - DNA, 56 bp, Homo sapiens
cctgagcatgtatgtcaccctccccactaagtctagggttggcaagacagctcagg

SEQ ID NO: 6757623 - DNA, 57 bp, Homo sapiens
gccctttggcctgggacagcaagcagagtattatcccagctggtcagggcaatgggc

SEQ ID NO: 6757624 - DNA, 74 bp, Homo sapiens
ctacactgtagcatgtaattaagatgtagtcataaatcaggaaaacattatatcttgtttaggtgcacaggtgg

SEQ ID NO: 6757625 - DNA, 69 bp, Homo sapiens
ggcagaatggctgcagccggccctgcgcatgctccctgcgccgcgcatgctccctgcgccacccctgct

SEQ ID NO: 6757626 - DNA, 63 bp, Homo sapiens
tacatgcactggaatctgattacactggccccactgcttctgttatcattatcaagtcatgtg

SEQ ID NO: 6757627 - DNA, 93 bp, Homo sapiens
taatgctcaggggatcacccccttcagtactttccatctcactgcagatacttcacattagggcaggtactgggtggtgagctatgagcattg

SEQ ID NO: 6757628 - DNA, 57 bp, Homo sapiens
ggcttctttcagagtgaatagatatttcaagactattatctaaactctaatggagcc

SEQ ID NO: 6757629 - DNA, 62 bp, Homo sapiens
ggtaagtgttatttgcaagtgagtcacaccaagatgtaatttacttgcaaataacaattatc

SEQ ID NO: 6757630 - DNA, 80 bp, Homo sapiens
gtcttccacttagattcagtaattgttaacatattagcatatttgtgtcagcatgtgacaatatttggtcttatggagac

SEQ ID NO: 6757631 - DNA, 60 bp, Homo sapiens
gggaccctgggctctgggcctatccagcaaggatggcctaaaatgcagaccctgggtcct

SEQ ID NO: 6757632 - DNA, 56 bp, Homo sapiens
ccctgggaggcttccaggcagaccttccacagcggtgtgtgtgaggagtcccaggg

SEQ ID NO: 6757633 - DNA, 90 bp, Homo sapiens
tccccatatttttcctgccatctttgggaactgggcctggcacactggtgaggctagggtaacagatgtggcagacaaggggtataagga

SEQ ID NO: 6757634 - DNA, 56 bp, Homo sapiens
gctgcctttggaagtccagagctggatctctcagctcccgcccccagaggctcagc

SEQ ID NO: 6757635 - DNA, 79 bp, Homo sapiens
taataggaatatagcaatagaaacatataaagtccctgaactcatggggcttatattctactgttagagacagatatta

SEQ ID NO: 6757636 - DNA, 59 bp, Homo sapiens
ctcactgaactaaacacatgagattcctgcctttgggcagcttgtggtttagtagaggg

SEQ ID NO: 6757637 - DNA, 67 bp, Homo sapiens
gatctctgctggcaggttatagagctgccctttctccttgggctctcccacaacgtgccagtagatc

SEQ ID NO: 6757638 - DNA, 84 bp, Homo sapiens
gcactttttaaagcttgtcctttctctgttattaactttgttctttcagttgtgccagagaaagcacaagagatagaaattggc

SEQ ID NO: 6757639 - DNA, 103 bp, Homo sapiens
ttgagacggagttttgctcagtcgttcaggctggagtgcagtggcgcgatctcggctcactgcaacctccgcctcccgggttcaagcgactctcccgcctcag

SEQ ID NO: 6757640 - DNA, 77 bp, Homo sapiens
tcactcttgttgcccaggctgaagtgcaatggcacgatctcggctcactgcaacctccgtctcccgggttcaagtga

SEQ ID NO: 6757641 - DNA, 68 bp, Homo sapiens
gaggcgggcggatcacgtgaggccagaagtttgagaccagcctggccaacatggtgaaaccccgtctc

SEQ ID NO: 6757642 - DNA, 64 bp, Homo sapiens
atcaccggaaacttcacatctccctaaaacagcttaggctgtcttgagaaatgtgaaaggtgat

SEQ ID NO: 6757643 - DNA, 93 bp, Homo sapiens
gtagtgctcaattaatatttgtggaattaatgcatatgaattacaactgtggtcaggataattacgttctacaagcattgatctagtagctat

SEQ ID NO: 6757644 - DNA, 98 bp, Homo sapiens
gtgatcaagcaaagatcaggaattaggtgagatggaaagagggagacccattttgctcattacttgaagatcttgttaaagtttgctttatagatggc

SEQ ID NO: 6757645 - DNA, 88 bp, Homo sapiens
gggggctggctgcatggcacagagtgctgagatgtttgggacaaagatggctctactctggctcaccattttcactctctgcgccccc

SEQ ID NO: 6757646 - DNA, 91 bp, Homo sapiens
tttttggttgttgtttgatgacgacattgtagaaaaaatagatacacaagctattgaagaattctacgggttgacatcagatactcaaaga

SEQ ID NO: 6757647 - DNA, 59 bp, Homo sapiens
ccatgagatcctatgatgtgatagttaatttgatgtgtcatcttcactgggtcacaagg

SEQ ID NO: 6757648 - DNA, 91 bp, Homo sapiens
tgccttagagtgctaagaacagtctaccctccttacgagactgagtgtttcctgaaggcaggagctgtatcttattgaactctccagcgca

SEQ ID NO: 6757649 - DNA, 65 bp, Homo sapiens
ttctctgtgagggtgctggatttgagtcctacccaccagcttcgcccagcaccctctcagctgaa

SEQ ID NO: 6757650 - DNA, 72 bp, Homo sapiens
cagatgattttttttcctggctttgcttcccttttagaggatgtggattgagccagaaaggggcattatctg

SEQ ID NO: 6757651 - DNA, 55 bp, Homo sapiens
cagggacattggtggccaggttgttgtccacggaacctctccctttgtgtccctg

SEQ ID NO: 6757652 - DNA, 74 bp, Homo sapiens
ccgttacagccccagcacttagctgagtgactggcacctagtaagcactcagtaactgtttgctgaataaatgg

SEQ ID NO: 6757653 - DNA, 64 bp, Homo sapiens
ttttacacttcggttgtgtgcatacacttgtgtatttgatgttttatgcaacaaaagtgtaaga

SEQ ID NO: 6757654 - DNA, 69 bp, Homo sapiens
gcatttcctaggagattgatcacatttatcaccatttagatatctatgtgccaaagtcttcctaagtgt

SEQ ID NO: 6757655 - DNA, 96 bp, Homo sapiens
ggcaggagaatcgcttgaacccaggaggcagaggttgcagtgagctgagatcgtgctactgtactcaagcctgggcaataagagcaaaactccgtc

SEQ ID NO: 6757656 - DNA, 89 bp, Homo sapiens
gggaaaaggctgttggcttttcgttggtcattccccagcccatccccaggatccagctgcaagaaccaaggaaagaagccagcctcccc

SEQ ID NO: 6757657 - DNA, 65 bp, Homo sapiens
ttgccttttcctttcatcaggacaaagctcagccaggctgatcagaataagagaggaaagggtaa

SEQ ID NO: 6757658 - DNA, 64 bp, Homo sapiens
tcaggtgatggtgggagaggagaagcaagatgtgctctcatgccttcttcaccagtttacctga

SEQ ID NO: 6757659 - DNA, 59 bp, Homo sapiens
tcactgctcagagtagagtttagcccagcacggattcagacttccactttgtgcactga

SEQ ID NO: 6757660 - DNA, 93 bp, Homo sapiens
ggactttctgttagggcagcacaaggcatggactcaatcctataggtcagcatccagatccccagtcctctgctgtgcgtctttggaaagttt

SEQ ID NO: 6757661 - DNA, 57 bp, Homo sapiens
catggggatgaggctgagacttcttccaaggagcaatcagcttgcttcattattatg

SEQ ID NO: 6757662 - DNA, 60 bp, Homo sapiens
ggttaatacatgggtgtgctttatctgtccgctacctggatattaacatcagtgttggcc

SEQ ID NO: 6757663 - DNA, 89 bp, Homo sapiens
tatgtggaactgcagatactgttggcagcagaccagaatttatagttaattctgtttggccttgcacgtcatctagtcagttgtatatg

SEQ ID NO: 6757664 - DNA, 130 bp, Homo sapiens
cattggaatcccacagacaatttaaatagattctgatgcctgggtactgcccctcagagattctaaactaatcagtgtgaggtgaagccagggcatcaatatttttaaagtcctccaggtgattctaatg

SEQ ID NO: 6757665 - DNA, 61 bp, Homo sapiens
gcagattataagcttcttttattcagtttatcaactggttgaagaaaagctagtatggtgc

SEQ ID NO: 6757666 - DNA, 76 bp, Homo sapiens
gcaggccagggctgtgggggcctgaaccacctccttctttgcaaagggacagcctggagccacagcccagggctgc

SEQ ID NO: 6757667 - DNA, 101 bp, Homo sapiens
ttttgactgattgtgacagcttgagttttggatgaagtgccaacctctaatttttattcccttggctactgtaaactaaagcttgtaatttttcttcaaga

SEQ ID NO: 6757668 - DNA, 70 bp, Homo sapiens
cctccccagtatatgtgaatggtgtttgtaagttaccaatggaattccccattcacatataccagggagg

SEQ ID NO: 6757669 - DNA, 55 bp, Homo sapiens
cagtctcaccctggaggccccagttgcaatattgggtgtcacaaatgtgagagtg

SEQ ID NO: 6757670 - DNA, 81 bp, Homo sapiens
agtgacttgagagaggtggcctgcaagtgcagatggccaagacgagtggccagcaagtgcagatggccaagacgagtcatt

SEQ ID NO: 6757671 - DNA, 102 bp, Homo sapiens
gtggagagttgaaaatatgcgaagctgtaagactttcttgtttatttctgtgtcgaaggcaaggcagcttaatagaatttgaatataactaaatccatccac

SEQ ID NO: 6757672 - DNA, 129 bp, Homo sapiens
gtcgggaaccaagagcagtgcaaggcggaaatgaaactgggtaaaggaattgggtttcctggcttcccaagatgtgtccattctttgctcctcctcgttttcttccttcttgacttctttttctatttc

SEQ ID NO: 6757673 - DNA, 65 bp, Homo sapiens
ctatttgtctcataagtaatctgtcacattcattttaagttgaagtgtggatatgtgacaggtgg

SEQ ID NO: 6757674 - DNA, 92 bp, Homo sapiens
ggccgggcgtagtggctcacgcctgtaatccaacactttgggaggccaaggtgggcagatcacgaggtcaggagttcgagaccagcctggcc

SEQ ID NO: 6757675 - DNA, 64 bp, Homo sapiens
ttagtgatcatccagtttcttgtccagcaccagtctagtgcttgactagattatctggatctaa

SEQ ID NO: 6757676 - DNA, 68 bp, Homo sapiens
ggctccatcctggcctcgctgtccaccttccagcagatgtggatcagcaagcaggagtatgaggagtc

SEQ ID NO: 6757677 - DNA, 62 bp, Homo sapiens
gctgcccttccaggttgccacagtgcagtctgcacttggcctgcccagccagaaggagcagc

SEQ ID NO: 6757678 - DNA, 64 bp, Homo sapiens
acggaggggagaaagctggcatattgatcccccactccttggttgtcagctccctgtcctgtgt

SEQ ID NO: 6757679 - DNA, 79 bp, Homo sapiens
cccaagctgaagctgcctgggaggaagggctgagcatgcctagcccagccccttctttggggagctgactgcctatggg

SEQ ID NO: 6757680 - DNA, 69 bp, Homo sapiens
gcagggtatgtttttatctactgtgaggttcctggggcggagatgtgcagtggagcgagaacttcctgt

SEQ ID NO: 6757681 - DNA, 61 bp, Homo sapiens
gaaagaatcaactatgtctctggcatgcacatcaatgatgagaacagtgttgtattttttc

SEQ ID NO: 6757682 - DNA, 73 bp, Homo sapiens
gaaagagacctatctgtgagctagcaagagttatcattcccactagctctttatagaaatgagtgtcttggtc

SEQ ID NO: 6757683 - DNA, 79 bp, Homo sapiens
gagaggttgctggaagctatggtccagttctatttttatatatggtctgaccatggtctatttagatattcagcctctc

SEQ ID NO: 6757684 - DNA, 85 bp, Homo sapiens
cctctgcaaccctttggcttttgaaaaggtgatgtacagctggtgctagctgtatatacactgattaggattttctgggcagagg

SEQ ID NO: 6757685 - DNA, 59 bp, Homo sapiens
gagaggtgagtcattacctagtgaaaccagaagcccacaggtctccagcatcacctctc

SEQ ID NO: 6757686 - DNA, 67 bp, Homo sapiens
tctccttcctctcttgcccataagagtctacttaatatgtttcctctttggaggggaggacaggagg

SEQ ID NO: 6757687 - DNA, 66 bp, Homo sapiens
cctggcaacctgtcctctgaagtgtggcctccaccaggaggggccatggacttctgcggacacagg

SEQ ID NO: 6757688 - DNA, 60 bp, Homo sapiens
caatgcttgtggagtgcctgctgcagtccaggcctgggctaggtgcttccacacgtgctg

SEQ ID NO: 6757689 - DNA, 69 bp, Homo sapiens
tatccctcaatggcatctggccctgggcttacttttattctccccatttttcagcttcattgaggcata

SEQ ID NO: 6757690 - DNA, 71 bp, Homo sapiens
tttagatatcttgcactgcataggcagtccttacaaggaagaactgtcctgaatactgcatgacctttaaa

SEQ ID NO: 6757691 - DNA, 56 bp, Homo sapiens
acaagggggagaaatgatcttgtaatctcaacaataaaagcgtttccatcctttgt

SEQ ID NO: 6757692 - DNA, 58 bp, Homo sapiens
aatttctcttagcaagacattacactgcatggtggatggccttcttgctcaggaagtt

SEQ ID NO: 6757693 - DNA, 70 bp, Homo sapiens
tttgaaaggaggacatcaccacactctactagcaactgaatagaagatgtggtgaaatgcctcccacagg

SEQ ID NO: 6757694 - DNA, 109 bp, Homo sapiens
gagaaggagtcgggtggtaacggttggggtcaggaagaattctgccaagtatctttactgtcattctgaccatagcctctttgttcccgcattcgaacttttggttctt

SEQ ID NO: 6757695 - DNA, 86 bp, Homo sapiens
tctgtctcatgtttctagaataagagctccgtgaagaaagagacttgttctgttttgttcatgcctatattctcagcatgagaaga

SEQ ID NO: 6757696 - DNA, 79 bp, Homo sapiens
cttgagaagcggatccatagagcaactcatctccactgaaacagtagaacaatgaatttctggaggaattgttttcagg

SEQ ID NO: 6757697 - DNA, 59 bp, Homo sapiens
gagctgggacttggaatccacagaggtgaaacggtggggcaaatccaatcactcggctt

SEQ ID NO: 6757698 - DNA, 68 bp, Homo sapiens
gaaagtgggcatgtcttcaggagtaaatatcatttcactgaaatgtccttcctgagatccctgttttc

SEQ ID NO: 6757699 - DNA, 110 bp, Homo sapiens
gtgtcctagctggagtggatccagtgtccacagaagcttgagtcagaaattgtaagagcctttctcctggtatgtgacactgacatctgctccctcctggtatgtgacac

SEQ ID NO: 6757700 - DNA, 71 bp, Homo sapiens
aactgattgtttttcataatctatagggttttagatgaaactcaactagaacttattagaaaggctcagtt

SEQ ID NO: 6757701 - DNA, 69 bp, Homo sapiens
gtccgatggcacatcttaggtgctttgttcacctggctatgcttaatgagcagagaatctacatcggat

SEQ ID NO: 6757702 - DNA, 59 bp, Homo sapiens
ccactctcctcacatgttcccaatggaaaccctgggacatgaagcatcggaggcagtgg

SEQ ID NO: 6757703 - DNA, 59 bp, Homo sapiens
aggaaggtgacagtgtccacctacccattccccagtagctggccacattgtgccgtcct

SEQ ID NO: 6757704 - DNA, 61 bp, Homo sapiens
ccaagctctgggatagcagagagcatgcctgtcgtttcactgctgaattcccagagcctgg

SEQ ID NO: 6757705 - DNA, 96 bp, Homo sapiens
tatttttcccccaaccctatctcatttcactcattcatgttactttcatggcccatgtaggtatgtgggtgagaggaggaggttgttggaagaatg

SEQ ID NO: 6757706 - DNA, 78 bp, Homo sapiens
ctggtagcaaagctgctcccttttgtcaagccctcctggtgcatcctttacagacaagtgggctgcagcttttgccag

SEQ ID NO: 6757707 - DNA, 59 bp, Homo sapiens
gtaacagtttactggccttgccgttctcttaagaggcactaatggtagtggactggtgc

SEQ ID NO: 6757708 - DNA, 75 bp, Homo sapiens
ggggtcagtggagggtggggtgtcagaggaagcacctaggtctcccattacttatggcccacccccgccaacccc

SEQ ID NO: 6757709 - DNA, 74 bp, Homo sapiens
tcggttgccaggcaactgcccagccatctatgacagaggaattccctcagaggagggcgccacctggcggctga

SEQ ID NO: 6757710 - DNA, 62 bp, Homo sapiens
tatatggttgtttcactagctctaatcttatgtacagtttttagtcagttgacagccatata

SEQ ID NO: 6757711 - DNA, 95 bp, Homo sapiens
gaaggaatactcatggcagtggtgataaccgctatcatagctaccataaaattactcgttgtgactggttgtcccgctttcctcaggttttcttc

SEQ ID NO: 6757712 - DNA, 82 bp, Homo sapiens
gatctctaatacccattagtgttagggcctgttacctcaatcatgagtgacagagccctaattattaaggtaattagaagtt

SEQ ID NO: 6757713 - DNA, 124 bp, Homo sapiens
ctactttacacaatattgggcatcttcatgacagctattgacgtctttaattatttttaactccacttatattattgagctcagtgtagtcatggctttcagaagcacaaaaacaaaatagtag

SEQ ID NO: 6757714 - DNA, 92 bp, Homo sapiens
cccctgcgtttctgctcctgcacccctgaaatttgaagacctgaatgttcactattgcacggactaaatttacagcggggagcagacggggg

SEQ ID NO: 6757715 - DNA, 60 bp, Homo sapiens
cttctttctgcctatttatgatccattcagcatctgacaggtgtctaaggcagacagcag

SEQ ID NO: 6757716 - DNA, 96 bp, Homo sapiens
ggcggtgagttggtgaggaagtcaccagctggaatgttggagtctgaacagataaactcttagcccagcttggcctatttctttatacttattacc

SEQ ID NO: 6757717 - DNA, 65 bp, Homo sapiens
tctcagggaggctggcgcagagtttatgatacaagtattggagtactgcgagctgccagaggaga

SEQ ID NO: 6757718 - DNA, 75 bp, Homo sapiens
acttaaattcagatcctgacattttaggtatttttgaaacaacaactatgcttaataggagttgaacattggagt

SEQ ID NO: 6757719 - DNA, 61 bp, Homo sapiens
tattgatagtttttgtgttttccagacactctctttgtgttctggagataagctgtcaata

SEQ ID NO: 6757720 - DNA, 61 bp, Homo sapiens
ctggccttgttcctccccaagtgctcaactcttccctgacttgggcaggacacaggggcag

SEQ ID NO: 6757721 - DNA, 64 bp, Homo sapiens
gagatactgcagttaagtaattagctgtctgcaactagttaattaagagatactgcagtacctt

SEQ ID NO: 6757722 - DNA, 69 bp, Homo sapiens
gagtactcagtggcaagtccggtattgaagttgggcctgtctaactacaaagcttgtactgtgtgactc

SEQ ID NO: 6757723 - DNA, 129 bp, Homo sapiens
tcctagtggaagggttgttgtgaagattagtggaaaaccaaggcctgccacactgtttgtatgccatgtgcagcagtgacttgctttgtttcccctttctggttctagtgtttcctgttgtaactaggg

SEQ ID NO: 6757724 - DNA, 79 bp, Homo sapiens
gtgtctcccagaggtggggacaggtgatgcaaggtctggcacagattggtaatcagaagtccaataccatgggagatgc

SEQ ID NO: 6757725 - DNA, 90 bp, Homo sapiens
gaaagtactagaacctgacaggtttgtccttgaatcaattcacaaccttcaaagaatgttgtttcgaagggcactgtcaccatcactttc

SEQ ID NO: 6757726 - DNA, 58 bp, Homo sapiens
tccagcatgaaggggcttttatagccacagaagccatgaggggcccagcatcctgtga

SEQ ID NO: 6757727 - DNA, 130 bp, Homo sapiens
tgctgttgagtgtagaaaataaaatgtgtgaatttctttatcttgagtattgagattctccccttagaataaaacaagaatttttctctcagtgtaaaaatgtcaagttttattcttgaaatgaatagca

SEQ ID NO: 6757728 - DNA, 67 bp, Homo sapiens
ggctagctgacagtgcacccagggctggcaggggcaggctgggcagcagctgttaagcagggaggct

SEQ ID NO: 6757729 - DNA, 111 bp, Homo sapiens
ttcaatggcagatgacttgattcttggtggtaaagcaagtggttggttataagtatggggtctcattgtgcctaggttaacatttcttttccactcatatgtgccattgag

SEQ ID NO: 6757730 - DNA, 87 bp, Homo sapiens
tcatctccttttgagctggaggttatcagagagcatctcaatttatagaaatggaatctgaggccttcagcatgaatctttgggtga

SEQ ID NO: 6757731 - DNA, 58 bp, Homo sapiens
gtgggagacagtcttgtgcaatgtgagatgtttagcagagtatatggcttctacctac

SEQ ID NO: 6757732 - DNA, 76 bp, Homo sapiens
cgttttaaaggaagctggagtaaattctgtaaagtggagacgtttttggcaggatatgcaccagctgcttagaacg

SEQ ID NO: 6757733 - DNA, 65 bp, Homo sapiens
aaacaagactagaaatcatttgttgagcacttaatgcttagcagtcactgttctaagtattgttt

SEQ ID NO: 6757734 - DNA, 61 bp, Homo sapiens
tggttgtgctgagtttagtgcaagactaatgttttttctacttgaccggcttagcaaacca

SEQ ID NO: 6757735 - DNA, 96 bp, Homo sapiens
ctctgattattggcctgctgtttgtatggacctgttctatgcatactttgtaatggttcacatcctataattacagcaccaacatttccttcaggg

SEQ ID NO: 6757736 - DNA, 65 bp, Homo sapiens
aaatggaagaagtgcaatactgactgcattccctgtagttcaacatgcatttttcaatctcattt

SEQ ID NO: 6757737 - DNA, 77 bp, Homo sapiens
gatttcctaatgtggatctctgaactcattttactcacatcattgtgattgtgtaagaggtttaaatttgggaagtc

SEQ ID NO: 6757738 - DNA, 74 bp, Homo sapiens
gatctaattttcactcatttgctaaaaaattgctagacaaaattcagtaaggcaacttggttgaaattagagtc

SEQ ID NO: 6757739 - DNA, 62 bp, Homo sapiens
gctggcgccaggcctctggccactccagctgctgtcccgactgagccagggcctgggtcagc

SEQ ID NO: 6757740 - DNA, 79 bp, Homo sapiens
ccattaaaagaataacagaataagtcattaccgctttaatgcaaggcggtacatggaagattctcgttttctcttaggg

SEQ ID NO: 6757741 - DNA, 82 bp, Homo sapiens
gggctttgcaggtggtcagtaaacaacgccgtgcttcgcacaccgcgtgtggacatgactagctgccagcgctttaaagccc

SEQ ID NO: 6757742 - DNA, 79 bp, Homo sapiens
ctcattctctcaggcttcttttctttccagacggggccctgtatcttgcatggttagccttgagagttaagagaatggg

SEQ ID NO: 6757743 - DNA, 64 bp, Homo sapiens
tccctgggaactgaatgtctcggtataaaacccgattgtacatttgttcagttctgagaaagga

SEQ ID NO: 6757744 - DNA, 55 bp, Homo sapiens
tgcagagatgggagtgagagcccgtctctttgacattccaactcacatctctaca

SEQ ID NO: 6757745 - DNA, 116 bp, Homo sapiens
catgtaagctagatcagtcagtcctgcaagctgacatccagagagatgctgtggttctctccaaactctctttgtggtgcattttagcttgtctattacttctcaaagtttatttg

SEQ ID NO: 6757746 - DNA, 79 bp, Homo sapiens
tcagaggggagaagtgagctggttcaaagttcacagagttaggactgtgtcctggctggctcatttttcattgtactga

SEQ ID NO: 6757747 - DNA, 61 bp, Homo sapiens
gactgagaaacagtacattaccaggactccataaaaccgtccttcatactgtcttctggtc

SEQ ID NO: 6757748 - DNA, 56 bp, Homo sapiens
ttagaaatttctcctgagtagtgctcatttgacacactcttcccagaaggttctga

SEQ ID NO: 6757749 - DNA, 74 bp, Homo sapiens
agagcgtaatacaatctagcagttcattgtgctatggggcttttgtcattttgcagtgtgctgttggcagctct

SEQ ID NO: 6757750 - DNA, 78 bp, Homo sapiens
agaagtatgtacagtttattgcacaggtaaccagaacacatttctgcgtcccacaagccataaataatatatagttct

SEQ ID NO: 6757751 - DNA, 58 bp, Homo sapiens
gtccccaaaattacaagacacagccactcatgaagtgttatgtaatgccacggggtgc

SEQ ID NO: 6757752 - DNA, 63 bp, Homo sapiens
actgatgagtgtccttaaggttgttctcttacggatgtgagaagcatatggtacattcttggt

SEQ ID NO: 6757753 - DNA, 59 bp, Homo sapiens
cattacttacagttacggcaagtggtctccaaagatggctgccaacattgttagcgatg

SEQ ID NO: 6757754 - DNA, 113 bp, Homo sapiens
attgtgtttcaggagagaaggcattcaagagtctccctgtggggtccgcctgtccggccccatcagcggggtggccaggccccacagggctgtgttctctttcctaagccaat

SEQ ID NO: 6757755 - DNA, 59 bp, Homo sapiens
gcccatccactaggcggcccacagcagcacccctgcgtctgcctgcagtgtggcagggc

SEQ ID NO: 6757756 - DNA, 78 bp, Homo sapiens
ttccacccactttccctggaggtcctctctggcagataggtgccagaaatggccctagtcagagggaagtgggtgggg

SEQ ID NO: 6757757 - DNA, 66 bp, Homo sapiens
atgccgtgtgctccctctgtcgtcataactcaggaataaatgctgtgattatttgggaactggcat

SEQ ID NO: 6757758 - DNA, 93 bp, Homo sapiens
taaagaagatttcaggtgtatcatggagttgaattggctaatattgtttttctgatagtttcttaggctgccggtacatctgttctatcttta

SEQ ID NO: 6757759 - DNA, 60 bp, Homo sapiens
gaaaccagaaagacctgggctcaagagggggcttcttctgctcttggctttgctggtttt

SEQ ID NO: 6757760 - DNA, 87 bp, Homo sapiens
tttgttggagatagtttgttcttatgccctatatcaataataataataaaaaacctttgaggctcaagaatagacagtattgacaga

SEQ ID NO: 6757761 - DNA, 71 bp, Homo sapiens
gagaggatgggctgctgtggatgcaggacctcaggaaaggttgaggctgagccactggcagagcgctgctc

SEQ ID NO: 6757762 - DNA, 69 bp, Homo sapiens
ttcagagtctaaggaaaaatagagtattatggttcaatggtgttcttatgtagtcttatgattcttgaa

SEQ ID NO: 6757763 - DNA, 69 bp, Homo sapiens
caagcttttcttttgatatttgttacatttgtgaaataatataacaatgcagttaatgggaagagcatg

SEQ ID NO: 6757764 - DNA, 61 bp, Homo sapiens
ttggtgtggagggtggccaattctgatgatgatgcggataatggccaccactgtatatcaa

SEQ ID NO: 6757765 - DNA, 60 bp, Homo sapiens
tgctttcaggacaaggtttaaactccttaaatggtgggattataaacctttcttgtggca

SEQ ID NO: 6757766 - DNA, 82 bp, Homo sapiens
ggggctgcttcattcttatctctctctgcagctttctctgctatttaatctgcatggaggaagatgaatgcaccacagttcc

SEQ ID NO: 6757767 - DNA, 97 bp, Homo sapiens
ggtgctgagattttgattgactgggaggggaggcatggaagctcttgtaccacaggctgcttgctcaacccccgtctctcttcagagctttcaagcc

SEQ ID NO: 6757768 - DNA, 62 bp, Homo sapiens
gcaggaaggtggagcaggtggggactgcagttgcaggacctctctgtgtggcctctccatgt

SEQ ID NO: 6757769 - DNA, 130 bp, Homo sapiens
agggcttgtgagacgaggacgctgggctgagaagatagggcttcactaggcggagggccccagggtaccccatacacaagcctgccttggcttctcgtccaatttggtgcatctcacactacacagccct

SEQ ID NO: 6757770 - DNA, 89 bp, Homo sapiens
ctaaagggctgcaaagagatgtaaatacttgtgaataggaatgattatacactgtgtaaaatgcacttttgtttgctgtattcctttag

SEQ ID NO: 6757771 - DNA, 93 bp, Homo sapiens
gaggcaggagaatcgcttgaacccggggaggttgcagtgagccgacatcacgtcactgcactccagcctggtgacagagtgagactccgtctc

SEQ ID NO: 6757772 - DNA, 59 bp, Homo sapiens
ccacattcatcagttgttaatgtactcattatattggcctgatgctgatgaatgactgg

SEQ ID NO: 6757773 - DNA, 70 bp, Homo sapiens
taaaatttttctctgaagatttatcacagtccattcaaatcaagattgaggtctcaagagaaaagtggtg

SEQ ID NO: 6757774 - DNA, 60 bp, Homo sapiens
gggagttattaccctgattttcaaatgaggaaatcaaaacctacagaggtaatgacttcc

SEQ ID NO: 6757775 - DNA, 94 bp, Homo sapiens
ctggtgggcagccggtggggagggcagggctggccataggtacaagtccagtgctggctttttggtccttgctttgtcgtatgtcctttactag

SEQ ID NO: 6757776 - DNA, 129 bp, Homo sapiens
ctgttgaattctttatctgaacaccagttttctatatgaactgagagagatggcaagaaataaagaattggtactttcttaggctgtataaatgagaggattgtgcaaatcatgatagacaaaacccag

SEQ ID NO: 6757777 - DNA, 64 bp, Homo sapiens
tctttctatggtctgttggccatttcataactttggaaatgtaatggtcaattcattagaaaga

SEQ ID NO: 6757778 - DNA, 62 bp, Homo sapiens
acaggaggaacaagaggttctggttgccactcttcaatgagttcttctttttccttgactgt

SEQ ID NO: 6757779 - DNA, 82 bp, Homo sapiens
ttgagtgataaagctgaagatttttgctagccccgtagagaaatggggagaaatttggcaaggcatctttgacgtggctcag

SEQ ID NO: 6757780 - DNA, 118 bp, Homo sapiens
gagcccaggagcagcatctgactctatgctcccttagtgtgcctgaggcagatatcactaatcgatgactgcagtcttctacattgagcttagaagcagcatctgactctgtatgctc

SEQ ID NO: 6757781 - DNA, 82 bp, Homo sapiens
gattatgtgttgactgtttagaaatttgtccaattttaaaatttttgttggactgtacacatctacatatcaatatgtaatt

SEQ ID NO: 6757782 - DNA, 78 bp, Homo sapiens
gcctggtggagcctaggctaagtctacaaaaatacggagctcagagctcctacctagatttctttgctttattcaggc

SEQ ID NO: 6757783 - DNA, 56 bp, Homo sapiens
cagacctggggcctgggagcccgccctgggcaggtgagttctggggcctcaggctg

SEQ ID NO: 6757784 - DNA, 73 bp, Homo sapiens
gattagaagaacttgttagcctaagaaagagttcaaagaaagggcaaggctgaatgtttgagtttttctaatc

SEQ ID NO: 6757785 - DNA, 79 bp, Homo sapiens
atcagatttgctaatcaagtattttccagtggcacagagattaacaaggcctctgccacaatgttgaggcaaagtagat

SEQ ID NO: 6757786 - DNA, 63 bp, Homo sapiens
tccagcagccagaggggccagagtcggaagctgggggtcggactcttggcatcttctggtgga

SEQ ID NO: 6757787 - DNA, 91 bp, Homo sapiens
gctttttttgtgtgagcttcagtattagaagttttagctggatttaatgctaaattgcttataaagatgaatgaagctgcacagggaaagt

SEQ ID NO: 6757788 - DNA, 86 bp, Homo sapiens
gctgaagaggcctgtttctcagtgagtagaaaggctggaaaggttctttccagctcttgttgcccactgcccagttcttcttcagt

SEQ ID NO: 6757789 - DNA, 65 bp, Homo sapiens
acccgtaaatggcagcccacgatggcaatggacgactttcttaattgcccgtgatgcttgcgggt

SEQ ID NO: 6757790 - DNA, 57 bp, Homo sapiens
ctgtggaaaattggaacgttcctggccctgctagaaggggcaactaattctccagag

SEQ ID NO: 6757791 - DNA, 78 bp, Homo sapiens
tgatacatgcaatagcaattttgaactataatgatgatagctttattgagcattgttcaaagtgctttgcatgtatta

SEQ ID NO: 6757792 - DNA, 60 bp, Homo sapiens
gtggtttgttttattcctggaaggactacttcactgtaaagggacaaaacacaatgccac

SEQ ID NO: 6757793 - DNA, 59 bp, Homo sapiens
gggagggccaatggatttcaactgatgtatcaattccagctggtcgccaatggctccct

SEQ ID NO: 6757794 - DNA, 75 bp, Homo sapiens
tgtgctcctggctctctgagggctggagctgttctatttccatttgcttctgccccacctctgccaggatgccca

SEQ ID NO: 6757795 - DNA, 67 bp, Homo sapiens
tgggtacatttgcttctgctaaacaacttctcatttgatagggcgtgggcataagtaaatagattca

SEQ ID NO: 6757796 - DNA, 68 bp, Homo sapiens
gcccatatctgctctctgctctggaggaggaggcattcctccacggcccattgggcaggacgaggagc

SEQ ID NO: 6757797 - DNA, 119 bp, Homo sapiens
gggggtgtttttggagacagatcctcactttgtcacccaggctagagtgcagtggtgtgatctcggctcactgcaacctctgcctcccaggttcaagtgattctcctacctcagcctcc

SEQ ID NO: 6757798 - DNA, 56 bp, Homo sapiens
tctgtttcctgcatctatctctggtatcatccaagtcaagtactacaggaaacaga

SEQ ID NO: 6757799 - DNA, 82 bp, Homo sapiens
aggcagagtatagaagctttgctctctctttctcagggatttttcctgaacctagagggttaaatcttttgtttgtttgttt

SEQ ID NO: 6757800 - DNA, 67 bp, Homo sapiens
catctgaggcaggtctcttttctggaaggtgaattccagcggctggttggagatcccgctgcagatg

SEQ ID NO: 6757801 - DNA, 93 bp, Homo sapiens
tatacctcatttacttttcacttcacattagctaaaagggaaactaggaaattttctttgtagctaatgtgaagtgaaagtaaatgaggtata

SEQ ID NO: 6757802 - DNA, 75 bp, Homo sapiens
atgggtccaggaatcaaaagatggaagtaggaatagcccctttcaacttgaagaattgatacttcctgtccctat

SEQ ID NO: 6757803 - DNA, 65 bp, Homo sapiens
ctcatggaaggatgccctgcaagtccctcttgagtttcttaagatgttttggggccctttcagag

SEQ ID NO: 6757804 - DNA, 92 bp, Homo sapiens
gtaggccagcagagggctgaaggagtttgggtagtcatacacctgtttccacgggtcactgaggcattcatgctctggtcctcttggcttgc

SEQ ID NO: 6757805 - DNA, 100 bp, Homo sapiens
tgaggcaggagaatcgcttgaacccaggaggtggaggttgtggtaagccaagattgtgccattgcactccagcctgggcaacaagagtgagtctgtctca

SEQ ID NO: 6757806 - DNA, 83 bp, Homo sapiens
tggttaaattcatgactctcttcctaatagcaccttgagtttatgcattggaaatggtgctactaggagtcagtgtttcatca

SEQ ID NO: 6757807 - DNA, 67 bp, Homo sapiens
taagatgaggatggttaaagaacattgtttagaaataggcaagttctgcgctgattatcctttttta

SEQ ID NO: 6757808 - DNA, 55 bp, Homo sapiens
gctcagtctttgtggggtacgggacatgctgccacctcacttcacagaggagagt

SEQ ID NO: 6757809 - DNA, 109 bp, Homo sapiens
cctgggtaagagcaagccacccaggagagagctataaaatctcctgctgaaatttggtttagctttctttgtgtgtgtgccctattctttgctacatttttttcccagg

SEQ ID NO: 6757810 - DNA, 61 bp, Homo sapiens
atgatgtaagggtaattgtctatccatgtgggaaaaagataaagctgtacctttacatcat

SEQ ID NO: 6757811 - DNA, 73 bp, Homo sapiens
ggctgcacctgctgccattagggcacagaccccagctaatggcatgtcttctgcccaggcagacggagcagct

SEQ ID NO: 6757812 - DNA, 57 bp, Homo sapiens
gatgaggctagagacatgtgtagggagcataccatagacagatttgtaggtcttatt

SEQ ID NO: 6757813 - DNA, 59 bp, Homo sapiens
tgactctccctctcctgaggcttccagacaactggtctcagagattcagggagaagtta

SEQ ID NO: 6757814 - DNA, 56 bp, Homo sapiens
ggttgttctcttttctccttgggcttttctgttgctcttagatatggagaattacc

SEQ ID NO: 6757815 - DNA, 129 bp, Homo sapiens
agacacaaacgctgacttcagattgtttacagttcgagagaaaaggcatatatgcaatgtccaatgtcttgtaatgcacctttgctttctgaatctgctccccatctttgaatctcctgaattctgtct

SEQ ID NO: 6757816 - DNA, 64 bp, Homo sapiens
atgctttgaagtttttcctcataaagaacataatgcagtaacttaggagagaccattaaagcat

SEQ ID NO: 6757817 - DNA, 65 bp, Homo sapiens
ccctattgatctggatatttagacaggtttcaccctattgatctggatgtttaggcaggtttggg

SEQ ID NO: 6757818 - DNA, 65 bp, Homo sapiens
ggaagtgtagtcttttttggtgaaaggtggtctaaactcctctacttgaaatcaggcttacttcc

SEQ ID NO: 6757819 - DNA, 63 bp, Homo sapiens
agccaaatataaagtggttttggccaggagttccccggctaagtccaagggtatgagttggct

SEQ ID NO: 6757820 - DNA, 118 bp, Homo sapiens
cctcaagagctctgccacctgtccaaggagagagccatgttgggctggccacagctaaaaactgtcctggcccagtggcatcttcactgcttgggttgtgtgcagttgtatttagagg

SEQ ID NO: 6757821 - DNA, 63 bp, Homo sapiens
gtgtgccttcatgtcattggacaccttgatgtcgccatcagagatagccacactgaaggccat

SEQ ID NO: 6757822 - DNA, 58 bp, Homo sapiens
ttcttttgtgaattgcttcttcaagtcttagatctttggctgggggaaggcaagaggg

SEQ ID NO: 6757823 - DNA, 75 bp, Homo sapiens
cctggactgtcttgttccaagactaaaattttccaaagaccttcaaatttacagtgctcttcaagacttcccagg

SEQ ID NO: 6757824 - DNA, 78 bp, Homo sapiens
aggatgtgaagtagagcatttggttatagtaatttctaagttaggcagttctaagtttaaattctatttttgcatctt

SEQ ID NO: 6757825 - DNA, 98 bp, Homo sapiens
gtggtttgtatgatgtgaagacatggttgagaataaagtgatggttccccacctgccacccggttttccaatgcatagttaatacaccgacatgccac

SEQ ID NO: 6757826 - DNA, 78 bp, Homo sapiens
gtgttcctgtaccaaagttgagtggaccagccctgtggcacatgcctggcaaggctgcccacttcaaaagagcagcac

SEQ ID NO: 6757827 - DNA, 82 bp, Homo sapiens
agaatgagatttgaggaagcagctggcagtatacttctccctccaagttcactgccagtcattccacaatttctcaatttct

SEQ ID NO: 6757828 - DNA, 73 bp, Homo sapiens
ggttgcagcagggaggtctagcacgtgggtcttgagatcagcataccagtggacttctccctgtggtgcagcc

SEQ ID NO: 6757829 - DNA, 57 bp, Homo sapiens
tacatcccagccagcagaatcagaaatcttgaatttggtcctgctgcctggggtgtg

SEQ ID NO: 6757830 - DNA, 63 bp, Homo sapiens
tggctctgaggctgtgaggtgctgcttccacctggaaaaactggccctgagggctcggagcca

SEQ ID NO: 6757831 - DNA, 76 bp, Homo sapiens
cctgtgctagaagaggatggaccttgctcattggtttaggcctaggttacaactccatttcttagctacacaatgg

SEQ ID NO: 6757832 - DNA, 81 bp, Homo sapiens
catgtggcaagtggcagacacaatgtgggcactaggcaagtggcaagtcccttgtattgagtcttatttgtctattcagtg

SEQ ID NO: 6757833 - DNA, 79 bp, Homo sapiens
gcacttggacaacctaagagcctcttcagtaagatcctgatagctttattggagaggtcttgggtagaaaaaaagctgc

SEQ ID NO: 6757834 - DNA, 109 bp, Homo sapiens
aaaaagggaatgccgataactcgtggagcactgaatggatctgatgagcataaatatgtgtgtcagaaatcagtgcctcggcagtaatggctatacacatttccttttt

SEQ ID NO: 6757835 - DNA, 64 bp, Homo sapiens
gtctgggcagcagcatttcttatccagcatcactgggcaggctctcagatgtgcaggctcaggc

SEQ ID NO: 6757836 - DNA, 118 bp, Homo sapiens
ggacctgatctccaggactcagaagcacttggaggaaggcctattcacttagaagcagttaccagtgctgggcagtgtcctccaagtgccagaggagtgctgtggagaaaagaagtcc

SEQ ID NO: 6757837 - DNA, 75 bp, Homo sapiens
ttgacttgctaaaagtaaactgtctactctgtgctagccattataatgggtgctagggatatagtggcgagtcaa

SEQ ID NO: 6757838 - DNA, 85 bp, Homo sapiens
gttgcctcacctgtaaaatgtggatgatactagtacttcataggctgtgaagattagacaggattatgcatgcagagtgaatgac

SEQ ID NO: 6757839 - DNA, 56 bp, Homo sapiens
ttatatgattgaagtgcataagacatacttttaggttttggcactgagtggtataa

SEQ ID NO: 6757840 - DNA, 90 bp, Homo sapiens
tcacctggggatcttgtcaaaatgcagattctgattcagtaggtcttgggtggggcctgagattctgcatttctaatagctctcaggtga

SEQ ID NO: 6757841 - DNA, 73 bp, Homo sapiens
gtgcataagggaagaagacaagaaaatgatattgtcgtttaatagttcactttagatcttcatctcttatcac

SEQ ID NO: 6757842 - DNA, 61 bp, Homo sapiens
gaggtatggcataaatcacaggggagggcataaactcagcttcatgagaatgccaggcctc

SEQ ID NO: 6757843 - DNA, 59 bp, Homo sapiens
gatacagtttgttacattgttagtgggctagtccacctagaatgaagcaatgctgtctc

SEQ ID NO: 6757844 - DNA, 57 bp, Homo sapiens
cctggggagagaaagcccagccacaccctccagcctgactataattctgtctccagg

SEQ ID NO: 6757845 - DNA, 68 bp, Homo sapiens
aggagcgagggctcttaattctcaagtaacaatcccattgtcccagaggatagaagccccatgttctt

SEQ ID NO: 6757846 - DNA, 122 bp, Homo sapiens
cctcctacagttcagctttccacgttccaggaggaaatgtgaccctgctgtttcgggaaccccacctcatgtagtcttaatttctctccgaatgtgtttgaagtcttgccagcgtagagagg

SEQ ID NO: 6757847 - DNA, 84 bp, Homo sapiens
tcaatccaagcaacaatcctgaggtactgcagggccgaacaccatctttctgggactgggtcctcaggacaagcaaggagttga

SEQ ID NO: 6757848 - DNA, 71 bp, Homo sapiens
gccggaggggctggtctttccacttactctggacaccagggaagggttcaggtgggcctgcccctctgagc

SEQ ID NO: 6757849 - DNA, 61 bp, Homo sapiens
agattttatagataatttcccaggctgcttcttccaaagcctaacggaagctgtaaaatct

SEQ ID NO: 6757850 - DNA, 106 bp, Homo sapiens
ttcagctttgccaaaaagggtggcttgcttttgttgggggttaggggcaattaaaacattgccactatttgctttgggctagagttgcattcttaaggcagctgaa

SEQ ID NO: 6757851 - DNA, 65 bp, Homo sapiens
ggaatctgtgcttttcacaagctttgctgatggtccttatgcagcagatttgggaaacactgtcc

SEQ ID NO: 6757852 - DNA, 70 bp, Homo sapiens
tgggttgtagcactggatgggctggtacatggagtagaatcagtccttggcatttaggagctacaagcca

SEQ ID NO: 6757853 - DNA, 58 bp, Homo sapiens
tcacttaggcttcagtttcttcatctgttaaatgaggccatggaactagcttgggtgg

SEQ ID NO: 6757854 - DNA, 55 bp, Homo sapiens
agcactttcctggcaaatgtggtctcggccatcaagctgccaatggtaagctgct

SEQ ID NO: 6757855 - DNA, 126 bp, Homo sapiens
acaggactcaagccaagacaatgagaatagagaacagaaattggaaaagtagcttccttgcttttctgagaatgcttctggaatcacttttctttgtctctctctgtcatggacaaggacttctgt

SEQ ID NO: 6757856 - DNA, 73 bp, Homo sapiens
agcttaaattttaagtgcatctgatctttcatgctgcccaagacagctatgaagggtgtacaaaatggaggct

SEQ ID NO: 6757857 - DNA, 74 bp, Homo sapiens
agggaagtttaaaaactttgtgaaatatgataccaggcaaaggttcacaggttctttttaaggctgacttccct

SEQ ID NO: 6757858 - DNA, 74 bp, Homo sapiens
tccataggtctgtaccctgtccttctgtgctcttagagttccaggaggccaggagggtgcaggctgtgtctgga

SEQ ID NO: 6757859 - DNA, 118 bp, Homo sapiens
gcagccctgacagcagataacttactctgactggattctgctttggctgtggtttgggttacagatgagaaggctgaccagttaaggcagagaagttaaaggcctggtgcagggctgc

SEQ ID NO: 6757860 - DNA, 70 bp, Homo sapiens
aaagcatcttcttccatcagttctggcctcacaagacagagaggaatgagcaggggtggaaggtagcttt

SEQ ID NO: 6757861 - DNA, 92 bp, Homo sapiens
tgagcacagcacagagttgcagagagcgtcccttaaatcaatgcaggcgaacagattagctacgcatcggcctgcctcgtgcgctgtgctca

SEQ ID NO: 6757862 - DNA, 120 bp, Homo sapiens
gtgtgtgcccccggccggccggccggggctctccgtgcggggcctgacccggaggggtcacatgtgtttcctggcagcccgcaggtgctgcgctgggcggggcgggtggtgggcgcaggc

SEQ ID NO: 6757863 - DNA, 64 bp, Homo sapiens
ggtcactggcagggcagtgagatttgaacttcagagtatcagacctctgaccttgccaaagacc

SEQ ID NO: 6757864 - DNA, 61 bp, Homo sapiens
ctcacctgggggctctgaggcatttgagcacttcagctcagtttttcagccctgaggtgag

SEQ ID NO: 6757865 - DNA, 70 bp, Homo sapiens
atctgaggtggtttttctttctttcatttgtttttctctgttgcagatggctatagatagcctttcagat

SEQ ID NO: 6757866 - DNA, 55 bp, Homo sapiens
agttgtttcctcagaggggcaatgcagcatggtgaacctctgcatggaaacagct

SEQ ID NO: 6757867 - DNA, 98 bp, Homo sapiens
taagagctaattgcttaaatgaccagaatacaggcttccaagctgatctttgtagaaaggccaaggcaagcctgtatcatttaaattttagttactta

SEQ ID NO: 6757868 - DNA, 59 bp, Homo sapiens
gatgaaggaatacatcagtggctttgtgaatgccaaggcatatgattgtaacctttatt

SEQ ID NO: 6757869 - DNA, 64 bp, Homo sapiens
tgtgaccgtggggacttgctcgggcttttgttcccagaaagtaagaccaagtgatcatttcaca

SEQ ID NO: 6757870 - DNA, 85 bp, Homo sapiens
ggagttataaatgaaatttagcaagcaggcaaattcacaaatgcaaaatttgtaaataatgaggtttgactgtatttctgatttc

SEQ ID NO: 6757871 - DNA, 56 bp, Homo sapiens
ttcacattagccaagagatggaatcaacttgggtatccattaatggctcaatggaa

SEQ ID NO: 6757872 - DNA, 81 bp, Homo sapiens
tgaagacatgcacacattcccagagtctagagtttaaatgttcaagacagtttctggattctgggctgtttgcatttatca

SEQ ID NO: 6757873 - DNA, 75 bp, Homo sapiens
ttttttatcagcatcttattttctatggaaacagtcccacctaactgaagttccatagctttaagagaaagagaa

SEQ ID NO: 6757874 - DNA, 72 bp, Homo sapiens
gacctaaaggagaacaagacccaagtcttcccataccagggtgacattctgtcaatgttgactccgtaggtt

SEQ ID NO: 6757875 - DNA, 104 bp, Homo sapiens
ctgacttgacagcctggccgttcctcagggccagggatcagtcgaggccaaagtatcacttgatccttccctgaaatgcctctgccaatctgtagccacatcag

SEQ ID NO: 6757876 - DNA, 77 bp, Homo sapiens
gccatgtgactttacagttcctctcgtggaggtgaaatgtactttcactccactgatgttgaatttagtcatgtggt

SEQ ID NO: 6757877 - DNA, 64 bp, Homo sapiens
gaagtggaacaggacacaaatttagtggaatttctttacaatgtgtgcttcttgtcaccagttc

SEQ ID NO: 6757878 - DNA, 57 bp, Homo sapiens
cccagtagacaggtgtgcctacagatgggattgacaagtagaaccatgtgtgctggg

SEQ ID NO: 6757879 - DNA, 95 bp, Homo sapiens
tatggtggcataatgctgtggtggcatgatagtgtgaatgcacgatagcgtgaatgcatgatggtgtgatggtatgatggtgtgatggcatgatg

SEQ ID NO: 6757880 - DNA, 64 bp, Homo sapiens
ttgaagcagagttagcttgtcacctgcctccctttcccgggacaacagaagctgacctctttga

SEQ ID NO: 6757881 - DNA, 119 bp, Homo sapiens
gtcagccctgtaaccctgcattcgtcagtaggaaaatgctttgatggggctggcttttttcttctagctatagtacttggcttttctattgagtgaattaagggacactaaggggtgat

SEQ ID NO: 6757882 - DNA, 58 bp, Homo sapiens
cttagttcttgggtgaacttttggcttcctactaagttagaattttcacagagctagg

SEQ ID NO: 6757883 - DNA, 65 bp, Homo sapiens
agcctcccgaggaatttttataagatctgatctaatcatgaatttgtttaaaaatccttctggct

SEQ ID NO: 6757884 - DNA, 58 bp, Homo sapiens
tcagcagccgcagctgactcagcagtgtcatttgccatccatcactgaggctgcttga

SEQ ID NO: 6757885 - DNA, 70 bp, Homo sapiens
attctatctttggtagctttcctaagaatggcaccactttagaaaagtttcaaagagttgtatttagaat

SEQ ID NO: 6757886 - DNA, 80 bp, Homo sapiens
tgtgtagcaggtttctagttctaagaatattattaaagtagctatttagtcatagaacaaggcagaaatctggttaagca

SEQ ID NO: 6757887 - DNA, 69 bp, Homo sapiens
gtagatagagatgtttgggcctcatccagatcccctctctgccctgtggggctcccatctcctggctgc

SEQ ID NO: 6757888 - DNA, 77 bp, Homo sapiens
ttccacttatatgagttatctaaaatagtcaaattcatagaatcaaagagttggattgtggttaccagtgggtggag

SEQ ID NO: 6757889 - DNA, 72 bp, Homo sapiens
ggctcttctgccagccctgggccatcatttgcataggaagcagatttggctcggctgctgatggtgatcgcc

SEQ ID NO: 6757890 - DNA, 83 bp, Homo sapiens
agctctgtcaagcaataattacctagagctgctgagcgtttgacccaagggccaagcagtctgctaggagtttaagaagagct

SEQ ID NO: 6757891 - DNA, 83 bp, Homo sapiens
ccccagccatgcaaagtgctgtacagtgtgtaaatctacctttaccttggattgatgggtacagtagttttgcatctgtgggg

SEQ ID NO: 6757892 - DNA, 76 bp, Homo sapiens
gctacctatatatacacctgctatgtgtgtggatatgtatttacacatacacatatcaggtgtatacatacgtagc

SEQ ID NO: 6757893 - DNA, 72 bp, Homo sapiens
gtgtgtgtgtgtgtgtgtgtgtgtgtgtgtgtgtatgtgcacacatgcatgtgtgtttacatgcttgcatat

SEQ ID NO: 6757894 - DNA, 83 bp, Homo sapiens
actctgcatcagcttctgtcctagaaactgggcttacatccatgaacaaggccgtttttgctcacacgaagcttcatcattgt

SEQ ID NO: 6757895 - DNA, 61 bp, Homo sapiens
gcagtgcattgcagtaggaactaagtaaataatatattcaaagtcctagtgaaatgcctgt

SEQ ID NO: 6757896 - DNA, 88 bp, Homo sapiens
gctaaaccgaggagtgcagggctggcaccggaggcatgatttgaaacgccgttggccctttgtccctgcttccttctctgggattggc

SEQ ID NO: 6757897 - DNA, 64 bp, Homo sapiens
cacccctcaggtctggcagtcccctacccactggcctaatcatactgtgcagcctgaggatgtg

SEQ ID NO: 6757898 - DNA, 87 bp, Homo sapiens
gcttctcattgggcctctgggttagtccctaagcagacaggttgtgatggaactagggttacccagagcttgctttctgagatcagc

SEQ ID NO: 6757899 - DNA, 62 bp, Homo sapiens
ttttcagtatgctgaatgatttttctgatcatggataatcagaaaaacagtaatgctgaaga

SEQ ID NO: 6757900 - DNA, 77 bp, Homo sapiens
ctgacagtagaatgctgagtcttatctcttatctctttgttggggtagtagattttatttcatgttctgctccacag

SEQ ID NO: 6757901 - DNA, 60 bp, Homo sapiens
atcaaatattttccttttcatcagcactcccagggttgctgaggaaagaggataaaagat

SEQ ID NO: 6757902 - DNA, 66 bp, Homo sapiens
gaaagcaagtgtatctattagtcagtgatacaagtgtcaccaagttgatgaatgcataaatctttc

SEQ ID NO: 6757903 - DNA, 56 bp, Homo sapiens
atcttggggaatcctctgtgtaacactggtgtattacacaggcagtgtcccgaggt

SEQ ID NO: 6757904 - DNA, 95 bp, Homo sapiens
attcagatagttattgacatttcattatatagacttttcagtaccccacataataatggctgaagaaatatgattgcttaataaaaggtctgagt

SEQ ID NO: 6757905 - DNA, 70 bp, Homo sapiens
aaatttcacattcttctgaatctacatctgtttttcagtctcaggacagtagatgaagagtgtgtaattt

SEQ ID NO: 6757906 - DNA, 105 bp, Homo sapiens
gtagttagtagagaatggttttaaatattccacagaggactccgattggtttttgagcttggatagttactgtgcagttgagatagagccattctaaaagactac

SEQ ID NO: 6757907 - DNA, 68 bp, Homo sapiens
aagggagttggaggaaagaaggttgatataaagagtattaaattaaatttctttctttttgctttgtt

SEQ ID NO: 6757908 - DNA, 78 bp, Homo sapiens
tctgcaaaagtgggttttgggacagccaagctctgagccccttccagagtttgtaacctaagattcaggttttgctgg

SEQ ID NO: 6757909 - DNA, 62 bp, Homo sapiens
tagaagtttcattgttcatgtaacaatattggccagttgttcaggtttgcaatgaagctctg

SEQ ID NO: 6757910 - DNA, 55 bp, Homo sapiens
cagtgactcacacaaacatgtgtgctcatgtttcatgagagctgtgagtctgctg

SEQ ID NO: 6757911 - DNA, 104 bp, Homo sapiens
tttgagttttcttttatttggatacaatcatttgcttagacacatatttttaaacttttaatgtattggtagcaatgatgttttcaagtagggaaacacttaaa

SEQ ID NO: 6757912 - DNA, 59 bp, Homo sapiens
ccaggtctggcactggccagtccagcctagcccatgctgacactcagtgccagggctgg

SEQ ID NO: 6757913 - DNA, 91 bp, Homo sapiens
agaaactcagtttgatagtaatgtgtttaaatgtcaagtaattcttattgcctatggcctggttatattgctatcatttgtacatttatct

SEQ ID NO: 6757914 - DNA, 57 bp, Homo sapiens
atttcctgatatatcctgtagtcaggttatatcaggaaacaggatatatcaggaaat

SEQ ID NO: 6757915 - DNA, 81 bp, Homo sapiens
tttttcaaatgagcaaacagaggttgaataacttgtatgaggtaacataaccagtaagtattcgagtctccatttgaaaaa

SEQ ID NO: 6757916 - DNA, 81 bp, Homo sapiens
gcctacagtattttggtgcagcagcctgagtggactacaggaatgccagtgcctgctgcccaatatttaaatcatgtgggc

SEQ ID NO: 6757917 - DNA, 94 bp, Homo sapiens
cactttttatttattgtgagaaaattgcctaattttgtgtctcagtttctttatctgtaaaatggggataatttttttaactagtagagttgtg

SEQ ID NO: 6757918 - DNA, 83 bp, Homo sapiens
ggttttgtatgtgctctgagtcctagtttttatgtcttggctgagaaccacagaaaggactagatattcatacatgcgagagc

SEQ ID NO: 6757919 - DNA, 72 bp, Homo sapiens
atacatttgcttgtaaatgtatgccttattacaatgacttatagtgtaaggtgcttaaacaagcaaacatat

SEQ ID NO: 6757920 - DNA, 55 bp, Homo sapiens
gctgtcagcgcccaaggagctccaggcgaggccaagccgtcctggcactggctgc

SEQ ID NO: 6757921 - DNA, 66 bp, Homo sapiens
atcttatctgaaagtctccagcttgtctgcaacatcacagctgaattttgggactcaagatggggt

SEQ ID NO: 6757922 - DNA, 68 bp, Homo sapiens
cggtttccagcttgggcctggggattggagatgtccccactgagagtagggcacaagtgaggaaattg

SEQ ID NO: 6757923 - DNA, 89 bp, Homo sapiens
gagcgtgcatattacgatttgagttataacatattcgtagtttcaatgttccagaactttgtgaagtggataactctgtcgtagcgctc

SEQ ID NO: 6757924 - DNA, 81 bp, Homo sapiens
tctggccccaaatgtcaatagtactgaggttaagaaatcctgctacagtctgattgtccatttggctacttttggcccaga

SEQ ID NO: 6757925 - DNA, 81 bp, Homo sapiens
ggtggcatcctgtccatggatagagctgctcgtgccccttgtggcctgtgaacgcagttccatggcagtggtggtgttgcc

SEQ ID NO: 6757926 - DNA, 55 bp, Homo sapiens
gtaactaggggcatggacacatgtgacctgttagggtgtctagccatctggttat

SEQ ID NO: 6757927 - DNA, 72 bp, Homo sapiens
ctgaccatcctggagcaaacatttaatttggtggcaggttagtcatattgaacattgttctaggaggcacag

SEQ ID NO: 6757928 - DNA, 63 bp, Homo sapiens
ggtgaggaagacttggcattgctgagttcccttctacatttatgcaatgttcctttcttcacc

SEQ ID NO: 6757929 - DNA, 77 bp, Homo sapiens
ttccaataccacctcattctggaggctgccggaggagctgaagcaattttgtcccatgggtgaggtggtggaaggaa

SEQ ID NO: 6757930 - DNA, 62 bp, Homo sapiens
gatgtacaatgtcactatgacctcaggaagtggggagaaagagtggtgaacattttataatc

SEQ ID NO: 6757931 - DNA, 55 bp, Homo sapiens
gactgagaattggctttttcctttcaaagaggatggaagtcactgttttcttgtc

SEQ ID NO: 6757932 - DNA, 121 bp, Homo sapiens
ttttattcattttatttttgcaatctagaagtggtaccagagagaacaacaaatctgcaactgtactcttgcagaaaacagttttcttgtgccttagtgtgctaaaatgaaaagtgtaaaa

SEQ ID NO: 6757933 - DNA, 74 bp, Homo sapiens
aagaatgtaagagtactttagtaggcaaattaaaaatgtttaatttctagggactaaggtgctataactttctt

SEQ ID NO: 6757934 - DNA, 65 bp, Homo sapiens
ctggttcactaaggggtcagctcaggcctaggcagctacttccctggctcaccccttatgtccag

SEQ ID NO: 6757935 - DNA, 114 bp, Homo sapiens
gaagatctaccctttgatctggagctttatttgtaataatagttggcgcagaaggaatcatttgcacatttaatcctttataagtagctttctttgatcattttgtagaatttc

SEQ ID NO: 6757936 - DNA, 63 bp, Homo sapiens
gatgatgtttacacatagcaggtgctcaataaatatatgtgactgattgtgaaagtcatcatt

SEQ ID NO: 6757937 - DNA, 77 bp, Homo sapiens
ggtattaccaagatctagttttctaggttttcttgagaaattagaaaatctggcaacactaagtttgtaataatacc

SEQ ID NO: 6757938 - DNA, 68 bp, Homo sapiens
tcttcgggagaatggatgagtgtttggggtgtttcatctgctccaacaatttcccagtttcccatgga

SEQ ID NO: 6757939 - DNA, 58 bp, Homo sapiens
ctggctgagttactccactgagaaggatttctgcagctctagtggcttgcttagctag

SEQ ID NO: 6757940 - DNA, 57 bp, Homo sapiens
cctcttgattggttggaagcggcacttactacgtggcggattctgactgtgaagagg

SEQ ID NO: 6757941 - DNA, 106 bp, Homo sapiens
gcatgttaatgagtccctcaggcagataggaaataattctgcaggagttggagttgatattcaggctccgtctttattttctctgactgatggggctcattgctgc

SEQ ID NO: 6757942 - DNA, 59 bp, Homo sapiens
agggagctttcaggtagcttaaggtcattttccactgatgaagaagcagaaagtttcct

SEQ ID NO: 6757943 - DNA, 81 bp, Homo sapiens
tctgtttgcaaagcatatatttttggttatttctgttaaggttattacttagcagcaatttcagaagtttgttttaataga

SEQ ID NO: 6757944 - DNA, 83 bp, Homo sapiens
gtgtggtctgtgtgcatgaatgtgtacctgtgtgtgtgtattgtgtgtgcatagtatgtgtgtttatgtacatagagccacac

SEQ ID NO: 6757945 - DNA, 70 bp, Homo sapiens
tcctgccttcagcttcctctgaggcttctgagtcagcacctggctgtcagcagagagcatgaaggaaggg

SEQ ID NO: 6757946 - DNA, 55 bp, Homo sapiens
ggtggggccgtgggtccattctgtgtggacaggggcaagggctcacggcccagcc

SEQ ID NO: 6757947 - DNA, 85 bp, Homo sapiens
actctaagtctgtgtgagtttaggttcatgaacgagtttccccagaacttaatcaactgtgcactaaataacatagacttttagt

SEQ ID NO: 6757948 - DNA, 75 bp, Homo sapiens
gacagctgagttattgaagcaagcttttctgagttctgccctacacctgaatttagtggtttaagtagcgctgtc

SEQ ID NO: 6757949 - DNA, 92 bp, Homo sapiens
tttttttaacatgaggaagagttgggtaaggaagagctgtgttttaattgcattacggctcaactgctaactgttttgatatgttgaacaaa

SEQ ID NO: 6757950 - DNA, 60 bp, Homo sapiens
cttgcagtagaaggtgctttctggatttcccagagtatccaatggctcacttttctcaag

SEQ ID NO: 6757951 - DNA, 91 bp, Homo sapiens
tatcatgggctccactttatacatcactctgagttcaccctgggtaagtaagcatggtgtctacagttctgtgtatgagatggtccagata

SEQ ID NO: 6757952 - DNA, 64 bp, Homo sapiens
tttttttctctctgttctacacaactctactttccgtgattttcagtggacagggtggagaaaa

SEQ ID NO: 6757953 - DNA, 80 bp, Homo sapiens
acagaagctggaaatgtgaattaaggttagcttttgaagtatcttcaataccatgataattaattcatgcccttttctgt

SEQ ID NO: 6757954 - DNA, 66 bp, Homo sapiens
gtttccatctccaggacataatcttgcaggatcacctctcacccttatctcttggtgactgggtac

SEQ ID NO: 6757955 - DNA, 72 bp, Homo sapiens
catgaattggcattgagacatttcaatgtcataatgtactacattatgacattatgtattacatgttttatg

SEQ ID NO: 6757956 - DNA, 81 bp, Homo sapiens
cacagagagaagctaatgtcttggagtgtcaagactgtcaaacatcagttgaaatacattgaaagcatattatctcctgtg

SEQ ID NO: 6757957 - DNA, 66 bp, Homo sapiens
aggcgggtggatcacctgaggccagaagttggagaccagcctggccaacgtggtgaaaccccgtct

SEQ ID NO: 6757958 - DNA, 58 bp, Homo sapiens
attttttcatttgacagccacagaagctgactttggctgaattaagcaatgaagaaat

SEQ ID NO: 6757959 - DNA, 75 bp, Homo sapiens
cctgactggcctttttgtgcatggcccagtggtaagagacagcccttgccctggaaccatctacagtccagcagg

SEQ ID NO: 6757960 - DNA, 101 bp, Homo sapiens
cagttctgtcttgctggggtaagtctgtgctagcacgcagcaagggcagcaaagaaggaaccccaagctgacgagctcagctacatagccccaagaagctg

SEQ ID NO: 6757961 - DNA, 60 bp, Homo sapiens
cccagaaggctaagcgtggatttctggttatcagcttccgtgtgtcagctttcggctggg

SEQ ID NO: 6757962 - DNA, 75 bp, Homo sapiens
gatgtgtttatttgcacacagtctcctgtggtccagaacacttctgccccccataggtgtgtgcaaatgctactc

SEQ ID NO: 6757963 - DNA, 72 bp, Homo sapiens
tgttttctaaaccaagtgtccatattagtactttacagtagtgagtgagaaaagctgggtgcctagaaaaca

SEQ ID NO: 6757964 - DNA, 63 bp, Homo sapiens
acaaagtacaatgcacctattttaaaacttggagccaggtttcaaaggtgttttgtgtattgt

SEQ ID NO: 6757965 - DNA, 57 bp, Homo sapiens
gcagtcagacaggaggagctccctcttacctgtgggaaggtcagcctgttttactgt

SEQ ID NO: 6757966 - DNA, 59 bp, Homo sapiens
tgggtcagatctggccaatggttcaccagttagtggcctaaaggctaggtctgaactca

SEQ ID NO: 6757967 - DNA, 57 bp, Homo sapiens
gaaagagaggggctgagatgcagaccagtctgttctctcagtggcttcctcactttt

SEQ ID NO: 6757968 - DNA, 59 bp, Homo sapiens
tgtggcagagtaaggacccagtgggaacacagatctacctgaagccaaagtctgctata

SEQ ID NO: 6757969 - DNA, 56 bp, Homo sapiens
aggaccattatgcttgctgaaacatggatctcccaagttttcacatactggatcct

SEQ ID NO: 6757970 - DNA, 93 bp, Homo sapiens
gctcctcattccaagcgtagatttgggccaaggctgaatgcttaagctgtttaaaaagaatttccttcccagatttggttctctaaaagtagc

SEQ ID NO: 6757971 - DNA, 60 bp, Homo sapiens
tgacatcttatacaagggaatatgtgcacatatgcatttcttcaaagtgtatgatatgca

SEQ ID NO: 6757972 - DNA, 56 bp, Homo sapiens
ggagctctcctgatgtgaagattggaccaaacagcttctctagcctcagcagctcc

SEQ ID NO: 6757973 - DNA, 92 bp, Homo sapiens
ttttgtactagccactgtatgatgtgtctgggatataggttagaaaaataaacatgactcttcctctcatgcggtcatacactagtggagaa

SEQ ID NO: 6757974 - DNA, 84 bp, Homo sapiens
tcacgtcatcttctagcactgtgattatgctcatcatagcatgtgattatgcacccttatgaatatgatctcatggaaatgtga

SEQ ID NO: 6757975 - DNA, 57 bp, Homo sapiens
cctgataaaccctggaatttgtggccataatctaacccagagtttaggtctatcagg

SEQ ID NO: 6757976 - DNA, 55 bp, Homo sapiens
aatacagacatttaataaatgctgagcaaatgctcagagcatagagtcttgtgtt

SEQ ID NO: 6757977 - DNA, 65 bp, Homo sapiens
gtactaagtgtttctccagtgtctttcattgtaaaattagagaaagtgggataagcgctttgtac

SEQ ID NO: 6757978 - DNA, 66 bp, Homo sapiens
cagtgctgtagacaaacggtttgtttgaaaacattttgtgaaagcctgctttgttccacagcattg

SEQ ID NO: 6757979 - DNA, 121 bp, Homo sapiens
aagattttatacttctattaatatggcccgaccttgcattggctttcttggcagctgcgttacactcctaggttctgttaagcttgtaatcggcccagccttctgagatccatgacttctt

SEQ ID NO: 6757980 - DNA, 97 bp, Homo sapiens
gggaccccagaataacatggggggatcgggctcctaatgcaattgcaggagcaggctctgcaccgctgggaggatctctccctgtcctctgcttccc

SEQ ID NO: 6757981 - DNA, 89 bp, Homo sapiens
gggtttaatttgcatttcccattgagtaatgatattgagcatttttctcatgtttattggccagttggatttgtattttggttaagcct

SEQ ID NO: 6757982 - DNA, 58 bp, Homo sapiens
gcccaggctagagtgcagtggcatgatctcagctcactgcaacctctgcctcccaggc

SEQ ID NO: 6757983 - DNA, 60 bp, Homo sapiens
gcaggagttaggcgtcgtggatgtcagatttgtattccaaagcagtggctaactcactgt

SEQ ID NO: 6757984 - DNA, 59 bp, Homo sapiens
tggttttgctaaaatagaaagattagtttgaagttcatcctgctgttttggtaaaatca

SEQ ID NO: 6757985 - DNA, 84 bp, Homo sapiens
ctttttataggtctcagatatggtttttcaagtattcagaatgttttctggcttttcttgggacttatgggagaggatgaaaag

SEQ ID NO: 6757986 - DNA, 100 bp, Homo sapiens
gcagtggcagtcgaacaatggctgggctggagtcttctgaaagccaaactcatctgatggcccagatggctcctcccatcacagatttgacagttgatgc

SEQ ID NO: 6757987 - DNA, 63 bp, Homo sapiens
ctctacagctgctgcccctggtgctcccaggaagagtctcgggtacaggcagaggttggaggg

SEQ ID NO: 6757988 - DNA, 96 bp, Homo sapiens
tctttacttagagaacataatgaatggcattgtcagcctttatgctgtgtaaagtgatgaaggtttggccaatgttacataaacattaagtgaaga

SEQ ID NO: 6757989 - DNA, 82 bp, Homo sapiens
caagtactctacagattcattgctacggtggtctccatttacagaggtggcagctgtaagatgagtgaatgtaaggagcttg

SEQ ID NO: 6757990 - DNA, 129 bp, Homo sapiens
tatctagagagtcacaagatggaatggcttctagagcccttcccctctttattggacagatggagaaactgaggcccagagaggggaagggcttgcccaaggccatacagaaattttatggcagagatg

SEQ ID NO: 6757991 - DNA, 57 bp, Homo sapiens
agcaccaatctggacccctgcccaggggtctccaggggcctaggggcagatggtgct

SEQ ID NO: 6757992 - DNA, 112 bp, Homo sapiens
gtcaagttattcttacgtctagaaataataagcttttgattcacttcagaatattttgagctgacgtcaaggcttttaatacaattttgttgatgcgggagcataatatgac

SEQ ID NO: 6757993 - DNA, 64 bp, Homo sapiens
gttctcagcagctgggaggcccagccagagctggtagggcagccacccaggctgcttggagaat

SEQ ID NO: 6757994 - DNA, 60 bp, Homo sapiens
ctttgctactgtgaatagtgccacaataaacatacgtgtgcatgatttatagtagcatgg

SEQ ID NO: 6757995 - DNA, 72 bp, Homo sapiens
acatttacagtgctagacaatcaccaatagaaaataaattgaggattccaactgtgtttagattgtgattgt

SEQ ID NO: 6757996 - DNA, 60 bp, Homo sapiens
catggtgtgctgaatatgaagtttaacctttaaagaatttctagtaggcattacactatg

SEQ ID NO: 6757997 - DNA, 55 bp, Homo sapiens
tgggttataatttgttatgaatgaagatttgttttctcataaaaatggtaaccca

SEQ ID NO: 6757998 - DNA, 69 bp, Homo sapiens
acctgctgctttgacagtgggaacagtggaaacatcctttgctccaggctatcagaaagggcatcaggt

SEQ ID NO: 6757999 - DNA, 61 bp, Homo sapiens
gtcacactcaaaagctaggatgggcccaactgagaggctgccctagttttctgagcgtgac

SEQ ID NO: 6758000 - DNA, 58 bp, Homo sapiens
tagatttcctcttcctcattcctatagacaacatatgtgaagaggaaatgggaattta

SEQ ID NO: 6758001 - DNA, 71 bp, Homo sapiens
tattgacacgtgtctatcaggaggtgtggtcagggttccttccccttttctctgggtgggctgtgtctata

SEQ ID NO: 6758002 - DNA, 56 bp, Homo sapiens
gcctcctgttatgccatgtgccgcctctgaaggccaacggggcagaccagagaggc

SEQ ID NO: 6758003 - DNA, 57 bp, Homo sapiens
tcttctttttgtcccacagaatggctgctataccattaggaaggggagggaagagga

SEQ ID NO: 6758004 - DNA, 76 bp, Homo sapiens
ctgagagagtggtgatcagtaagatggattccttatgtcacctgttgtagggaacccaactgactgacagcttcag

SEQ ID NO: 6758005 - DNA, 74 bp, Homo sapiens
cagagactacgtctgtttttgaggctatcttctctctccttgggcaggaagaaagtagaaaaccgtggtttctg

SEQ ID NO: 6758006 - DNA, 85 bp, Homo sapiens
attccatttgagcttaagtatctgcatttgaacttcaactacagcctcaatatagcagtgtacttgagaaccgccaatgtggaat

SEQ ID NO: 6758007 - DNA, 70 bp, Homo sapiens
actgaaaaatgggagtgtgcatttgtctttagagacattctctgaagattaaatggctcccatatttagt

SEQ ID NO: 6758008 - DNA, 68 bp, Homo sapiens
atagctaaaaaggaagtaaagtcctgttgagaaaggaggaacactttaacattccttttcattgctat

SEQ ID NO: 6758009 - DNA, 55 bp, Homo sapiens
ggagaagaggggtgtccctgtggcccagcacactggagccaccctcctcgtctcc

SEQ ID NO: 6758010 - DNA, 61 bp, Homo sapiens
gtgagcacagttgcattgcaagtgagtgattctttcattttgttaatgtcaccgtgcttgc

SEQ ID NO: 6758011 - DNA, 94 bp, Homo sapiens
ttgatagacaggtgagtgttcagccactacccaccttaacaggatcttcagggaaattgttaggaggctagttgagcaccaggctgtccattgg

SEQ ID NO: 6758012 - DNA, 81 bp, Homo sapiens
atattctgggtatttacaagattaattattggagtgtttatcaacactctactaaggtgtcttttaagtttacctaaatgt

SEQ ID NO: 6758013 - DNA, 73 bp, Homo sapiens
tgcatgaatgcaatttactgtacataaattatatacctcaataaagttgatgaaaatgaattgcatgcatgca

SEQ ID NO: 6758014 - DNA, 59 bp, Homo sapiens
gccccttccatcatgtgaggacacagagagaaggtgccgtctataaatcaggaaggggc

SEQ ID NO: 6758015 - DNA, 75 bp, Homo sapiens
ggctcagtgcagcctttctgtatctcactgtattctgcaagatgctcctgtgaagaaagttgtgctgcatcagcc

SEQ ID NO: 6758016 - DNA, 59 bp, Homo sapiens
tggggaagaaggcagctgcttgacacccacaggtctgttcaaggagtttctcttttcca

SEQ ID NO: 6758017 - DNA, 62 bp, Homo sapiens
gtttttctgtcattttagaaattttccttttcagtggccttattctaatttgatggagtagc

SEQ ID NO: 6758018 - DNA, 57 bp, Homo sapiens
ctggcaggatctaaccagggaaggggagctacctagggcaaggagtcctgcattcag

SEQ ID NO: 6758019 - DNA, 84 bp, Homo sapiens
ctattaggctggtgcaaaagtaattgtggttcttgccattgaaagtgatggcaagaactgcaattgcttttcacaacctaatag

SEQ ID NO: 6758020 - DNA, 67 bp, Homo sapiens
ctggtgttgatgttgcaccatagttttataggtttcactatgaagcacaggcatacacaacctacag

SEQ ID NO: 6758021 - DNA, 56 bp, Homo sapiens
ggttcctggcagatgtagggctgatgttcctgcttccttactgtcagccaggaatc

SEQ ID NO: 6758022 - DNA, 81 bp, Homo sapiens
gatatctcagatatgcacagttacaagaatatcaggtggtagctgcacttgctgtgaaataatattgtgcaattttatatc

SEQ ID NO: 6758023 - DNA, 61 bp, Homo sapiens
gaagttacacatgaaggtccaatgttacttcaagcatctatcttcaatgtgtgtttatttt

SEQ ID NO: 6758024 - DNA, 80 bp, Homo sapiens
ctgtccagatgcctgtggggcactacagagttttgaggaaatagagtctcagactggagccccaaggaccttgaggacag

SEQ ID NO: 6758025 - DNA, 88 bp, Homo sapiens
ctcagccccagcccagtgcctctgaccggagaccagggccgcgaagcagcttgtctcccgctagagggcgctgggctccttggttcag

SEQ ID NO: 6758026 - DNA, 67 bp, Homo sapiens
tgcatgaggctttcttcagctcaggagttaacagatttgcctgggcaacatagaactcgtctctgca

SEQ ID NO: 6758027 - DNA, 55 bp, Homo sapiens
gctcaaggacactccctgctgggcataggatgtgcctgcaaaaagttccctgagc

SEQ ID NO: 6758028 - DNA, 55 bp, Homo sapiens
ggctagctcctccgcgcatccacgttcaaccgaggctggtgatgttggagcggcc

SEQ ID NO: 6758029 - DNA, 58 bp, Homo sapiens
aaggatctgacagactatagaagaatgggcattactgctgaatctggttcagatcttt

SEQ ID NO: 6758030 - DNA, 58 bp, Homo sapiens
cccaaatgctttgttacagctggatgcttagaggtccctgctgtgggaagagtttggg

SEQ ID NO: 6758031 - DNA, 58 bp, Homo sapiens
ggtggtggtccagggcagggctgaaccacgagggaaggcagtgttccagaccttcacc

SEQ ID NO: 6758032 - DNA, 76 bp, Homo sapiens
atcttggaatccttctcttctcttatgtattctgaccttgaagggtcactgtatttggaagggatgggaccatgat

SEQ ID NO: 6758033 - DNA, 68 bp, Homo sapiens
tccaaactagtatcttccgtgccatgcaataagggctacattgcaaggctgcagagggtgctactgga

SEQ ID NO: 6758034 - DNA, 57 bp, Homo sapiens
gcagggaagtttgatctttttcggattttgcggttatattagatgagatgtccctgt

SEQ ID NO: 6758035 - DNA, 56 bp, Homo sapiens
gaccaggctctgctgctttctaatcttatgagcttgggaaagtcatagagcttgtc

SEQ ID NO: 6758036 - DNA, 84 bp, Homo sapiens
gtgtctggagacatttttggctgttatagctaaggagatgctaatgtctcctggtggatagaagccaaggttgccactaaacat

SEQ ID NO: 6758037 - DNA, 70 bp, Homo sapiens
tttccttcatcatctgagagctggagaacaagcatgtgtgtgccggccatgagatgactgtacaggggaa

SEQ ID NO: 6758038 - DNA, 72 bp, Homo sapiens
gtgctgcagggcctcctgcacctggagcccaccctccgctccagccagctgctctgggaggccctggagagc

SEQ ID NO: 6758039 - DNA, 79 bp, Homo sapiens
aatttataagcttgttttacagtagtctggaagaggctttgaggccaattttgtagaactgtagaacaatgcatgagtt

SEQ ID NO: 6758040 - DNA, 55 bp, Homo sapiens
agctgcccaggttcattgggccatatcactttggccatgagtgactgaggcagct

SEQ ID NO: 6758041 - DNA, 69 bp, Homo sapiens
tggaactttaatcccttgggcttagatatcaagtttaggacaggctaaaagggataattagggcttcca

SEQ ID NO: 6758042 - DNA, 86 bp, Homo sapiens
cagttggggacacattcacaaatgctgccccattccatggaaggatagatttggaccagagagggcagtaccgtgaatgccaactg

SEQ ID NO: 6758043 - DNA, 77 bp, Homo sapiens
tgcttgcacaggctttatggagtgacacaatgggaaagtcccctttcagtcatttacatgaagttgattccacagca

SEQ ID NO: 6758044 - DNA, 72 bp, Homo sapiens
gagcagatcacagagcctccaggagtgctggctcctccctggcatcccagcctccctgaggctcataggctc

SEQ ID NO: 6758045 - DNA, 129 bp, Homo sapiens
atagggcctggtacttagcaggtgctcattaaatgtatgttgaacaaatgaatgaatatctacctaacagtgtttattattgcaagtatataaagtaatgatgttgcttgtcatatggtaattccctgt

SEQ ID NO: 6758046 - DNA, 69 bp, Homo sapiens
ttgcttaattgctaaagattatgttttcaacagtttttgaaaatgatgatttggggcaaatatgtgcaa

SEQ ID NO: 6758047 - DNA, 61 bp, Homo sapiens
ccagtgatgataggaagaccctttcccccacctctgcctgaacaggtcccttcattcctgg

SEQ ID NO: 6758048 - DNA, 66 bp, Homo sapiens
gtgtatgtgtttatagggaggtggaaagttttcctttgtaaaatctccttgtaaaatatagaacat

SEQ ID NO: 6758049 - DNA, 82 bp, Homo sapiens
gttcagttgttgataatgagtgttctttgagctggcaagaacgcagctagtaataaaggctaccatttattataaatgtaac

SEQ ID NO: 6758050 - DNA, 69 bp, Homo sapiens
ctctaatgtctagtccaagaattcaattctagatcccagaattgatactctgtaggctggtggttggag

SEQ ID NO: 6758051 - DNA, 63 bp, Homo sapiens
ggctactgctgtcccagagcatgtcagatctcctagctgttcagctgtgagcagccagttgcc

SEQ ID NO: 6758052 - DNA, 66 bp, Homo sapiens
agttcaacaaggggtctgcttcatagacattttctgtggttttgaggcaatattccatgtggaact

SEQ ID NO: 6758053 - DNA, 103 bp, Homo sapiens
ttgagacggtgccttgctctgtttcccaggctggaatgcagtggtgtgatcttggctcactgcagcctccatctctggggttcaagcgattcttccgcctcag

SEQ ID NO: 6758054 - DNA, 63 bp, Homo sapiens
gggcgaactctgagcctgaggcagggtatgcgtgctcaatcctagaggctcagggcttctctc

SEQ ID NO: 6758055 - DNA, 55 bp, Homo sapiens
gtgtttgctgttcaggttgcatgaagggcaatctttagcaacctgtcagagatgc

SEQ ID NO: 6758056 - DNA, 76 bp, Homo sapiens
tctgtagaacagttaatagatttgattttaaaggcattgttacagccttttataaagttgtattgaaacctgcaga

SEQ ID NO: 6758057 - DNA, 59 bp, Homo sapiens
gggctatggcctgactgtgctgccaaacagattgcctgggagctgtggggcctagcacc

SEQ ID NO: 6758058 - DNA, 102 bp, Homo sapiens
gagtcaagtcttttcatgaataatgcttttacgacatgtaccttggattctaacgatatgcattttgtgaaaacgtcttcagatttcagagaattaaaattc

SEQ ID NO: 6758059 - DNA, 58 bp, Homo sapiens
gggacacagagcaaatcatgacagatgtgggcccatctggccatttgatcgtagtccc

SEQ ID NO: 6758060 - DNA, 73 bp, Homo sapiens
tgatacttggatgttggcagaattagaagtatggccagtgtaacaggacaggatctgccaatattcaacctca

SEQ ID NO: 6758061 - DNA, 73 bp, Homo sapiens
cttcgagctccctcgccagaagttgttaggagagaaggctgccaacaacctgatcccgaggctgagctgggag

SEQ ID NO: 6758062 - DNA, 129 bp, Homo sapiens
ctgttttgtggctgctgattaaatctccaggtctcacacagagtagattttgtagcttttctataaaaattagactactagtagtgaaaacctgttctgtttaatatagcaataaatgtttttcaatgg

SEQ ID NO: 6758063 - DNA, 71 bp, Homo sapiens
ttagtgggatattggctattcattcatttatatgtggactattttttgaaagcctctgtgtcaggcactga

SEQ ID NO: 6758064 - DNA, 74 bp, Homo sapiens
ttggctcaggctttcattgtaaatgatggtgtaaatatccaccaacagttcaggaataatgaaggtggagccag

SEQ ID NO: 6758065 - DNA, 101 bp, Homo sapiens
ccggcgtccctagagaagaagcacccagagggcctttggagttatccatcgacctggatctctccttggctttgttggatctctcattcctggacctccgg

SEQ ID NO: 6758066 - DNA, 61 bp, Homo sapiens
cctccaggcatcgctgactttgcattgtgtaattcactgcagctcattggtgtcctggtgg

SEQ ID NO: 6758067 - DNA, 62 bp, Homo sapiens
agcttcttcttggtctttcccacctttaactgttggacttcttcaggactaggtcttgagct

SEQ ID NO: 6758068 - DNA, 67 bp, Homo sapiens
agggtacagggcctgctctccccagcttctcccctacaggcccaggacacaggccttgtctgcgcct

SEQ ID NO: 6758069 - DNA, 80 bp, Homo sapiens
ttgagctatctcaggcactcacatttggagtttcagctttgtcatctccaaaatgaaggtgctggactggggttcttcaa

SEQ ID NO: 6758070 - DNA, 81 bp, Homo sapiens
gacagtaaaatatagcaatttgcccaattacctgcttggtagtctgagtactgattttggggtagatacctctttattgtc

SEQ ID NO: 6758071 - DNA, 60 bp, Homo sapiens
tggtgatttatgccaaacacctgatttccttctggggatctggaattttggtatgtgcca

SEQ ID NO: 6758072 - DNA, 81 bp, Homo sapiens
tctcttcccactgcaggaagattgcagaaggctgtggattaattgtagcatttcactgatcttcactccagtcactaggga

SEQ ID NO: 6758073 - DNA, 91 bp, Homo sapiens
tgaagagcatgcactcaggggttaggtagacttttaggagttttatagccttgtcaagtcactttaacctctttgaacttctggtttctca

SEQ ID NO: 6758074 - DNA, 56 bp, Homo sapiens
cattgtgggcctgtcgtgggtggggccagcagcacatgcatgccgggctgacagag

SEQ ID NO: 6758075 - DNA, 76 bp, Homo sapiens
ctgagggatgggataatgttattttcttgtcagtggtcacaagctatatggcattacattgttaaatctcccccag

SEQ ID NO: 6758076 - DNA, 129 bp, Homo sapiens
ctaagtaattttgtggcttcatcaacagaatagaatagtggcttggagtgtgaactctggagtcagacaacctggattcaaatttcagctctgtcacttgctagctgtatgtccttaggccagacttag

SEQ ID NO: 6758077 - DNA, 69 bp, Homo sapiens
tggctggtgagttcagagaacccaaagtgggacagatgggccatgctggggttcttggacttaccacca

SEQ ID NO: 6758078 - DNA, 72 bp, Homo sapiens
aggcattctcttacaggagtatcccaaggccagggattttcccacatgtttttgggcctgtggcagaagtct

SEQ ID NO: 6758079 - DNA, 125 bp, Homo sapiens
tgaatgtttcttagtataaaactccattttctcactaaataccggattaatgctgtttaaattgcattgctggaatgagtcggggaggggagaattaatgaacttctactaagcaaaaatgttca

SEQ ID NO: 6758080 - DNA, 72 bp, Homo sapiens
ggatctttgctctttctgtccgcagggcctgggatctcagccccaccccaagacagtagaagagaagggacc

SEQ ID NO: 6758081 - DNA, 58 bp, Homo sapiens
gggttcctggctcctgtgtggtgacaaccccttccatcccatgcctcccggtgaatcc

SEQ ID NO: 6758082 - DNA, 62 bp, Homo sapiens
tgggcactatggctctgtgcacacaggtgttgcagtatggagcagggcctcccgagtgccca

SEQ ID NO: 6758083 - DNA, 92 bp, Homo sapiens
tctaaattactgggcttgcatatcacaaacaagtctgtacttgtcctcctactctacaaatataaatatagtatgtgatgtaggcctttgga

SEQ ID NO: 6758084 - DNA, 58 bp, Homo sapiens
ccatggtaaattcttaattggttttgttaaaactaccagtgaagagtgaaacacatgg

SEQ ID NO: 6758085 - DNA, 65 bp, Homo sapiens
acagctcttaggcagaaccaaccctgctgaaaggttgattttgggtttctagcctccagagctgt

SEQ ID NO: 6758086 - DNA, 72 bp, Homo sapiens
gcagcaacagcagctgaggagctgggctctggccctccaccccggtgcccacctctgcactgttgatgccgc

SEQ ID NO: 6758087 - DNA, 62 bp, Homo sapiens
tgagcttcagctgccatgactgtcacacgcaggaagccgatcagtcttggtagctgtgccca

SEQ ID NO: 6758088 - DNA, 89 bp, Homo sapiens
gttgtcaactgtaaagtcctacatatgtcaggtgttattatcacacatagtgctttacatgtaatgggtactttcaatgttttgccaac

SEQ ID NO: 6758089 - DNA, 58 bp, Homo sapiens
atgtgtgtgtgtgtgcatgtgtgtgtgtgtacacacatatatgtgcgtgtatatgtat

SEQ ID NO: 6758090 - DNA, 79 bp, Homo sapiens
ctcgcagtctttatctcgctcctggattggcagggagctgaaagatcagaagcaggaggaatgaagtcaacacagtgag

SEQ ID NO: 6758091 - DNA, 88 bp, Homo sapiens
ttatgtgaataacatttcttatcaataatgactgttgagaatttaaaggtattatcatttagaagtcttgataaggaattgcatatgg

SEQ ID NO: 6758092 - DNA, 69 bp, Homo sapiens
tgggcctggggtgacgtacccctgcgggggaagggaggctgctgcagggggctgggtgctgaaggccca

SEQ ID NO: 6758093 - DNA, 59 bp, Homo sapiens
tccctcaggtggttcttgtttcaattaaagtccttttgggaaacaatctatccggggga

SEQ ID NO: 6758094 - DNA, 64 bp, Homo sapiens
ctctgtccttggctatccagggcttatgcaatggctcatgaatggagcagccatgatgacagag

SEQ ID NO: 6758095 - DNA, 80 bp, Homo sapiens
gatagtttggcaatttgtagagtaaattagatttaatttggcctgaatgccactgatttctcatattgttcaaaacaatc

SEQ ID NO: 6758096 - DNA, 67 bp, Homo sapiens
ttatgttacaaagtttttctaaaatgggttcaatattgataatattttgagagaagctatgacataa

SEQ ID NO: 6758097 - DNA, 66 bp, Homo sapiens
ggctgggctctgcctgtctgggatgatgccattcctcccttgccctcggcaggtagagggccagtc

SEQ ID NO: 6758098 - DNA, 62 bp, Homo sapiens
gggctctcaaggcagggccccatgttcgctcctggcaccagcccttactagctttgagcccc

SEQ ID NO: 6758099 - DNA, 82 bp, Homo sapiens
acttccttttcaaccatacagccaccgctggggccaaccactccctacgtttgtataatgctgtatggttttcaaagcaagt

SEQ ID NO: 6758100 - DNA, 60 bp, Homo sapiens
ttccatggcccagcacctggctttttgtaaaaaagcatgccagccttctgtggcctgcaa

SEQ ID NO: 6758101 - DNA, 74 bp, Homo sapiens
tgccctcggcagcgcccgctccgatgtctctgggggttcggttgctacctagcagagcgggtgcgaggcgggca

SEQ ID NO: 6758102 - DNA, 56 bp, Homo sapiens
ctatcatcatagtgattgggagggtggatttttccccagagtatttgtgatgttag

SEQ ID NO: 6758103 - DNA, 77 bp, Homo sapiens
ttggagagctttccatgtgtactggccagaagcagaagggagctgctttaggttttttcacgtggctaagcttacaa

SEQ ID NO: 6758104 - DNA, 86 bp, Homo sapiens
tatttgctagagtttagagcagcaaagggagggtaaatcaaagaccactgatttggactcagccttcttgctctgctctgcatttg

SEQ ID NO: 6758105 - DNA, 64 bp, Homo sapiens
aggtctcctggaggcaaatgagcacatttgttaaaatggagtattacgtttgtaccagaaacct

SEQ ID NO: 6758106 - DNA, 76 bp, Homo sapiens
cgttttcaagtagtcacacatgatatccagagatttagattctgcctttggcatatgcagtagacatttgaaaagg

SEQ ID NO: 6758107 - DNA, 70 bp, Homo sapiens
tgaagcacttactaagtgtaaggcagtgtggttgagcccactgttcatattcttagaaattgtaaattca

SEQ ID NO: 6758108 - DNA, 96 bp, Homo sapiens
gacatgaacttccagtataatgtttaatgttagtggtaatgaaaagcatccttgtattgcttctgattttaaatgagtgctttaagattttatgtt

SEQ ID NO: 6758109 - DNA, 93 bp, Homo sapiens
gacagggttgccttgacttcccttctagctcccagacgatgagcacgacctctcagacagggagctggagctggaagactctgcagctctgtc

SEQ ID NO: 6758110 - DNA, 73 bp, Homo sapiens
tcctggttatactgtagtttctgcagctgtggagccaagtccactttctgagggaacagcagccaactgagga

SEQ ID NO: 6758111 - DNA, 60 bp, Homo sapiens
ttttgtttgcttcagtgcattgcagagcacacccatgcagtgtgtttggagcgagggagg

SEQ ID NO: 6758112 - DNA, 65 bp, Homo sapiens
ctagtttcctaaaactactctactgcttactcggtagctgagggaccatgtttcaggagagctag

SEQ ID NO: 6758113 - DNA, 59 bp, Homo sapiens
tctgtgggcctgaggcatcagaagcacttatgtaaaaattactgggtctgggtcctgga

SEQ ID NO: 6758114 - DNA, 67 bp, Homo sapiens
gagtgagtagctacagtttttaacatgtttaacttacggccttcaaaaattgttagcggactttctc

SEQ ID NO: 6758115 - DNA, 84 bp, Homo sapiens
catggaaaagtgccacgacactcattgggaaagtgctctctggggtgcctgagaaagctccccatgagatgatgccactccatg

SEQ ID NO: 6758116 - DNA, 77 bp, Homo sapiens
tgtctccctcagcctggctgggaagagcctctcaggggaggtgttgaccaagctggtctagaagtgtgtgggaggca

SEQ ID NO: 6758117 - DNA, 55 bp, Homo sapiens
aggggaaagaccacttgaggaggatgagtttttctctgtcttgtgggcttcccct

SEQ ID NO: 6758118 - DNA, 57 bp, Homo sapiens
gagctgctggcctcctgcgggaagaagttctgcagccgagggagccggtgcgtgctc

SEQ ID NO: 6758119 - DNA, 92 bp, Homo sapiens
ctctgtgctggcgccaccgcactctgtagcctgtaagagagcagcaaagaggaatgtgttgctcaggtatagacgggggtgggtgcatagag

SEQ ID NO: 6758120 - DNA, 60 bp, Homo sapiens
ttcatgtctttgattctgataattggattttccccaatcatcagaatctctagatttgga

SEQ ID NO: 6758121 - DNA, 61 bp, Homo sapiens
ggatctggcctaggaatggttttccggatgcgaatctgtgagactttctttggcctcttct

SEQ ID NO: 6758122 - DNA, 76 bp, Homo sapiens
ggcggagggttgggggagtactggtggcctcggtgtcccctggaggcctggtgtgtctcccgcttcctctcacgcc

SEQ ID NO: 6758123 - DNA, 66 bp, Homo sapiens
tatctttaggtatgtcccttaatgtctgctttctcatcttagaaagaaggatgtgaaccagagata

SEQ ID NO: 6758124 - DNA, 78 bp, Homo sapiens
tcataaacaatccaggaacctgtttatccatctgatattccagcttggcaagtaaataagttcttcattgtttgtaga

SEQ ID NO: 6758125 - DNA, 56 bp, Homo sapiens
tggcatatgttccaaataatcctcatacagggaagatttggcaaaggcgatgcaca

SEQ ID NO: 6758126 - DNA, 67 bp, Homo sapiens
attgttctgttattctgctcagtatagcaattgcatcattgtttcacagaaaggataacattatgat

SEQ ID NO: 6758127 - DNA, 107 bp, Homo sapiens
gcagattcattcctttttgttctttgattgcaaattattttagtcccttcaggtattatatgacaagtggatgtaatagattgtagaataattctgagtgaaattgt

SEQ ID NO: 6758128 - DNA, 56 bp, Homo sapiens
gctcattccagattccaggtgtgatgtctgtggtgcctgctgtgatcttagtgagt

SEQ ID NO: 6758129 - DNA, 89 bp, Homo sapiens
gttctggggatataattcagaccttcgcttttaatttcctgaaaccaatttcagaatagcaaagcaagctagattattttctgccaaac

SEQ ID NO: 6758130 - DNA, 68 bp, Homo sapiens
ttctcatgtaaatgccatcatcctgatctttctttcaggatcactagtaatatggcatttatctggaa

SEQ ID NO: 6758131 - DNA, 98 bp, Homo sapiens
cagaagccagagcttctctctcactgatggtggaaagcctttctacaacccaagaggaggccattctctcagtagcagcagaggctcaggtgtttatg

SEQ ID NO: 6758132 - DNA, 57 bp, Homo sapiens
gggaacccatgattatggttaggtcctatggggatcgttgtgagaacttgggttttt

SEQ ID NO: 6758133 - DNA, 71 bp, Homo sapiens
gagtatagggataagaattaaattcttgttttcaaaggtgagaagcaagaaaatctctgtccaatgggctc

SEQ ID NO: 6758134 - DNA, 72 bp, Homo sapiens
acatcctccaggatacaagccctgatacatttggagcccctaaaaaatttggtcttgtatcctggaggatgt

SEQ ID NO: 6758135 - DNA, 74 bp, Homo sapiens
aatgagctctgaaggaaggatctggacatgtgccactatatctaccacattactctatccaactatcgctcatt

SEQ ID NO: 6758136 - DNA, 112 bp, Homo sapiens
ggtttctggcttgagcagttgtgtaggtggtagtaatttttcatggtgaagatgatgaaatactttttgtacctgtctcatgattgctttctgtacatcaaggtcagaggtc

SEQ ID NO: 6758137 - DNA, 67 bp, Homo sapiens
ccttccccccatgctccaaaaacaagagaattgctgattattcttatttttgtgtattgggggtagg

SEQ ID NO: 6758138 - DNA, 61 bp, Homo sapiens
tatgttaccatcttttatctacatctttaataaggtgggacacattaaagttggtgacata

SEQ ID NO: 6758139 - DNA, 67 bp, Homo sapiens
gactaagggagagctgtgcttgcaagtggaaaaagaagagaggcaggcagcagtgagcaccttggtc

SEQ ID NO: 6758140 - DNA, 61 bp, Homo sapiens
gtctgactctaaagcctgtcttctttctcctaaacattgtggacaggtgctaaagaggggc

SEQ ID NO: 6758141 - DNA, 55 bp, Homo sapiens
attctgatatcttattctagctctgtcacttatgagctgggaaagtttatagaat

SEQ ID NO: 6758142 - DNA, 84 bp, Homo sapiens
tttccatcccaaggagctcatattcttgttggaggcttcccatttaccacttcagggatgaaccaagagtccttgaaatggaaa

SEQ ID NO: 6758143 - DNA, 76 bp, Homo sapiens
atgactgttatgggactggaacagaaattcttatgctatcctgtgccttttcagttccttgtcctctaagcatcat

SEQ ID NO: 6758144 - DNA, 59 bp, Homo sapiens
gagtccagagctgagggtcagtagattctagtcactagaccaccaggtctgactggctc

SEQ ID NO: 6758145 - DNA, 69 bp, Homo sapiens
acctaaactagtaaaagtttagttgaaagttttataagtaattttcagccaacgttttgcactgtaggt

SEQ ID NO: 6758146 - DNA, 101 bp, Homo sapiens
ggtgctcaggaagatcaaatcaaactgatttgttatttttatagagtgctgtatgtatgtgtgtatgacagacagagaaagagagatcttccttgggcacc

SEQ ID NO: 6758147 - DNA, 65 bp, Homo sapiens
gaggatcaggcattgagaaggatggctaaagaacttgaaaactagtcaccattttcacctgcctc

SEQ ID NO: 6758148 - DNA, 96 bp, Homo sapiens
agggagctcagctgcttggtgaatttggagacggaactgagtgtgtccagctcaagctctttccctcttcagaactgcctgcttgccagtctccct

SEQ ID NO: 6758149 - DNA, 122 bp, Homo sapiens
tctgtcgtgacctctggagttatcctcattcagacagttttcagattcattcacgtagacatgatatgtgtatgtcttgaggataataatcaagagcttccccctttatcatgaattacaga

SEQ ID NO: 6758150 - DNA, 71 bp, Homo sapiens
tgaagttaatcacattacaaaggactccagtctacacaggctgttgagtccctgtgatttgtggggcttca

SEQ ID NO: 6758151 - DNA, 78 bp, Homo sapiens
tctgtgaactgctgccacctgttggtcatagattacaatacatcagatcatggctccagctggtagagatttttcaga

SEQ ID NO: 6758152 - DNA, 55 bp, Homo sapiens
cagatttcaaggaggcactccacaactttaagagtgagtgcccctttaaatcctg

SEQ ID NO: 6758153 - DNA, 64 bp, Homo sapiens
ttgtgtgcccgattgaggtttcaacttgcaggcaactgagaggccattcagctgggcagcacgg

SEQ ID NO: 6758154 - DNA, 73 bp, Homo sapiens
ttcacccctggggccctgggtctgccctccgcctggcagctggtggagaggagagccaggtcccagctgtgga

SEQ ID NO: 6758155 - DNA, 56 bp, Homo sapiens
ggcatttcagtcttgtggacttttgggaaaaaaatgttaaacataactgaagagcc

SEQ ID NO: 6758156 - DNA, 57 bp, Homo sapiens
tgctctattaattttaacgatgccataaagtgggtgatcagaaaatgtaatggagca

SEQ ID NO: 6758157 - DNA, 58 bp, Homo sapiens
gactcccgtggcagatgcgagcctcaacaaagctccagggctggcacttcaagggagc

SEQ ID NO: 6758158 - DNA, 55 bp, Homo sapiens
ctgaagaggatgctgccatcaggcccagagcattcctgaagcagcaaactctcag

SEQ ID NO: 6758159 - DNA, 78 bp, Homo sapiens
ctgttctgtcgtgtcgggggaggaagttgctgcccctcagtgtccctgagtctcggtttcccctccaacaatcagcag

SEQ ID NO: 6758160 - DNA, 61 bp, Homo sapiens
tcatggggaaagcccgccctcacacttgaccaatgagaaagggtctttgatttccctctga

SEQ ID NO: 6758161 - DNA, 63 bp, Homo sapiens
ggagtcagtcctgggccggcatcctcagcaggctgggttttgaaaggcaggactgactgtacc

SEQ ID NO: 6758162 - DNA, 92 bp, Homo sapiens
agcaccctcaggggccctttttcaccagcagtgtgcatctcacgagtctgctcttgaaaaagtatttcaggctcctgctgggaagatgtgct

SEQ ID NO: 6758163 - DNA, 64 bp, Homo sapiens
ctgggacctgtgtgcctgggccagtcccatgcctgccccaagccctgaggcccacaagtcccag

SEQ ID NO: 6758164 - DNA, 63 bp, Homo sapiens
ctgtaccgcagtgacattccttgatacttgtcatggtgatccagtgagtgcagctgttgtcag

SEQ ID NO: 6758165 - DNA, 61 bp, Homo sapiens
gtgaggcagcatgggcccagagtcccagcggcctgggttcgaagcccagtgctgcacccac

SEQ ID NO: 6758166 - DNA, 64 bp, Homo sapiens
ccttgtgtgaggtcggttacctgagacaagcaagtgtttctcataaggtcagatttcacaatgg

SEQ ID NO: 6758167 - DNA, 104 bp, Homo sapiens
gaggcgggtcccgggccctcgcgtgtcggccacgagggagccgcgcccataggtctttgagtgcagtgcgggccggcaggcaacgctgggcccggcctttcctc

SEQ ID NO: 6758168 - DNA, 128 bp, Homo sapiens
acagccctatcctcctcagctttaagaagttaccattaatctatgttctgtctgtacagatttgcctgttcaggacatttcgtatgaacggaatcatacaatagtgtggcattttgggactggtctgt

SEQ ID NO: 6758169 - DNA, 76 bp, Homo sapiens
gcttccctcccccaggtaccaaactctgctagcagacccactacagatttgactggtacctggcctcacagggagc

SEQ ID NO: 6758170 - DNA, 99 bp, Homo sapiens
cagcagcagactggcagggacatgtttgcctgcaggcttagtggtaaccctctggggctgccaggcaaccaagaaaccaaggctgtgggtctgcttctg

SEQ ID NO: 6758171 - DNA, 56 bp, Homo sapiens
ggtaaaatgacttcctccaacatccaaatactctggatgtctgtggtcattttacc

SEQ ID NO: 6758172 - DNA, 86 bp, Homo sapiens
aatccttacagaaccaaatgctgacagcatgacttgtcaaactacggacagaagtcatctcaggtagcatttactgtgaaaggatt

SEQ ID NO: 6758173 - DNA, 83 bp, Homo sapiens
tctgtcagggcagccttctgtggggagagtaagcccaattgccacataatcaggctctgccacctagattaatgccttacaga

SEQ ID NO: 6758174 - DNA, 78 bp, Homo sapiens
gagtagaacaggctgtcagagcgggaaagtggctttaataccctgaaaagcaaaggaatccgcctgtcagctttgctc

SEQ ID NO: 6758175 - DNA, 77 bp, Homo sapiens
gcctctcagtcccagcacctgcccaggctttggatgaccgaccactggctcaggagctgggagagctacttgagggc

SEQ ID NO: 6758176 - DNA, 86 bp, Homo sapiens
gtccatagttcaatcctagtgcttggtggagatggagaggcttgggttctcattttggctccagcacagccttgtcaactttggac

SEQ ID NO: 6758177 - DNA, 64 bp, Homo sapiens
tgtcatgctaaactatgatcattttctgagagagagactcagaaaattgtctctttagatggca

SEQ ID NO: 6758178 - DNA, 87 bp, Homo sapiens
ttcactgttgtatccccagcatctagtacaactactggtatataataagtacacagtaaatatgtattgaatgcatagactagtgaa

SEQ ID NO: 6758179 - DNA, 84 bp, Homo sapiens
ctcagagcacagaaagcacatttgaaatggtaatgagaagcgagccccgtgacaaagtgctagtcggtgaaatatttctctgag

SEQ ID NO: 6758180 - DNA, 63 bp, Homo sapiens
ggttctaggagtctggttcctgccttggtgcaggagtcttgggggagctggactcctagatcc

SEQ ID NO: 6758181 - DNA, 81 bp, Homo sapiens
cattagcccaggcccagttgcaaggcaggccctcgtctagcaaggcaggccctcctctagcaaggcaggccttcagtggtg

SEQ ID NO: 6758182 - DNA, 64 bp, Homo sapiens
gtggccctgccgtgggtgtcatggcccataggagatgctttgggcccagcacccacagcccctc

SEQ ID NO: 6758183 - DNA, 129 bp, Homo sapiens
agcacacagtaaagaccctaagcgtgaattggtttgcttggagtcagaaggcttgtcaatagcttctctatgattaagtttccagattgtaagtccactactctttcctctctctaccttatgctgcct

SEQ ID NO: 6758184 - DNA, 86 bp, Homo sapiens
tggtatctttcagagtacaaagtgattttggaattgaaagaatttctttgggttaaagtttgtcactgacttgtgttcctgaacca

SEQ ID NO: 6758185 - DNA, 66 bp, Homo sapiens
ccatgtgatgtctcgtcagtcctcccaccagcactgtgaagtggagtgatgcaggcatgccaatgg

SEQ ID NO: 6758186 - DNA, 91 bp, Homo sapiens
ttatgaggttggtgcaaaagtaattgcagtttttgccattactttcaatggtaaaaatcacaaatactttagcgccaacctaaaaacataa

SEQ ID NO: 6758187 - DNA, 100 bp, Homo sapiens
gtattggggtaggaggaatgattggcaaaggaaatgatttaagaaacacaatggcaatttcttagcaaattttctttgcctctgtctgttatataattac

SEQ ID NO: 6758188 - DNA, 82 bp, Homo sapiens
ccttgtatctttatccctcgttggagcctaacataaactgttgcatgtggtaagttttcactgagggtttattgattgaagg

SEQ ID NO: 6758189 - DNA, 88 bp, Homo sapiens
cttcaggaatcatttattcatagatttaggaagctttttggcagagatagctagttaaactatgaatacaccaggcccttctctgaag

SEQ ID NO: 6758190 - DNA, 67 bp, Homo sapiens
gctgtacagccatgggcttctctgtgtccttccctggactcatggtagcacaggctgtgtgagcagc

SEQ ID NO: 6758191 - DNA, 116 bp, Homo sapiens
ccgtgtggcgggcgagggggccctggaactggttctggaggctgcaggggcccccacatccactgcagctccggaagcgggtgaggatgagggtccccccagccctggcaagacgg

SEQ ID NO: 6758192 - DNA, 73 bp, Homo sapiens
ttaattcctacttcctgaaactgaagccgtttatgagaaacagtgtgtttcagagaggctgtaccagaattaa

SEQ ID NO: 6758193 - DNA, 56 bp, Homo sapiens
ccaatgggtagttttggaatatgaactcactttctattttaggcattgcctgttgg

SEQ ID NO: 6758194 - DNA, 67 bp, Homo sapiens
cacacttgttgctaacatatgcttctcccagtggtcattaagagaagctatttagctgcactttgtg

SEQ ID NO: 6758195 - DNA, 68 bp, Homo sapiens
tgacaagggatggtgccaggatctaatcccacggttggattagtagatcctgagccctatctacttca

SEQ ID NO: 6758196 - DNA, 66 bp, Homo sapiens
ggtaagtgcgcctcgggtgagcatgcacttaatgtgggtgtatgtcactcggctcggcccactacc

SEQ ID NO: 6758197 - DNA, 56 bp, Homo sapiens
gggagcaggaaggtgctggcatgtcatagtgttggggccctggctttcctgttctt

SEQ ID NO: 6758198 - DNA, 77 bp, Homo sapiens
tgtttcatacaggaggtgctgtttgtcctggattttagagaaagcttccagagagatagtggctaataaatgaaata

SEQ ID NO: 6758199 - DNA, 110 bp, Homo sapiens
ggcttggaagattggctcctcccatacttattcattccttatccgtatcttttgtaatgtcctataaattgcacccgaggaggaggttgtgggaacctcgatttagagct

SEQ ID NO: 6758200 - DNA, 59 bp, Homo sapiens
gggttagctaagcaggtatctgggggaagaacatccctggcagagaacacggctgatct

SEQ ID NO: 6758201 - DNA, 63 bp, Homo sapiens
atgtttcaccagcaaattacctcgatgagtccttcctggggatttgtaatttgtttgatacgt

SEQ ID NO: 6758202 - DNA, 74 bp, Homo sapiens
gcctcctcttttctgttcctttgagctggccagcaccagcaaggcctacagagaggggcccaatatgatgaggc

SEQ ID NO: 6758203 - DNA, 85 bp, Homo sapiens
ttattttaggtggtagaacagggtagagtcatgtcattatttgctggtggaagacactatttaccaggtgttctttgctgaataa

SEQ ID NO: 6758204 - DNA, 57 bp, Homo sapiens
gtctgagcaccctggcctgtcatcagcgagagtcctgttgggtcagtgtattcagat

SEQ ID NO: 6758205 - DNA, 58 bp, Homo sapiens
gaagaggctttcctagggcaagagccagctggtggccatagctgtaagaagcctcttc

SEQ ID NO: 6758206 - DNA, 60 bp, Homo sapiens
catggtctacaatttcattttatgatgtctttaaatgagagggagattgcaaagactatg

SEQ ID NO: 6758207 - DNA, 58 bp, Homo sapiens
ctcagttgttgcatcattcatggttctttcatattgatgttcagtgcagtggcctgag

SEQ ID NO: 6758208 - DNA, 65 bp, Homo sapiens
agtgaatatggcttgagtttcagactatgttagagctcctgatattcagtctcatcaaattcact

SEQ ID NO: 6758209 - DNA, 72 bp, Homo sapiens
tgcttctttacttgagctgctttttgtatgtgtatgtataaatgccataggaagctagatcagtagtaggca

SEQ ID NO: 6758210 - DNA, 77 bp, Homo sapiens
ctcatgcaatttagaggactgtaggtgggaatacaggaactctttatttccataagtgtccactaaatgattgtgag

SEQ ID NO: 6758211 - DNA, 87 bp, Homo sapiens
tgggatggtgcaaggggtggcagtggtctctgacagagctggctggctgctgatagccatggcctcctgtaaagctgcggtatccta

SEQ ID NO: 6758212 - DNA, 84 bp, Homo sapiens
aggttttggtttccaatgacaaacactgttcctaaaaagtgaaaataaggaagaagtcagattttaatgggatgaccaggacct

SEQ ID NO: 6758213 - DNA, 130 bp, Homo sapiens
actttactgatactccaaaacacatttcaaaccaattatgactgtcttttgaataaaaatggtaataatgtgctataatttaacatgagggcatttttcttgattgaggtgtttttgtttgtttgttttt

SEQ ID NO: 6758214 - DNA, 102 bp, Homo sapiens
cgaattaaggtgtcagcagacctgtgcttctctggaaggctctacgggagagatttaccttctccagcttccagtggctggctgcccacacaccttggctcg

SEQ ID NO: 6758215 - DNA, 79 bp, Homo sapiens
ttcagcgattctttctgcaaatgctggaaaaactccctcctgtgaatctccagaggtatgtagagagtatatgtaagaa

SEQ ID NO: 6758216 - DNA, 73 bp, Homo sapiens
tctcacttgtgcctcataacactcctggagttaggataactctagttaggggtgtcatgaggagtaagtgaga

SEQ ID NO: 6758217 - DNA, 81 bp, Homo sapiens
gctcaggaggtctcaaactctagggctccacattccttttctaggagttttgtctgtcctggggtattgtgaaagatgggc

SEQ ID NO: 6758218 - DNA, 68 bp, Homo sapiens
gcctggctaagcagaaggaccccctctgtggccctagagactgaagtcctagtgcttggtgcccaggc

SEQ ID NO: 6758219 - DNA, 77 bp, Homo sapiens
acaagatagcacaactttgtagcaattccacgagattcagatttcaaagagtttgagctagaaagtatttattatgt

SEQ ID NO: 6758220 - DNA, 67 bp, Homo sapiens
tgaatcataaactgcagggttgggacaagggattcaaaaaatctcaacaagtgatgctcatgattca

SEQ ID NO: 6758221 - DNA, 62 bp, Homo sapiens
tgccaggctccggaacgacagttgataactagctggctgtgttctaagagaggaggctgaca

SEQ ID NO: 6758222 - DNA, 60 bp, Homo sapiens
cttcaaatttttctatggagaaggcagttgtgattgactgtttacaaggagaatttgagg

SEQ ID NO: 6758223 - DNA, 73 bp, Homo sapiens
tgctgcaattaagatttagagaaaagtatgtgcttacgtctattacgtattacaaataaatgttactgtagca

SEQ ID NO: 6758224 - DNA, 119 bp, Homo sapiens
ctcccccttctgaaaaaaaagggggaaatgtgagctctcttctgattggtgggtgacgattttagtccgcaccaatgagctggcggcctcgtctgtatttatttagtgctctgggggag

SEQ ID NO: 6758225 - DNA, 110 bp, Homo sapiens
aactctcagttaatggaagaagaacagtgtcatgaatcaaagattatttaaaaattgcttataaaaatgggactttggaatgcactctttgacttttttggcagaggatt

SEQ ID NO: 6758226 - DNA, 87 bp, Homo sapiens
tttgattttaatgagaatgcttgtttggagatgaaattggtgagacacaagaaagctgaataaccacaggcttcttttgaaatcaga

SEQ ID NO: 6758227 - DNA, 71 bp, Homo sapiens
tatgtgtgagacataaaccttgagatattaaaactgtgtgtcttgatgtggtggggttatgggtacattta

SEQ ID NO: 6758228 - DNA, 57 bp, Homo sapiens
gtttcagttcatgtattccgagtgaatttctggttcactcgtattttcaactgaaac

SEQ ID NO: 6758229 - DNA, 79 bp, Homo sapiens
tctaagctccatctattggcaacatggcttggatcaaccttttcttgcccaaatgtttcaagagaaaaagagacttgga

SEQ ID NO: 6758230 - DNA, 78 bp, Homo sapiens
ggtctcaggcactcctccacccctccccttgcaccagcgcacagcaagcagagaatctgggagcgagggccttaggcc

SEQ ID NO: 6758231 - DNA, 96 bp, Homo sapiens
gtgtcatagatgtatattctgtgccaggatatctttaagtgtgtttaaggctgtgacatctataggccaggttgatatgcactctccaatgaccac

SEQ ID NO: 6758232 - DNA, 55 bp, Homo sapiens
gtcaccaaccagcctgcctctggggcctatttcagaaataaactggtttgtagat

SEQ ID NO: 6758233 - DNA, 60 bp, Homo sapiens
ggagcaaagcttccataaagcagccttgaaccaggatgcccagaaatggcagctttatcc

SEQ ID NO: 6758234 - DNA, 59 bp, Homo sapiens
gagaggcttggaggtgcaaggtttgaaattgcttaaaagctgaatatgtccatcttctt

SEQ ID NO: 6758235 - DNA, 66 bp, Homo sapiens
tgtcatctttcttactatgagttatgaattttgtaatcactcatctttcatggaagaaatgtgata

SEQ ID NO: 6758236 - DNA, 66 bp, Homo sapiens
gctaaattgtaagttgtatgcatattcaactctcctgattagtgccaatcagctttgcaacttggt

SEQ ID NO: 6758237 - DNA, 55 bp, Homo sapiens
cccgaggaaccagaggtagctccgttttggaaagagcttcctggttgcccatggg

SEQ ID NO: 6758238 - DNA, 100 bp, Homo sapiens
atgttctaatttggtaaaacgtcattgattgatggtagtacacatttctcaaacttgactgctcttaggaagtgacaaaaatattgaatttcagggacgt

SEQ ID NO: 6758239 - DNA, 74 bp, Homo sapiens
acacctaatctattgggtaaataatgtgtgtttcagaaaatctactgtgaatttacataatagactttaggtgt

SEQ ID NO: 6758240 - DNA, 66 bp, Homo sapiens
taagtatttattatctctcctgtacttccagttctctaacctggactaaaggagggaaatagcttg

SEQ ID NO: 6758241 - DNA, 77 bp, Homo sapiens
gattaagatttattagatgcttacctgcgccaatgggagatatactggcccaagtaagcatccaataaatgttgatt

SEQ ID NO: 6758242 - DNA, 69 bp, Homo sapiens
tttgagaagtcctgttcctgaagaacatagtaaaccatgggctggatcatggaactgggcaatcttgaa

SEQ ID NO: 6758243 - DNA, 62 bp, Homo sapiens
gggcctgctctgtttagagggggtgccagggtcctgggtccctccctctgttagagctgtct

SEQ ID NO: 6758244 - DNA, 67 bp, Homo sapiens
gcaagttatttccatttaaagctaagcacatgacagctggtgacttttaatggaaagtaaaatttgc

SEQ ID NO: 6758245 - DNA, 87 bp, Homo sapiens
cattggccctctaagcccttgctagagaatatttgttaagacattttgtagtctaatactcatttctgtaactcggcttcgggaatg

SEQ ID NO: 6758246 - DNA, 72 bp, Homo sapiens
aggcacagggttactgtcactgttgattgaccaaacttgcttttttggcagctcagaaacttcattgtgcct

SEQ ID NO: 6758247 - DNA, 61 bp, Homo sapiens
tttttagttgtactgtcaacagtttcaaaacaaagaagaaactgcgactggcaaatgagga

SEQ ID NO: 6758248 - DNA, 83 bp, Homo sapiens
gcttgagggtctgattgatggtcagatatgagcgcacatatatgtacgctcacatctgaccataaaacaagtgataatttagc

SEQ ID NO: 6758249 - DNA, 76 bp, Homo sapiens
cccatagaaggtagcaatctgggaagacatggtacaactttcagccctaaccatgatctgtttcttcaatggtggg

SEQ ID NO: 6758250 - DNA, 76 bp, Homo sapiens
tcttgtaaggatgtcagtcattttggatagggccctctctaatggcctcatttaactttgattacctcctcaaaga

SEQ ID NO: 6758251 - DNA, 115 bp, Homo sapiens
atctccatgatagccacttgtcagcaagtagagcatgcaccctgtacaggaaccaggtgtgtacaaggccatctacatgctgtagagtcccttaaagccagtggcttatggtaat

SEQ ID NO: 6758252 - DNA, 76 bp, Homo sapiens
caggctgctgtgaggaggcggccagaagagtggggacgggcctgtgttgtgtgtttcctcctctccagagagcctg

SEQ ID NO: 6758253 - DNA, 65 bp, Homo sapiens
aaatagggccagttagggaagctttgcaatcgtgcaaaatgtctgccccttgctgtatcctcttt

SEQ ID NO: 6758254 - DNA, 57 bp, Homo sapiens
catgtgtgaagactgcgggccaggtgagaaggaacagggcccgctgtgtgtatcgtg

SEQ ID NO: 6758255 - DNA, 70 bp, Homo sapiens
gctcagcttctcgggagcgcatgtgctcaccccatctgtgaaaaatgcgtgcgccttgaagaggcgtggc

SEQ ID NO: 6758256 - DNA, 78 bp, Homo sapiens
gaatgtgataggaggagacccaagctctgcagaggactctccagtataaaacagattgggtttgcttctgtgccactc

SEQ ID NO: 6758257 - DNA, 61 bp, Homo sapiens
tctcaggggcccttccctcagcaggtcaagagacattctctgctgggcaggacccctcaga

SEQ ID NO: 6758258 - DNA, 74 bp, Homo sapiens
gatctctaggtgaaaaatcatcatgacttgaggatattattgttatagaatggtggattttctgcagagaggtt

SEQ ID NO: 6758259 - DNA, 67 bp, Homo sapiens
ttgaacccatgaggtggaggttgcagtgagccgagatcgtgccactgcactccagcctgggtgacag

SEQ ID NO: 6758260 - DNA, 81 bp, Homo sapiens
tgttacctcattatggtgtccttgtttcttgtttagcaatagcctaaacaggctctgcgggatgctcagaaaatggttaca

SEQ ID NO: 6758261 - DNA, 68 bp, Homo sapiens
aatgcacctaccttgattctgcagcttatatcctctgcagaattcggcatttaaggtaggattgcatt

SEQ ID NO: 6758262 - DNA, 66 bp, Homo sapiens
ggagagatgctaagctcaggccacagttcaacttcacaggaagttgaagagctacttagcctttcc

SEQ ID NO: 6758263 - DNA, 62 bp, Homo sapiens
gaacatgatgacaaaggtatattttattatctccaagtaaggtgtatatcaatattatgttt

SEQ ID NO: 6758264 - DNA, 116 bp, Homo sapiens
ctagtatgctttcatccacagtgtatgtacatgatttcatttgcttttcaccaacctatcagagacaaatggtaattatgtctagtaagtgcaaacactaaacacgagcagcacag

SEQ ID NO: 6758265 - DNA, 108 bp, Homo sapiens
gcccaacaaactgccccaggatgtttcttccatgagtagcagtatttcctgtttctcctctcaccttgcaggacatgctgtgactgatgttccctggggacatgaggc

SEQ ID NO: 6758266 - DNA, 61 bp, Homo sapiens
catagtgtgatttattggaagaggtagtatttcactaaatcctccctgtaaatccagtgtg

SEQ ID NO: 6758267 - DNA, 58 bp, Homo sapiens
tgagatggggtcatgctttgtcacccagactggagtatagtggcatgatcctagctca

SEQ ID NO: 6758268 - DNA, 56 bp, Homo sapiens
ggccttagagaccacctagtctgattatcacacttcactgacagggaactaaggct

SEQ ID NO: 6758269 - DNA, 116 bp, Homo sapiens
gggatgaagccctgaccaggttcagaggcagcgggtcaggaccgtgcctgggctcagtcccgccctggctccttcgcttctcgccgctgtgagcctgggcagtggcttcgctgctc

SEQ ID NO: 6758270 - DNA, 58 bp, Homo sapiens
tatttttggctgttgtcagaggtgtatatttgatcatttcgactgtaagccaaaaatg

SEQ ID NO: 6758271 - DNA, 126 bp, Homo sapiens
tggctagaaacgtgctatctttcagtgataaagacgctctagtttcctcctggcatggtgcctgtcagaggctatcatcctagaaggaagctaggatcacagggttattagcaacatctttggcca

SEQ ID NO: 6758272 - DNA, 81 bp, Homo sapiens
gtcgacttcacaacagcattactctcctgttttgcagagtatttaaggcatgcagggattaaatgactgccttgaggtgat

SEQ ID NO: 6758273 - DNA, 96 bp, Homo sapiens
aatagaggagatttgtatgtctaaatgtaaggagattatcccccagaaaggagggggagttggcttttatttgagttttacaaagtctctcatgtt

SEQ ID NO: 6758274 - DNA, 55 bp, Homo sapiens
caggctgcatggaggggtacaggactctttctgcttcttttattggcagatcctg

SEQ ID NO: 6758275 - DNA, 66 bp, Homo sapiens
tcatcccatgctacatacaatttgtctgtaaaattcttacagtgcaatgtgatgtagattaaatga

SEQ ID NO: 6758276 - DNA, 56 bp, Homo sapiens
taggccagattactagagtaggctcctgattttcctgcttttactcctgccgccta

SEQ ID NO: 6758277 - DNA, 55 bp, Homo sapiens
gggtgaacacactctgtgtgtgtatgtgtgaatgtatatgcatgtgttttcactt

SEQ ID NO: 6758278 - DNA, 72 bp, Homo sapiens
gaaatgtcaggctattatccattcttgttgttcagtgttttctgaacactgagtgtagaaatagccactttc

SEQ ID NO: 6758279 - DNA, 55 bp, Homo sapiens
gcttctggagtcttcagaggaaactgttgtcttgccttttccagctcctagaggc

SEQ ID NO: 6758280 - DNA, 109 bp, Homo sapiens
gttggccaggctggtcttgaactcctgacctcgtgatctgtccacctcggccttccaaagtgctgggattacaggcatgagtcactgtgccaggccacacctggctaat

SEQ ID NO: 6758281 - DNA, 55 bp, Homo sapiens
ggtggttcacgcctataatcccagcactttgggaggccaaggcaggtggaccact

SEQ ID NO: 6758282 - DNA, 77 bp, Homo sapiens
atctcacattctcaactactgcgagagctataatgttaaagtttccagtgcaatgcagtagttcagcacagtgagat

SEQ ID NO: 6758283 - DNA, 129 bp, Homo sapiens
aatgggtgttacattaagatgctaattttgtggtaatttgttacacagcaatataaaatatagtgtattagtttgttaggcctgctgtaacaaagtgccacaaaatgggtggtttaaacaacataaagt

SEQ ID NO: 6758284 - DNA, 60 bp, Homo sapiens
gagtttaaataacacatttccaagtcacgtagctagtggcaagatgtggagtttgatttc

SEQ ID NO: 6758285 - DNA, 80 bp, Homo sapiens
gcattctttaggtttaggagtgaaggtgaacattgaggttagctcggtttcaccttgaatatgtcttaaatcccctatgc

SEQ ID NO: 6758286 - DNA, 101 bp, Homo sapiens
tttgatgcataattagaagaacaggcccataatgcaaatatttggttgtcattagcatagagatagtgtattagttgggccaggttaattgcttcatcaaa

SEQ ID NO: 6758287 - DNA, 65 bp, Homo sapiens
gtggaaacaccttggtctgattcagagcattaccttgtaatggcactaggaccaggggttgccat

SEQ ID NO: 6758288 - DNA, 104 bp, Homo sapiens
aggacagtttatcttgaagtcttccacagtagatacctccagtacacattcaaaaaagatgttttgggtaactgtctgtgaaataagaactacaaatctgtcct

SEQ ID NO: 6758289 - DNA, 56 bp, Homo sapiens
tgttcagccctgaaaatatatgcattttgtgccattgttttctaaagggcggatca

SEQ ID NO: 6758290 - DNA, 98 bp, Homo sapiens
gtgtttaaccagacgcatgggcaccttgtggcccagtcaggttgatacataaaattaaccatcacaagtgggtcacaaccagcgttttctaaaaatat

SEQ ID NO: 6758291 - DNA, 58 bp, Homo sapiens
gaggtggggcaggaaagtgctgtggtgtcccccagtggcagctgtcatgccctagatc

SEQ ID NO: 6758292 - DNA, 69 bp, Homo sapiens
ggttatacagatcttcaatatttttgtgtagatctacggatttagcaagtctttgaagtcattagaatc

SEQ ID NO: 6758293 - DNA, 84 bp, Homo sapiens
ttcgcccttcttcttggtaatgtcacatttcctgtaccctcaggctatcgaggaagcctggcattaaaaagcaaaaagagtgaa

SEQ ID NO: 6758294 - DNA, 66 bp, Homo sapiens
ctccagcttgggtgggaggaggtggttcctcacacagagaaagcctcctcttctactcgcctggag

SEQ ID NO: 6758295 - DNA, 66 bp, Homo sapiens
cagagggtagactgtcaaacactagccagggcacaatgctgtgactacaaaaggttctacctgatg

SEQ ID NO: 6758296 - DNA, 81 bp, Homo sapiens
tcaggcttttattcatggctgtgttgttcctctgaagctcattttgccttctggagacccagcaacagggccatgttctga

SEQ ID NO: 6758297 - DNA, 86 bp, Homo sapiens
attaatgcacagatcacagcatttaatgcagtgcttccagcagagatgggcagcatcttattatgtgtaatgataaagcatttaat

SEQ ID NO: 6758298 - DNA, 56 bp, Homo sapiens
accattctgagtacatttcctcagctgtgaaagaggaagagctgactcacagtggt

SEQ ID NO: 6758299 - DNA, 56 bp, Homo sapiens
gtaagtttttccctagatgtagaaagcactatgcttcagcatctagtgagatttgc

SEQ ID NO: 6758300 - DNA, 75 bp, Homo sapiens
tcaacttactggtttcatacagattattcatgggaaggcaacatgttccgtcagttatctgagaggcaaagttga

SEQ ID NO: 6758301 - DNA, 65 bp, Homo sapiens
ctgaagccagtttgctgcccttggggaggagataaaatctgagtggcaaaataactgagctccag

SEQ ID NO: 6758302 - DNA, 106 bp, Homo sapiens
ctccatttgtgtcagaactttcttgatacagcagcctgtgatcctgacttattgggagcggggatggctgcctgcatcaggaggctggggtctggcatggctgggg

SEQ ID NO: 6758303 - DNA, 64 bp, Homo sapiens
tgtactaaatgttttatcttcctggcattggaaaaaaatggggaagaaatagaacattttgata

SEQ ID NO: 6758304 - DNA, 101 bp, Homo sapiens
gcgcagtcctgtgctattgtgcatatgtcattcgatccgtgttcagcctggtcctggagatcaatatgcattactaatcaaaatggcataggaatcagtgc

SEQ ID NO: 6758305 - DNA, 63 bp, Homo sapiens
atgacatggtgcagacagtgtctaaaacgtctgaaatgaacacctgtacaggcatcgtgtgat

SEQ ID NO: 6758306 - DNA, 76 bp, Homo sapiens
tcttcactggccaaactgaagaatgaaggggaaattgataaaatcaccaccccagaatttttcaaggccgtgatga

SEQ ID NO: 6758307 - DNA, 72 bp, Homo sapiens
aaatcctggagagaagaaaggtgcagaaaagggagcctgatatttggcaccatttttattctctgggcattt

SEQ ID NO: 6758308 - DNA, 55 bp, Homo sapiens
gccactgcaaccttggcacacacctgacagtgtttatgctggaggttgacagggt

SEQ ID NO: 6758309 - DNA, 76 bp, Homo sapiens
tcacttgagcccaggagttcaaagctgcagtgagctatgatcgcaccactgcactccagcccgggcaacagagtga

SEQ ID NO: 6758310 - DNA, 70 bp, Homo sapiens
ggcaccagctgtcaccaggagccggaccacagacggtaatgtggtgatcacagccaggtggagcggtgtc

SEQ ID NO: 6758311 - DNA, 68 bp, Homo sapiens
aggcagaagcctagcactgaggaaaagaagggaagagttgctctttttcacagtgtgaggctgtgctt

SEQ ID NO: 6758312 - DNA, 72 bp, Homo sapiens
ctgtaggccctgcctctgcctttgctgggaagaagcacacactcctgccctgcatgcagggagctgtcacag

SEQ ID NO: 6758313 - DNA, 101 bp, Homo sapiens
tttgcattttggaaataagaaactaaagctcagagagatagtgaagtttgtggctaattgtcatccttcagctctctatttagatgtcatttccttgcaaa

SEQ ID NO: 6758314 - DNA, 59 bp, Homo sapiens
tttattcagcagcagcagtggtctttggttaagactgacattctgactgactgaatagg

SEQ ID NO: 6758315 - DNA, 78 bp, Homo sapiens
ggtgcttggggtatcattaaatataagcttcacaattagttctgattgatgctacatcttaatgggttccacagtact

SEQ ID NO: 6758316 - DNA, 90 bp, Homo sapiens
aaggtgaaacctgggggaattccagggttagctcatttggtagctctggggagccaggttggcttctctgggattcttttgtttctcctt

SEQ ID NO: 6758317 - DNA, 55 bp, Homo sapiens
ctgggggcagggaggtaccctacaggagaagccaggtggggcctcctgtccctgg

SEQ ID NO: 6758318 - DNA, 55 bp, Homo sapiens
ttcctgagctccacctcaaattctgatttacgaggtctggggtgaagcccaggaa

SEQ ID NO: 6758319 - DNA, 90 bp, Homo sapiens
cagaaaatgttggctgaaggaataaatggatggatctaggtttatgtgtctgtttgctcacttatttattcattcagctcatgcttgctg

SEQ ID NO: 6758320 - DNA, 57 bp, Homo sapiens
gcaacaacttgtaggactgcactgtagctttgctaggtgctgtttcccaagtggtgc

SEQ ID NO: 6758321 - DNA, 60 bp, Homo sapiens
tgaaagtgtttttgagctgtagtttcacatttgtaactgcttccttggcaggcatgttca

SEQ ID NO: 6758322 - DNA, 129 bp, Homo sapiens
ctggcaaacgtgttccttctctcataattcttagcttctctacaggtgtccagtgttctatggctgcccctactctttgcagtctcagccacacagacctatgaaaagctgctattctggagtccccag

SEQ ID NO: 6758323 - DNA, 72 bp, Homo sapiens
aggaaggaaaggaagtgttacctgtaaaatcttcacgatttcaacagcataatcacttctttcttaaattct

SEQ ID NO: 6758324 - DNA, 99 bp, Homo sapiens
gttggtcaggctggtctcgaactccttaccttatgatccacctgccttggcctccctaagtgctgggattacaagcgtgagccaccatgcctggcccac

SEQ ID NO: 6758325 - DNA, 90 bp, Homo sapiens
cccagcggctcttgctacgttcttgtttggaatgagggagggcctttcctcagtcttggacaggaacaatctgttggccttagtcctggg

SEQ ID NO: 6758326 - DNA, 68 bp, Homo sapiens
agttttcctatgatattctatgtgtcctgcatttgaaagtggggcaccattaatcatccataggagct

SEQ ID NO: 6758327 - DNA, 129 bp, Homo sapiens
ttcaacattctatttcaacactgagaatgaataatatgcttatgatgtctcaagtttattaccagcgaataattctggttgactaaagatgtctaaatatattgttcctattaagtgtatacatgtgaa

SEQ ID NO: 6758328 - DNA, 62 bp, Homo sapiens
ggcagtgtggcataacatgtaggaagcatgacaagctgtggacttactcaggccacactgcc

SEQ ID NO: 6758329 - DNA, 66 bp, Homo sapiens
tagttcataaattgattatgtgcttttgtttgctatgttgtatttaaagcatttagtttgtgtcta

SEQ ID NO: 6758330 - DNA, 62 bp, Homo sapiens
tttctaagccatcagtgatttccctattggaacaagggaaagaaccctggatggctgggaaa

SEQ ID NO: 6758331 - DNA, 87 bp, Homo sapiens
cataaaagctagaaggaaaggcagtacagctgagcctcaaggacaactagaactactgtcactgtctctcatctctgcttctttgtg

SEQ ID NO: 6758332 - DNA, 82 bp, Homo sapiens
atccaaccttgctcagcaatgagaactggcatttctgggagcccaaattctccagagtcagtgacttttgctgagagtggat

SEQ ID NO: 6758333 - DNA, 61 bp, Homo sapiens
caggcaacatggtgaaaccctgtctctacaaaaaatgagccaggcttgaggaatgtgcctg

SEQ ID NO: 6758334 - DNA, 57 bp, Homo sapiens
ttcctttgttcatgaaaacctagatctatgcaaccaaggctggggtggacagaggga

SEQ ID NO: 6758335 - DNA, 123 bp, Homo sapiens
gaatggtcaaggctgaatgcacactgaggtttccatgtgctcagctcagcagattcaggtatgacccctacagagcttggactctgaactggcactgacattctctacgctcagcgaccattt

SEQ ID NO: 6758336 - DNA, 58 bp, Homo sapiens
ggggctcagtgaagctaagtgtatggcccacaagtggtcatattggctccacttcctc

SEQ ID NO: 6758337 - DNA, 74 bp, Homo sapiens
cactacaaagacctgtgatcacatggaatgagatggttagatgactcatctatggctgtcagaggtttatggtg

SEQ ID NO: 6758338 - DNA, 130 bp, Homo sapiens
tgcagcctgctttccgactgtatctgtgcttatgaaaaactggaaaaaggctttgtaattgtccttcttacactgagccttacataaacagccttataactattcacaggagcactcactgcaccatgta

SEQ ID NO: 6758339 - DNA, 64 bp, Homo sapiens
catactgtgaagcttactatttcattatctcttccttcgctagaatgtaagctttgcaagtgtg

SEQ ID NO: 6758340 - DNA, 75 bp, Homo sapiens
cagtacttatttctatttagggattctgggcatcttccgcagccctaaaccacctaaatggacttataagagctg

SEQ ID NO: 6758341 - DNA, 67 bp, Homo sapiens
ggccaattttcttagagaagcatgtttggaagaacattctagatggagtggagatgagtaaatggcc

SEQ ID NO: 6758342 - DNA, 85 bp, Homo sapiens
agtagtacatggcagatgtggcatagagcatacatagataattaaagcaaatgtatacttcatgcttcatgtctgtatttttgct

SEQ ID NO: 6758343 - DNA, 64 bp, Homo sapiens
gaataatagggttatagcagtgttaggctcaatattgtagctattctgagaatcctacttattt

SEQ ID NO: 6758344 - DNA, 57 bp, Homo sapiens
tcatctgcatcccccaggaaatgctgggttgccttgaccccctgggaggagttatga

SEQ ID NO: 6758345 - DNA, 74 bp, Homo sapiens
cataaggaacttggtaaattgtgtcagataccatgaaaatgcatcttttcatagttaaccacagattgtttatg

SEQ ID NO: 6758346 - DNA, 60 bp, Homo sapiens
gtgggaactcagcgccctatttctactgtcagagctggaggccgcaatgcagtttcccac

SEQ ID NO: 6758347 - DNA, 60 bp, Homo sapiens
cctcatttacactatgggaactacactataagtgtagttgttacttagtgtcaaattggg

SEQ ID NO: 6758348 - DNA, 59 bp, Homo sapiens
ttggttaggaataagaccatcctaataattagccattagaaaatggtctcactgagcaa

SEQ ID NO: 6758349 - DNA, 70 bp, Homo sapiens
ggcatggcccaggcaggctggtactagataatgtgtgggggccatatggtgatagtccctggcccgtgtc

SEQ ID NO: 6758350 - DNA, 60 bp, Homo sapiens
ctcctgaccttgtgatcctcctgccctggcctcccaaagtactgggattacaggtctgag

SEQ ID NO: 6758351 - DNA, 59 bp, Homo sapiens
ggggatgggggtgatgagggtacacagcacatactcacccttcaggacccatcctcccc

SEQ ID NO: 6758352 - DNA, 129 bp, Homo sapiens
ctgttgcacatcctcaaggctggtgacagtgcacacagatttcaggactcaaaacgataattcgtgtaaagccgttgttgttatctttaggctgtgactagctgccagactatgagaggtgaccccgag

SEQ ID NO: 6758353 - DNA, 66 bp, Homo sapiens
ttcatatatatgtgtgtgtgtgtgcatgtgtgtatatgtatccttatacacatttatattagtgaa

SEQ ID NO: 6758354 - DNA, 60 bp, Homo sapiens
gaaggccggagagtgacagcttccagaccagagactctgctgcccactcttccagccctc

SEQ ID NO: 6758355 - DNA, 100 bp, Homo sapiens
gctggaggaacaagggattggggggcaggagaagtgtattttagtcttggctctagcacttgttttatgttcctgagaaagtcccttaatctctcctggt

SEQ ID NO: 6758356 - DNA, 59 bp, Homo sapiens
ggtgtttatgagtgaccttgtcttgtcctctgaattatggacaggcagctcagaacatc

SEQ ID NO: 6758357 - DNA, 77 bp, Homo sapiens
taagtctgagttttctgtgattatgcttttttagaaaagagcaccttaattatgcagagaaaacaccaaatgatttg

SEQ ID NO: 6758358 - DNA, 85 bp, Homo sapiens
caggcctttttacctttttcttcacctttattccttatcaagaagaatgcaaaataaatcggttggttcaaggtaataaggtttg

SEQ ID NO: 6758359 - DNA, 70 bp, Homo sapiens
ctctccttcccagcacctcagtctggccaaacatgtttttctggcttctggtagtgctggggaggtggag

SEQ ID NO: 6758360 - DNA, 56 bp, Homo sapiens
ttgcctgtgaggattctggttgcttaaggtgaaccaatcagtgttctcaggggcaa

SEQ ID NO: 6758361 - DNA, 88 bp, Homo sapiens
tctcattttagacctgctgctaatttcaaaatcctacaggcattaaagatgctaaggagggtcttgcaaattagcctctattatgtga

SEQ ID NO: 6758362 - DNA, 56 bp, Homo sapiens
atctttctcagctgtaatcaaagagagatgacttgatgaaggcaggtaagaaagat

SEQ ID NO: 6758363 - DNA, 94 bp, Homo sapiens
gctttgcgctaatggactgttataaaatgcacagttgtttcttgcagtcactgccaaatgcctcccattctactgacagttttgtgcattaggc

SEQ ID NO: 6758364 - DNA, 101 bp, Homo sapiens
tgactattctccaacatgtactgttttaacatttagaaagtgtccatttttagcaaaatcacagctgtgtgaatgtaacatattggtgtggaggagggtta

SEQ ID NO: 6758365 - DNA, 67 bp, Homo sapiens
gtgtgagtgtacctattttcaaaagtgctgttaacataaacagagcagtaaatctggggcaccatgc

SEQ ID NO: 6758366 - DNA, 69 bp, Homo sapiens
agtggaacatgcacatcatagctcgtgtccacaaaagctcgggccatgtgctatgttaagaaaatcact

SEQ ID NO: 6758367 - DNA, 67 bp, Homo sapiens
agcctggggtgaggccttgctgccatcagttctccccaagctgctgccgggctttatccccaaagct

SEQ ID NO: 6758368 - DNA, 66 bp, Homo sapiens
gcctttcacgcgttttttcctgtgtctcaaacggggtaccaggaggctcagggaaacagcgcaggc

SEQ ID NO: 6758369 - DNA, 62 bp, Homo sapiens
agaggagccaagaaacaatattggtaggtgagatctcctaacttttacatttggctcacttt

SEQ ID NO: 6758370 - DNA, 57 bp, Homo sapiens
gcctcctagagctccagggactccttccaaaaatgggtctcttggccatggggaggc

SEQ ID NO: 6758371 - DNA, 72 bp, Homo sapiens
tacagaatccacatagttgatgctcagttttattaataaatgaataagcaagcctgtgtgcaagactttgta

SEQ ID NO: 6758372 - DNA, 61 bp, Homo sapiens
gcctgtaggaggtagcttaatctcacgtactgttggaacttggtaccaccttctgaagggc

SEQ ID NO: 6758373 - DNA, 75 bp, Homo sapiens
gatgcttcctccctgttagagctgctgctgttattcagttagctgcagtcagtgctaatgggtacaaggttcatt

SEQ ID NO: 6758374 - DNA, 60 bp, Homo sapiens
gaagaaggtcaaatgtgtttagtggaaagtttgctcttttcaatagaaatgacattcttt

SEQ ID NO: 6758375 - DNA, 68 bp, Homo sapiens
aaagatcatgctgttttgtgatgctcagcatttgtaattaatgcacctaccattgacagtatatcttt

SEQ ID NO: 6758376 - DNA, 68 bp, Homo sapiens
aggagttcaaggcgagctcaataaactagatcacaaagtcatttttacaacgcttgccttgtcttcct

SEQ ID NO: 6758377 - DNA, 57 bp, Homo sapiens
gggctggatctcacgtgagaccttaaagttcctcctgtctcatttggattctagctt

SEQ ID NO: 6758378 - DNA, 56 bp, Homo sapiens
gaagattagaccatttccagctgagactggtttttgctagcagtggttagattttc

SEQ ID NO: 6758379 - DNA, 92 bp, Homo sapiens
ctcttccaattcatttgactattaggtcgtctgtgataaagtgctgttgctaggcaacaagggtagtcagtgagactcatgagcatgaggag

SEQ ID NO: 6758380 - DNA, 74 bp, Homo sapiens
gagtatggcaatatattaaaaattatcctatcctcttgaggaaggatgaacattaatacatcagcagacgattc

SEQ ID NO: 6758381 - DNA, 85 bp, Homo sapiens
ggagaagagaaaacagctggtctcaaatgttccttcttctaaaaatagggattagagcagatgtaggcacagttgctacttctcc

SEQ ID NO: 6758382 - DNA, 80 bp, Homo sapiens
tggagcccctgatgtcctgcaaatgaaggaggaggatgtccttcagttccttgcagcaggaacccacttaggtggcacca

SEQ ID NO: 6758383 - DNA, 62 bp, Homo sapiens
aaggataattggcagtaatgtgatttaaacttacttgaatttgtagctgttaattgaacctt

SEQ ID NO: 6758384 - DNA, 79 bp, Homo sapiens
cagtctggctttcttgtatagttaataacattattacttataacattataaacttgccaagaaggagaagtcagatctg

SEQ ID NO: 6758385 - DNA, 77 bp, Homo sapiens
gttttttcatatgcagattaacaaatatggctgtctggatttagttatatttttaaggctctgacatctggaaaaat

SEQ ID NO: 6758386 - DNA, 81 bp, Homo sapiens
ccagaagcaaacagctgtttttgtgggcatgtgattgaggtacctgagcagtctatgctagaaggtcagttgaagctctgg

SEQ ID NO: 6758387 - DNA, 69 bp, Homo sapiens
tagctctgacatttgcaattacaagtctgtctttctttcttagaaatagttacattattgtcagagctg

SEQ ID NO: 6758388 - DNA, 55 bp, Homo sapiens
cagttagaggaggtgggttaagagagattttctatcttacctcccttctttcctg

SEQ ID NO: 6758389 - DNA, 130 bp, Homo sapiens
agatcattgctgctgattgggatttgcatcatgtggggcttaccagagtgatgtgatagaaagtttttgttctagagctgttcacatgctactgagccagaccttgcagcccccgaggcagtttccatct

SEQ ID NO: 6758390 - DNA, 69 bp, Homo sapiens
agatataaatttcatggtccaactagtaagcaccctattttgcttttaaggaatgtgcagtttatattt

SEQ ID NO: 6758391 - DNA, 71 bp, Homo sapiens
ctgagtctggactattctggtctttttgatgcctcacatggggtcttaagaatgaataaccaagatattag

SEQ ID NO: 6758392 - DNA, 68 bp, Homo sapiens
aaggagagatgggctcttttagacaggaactcctggaggggaacagacagaagcttatctccttcctt

SEQ ID NO: 6758393 - DNA, 130 bp, Homo sapiens
ctgcagcagatgtggcctgtacagggccggcacggggcggtgcctggcagtggggccctgggacgtggcaggtccgagggctggacgcaggggccctgcagctgcagccctggaggtcagctgtgggaag

SEQ ID NO: 6758394 - DNA, 63 bp, Homo sapiens
caaggctttgtgggctgcaggcagaaacttggactttttccctgagagcactggggagccatg

SEQ ID NO: 6758395 - DNA, 59 bp, Homo sapiens
ggcagagtggcagtcccaggcccacgcagtagcagtcaaggtggcactgccgctatgcc

SEQ ID NO: 6758396 - DNA, 60 bp, Homo sapiens
ttccatccactcctcagctctattccctgcatatctctaggaggctgtgaggggaaggaa

SEQ ID NO: 6758397 - DNA, 69 bp, Homo sapiens
gcctggccctggagctagactaggacattggcgcctagagcctgtgtctggtctgcccaggttctgggt

SEQ ID NO: 6758398 - DNA, 66 bp, Homo sapiens
acgaggtgtcccgcagtccccaagcagatctggagaaccttggaggaaaggcagggagaccggtgt

SEQ ID NO: 6758399 - DNA, 63 bp, Homo sapiens
ctccttcagcagatgcaaaacccctcggtaaaactgcaggattagcgtctctgttggcgggag

SEQ ID NO: 6758400 - DNA, 73 bp, Homo sapiens
ggctgggttccaagggtgagcctcacaagacagagaaccaggtggaggctgtgccatctttggtcacctagtc

SEQ ID NO: 6758401 - DNA, 87 bp, Homo sapiens
cagtgcaaaatgagactggagatgcaaacaaggaccaaataatgaaagaccttgcatgacatgctaagattatgttattttgtgctg

SEQ ID NO: 6758402 - DNA, 71 bp, Homo sapiens
agcaacctgggggacaaaaacaacagccttgtctaggggaaagaagggggtgtctgtgttcttcagttgct

SEQ ID NO: 6758403 - DNA, 99 bp, Homo sapiens
ggggaaaagaaaggttaagtaacttgaacaaggccatacagctggtaggcagtaaagctgggcttctattcaagtctgtttgactccaaagctgtcccc

SEQ ID NO: 6758404 - DNA, 56 bp, Homo sapiens
tagttttaagctgacattgttccatatgtgataggaacaacttagttgagagacta

SEQ ID NO: 6758405 - DNA, 64 bp, Homo sapiens
ctcctataatcccagatactcaggtggctgcaacacaggaattgcttgagcccaggaagtggag

SEQ ID NO: 6758406 - DNA, 77 bp, Homo sapiens
gcagttccactacacagctctgagatattactattggtactattaatagcaacttttattgagggcttagtgtatgc

SEQ ID NO: 6758407 - DNA, 64 bp, Homo sapiens
atcttgttctcccttgttcttagaacaatatatgacacctaagagcaatcaacagaggcaggat

SEQ ID NO: 6758408 - DNA, 100 bp, Homo sapiens
ccatctctgtaggataaagtgtgcacagttggcttggcactcactcttctgtgtccagcagtagctcttgccatctgtcttatcaagagaataaaaatgg

SEQ ID NO: 6758409 - DNA, 121 bp, Homo sapiens
ttatattcatcatattttattttcaacctatcttggataagcatgaaaataggtctgatagtcataaggctatcactacacttcagctttaagaagttgttaggtttatgaggacttgtaa

SEQ ID NO: 6758410 - DNA, 85 bp, Homo sapiens
tcagattatcccgattacagtagctttatttggagtaactttccctcttacttgccaaaggctgtgtagctaataggattattga

SEQ ID NO: 6758411 - DNA, 62 bp, Homo sapiens
gtgttgttttgtgttttcacagcaatctgactgtgtgcacgtgaggatacttaagagaacac

SEQ ID NO: 6758412 - DNA, 68 bp, Homo sapiens
ctttaggaggctgaggcaggaggatcacctgaggccaggagtttgagaccagcctgggcaccatagag

SEQ ID NO: 6758413 - DNA, 73 bp, Homo sapiens
gagagggactggagaaagggaacttacagagtgataactggtctctccaataacttgttttttcctccctttt

SEQ ID NO: 6758414 - DNA, 67 bp, Homo sapiens
ctgggctctggccagtgagttcctctcttagaaggaaaactggagagagagctcattagctgcctgg

SEQ ID NO: 6758415 - DNA, 91 bp, Homo sapiens
taaaggaaaatgtcacatttgctgcaaatatgaaatggaaattacatacagtctctatattatatgtagtttgtgtgagaaatatctatta

SEQ ID NO: 6758416 - DNA, 68 bp, Homo sapiens
ttactcttgctttgcttcacagttccgtagagatatctcaggggtgcctgtgagcagatgctgagtga

SEQ ID NO: 6758417 - DNA, 55 bp, Homo sapiens
tggccctgctatgatcctgcaaaggtcatcctgatcccaggattagagagggcca

SEQ ID NO: 6758418 - DNA, 68 bp, Homo sapiens
acagtattagcaaggttcatgagaagacagtaggccagtgcctcggatgtgtcaatcttggtgactgt

SEQ ID NO: 6758419 - DNA, 58 bp, Homo sapiens
agatatagttgttgagaagaactgggatgccccccagattttcttaaattttatttct

SEQ ID NO: 6758420 - DNA, 75 bp, Homo sapiens
tggaaatcaaaataaaatgtctccactgggctcattacctgagatctttttgttgaccttttcttgagttttcca

SEQ ID NO: 6758421 - DNA, 64 bp, Homo sapiens
gcacagtgcacaacccacacagccgtatggagccaacatgatgtctggagttttgcactgttgc

SEQ ID NO: 6758422 - DNA, 61 bp, Homo sapiens
tggatgttggcaggtcttgttgggactttataataataaaatcttacaatcgttacatcca

SEQ ID NO: 6758423 - DNA, 116 bp, Homo sapiens
ttctgtcctaccctcctactgcagaaagctcacttcctggcagtgcccagtcactgttcctagagcagccctagggattgctgttttctgctatctgtggaagcccaaggacagaa

SEQ ID NO: 6758424 - DNA, 56 bp, Homo sapiens
gggagccactgcggtccactgcaattgatgcagcaacaggggctgacagtggcctc

SEQ ID NO: 6758425 - DNA, 129 bp, Homo sapiens
gcctttggagggctttgatgtggtgatgagtatgttcttcccaggtaaagaaaagtcccatccgtggtctcttttcagcctggggaatggggtgcatctcagcccaggtctctttgcctactggggtgc

SEQ ID NO: 6758426 - DNA, 125 bp, Homo sapiens
ctttcagggatgaactgaacaaattatatggctccagtcatctgtcacatcaggggtgttgacagccactgttttcaaatctgagtgccgctgacttttgctgtatttggttattttcctgagag

SEQ ID NO: 6758427 - DNA, 64 bp, Homo sapiens
gactctgatttatctgcgttccttggacaccaacaggaattgcaggcagatctcaatcagagtt

SEQ ID NO: 6758428 - DNA, 64 bp, Homo sapiens
ctcaggctgtctaatggattagcaaatgtggctaacacatggatacccattagtagaacctggg

SEQ ID NO: 6758429 - DNA, 76 bp, Homo sapiens
gttctgagctaaccatcttacaaatgtctgctctaattctccagggtgatggggtgaaagatgggttagtgagaat

SEQ ID NO: 6758430 - DNA, 62 bp, Homo sapiens
gggaaaccaatctatccttcatcctggggtccaaaattcccaggtaagagacggattggccc

SEQ ID NO: 6758431 - DNA, 60 bp, Homo sapiens
agtgagcagagacgggggcctccagcatagctgctggttttgacctgtttctagttctct

SEQ ID NO: 6758432 - DNA, 56 bp, Homo sapiens
tccttcccatagatcttgagtgccaatgagaggcacctgtgtaagatctggaacga

SEQ ID NO: 6758433 - DNA, 76 bp, Homo sapiens
gcatgcagcctgagggatggtgagagtctgatttttagataatcaaggatatttatatcttttaataggctggtgc

SEQ ID NO: 6758434 - DNA, 56 bp, Homo sapiens
agtggagggagttgatttgctgccagacattctcttatgcagccagtcccttcatt

SEQ ID NO: 6758435 - DNA, 65 bp, Homo sapiens
gagatggagttccgctatgttggtcaggctggtctccaaatcctggcctcaagtggtccaccctc

SEQ ID NO: 6758436 - DNA, 79 bp, Homo sapiens
acgtccttggagctgtggagccctggtagggaccccagctctcgggaggggccctgcgggggctcctagtacaggatgt

SEQ ID NO: 6758437 - DNA, 78 bp, Homo sapiens
gctgaggaggtagatgtccttgttaataattgttaattaattaacaattaaggattatactctcctttcattcacagc

SEQ ID NO: 6758438 - DNA, 58 bp, Homo sapiens
agttcttttgtgaacatatgctttccgttctcttgggtatatgcctacaagtggaatt

SEQ ID NO: 6758439 - DNA, 65 bp, Homo sapiens
caggatgggtgtcggccagcacctcaaacacctcctaatttgcattaccactgacacccttcttg

SEQ ID NO: 6758440 - DNA, 75 bp, Homo sapiens
gaggcatttggaattgtgtatagaaaacacatcatatgaaatactggtatcattttatagacagttccaagcatc

SEQ ID NO: 6758441 - DNA, 63 bp, Homo sapiens
agaggtaattactatgttcagattcctgggacctttccaggtatctgatgtataaatacctct

SEQ ID NO: 6758442 - DNA, 84 bp, Homo sapiens
tgctccagtggcttcttcttgggagctgcattctatgactttcctggactgcatgcttcccaagggcggggaccacgtcagtca

SEQ ID NO: 6758443 - DNA, 79 bp, Homo sapiens
ggaaggtgtgagggagggagagggaatgtcagctctagatgtgagaagacagacttcatatccttcctctgcgacttcc

SEQ ID NO: 6758444 - DNA, 129 bp, Homo sapiens
ttaaaattgcttgagggaacttgttataatgcagattcctgagtcctacctcctgagcttctgattcagtaggtctggaagctggagtccaggaatatgcattttaacaagctccccaagtgattttga

SEQ ID NO: 6758445 - DNA, 102 bp, Homo sapiens
ctctgaatcaaggtcatgtgtcagcatcctttgggacagtgcttacttttcatatagtgtctttcccgtttgaaggtgttttcactgatccgccttacagag

SEQ ID NO: 6758446 - DNA, 63 bp, Homo sapiens
acatgagggacgtaattctaaagagtactggccttgcaataactctttagatttatcttatgt

SEQ ID NO: 6758447 - DNA, 55 bp, Homo sapiens
attcagctgactttgattcatttataaataaaatgtaaagtagagtcagctaaat

SEQ ID NO: 6758448 - DNA, 78 bp, Homo sapiens
gcgaagtgtagtgggctgtgatcaggatgcagtctccttcctgcccatctctgtgccatcattgcccctgaactaggc

SEQ ID NO: 6758449 - DNA, 66 bp, Homo sapiens
gagttaaagaagtgttgtgtgggtttttatagaaatcaaaagtacatgcaattcttctgaaggctt

SEQ ID NO: 6758450 - DNA, 69 bp, Homo sapiens
aggcggactggactctcaggctcacatctcaaatatggcttgtgggtgtggttgtcctctctagagcct

SEQ ID NO: 6758451 - DNA, 56 bp, Homo sapiens
aaggtattcttgataaggcagataatgggtggaattatgctaatcaagaaaacctt

SEQ ID NO: 6758452 - DNA, 99 bp, Homo sapiens
gagatggagtctcattctgtcacccaggctggagtgcagtggcgccatctcggctcactgcaacctccaccttcagggttaaagcgattttcctgcctc

SEQ ID NO: 6758453 - DNA, 58 bp, Homo sapiens
agtatgttactcatggattgtttgggaaaactaaatacacgtacatgtgtaaaatact

SEQ ID NO: 6758454 - DNA, 68 bp, Homo sapiens
ttctggtaaaatgttacatgctcccacttaggacctctttttggattcatgcaggatttaacctagaa

SEQ ID NO: 6758455 - DNA, 103 bp, Homo sapiens
ggtgctatgtgtatttgatttttgttgtgaaagttgcattcactgtgtccctttatttgacatcagcaagatgtaatttctataaaccaattaatgatgcacc

SEQ ID NO: 6758456 - DNA, 66 bp, Homo sapiens
cacctccactcatcagtggttttaatcaagaggtatctcttttaaggaaactgtgagttgaaggtg

SEQ ID NO: 6758457 - DNA, 87 bp, Homo sapiens
atgaattataggacagttatgggttttatttatgctattgttgcatacttgagtagggcctttaaaatttgtacctgctatcctcat

SEQ ID NO: 6758458 - DNA, 96 bp, Homo sapiens
gaatttgatcctttggcagagaacctgggctttgtgaaggtcagttctcacaaccactaagagagtttgaggtttctgactaaagcttcactgttc

SEQ ID NO: 6758459 - DNA, 57 bp, Homo sapiens
gcccggccggagccgcgggggtgagtctagccccagctccgagctccgagccgtggt

SEQ ID NO: 6758460 - DNA, 72 bp, Homo sapiens
ttcaaggggacccaggactttgggacccccctgtgctcccacctggagggagtttcattcctgcccctagaa

SEQ ID NO: 6758461 - DNA, 65 bp, Homo sapiens
ggcttgtggtggctattctggtctcattgctaaatccatctggggtccagtgccaccccaaggcc

SEQ ID NO: 6758462 - DNA, 77 bp, Homo sapiens
cagttttgaataggggaaaagtgttgtctctagataaattagaatttaaagcatgctgcttttccattttagaactg

SEQ ID NO: 6758463 - DNA, 80 bp, Homo sapiens
tgcattgatagaaacagcaaaagacaagaacttaagccagctttgcctttgattttttgttgtattttccctatagtgca

SEQ ID NO: 6758464 - DNA, 61 bp, Homo sapiens
ctgtccgaggctctagatcaaggtgggaggttagtcctcactcccttcaggggctggacag

SEQ ID NO: 6758465 - DNA, 71 bp, Homo sapiens
caaagatgttaatagcaccatttcctgtcactaaccttcaagccaagaaaggaaaagttgttacatttttg

SEQ ID NO: 6758466 - DNA, 89 bp, Homo sapiens
gcggccagatcaggccaagctgccaggcctccgctgtcccccggcactggccaggaggggagcgggggccggccctgagaatgcgctgt

SEQ ID NO: 6758467 - DNA, 55 bp, Homo sapiens
ctcctatattgcttctgtcctgggtaactccaggcaaaacagatttgtatgtgag

SEQ ID NO: 6758468 - DNA, 76 bp, Homo sapiens
gtcctacattctttaggcaagaactcactgagaatgtttttagtctcacattctgccaaagagaaagtggcaggac

SEQ ID NO: 6758469 - DNA, 129 bp, Homo sapiens
agttaggggatgatctgaaattcaacctgtgccctgtgtgcagtggagcacagaggtctggtcactaccctgtactgcctctgcctccattgttagtctatctgctttgaagcctggttgtcccctgct

SEQ ID NO: 6758470 - DNA, 57 bp, Homo sapiens
tgatggtatgggattaccatgttataaatcaatgaggtgactgagatcatatcatca

SEQ ID NO: 6758471 - DNA, 57 bp, Homo sapiens
tttcctgtctcccaactgacattgatcataattcagtgcctgtgcggactcagggaa

SEQ ID NO: 6758472 - DNA, 95 bp, Homo sapiens
acctgcctgtgctatataacgagaaactgcatttatttatttcctttttctggagttagatgcttgtcagtttctgtcgataacagttgcagagt

SEQ ID NO: 6758473 - DNA, 67 bp, Homo sapiens
ggggtcttgggtagcatatagagctgggttcaaatcctgtctctgccctcattgctgcctggacctc

SEQ ID NO: 6758474 - DNA, 60 bp, Homo sapiens
gctctctggtcccacctggccatttatgccctggtcctgaatggggtgggtccaggcagc

SEQ ID NO: 6758475 - DNA, 64 bp, Homo sapiens
gagaagagggctcgatttggcaaaatgaccagctctcgtcatgttccagatacgccttttcctc

SEQ ID NO: 6758476 - DNA, 129 bp, Homo sapiens
attaagtgtgtgtatttttttcataattgagattttatttgttgtgttgaggatcagtatacagacatttcaatttgtatgcaattcttaacatacacactgaaaatctaaaaagccatgtattgtaat

SEQ ID NO: 6758477 - DNA, 81 bp, Homo sapiens
gtgtgtagccgtgcttactcatctctgagcctaccccagaaggcagatgtaaggaacagaagagcaatgcaggcaacacac

SEQ ID NO: 6758478 - DNA, 79 bp, Homo sapiens
ggggcggaggccagcgggaagcacctgcacctcttcagggtacatccgagcctgggcctggcttcccgccctccacctc

SEQ ID NO: 6758479 - DNA, 59 bp, Homo sapiens
gggctatagcactatgtatgggatccactttttccagttcatgcatacttgcatagttt

SEQ ID NO: 6758480 - DNA, 60 bp, Homo sapiens
tggtataaacagttactggagaacatggcttatgtcttcaggcaaataacttttatacta

SEQ ID NO: 6758481 - DNA, 60 bp, Homo sapiens
atgtgtggatatgtgtgtgtatatatttgtacctatgtatatgtatgcgtatacacacat

SEQ ID NO: 6758482 - DNA, 79 bp, Homo sapiens
atttacataaccagttctttgtgatggaaatttaggttgtttacagtctttttctattacaaatgatgctttagtgaat

SEQ ID NO: 6758483 - DNA, 71 bp, Homo sapiens
gaagagggtaggtgtcagaaagcccatctgagaagagctgcccactctcaggtgggcacacctcccttctc

SEQ ID NO: 6758484 - DNA, 129 bp, Homo sapiens
tatggattctgtgcaaaatgcctggtagagtgcctggcagttatattgccttagggacacatcctatgaattgctcccataggtagctatgaactctggtctgaatctgcataggcaagccagatcata

SEQ ID NO: 6758485 - DNA, 89 bp, Homo sapiens
tcctctcccccatcctttctccagaggtggctagagttgaaaaaacatttgtctctcagctgatcatctgggactgaggagaaagagga

SEQ ID NO: 6758486 - DNA, 64 bp, Homo sapiens
cccacctcactgtctgtactagctgattaggtccaaatcagccaattacagaacatgatttggg

SEQ ID NO: 6758487 - DNA, 71 bp, Homo sapiens
attccttggctcatggctcactcccatcttctaaaccagccatgataggttgagtcttttgcacaaggaat

SEQ ID NO: 6758488 - DNA, 73 bp, Homo sapiens
gaaagttctattggtaggggctgaggcatctccaaaggtagtctcagctcaccatactaagttaggattcttc

SEQ ID NO: 6758489 - DNA, 103 bp, Homo sapiens
ttcttcttgggcttttgggctttttctctccataaatattttcaggacaagtgagaattgtccttttggctgtctatggttagagccaaaagctagggaggaa

SEQ ID NO: 6758490 - DNA, 80 bp, Homo sapiens
ttagagttgcagtggcaagagggtctattgttgaagatcatctttgtgacattattttattcttgctatgaggattctga

SEQ ID NO: 6758491 - DNA, 80 bp, Homo sapiens
cttttcattcagtaagactttgagtgtttttgagccaggaaggcaagatgttagaggtcatgcagagtccaagagagaag

SEQ ID NO: 6758492 - DNA, 91 bp, Homo sapiens
ggcggggtctgggtgacaggttgaggatcctggcatgtggcagttcacaggctctgtagtcccccgtcctgcttgtctagcctaccctgtt

SEQ ID NO: 6758493 - DNA, 97 bp, Homo sapiens
atttttaaaatttgggttaaaattatcatgtacatctctagtaaattttgtatgtttcgtatgagaagaacaggtgactttggcccacagtgaaaat

SEQ ID NO: 6758494 - DNA, 85 bp, Homo sapiens
cccagttcaaaggccttattccagctaagagtcctggtccaaggtatattaggaccacagctacctgcgtggaagaggaactggg

SEQ ID NO: 6758495 - DNA, 103 bp, Homo sapiens
atatctatagtggggctatgatatgctacaaataaacttttacagtgagagatctgtgatatttgtgttgtagcatattataagcttgcaatcagataggtat

SEQ ID NO: 6758496 - DNA, 64 bp, Homo sapiens
tatttcatcaaaggataagaatagtatgattatatgagcattgacttgattctttgatgaggta

SEQ ID NO: 6758497 - DNA, 69 bp, Homo sapiens
ttaattggcagagacattggcaattacagaattacaatttgtttctttgctagtgtcttttttaattgg

SEQ ID NO: 6758498 - DNA, 77 bp, Homo sapiens
cttgttctctactgcctggagcattggtgctcaataaatattcattgagtaactgaaagccatgttgtaagaaaaag

SEQ ID NO: 6758499 - DNA, 94 bp, Homo sapiens
tcagtaataagattttggttcatttgaatgtaaatgctgcagctgagtatccagaagctgcgtttatttaaatccctatccaagatattactga

SEQ ID NO: 6758500 - DNA, 85 bp, Homo sapiens
gagacctagaaagttaatgcttgtctagatcttcttttcccaaaaagagatagaattcagtgactgcattttaattttagggctc

SEQ ID NO: 6758501 - DNA, 55 bp, Homo sapiens
tgattcctttaacggtgcaggaaattaatcctgcacttttataggtggggaaaca

SEQ ID NO: 6758502 - DNA, 77 bp, Homo sapiens
gaactccccctaacactggttctgactacacagcttttctaggagggctgaggttgccggtgtaagagaaggagttc

SEQ ID NO: 6758503 - DNA, 82 bp, Homo sapiens
tgtgcattttgtgatcctggctgaggtaactatgaataactctgtaagtatctagttatgtacctcaccaagacactgctca

SEQ ID NO: 6758504 - DNA, 86 bp, Homo sapiens
gactctaattcagttggtcacatgagtataaaacggcacccaggggctgttttgaactatgtaccaaactgaattctgcagttgtc

SEQ ID NO: 6758505 - DNA, 62 bp, Homo sapiens
ctgttagtcatatgtggcattttctaatctagtgataagagtctgtgtcattgtgaatacag

SEQ ID NO: 6758506 - DNA, 59 bp, Homo sapiens
tgccaataaactgtaaagagggaaaaaaaggcccctgttttctttgcagttacagggca

SEQ ID NO: 6758507 - DNA, 69 bp, Homo sapiens
tggatggattgacgaaggcagcaaagcctagcagtcacactgaagcagctccctgccgtcaaccaacca

SEQ ID NO: 6758508 - DNA, 87 bp, Homo sapiens
gcatgggacctgccatgtgatttgatgctgtctttcagaatcactatcagtggcccctgaggagcatcagccatggtaggtacatgc

SEQ ID NO: 6758509 - DNA, 57 bp, Homo sapiens
tagagtctcaatgaatagcctgctgaaattccaatggctttatcaaatgagaccctg

SEQ ID NO: 6758510 - DNA, 71 bp, Homo sapiens
gctgccagcctaggccaggggtgagcacttctgggcaagggcctgagctgccccctggcctgctctggtgc

SEQ ID NO: 6758511 - DNA, 82 bp, Homo sapiens
ttcaatggattgcaccttttaaaatgtgaacatccctcctagaggggaaagatcactttttagaatgttgtcagttattgaa

SEQ ID NO: 6758512 - DNA, 67 bp, Homo sapiens
aattctgtcttttgtatgcatgtcagagttataaaattatagctaaacatggatataggactgaatt

SEQ ID NO: 6758513 - DNA, 109 bp, Homo sapiens
catctctttactccatccattcatttgcccagtaagtcacaggttttcttcttgaatcactgactctcactggttagttgagttttaggatgattgaggaggagagatg

SEQ ID NO: 6758514 - DNA, 103 bp, Homo sapiens
ggatggggaggtatgttgaagcagcatgattgtaatactatggtcttctctcctacctcctagttccacagttttgtctgtattggaaatatcgtctccatcc

SEQ ID NO: 6758515 - DNA, 70 bp, Homo sapiens
cctgcagaacatagtggactttggcaaaaatgtcatggagtttttgggggagaactatgttcattgtggg

SEQ ID NO: 6758516 - DNA, 55 bp, Homo sapiens
gggtcttctgatataggtccagctcagcttgcttctagaccggcttcagaaacct

SEQ ID NO: 6758517 - DNA, 61 bp, Homo sapiens
cttcagcagatgtgctagagataggggcagtgatcccaaatagcatgttctctgcatgagg

SEQ ID NO: 6758518 - DNA, 74 bp, Homo sapiens
ggtgccagggctccattgctcatccttgagccacagaaagggccaagttcaggaattgcctggggcctgggatc

SEQ ID NO: 6758519 - DNA, 59 bp, Homo sapiens
acctgcaggggtgctctctgggacatctcattaaccgtgtcatcaaagccccctcaggt

SEQ ID NO: 6758520 - DNA, 84 bp, Homo sapiens
gatctcatccccagtacctgtggcttgttggatggaagcctttgctaggtttgccaatccactgcagccacagaggatgctatc

SEQ ID NO: 6758521 - DNA, 86 bp, Homo sapiens
ctggcaattgtccactgtctgccgagtggccttagaaacgccaccatagccattttcctggtagccaatgaaatgacagttcccag

SEQ ID NO: 6758522 - DNA, 58 bp, Homo sapiens
aaggtgtattgatttcagtggctttattgattttaggtctgttgaacctagacacctt

SEQ ID NO: 6758523 - DNA, 118 bp, Homo sapiens
gcaagtttgtgtcttctttttcttcttctttcttctcttttaataagactaataactagaggtcttagttaaaataatggagatgttgaaagtggatttgaaaatgcacggtagctgc

SEQ ID NO: 6758524 - DNA, 104 bp, Homo sapiens
caagttcacatgcatccttaattctccactctagaatttcaaatggaagttttaaacaatgttttggcttcttgtgaaatctgagaatccagtgtatgtccttg

SEQ ID NO: 6758525 - DNA, 91 bp, Homo sapiens
tcaaggccaagaatgactttctttaaaatatttttgtgaaaaaggaagaaacaagtaaatgtccttagagaaaagtcagtgcatggtgtga

SEQ ID NO: 6758526 - DNA, 75 bp, Homo sapiens
cccctggcccattcataagtaaatgattacctaattgtgaggttgggaatggaagacattatgatggggcagggg

SEQ ID NO: 6758527 - DNA, 58 bp, Homo sapiens
ctgaggctctttaaatcttttggatctacccaggttccaggagaattccagggcccgg

SEQ ID NO: 6758528 - DNA, 76 bp, Homo sapiens
gagtgggtgtctcaagaatgggggtccctccaggccaccattaccaagagttccccaatttgagtcacctctgctc

SEQ ID NO: 6758529 - DNA, 84 bp, Homo sapiens
agtcttgctctgtcaccgaggctggagtgcagtggcgtgatcttggctcactgcaacctccgcctcccaggttcaagcaattct

SEQ ID NO: 6758530 - DNA, 101 bp, Homo sapiens
agaaggaagagtagtgtgaatatttggttatggtcatggacacctggggaccagcctgtgtccttgcccatatttccaaaggtcactcttttttttttttt

SEQ ID NO: 6758531 - DNA, 57 bp, Homo sapiens
tcctgacccattatagtgacctgtggtttgaaacacagggtcctacagggctcagga

SEQ ID NO: 6758532 - DNA, 63 bp, Homo sapiens
aaaagttacagttggaactgtgaaaaagtggatacgcttattttacaccacctagtcattttt

SEQ ID NO: 6758533 - DNA, 72 bp, Homo sapiens
atctaggcatttattttccaagccaatgtcctgtcttattaaggtaccactttggaagataatgcttatgat

SEQ ID NO: 6758534 - DNA, 84 bp, Homo sapiens
cccagcagggtggcaagtctttctgcaacatttttggaatacaagcagaaagtgatttgctattccacacaaaacatgattggg

SEQ ID NO: 6758535 - DNA, 62 bp, Homo sapiens
catgagctaatcagaaagcaaggatgcttaattatgcatttaaacctcctgattcagctatg

SEQ ID NO: 6758536 - DNA, 73 bp, Homo sapiens
ttgatgggaagttctgaccatatggccaaggtaaaggaatcctaggagtttgaagtcagacttcattaatcaa

SEQ ID NO: 6758537 - DNA, 66 bp, Homo sapiens
gagctgtcaatcacttttaccaatcagctatttttgatagaagatcttaaaagctgactgcagttt

SEQ ID NO: 6758538 - DNA, 63 bp, Homo sapiens
cagatgtacatgaagggcaatgagaagcgcgtgcaaaaatacattctccttcaatgtgcaatg

SEQ ID NO: 6758539 - DNA, 63 bp, Homo sapiens
tcctgttatttgcacaacatgagtaaacctggtggacattatgttaagtgaaataggccagga

SEQ ID NO: 6758540 - DNA, 60 bp, Homo sapiens
cctggagtctgtgactttcctcatgcaaattgctctaaggtaaggtatcagaagtccagg

SEQ ID NO: 6758541 - DNA, 65 bp, Homo sapiens
gtgaccctggatagctactggccaggcgtcccgccacgcctcccagccatgttctccggtggcac

SEQ ID NO: 6758542 - DNA, 56 bp, Homo sapiens
gcacacaggtagagcatgcttttgtccttgaagaggataattatttacttttgtgc

SEQ ID NO: 6758543 - DNA, 56 bp, Homo sapiens
gctatcttgagagacaacacagcaatacctggtatgttgcaagttttcaagatagc

SEQ ID NO: 6758544 - DNA, 72 bp, Homo sapiens
agaaactcctaattctgctttaacagatgatggtgtgaatgtgtttagattatcatttttagagggatttct

SEQ ID NO: 6758545 - DNA, 62 bp, Homo sapiens
ttctcagggccctgtgttagctggcttctagctgagtttggctaatgggaggctctggtggg

SEQ ID NO: 6758546 - DNA, 70 bp, Homo sapiens
cagcacgttgtgggagctttgctattagatatcgtcaacagcatctggcaaaggcaaccacagttctttg

SEQ ID NO: 6758547 - DNA, 66 bp, Homo sapiens
gggggtattattacctagagcagacagcttagtgtctgtttcaaaacagtgataatttttattccc

SEQ ID NO: 6758548 - DNA, 60 bp, Homo sapiens
gagagctgggctttgggtgaagctggggaactggacgtgactcatccagaggccactctt

SEQ ID NO: 6758549 - DNA, 76 bp, Homo sapiens
tacattattaggctgtgagttacttgagaaagggacctccttttttatctacagattctcagctattagtaatgtg

SEQ ID NO: 6758550 - DNA, 70 bp, Homo sapiens
tggtaacaggatgataaaggatggccaaggataaaccttaacttttggtcaaaccagttatctgtaatca

SEQ ID NO: 6758551 - DNA, 63 bp, Homo sapiens
gtcattaaatatcaacctagactactaataattagaagtggttttaaaagatgtttgagagac

SEQ ID NO: 6758552 - DNA, 64 bp, Homo sapiens
ggggcagggatgaaggttggagtctccaggctgggcagggtcttcccaccattcctgcagaccc

SEQ ID NO: 6758553 - DNA, 75 bp, Homo sapiens
ggatggaaacaaagctggatgtagtaatcagctcagaataaatgaggctacatttcatgctctgtttttccatcc

SEQ ID NO: 6758554 - DNA, 89 bp, Homo sapiens
cataaaatctacattgagtatcaatcactggaatctgaaacttgagcttagattccagtccgtgactattcttgatttgtggttttatg

SEQ ID NO: 6758555 - DNA, 120 bp, Homo sapiens
gaagtgtgggctgtcttggcgttgccaggagacatcagtgggtgccatcgtgcccttcttagtttggaaggggcacaattgtacccaagtctctgagtgtgagcttaagtgccctgcttt

SEQ ID NO: 6758556 - DNA, 80 bp, Homo sapiens
tgagcacatttccaggactagcatttctgatagacttgacttgggataagaatgtttattgcagtgctgggctgtgttta

SEQ ID NO: 6758557 - DNA, 67 bp, Homo sapiens
cagccctcctaccctgccaggcacactcataaaaggcctggataccagacagggagggagaaggctg

SEQ ID NO: 6758558 - DNA, 56 bp, Homo sapiens
gatcaccatggccagtgcaaccagaaggctctctgggacacagggtcatggttatt

SEQ ID NO: 6758559 - DNA, 56 bp, Homo sapiens
agtgggagctcagctcctctgctgaaaggctttagggctagcattgagtacccact

SEQ ID NO: 6758560 - DNA, 59 bp, Homo sapiens
gtaaatcagtgtcattttagaatgagatactcagcttgcttctaaagtcactgaattac

SEQ ID NO: 6758561 - DNA, 91 bp, Homo sapiens
aaaattacctaacttgatgaggacagtgtacaaattcttgataatcagcaaatgttaagcagaaaatttgagcactgttttgggtattttt

SEQ ID NO: 6758562 - DNA, 72 bp, Homo sapiens
tgtctgtcatgcccattttcttctttgtctgaagcaatctcataccgacaaagtttgtggtattccaagata

SEQ ID NO: 6758563 - DNA, 59 bp, Homo sapiens
ttatgttcacctaggctgtcacaacagtactagctggagtatcagtttggtggatataa

SEQ ID NO: 6758564 - DNA, 70 bp, Homo sapiens
gcttcccgtggcctctaatgggattatgtgcttcccatggggagaaaaaccattgagaccatggaggagt

SEQ ID NO: 6758565 - DNA, 61 bp, Homo sapiens
gggaagactgctgcaaggctaaagccagtgaagaactggtaaagaagcaccagtcattcct

SEQ ID NO: 6758566 - DNA, 87 bp, Homo sapiens
ggactgtcccctgggaggtgcagcaaaaatcagaacggagacagaagctcacagtctggttttagctgccaactcctatggaagtcc

SEQ ID NO: 6758567 - DNA, 92 bp, Homo sapiens
cacatgggaattttaaagaattggagttgtgaaacagaaatgaaagcacaagaagcatttcctctgtacagcctctttattgttcattggtg

SEQ ID NO: 6758568 - DNA, 79 bp, Homo sapiens
gccaaatcaattcattgactggttcgttaagtacagccatattgtccaacacaacaatcacttaatgatagatgggggc

SEQ ID NO: 6758569 - DNA, 73 bp, Homo sapiens
acctacatgggccacctgctctgtttctaggcatccttacctggaatccaggaggagaggctcacctgtaggt

SEQ ID NO: 6758570 - DNA, 66 bp, Homo sapiens
gggagggtcctgccatctattttcagtctccagcccggtcttctgtcaagtatagcaggccctccc

SEQ ID NO: 6758571 - DNA, 109 bp, Homo sapiens
catgaccggctatgagcaatagaattcagtggatgtgatgctccaattctgaacttatcctcaagaagctttgcacacatcttgtaatcctgagctgcctgctggagtg

SEQ ID NO: 6758572 - DNA, 68 bp, Homo sapiens
catttgaacattctatggttgatgagttgatgtggaaacagcaaagaaaccagatagagtggacaatg

SEQ ID NO: 6758573 - DNA, 58 bp, Homo sapiens
gcctaggattgtaaaagagctttgcaaatgacataaagctatcttactttcctatcgc

SEQ ID NO: 6758574 - DNA, 56 bp, Homo sapiens
agattggggtccagactcctgagtgctccccatcagggctcgtgtttcccaactct

SEQ ID NO: 6758575 - DNA, 79 bp, Homo sapiens
ggatgcttattgagttctgctagcagtggtgcacttaaaccagcttgtactaacttctgagaaccaattgttagcatct

SEQ ID NO: 6758576 - DNA, 83 bp, Homo sapiens
ttccagctcttttactgctgaagttcagctccttttccatggggaaccatggagaaatggctgattttagcactgggcaggaa

SEQ ID NO: 6758577 - DNA, 58 bp, Homo sapiens
aggaatatatttggaatatgtgacgctaatctagcttattgcatccaaatgcattcct

SEQ ID NO: 6758578 - DNA, 73 bp, Homo sapiens
cagagttgcctggctagttagtgtcaggttcattagactagatgcatctctcctggcttgccagagtctctag

SEQ ID NO: 6758579 - DNA, 89 bp, Homo sapiens
gcaaaacaatgagtgggtggccggatgggagtgtcagagtcagactatcccggctccaactcctagctggcctctcaccagcagtttgc

SEQ ID NO: 6758580 - DNA, 73 bp, Homo sapiens
cccggtgtggtggtggatgtctgtaatctcagctacctgggaggctgaggcaggagaatcaccggaacctggg

SEQ ID NO: 6758581 - DNA, 74 bp, Homo sapiens
gggtatgcatttctggatctcccagcagtcctgaggccaggagtctggctggccatgtagagatgattgtacct

SEQ ID NO: 6758582 - DNA, 127 bp, Homo sapiens
ggatggtgtattcttagctttcatatttatcttgacccacaagcctgtggctttctgggtcactttgtccaaagcagagccagagcttgtcatgaggtatcagtgattagaggaggacgcattatcc

SEQ ID NO: 6758583 - DNA, 109 bp, Homo sapiens
gttcattgtcttttcaattctatcactttcccacttaatgtatttatttctttcacacataataagccttagtatgaggaaaggagactggcaggagagacaactgagc

SEQ ID NO: 6758584 - DNA, 72 bp, Homo sapiens
gaagtagagtcaaaactgtctagagagagaaggaagctgacccttgcctctgctaatggtttctgctgcttc

SEQ ID NO: 6758585 - DNA, 59 bp, Homo sapiens
taggacttggtttgaagattttaattcctgtgcgtggtaagatctcactccaagtccta

SEQ ID NO: 6758586 - DNA, 64 bp, Homo sapiens
gctggctctgtggcttccttcatggaccctcaagaggccagagggctgctgcacagtgctcagc

SEQ ID NO: 6758587 - DNA, 105 bp, Homo sapiens
ctataaaagtcttaaaagtattctactctaaattcctccctttgcacaagagggagctgaagtaggggtaaatagaatgctgtcacaaagatacacatttaatag

SEQ ID NO: 6758588 - DNA, 58 bp, Homo sapiens
atttctttccatgagcctatgtacccatttctgttgggtatattcctaggagagaaat

SEQ ID NO: 6758589 - DNA, 62 bp, Homo sapiens
tttcagagctcagcagctagagtccttgcttaattatactcctgtcagctggaactctgaaa

SEQ ID NO: 6758590 - DNA, 91 bp, Homo sapiens
gacagtttcaccagaggccccggggcagagggtcttctccagctcttccagggcggggctcatctgttcctgggccagaggtggacctgtc

SEQ ID NO: 6758591 - DNA, 79 bp, Homo sapiens
gttgtttataaattacccagtctgtggtattctgttgtagcagcccaaacagactaagacgtgggtgaatttaaatagc

SEQ ID NO: 6758592 - DNA, 72 bp, Homo sapiens
aaagaagacaagccttgtttttctgcatctggaaatatgttatagaaaacccagggtttgattttcttcttt

SEQ ID NO: 6758593 - DNA, 57 bp, Homo sapiens
ccctggccagggcacagggaggggagctgttacctttccttagcctgccttccaggg

SEQ ID NO: 6758594 - DNA, 88 bp, Homo sapiens
catcttgcaaaggggaataaagcaatttggtgggtttgactggtgttctgattgtcctttacttcctcttctctgataatgcatggtg

SEQ ID NO: 6758595 - DNA, 69 bp, Homo sapiens
gcctggagaattaaaaggaagggcacattattacgtctgcctctatttggtcttttggctctcttaggc

SEQ ID NO: 6758596 - DNA, 68 bp, Homo sapiens
ggctttggctagaatctgatggcccgtctgggctcaggctgagcccgtcggttccaggaagccaagtc

SEQ ID NO: 6758597 - DNA, 62 bp, Homo sapiens
tgttattttgtcagtgtggagaatagttcaaaaagggcctttgctcacattataatgtaaca

SEQ ID NO: 6758598 - DNA, 68 bp, Homo sapiens
actatgttggccaggctggtctggaacgcctgacctcaagtgatccgtccgcctcggccttccaaagt

SEQ ID NO: 6758599 - DNA, 71 bp, Homo sapiens
tgacttcataggaatgatattttatctcacctaaaaagaggcttggaggtatgtggttccatgatgagtta

SEQ ID NO: 6758600 - DNA, 71 bp, Homo sapiens
gggacaaataggtcaacaggagggattggcgccgtgcatgtcataaaacccctccaggcctgtcatgttcc

SEQ ID NO: 6758601 - DNA, 62 bp, Homo sapiens
ttaagagcactgaagtcttcttaggaaagggatgtgggtcttgggaaacttgagtcttttgg

SEQ ID NO: 6758602 - DNA, 78 bp, Homo sapiens
ctcttacaagatcttggctgaagtacaggggccaaagtttaaatccttgctctcaaccatgttaggattttgtaaaag

SEQ ID NO: 6758603 - DNA, 69 bp, Homo sapiens
tagggaccaagtggctttaagaactggattaaagttgatccagtgcattcagacacttggcattccctg

SEQ ID NO: 6758604 - DNA, 57 bp, Homo sapiens
cacaagtttttactgcattcctctgacctcttctggggtgtcagtaaatattatgtg

SEQ ID NO: 6758605 - DNA, 71 bp, Homo sapiens
tggctgacttatgattcaaataggatcttctttgtcccaattaagcaagcctacttgaacaaagatagcta

SEQ ID NO: 6758606 - DNA, 62 bp, Homo sapiens
tgatgccagtgcttagaccattaagatcattttaaatggttaaaaatggggcagtggtgtca

SEQ ID NO: 6758607 - DNA, 60 bp, Homo sapiens
cagggaaagggatgcagtaaaatgatttgaaaacattttaatttattcacctttaccttg

SEQ ID NO: 6758608 - DNA, 62 bp, Homo sapiens
gacagaactcttcaggagcgtatcttttgcaagaaaggagatacacctgtggagtgtctctc

SEQ ID NO: 6758609 - DNA, 66 bp, Homo sapiens
ctaatagagcttcggaactctgttgtgagcaatttggaaattcacatcgagtttcgggttcattag

SEQ ID NO: 6758610 - DNA, 63 bp, Homo sapiens
ctgaagaacacctgctgcccagtggcaggtgttcccagaccactgggcagcaggtgttcccag

SEQ ID NO: 6758611 - DNA, 56 bp, Homo sapiens
gggtgagggcctgggtgctccagatggctcagtgcctggcaggactggctccaccc

SEQ ID NO: 6758612 - DNA, 86 bp, Homo sapiens
ctgagctgaggagtttgcaacctgctgtaggagcaatgctcaggcttcttacatgcaggtcagactgcatttcagcaataactcag

SEQ ID NO: 6758613 - DNA, 71 bp, Homo sapiens
tggagccatccccaccctccctgtgcacatttgctgggagtttgacagggacagtggagatggaacagcca

SEQ ID NO: 6758614 - DNA, 56 bp, Homo sapiens
gcagatcagagaatgtgctgggaataacgtaatctgcattcaaatcctgatcctgc

SEQ ID NO: 6758615 - DNA, 58 bp, Homo sapiens
tgtttcaccttaagagacaaacgtgggttgaaaggatgtgtttctttaaggtgagaca

SEQ ID NO: 6758616 - DNA, 83 bp, Homo sapiens
cagtgtcctgtgagggctatagggcagggccctgccccagcggatgggctcgggagggggctccctgaagccagtggacactg

SEQ ID NO: 6758617 - DNA, 65 bp, Homo sapiens
gagtgggcctggggggagcaggctggcagatgtgcagccttgcctcctcccagcagcaacaattc

SEQ ID NO: 6758618 - DNA, 56 bp, Homo sapiens
gaacgtgtggggcttggacagcatagctactgttgctggctctgccccacctgttc

SEQ ID NO: 6758619 - DNA, 69 bp, Homo sapiens
ttttagccgagtaaatgctagccctttaaagttgatatcaatactttgggaagctgcaattgcctaaaa

SEQ ID NO: 6758620 - DNA, 62 bp, Homo sapiens
gagaaagagactatggtgtctatgaatatcactcactttcagggatcctatagcttattttc

SEQ ID NO: 6758621 - DNA, 88 bp, Homo sapiens
aattttatgccaagatccaacaggacaaagaaaggacatgttagcccacatttcctttgctcttggttggatttataggtgttctatt

SEQ ID NO: 6758622 - DNA, 74 bp, Homo sapiens
ggtcatttgccaattcagcagttcctgcttcagtgccttgtgacatcaggcaggatgctgtctgaagaatgatc

SEQ ID NO: 6758623 - DNA, 73 bp, Homo sapiens
ctccagagtccttgtctgattgctgtggcgctgagctatgccagggccctagggaatgagacattacgtggag

SEQ ID NO: 6758624 - DNA, 85 bp, Homo sapiens
cttctctgtgtttcccaagtcctctccaggaggctctgatgaacgtctgtctggtcttgctgccctgggaggctgcacagaggag

SEQ ID NO: 6758625 - DNA, 55 bp, Homo sapiens
gaacagcctcaataacatccttataggagacaggatgattttctgagggttgttc

SEQ ID NO: 6758626 - DNA, 62 bp, Homo sapiens
ccatctcatcagatctgtataagcagctataatttaagccaggccagagttatgatgagagg

SEQ ID NO: 6758627 - DNA, 115 bp, Homo sapiens
tgcatctcttacatttttaatctacagtaaaacatttttattaggaatctatgtttttaattaaacagaacatttaattaaggtgctttttaagtgggtgaaacaattaagtgca

SEQ ID NO: 6758628 - DNA, 57 bp, Homo sapiens
tggtaaaatgacactaaacatagcccctcagggcaggtgtggagtgttattttagca

SEQ ID NO: 6758629 - DNA, 68 bp, Homo sapiens
gccaacctctcctggccgggctgtcccctggtaaaatgaggtgggagcactggccagcagatgagggc

SEQ ID NO: 6758630 - DNA, 94 bp, Homo sapiens
ttctggagcctgcagagacaagggatcgtcttgcaagcagagagagcagccctcctcagccagtgccttgatcttgccttcccagccttcagaa

SEQ ID NO: 6758631 - DNA, 59 bp, Homo sapiens
cagtaaatacatatcagagaagcaggaacatatgtgcttctctgatacgtgctttattg

SEQ ID NO: 6758632 - DNA, 75 bp, Homo sapiens
tgcagagagctgcacagttaatatgtgacagaactagtcaaacctagttctcaagacaattacctgtgtagtgca

SEQ ID NO: 6758633 - DNA, 56 bp, Homo sapiens
tgttttgtagctaatagctatttgtactaatatttgtagctaatagctacgaaaca

SEQ ID NO: 6758634 - DNA, 88 bp, Homo sapiens
cagtggcttagagcgtcactaacattatattaattctggtttcaacattaactagatgtgttcagttggtgcagctgctaaacttctg

SEQ ID NO: 6758635 - DNA, 76 bp, Homo sapiens
gactctgctgttcattattgttgtgtagtgcagtggcttacagatagcaacataacaatcataggacatagcagtc

SEQ ID NO: 6758636 - DNA, 109 bp, Homo sapiens
ggtgcttcaagaagggcctctctgagagagctgagggcaggatggggtgaccagctatcctggtttgcccagaactgtcccagttttagcactgaaagtcctgggcact

SEQ ID NO: 6758637 - DNA, 72 bp, Homo sapiens
tttggctggctagtgggcaggattatgtctgagaaaacctccttttaatcaatctgatgcttgccagccaag

SEQ ID NO: 6758638 - DNA, 85 bp, Homo sapiens
gcggtgacatcagggcccagtccctgctgtcatgccccaggtgacgtgctgggctgacagcagggctggccgctaacgtcactgt

SEQ ID NO: 6758639 - DNA, 78 bp, Homo sapiens
gagacccatcccaagagattctagccccgtagatgtgtggcagggctcaggctctgggattctgatgtagttggtctc

SEQ ID NO: 6758640 - DNA, 130 bp, Homo sapiens
ttgttacatctgcctgagaagtctttgggctaatcacaaatttagacagagctgaattcttcaatctgtcttcttttgtggttttgtgatcctagaaggctctcgggggtaaagatccagaagtatccca

SEQ ID NO: 6758641 - DNA, 79 bp, Homo sapiens
aagatgaaactggggtgaggtacctctgggtcactgttaagaagtaaaatgtagaggctcttcattgcagtagtatctt

SEQ ID NO: 6758642 - DNA, 76 bp, Homo sapiens
gcctccagctctgctgtacttttgcaggtcacagcccgtgcacggtgtttggtttgcagtacaggagtctgtgggt

SEQ ID NO: 6758643 - DNA, 59 bp, Homo sapiens
tgcttcatggaactgtataaaggcacttgctacataggctagtggcagatctggaagta

SEQ ID NO: 6758644 - DNA, 79 bp, Homo sapiens
ccagagctgactttgtggtggtgtcagatttgctgtctggagcagtgctgatcccatggcagagagagaagagctctgg

SEQ ID NO: 6758645 - DNA, 59 bp, Homo sapiens
ggaaggaaagtctggttccagttatttcatcatggttggaagcagaagtttcaatatcc

SEQ ID NO: 6758646 - DNA, 78 bp, Homo sapiens
tggaaatctgaataaattagggactttagttaataacaatgtattgatatcagtttgctgattgtaacagatgcgcca

SEQ ID NO: 6758647 - DNA, 96 bp, Homo sapiens
attgtgttgtgacttgaggcattttaagatgctctgcaggctttttattagatttctgcagtttctgtaaaccttgccttcagtagcccccgcagt

SEQ ID NO: 6758648 - DNA, 71 bp, Homo sapiens
tcttatttgatcaggaaggagagggatgttgctcaccctcagcttcttggattaatccagcatttatagga

SEQ ID NO: 6758649 - DNA, 67 bp, Homo sapiens
aggaagcttgctcctacctcatagcaggcttatcagaggctgtttatagcagagcaagcctcttcct

SEQ ID NO: 6758650 - DNA, 106 bp, Homo sapiens
ctgaatgtttgtgaaggtgttgacccatggatactaaggtatgtgaaaataactcacacatctcaggtgtttaatgaggatcaataacaatttgtgggcccatcag

SEQ ID NO: 6758651 - DNA, 87 bp, Homo sapiens
tcactcaacaaaagctgtgctaggctaggggatggagtagcaaacaaaattgaaattctaaagcttgtggagcttatgttctagtgg

SEQ ID NO: 6758652 - DNA, 70 bp, Homo sapiens
cagaggaaatgccttggcgctgctggtcctccctgacccggggaaaatgaagcaggtggaggctgctctg

SEQ ID NO: 6758653 - DNA, 71 bp, Homo sapiens
gtgtggtctagctgcttctcacatgggcaactctgtgcagtctgcgttattgaaaagcagccagattttat

SEQ ID NO: 6758654 - DNA, 77 bp, Homo sapiens
cacaaagctttttaggaaatgctccattgcataaagagagatgttcttgtgctagctaatttcctctcagctttatg

SEQ ID NO: 6758655 - DNA, 63 bp, Homo sapiens
tgggcaggtgctattttccatggtcatttttgtcacttgacttcataaatatttacttgctta

SEQ ID NO: 6758656 - DNA, 65 bp, Homo sapiens
ccttagatcaggctgtctagggaaggactgctagctcccatccccagacggatcttatcctgagg

SEQ ID NO: 6758657 - DNA, 91 bp, Homo sapiens
acagaggcctcagcccttctcacacagttctctgaagcttgaatatcccctcagacctgagctgaattgaagcaaggagctcggcctttgt

SEQ ID NO: 6758658 - DNA, 66 bp, Homo sapiens
gttcactgtagtgagcagaatatatttccccatcccaatgagatattaatgaacatgacagtgagc

SEQ ID NO: 6758659 - DNA, 63 bp, Homo sapiens
aagacagagaaagggtgaattccttctcccttctggagcagggctatttctttttctgctctt

SEQ ID NO: 6758660 - DNA, 59 bp, Homo sapiens
gattacaatgagaaatggttggcaatgatatttcagctgtcatttatcttatagtaatc

SEQ ID NO: 6758661 - DNA, 109 bp, Homo sapiens
ggggggcaaggagctaatgactgcaccttgggaagcgccagttgggtaattaattcacagttctgagctttcccagaaggaaaaagataaattgttcacttgcactccc

SEQ ID NO: 6758662 - DNA, 72 bp, Homo sapiens
taagactatacagtatgtacgtgcacacacacacactgtcatgtgcacagaaacatacaatgtgtattctta

SEQ ID NO: 6758663 - DNA, 78 bp, Homo sapiens
ccagagattgctaatagtgagagggtcccaaaagatgagaagaaggtgtccaatcacactcattagtcatttctctgg

SEQ ID NO: 6758664 - DNA, 62 bp, Homo sapiens
atctattctactcacaggaagggtttcccaatttgttaaagaaaccctctctgtagaaagat

SEQ ID NO: 6758665 - DNA, 118 bp, Homo sapiens
tggagagcaaatagcaagttattctggcagtgaaatagggcaatggactacaaaaggtataacttcaaatgtatcttttccaactgcttttgtctttgttttgttttgtgtaccttca

SEQ ID NO: 6758666 - DNA, 64 bp, Homo sapiens
gatgctgtacttggctttggaaaacacaggggtctggcctgtgagctgctcaggtcagtctgtc

SEQ ID NO: 6758667 - DNA, 56 bp, Homo sapiens
agaagtcagcctcattgaagccactgtaacagatggcagatacaggcatgacttct

SEQ ID NO: 6758668 - DNA, 77 bp, Homo sapiens
ggtgtgagattttccagcatgatgctcacacaaaaccccgaatgtgaggttgggggtgagtacagcatgctggcgcc

SEQ ID NO: 6758669 - DNA, 102 bp, Homo sapiens
tccacacaggtgtccagggcttgtctggagtctggtggttatggtgtcactgcccggaagcacgacccccaagcctccagccgcagccccagcaggtgtgga

SEQ ID NO: 6758670 - DNA, 73 bp, Homo sapiens
agtgtgaggtgaggagagaagcatatttagacctctgatctttttcctgtgcttctctttctcacttaaatct

SEQ ID NO: 6758671 - DNA, 126 bp, Homo sapiens
aaggtcttcagagaccacctgggtctacccctgctggcaccgatgaaagacagtgcttcattgtgtctagcgctggtgctcaggctagggattcaggccctttgttccaaatatctgtatgacctt

SEQ ID NO: 6758672 - DNA, 129 bp, Homo sapiens
ttcttttataagggtgccaaattctagacagcaggagccttcatatgctgtaattatgtctgtggtaatcttatatttagagcatgaatgtttctgttgtaattttaaggcagtaagaaggtagaggga

SEQ ID NO: 6758673 - DNA, 58 bp, Homo sapiens
acaaacacagtttctgcattggtagtgtaaagcataccttgttaggaacgtgttttgt

SEQ ID NO: 6758674 - DNA, 61 bp, Homo sapiens
aaatgcaagatcacaccaaacacgtgccatcacaatttgtgttagatttgatcttgcattt

SEQ ID NO: 6758675 - DNA, 79 bp, Homo sapiens
ttttgaatccagggttgtttgagctagaagagcctctagagcttttgatatagcaagaagtagctctggattaacagag

SEQ ID NO: 6758676 - DNA, 107 bp, Homo sapiens
tccaagttcagatctttgatcagagtttataacatcaatcagagttaatagtctgatgatttttgtcactctataatgttttcagctttcgaggcatgaattatgga

SEQ ID NO: 6758677 - DNA, 55 bp, Homo sapiens
tgacacagtatcaaacatgatttcagatgaaatgggtggtgttaatattgtgtta

SEQ ID NO: 6758678 - DNA, 59 bp, Homo sapiens
tgagccaagattgtgtccctgcactcaagtatgggtgacagagtgacactcttgtctca

SEQ ID NO: 6758679 - DNA, 74 bp, Homo sapiens
ggtgtaagcagtctagggtgtataaggaagcctcacacttttggggctcttctggcatgctgctctgctgttcc

SEQ ID NO: 6758680 - DNA, 59 bp, Homo sapiens
aagaaaagctattttattgcagctctttcccaagagctgttctgggaatggctggtctt

SEQ ID NO: 6758681 - DNA, 56 bp, Homo sapiens
cagcatgagctttggctgagcctcttccaggaggaagagcccagggcttgatgctg

SEQ ID NO: 6758682 - DNA, 81 bp, Homo sapiens
tggaatgaaggagatggcctttctacaccaggtgcacattcattctctgttagtcaaaaagggtccatagctatcattaca

SEQ ID NO: 6758683 - DNA, 66 bp, Homo sapiens
ggtggtgtcaaacattctagctgttctgattttcaattagtttcattgagatgtttgctacccact

SEQ ID NO: 6758684 - DNA, 66 bp, Homo sapiens
tgcagcacattcccacctgtacttctgtttatctaattgaaaacatggagggaatttagtgaagca

SEQ ID NO: 6758685 - DNA, 85 bp, Homo sapiens
gtggctgcagcaagaagtccctgtggggtggaggctgtttggagccagcagaagcctctacacccagcaggtgcttaggagccac

SEQ ID NO: 6758686 - DNA, 62 bp, Homo sapiens
cccaatcactgccatccaagcagccatctcatatggcagcagggaggccagtgttccctggg

SEQ ID NO: 6758687 - DNA, 78 bp, Homo sapiens
aggttttgaatagtgtcccagtttgcagccttggctgaatataatcccttggctgcaaactgggatactattcaactt

SEQ ID NO: 6758688 - DNA, 100 bp, Homo sapiens
ggatggggctaaggcagggtttctctgtgggagcttaccccaagattgccctgggtagcagcagggttcctatggaggcaagtttggtaagagccagtcc

SEQ ID NO: 6758689 - DNA, 75 bp, Homo sapiens
ggcaggaaggccaagatcaaggtgccagcagagttggtttctgctgaggcccctctcttgagcttgcggactgcc

SEQ ID NO: 6758690 - DNA, 71 bp, Homo sapiens
agagccagcaagtgaatagtgacaaaaggcaagacattcataactaggcccacagtttacttaatgcctct

SEQ ID NO: 6758691 - DNA, 58 bp, Homo sapiens
gcttttgatgaaaggcagccattttgtaagcaagacattgctgcttttaattgtccgc

SEQ ID NO: 6758692 - DNA, 73 bp, Homo sapiens
ggtgcctgcctgggctcacttgccagcatcctgcaattagagagggacctggccagcctcccaggtacccgct

SEQ ID NO: 6758693 - DNA, 98 bp, Homo sapiens
gcttagttagaatctcggccgctgcccaggggagtgctgtcgggaaagatcaaccaccaccgcaaagcggccctctgggcacactgcctgagctgggc

SEQ ID NO: 6758694 - DNA, 58 bp, Homo sapiens
gccagtgtgtcttgcaggctcccctgcctctcgcagtggagcagagcttacagctggc

SEQ ID NO: 6758695 - DNA, 130 bp, Homo sapiens
gcccaacagaactacctggagagtgcttattttatttatattcgttgaaattcagatctgaaggctctgcgagatctgagctagaaagtatgccctagaaatcagcattcaagtagtgtgtactttgggc

SEQ ID NO: 6758696 - DNA, 84 bp, Homo sapiens
gtcaatgaatgtgtgttgttacaagctgccaggttaaagataatttttaatgcaacgtgagataattaacacaaatctattgac

SEQ ID NO: 6758697 - DNA, 72 bp, Homo sapiens
cgccagtcccaagagccgccagaccttcgcacgcgcagcgcgcgctgtgggagggaaggcgcggccctggcg

SEQ ID NO: 6758698 - DNA, 63 bp, Homo sapiens
gaagggctaaaacatggttttgaaatccagtgattacactttggaaacctgttttagctgttt

SEQ ID NO: 6758699 - DNA, 64 bp, Homo sapiens
gttttgtgggttttaccctgaataggccagggcaatggccagtggagactgaaacccattccac

SEQ ID NO: 6758700 - DNA, 66 bp, Homo sapiens
aaaaactcatcaaaggctgcaaagctgtaagtggcaccgcttgcattgttttcctttagggttttt

SEQ ID NO: 6758701 - DNA, 83 bp, Homo sapiens
gggcagggggctgagtccagggacagaggcgttcccaggaggaaggggcacaaactctgcacctgtgattccaactcatgctc

SEQ ID NO: 6758702 - DNA, 75 bp, Homo sapiens
catcttggctttgaaatccagtcattaggtgagaaacccctggactaaaaactgtctttcctaaagcaggagatg

SEQ ID NO: 6758703 - DNA, 78 bp, Homo sapiens
agtagggcccaccactgtagagatttgaatgccatacaaggatggtgtattttatcctatcagagagacagtcctatt

SEQ ID NO: 6758704 - DNA, 91 bp, Homo sapiens
tttctgtatatctctgtgatacaaataaacatatgctcattctattagccaagtatttgtggatttgtattggtgaaataaaatatagaaa

SEQ ID NO: 6758705 - DNA, 67 bp, Homo sapiens
cttttagctgtttccatggcaaccaacacccagaccatttagttgctagtcaactgacagctgtaag

SEQ ID NO: 6758706 - DNA, 116 bp, Homo sapiens
gaaatgctgcttctccaacttgctgattcatgtcttcctggagcagatgggttggctatttttgcccaaggtctaggagacattgatcccaagaaaacatgcacttaaggcatttt

SEQ ID NO: 6758707 - DNA, 71 bp, Homo sapiens
ctgatggccatcctgccacctgcacagctcccttccaggactcagggagctgttgaaggtgcagggcccag

SEQ ID NO: 6758708 - DNA, 91 bp, Homo sapiens
ctccaagggtaaaggtaaatctgtacatttgtgttgtgaatttcctggaggttcaaattgagatggtataaataccacataacccatgggg

SEQ ID NO: 6758709 - DNA, 66 bp, Homo sapiens
aagtttgggaagttctagggtaaacaaagcaaagctagtttctgtgctgcccaacttctcaaactt

SEQ ID NO: 6758710 - DNA, 61 bp, Homo sapiens
tcttggaagccctggattaaagatgccagaatcgcaaggtggcaaaatcctgggtctatga

SEQ ID NO: 6758711 - DNA, 81 bp, Homo sapiens
gtaacctcaaagacttcctcctttacatatctggtggttaatgctgggaccagataaagggaggtccctctgttgttttgc

SEQ ID NO: 6758712 - DNA, 65 bp, Homo sapiens
ggtggatagccttggctttgggcagttagctggagcaccagccggcaagctgagggctgtccacc

SEQ ID NO: 6758713 - DNA, 108 bp, Homo sapiens
tgtgagcttgcattgcagtagtttaccaccaaggcaagaactgcatgctatctaagtttaattgcctttaagtataactgctgcaagccttagtaattatagttcaca

SEQ ID NO: 6758714 - DNA, 77 bp, Homo sapiens
agaatactcaatttgttggaaagcatgtaggttagcaaatttcaattcctgtgttcttttaatcatattgaaattct

SEQ ID NO: 6758715 - DNA, 58 bp, Homo sapiens
tgtgtcatgtgtgaggctcccttcttggtccttggctggctgtatcagataggacaca

SEQ ID NO: 6758716 - DNA, 76 bp, Homo sapiens
caggcagccagaggggcctggcactgagctggcacggaggagaacggccctgctggcccaggcccctcgctgtctg

SEQ ID NO: 6758717 - DNA, 64 bp, Homo sapiens
actcaggatgcagtgggacccaggggagggacactgagcctcaccctctgggctgcatcttggt

SEQ ID NO: 6758718 - DNA, 76 bp, Homo sapiens
aatctactgacatctctgtgggttcaggttcctcctctgtataggtgacctacctcttagagttgtcgggaagatt

SEQ ID NO: 6758719 - DNA, 72 bp, Homo sapiens
aactcacaagaacccttggttcatcccagagggtctattctgctatctgtggactcaagggatcacagagtt

SEQ ID NO: 6758720 - DNA, 56 bp, Homo sapiens
ggtctctttgcttcagctacagctggctgtttgctgcccctcaagcagatgaaacc

SEQ ID NO: 6758721 - DNA, 55 bp, Homo sapiens
ctggatggctgcacctagccctttctgcttgcagatatagcaggttagtttccag

SEQ ID NO: 6758722 - DNA, 82 bp, Homo sapiens
aacagatccaaacagataagggacaatttcagctaggacatgtcatttgaattttgttgtttgttttcgtcttgtttttgtt

SEQ ID NO: 6758723 - DNA, 80 bp, Homo sapiens
gtgcattttgttttcaggaaatgtgcaggaatagcattatcagaaatcaatcccccatgtttccttatagataaaagcac

SEQ ID NO: 6758724 - DNA, 122 bp, Homo sapiens
aatgaataagctaagcagagttgataattgatggctggctatatcaggggaccccttctgctggaaggagtttgttgaataggttaaacattactctcttaattgtgctagcacaattcatt

SEQ ID NO: 6758725 - DNA, 91 bp, Homo sapiens
cttgccaagcatataaagaacaactttcttggatcttctctaagattgctggagaaagaaagggaagtttgtttttagtcagtaatgtaag

SEQ ID NO: 6758726 - DNA, 77 bp, Homo sapiens
ttcctttcacagctgtccagtgtgtcgtgctggagacttcccacagcttgcctgccactacagctgaagaataggaa

SEQ ID NO: 6758727 - DNA, 86 bp, Homo sapiens
cagagtagtggagtgatatactttataaaagcattttcccaaaattacagaaacaggctgaagtttatgtcttcttttctgctctg

SEQ ID NO: 6758728 - DNA, 127 bp, Homo sapiens
tgtggagaaactggaaccctcatacactgctggtggaattgtaaaatagtgtggccgctttggaaaacagtctggccattcatcaactgatagccatagagttaacatatgacacagaaattccaca

SEQ ID NO: 6758729 - DNA, 74 bp, Homo sapiens
attgaattaagggctatgttttcaaaatcccaaatttattcttctgaggcccagtgaaggccctataattcaat

SEQ ID NO: 6758730 - DNA, 68 bp, Homo sapiens
ggcttcactgtaatgttttagcaggtctgtggagagcagatatatcaccttctccattacagtaagct

SEQ ID NO: 6758731 - DNA, 68 bp, Homo sapiens
cccacacaggcaaaggatgatgtttgtaaatctaattacattgaatttcacttttgtacctttttggg

SEQ ID NO: 6758732 - DNA, 124 bp, Homo sapiens
ttccataaactttccttagctttaggttatacacagggttacatctcaagtggagtcttgtctgcctgtttactagaccactttagagattgttcaaacccaaatagccaggagagagatggga

SEQ ID NO: 6758733 - DNA, 55 bp, Homo sapiens
gatgagtttgcctggcctgcagctgggaaaggctggttgttagggaagattcatc

SEQ ID NO: 6758734 - DNA, 61 bp, Homo sapiens
atcgctgggtggccgcggcggcgacagcgtcctgcgcctcgccagcctgtttacctgtggt

SEQ ID NO: 6758735 - DNA, 74 bp, Homo sapiens
taggtaggcagtcactagtaaatacaggtgccagagaacatggcagcctggagactttgtgaaatggctgctta

SEQ ID NO: 6758736 - DNA, 63 bp, Homo sapiens
ggcagcctctgccatggcttcagcctccatggacaatcctggcactggggctttggtactgcc

SEQ ID NO: 6758737 - DNA, 93 bp, Homo sapiens
tcttgtgtgaaacaattatcatatacattgcaaaatagaatatgtataaatgtttccgtgtatatgtgtagatgggtttgtgtgtatgtgaga

SEQ ID NO: 6758738 - DNA, 58 bp, Homo sapiens
agttggcaggctgcaccaaccagcctcttagggcagaatgggcctgagcctgtgggct

SEQ ID NO: 6758739 - DNA, 97 bp, Homo sapiens
gctcagagttcactgttctctttctgtttcatatgctcaggtgtgttgctaaacatgagatgctgggaaactgaaaggaatacgtaagaaagatggc

SEQ ID NO: 6758740 - DNA, 59 bp, Homo sapiens
tcgacaagtgcctaacccagtgcctggaacacaacaggcttgcaatggacacatgtgga

SEQ ID NO: 6758741 - DNA, 81 bp, Homo sapiens
caatagttttagcaacaattgatgattcttatgtgaaacattatttctgtgttgcttatcaaatgagtgctgagactcttg

SEQ ID NO: 6758742 - DNA, 65 bp, Homo sapiens
cttggctggctgcagtcctgatattatgaaacagaattgatttgcaaggatttgagccaggagag

SEQ ID NO: 6758743 - DNA, 55 bp, Homo sapiens
agttcttgagtgcttaccatacagaagacactgtgctaagtactttacaagtact

SEQ ID NO: 6758744 - DNA, 84 bp, Homo sapiens
gtatttgtttagaaatgtgcagaatgtgttagataaaccaatcaatatctaattactagtctgcagccttctctattttaatgc

SEQ ID NO: 6758745 - DNA, 81 bp, Homo sapiens
agtaaatgtttgttaaatggatgcagaataagatggtgttttaatattgcagtacatttctagaataataaacatgtgact

SEQ ID NO: 6758746 - DNA, 69 bp, Homo sapiens
acctagggtagttcgattatatgcagagctgttttattcattgttaatcctgcaatcagctacccaggt

SEQ ID NO: 6758747 - DNA, 75 bp, Homo sapiens
cctttgaccctctgacctctctggaaatgttcgcaggactgtgcttgcatcatcttgagagtcctgggttaaggg

SEQ ID NO: 6758748 - DNA, 97 bp, Homo sapiens
ggcttcggcactttcccagtggggaccctggcaccagagccctcccctaacccgccttctagaggaatctgtgtctgggcctccgcctgccggctcc

SEQ ID NO: 6758749 - DNA, 59 bp, Homo sapiens
aagcacatacataataaagtcctttgtgcccttcaaaagggatttatttgtatgtgctt

SEQ ID NO: 6758750 - DNA, 72 bp, Homo sapiens
agacaacagaactcctgggatttttctttaaccattttttatcatggaaacatttccggccttttgttctct

SEQ ID NO: 6758751 - DNA, 68 bp, Homo sapiens
tgctagagataccgtagtcaactaaaagtggaggcttccacccactagaacatcggtgtcttggagca

SEQ ID NO: 6758752 - DNA, 94 bp, Homo sapiens
cacctgcaactttgccatctggggagggtgtcaccctgttacgtaaatggggcataactggggacacttctctatggagagcaattgttctgtg

SEQ ID NO: 6758753 - DNA, 69 bp, Homo sapiens
tatgcgatttggttacagaagggcaatgcagggcacctaacccaagtgcttttttaaccaaaccacatg

SEQ ID NO: 6758754 - DNA, 128 bp, Homo sapiens
actcaggctggcccctggacctgcacctgctccggggagggcatcaatcaggcctggaccacaccaggagtggctggtgaccttctgcgggttggtgctagcattgcctggggcccaatcccctgagt

SEQ ID NO: 6758755 - DNA, 61 bp, Homo sapiens
ccagtgttaaatttctaatttgtgatcattgaactatggttatgtgagatgtttacattgg

SEQ ID NO: 6758756 - DNA, 60 bp, Homo sapiens
ggtatctcctctatcaatttggtactccacacaggagagcaacaaattagggggatttcc

SEQ ID NO: 6758757 - DNA, 83 bp, Homo sapiens
gccctgcttgtctcagctgatgccatgtggaacagtgctggcctggcagtgccctgtggcttcagcaatccggcaggcaaggc

SEQ ID NO: 6758758 - DNA, 115 bp, Homo sapiens
gccactagggaaaatattctccaatgataagcccagctagttcagagagatatgtaatctttttcgtaaaatctctggctagttcctgggatatcagaaatattttttagatggc

SEQ ID NO: 6758759 - DNA, 61 bp, Homo sapiens
tggcatggtttcctgcaacgttctgcctctggggcagagcagcttttcggaaccactgcta

SEQ ID NO: 6758760 - DNA, 62 bp, Homo sapiens
gtttgagggaggaagcttgtgggcaaggccacagccgtccgcaatgcaagccttttatgaat

SEQ ID NO: 6758761 - DNA, 130 bp, Homo sapiens
gcttttgatgcacttgatttcctttcaaggtctcattttcatatgtcattttagggataggaaaaataattgtgattatggcaattgtaaatggaaagaaatggaaggaaaaaaagactgtattaatacc

SEQ ID NO: 6758762 - DNA, 63 bp, Homo sapiens
actactgttaggattcatgaggtatcacaggaaaactgcctagctcagaagcctatgcatagt

SEQ ID NO: 6758763 - DNA, 64 bp, Homo sapiens
ccagaggagggactgtgagctctccaggccgcttcctcggaggaggagttcccagccctcctgg

SEQ ID NO: 6758764 - DNA, 78 bp, Homo sapiens
tacagtaaaaagtaaacaggccccagggaggttgaaagagctgcattcacaacctgggtctgtcactggctagctgtg

SEQ ID NO: 6758765 - DNA, 83 bp, Homo sapiens
tcatacaccagaattcagatcatgaatgactgacagaatattttgttgggcagtcctgatttaaaactaatactggcttgtgg

SEQ ID NO: 6758766 - DNA, 79 bp, Homo sapiens
ggcaggaatttctgttggtcttgtttgctgagttattcccagtatctgaaacatagcaggcatccaataaatacttgtc

SEQ ID NO: 6758767 - DNA, 55 bp, Homo sapiens
cctgggcagcctgctcaaggactttaacattgtgtctcctttcagactgttcagg

SEQ ID NO: 6758768 - DNA, 55 bp, Homo sapiens
ggctttcttggttctgcaggggcctccgggcctttgttctctgaacaagaacgcc

SEQ ID NO: 6758769 - DNA, 78 bp, Homo sapiens
tctgaacccagctgcaccacagcatcccaggtccctattctttacagcctgtggagctcagaagtagcagtgttcaga

SEQ ID NO: 6758770 - DNA, 90 bp, Homo sapiens
tcgcagagcacctcgatgggcgtggcgcgtttggtgtccccgatcttctggtaccgctccttgagcgtgtcggcctgcgggggtctgtgg

SEQ ID NO: 6758771 - DNA, 90 bp, Homo sapiens
acctccttccctcaactcctatgcaggttggcagcatcagggcggcctgaatatggcacctctgtgtaaacggttgaacaagggagaggt

SEQ ID NO: 6758772 - DNA, 93 bp, Homo sapiens
gagatcattagacccacatccgtatttgactattgcaccggggtaaagtttggtggcaggaaccagatatcagggatgggaggatatgatttc

SEQ ID NO: 6758773 - DNA, 78 bp, Homo sapiens
cttgaggtagaagtgaaagacttgatgtcactgtgagaagcagtatactaaagggcaaagttttcatctcataacaag

SEQ ID NO: 6758774 - DNA, 66 bp, Homo sapiens
gcctaatgtgatcgctttagaagcttggtggtttttacataggcatatgaattgatcaaattgagc

SEQ ID NO: 6758775 - DNA, 85 bp, Homo sapiens
tctgaggatattgttacaatgcagatcttggttcacatggcaggaattggggcctaagattctgtatttctaacaattcccaaga

SEQ ID NO: 6758776 - DNA, 64 bp, Homo sapiens
agacttttattttcaccatgtatccctgttcttagaacacaaccgtggtggagatattcagcct

SEQ ID NO: 6758777 - DNA, 74 bp, Homo sapiens
ccactcaggctcatatcccatcagcaaaaactggccctgaatgccaggaggctggataatgtagcctgtagtgg

SEQ ID NO: 6758778 - DNA, 60 bp, Homo sapiens
tgcaagtgtcaatgctctgttaaaaattcattttgcatttttaacacagtcctgatagca

SEQ ID NO: 6758779 - DNA, 60 bp, Homo sapiens
tctgcagagcctcaggagaacaagacctagcccttcccctttttctgcaggcactccaga

SEQ ID NO: 6758780 - DNA, 59 bp, Homo sapiens
tttcttttcttttaccagccagaaagatcatgtctctctggacataacggagaagcaaa

SEQ ID NO: 6758781 - DNA, 93 bp, Homo sapiens
gtttcctcttagaattgttccttttcttatgcatcattacctggcattccccgtagtcacagtacaggataaagaatcgaatcgaagggaaat

SEQ ID NO: 6758782 - DNA, 69 bp, Homo sapiens
caggaagaaagaggtgaggtgtaatccaaaaagcaatcagctcactgacattttatttatttttacctg

SEQ ID NO: 6758783 - DNA, 70 bp, Homo sapiens
aggtataaaccctattttgcttatctgctcatccattgatggacactgggcacttgggttgcttctacct

SEQ ID NO: 6758784 - DNA, 111 bp, Homo sapiens
gattgtgatgcctctgtgatgtcatgtagagtggagttgatttgtaacaacaccagaaaagatgtccataaattacacttctattcttggtactaagggcatttctaaatc

SEQ ID NO: 6758785 - DNA, 113 bp, Homo sapiens
tgtacattgccaaaactctgggagaaatcatgggaaatggaatgagggggctgactgcagctgcctgtgcactttctcgtaatttccatgtttctagtagcttggcaggtaca

SEQ ID NO: 6758786 - DNA, 76 bp, Homo sapiens
ttgagtattcactatggagtaatgaagaattccctgtaacccttgggttgtttctaagttactgttatggtctcaa

SEQ ID NO: 6758787 - DNA, 97 bp, Homo sapiens
gttcgtggtgcttgcaagccggaatgcaacagctgggaatatgtatattattactgcaatgttaacccctgctgtgcggtatgggaataccaaaagc

SEQ ID NO: 6758788 - DNA, 93 bp, Homo sapiens
ttttaaaatgtctactcccctttcttcttgactgaaaactaaagtttaaagtcttggaaggaggaatggtaatttttaggtagatttttaaga

SEQ ID NO: 6758789 - DNA, 110 bp, Homo sapiens
agaatggaagaaaacaagcacttttcccttagatcatttgaattgaggtaggaatttaacctttttgtccttacttgcatgatgtgggagtagcttgtttctttctttct

SEQ ID NO: 6758790 - DNA, 77 bp, Homo sapiens
gaaccactgccagcaatgtgaccatgctgtgtcattcaagcacgtggaaagcaggctaatcttgctgaacagggttt

SEQ ID NO: 6758791 - DNA, 67 bp, Homo sapiens
tagttaagagcagaggctgtaggagcagactattatgacttgaattcttgcctctgttgcttgcctg

SEQ ID NO: 6758792 - DNA, 76 bp, Homo sapiens
caaagagaactatcagccactggggttaaaactcaataaggaggcattccagtgtgcatggtacacaattcctttg

SEQ ID NO: 6758793 - DNA, 94 bp, Homo sapiens
atgagtgtatgtatatatcactacactaagatacagatctagccctatgggtgtgtgtgtgtgtttgtgtgtgtgtgtgtgtgcatgcatttgt

SEQ ID NO: 6758794 - DNA, 77 bp, Homo sapiens
gaaagcataatgctgtcagaaaagaatgtgagctgtagtgtctatggcttttggcttctctctgtagcattcctttc

SEQ ID NO: 6758795 - DNA, 85 bp, Homo sapiens
gtttttccatttactcattcgctgttcaacattgagcatctgcgacacatcagctccagtggatacagcagtggggtggaaaggc

SEQ ID NO: 6758796 - DNA, 76 bp, Homo sapiens
ccgcccggaccctgagggatgagagttgcagcctagaaaaccaggtgccaggccctgcggggtcccacgcgggcgg

SEQ ID NO: 6758797 - DNA, 77 bp, Homo sapiens
cagaccctgggtccagttttgtcataaagcacatgctttaaaatgttgctgtagatggactggcatccatttgtctg

SEQ ID NO: 6758798 - DNA, 80 bp, Homo sapiens
aaagttccatgttggactaaagaaacattccgtgagagtttttcgtgttctcagtggtccattttgcatgggttggcttt

SEQ ID NO: 6758799 - DNA, 56 bp, Homo sapiens
tggcctgctttcttaggtgttcatcagttaacatgtttgaggtgacaagcaggcca

SEQ ID NO: 6758800 - DNA, 59 bp, Homo sapiens
tttgattacctggggccctctgcttcctcacaggtgtcagccctgccccaggaatcaaa

SEQ ID NO: 6758801 - DNA, 76 bp, Homo sapiens
gcttctgtcttgtaattgaagagctgttcctcattcatctacatgggaacccagcactctaagtgcaagacactgc

SEQ ID NO: 6758802 - DNA, 108 bp, Homo sapiens
tatatatgtgtgtatatgtgtgtgcatgtgtgtgtgcctgcttgtgaatgtgtgtaaatatgtgtatagatgcatgcatatatgcatatgtaggtggatgtgtatata

SEQ ID NO: 6758803 - DNA, 61 bp, Homo sapiens
gagtgattggagttagcattctggacgtatttcttacagagttgactagcactattcattt

SEQ ID NO: 6758804 - DNA, 57 bp, Homo sapiens
gaggctcacgacgggacgaactcaactcaaagaccagttctgttgactgtgggcatc

SEQ ID NO: 6758805 - DNA, 72 bp, Homo sapiens
tccctgcagcgccatcacccacccgtggctgggaggtgacctcccagggtcagtggtgaggccgcccaggga

SEQ ID NO: 6758806 - DNA, 78 bp, Homo sapiens
caggctcccccaatgtactcctcaatctgatcggtggccaaaacaacagacacttgtgaggagtgtggatggagcttg

SEQ ID NO: 6758807 - DNA, 66 bp, Homo sapiens
tgcatgaccgtgtttttggtgacacaactcccgcctgccctgtgtcctccagcagcatggtatgta

SEQ ID NO: 6758808 - DNA, 81 bp, Homo sapiens
tgacgcctattaaggcaactgagaggcccgtgttggggctgagcctcattgcgagcctctggttgtctagcgatggtgcca

SEQ ID NO: 6758809 - DNA, 60 bp, Homo sapiens
ggcgaagggcttctcgcctgtgtgcacgcgctggtgcaaaaagagcgaggagccctggct

SEQ ID NO: 6758810 - DNA, 90 bp, Homo sapiens
tctctgtccatgaacagcacaatctgagtcccagacaccactacttttggggatctgttcctcaaggtctgtgtgaatttatggcagtga

SEQ ID NO: 6758811 - DNA, 83 bp, Homo sapiens
gatagccaatggccagggccaaaagagatgcctttggagtagtgctagccaatatctcacttgagctttgcttttctgttatc

SEQ ID NO: 6758812 - DNA, 85 bp, Homo sapiens
ggagataaggaggtgcctcaagggcagggagtttgtgtctagagggctgcacggcacagaccccagcccagtcacctcaactgcc

SEQ ID NO: 6758813 - DNA, 70 bp, Homo sapiens
ggagccaatgggagggtgaggaggcagctgttggaaagcccttgagtagtcacttcacccatcccactcc

SEQ ID NO: 6758814 - DNA, 72 bp, Homo sapiens
tgtggttggaaatgtaaaagtggggtttgtgaaacatctttcattacagaccactgttaccagtcaatcaca

SEQ ID NO: 6758815 - DNA, 91 bp, Homo sapiens
cttagaggacaggggctggtgtcttcctagttttgtattcattcccacctacatcatggaggacagtggacactagtccctgtcctcaagg

SEQ ID NO: 6758816 - DNA, 98 bp, Homo sapiens
tctttatattatcagttattgagatttgggggctagggctggtttgttatttggctcaaactagcacatcctaaatgcttcagaaattgatatgagga

SEQ ID NO: 6758817 - DNA, 66 bp, Homo sapiens
tatcttaaaggaggttttgtttccataattcacttcagttgtggaagcaaaatatcctttaatgta

SEQ ID NO: 6758818 - DNA, 65 bp, Homo sapiens
cctttcatcaacatttgcatccttccactcaagattcagagttcggcaggaaagcgttgaatggg

SEQ ID NO: 6758819 - DNA, 100 bp, Homo sapiens
ttgagctttgttctggcatgtagctaagttacttggcaacagtttaatactttggaccttgctatcatgatttgttaggtggaactggaccagtgctcag

SEQ ID NO: 6758820 - DNA, 78 bp, Homo sapiens
gggtcttgggtgtggggcatgataggagcccatctgtggattaggacactgagcagccccaccagccattaaagactc

SEQ ID NO: 6758821 - DNA, 125 bp, Homo sapiens
acacggccgctttggggccccgagtctttgtctgcctgggactggatgtgtttgtgtcggtgtgactaatgggatttatggatgtcagtgccagggtgactgatgaagggcttggcagcacgtgt

SEQ ID NO: 6758822 - DNA, 71 bp, Homo sapiens
ctataaaatgagaatagttgtagtatctatctcgtgaatttattatgagaattaaattattttctctgtgg

SEQ ID NO: 6758823 - DNA, 70 bp, Homo sapiens
acagatgatatgggaaaagggctcggattcacctggcttcaaatcctggtgctgacacccatagctctgt

SEQ ID NO: 6758824 - DNA, 84 bp, Homo sapiens
tggtcctggtggcattggcagttgacatatattattggtattaattgcagcagatgtagcggcagctgtttttccatcaggcta

SEQ ID NO: 6758825 - DNA, 116 bp, Homo sapiens
attgtcaccagccaagtcttacaaacaataaggcctggcttatctgggagggagggagcaggagctgggtggcacctggcccagagagcagagcttagtgagtggctggtgacaat

SEQ ID NO: 6758826 - DNA, 72 bp, Homo sapiens
gattcaagtaaagtagcgcctaactaatgtggggtttcttttcaaattatttactgctattgttcttgattc

SEQ ID NO: 6758827 - DNA, 85 bp, Homo sapiens
ttccgcctcagcctcccaaatagctgggactacaggcgcccgccaccatgcccggctaattttggtatttttagtagagacgggg

SEQ ID NO: 6758828 - DNA, 63 bp, Homo sapiens
tgagctgtagcagatgctgttgatgccttagtcacttgggcagcaagtgtcagctgcagctca

SEQ ID NO: 6758829 - DNA, 77 bp, Homo sapiens
acagatgctctccgtctcatcatagttgacatgaactatagttctgctggctgtatatgtgagagtggagtttttgt

SEQ ID NO: 6758830 - DNA, 80 bp, Homo sapiens
ctaggttctagtaacggtggcctctccctgcccctttaaaccttgggtggtaatggattcctacttttgttagtccctgg

SEQ ID NO: 6758831 - DNA, 60 bp, Homo sapiens
tcctcactcctgctgttggtctcatttcttcctgtcaaagacctacatgtatagtgaggg

SEQ ID NO: 6758832 - DNA, 62 bp, Homo sapiens
aagccctgttaggcactggggatatgacaataaacaagaaaattctcagcctcattgggctt

SEQ ID NO: 6758833 - DNA, 62 bp, Homo sapiens
ggagctgagggagaggcctaggggacaggattctgggttgtgtatgcctactcctatactcc

SEQ ID NO: 6758834 - DNA, 75 bp, Homo sapiens
gagcatcatcagagtgtaagttctttcctatctttgaagtgaacagggacaaatgagcactttgacacagtgctt

SEQ ID NO: 6758835 - DNA, 91 bp, Homo sapiens
gctgtgtccattttgtgtcgatccaatatgtttgagacagtctcacaggactttccacaccattttgtggtgtcattatgatggaataggc

SEQ ID NO: 6758836 - DNA, 59 bp, Homo sapiens
cccagcacaggcaattccatacagacaagacggtagatgagtggatgccagaggctggg

SEQ ID NO: 6758837 - DNA, 84 bp, Homo sapiens
gagatggcgtctcacccaggctagagagcagtggcacgatcttggctcactgcaatctccgcctcctgtgttcatgcaattctc

SEQ ID NO: 6758838 - DNA, 75 bp, Homo sapiens
attggctcatttgtagaatcattatttctagtaatgtattacggagacaaagatgctacattctcatcagtcagt

SEQ ID NO: 6758839 - DNA, 78 bp, Homo sapiens
ggtctaggggtccaggcggcatagttgtaggccctgggtggggtatgcaaaggtttgtgcttggaaaaaactggagcc

SEQ ID NO: 6758840 - DNA, 60 bp, Homo sapiens
gtgaagcagttgcgtgggttccagtgacagagatcctgggtttcatttgtatctgctcac

SEQ ID NO: 6758841 - DNA, 91 bp, Homo sapiens
gccaggatggtctcgatctcctgaccttgtgatccacctgccttggcctcccaaagtgctgggattacaggtgtcagccaccgtgcctggc

SEQ ID NO: 6758842 - DNA, 62 bp, Homo sapiens
aggatgcatgttaagcctgactggatctattcattctcctgtcaacagctggcatgcctcct

SEQ ID NO: 6758843 - DNA, 130 bp, Homo sapiens
gttatatagccttgggaggaaataaatatatacaaggcaagcaatgtgaatgtttaccaacctgaaatatgtataacagtcaaagtttggttccttgtgtgttgatgtgatggaaggctatgttttcaac

SEQ ID NO: 6758844 - DNA, 73 bp, Homo sapiens
gactcaggtataaaagctaggtagtctcagtaaaaataattgggccaaatagctatttactacccatgagatc

SEQ ID NO: 6758845 - DNA, 68 bp, Homo sapiens
actagatggcgaggaagaagtttgagtcaagagacctattcttggcactgtcttcttcgtgtaagggt

SEQ ID NO: 6758846 - DNA, 55 bp, Homo sapiens
acaggggtgcatggtgcatggtctctgggactgatagcagcggtgacacccttgt

SEQ ID NO: 6758847 - DNA, 66 bp, Homo sapiens
tacttgaggccaccagtcctctggcagggtaaaatacacccaacagaatacggatggctgatagtg

SEQ ID NO: 6758848 - DNA, 64 bp, Homo sapiens
gttgtgaatagtgccgcaataaacatatgtgtgcatgtgtctttatagcagcatgatttataat

SEQ ID NO: 6758849 - DNA, 64 bp, Homo sapiens
gagggtaatattgctggaaaatggtgtgatcaaattgatttctcagtaatctcagcaattcctc

SEQ ID NO: 6758850 - DNA, 85 bp, Homo sapiens
ggtacatttttaaagaaaacgttttgaggagtttgggtctacctaatgttttttccatgttttactaaatcttttcaaatgaacc

SEQ ID NO: 6758851 - DNA, 84 bp, Homo sapiens
ttctagtctagtcagcatattactttaaaaaatcttcatagagatgccatttttggagagtgtgcatagggacaagactcagaa

SEQ ID NO: 6758852 - DNA, 87 bp, Homo sapiens
tgctaggtcttatgtcacggctatttgtgtccttttgtttatcctatgagagggaaaaacccactgaagcctgggagtaagacagca

SEQ ID NO: 6758853 - DNA, 75 bp, Homo sapiens
gggacggcaacatgactcgctaaggaggaatagtgaggcagagctgctgcttctctttttagcgtctgcagttcc

SEQ ID NO: 6758854 - DNA, 63 bp, Homo sapiens
ttggctggggattgggtggcaggatattcgagtaaccaccgtcaccataatccgttagaccag

SEQ ID NO: 6758855 - DNA, 67 bp, Homo sapiens
gggcgctttgtggagacctcctaggatgtgtaggacccccacacaccctgtgagtccctggctgccc

SEQ ID NO: 6758856 - DNA, 55 bp, Homo sapiens
agggcctcccatggttctttgaagagctgtgctcttacatggacatggaggcctt

SEQ ID NO: 6758857 - DNA, 87 bp, Homo sapiens
gagtttcgctcttgaccccgaggctggagtgcagtggcctgatcttggctcactgcaacctctgcctcccggattcaagcgattctc

SEQ ID NO: 6758858 - DNA, 78 bp, Homo sapiens
tttgagacttgggccctttcctcagggagcttatgccttacttagctccaggataagacaggtgcacaagtaagcaga

SEQ ID NO: 6758859 - DNA, 56 bp, Homo sapiens
agtccaaagcagatgagggccagggaatggatgctggccttgtctggtgaaggact

SEQ ID NO: 6758860 - DNA, 60 bp, Homo sapiens
ccattctaaagttcaagcaagggcatggttagtaaaataccagctctaattttagaaagg

SEQ ID NO: 6758861 - DNA, 68 bp, Homo sapiens
caagaagtcttacataaacaggaaatggagttgtgtgcgcttggttgctgtaaatgtagacttcattg

SEQ ID NO: 6758862 - DNA, 55 bp, Homo sapiens
cgctcagacagacaccagccagcttcaccttgtgctgcctctgcgactctgggcg

SEQ ID NO: 6758863 - DNA, 67 bp, Homo sapiens
taacagaaaggggacagaaataagaatttgaatgaaaatagttgcttttatgtctttggttctgttg

SEQ ID NO: 6758864 - DNA, 58 bp, Homo sapiens
gagagctggcagtgtttacaggtactggtagggtaaagagaacaatttgttagctctc

SEQ ID NO: 6758865 - DNA, 57 bp, Homo sapiens
caactgtttgaacagatggcttttaccatgtaaaacatggcatttgttgatcagttg

SEQ ID NO: 6758866 - DNA, 129 bp, Homo sapiens
ttgtagatgttctttatcagttttaggaagttttcttctattcctcatttgttgagaaccacaaaacgcaggctggtggttttctctgaggaaggagagaaggagatggaattgggaagaagcaaaaga

SEQ ID NO: 6758867 - DNA, 57 bp, Homo sapiens
tccaagtttcccaggatccttgcctttttcatagaaaggacaggaggggaattagga

SEQ ID NO: 6758868 - DNA, 55 bp, Homo sapiens
gaacagtactaagagctttacatgtattaagccaattagcccttaagtactgttc

SEQ ID NO: 6758869 - DNA, 84 bp, Homo sapiens
agctatttggtcatgttcagtgtagacagagcattgcattaagacacaagttaatggtactgcctggagatgaatcaatttgct

SEQ ID NO: 6758870 - DNA, 75 bp, Homo sapiens
tcccttttcaaaggttctggtgaaggatctgaagtgtatggccacaccagtcccagaagagcctgggagaaggga

SEQ ID NO: 6758871 - DNA, 63 bp, Homo sapiens
tttcacattggcaaacggggttgcaaagtgctcttcgtgctctttggacagtgccttgtggag

SEQ ID NO: 6758872 - DNA, 71 bp, Homo sapiens
atgggcccttgtaacgggctgacccaagtgcccaggggctagctgccctgggccagctcggaaggtcccat

SEQ ID NO: 6758873 - DNA, 67 bp, Homo sapiens
gttcaagtctggggctgccagtaaagagataccccagtatctgatcttggctgcctgagattagaat

SEQ ID NO: 6758874 - DNA, 130 bp, Homo sapiens
gttagaaagaattattgaagaagtgtccagttaaagctgaaatgattatgacaagcctgtgttataactatgtggtaaatgtctagtcttagctctaattggtcttattttaatgtgtttattgtttaat

SEQ ID NO: 6758875 - DNA, 69 bp, Homo sapiens
gcctgcttaagatgcaaagaacagacatagttagtttcttaccttggtttctgcatcttgaaacagagc

SEQ ID NO: 6758876 - DNA, 78 bp, Homo sapiens
atattcttttcaggtggagatccagtctttgtgtgaacatatctaaagcagggacctcactacccccagaagcaatgt

SEQ ID NO: 6758877 - DNA, 70 bp, Homo sapiens
gggtggaaatatacaatgtgtctcttgccagaggcaaaagacttagaagagataacagtatgttccactc

SEQ ID NO: 6758878 - DNA, 80 bp, Homo sapiens
cagaagtacaatggaacttgtaattatgtcctctttgataacatgaatttggatatgacgagtttggtgattggctcctg

SEQ ID NO: 6758879 - DNA, 71 bp, Homo sapiens
agtgctgtgaatccatttcaggtgtgcaaggtcgggacctctgatttgcgtctcatttgaaatcatggcct

SEQ ID NO: 6758880 - DNA, 56 bp, Homo sapiens
gcacagcctctaggatcgcttccagtagaatgagtcactggcaaggctttgagtgc

SEQ ID NO: 6758881 - DNA, 58 bp, Homo sapiens
atgcctggactgtatcccagatcattaaatcagaatctctgggagtgtatccaggcat

SEQ ID NO: 6758882 - DNA, 80 bp, Homo sapiens
cttggattaggaggtcatggacaaggtgtgagccatggatggaacttggagggcatgctgtccatgggctggggtccagg

SEQ ID NO: 6758883 - DNA, 60 bp, Homo sapiens
ttcccagctgtcctttgtcctataagaagttgagctttttagcatgaagcagctggagaa

SEQ ID NO: 6758884 - DNA, 86 bp, Homo sapiens
gcatctatgcactgcactgaggtgaaggggtgcttttcctcagtgtccatcagagtctccttggcctcaatgcctgctacagatgt

SEQ ID NO: 6758885 - DNA, 64 bp, Homo sapiens
tcttcattctttccttaattgatgctcagccacaaaaagttcgttgtcatgaggaaggagaaga

SEQ ID NO: 6758886 - DNA, 129 bp, Homo sapiens
gcctgcttacatactgtctgatgttgggtcatattgcttattaagtggccgaaatatttttcaattatttgatgctaagatttaataaagtagatgaaataagaaccagaatacagtccacaatcaggt

SEQ ID NO: 6758887 - DNA, 55 bp, Homo sapiens
gttccagtatgattccacccatggcaaattccatggcaccatcaaggctgagaac

SEQ ID NO: 6758888 - DNA, 104 bp, Homo sapiens
ggaattccagacctgggtgatgcattctgacttccacactctgcgtaacctctgacctcaagcatctccgaaagtcttgtcacccccccaagagtctcagttcc

SEQ ID NO: 6758889 - DNA, 71 bp, Homo sapiens
aaatgtaacttatttaagttgtttatcctttggctttgtaggtcgaaggttagttttcaataattacattt

SEQ ID NO: 6758890 - DNA, 89 bp, Homo sapiens
aatcctgtgtcttatgtatgctactttgtggtcaagttcatatccttacacctgcttatcaaattagcatttatgaaccaactagggtt

SEQ ID NO: 6758891 - DNA, 99 bp, Homo sapiens
gatgtcaaagctccaggttcttgggcctttagactttgggacttataccagtggccacagtgattatcaggtctttggtctcaggctgagaactacatc

SEQ ID NO: 6758892 - DNA, 56 bp, Homo sapiens
tgactcctcctcccaagtcctgtttctgtctattgcagggcccaggaagagagtta

SEQ ID NO: 6758893 - DNA, 71 bp, Homo sapiens
aagagtaaggttttaaaaatcaaatacagggcttcaaatttggggtttctgatgtttaatactatgctttt

SEQ ID NO: 6758894 - DNA, 66 bp, Homo sapiens
tccacaagatgataaagagagggcagaagatgtaaaatgtttatctctcttcagttaccttgtgga

SEQ ID NO: 6758895 - DNA, 64 bp, Homo sapiens
tctgctgacatttatgaatagaccatcgccaattgtgacatttctatgttgtgtgtcacacaga

SEQ ID NO: 6758896 - DNA, 77 bp, Homo sapiens
gctcttcatcagactctgcttgtatcacatttgctaggatactacagggtatataggcaaagctaaatgtgaggggc

SEQ ID NO: 6758897 - DNA, 59 bp, Homo sapiens
catgcccttcaacgtgaggatttgcagtatcaaagagaggggtcaaagtggagggtatg

SEQ ID NO: 6758898 - DNA, 60 bp, Homo sapiens
ggagtaggaaagggacagtctaacaaggcagaaaattctagacagtaactcttctactcc

SEQ ID NO: 6758899 - DNA, 55 bp, Homo sapiens
ttccattcacctatctcatcttataaaatagaataggtgaacaaggagaatggga

SEQ ID NO: 6758900 - DNA, 57 bp, Homo sapiens
gacccagaaggagtgccctagaaaattctggattgttttctagctctacttttggtc

SEQ ID NO: 6758901 - DNA, 75 bp, Homo sapiens
ccagtagtggacattcactctgctgcccgagggctggggtagcctgccccggcccgcggacgcagcagggtctgg

SEQ ID NO: 6758902 - DNA, 56 bp, Homo sapiens
ggagatgcacgagcaggtggagcagctgaagcagagcatccaccgcgtgcacctct

SEQ ID NO: 6758903 - DNA, 63 bp, Homo sapiens
ggcctctctggcatggctgccccaggagaatgggcaggtagttaatttccggtgaggggggct

SEQ ID NO: 6758904 - DNA, 71 bp, Homo sapiens
tcttttctccagacctgggatctggcctctggaattctctctccccactctgtcctagatttgagaaagga

SEQ ID NO: 6758905 - DNA, 55 bp, Homo sapiens
aaaagtgttcaggaagaataatgttgcatttccttatgtctcctgaaacactttt

SEQ ID NO: 6758906 - DNA, 63 bp, Homo sapiens
gagtcctgggttctggtgttttgtgtgttaaggcgatcagggctgtcagggacctcaggactc

SEQ ID NO: 6758907 - DNA, 91 bp, Homo sapiens
ggctgcccgaccccagtcccatggagaagacttgagcttgctgaattatggacagcaggtgtcactttcactccaagactgggctcccacc

SEQ ID NO: 6758908 - DNA, 80 bp, Homo sapiens
gattttgaattctgtaactttactgaatttgtctattaattcttacagtatttggtggagacagaataacttttaaactc

SEQ ID NO: 6758909 - DNA, 60 bp, Homo sapiens
tggcagagcaaaaagatagaatgtctttatgacaccgaagaactgtcttttttctctcca

SEQ ID NO: 6758910 - DNA, 84 bp, Homo sapiens
cagctgtcagaaaccccaacaatggagacttaatgtctacttttccagagcagtttctccaagttattgtgggtatcttggctg

SEQ ID NO: 6758911 - DNA, 69 bp, Homo sapiens
ctctcaccttgtggctgtgggtcaaaaatcagcaaaaaatcaatgacaatacctacatcattgtgagag

SEQ ID NO: 6758912 - DNA, 121 bp, Homo sapiens
gaagcatgtaaagctaggtggaccaatgcattctgcagatattctcccaagtgttgcatccaagtggatgaactggaaggattgcagatgtcattgtagatgatctagtgccaggtgcttt

SEQ ID NO: 6758913 - DNA, 75 bp, Homo sapiens
acaggctactcagggactgtgacatgatgacacttgtaggaacccagtgtgtcatttagtcctctgtgtgtctgt

SEQ ID NO: 6758914 - DNA, 100 bp, Homo sapiens
gatgacctgcttaaaggcgataaggcagtgttttaaggatgaccactaaatctttgttttgccaacactacttataaaatgttttacaaatggtttagtc

SEQ ID NO: 6758915 - DNA, 63 bp, Homo sapiens
taaattgccaggagggttgagaatacgtagattgtgtatgtttttgagactttttggagttta

SEQ ID NO: 6758916 - DNA, 79 bp, Homo sapiens
ttccttgcaagttcttaaccgatttgttctgatgttgacataacacagataaggcagttaagagtttaaaaccaaggaa

SEQ ID NO: 6758917 - DNA, 68 bp, Homo sapiens
gtcacataggcccttggactcatgctcgaaccggaaggtcgggttgatcaacaagggctcagtgagac

SEQ ID NO: 6758918 - DNA, 56 bp, Homo sapiens
atgagtttaatggactgggaaggtgactgggatgttggaccgtccattaaactcat

SEQ ID NO: 6758919 - DNA, 64 bp, Homo sapiens
gtcctcagggagggaggaaaatttgctcagctaccatttgagacgagttgcatctccccaggat

SEQ ID NO: 6758920 - DNA, 59 bp, Homo sapiens
ggcgcccagggcaggaggccgctcagagcgcagcagcaggagtggaagctcggggcgct

SEQ ID NO: 6758921 - DNA, 69 bp, Homo sapiens
cactagtcctggtttcatgctattcaaaaactaaatgaaaaatgaagaaattgaggctcagagacggtg

SEQ ID NO: 6758922 - DNA, 61 bp, Homo sapiens
tctgatcctttgtcttcttgggtagcttcttggagccttctttggagtgctaggggttggg

SEQ ID NO: 6758923 - DNA, 57 bp, Homo sapiens
gaattttaataaaggtttatcaggcgcttgttatggtgcagaacttttattaaattc

SEQ ID NO: 6758924 - DNA, 56 bp, Homo sapiens
cagagcagatttctaagtattgggtgtatttctctatatacatgagtctgtttctg

SEQ ID NO: 6758925 - DNA, 83 bp, Homo sapiens
gtcacaagggagttgctgcatgcaggtttggtgcagaaaaacaaacaaatacatcacctctgttcagtgaattcctccttgac

SEQ ID NO: 6758926 - DNA, 58 bp, Homo sapiens
catcaagatggaagagcaaatagtttctcatgctggagaaatgctctccagtgtggtg

SEQ ID NO: 6758927 - DNA, 72 bp, Homo sapiens
aggggaagaggaaggagtacccagcaactcgctctcacagtggcccatgctcctggctccttccctaacctt

SEQ ID NO: 6758928 - DNA, 129 bp, Homo sapiens
ggaagtagcagaagtagtggctgtggcagagaggagcagcactggggttccacggaggggcagccccaggagagtctgtccccagagcctgttcctgcagcatctgcataaatattaactctccagtct

SEQ ID NO: 6758929 - DNA, 66 bp, Homo sapiens
aatcaattttgaggatacaagaagttcctgggaatccacactgctattcttgtaccttaaatgatt

SEQ ID NO: 6758930 - DNA, 128 bp, Homo sapiens
cctgccacgcccaccccctgcccacctctccaggttctgctctgtagcacacccttgggtgacccctcaccccagaagcagcagtggcagcttgggaaatgtgaggaagggaaggagggagagacggg

SEQ ID NO: 6758931 - DNA, 79 bp, Homo sapiens
acaagatgttaaaccagttttgcatcatagggataaattcctttgatcatggtgtgtaactggttttgttttgttttgt

SEQ ID NO: 6758932 - DNA, 66 bp, Homo sapiens
taatcatagtgggtacaggggcagagaacattaatttctctacttctatgtaactacttcatttta

SEQ ID NO: 6758933 - DNA, 67 bp, Homo sapiens
gtttcagtcatggtttctgttacaggcagctgaaaacatccagctgtacagcagccttgctagaaac

SEQ ID NO: 6758934 - DNA, 60 bp, Homo sapiens
aggaattctggcattttattatggagctgcactattgcagaatcctattgtcagattctt

SEQ ID NO: 6758935 - DNA, 68 bp, Homo sapiens
tgtagaggggtgtcaatattaccaaagttacttgctttggggactgagaggtgatagtgacatttaca

SEQ ID NO: 6758936 - DNA, 75 bp, Homo sapiens
gagaccacagccaccttgatgcctttccaagatgtcttatcttaggtgcagaggcattttgggtgaagtcatttc

SEQ ID NO: 6758937 - DNA, 84 bp, Homo sapiens
atagatgttagtggattgactgttaaacgaattaatcattctctttcaattcgtactgctggcagaagttcactagtagcttat

SEQ ID NO: 6758938 - DNA, 70 bp, Homo sapiens
acttcctgcgtgtttgcaccctgtctgtttgaacgtttatatttagaattctcaaacatgcccagggagt

SEQ ID NO: 6758939 - DNA, 72 bp, Homo sapiens
ccacagatgtcacatggcctgtactttggactgtgatgcatacctatgctcgctatgtcacattccctgtgg

SEQ ID NO: 6758940 - DNA, 75 bp, Homo sapiens
ttcttcacattttagtggtttgtcagtgtttgacaattaaacctcaaatttagatatatgattataatggaagag

SEQ ID NO: 6758941 - DNA, 63 bp, Homo sapiens
ctatgtgtccatgtgttctcatcatttagttcccacttataagtgaaagcatgtggtatttgg

SEQ ID NO: 6758942 - DNA, 68 bp, Homo sapiens
gacaggataggagcttttcttccagttaatgaagtgaggcttcatggaggaagaagattttcttagtc

SEQ ID NO: 6758943 - DNA, 93 bp, Homo sapiens
cactccagaaaagacctccaggttatctggattaatatcagagatgttttctgattttgtaaggaactctggaggtataacctctggccagtg

SEQ ID NO: 6758944 - DNA, 60 bp, Homo sapiens
gccaggaggctgctgtgtaggcaggaacgtctgcctttgaatttgctagcctaacctggc

SEQ ID NO: 6758945 - DNA, 77 bp, Homo sapiens
acaggctttgtagttctggctctcccctgctgggttcagtcgggctttccaagggtagggccaggccttttgtctgt

SEQ ID NO: 6758946 - DNA, 64 bp, Homo sapiens
atctcccaattccctgataaattattttccacacttcttcaagttgacaggaaagaggggagat

SEQ ID NO: 6758947 - DNA, 77 bp, Homo sapiens
cctgcagcatgccatgcagccctcctgaggccctacagagcaggcagccatgggaggtctgcaaggtgctgtgcagg

SEQ ID NO: 6758948 - DNA, 76 bp, Homo sapiens
tgtggctttcaagaagtcatttagcctctcagactatttttcatctgtgaaatgaagataattcttgtctgcttca

SEQ ID NO: 6758949 - DNA, 63 bp, Homo sapiens
gctattctggctctttgggtgattgtaaataaatcttttgcaatgtcctggaaccagatcagc

SEQ ID NO: 6758950 - DNA, 106 bp, Homo sapiens
gtggagcagatgtgtttttgcatcgttgtctgagaaagtttatgtttatttctgcatccttggttcagtagattgcttttcagacaatgaggcatatccgctccgc

SEQ ID NO: 6758951 - DNA, 81 bp, Homo sapiens
cttttaaccattgtgtgtgtgtgtgtgtgtgtgtagtgaattagataatgcatataaagagcttagtatagtgcttgaaag

SEQ ID NO: 6758952 - DNA, 73 bp, Homo sapiens
gtgagcacaggacctagccaggctgattgggagaccttatccctttcactactgtgttggtctaggtgtgcac

SEQ ID NO: 6758953 - DNA, 55 bp, Homo sapiens
ctgtccacgtggggcttgatgtagccgcgggcttccaggtccagcacgtgcacgg

SEQ ID NO: 6758954 - DNA, 91 bp, Homo sapiens
ctcaggctaagggttgtgagcaggctgcacaaaccgaccaattctctctggtaggaggttacagtagcctgtcatcaaaccctagtgggag

SEQ ID NO: 6758955 - DNA, 80 bp, Homo sapiens
gaatagctgtaggctagtgtcttcagagaccaatctatactctctcccaggtatctgtttttacttgtttgctgttgttc

SEQ ID NO: 6758956 - DNA, 67 bp, Homo sapiens
agtaggtcttaggagtcatccggcatcttgtttctgtagctgagctgggcaactcttagatcttatt

SEQ ID NO: 6758957 - DNA, 105 bp, Homo sapiens
ggatagagtggagatgagaacttaggtctcctggcttttgtcccagtgcttttaactccaggacttgtcacagtgccaggcttctctcatcgtccatcaaagtcc

SEQ ID NO: 6758958 - DNA, 68 bp, Homo sapiens
gagactctagattggttaagtaacttgcccaaggtcatacttggagctggtattccagtttagttctt

SEQ ID NO: 6758959 - DNA, 57 bp, Homo sapiens
gaacatcattgtttggttctcttctttgaggctagaatgagaatctctttgatgttt

SEQ ID NO: 6758960 - DNA, 61 bp, Homo sapiens
ggctgaaagaatgggggccctgggccttcttggtgggctgttgttccctgttctctctgcc

SEQ ID NO: 6758961 - DNA, 68 bp, Homo sapiens
ccctgtccgcctcctggcattgtccccatttcagaatgtgggtgcaggcagcccaggcaggagcgggg

SEQ ID NO: 6758962 - DNA, 82 bp, Homo sapiens
ctatggctcaggggctgagagcagggacttgagccagactgaggcccagtcctggccctgccactcactgctgagtccctag

SEQ ID NO: 6758963 - DNA, 77 bp, Homo sapiens
tgggaaatctgcttcctagggctgttagaaggaaattggtctccttaaattacgtcagcatctgaggcagtttccta

SEQ ID NO: 6758964 - DNA, 58 bp, Homo sapiens
ttggtcagatgtgtctcctcctcctcaaccccagagggaggaaggagaatctgagcaa

SEQ ID NO: 6758965 - DNA, 59 bp, Homo sapiens
ttcactgtactgactgtcttatccataccagtgtggagtcaggcagaagttgcaatgag

SEQ ID NO: 6758966 - DNA, 58 bp, Homo sapiens
cagctgtgtaaacacatgtgtatatgtgcatatactttatatatatgatacacaggtg

SEQ ID NO: 6758967 - DNA, 61 bp, Homo sapiens
ttgaaggtcctgtttctatccaaagccagctgttagagcctataggttacaggtctttcaa

SEQ ID NO: 6758968 - DNA, 77 bp, Homo sapiens
tgtggtgggccctggggccgggggtgggatgcaggcatcccggctgatttctaccctgcggtcttggggcacctaca

SEQ ID NO: 6758969 - DNA, 65 bp, Homo sapiens
cagttgcttgttagtggtgaggttctatgatcctaagtaggggacttagtggctacaagcagctg

SEQ ID NO: 6758970 - DNA, 56 bp, Homo sapiens
ctggcagcagcttctggatcgatcgacgctccgacaggccgggaagcagttgctag

SEQ ID NO: 6758971 - DNA, 81 bp, Homo sapiens
tggttgctggttcacagcatacgctgcattttataggattgcttcccaattctgcatggtggtgtctctgagctagtgcca

SEQ ID NO: 6758972 - DNA, 58 bp, Homo sapiens
atggctggctttacttgctttgggggaattaatcctgatgttgtaggtgttagtccat

SEQ ID NO: 6758973 - DNA, 79 bp, Homo sapiens
aacgtatttgtatgtatgaataagcaagatagcaagttttaactagtggttgtgtttaatttatttatacaaatgtgtt

SEQ ID NO: 6758974 - DNA, 98 bp, Homo sapiens
ccgtccccgacctcctcggaaaaggtgagcagtgcaggtggcagaggacagcctctgggctgctgtcatctggcgctgtgcaggcgagacggggacgg

SEQ ID NO: 6758975 - DNA, 102 bp, Homo sapiens
ggcgtggtagctcatgcctgtaatcccaactacttgggaagctgacaaaggagaatcccttgaacccgggagtcggaggttgcagtgagctgtgactgcgcc

SEQ ID NO: 6758976 - DNA, 72 bp, Homo sapiens
ggcctagctgaggcaggctcaatgcccagtctgagctgtagaggagtagctgagctctgcactttgccagcc

SEQ ID NO: 6758977 - DNA, 83 bp, Homo sapiens
aaggcattgtgtagctgtgtataattgagaataggatatttatttttgttcttttagcctatattagttgcctttattgcctt

SEQ ID NO: 6758978 - DNA, 80 bp, Homo sapiens
cttgaagcctgttacttatttgtaaaggtccatagtaagattgaacttactatttggaattttaaattggtagcttcaag

SEQ ID NO: 6758979 - DNA, 78 bp, Homo sapiens
agactgagattctttcatgcagttgacaaggtgtcttctccaagtactttatctacctgcagatggagatcatggtct

SEQ ID NO: 6758980 - DNA, 61 bp, Homo sapiens
caaaattgggttagctctcagcagcccgctcttgagctctgaaaaagcttgccttcttttg

SEQ ID NO: 6758981 - DNA, 93 bp, Homo sapiens
atgttattgacagagctgaaatctgaactctgtatccttcagcgtagaagatcaatgttcattaagatgcttcagttctggaaatttcaacat

SEQ ID NO: 6758982 - DNA, 66 bp, Homo sapiens
gcttgatctctggattcagacagttcctggctcctccacttatgagctgtgtgacctagggcaagc

SEQ ID NO: 6758983 - DNA, 77 bp, Homo sapiens
gagggtgccagcatgattggtgtctggtgagggctctcttcctggcttgctagtagccgccttcttgctgtatcctc

SEQ ID NO: 6758984 - DNA, 105 bp, Homo sapiens
cagctgacagccagtcgctccctcatatacccagcgagagctcccactcagctttcagtgggcataggagggaacccagccaagaccagaagaactgcccagctg

SEQ ID NO: 6758985 - DNA, 81 bp, Homo sapiens
aaggaatagatatttgtgtcctggcagcccaagtgatttgagtgtcacatcacagacaattgtcagaccaaaatagtcctt

SEQ ID NO: 6758986 - DNA, 56 bp, Homo sapiens
ttttgcttctcatgataggttagctagccatgggggactttaatttgagagcaaaa

SEQ ID NO: 6758987 - DNA, 77 bp, Homo sapiens
attcggcctgggcaccaggcatgacagggcaggtgccgaatcaccctccgtgtgatagtgtggtgccctggcttagt

SEQ ID NO: 6758988 - DNA, 89 bp, Homo sapiens
cacggtgatcactgttcctgctgtctagtatcttaaaaacacaggttctgcctattttttatggttttagataggagggtgattctgtg

SEQ ID NO: 6758989 - DNA, 59 bp, Homo sapiens
tttaaggtaagtttcagcttggaagaggatccttcagtggcagtaagatttactttaag

SEQ ID NO: 6758990 - DNA, 80 bp, Homo sapiens
catttttatatgagtcattattgtaatttttgaaacttacatgtttgttgagttacagagatgaaagaaatgtgaaaatg

SEQ ID NO: 6758991 - DNA, 58 bp, Homo sapiens
ggtttcaacttcaacctctccattttatactttgttttgtgaggctggggttggaact

SEQ ID NO: 6758992 - DNA, 91 bp, Homo sapiens
acagataggaaactaactcccttttcccgtaatctatttgaggaagatggttccgagctgggaaggggctgcaggtgggttacctgtctgt

SEQ ID NO: 6758993 - DNA, 70 bp, Homo sapiens
gtgatgtttgtcactttcaagtggcaactttaagctagagtgtgcttcactgggaggtgaacagcattgt

SEQ ID NO: 6758994 - DNA, 73 bp, Homo sapiens
gtctcttttgggtccagatggtgagagttaaggctattatgtgtattaaaacaccatctgtatttttgagaac

SEQ ID NO: 6758995 - DNA, 67 bp, Homo sapiens
cctgatctttgactgacctctgaccctggccgtggactggctttgattcagacagtcgcagttctgg

SEQ ID NO: 6758996 - DNA, 97 bp, Homo sapiens
gttggaaacataaattgcatgcatgtttctcattctctttcgtgttctgaataattcccacatggagaagaggaaatgttgtctttgtgtgtttaac

SEQ ID NO: 6758997 - DNA, 72 bp, Homo sapiens
caggaagtgaaatcctggtcaacaggtaggttccggcttcctactgttcatttggatttctctgtaaacctg

SEQ ID NO: 6758998 - DNA, 64 bp, Homo sapiens
aaaagctggcaattatcaaaactggtacaatcctctacctctgagttcatggtagccagtggtt

SEQ ID NO: 6758999 - DNA, 104 bp, Homo sapiens
attttctctcacatcctcctcacccacccactgctcattggcctatattttgtgtgccaagaaagaacagcagggaagtggaggaaggggggttgagagatagt

SEQ ID NO: 6759000 - DNA, 80 bp, Homo sapiens
tatgctgactggtaatggctgtgtatatacggattctgtagacaaatgaaagtatatgtatagccagtctttagggtata

SEQ ID NO: 6759001 - DNA, 71 bp, Homo sapiens
tcatttggtattaattttcagaacctgtcgttctaaaaccttaatacagtttgaagattatgccagagtga

SEQ ID NO: 6759002 - DNA, 84 bp, Homo sapiens
tttaggtgggcacctagcaggactcagcagatattgagtgaatgcagatgtgtgtgccctgggcctgccagtgtctgacccgaa

SEQ ID NO: 6759003 - DNA, 69 bp, Homo sapiens
gatctttggtagcttccttaaatgaccttccatgttccctagaatgtcatcttaaggactgctatagtc

SEQ ID NO: 6759004 - DNA, 82 bp, Homo sapiens
tgggcctggagccagcctccgcctctctcccttcaagagccttgccaaggctggagagagcgggggtcaggctctggggcta

SEQ ID NO: 6759005 - DNA, 81 bp, Homo sapiens
gggttcagaattacatccttcaaagtcactcatgtttttttctcaaggttggtatctgtggaggaagtaaaatctgtgccc

SEQ ID NO: 6759006 - DNA, 68 bp, Homo sapiens
acaggtgtaagctgcagaactggaacttgaggtctcatagtcttcaggccctttgctgctgcccctgt

SEQ ID NO: 6759007 - DNA, 83 bp, Homo sapiens
aggataaatgtactcctgtctccactggctgaaaccatctggatggtatcacattgtctgtagaataaatatgagtacttcct

SEQ ID NO: 6759008 - DNA, 68 bp, Homo sapiens
gtgagtgaagtaagagtacagtaagatggcactctcatgccctgatagtattcattatttgcacttat

SEQ ID NO: 6759009 - DNA, 62 bp, Homo sapiens
ccacaattccacagcaacttgcttaggtagagtgaataaaggtaaattgctaggagttttgg

SEQ ID NO: 6759010 - DNA, 79 bp, Homo sapiens
acttgtcacatgcccctgcctgattccaggatggctggggagtgtattgagctgtatgtgcaggcgggtaagaacaggt

SEQ ID NO: 6759011 - DNA, 57 bp, Homo sapiens
agaggcagattggtgccctctgtatagggatggtggagaggtcattgggctggttct

SEQ ID NO: 6759012 - DNA, 79 bp, Homo sapiens
cctccactgctctgccaggagctggaaagatgagcagcccggctttgtgccagctcttttggctgagtgagagtggtgg

SEQ ID NO: 6759013 - DNA, 73 bp, Homo sapiens
ttcaggcttacatggtgccccgatggtactcccatgtagcaggtggctaccaggtgtcgggcacgatgctgaa

SEQ ID NO: 6759014 - DNA, 76 bp, Homo sapiens
ggagaacgcagccctgcagagggcgctcctcagcagaaaggccgagcagccagccagcccactgcaggtgcgctcc

SEQ ID NO: 6759015 - DNA, 67 bp, Homo sapiens
tgtagactttgtgccaattgcaggattaccgagcacttcctgcagtgctttggaacaaagtctgtca

SEQ ID NO: 6759016 - DNA, 84 bp, Homo sapiens
ggaatagatttatttgacagcttagtgaaaatgtaaatacacaattgttttgcattttagatttaggccttggtaggctgtttc

SEQ ID NO: 6759017 - DNA, 83 bp, Homo sapiens
agttgcatggtgtgatggaaggagaatggtctttgaaagcagacagacataatttcaaataccagcttttccagaatgtaact

SEQ ID NO: 6759018 - DNA, 96 bp, Homo sapiens
ttctgaagacccctgctctaaatctcatggaacttgcattaatcagcttggctaccataacaagatcccatagagcaggtggcttaaacaacagaa

SEQ ID NO: 6759019 - DNA, 72 bp, Homo sapiens
tgggactagactgagtatgccatcagagaactcataactcttgtatcctgataatacagcagtttgtctcca

SEQ ID NO: 6759020 - DNA, 85 bp, Homo sapiens
gccagaggcattattttgccatcctaggcagcattaacaagttaaaaaaattctaggttccaggatggcaataatgaattttggt

SEQ ID NO: 6759021 - DNA, 130 bp, Homo sapiens
ttgggttacccaggctcaaaaggagttttgttcataggagagaagaaagtgtgttcagggtgtagtacttgaaaacatgctagactttctttatgaattccacttccgtaagctgacttggaatactcag

SEQ ID NO: 6759022 - DNA, 73 bp, Homo sapiens
tgtttgtttttgttgttgttttgcttgacatacttgcctggatttgcttaacactgacgacgtgaactaaaca

SEQ ID NO: 6759023 - DNA, 76 bp, Homo sapiens
agaggagaaggcaaagagttttaccagctattttggtctttagcaaaataatgttaggcctttgctctctaaatct

SEQ ID NO: 6759024 - DNA, 59 bp, Homo sapiens
ttcagaagttttcaaaactaagcatccccaattgcttagttttgtcagaattgtcagaa

SEQ ID NO: 6759025 - DNA, 56 bp, Homo sapiens
ggttgcagtgagtgtgggaagtctctgccctgcaggcagcctccactcactcagct

SEQ ID NO: 6759026 - DNA, 72 bp, Homo sapiens
atcttttggcaaattgagttttcagttctttgctttcaataaaattggaaaaagacttaattgccagccgat

SEQ ID NO: 6759027 - DNA, 127 bp, Homo sapiens
ctaagggagtgacatctatctttaattatatatgggagctatttatagaggctgatgcctcattagtctaaccaggaaatagttatttgtatttattagaaaagtgttaaaaaattaaaattcttgg

SEQ ID NO: 6759028 - DNA, 55 bp, Homo sapiens
gggctgaccaatgccttgctttggaaaacagaatatggaggaagtgagtcagttc

SEQ ID NO: 6759029 - DNA, 61 bp, Homo sapiens
ggactctgcctttgtggtcgggagaatgatagtttctccattttacagataaggcagctcc

SEQ ID NO: 6759030 - DNA, 106 bp, Homo sapiens
attctgtatctttaaccagttataggtgacattgctaggaacagattttgacagcagacttgtgcaagggatctgtttgcctagagatttacttaaaaggtagaat

SEQ ID NO: 6759031 - DNA, 95 bp, Homo sapiens
tcacagatattactagcttgcaagaggtgattttattgacctggcagctggcttgtacaaaactagattatttttgaagttaggagcatttgtga

SEQ ID NO: 6759032 - DNA, 67 bp, Homo sapiens
ggagctgctgtgaggggagcttctgtgggggaaactgccatgggggagctgctgttgggggagctgc

SEQ ID NO: 6759033 - DNA, 77 bp, Homo sapiens
tgcatttcaaacagttacagctgcaaggattactcatagtaatagcagtgacagacaactgtttgagctttagtgta

SEQ ID NO: 6759034 - DNA, 55 bp, Homo sapiens
tgggtcaaatggtaattctatgactatctttttgaggaactgccaaactgatcca

SEQ ID NO: 6759035 - DNA, 111 bp, Homo sapiens
ctttataaaatgtattcataactcttaaggcaattgattatttttcctcgtaaaccgaatgaaagagaatctgttttcagaaagaacctgttggatacatgcagaagaaag

SEQ ID NO: 6759036 - DNA, 80 bp, Homo sapiens
tagatttatttcatgaggagccctcatttaggtttcaaacatctggagccttagtctggcttctcttttgaaaacatctg

SEQ ID NO: 6759037 - DNA, 94 bp, Homo sapiens
ccgggggcgtctatcctcctcctggccccatccctcacctgtgggggaggctaagtgggtgtcagggccctgtcagagggtgagccacccccgg

SEQ ID NO: 6759038 - DNA, 81 bp, Homo sapiens
ataagtattacagaagtgttgaagttttcatgggttattccataaaacattttatgacttcatgcttcactgtccatttat

SEQ ID NO: 6759039 - DNA, 80 bp, Homo sapiens
agcttttcagcatccctctgttgcagtgattttagataaacgtcaatcctattcatacaaggagggtgttcaaagaagct

SEQ ID NO: 6759040 - DNA, 76 bp, Homo sapiens
ggataaacacagagggacagtatgatgaaagcatgttatttaattcataagcttttccaaagtccatctggtctcc

SEQ ID NO: 6759041 - DNA, 86 bp, Homo sapiens
tgtttgagactttaccaagagttgtcactgtttcagaatgtcagttcatgacagggacgctgctctaggtattcgagtcttcaaca

SEQ ID NO: 6759042 - DNA, 78 bp, Homo sapiens
aaaatgcagatttctttgctgcaccctcaaaatttatgactcagtacttctagggtagcacagaggaatctgcatttt

SEQ ID NO: 6759043 - DNA, 72 bp, Homo sapiens
tggttgatgatcagtggacatggcatgtgaagaaataactccttagccatgtcacatatggtcatcgaacca

SEQ ID NO: 6759044 - DNA, 70 bp, Homo sapiens
ccctctgtccccaccaacatatgcctgactccctgagcaggcccttagccttggtgggatttcagcaggg

SEQ ID NO: 6759045 - DNA, 61 bp, Homo sapiens
gttttacagcactaggatatacatttcccatcttttgtgggtttgtaaccagtgccaggac

SEQ ID NO: 6759046 - DNA, 62 bp, Homo sapiens
taattggctatagcattatggattgtttctggagtgaaatagtcttagtctatagttttgta

SEQ ID NO: 6759047 - DNA, 69 bp, Homo sapiens
gattatgggcttctgaaccaggccctggatatggctatgtacatatttcctttctagaagcctaaattc

SEQ ID NO: 6759048 - DNA, 57 bp, Homo sapiens
tgcaaacaggcatttcacaaacggttggtttcgtgtgtttgtgtgggtgcgtgtgca

SEQ ID NO: 6759049 - DNA, 72 bp, Homo sapiens
gatagtgccaggcatttgacagacacttccagaaaacaccgaatgtgcatctactatgtgccaggcactgtt

SEQ ID NO: 6759050 - DNA, 75 bp, Homo sapiens
tgcatttgcaaattttaatttcatggttcatggcaatgacctcaaggcattgattctgaagtgaaatgcaaatca

SEQ ID NO: 6759051 - DNA, 57 bp, Homo sapiens
tcttccagggagcctcaaacctgattaacgggttagaaaatagggcctgtggagcga

SEQ ID NO: 6759052 - DNA, 63 bp, Homo sapiens
actgttggttgtgaaggttaagtgcaaagttctttaagcagggtattacacacaatgagcagt

SEQ ID NO: 6759053 - DNA, 78 bp, Homo sapiens
tcccatatgtcatccatgattgcccagaggtgtctcataaagagaatttctctctgaatcctgaagtactatatggga

SEQ ID NO: 6759054 - DNA, 58 bp, Homo sapiens
ctcccgcatgagatgctgcagctgagaattcactcagctgcagatgctcagcgggcag

SEQ ID NO: 6759055 - DNA, 67 bp, Homo sapiens
gaggactggtgaggactggtaaggactgcagcaccctgggctgggtcctcacctcctcactggcctc

SEQ ID NO: 6759056 - DNA, 57 bp, Homo sapiens
tagatctaatgcagtttatgtaaacgtaagttactgtggttactgctattagattta

SEQ ID NO: 6759057 - DNA, 58 bp, Homo sapiens
ctgttccctgtccctctgaagcctcccttgatgggacagtgtggtggacaaggagcag

SEQ ID NO: 6759058 - DNA, 98 bp, Homo sapiens
catacccagaaacttccagattgcttaactccatatatttttagcagcccaacttggtgcctatggattggagaaggagctgctgtttcctgggtgtg

SEQ ID NO: 6759059 - DNA, 81 bp, Homo sapiens
gtggccggcttgctggagccttctgcaggagcacctgtcccattggccccagtgtggctgcgtagggctctcaggcaccac

SEQ ID NO: 6759060 - DNA, 56 bp, Homo sapiens
agcagctgcttttcttcattggtaagttagaaagcattaaaagaagagtatttgct

SEQ ID NO: 6759061 - DNA, 74 bp, Homo sapiens
gcaagacctgggagcctctgcggcccacgacacctacagttttagaatctggagagcagatgcctctggcttgc

SEQ ID NO: 6759062 - DNA, 65 bp, Homo sapiens
agctcctctttcagctaattagatattgttctacaaattgggctgttgtctctgaaagatgagct

SEQ ID NO: 6759063 - DNA, 69 bp, Homo sapiens
tcttcttcttcaagtgctgcattctttgtaaatgaaagaggccaatcaatagggcaataaggaaggagg

SEQ ID NO: 6759064 - DNA, 64 bp, Homo sapiens
cagagttcttttgagcatggattacctgtatcttacagataaaagttgtttaaaatttattctg

SEQ ID NO: 6759065 - DNA, 59 bp, Homo sapiens
aagaacattgactaagaggggccagaagctatgactttccccctctgatcagtattctt

SEQ ID NO: 6759066 - DNA, 112 bp, Homo sapiens
ggattaaaatgagataatggtcataacaaagcatggttgtgagggtaagaggctgtcaaataaatgagctggaattcgacaaccttgttttgtacctatcgtatttgttttc

SEQ ID NO: 6759067 - DNA, 78 bp, Homo sapiens
tctataggaacctgaaaagctgtgccaagcaagtctgaataaagatcaagcagggatatagttttctgtttctggaga

SEQ ID NO: 6759068 - DNA, 68 bp, Homo sapiens
agcgttgtcctccaggtttgtgcacactgagccagtgaggcgcttgcagggagtctggaggaagcgtt

SEQ ID NO: 6759069 - DNA, 76 bp, Homo sapiens
aaagctctggattcctattttatatcatcttctttaggacagatactataatgtaaagtgggaagtgtttagtttt

SEQ ID NO: 6759070 - DNA, 84 bp, Homo sapiens
tatgataaagatgcccacattgcaggtaatgataattccaagtgttcgcaattcatcacctgcctactggacattttcagcata

SEQ ID NO: 6759071 - DNA, 56 bp, Homo sapiens
ccttagcattagaagctgtgggcaatgcatcctatgccattagctttgtgttgtgg

SEQ ID NO: 6759072 - DNA, 64 bp, Homo sapiens
ctctgagatgataccttctggaccgttcagcctgggttcatagactggtgttcatcagtcagag

SEQ ID NO: 6759073 - DNA, 59 bp, Homo sapiens
tgattttcatgggtgatctttgatttcttataatcacaatggattgtcctgatgaatca

SEQ ID NO: 6759074 - DNA, 57 bp, Homo sapiens
gataggctgaaagactatggcgaggaagagccctttatacagttttataggcctgtc

SEQ ID NO: 6759075 - DNA, 55 bp, Homo sapiens
actcctgccttaagagatttacaagcagagaagtagctaaaattcaaggcagggt

SEQ ID NO: 6759076 - DNA, 74 bp, Homo sapiens
acactagcgattctagccaaccatctgagatcacgccactgggtccagggagagggcaggatggatgagagtgt

SEQ ID NO: 6759077 - DNA, 99 bp, Homo sapiens
tgctaatacatgcctttggagaatccaacatgcaaacaagaaaatatacacttctggcaatgtggtcttcttcagtttggcagataaatagacttagca

SEQ ID NO: 6759078 - DNA, 129 bp, Homo sapiens
attcatttacacaccatggctttttaaaagggttgtccttagatgtggcctccagggatagttaagctgtaaatggaaggcttcatatgtaaagacattttccttttgaccttgtctcttatactgagt

SEQ ID NO: 6759079 - DNA, 94 bp, Homo sapiens
tttgtggtatgagtcatcagagtgaccttacatggtcttagtctgtctggaccataaaagagactgttggggtccggtctgaaaccatcacaaa

SEQ ID NO: 6759080 - DNA, 71 bp, Homo sapiens
aggttgggctgtggggtacccctgagtctgcaagttggcccaggccaggtgtgtcaccattgcccaggcct

SEQ ID NO: 6759081 - DNA, 65 bp, Homo sapiens
gaggcagacaaggtccctggtctttgggagctaccaatgaactaggaaaggggcctgtctgcttc

SEQ ID NO: 6759082 - DNA, 79 bp, Homo sapiens
cactgtattaatttcaccgttgctagaaatgcctggaaaataataggcattcaataagtcactgtggaataaataaatg

SEQ ID NO: 6759083 - DNA, 60 bp, Homo sapiens
cctgtcacccacccagcctgtcaccggagccgcctgacagacatctgggtgggggacagg

SEQ ID NO: 6759084 - DNA, 57 bp, Homo sapiens
cacaggagagctgggaggtgccaaggataagctttactcacttctcagtttttcgtg

SEQ ID NO: 6759085 - DNA, 100 bp, Homo sapiens
gccatcaccagcacagcagcccgcagcagcttcagagcggctggagagacatttggggacgagcagcccctctgtggctctgcctctgtttgccagtggc

SEQ ID NO: 6759086 - DNA, 77 bp, Homo sapiens
gtattataaggtagtcttgataagcattctcattttgttcaaaatgagattcagttgattagtgatgatggtgatgc

SEQ ID NO: 6759087 - DNA, 72 bp, Homo sapiens
ctgaagattttgctgaggtgaggtgaaggttgagtaattctgcaaatgtttccctttcctccagtctttcag

SEQ ID NO: 6759088 - DNA, 62 bp, Homo sapiens
cccttagaggctggaggcagcaaacagaacgtgtccctctgctgcttcctggccactgcggg

SEQ ID NO: 6759089 - DNA, 71 bp, Homo sapiens
ttccattaatccacagatataaactatagtagtgtttctgcattaccataattatttctgcagagcaggag

SEQ ID NO: 6759090 - DNA, 58 bp, Homo sapiens
acagcaggcaggctgccagtgaatggaattcacttcatttaactggcctgtttgctgt

SEQ ID NO: 6759091 - DNA, 128 bp, Homo sapiens
tgccagtatctgttagatttttggtgaaaaatggtgtttgtgtgggagtatacagtttcaggaaatctggttttaagctcttatgatatttatttatatttcctataaatctaatttgcttccaggca

SEQ ID NO: 6759092 - DNA, 87 bp, Homo sapiens
gctcaggggtagtcggttgggtgggggcccgctgaactgacaagcggcatttcagctcctttcttccaccagtcggaaccccagagc

SEQ ID NO: 6759093 - DNA, 72 bp, Homo sapiens
agagcagcaggaaagacatctgagcattttgtagttaaagtcaatattgcttacgatttcttccagtgctct

SEQ ID NO: 6759094 - DNA, 62 bp, Homo sapiens
gtatacatttattgagcacctgctgaatgccagatgctgtgtgctaggtgccagtgatatac

SEQ ID NO: 6759095 - DNA, 64 bp, Homo sapiens
tctgtgacttgcgggaggagaatgtgtgggatttttgacattggttccttcttcagatgacaga

SEQ ID NO: 6759096 - DNA, 78 bp, Homo sapiens
ggaattgaatcattgagatgctgattgaattgttgttgatggttcaacaattttgagatgagacagatcaaattttcc

SEQ ID NO: 6759097 - DNA, 70 bp, Homo sapiens
agcaccccctcacagtctaggagcagcttctctctcccccacattttgagctgttccccttgaggttgct

SEQ ID NO: 6759098 - DNA, 75 bp, Homo sapiens
gcattgaagcagagattattataactaattagaagtcacacatctgttagcttttggtttctgacttacttatgt

SEQ ID NO: 6759099 - DNA, 69 bp, Homo sapiens
ttttgacactggaatttttaactgtcagtgctattgtgtttacagcattcaagttctcagagttcaaag

SEQ ID NO: 6759100 - DNA, 72 bp, Homo sapiens
gctgatagggatcactgtctaaagttcttgtttgcattttgaagtcaacaataattgcggttctctattagt

SEQ ID NO: 6759101 - DNA, 89 bp, Homo sapiens
atttatttttcattagtggtgttattagagcattaattttccaaaagaaaatttgtagaatgttaatgaagctacagtaggaaataaat

SEQ ID NO: 6759102 - DNA, 75 bp, Homo sapiens
tagactgaaattctgtgttaccagaaagtgataccacataatatccatggtctctacagaatgcgcttcagtctg

SEQ ID NO: 6759103 - DNA, 79 bp, Homo sapiens
ggtcagcgagatattttggctcacacccagatgtcccactttcttagctggctgtgtgccaggctgtctgtctgctgct

SEQ ID NO: 6759104 - DNA, 102 bp, Homo sapiens
tcccaattgaacattcattttctctagggagagttgttatgggttaaccgattgagggagccaaaataagtctccgtataacatgaaaatgatttccaagga

SEQ ID NO: 6759105 - DNA, 55 bp, Homo sapiens
ggctgccgggtgagggccgggctggctcactcttggccactaccacctggaggcc

SEQ ID NO: 6759106 - DNA, 73 bp, Homo sapiens
gtgtataactatctatctagtaagcataaagagatgttaattttcagtagaatacaagatagaggtaatatat

SEQ ID NO: 6759107 - DNA, 68 bp, Homo sapiens
agaaagcctgagcagacggagcttggcaccttccctccaaaacagctcctcctgctgggttcctttct

SEQ ID NO: 6759108 - DNA, 87 bp, Homo sapiens
cttgcctaaatttcccaaaggcttttaactactgttttatagtggctttaaagcttaatagtaaagagtaggagagtttatggtagg

SEQ ID NO: 6759109 - DNA, 58 bp, Homo sapiens
catttatcatcagaccttttaaaagcctctgcttttaaaacggacatggtgatagatg

SEQ ID NO: 6759110 - DNA, 85 bp, Homo sapiens
tcaaattgagtagatccagattagaacccagatgtatatattcttataatgctttctaggtgatctgaggcctgtgcagctttga

SEQ ID NO: 6759111 - DNA, 79 bp, Homo sapiens
tccatataatgatactgttggatcagtgtcttcagctgcagtatgtaagcacacaggacttgattcatgatcatatggg

SEQ ID NO: 6759112 - DNA, 94 bp, Homo sapiens
ggtctgccttagcttgcctgcccttggcaccaggctctgtcccagtgccaggagccctgggcaagttcatacatcaaacgaggaggcagtggct

SEQ ID NO: 6759113 - DNA, 56 bp, Homo sapiens
cagctgccccgctggctgaccacaaacttatgagcaagcccagctgaggtcagctg

SEQ ID NO: 6759114 - DNA, 61 bp, Homo sapiens
tgagccaggttttccatcattcagttgatttccccttctgaaaggatgtacatctggctca

SEQ ID NO: 6759115 - DNA, 62 bp, Homo sapiens
tttgtgctaagtattttcttatttttaaggtaaatctctagaggtggaattactggcacaaa

SEQ ID NO: 6759116 - DNA, 78 bp, Homo sapiens
cattccttaatttcacagttcaacgcacaacgtaactggatctacatgtgtgcacatgcgctgaggatagaaggaatg

SEQ ID NO: 6759117 - DNA, 64 bp, Homo sapiens
cacagaaaggctcaaatcccaaggaaactcctccctgggatgtgaaaagtctcaattttctgtg

SEQ ID NO: 6759118 - DNA, 100 bp, Homo sapiens
atggtaaggcaagattgtgccctgaaggatgtgtggtgggagtgggtaagctgggctcccaccttaaccttcacatgagcattttcctttccttcaccat

SEQ ID NO: 6759119 - DNA, 90 bp, Homo sapiens
gggtggggtcctgtccccagaagggcagcactgggaagggtccctggcagagtctcccaggagctcctatctctgggacagatcttacct

SEQ ID NO: 6759120 - DNA, 69 bp, Homo sapiens
cccagctcagtggtggtcacttggtggaagaatatgatctatcaccaaggagttactacttagtttggg

SEQ ID NO: 6759121 - DNA, 56 bp, Homo sapiens
gttgttgtactttgactagttgactgggctagttatcttcagcaaagtgcaaggat

SEQ ID NO: 6759122 - DNA, 79 bp, Homo sapiens
cctcaacgagacattcttaggaacaatgttgtcaaggaaacatactgaaactgttacataaaagaatgtctctgtgagg

SEQ ID NO: 6759123 - DNA, 55 bp, Homo sapiens
ctgctggcttctagtcattcaaatcactaatttgaatagtgaagaagtgagacag

SEQ ID NO: 6759124 - DNA, 79 bp, Homo sapiens
agaggtgttgagtgaggaaggaattgaggttttatctgtagttggtagcatctttttctgtcttctaaacgaggcctct

SEQ ID NO: 6759125 - DNA, 122 bp, Homo sapiens
cagtgaccctctggataggtaagctgcatggaccaggctcattgagaatgtactgacacttccaggaggcagggctgtgcccgcttctcaactgttcatatattgatgcttttgggtcactg

SEQ ID NO: 6759126 - DNA, 65 bp, Homo sapiens
agagttaaccttagagcctcgactagtgctttacatataggcactagtctaggtgctaagattct

SEQ ID NO: 6759127 - DNA, 55 bp, Homo sapiens
ttagaatccagctctctctgagctccctttgagctctgacattctgtgactctga

SEQ ID NO: 6759128 - DNA, 63 bp, Homo sapiens
gctgtttctaataaaaatgaaagattacattcacaatagtaatttttcaactttggaaatggc

SEQ ID NO: 6759129 - DNA, 73 bp, Homo sapiens
ctcgataggtggtgtgcgaagagcgtgttttccaaaaatggctgcgactgtatttcccacattctctatttag

SEQ ID NO: 6759130 - DNA, 73 bp, Homo sapiens
ggaattctcacattttagtaccatgatttagaatcaggctaaatttgtcaagtgtctgaaagtgaggtttttc

SEQ ID NO: 6759131 - DNA, 85 bp, Homo sapiens
agaggtgtgagttcatcagcttctcaaaatggcttagatcccaaaaagattaagacccattgctggaagtctagttcatgcctct

SEQ ID NO: 6759132 - DNA, 62 bp, Homo sapiens
ggctcagccccgtaacacagcaaccttctaagacatctcagctgtgcacgacggcagaagcc

SEQ ID NO: 6759133 - DNA, 109 bp, Homo sapiens
gccccagagtccacaaaactgtctgtgtttctgcttcactggcctggaggtgattggatttcttctcctgggcttggttgaagttacgttcatagtcaagctcaggggc

SEQ ID NO: 6759134 - DNA, 93 bp, Homo sapiens
atggttttaaacaacagtattcagtttgggcagcagttttaagtctaactagcttaaaccaatctgaataagtctggacagttttcctaccat

SEQ ID NO: 6759135 - DNA, 65 bp, Homo sapiens
tgaaagttcaataccaatttgggcctcagggtcactgagttacaaataggagtggaaccttttca

SEQ ID NO: 6759136 - DNA, 83 bp, Homo sapiens
gtaggttctctgcagggcccaaggtcaacggaacattccaggccgactttcctctgggccctgccacccacggaggaacctac

SEQ ID NO: 6759137 - DNA, 63 bp, Homo sapiens
gcatttggaacttggttgagatgagaacatgtttcttaaaaaattacagcagtggccaaatgc

SEQ ID NO: 6759138 - DNA, 98 bp, Homo sapiens
gaggtagactctcgctctgtcaccaggctagagtgcagtggcgcagtcgcagctcactgcaacctctgcctcccaggttcaagtgattcttctgcctc

SEQ ID NO: 6759139 - DNA, 73 bp, Homo sapiens
ctacaagataaggtatgagcaatgagttttctggccgaaggaatgactctgaaattgccatacctctgtgtag

SEQ ID NO: 6759140 - DNA, 130 bp, Homo sapiens
cctaaggtgataaaagaaggtctggaaccttgcaaaagcagatcagtgtggcattagcagcagaagagatgtgccagtggctgatgaaatacgatcttaagggacagctgaaatctagttattagtggag

SEQ ID NO: 6759141 - DNA, 67 bp, Homo sapiens
acatgctttgacagagtcactaaatccttgtctgtttatttctggaatgatcatgtgaaagtcatgt

SEQ ID NO: 6759142 - DNA, 62 bp, Homo sapiens
ctggacagttcacattcactttccttgtacctagcagggaaacttgttattgtattttccag

SEQ ID NO: 6759143 - DNA, 66 bp, Homo sapiens
actagaatctgattaccctatgaataatttattacttgttttggtagactgtaatcagtttgtggt

SEQ ID NO: 6759144 - DNA, 80 bp, Homo sapiens
gcagggatttgaagcctccttattaaaggatatgttattaataatataaactttagcggaaggaggagtggtctttttgt

SEQ ID NO: 6759145 - DNA, 67 bp, Homo sapiens
aggcagttgagtggctttttcacactgtaaagacagcctgttgatttaagaagcatacttactgctt

SEQ ID NO: 6759146 - DNA, 80 bp, Homo sapiens
gctaaataataattatctgtaaatggcaatttcctaacttaattggttgaatttcattctgcaggtggtgatattaaagc

SEQ ID NO: 6759147 - DNA, 60 bp, Homo sapiens
tctccagccacaagtggccgtgtcaagtcccagagacacagcagctgcctcagctgggga

SEQ ID NO: 6759148 - DNA, 63 bp, Homo sapiens
ctgtcactgtcacgttctgaaactgtcactccattgacaccttctgagaactgagcagaccag

SEQ ID NO: 6759149 - DNA, 120 bp, Homo sapiens
taggattttgtggttgaatttgaggatttccagatttctttggttgggtttgaggatttctagacctaattctttaattcaattgaaggattctcccagacaatcagcaagtatatccta

SEQ ID NO: 6759150 - DNA, 85 bp, Homo sapiens
tctggggataaattgcgcatgcaggagagaaagacggctaggaaatccggtccttagttacttttcatgtccttttatttccaga

SEQ ID NO: 6759151 - DNA, 77 bp, Homo sapiens
gcctgcatattttgtgattctgtatatatgagatgtccaggataagcaagtttacagagacagaaagtagtttaggc

SEQ ID NO: 6759152 - DNA, 55 bp, Homo sapiens
ggctactcctggagctcagctgtgggatcagggtttgggctgaggatcaggtgcc

SEQ ID NO: 6759153 - DNA, 96 bp, Homo sapiens
gaggtatgctctcctccagctcccaggatgttggcggcaggtagctctgagctgaggcctcccctgcaattgtccttggctaaggagggccacctt

SEQ ID NO: 6759154 - DNA, 57 bp, Homo sapiens
tggagcaaattcttttcactgtgctttgtacaggcataaacttaagattttgtttta

SEQ ID NO: 6759155 - DNA, 121 bp, Homo sapiens
gtgcagaagtgacttagatgtgatagcggcttggtcctgctctggcccaggtttgtaccagctatagaaatgagccatggtagagcctaaagtagcatgatcactggagaaaattctgcgc

SEQ ID NO: 6759156 - DNA, 56 bp, Homo sapiens
acatttgagcatatttcttgtcacttttaatggtgctttaaatatgtagcaaatgt

SEQ ID NO: 6759157 - DNA, 58 bp, Homo sapiens
ttgcagacagtgagagtgaaaggtgttttattcttactattgactctcaaatttgcag

SEQ ID NO: 6759158 - DNA, 63 bp, Homo sapiens
gctatatgctctgaagttcactttgccactcaactatatggctggcatttcaggcatgtttgc

SEQ ID NO: 6759159 - DNA, 57 bp, Homo sapiens
agctgtctctctggtgtccatatgcatatgtatcttggtgcaatatgagagatggct

SEQ ID NO: 6759160 - DNA, 65 bp, Homo sapiens
tcttgcctttgagctccttgagggcaaggactatgtcctctttgtccttggctctagaggtgaga

SEQ ID NO: 6759161 - DNA, 74 bp, Homo sapiens
cccagtgaagcaagtctgtttactgaacacagactaaggtcagtgatttcagaatggattatgaaaaactgagg

SEQ ID NO: 6759162 - DNA, 77 bp, Homo sapiens
tcaactattgctttccagtgggccccttgaaataatttctgcacatgcacaggttggggggtcagccaactagttga

SEQ ID NO: 6759163 - DNA, 63 bp, Homo sapiens
tcttatcttatacctaacagcctcattattacaatagacactggctggtaggtgtaaaggaga

SEQ ID NO: 6759164 - DNA, 87 bp, Homo sapiens
tagtgcaggaggaacaagctgctttatcttcctctccaggcagatgcctgtgtgtggaagatggatgcacagcatctgcctgcattg

SEQ ID NO: 6759165 - DNA, 86 bp, Homo sapiens
atggagaagctaaaagagatgtggtttaatgaggactaaaatcaagacttaagagaatttacacattttaattggcatttctctat

SEQ ID NO: 6759166 - DNA, 103 bp, Homo sapiens
gggaggggatagggaggtctgaaggacagaatagtcagctgtaggcccaggtctctaagcttctgggtcagtgacttttttctgtggccccttttgccctcct

SEQ ID NO: 6759167 - DNA, 68 bp, Homo sapiens
tgttctctgtctccttaaaatggaattggttgctcgaggtgagctctgctgtgaggaggcaggatgca

SEQ ID NO: 6759168 - DNA, 84 bp, Homo sapiens
ccccaccacctgtccccagcacatgccccaggaatcactctgggaagctgcgtgcctgttccaggggagaggcaggccgtgggg

SEQ ID NO: 6759169 - DNA, 72 bp, Homo sapiens
ggaaggagctttcattacagccttgtgggtcttgactcaccagtccctgcaggagccagtggagttcctgcc

SEQ ID NO: 6759170 - DNA, 59 bp, Homo sapiens
ctgggtgtcagaaccaggcagtatgaaaatagaacagaactgtgggtctgaccacctgg

SEQ ID NO: 6759171 - DNA, 62 bp, Homo sapiens
aacagaaaaggtaggtggcttttttagtgcttgggtttcctgttggtgtgacttaccctgtt

SEQ ID NO: 6759172 - DNA, 68 bp, Homo sapiens
gcttgtttctgcatcagctagcaattaaagtttaaactgttgaacatgcagcttgctgtaggctaagt

SEQ ID NO: 6759173 - DNA, 72 bp, Homo sapiens
gggctgggagtggtgaagcctctgcctgcacagccagctgggtcacgctgcttgcttcccaccagccagccc

SEQ ID NO: 6759174 - DNA, 55 bp, Homo sapiens
gtgtaaatcagcttgtgtaataattgtggcacccacgcgcgcaagcagacttacc

SEQ ID NO: 6759175 - DNA, 63 bp, Homo sapiens
tggtgaagggtggcatggcaggcagtgctcatgccctgcttgtggcattgctatctctgacca

SEQ ID NO: 6759176 - DNA, 76 bp, Homo sapiens
aagcatttaacaaattggggaaaaacatttgcaactcagttgacagtgtcagtttcctaatatatattaagagctt

SEQ ID NO: 6759177 - DNA, 117 bp, Homo sapiens
aggaggcagtgaacctctcctgccctttccttccatctccatcaccttgagcatcttctgggcagctgaggtgaccgcagatgggaaggaagggcgcagagatgagcattttcttct

SEQ ID NO: 6759178 - DNA, 70 bp, Homo sapiens
gatgctagtttttccatgctaaccagagacataaagtggttttctccacttttggtagaaaagctacatc

SEQ ID NO: 6759179 - DNA, 84 bp, Homo sapiens
ctctcaatcatcagtctagtcttgctccttatcctgctctgaggaacagagaggccagtgtggctggagcacagtgagtgagag

SEQ ID NO: 6759180 - DNA, 74 bp, Homo sapiens
gtgatccactcctggaggtgccccatgggtaggaccttgagccaggtgagggtgagccccaggatggagatcac

SEQ ID NO: 6759181 - DNA, 96 bp, Homo sapiens
gaggcgggaggattgcttgagcccaggcagaggttgcagtgaaccaagatggcaccactgcactccagcctgggtgacagagcaagaccctgtctc

SEQ ID NO: 6759182 - DNA, 62 bp, Homo sapiens
gttgctgcaaaggagtgtaggtaacacaaaccaccacctgcaaacttcctttctagctcaac

SEQ ID NO: 6759183 - DNA, 81 bp, Homo sapiens
cagggttgaggtggtgtgatatcacctggaggaggaggggacaagggaactttctggagtgataaaacaccacacatcttg

SEQ ID NO: 6759184 - DNA, 84 bp, Homo sapiens
aaccagttctctgttcttctccactgtatgtgcagaactaaacacagcacctggcatatagggagacagcacagaatagtggtt

SEQ ID NO: 6759185 - DNA, 56 bp, Homo sapiens
tttcctccttttcttcactgatatcaatgaatgggattacaaggtagaggagggaa

SEQ ID NO: 6759186 - DNA, 66 bp, Homo sapiens
gcccgtgggcctcccctttacgagccacggagagcttcggggctggagggccggggcctgcgaggc

SEQ ID NO: 6759187 - DNA, 74 bp, Homo sapiens
tagttttatctgttgtacatttatgctgataaccctttattaggttagatgcagaaagtatatagatataattg

SEQ ID NO: 6759188 - DNA, 75 bp, Homo sapiens
gtccatctgtctgtccgtgcaggtcttatgtggaaggtaagggagtgagaagtgccgaaaggaagacagagggac

SEQ ID NO: 6759189 - DNA, 98 bp, Homo sapiens
tgaagattcctgctctcctgctgaggtggagattgcagtgagctgagatcgcaccattgcactccagcctgggcaacaagtgcaaaactcagtcttca

SEQ ID NO: 6759190 - DNA, 63 bp, Homo sapiens
gcccctgctggtccatgtgtccaaaatggttaaagcaactttgggtccatggaacagaggtgc

SEQ ID NO: 6759191 - DNA, 56 bp, Homo sapiens
gaatttcaacagtcctcaaatggtgggtattaccttatttgtggtagttgagattt

SEQ ID NO: 6759192 - DNA, 87 bp, Homo sapiens
tactaggaaaaacaaggtgttatgatgtcttgataaacatttggtaagataggagtcttgttacacataataacatttttctgagta

SEQ ID NO: 6759193 - DNA, 113 bp, Homo sapiens
tctcataaaaatgatactgggcacttctgataccagcttttcaaacctctaattggttcacagacaaagctttgaaagcaggtgtgggagggtcacgatcagagacagtgaga

SEQ ID NO: 6759194 - DNA, 75 bp, Homo sapiens
tttataacagtatagcctaacatttcctgcactttgggattttagggagatgtctatgtctatacttggggtaag

SEQ ID NO: 6759195 - DNA, 103 bp, Homo sapiens
ggggcaggggacgctccagctggtctggggttggccagggccctagtggcccgccctggggccccagctcggcccctcgcctcgctgagctctagtgtgcccc

SEQ ID NO: 6759196 - DNA, 86 bp, Homo sapiens
aaggagaagataatgaatttattgaatgtcttggtactgtgccaagtttttttacataaatggtttcatttaatctttacaaactt

SEQ ID NO: 6759197 - DNA, 82 bp, Homo sapiens
tttgacttttgatgtgtgaattcttaaatgtgcacaaaccaaagacaatggcatatatactttgacacattctgaagttaaa

SEQ ID NO: 6759198 - DNA, 56 bp, Homo sapiens
catctctcaccatggataaggcattttactttagaggcaaccctggtgagcagatg

SEQ ID NO: 6759199 - DNA, 66 bp, Homo sapiens
accaaagtgttttcagtaaggattctcttgttttgatcttgagagaatacaaagaagatatgtggt

SEQ ID NO: 6759200 - DNA, 63 bp, Homo sapiens
ggccagtttccatgcactatttctgaacggccccagcttctctcctagtgagtggatctggcc

SEQ ID NO: 6759201 - DNA, 59 bp, Homo sapiens
tgagtatcttggctctcaactagaatcagtactagccatggacctggccaagttactta

SEQ ID NO: 6759202 - DNA, 65 bp, Homo sapiens
tggcctattgtctgggaaaaggaatgtccaaggatgctcactacattttagacagtaaagagcca

SEQ ID NO: 6759203 - DNA, 82 bp, Homo sapiens
agtaaagtaaattcaaggatctgttaaatctggtaaaagtagatcaaatcagagattgacagcctgtggagggtgctgaact

SEQ ID NO: 6759204 - DNA, 69 bp, Homo sapiens
tctgaaagtacaaggaaaggatctgatgccgtcctctctcctagcttcgggtagttccttggcttgtga

SEQ ID NO: 6759205 - DNA, 81 bp, Homo sapiens
gtgatctgtaaactttcagccctagaaagtctaagcagaacattttcttagtcttttagaggctgctgtggggccagacat

SEQ ID NO: 6759206 - DNA, 63 bp, Homo sapiens
ccctgagaacaacttaggggtctcctataaagggatgaccaagttctaggtttttctctaggg

SEQ ID NO: 6759207 - DNA, 60 bp, Homo sapiens
gatcagtgctgagagactatcaatataggatgatctgtttgaatcttagcagggctggtt

SEQ ID NO: 6759208 - DNA, 75 bp, Homo sapiens
cccacgcggaggaggtcaggaggtgacacaggttcgcggaagaaagcgggactcatcttcctcatttctccaggg

SEQ ID NO: 6759209 - DNA, 78 bp, Homo sapiens
ttcgctgctggcccttctcttcctgggagcgctcatcattgcccagctgccagaagaggaggggttagcattggtgga

SEQ ID NO: 6759210 - DNA, 63 bp, Homo sapiens
tcttccagtgctgtgtagagctggatacatgtacagccctgccttcccatgcagctggggaga

SEQ ID NO: 6759211 - DNA, 62 bp, Homo sapiens
cacagtatccctctttctcccctcaccccaccagagatggcagaaacctcagggatgcagtg

SEQ ID NO: 6759212 - DNA, 57 bp, Homo sapiens
taccaggatggaaacttgacttttagaaaatcataagagctatacattcacctggta

SEQ ID NO: 6759213 - DNA, 55 bp, Homo sapiens
cagcagagctgggctttgaattcaggccaactgcactttaagtcccagctctttg

SEQ ID NO: 6759214 - DNA, 55 bp, Homo sapiens
cttctctgggaaagaagacatcaacccttgagtgttccttgctttcccagaggag

SEQ ID NO: 6759215 - DNA, 61 bp, Homo sapiens
acagacattttaagacactttactcaaatccgtcatcgagtaaaggagttgcattgtttgt

SEQ ID NO: 6759216 - DNA, 82 bp, Homo sapiens
gacttgctttggctttcctccccaaatcacacaactagtttccctttgtaacatttggtgaggtagccattgttagaaagtc

SEQ ID NO: 6759217 - DNA, 87 bp, Homo sapiens
caccagggccctgagtcatggagagaaccagtcccactcagcacctctgagactctggggctccctccacctttctgggtgatggtg

SEQ ID NO: 6759218 - DNA, 58 bp, Homo sapiens
acatctttgtttcttagtgtatagatcagggggttaacactgggagtgacaattgtgt

SEQ ID NO: 6759219 - DNA, 67 bp, Homo sapiens
tgtagaatccagccagtcccatttcaaataggtcttcaccctgtatcaaatgactggtgattaaata

SEQ ID NO: 6759220 - DNA, 70 bp, Homo sapiens
caggtggccaaggcccagccaatgggggcaggtcaaggagctgcctctacctggggccccgtggcccctg

SEQ ID NO: 6759221 - DNA, 67 bp, Homo sapiens
ggaagaggaagcctctctgttagtcactgggtcacagaccctgaccctatcagagggccacctttcc

SEQ ID NO: 6759222 - DNA, 85 bp, Homo sapiens
ccaggccctgccccccagagacagtctcacctggagtttaaactttttgaaaaccgtgggaggctgaatcagggaggcagccagg

SEQ ID NO: 6759223 - DNA, 61 bp, Homo sapiens
aaggaatatggtgttgtcctattcttgttagggaaggattggaccactactgttttctctt

SEQ ID NO: 6759224 - DNA, 68 bp, Homo sapiens
tctaggccttcaggtcttgagccatcaggatatgcagtcaagtctacctgggcaaggcctgtgccaga

SEQ ID NO: 6759225 - DNA, 57 bp, Homo sapiens
catactctctagaagagatagatctgcgggaaagagggattctgtccagggagtgtg

SEQ ID NO: 6759226 - DNA, 69 bp, Homo sapiens
attggagtggtttaaatagctgttgtttatttactatcacagagccggcaactgttttgagcacccagt

SEQ ID NO: 6759227 - DNA, 64 bp, Homo sapiens
cacctctgtcctggctggtctcgtgcacgcaagccatgcaggtgccagctctcaggcaggagtg

SEQ ID NO: 6759228 - DNA, 58 bp, Homo sapiens
ggagaaagcagtcccttccgaccgcctgaacagggtgggaatagaagatgcattctcc

SEQ ID NO: 6759229 - DNA, 65 bp, Homo sapiens
gctgaatggcggtttgggaagggctttctgacatttgcagaggcccagggtacaggccgctcagc

SEQ ID NO: 6759230 - DNA, 93 bp, Homo sapiens
gggcgggcagtccctaggggcatccctctgaggggccaggctccatcttctaggatgcctggtgtccagaggcgagtggaccgctgcctaccc

SEQ ID NO: 6759231 - DNA, 58 bp, Homo sapiens
attgggagaggggtgagagatgggaagagggtgctttcccctcaccattctgcccaat

SEQ ID NO: 6759232 - DNA, 60 bp, Homo sapiens
aagtcactttcccattccttgccttggtttccccaaatgtaaggtggtgacaagtatctt

SEQ ID NO: 6759233 - DNA, 82 bp, Homo sapiens
gtgggtgatttaatatggtactccttaagctaacaggcccctgtcaccattagcttaaggagtaccagatcaaatcacccac

SEQ ID NO: 6759234 - DNA, 76 bp, Homo sapiens
cttaggcttcctttaaagactgcataacttccaaaagtcaagggaattgtttggctttttaaaatgtgagcctgag

SEQ ID NO: 6759235 - DNA, 75 bp, Homo sapiens
atgatagttactgggaaattgccctagttcttcagtcactcctcagtaggacgcaatttccttagtgctagtcat

SEQ ID NO: 6759236 - DNA, 85 bp, Homo sapiens
gcccatcatagctgatggtggcatccagaccgtggggcacgtggtcaaggccctggcccttggagcctccacagtgatgatgggc

SEQ ID NO: 6759237 - DNA, 112 bp, Homo sapiens
attttttatatctaagttgttatggtttgtctaaatgagtaatactttataatttgttgctttctgttacatatttggataggttctgtcaaactttaggttttatttgagt

SEQ ID NO: 6759238 - DNA, 65 bp, Homo sapiens
ggagggaggggtggcgttggcatttaggcacttgggttccttaaatcctatgctcctttctctcc

SEQ ID NO: 6759239 - DNA, 88 bp, Homo sapiens
ggtggtagtgataatggggaatgataagtcattagctggattaaatgaattctttccatgttcccattatctagatagtcattccact

SEQ ID NO: 6759240 - DNA, 59 bp, Homo sapiens
ggcattgtttacagcactgcacactgctttcattacgaagggctgatgtagacagtgtc

SEQ ID NO: 6759241 - DNA, 93 bp, Homo sapiens
ccaagtagctgggacaacaggtgagcaccaccacacccagctaatttttgtattttttggagagacagggtctcactatgttgcccaggctgg

SEQ ID NO: 6759242 - DNA, 75 bp, Homo sapiens
ggaggttaagagcttccctgttgtagaggctactccagtttttgcccttgatgggggtaagctaaagctgcttcc

SEQ ID NO: 6759243 - DNA, 87 bp, Homo sapiens
cacataactcttcaggaatatgtcagtcaagatcctctggaagtttaagtgcaggggctggtgactgttcctggaggaaggagtgtg

SEQ ID NO: 6759244 - DNA, 78 bp, Homo sapiens
gaatatagtgattatatcagtaaaaacattgtaaagccactataatagctcacagtgtatgatatttcacagttgttt

SEQ ID NO: 6759245 - DNA, 76 bp, Homo sapiens
cttggcctccttttgtagggccatttcccaggcagcttcttgttaaagccaagaaatgcccctcacagaacccaag

SEQ ID NO: 6759246 - DNA, 99 bp, Homo sapiens
gtgcaggatgcccaggggccatgtggagaggagacggtgcagccctgggaatctggggcaggtgacctcttgtcctggcctgtgaggccggtcctgtgt

SEQ ID NO: 6759247 - DNA, 73 bp, Homo sapiens
ggtttagacttcatctctcactgtgaatggcggaattgttctaactaactacagtaagaggaaagcagaggcc

SEQ ID NO: 6759248 - DNA, 55 bp, Homo sapiens
ggtaattccttaagctgaagacttgaaggcaagtcctttctcatggaggaatttc

SEQ ID NO: 6759249 - DNA, 61 bp, Homo sapiens
cttccactgtggattccatcattgatctgtattaaggactctaatggcttctgagtggagg

SEQ ID NO: 6759250 - DNA, 70 bp, Homo sapiens
gaagcacatagttccctggttgattaaccatttaattttattgtaatggtagaaattagggatgagtttt

SEQ ID NO: 6759251 - DNA, 90 bp, Homo sapiens
gctatacctaagtgtctttttgtaaaatcctatttgtgaaactatgtttaattttaggaatgtggtttttgagcagatatggtaataagc

SEQ ID NO: 6759252 - DNA, 65 bp, Homo sapiens
gcctagccccagtagtcctgcagggtaggagcagctgcctgctgtagggcccctggggccttggc

SEQ ID NO: 6759253 - DNA, 128 bp, Homo sapiens
cattgttcaattgcttcttgttccaggaaaattctctctgctacattttgaacaagatgtattcagtgcatgaacttcacttgtaaatgcagccttgggggtcttcttttaacctggcacctactttg

SEQ ID NO: 6759254 - DNA, 75 bp, Homo sapiens
ttttccagcaaacaggaatgaggagaaaaggtcaaggacatctagcctttatcttcctgattcagatttggaaaa

SEQ ID NO: 6759255 - DNA, 88 bp, Homo sapiens
ctttcagataccccctagttatgccagaagtgcagagtgcatttatgtttctgaatcctccttgctggtctggtgtaattcctgaaag

SEQ ID NO: 6759256 - DNA, 62 bp, Homo sapiens
agagaacaaattaaaggtggttatagacagaagcattttcactactttttaatttggtctct

SEQ ID NO: 6759257 - DNA, 129 bp, Homo sapiens
ttgtttaagtaatacttggttttataatcttgtaagagaaaagaagtgaaaggcatttcagaattctacttttattttctatgtgttcatttctctctgctgtttgttatgaccaaatctgctatcaaa

SEQ ID NO: 6759258 - DNA, 77 bp, Homo sapiens
gaagcagtcttggagaactgggccttaagcccctgcattctttcgggcttgactcttgcttcccatggatcagcttc

SEQ ID NO: 6759259 - DNA, 60 bp, Homo sapiens
tatatgcctttaagtaatacgatacctgctgctatggtattggctttttaaaggagtata

SEQ ID NO: 6759260 - DNA, 75 bp, Homo sapiens
ggctgcaggagggctggggaagccagactcagtcccctagacctgggagctgggctccttgcccatccagcagcc

SEQ ID NO: 6759261 - DNA, 84 bp, Homo sapiens
gtggaggcccagagacgggagggattagttctgcctggggagcccagaaaagcatctggttctttcatttctgtattcctttac

SEQ ID NO: 6759262 - DNA, 73 bp, Homo sapiens
aaggaattcagagatatatagaaggcagtaaagaaaatagaggcagctgcttctttttatcttggagtacttt

SEQ ID NO: 6759263 - DNA, 74 bp, Homo sapiens
gggtggaggttcaagttcacttgtctacaagggatgccctttctactaacaagtgagcctgaagcaatataccc

SEQ ID NO: 6759264 - DNA, 55 bp, Homo sapiens
gagggtctcctgcccctggctctgccttgagtgagtgtgggtgagggaggccctc

SEQ ID NO: 6759265 - DNA, 107 bp, Homo sapiens
tttttctcttaatttcaccagggaggctgagactctgaatttttcccccttgcaggagggaataatttagattttcttccatccctgtcagaagttgaacagacgaa

SEQ ID NO: 6759266 - DNA, 62 bp, Homo sapiens
cagattcagtgtttggtttacaaattcctcctgatttataaaccattcagactgaaccactg

SEQ ID NO: 6759267 - DNA, 59 bp, Homo sapiens
cctgggggccaggaaggtgtgagcaacagtgctgaccggccactctttctgcccacagg

SEQ ID NO: 6759268 - DNA, 75 bp, Homo sapiens
gcaagattagaatcaactgtgaggggaactaatttaaacaagcccttccttagtcttattgagtctcatatttgc

SEQ ID NO: 6759269 - DNA, 72 bp, Homo sapiens
taatattcacagggggagaagggtataatactcccgatatcgcagggggtgtacactccccctgtgaagttg

SEQ ID NO: 6759270 - DNA, 77 bp, Homo sapiens
agctgaggcgtatggatcacctgaggtcagcagttcaagaccagcctggccaacatggtgaaacccccgtctctact

SEQ ID NO: 6759271 - DNA, 129 bp, Homo sapiens
aattaaggtttccctattcatccaacaaacacttattgagctttttcttcatacaagaacctttacaattcaaatcttaggaagcaaagagtttagtgggtgattcatattattaggggaaaaaacatt

SEQ ID NO: 6759272 - DNA, 80 bp, Homo sapiens
atggagggaaagatactggaaaatgacaggtctttttaactcaactataaagtcttgtcttattttaatagatcctttat

SEQ ID NO: 6759273 - DNA, 91 bp, Homo sapiens
gccaggatggtttcgatctcctgaccttgtgatccgcctgccttggcctcccaaagtgctgggattacaggggtgagccgccgtgcctggc

SEQ ID NO: 6759274 - DNA, 67 bp, Homo sapiens
ggggaggggctgggagaacagtgtgttaacattttgaagaccactactctctgagctttacttgccc

SEQ ID NO: 6759275 - DNA, 79 bp, Homo sapiens
cagctgtcaacacctctgggcctctggtccattctccctgttaagaaagagaaaatggcaagagccacagaggcggctg

SEQ ID NO: 6759276 - DNA, 81 bp, Homo sapiens
ggactctgatagagcaaaagtctgggaatgccacgggcgagagttgctgaaatctccaatcttttctttagtcccagatcc

SEQ ID NO: 6759277 - DNA, 129 bp, Homo sapiens
gaacagattttattagatgctaaatatagtaagcctctccagagacagtattacatttcaggggattagaggatttgtaaaaccactgtctgctcataatggagggcttatcaactgaaaaatattttt

SEQ ID NO: 6759278 - DNA, 71 bp, Homo sapiens
gggtacctggccaggccccttgcagggcagaacctcaggtggataggcctctcagggtctggccgggtccc

SEQ ID NO: 6759279 - DNA, 76 bp, Homo sapiens
ggagatatataggagaaagagtttgttgctgatgttatagaatcaccaatgcagcattgcacttttgttcttttcc

SEQ ID NO: 6759280 - DNA, 55 bp, Homo sapiens
tcatgataatacaggccttctacccattctgttaaaggtttgctgtatatcatgg

SEQ ID NO: 6759281 - DNA, 69 bp, Homo sapiens
gcagactggataggtttggtagaccacttgatacttctagctccacaccatggcctcatctagttgtgt

SEQ ID NO: 6759282 - DNA, 73 bp, Homo sapiens
cgaggagcatctctaaatccagtaagtgggttttgttccccatcagctgggcagggagaatgcctgctctttg

SEQ ID NO: 6759283 - DNA, 57 bp, Homo sapiens
gcctggctgtctggcaaggttcttccaaggaacctccaccatgaaagccatgaatgc

SEQ ID NO: 6759284 - DNA, 75 bp, Homo sapiens
ttctctctgctccaaagtggggctgaccaactaggttggtgacctggctgctttcactatggagttctaggagga

SEQ ID NO: 6759285 - DNA, 57 bp, Homo sapiens
caactgaggtctcagccaattatggagagctctggctgtgggatggcccctcagttg

SEQ ID NO: 6759286 - DNA, 80 bp, Homo sapiens
gaggcgctccattgctggaaggacgctgagaggggttcaaacatgggcagatgttccagaaccttcctgctggaagcctt

SEQ ID NO: 6759287 - DNA, 67 bp, Homo sapiens
ttggctgaatgaggtcacctttctttaattctcttagatgaagcctaagaaaactatatttggccag

SEQ ID NO: 6759288 - DNA, 81 bp, Homo sapiens
ggatatcactagtttggtttactctggggatatctgaaaaatctctggaagacttagagtagcatcagttgtaggtcatct

SEQ ID NO: 6759289 - DNA, 71 bp, Homo sapiens
gcctgcagaattctcagtcagactccttttccagcctgtacggtcaggaagtctgacaagaaaatgtatgc

SEQ ID NO: 6759290 - DNA, 68 bp, Homo sapiens
gttcttggtggcttctgaggatggcgaagggctcaccttctgtcatcccgaaccatcactgatgggac

SEQ ID NO: 6759291 - DNA, 84 bp, Homo sapiens
ttgtaattggaaaaatgtcaatttttgattctataactgaaaacaagtgttatttgggtttgagtgtggcagccttctgtgcaa

SEQ ID NO: 6759292 - DNA, 60 bp, Homo sapiens
accattctggttaagaacccattttgtttaatcctcatcaagatggagctagaacttggt

SEQ ID NO: 6759293 - DNA, 81 bp, Homo sapiens
gaggctcagtttacatgtctggtgaatgagaagaatcaacctaagtattcatttatagggcattgaaaactggcgagcctc

SEQ ID NO: 6759294 - DNA, 84 bp, Homo sapiens
aaaactgtcagttacttgagacgtttatgaaagaagtctagctgggcaccatttaattcataaatgctggaagctatcagtttt

SEQ ID NO: 6759295 - DNA, 81 bp, Homo sapiens
agaacacatcttggacgtggtcttctcagaatggcttttcctgactgccttccatgaagtacgtgcctccacttgtgttct

SEQ ID NO: 6759296 - DNA, 72 bp, Homo sapiens
gaaagggcttaggcagggctggaagatcttgctctcacattggcatagactggaagcctgccaagcaaattc

SEQ ID NO: 6759297 - DNA, 76 bp, Homo sapiens
ggtactgaagttttgacatctcatttcccaatagcttcccagctgggtccaagtgttatgtaggatttcagagacc

SEQ ID NO: 6759298 - DNA, 56 bp, Homo sapiens
tttcacatgtggaatgccaggttaaattcttgttgggccaaattccatgtgtgaag

SEQ ID NO: 6759299 - DNA, 68 bp, Homo sapiens
ccttagctagctggtccccttcacctttggtaaggtctaagttctgcagggatccagctgggcattgg

SEQ ID NO: 6759300 - DNA, 83 bp, Homo sapiens
tgaaagtggctcccttgagaagagatttatatttgcttcccccaggcatttgaaaatactcttttccagccagggccacgtca

SEQ ID NO: 6759301 - DNA, 57 bp, Homo sapiens
taggaaatgaatgcaggctcccatggggtatcccccagcctgattctgggtttccta

SEQ ID NO: 6759302 - DNA, 58 bp, Homo sapiens
gacaggaggcagagctcaggtggtaatgctcactcccactgctgctcacctcctgctc

SEQ ID NO: 6759303 - DNA, 66 bp, Homo sapiens
ccctggccttttgtttctggagaacggagctaaggtactttttctcccagaccaaaggcagcaggg

SEQ ID NO: 6759304 - DNA, 58 bp, Homo sapiens
ggctctgtggtggagtgggtcacccccctgggcgtccccatcatccagccgtatcgcc

SEQ ID NO: 6759305 - DNA, 88 bp, Homo sapiens
gggtcctccctgcttctgcttcagcagcaaaacccaggacagaagctgctctctgttttcctgcctgtctctagaggccggaggacct

SEQ ID NO: 6759306 - DNA, 67 bp, Homo sapiens
ccctgcttctatccctccactgcactgccttttatttataaaatgaggcactgggggatgagcaagg

SEQ ID NO: 6759307 - DNA, 60 bp, Homo sapiens
tttgtcagttaaatgaggtacaagagggacgctctatttgcccctaattagctgcacaga

SEQ ID NO: 6759308 - DNA, 55 bp, Homo sapiens
ctttctggaagaatgttctctttgcttgtccaagcccagagagaattccagtagg

SEQ ID NO: 6759309 - DNA, 62 bp, Homo sapiens
actgcatctgaactgtgaatggactgtgaatactttttaagatgtcatagttctggagcagt

SEQ ID NO: 6759310 - DNA, 60 bp, Homo sapiens
ttctatgcctgagaagaagccgcaaaaagagagaggtttctgcatgtttcagagctggga

SEQ ID NO: 6759311 - DNA, 75 bp, Homo sapiens
caggtcttcctccagctgcttcacaatgatcctctcctccaccagcacgtcattaatccagtcgaggaggacctg

SEQ ID NO: 6759312 - DNA, 60 bp, Homo sapiens
caaggcttatcagccaggagccaagtacagggaagggtatttcctggctggaggactttg

SEQ ID NO: 6759313 - DNA, 62 bp, Homo sapiens
ctgaggactactacattggacagcatgagtctaaggctttgctactcaaagtgtggtcccag

SEQ ID NO: 6759314 - DNA, 57 bp, Homo sapiens
ctgcctgcgttgcctcgtgcctggaatcctagcacattgggaggccaaggcaggcgg

SEQ ID NO: 6759315 - DNA, 62 bp, Homo sapiens
tcaatgcataggaggtggcagagtgtttccagaccaagacctgtcacctgattatgatttga

SEQ ID NO: 6759316 - DNA, 61 bp, Homo sapiens
aagcttctttacaggagagatttcaccaaaatctgtaaaatgaattcttgttctggagctt

SEQ ID NO: 6759317 - DNA, 56 bp, Homo sapiens
aagtattttatatggtggttgtgtagtttaagtgaaattatacatgtaaagtgctt

SEQ ID NO: 6759318 - DNA, 89 bp, Homo sapiens
ggttgatccagggatgcagcgtctgtagctctactccttgctgcttgacaatgatgtacagccacggtgctaggcccttaagtacaatc

SEQ ID NO: 6759319 - DNA, 79 bp, Homo sapiens
ggggtatttaagacaaatttgttttcctgtctgctagctcctgaaaagacaattaaaaaattatgcttaagtaaacccc

SEQ ID NO: 6759320 - DNA, 71 bp, Homo sapiens
gatgtggctgctctaaagcccatttttatctaaatatttacaacaaagttggtctgctgaacagccgtatc

SEQ ID NO: 6759321 - DNA, 84 bp, Homo sapiens
cccacgggtggagcagtaggagaaccctgagctccagagtgaatctggccagggttcgaatccgtatggctctcttaccgtggg

SEQ ID NO: 6759322 - DNA, 68 bp, Homo sapiens
gcctctgagccatgggtctaagcactccatcccctaccttgaagtgacacatggtggctctaaggggc

SEQ ID NO: 6759323 - DNA, 97 bp, Homo sapiens
tgtagtaataaagatccacatttatcttctgcagttctggctttggtattcttactttgaactggaatagcacaggaaaagtggattgaggaccgca

SEQ ID NO: 6759324 - DNA, 90 bp, Homo sapiens
tttttgatttactgaggtaaataaactgaaacaacataggatatctttcaagttgtaaaatatagttgaatttatcagtagcattagaaa

SEQ ID NO: 6759325 - DNA, 85 bp, Homo sapiens
tcccaggattctgctggagggagctgatagtgatacttgtcccttctgtacattgcttcatgtagccttctcagcatccctagga

SEQ ID NO: 6759326 - DNA, 65 bp, Homo sapiens
gccttattgagtcagttagctaactctatgctttgcttctatgtggctgcttgttttagtgaggc

SEQ ID NO: 6759327 - DNA, 71 bp, Homo sapiens
ggctctcattacagctggggttccaagtggtccaagataaaactggaaacatcctcaagtatgaagaggcc

SEQ ID NO: 6759328 - DNA, 88 bp, Homo sapiens
gggtcttgctctgttgctcaggcaggagtacagtggtgcaattagagctcactgcagcttcgacctcgggtgttcaagtaatcctccc

SEQ ID NO: 6759329 - DNA, 64 bp, Homo sapiens
gaagttcaatgtcagcatctatgtcttaaccatttttgtgttaattgttgatattgaaaacttt

SEQ ID NO: 6759330 - DNA, 71 bp, Homo sapiens
gctcaccagacagttactgcatgttcaataaataccatttgatgacaataatgtgcttagctgctggtagt

SEQ ID NO: 6759331 - DNA, 61 bp, Homo sapiens
cagcatctggatttcctccacttgcggcttcaagtaagatggaagaagaatcagaggcctg

SEQ ID NO: 6759332 - DNA, 64 bp, Homo sapiens
tctaatgggagctgaatgactgtgtcgtacaatctagaggcagagcaagcagaatccatctaga

SEQ ID NO: 6759333 - DNA, 80 bp, Homo sapiens
ccataactgccttttgctatatttaattacttataatctcctaaggctgttatgagataatagatgtgtaaatgctttgg

SEQ ID NO: 6759334 - DNA, 55 bp, Homo sapiens
ccgccctcacgaggtaggtaccaacagtgctcctatttccatggtgaggatgtgg

SEQ ID NO: 6759335 - DNA, 82 bp, Homo sapiens
ctctgggcaggaacaatcttactactattgttacttttaataattctaataatagggtcacaattgtatttttttcccagag

SEQ ID NO: 6759336 - DNA, 58 bp, Homo sapiens
tgaaatctgagtttatgctcccccaacaaattggaggacacatttatttcagaattca

SEQ ID NO: 6759337 - DNA, 69 bp, Homo sapiens
actcagaagacagagtgccacttactgaaaggttttttctctcagtaagtggcactctgtcttctgagt

SEQ ID NO: 6759338 - DNA, 69 bp, Homo sapiens
gggctggcgcctgctgcacccacggggggctctctgctctgcgtgatgagggtgcagcagcgtccctcc

SEQ ID NO: 6759339 - DNA, 67 bp, Homo sapiens
ggagggaggttgtccgtggtgagttcgcattatttaatgatgcccaatacacggtcgacctcttttc

SEQ ID NO: 6759340 - DNA, 83 bp, Homo sapiens
tttgatagctggtttgtcatgcaaggttttaattctctttccttcagaaatagcatgttcatgataaaataagacagatcaaa

SEQ ID NO: 6759341 - DNA, 70 bp, Homo sapiens
tacttctctgcgatcacttgataagttagtcaaatgattggcattttagacatgatggtgcagagaggta

SEQ ID NO: 6759342 - DNA, 99 bp, Homo sapiens
atgcacttcaccataaaacctaagatctggtatgtgacagctggctgtagctgcagtcccatgagcccagaacattctatgtttgtggtgtgtgtgtgt

SEQ ID NO: 6759343 - DNA, 55 bp, Homo sapiens
ttctcagccccaatttgccctcttggctctgccaggaggtacagggtgctgggaa

SEQ ID NO: 6759344 - DNA, 57 bp, Homo sapiens
cagctttcactgatatgctttgactcccctcttagagatcatgcaatcagtgaactg

SEQ ID NO: 6759345 - DNA, 86 bp, Homo sapiens
agaatattccatagactttccttttctctagtaagctttatattgtggagcctagaaagagaaaagactctaagtttgtatattct

SEQ ID NO: 6759346 - DNA, 63 bp, Homo sapiens
gaaatcagagggggtgaggactgaggaaaggccactggctttggcaatcttccttttgatttt

SEQ ID NO: 6759347 - DNA, 57 bp, Homo sapiens
gctcctgggctctaccttgctactgacatcaggcagtcaaaacagagtcctaggagt

SEQ ID NO: 6759348 - DNA, 55 bp, Homo sapiens
ggagaaaaggctgcttactcagctccctctgctccaagtcacagaccttgtctcc

SEQ ID NO: 6759349 - DNA, 91 bp, Homo sapiens
cacgagcatgtgtttcttttagaggagagcttcaattttactataattgtctaaagacggagctgctttgatctgaagaattattattgtg

SEQ ID NO: 6759350 - DNA, 108 bp, Homo sapiens
caggttggggtagggactgtggcctggggacactatctaggtgttacttaaagaatggtacttcctaagccaccaaataataccttccaagtctcctcctataatctg

SEQ ID NO: 6759351 - DNA, 125 bp, Homo sapiens
agaaacaccaagaaaatgctacgatatattacagttcgagtttctaggcactgtgatgacattatctgtaagctctggcatttggaccactgtgatactatagggtagtgttgagaataacgtct

SEQ ID NO: 6759352 - DNA, 63 bp, Homo sapiens
catgccctggactagctatactttatcctgcaaggggaataagttatggattccattggtatg

SEQ ID NO: 6759353 - DNA, 127 bp, Homo sapiens
gagggttccctggtaggttcttcactgtgatgtctgcatatagaaaccatgtcctgttctcctttatgcccaccataaaaggaagactcgcaggtctatggctgtcatggccctccctggcaccctt

SEQ ID NO: 6759354 - DNA, 58 bp, Homo sapiens
tctttttttctcactttatttcctgatggtgtgcaggaaagtgtgtggggaagaagga

SEQ ID NO: 6759355 - DNA, 84 bp, Homo sapiens
ttgtaggtgcagggtccatctttcatcactgccatgcgagtgagctgtgaagtgggaggggaccgtatatggactggacctcag

SEQ ID NO: 6759356 - DNA, 61 bp, Homo sapiens
aagtgatgccatgatgcaagccaggctctggtgagcagctggctctgtaggtggcatcctt

SEQ ID NO: 6759357 - DNA, 77 bp, Homo sapiens
gcaccatgagggaagactcaggtcatgatttcaaggacattcattccttcagagatgacacctggtgtttcctctgc

SEQ ID NO: 6759358 - DNA, 76 bp, Homo sapiens
gctctgctctttcaggcatagaccttgctggttcagtggcagtggctagatcatgagtgagcatctcttttagagc

SEQ ID NO: 6759359 - DNA, 58 bp, Homo sapiens
cactcaagaggtttagcttttaaagagcctaaaggattcctggcttatctgttgggtg

SEQ ID NO: 6759360 - DNA, 61 bp, Homo sapiens
gcggtcacgtgacggttacgactgcactctcgctggtgtcggtgggcggtcacgtgatggt

SEQ ID NO: 6759361 - DNA, 62 bp, Homo sapiens
ggccaggagatggacaccacattttgatggtttctcaaaccgtgtgtgaccttttcctggtt

SEQ ID NO: 6759362 - DNA, 79 bp, Homo sapiens
tgtcaaaactttcagggatacagaaatgaataggttatggtttatgtttgtttctggttttattctggggttttgtata

SEQ ID NO: 6759363 - DNA, 84 bp, Homo sapiens
ttgttgtctgtgaccagtctctcagctttcagctgtgtaatagaacatgggcattcaggttgagaggcaaacatttgacttcag

SEQ ID NO: 6759364 - DNA, 59 bp, Homo sapiens
taatgcattaaagttagagacttctgagagattctgaagtccttaactttggcgtatta

SEQ ID NO: 6759365 - DNA, 74 bp, Homo sapiens
cagtgacctagctgctctgagccctgattcttggcaggagaggccctggctagagcagctccagggtagagctg

SEQ ID NO: 6759366 - DNA, 130 bp, Homo sapiens
tagttttcttccctgtccgacaccctgctctgtgattctctggggacttcaaaagtaagtaggtgcagttcatgagctttggggaagaatacagaaaagtgggtcatgggcagtgagaagctgaaaatta

SEQ ID NO: 6759367 - DNA, 63 bp, Homo sapiens
ttgttccacatcacactacttgatttgttcaaaccaagatctaaagtcatgtttgtgggagga

SEQ ID NO: 6759368 - DNA, 78 bp, Homo sapiens
atctcttaagtcttatttggtcagccaggaaaacatatgaggtaatatggcttggactaaatggaccgtataatagat

SEQ ID NO: 6759369 - DNA, 66 bp, Homo sapiens
tccatgcagagtccaggcctcattcctcatttgaagctcacgtggtaaaacctgggctctgttgga

SEQ ID NO: 6759370 - DNA, 59 bp, Homo sapiens
gcaggtgtctgactgccttcttcaccctccagtcattgaggtctgagcagatgacctgc

SEQ ID NO: 6759371 - DNA, 64 bp, Homo sapiens
gtttagttctgggctccaaactcaaggagtggcattaagcgactggtgcgaggccagagcagac

SEQ ID NO: 6759372 - DNA, 69 bp, Homo sapiens
tggtcaggcctgagtcttgtgccccaccctggggctagagaagaggctcagccagccatgcctgaacca

SEQ ID NO: 6759373 - DNA, 64 bp, Homo sapiens
tgcagagccagtcttgtgcttctaaattttacactattttacaggtgcctatctggtctctgca

SEQ ID NO: 6759374 - DNA, 66 bp, Homo sapiens
tttattgcaatggtgcttcccttctatgtttagacatgaaagtgaatgtcactgttgaacagtaaa

SEQ ID NO: 6759375 - DNA, 102 bp, Homo sapiens
acatgacagtgcatacacagaaaataaagtttctacgcatgatggattcttcccagttgatggagaatattttgtatttatagtggcactaagacgtcatgt

SEQ ID NO: 6759376 - DNA, 62 bp, Homo sapiens
gcccaggctggagtgcagtggtgcgatctcggctcactgcaacctctgcctccctcctgggt

SEQ ID NO: 6759377 - DNA, 62 bp, Homo sapiens
acaatagtggtagtgctggtcatagtgatgaagaagaaacaagagcagcagctaccacttgt

SEQ ID NO: 6759378 - DNA, 57 bp, Homo sapiens
ggtccacatgcctattaaccaaacgagcagctcaggcttggctggatggctggggct

SEQ ID NO: 6759379 - DNA, 70 bp, Homo sapiens
agaccaccgggagggacgaacaactctggagtgccagctttatgaactgtaaccctcaccgcgaaggtct

SEQ ID NO: 6759380 - DNA, 75 bp, Homo sapiens
ctttaggcgaggcagtgggcggggtgcctgggataaaatcatgaccagaacctgaaacagtccttgccctcaaag

SEQ ID NO: 6759381 - DNA, 76 bp, Homo sapiens
aggactcacaggtgaaaaatgacctctttgcaatccttattgatccaccagctgaggtcttttttatgtggaacct

SEQ ID NO: 6759382 - DNA, 62 bp, Homo sapiens
tcatacaattcaatctctgatttaatggagcttgtagttcaaaggcagagatggatatgtga

SEQ ID NO: 6759383 - DNA, 60 bp, Homo sapiens
acaaacaggagagagatggattgagaaagcattcagtaacttacttattcacctgtttgt

SEQ ID NO: 6759384 - DNA, 73 bp, Homo sapiens
ggtttccacatccatggaatgggtgactctagagagcctctgatctgactccatattccatgggttgtgagcc

SEQ ID NO: 6759385 - DNA, 84 bp, Homo sapiens
gaaaacagtaaatcatcacgtaataattctgggatttttgggtttgtcacaactgagaaatattgctgacggtgtatggtcctc

SEQ ID NO: 6759386 - DNA, 75 bp, Homo sapiens
gcagcggaaacacagggaagtagcaggcagtaactcaaaaccaaaatgtctgcaacgtttatgttttctgtctgt

SEQ ID NO: 6759387 - DNA, 104 bp, Homo sapiens
aattatccatgttagcacatttggaacaaatgtataaatgtactttctgaataaagtcaaaagtctaacttgtttttagttccataatgttttaatgtttaatt

SEQ ID NO: 6759388 - DNA, 75 bp, Homo sapiens
cctggaatttactccagaacattatatctcaattctatgttaatggaaaggcttggtattttggagttggccagg

SEQ ID NO: 6759389 - DNA, 104 bp, Homo sapiens
ttctcttgttgggtggttctgttaggagaggaggctctgggatcgtcccgttgggcacaggatgttctggggttctcttgttggatggttctgctgggagagga

SEQ ID NO: 6759390 - DNA, 69 bp, Homo sapiens
taccttggagctggaggccaatgagactccctaatctacaactcaggctgagtctctcagcttcaggta

SEQ ID NO: 6759391 - DNA, 85 bp, Homo sapiens
ataaggtagaggaagggaggatttgatggctttctccctgaaggcttgagctgggacatcaatattcttttgccctcaactctgt

SEQ ID NO: 6759392 - DNA, 87 bp, Homo sapiens
gatattttaaataaaattgagggctgagaagggccctgttgtcaaaccctctgccttgtaggaccctcactcatctctcaagatgtc

SEQ ID NO: 6759393 - DNA, 62 bp, Homo sapiens
aagagtttttaatgggtactgggatttattcaataaagtttattactcagtccaaaactctt

SEQ ID NO: 6759394 - DNA, 63 bp, Homo sapiens
ctgaactgacagactgcctgctctgaaactgcaccaacagtccctggctattttgtcattcag

SEQ ID NO: 6759395 - DNA, 107 bp, Homo sapiens
cccgggcccgccctgcccgccgtgcgcctcagcctcgtgcgcctcggggagccggacagcgccggggccggggagccgcccgccacgcccgcggggctgggctcggg

SEQ ID NO: 6759396 - DNA, 113 bp, Homo sapiens
ttggctaagaattggtgtatatcacatctctggcttggattatggttggaagtggcccagtgcctgtcaaacctcatctctcactgaatataacaccatctaatacatgccaa

SEQ ID NO: 6759397 - DNA, 100 bp, Homo sapiens
agcttatgtggtgtagttaaagcagtagttatagggaaatatacagtttaaatgcttatgttaaaaaattattgcatgtatattatacctaaataaagct

SEQ ID NO: 6759398 - DNA, 57 bp, Homo sapiens
agcagcagggacaaaggaacaggtaacttcatagccttgttcacagtagttgctgct

SEQ ID NO: 6759399 - DNA, 65 bp, Homo sapiens
cttgagtatctgtggattttggtatcctagggggatcccggaaccaatctcccgcagatactagg

SEQ ID NO: 6759400 - DNA, 60 bp, Homo sapiens
caaaagggagttctctggaagggaaataattctgtccctacccctgattgctcctatttg

SEQ ID NO: 6759401 - DNA, 130 bp, Homo sapiens
ctgtgtggatgagctctgacaacaggctgtctgggtctggtgagctcctgaaagcggggactggtggagagtaccctagggtgggagctcatgaggagggggtctgtggggtctggaagccattctagag

SEQ ID NO: 6759402 - DNA, 58 bp, Homo sapiens
tctgggctgggagcgtgtggactggatttatttgtccaatgccacaccccaccccaga

SEQ ID NO: 6759403 - DNA, 69 bp, Homo sapiens
ttcctgtttcaagagtggctcaaaacttaggtaaatgaggagctatcttagaaatatcaacaattggaa

SEQ ID NO: 6759404 - DNA, 70 bp, Homo sapiens
taggtcttatgggtgacagaggaactaagtttggtgtgtcagccttgatttcttattaccctagttcctg

SEQ ID NO: 6759405 - DNA, 68 bp, Homo sapiens
ggcaggctccgtgttccattccagctgagcctttgctggagtaattacccacatggagtcttcaagcc

SEQ ID NO: 6759406 - DNA, 74 bp, Homo sapiens
tgtggggaacagaggagggtgttgctgatatctgaggtcatgggagacccaagcttcgccttcctttctctgca

SEQ ID NO: 6759407 - DNA, 74 bp, Homo sapiens
ctttgtttgtttgtccactgggagcaggaagaggaattatctcccttcctttagctttcttggacaaatcaaag

SEQ ID NO: 6759408 - DNA, 74 bp, Homo sapiens
atattgtattgaccttgcagggaagatgttctatttagacttaaaacatgtttccagtgtaaggcctacaatat

SEQ ID NO: 6759409 - DNA, 77 bp, Homo sapiens
aacccctagcttctgggagtgtttactacaaagattcacacttgtagaaggctcctctcagaaatgtctaggaggtt

SEQ ID NO: 6759410 - DNA, 74 bp, Homo sapiens
agaaatacaatgtttgttagagctctagagatgcttctgattcttctggatgcataacatgacatttctcatct

SEQ ID NO: 6759411 - DNA, 61 bp, Homo sapiens
cttccagtggcttccttcataagctttaaaaaccttttaaagtgaaggaagacacttatag

SEQ ID NO: 6759412 - DNA, 76 bp, Homo sapiens
cacataatctcaggggattcactggcacccattcatgggccccagtcacgaactcttgaactaaaaggataatgtg

SEQ ID NO: 6759413 - DNA, 76 bp, Homo sapiens
ggcataaggggatatgtagcttatatgaggaaattgtcttaagtttgtctttaattctacatatctcccatgtgcc

SEQ ID NO: 6759414 - DNA, 68 bp, Homo sapiens
tcagtgttacagtcattgttttctgactcaagagttctttgcttagaggaaagtgactccgatgttga

SEQ ID NO: 6759415 - DNA, 60 bp, Homo sapiens
ctccaccagagactgcatttctctgaaataccaattcgtgataaaagcagtgtttggcag

SEQ ID NO: 6759416 - DNA, 85 bp, Homo sapiens
ggcacttgggaatggcaaggaaaccgttaccattactgagtttagtaatggtaatggttctcttgctatacccagaaaacgtgcc

SEQ ID NO: 6759417 - DNA, 78 bp, Homo sapiens
tactgctatagattcaggagatcttaggaattcttaggagaatcctaagaaatcttaggatttcttctgtggcttgta

SEQ ID NO: 6759418 - DNA, 83 bp, Homo sapiens
gtgctccgtccatacgggttgttaaaaaatcatgaatatctccttcggtgtaataatgattatagcaattttgtagatggcac

SEQ ID NO: 6759419 - DNA, 123 bp, Homo sapiens
ggaagggagactccggaaaggaaaagcagatgacattttatcaaatcagtattggtatagaatgacatagatgttataatgcattgagctagaatggaaaattttatcctggagaacccttct

SEQ ID NO: 6759420 - DNA, 64 bp, Homo sapiens
gttgaactagaagctttggaactgaatgtgcctttggtccaggtgccaagcttctatgtttagc

SEQ ID NO: 6759421 - DNA, 59 bp, Homo sapiens
aacgtaagtctctcaagagggtcagcatttacttgctgtcctgaaagggagattgggtt

SEQ ID NO: 6759422 - DNA, 77 bp, Homo sapiens
tttattctcggatgtattccaagtgcctagaagagttggtactcaataaacacttgtggaatgaatgaatgaatgaa

SEQ ID NO: 6759423 - DNA, 88 bp, Homo sapiens
ctcctcggccagggagaggagcacggccttgggtgtgttcttgaaaagggctgcccagttctgctgctgccccttcctcgcccagggg

SEQ ID NO: 6759424 - DNA, 63 bp, Homo sapiens
gcatgctttcacttctctgcagccagttagtttagctggtatggctaacgaggtcaaggcggc

SEQ ID NO: 6759425 - DNA, 92 bp, Homo sapiens
tagtttacaataccattagcaggatgagtacaaggtaacttatctaggacttgtaattaacgttcttgttagatatggtctttgtgcaacta

SEQ ID NO: 6759426 - DNA, 106 bp, Homo sapiens
ggatggtggctacgggtggtggcctcaagtgatagatcccagatagtgaccctcagggtgtggcaccggatggtgaccctgggtggctggccctgcttccctgtcc

SEQ ID NO: 6759427 - DNA, 96 bp, Homo sapiens
cctcaccttaatattatgctcttcatctctgtagattgttacaaaaggaatatgttgcagagaatatggagaagaaatcatgaaattttggtgtgg

SEQ ID NO: 6759428 - DNA, 74 bp, Homo sapiens
gtgtgtgtgtgtgtgtgagagtgtgtcgctgccgcagtagccgctgcagcatcaggttcactgcgtgcacgcac

SEQ ID NO: 6759429 - DNA, 112 bp, Homo sapiens
gccttttagatatacataggaagataaatgaccagaaatacagctgtggtgcggggctgtgtactgtactgtcttttttgctgttcatttttatgctataggtatgatgggc

SEQ ID NO: 6759430 - DNA, 58 bp, Homo sapiens
tgagtgtcaactcggaataaggattgtgattgacaattcccatcccagtctgtactta

SEQ ID NO: 6759431 - DNA, 75 bp, Homo sapiens
cagtccttgctcaaagtctacagttagcacactaaataatgaatttctttttgtgaaaagttgagtaagaaactg

SEQ ID NO: 6759432 - DNA, 63 bp, Homo sapiens
gaagagactctactgcaaagttttctgtcctggctaagtgggcagtataacgttgggctcttc

SEQ ID NO: 6759433 - DNA, 66 bp, Homo sapiens
aaccaccccttccgccactgccttcttgtctcttttgccaagggggcatttcagagggtggtggtt

SEQ ID NO: 6759434 - DNA, 59 bp, Homo sapiens
ctgtcaatgacagttatttgggttaagtttttatgtctccaaatagcctccattaacag

SEQ ID NO: 6759435 - DNA, 63 bp, Homo sapiens
gttgacaggaaatatggtggcaggagtgggacaaagattcatctgttgcattttttgtataac

SEQ ID NO: 6759436 - DNA, 66 bp, Homo sapiens
cagagggcaccttcagtaatagctagttttaactgatttcctgagcattgatgcaaggtgcccctg

SEQ ID NO: 6759437 - DNA, 59 bp, Homo sapiens
caatgggacaggcatgggacttagagtcagagacactgagctccaagtctttccttatg

SEQ ID NO: 6759438 - DNA, 81 bp, Homo sapiens
ggagaagctgcagggagaagagaacaaagccctcactgtggtcaggatgggtgtatcattccttttctctggggtcattcc

SEQ ID NO: 6759439 - DNA, 65 bp, Homo sapiens
gcctcctcagagcagccctccgcatataacctgtatgtaggagtgtgagctctgaaacacagggt

SEQ ID NO: 6759440 - DNA, 57 bp, Homo sapiens
ggccaacgactgggagaacctctacctgtgccaagaggatccctaaggggtgtggct

SEQ ID NO: 6759441 - DNA, 87 bp, Homo sapiens
taaactagagtttcagatgcagtgcttaaatcatttgcatgttttctgcatgataattgaatttatgtatgcacttcctttcgttta

SEQ ID NO: 6759442 - DNA, 127 bp, Homo sapiens
gtggagggagagaaagggaatctggcctgtgcttaactgacgtgagagccagactttgaactccagtggcttcatttaccactcatgtcatcttgggccaactgagatcacttttctaagcctctgc

SEQ ID NO: 6759443 - DNA, 114 bp, Homo sapiens
tcacctcaagtgtgtaagtgaggaaattcaggtttaggagttgttacttgcccaagaacaagagaaagggcagcatgaccctggagcctgcattcctaacgcaggtgagtgtga

SEQ ID NO: 6759444 - DNA, 61 bp, Homo sapiens
cttcaacggatcatgtgacctttgagtggttgcctctgggacatcatatgattctttgagg

SEQ ID NO: 6759445 - DNA, 60 bp, Homo sapiens
ttttcttaggtgctccaagtagaaggcttttttaaaactgctaaaaagtagctaggagaa

SEQ ID NO: 6759446 - DNA, 60 bp, Homo sapiens
tctgtggattcaggcttttgcctaataaatatgggaaagaggcaggtgtgaatccgtaga

SEQ ID NO: 6759447 - DNA, 77 bp, Homo sapiens
accagaagagtaaaatgtagaaggctatagactaggagtcagaagtcctggttacttttttctacctacagtctggt

SEQ ID NO: 6759448 - DNA, 58 bp, Homo sapiens
ctggggatattgcaaagaattaaacctattaaattagaatcaaatgtcatatccccag

SEQ ID NO: 6759449 - DNA, 123 bp, Homo sapiens
gccccagagtccaaaggctagagaacctggagttctgctgtccaagggcaggggaagaagggagtcccagctccaagggacagcgaattcactgttcctctgacgttttgttctacctggggc

SEQ ID NO: 6759450 - DNA, 79 bp, Homo sapiens
agagcatcctcgcctccccccactcacccatattttattgtcagttcttttgcaagggtgaaggcagaggacatgtttt

SEQ ID NO: 6759451 - DNA, 74 bp, Homo sapiens
cgtgtggctagtgcaaccgaggaattgaattttaaattttatttcattttaatttatatgtaattaggcacatg

SEQ ID NO: 6759452 - DNA, 56 bp, Homo sapiens
ggtaagcgcttttctcgattcccactttctgactctggggcatggatgagcttacc

SEQ ID NO: 6759453 - DNA, 77 bp, Homo sapiens
ggagtgggaacttatactgccagattctgaagccaattataaagttaaaatagttgtagtagaactgtagtagctcc

SEQ ID NO: 6759454 - DNA, 69 bp, Homo sapiens
ggagcacctcaatttgctatttgggggtacctgaaatgaaaaattccaagtactgagttgggatgctct

SEQ ID NO: 6759455 - DNA, 60 bp, Homo sapiens
aggcaagctgcagagagtcctttactcccaggcctcttctcccaccagctatcagtgtct

SEQ ID NO: 6759456 - DNA, 76 bp, Homo sapiens
gagtaacgctcccagaattattctcttctcctcatctgtgagggggaaataggctgatttctttgaggagctattc

SEQ ID NO: 6759457 - DNA, 67 bp, Homo sapiens
tgtttgcacgcctgatctgtcctatattctaaagtggaggagtacagtatagtaaggtggtatagca

SEQ ID NO: 6759458 - DNA, 58 bp, Homo sapiens
tggattttgagcttccccactatctcagggttctctgaggtggagtgcttagcatcca

SEQ ID NO: 6759459 - DNA, 65 bp, Homo sapiens
ctagatagcgagtgtcttaggggcacgggtctaatttcagtgctcactgaactcttgctgtctgg

SEQ ID NO: 6759460 - DNA, 60 bp, Homo sapiens
gccatgctctgtgctgagagctccacattggtcaatgtgaagccgccctagggtataggt

SEQ ID NO: 6759461 - DNA, 77 bp, Homo sapiens
ggttaagaacttgttgaaggtctcagagctaggacttcaaaccaggcagactggcaccaggttctgtgtacttaacc

SEQ ID NO: 6759462 - DNA, 62 bp, Homo sapiens
gtccacttctattgggtcttggtgtgtttccaccaacctattgattccctcttggaagggat

SEQ ID NO: 6759463 - DNA, 86 bp, Homo sapiens
ttagcttttcatggggtgaattagtatgctacagaataatttagttatttaaggcagctatagtacttctctccttggctggctaa

SEQ ID NO: 6759464 - DNA, 55 bp, Homo sapiens
gctgggcaatgccagagaggagccccccagcgccacatgctctgcattccccagc

SEQ ID NO: 6759465 - DNA, 61 bp, Homo sapiens
ctgaatccagagctatttcgtccaaccaagcttcagcatggagaattacactctggatcag

SEQ ID NO: 6759466 - DNA, 83 bp, Homo sapiens
agtaggccttgggttttgacttgtttttactgttgtgaggtcatgtcctgagacaacattgggcaagtcccaaagggccttct

SEQ ID NO: 6759467 - DNA, 68 bp, Homo sapiens
agctttctttttacagtcatggtcactcatagctacaatctatgagaggatattttgggaggattgct

SEQ ID NO: 6759468 - DNA, 71 bp, Homo sapiens
agcaggtgacagggctgtggtgaagggcaaaggagaatcattccaattatgtcccatagcttttacttgtt

SEQ ID NO: 6759469 - DNA, 64 bp, Homo sapiens
cttcttccttattgccttttgttacacaagcagtgctgaatatgggctggatattggaaagagg

SEQ ID NO: 6759470 - DNA, 82 bp, Homo sapiens
ggagctcacaatctgagaataaagccagcaggagctaatgttggggcatttactctgagccatgctttgttctaaattcttc

SEQ ID NO: 6759471 - DNA, 83 bp, Homo sapiens
ggaagttttaaaaaaatctgtcattttccaaacccttagcaatataaggtatctggtaagaggcagacagtttagaagcatcc

SEQ ID NO: 6759472 - DNA, 130 bp, Homo sapiens
cctgcgggaaggagaggctggtgggaggaaagaagccttgttgagcatctactgcagtcccgccctggggctatggctgggagctggacaggccgggtccttgccctcctggggcctgccttctagtggg

SEQ ID NO: 6759473 - DNA, 82 bp, Homo sapiens
atcaaggcattggcagggctaggtcttctagggcttcaggggagaatctgttgcttgcatcttctagttcctagtctttgat

SEQ ID NO: 6759474 - DNA, 60 bp, Homo sapiens
tgccttagagcactcaagagtgagaaaaattctaaagcattcattcttggggtaaaggta

SEQ ID NO: 6759475 - DNA, 66 bp, Homo sapiens
aagagaaagagtcagttagaccagtcagggccgcgtcctgcgcacgtcagaaaggcttttactctt

SEQ ID NO: 6759476 - DNA, 77 bp, Homo sapiens
aaagggtagaggtttgatatgtggaatatttatctcagattattgagatggagaatgacaattaaggttttcctttt

SEQ ID NO: 6759477 - DNA, 55 bp, Homo sapiens
gaagccatgtgactatttctagctctaaaagtgagcagaattgttttatgtcttc

SEQ ID NO: 6759478 - DNA, 70 bp, Homo sapiens
gaggtactagtctgcagcggggaggggtgttgggaccctggggccctctcttctgcagcctccaaacctc

SEQ ID NO: 6759479 - DNA, 82 bp, Homo sapiens
caagttccagttggcttttgctatacacatgtgtatccaacgtttgctcatctggcttcagtaacagtctcactttaatttg

SEQ ID NO: 6759480 - DNA, 65 bp, Homo sapiens
gtttatatacaatcatcattatattcccagtgactgggcaatttgtagatggtgattgaatgaat

SEQ ID NO: 6759481 - DNA, 70 bp, Homo sapiens
ttagaaacaggccatgcaaggtttaaggcagggaagggtggccctagtgacctagtgcctggccttctgg

SEQ ID NO: 6759482 - DNA, 55 bp, Homo sapiens
tcactgccttccttgtcccagctacttgggaggctgagacaggagaatggcgtga

SEQ ID NO: 6759483 - DNA, 60 bp, Homo sapiens
cattacagtgtcagaggaactgtggcaaaaaattgagaggaacctatctgaggctgaatg

SEQ ID NO: 6759484 - DNA, 101 bp, Homo sapiens
gacataagcttgtactttgtggaaagagcagagactttggaatcagcctaggtttgaattctggctcttctgtttatcacctgtgtaatcttggatatgtc

SEQ ID NO: 6759485 - DNA, 130 bp, Homo sapiens
ttgaggtagagtcttgctcttgtcgctcaggcaggagtgcagtggcgcaatctcagctcaccacaacctctgcctcctgggttcaagccactgcactccagcctggcgacagagcaagactccctctcaa

SEQ ID NO: 6759486 - DNA, 69 bp, Homo sapiens
gcagaaaggcttgcttttgctcggtcgtcttactagacagccaagcaccaataaggttggctcctttgc

SEQ ID NO: 6759487 - DNA, 89 bp, Homo sapiens
ccctgcactccaccccacggcagtggggagcgagtcccagagtgaaccccacctcagaggaggctcctggctccgagtgggctgtaggg

SEQ ID NO: 6759488 - DNA, 61 bp, Homo sapiens
aagtgtcgctgggctctgcctcaatgccttccggcaggtggccaggaccagcagaccactt

SEQ ID NO: 6759489 - DNA, 78 bp, Homo sapiens
cctatcctgttaaaaatattcgcaagttattttaaagggaaatgattgaaatgactgaagggttttaaacagggaagg

SEQ ID NO: 6759490 - DNA, 72 bp, Homo sapiens
cacctggagaacagaccacagtcaggctcctggtcaaagccaagccagctaagtcggtcattaatccaggtg

SEQ ID NO: 6759491 - DNA, 68 bp, Homo sapiens
acatttgagtcatatttgcttagtcttctcagacttcttcacgaggagagcaaatctgaccaaatagt

SEQ ID NO: 6759492 - DNA, 63 bp, Homo sapiens
cccacctctcagagagccttgcttgcagaccccttcatctgatggattctcccgagaggtagg

SEQ ID NO: 6759493 - DNA, 74 bp, Homo sapiens
catcctaagaacatttccgagggtttgccaagggtcaatcatgattccaggctcccttggaggtgtaaggactg

SEQ ID NO: 6759494 - DNA, 64 bp, Homo sapiens
ggctttggtaagctatggcttctatacatcaagggcccccttatattggccatggtgcaaggtt

SEQ ID NO: 6759495 - DNA, 61 bp, Homo sapiens
actgttttctagaaacaatgcctatttcagttatgaactagtctgttttgaagaaaatggt

SEQ ID NO: 6759496 - DNA, 87 bp, Homo sapiens
ctatcttaggtatttttcagttctacaagagctttgtacctgattctaatgcacagctcctggtaagctgggggaccctgggtatag

SEQ ID NO: 6759497 - DNA, 65 bp, Homo sapiens
tgttgggtaaacagtgaaagtaagcatgttataataatatatgtacaagctgttttactgcagca

SEQ ID NO: 6759498 - DNA, 88 bp, Homo sapiens
ttgcctaaatctttattacatttagttttgttttcatatcttttaaagagatgaaaagggtactgaggagattgagggatgtgggtga

SEQ ID NO: 6759499 - DNA, 87 bp, Homo sapiens
ggtagagatgcatattctgggcttcacgccagagccactgactcacagcctctggggtggagcccagcaccctgcatttaacaaacc

SEQ ID NO: 6759500 - DNA, 62 bp, Homo sapiens
agctaaacatgttggtgctttaaattgggaaacccaattttaaagcattacaagtttgagtt

SEQ ID NO: 6759501 - DNA, 76 bp, Homo sapiens
ccttcaacattgtagacttttcatatgtggttgtctctgtgacttaaatgtacaatctagggtttgcatgttaagg

SEQ ID NO: 6759502 - DNA, 64 bp, Homo sapiens
tccactcaacccttggttcctgttgaagatgatggcaggtcctgggccacagggtgctggtgga

SEQ ID NO: 6759503 - DNA, 93 bp, Homo sapiens
cttgatacaagcaggggagctctctggggagatgggatttaagatgaaaggaaactcactccccccagggagggaggccaggcatgtgtggag

SEQ ID NO: 6759504 - DNA, 72 bp, Homo sapiens
catgattaaagatgttctcatttcataggttcttatatctgaattgtatgagagtgaaagcatttctgcatg

SEQ ID NO: 6759505 - DNA, 114 bp, Homo sapiens
ttggtggttataaaataccttaagctcttcagataaaagggatattagtgcaaaatactaataagcattattattataagtggtctgagcactaaggtgtttgcttagtactgg

SEQ ID NO: 6759506 - DNA, 56 bp, Homo sapiens
cgttgtctatttattctactgtgcttaacatggtaacaggcaaattttagacaatg

SEQ ID NO: 6759507 - DNA, 78 bp, Homo sapiens
ggaaggtgaaattgctaggaacaggttgcacccccaagaggcagaggatggttggtaactccctgtgcagtgccttcc

SEQ ID NO: 6759508 - DNA, 66 bp, Homo sapiens
gtccttctgattctgtggtagttaatgcctcaggcatagtctgtccagtgcagagaacagaggggc

SEQ ID NO: 6759509 - DNA, 130 bp, Homo sapiens
ggccagtggggtcctttctccatgttctgtaggctctgctgaggatggtgtggtcttctcattggtaaatggggtcctttctccattttctgtaggctctgctggggatagtgtggtcttctcattggcc

SEQ ID NO: 6759510 - DNA, 79 bp, Homo sapiens
ctccaactcattatggcatctgccagggactgacctatcgttccctctggtctggacgccatattgtatgtgtctggag

SEQ ID NO: 6759511 - DNA, 85 bp, Homo sapiens
tcgggcccccggggaatctaggcggggaggaggagggacatccacacagcctccccctcctgtggttttctgctttgcggtctga

SEQ ID NO: 6759512 - DNA, 94 bp, Homo sapiens
ctctcagtgtctgccttgctatgtgagatggctcaagccattagcccattctggagtttagttttcccatctacaaagcagggagacatcagag

SEQ ID NO: 6759513 - DNA, 62 bp, Homo sapiens
gccaggcacttccgcacagtgagagccaggatggcttcgtggctgtacacaggggacctggc

SEQ ID NO: 6759514 - DNA, 63 bp, Homo sapiens
tgtctcaagaaaggatggggctggaggcaagcaactgccagagcttcataattccttgactca

SEQ ID NO: 6759515 - DNA, 55 bp, Homo sapiens
gcaggtggttaaggtcccatgtgttacaacaaaatacaggggtcaaagcacttgc

SEQ ID NO: 6759516 - DNA, 92 bp, Homo sapiens
aggataacgcccagccctccccttgccccctgtggctgcctcccctttccgtctgttgagagaggaagccagggggtgttgggtgcaaccct

SEQ ID NO: 6759517 - DNA, 57 bp, Homo sapiens
agcagcatctcttattgcagtggttttcaaactatacactcaactggagagcctgtt

SEQ ID NO: 6759518 - DNA, 88 bp, Homo sapiens
gatactgctggtcttggaactgtgttttgagaaggcttttagcagcgcttcttaatcataacggtatcttagaatcaccaaaggaatt

SEQ ID NO: 6759519 - DNA, 56 bp, Homo sapiens
ttagaggtagagttacattagtcttagtataaaggcaattttagacctgcctttaa

SEQ ID NO: 6759520 - DNA, 75 bp, Homo sapiens
ggtgactcctttcaagagaaaactaacctatgatgccacaagtcgtcatagtggccattcttgaggggagcttcc

SEQ ID NO: 6759521 - DNA, 68 bp, Homo sapiens
aaaagttagggaggttctctctttgcagagccccaaaagggggtcaggaactagagcctcctcctttt

SEQ ID NO: 6759522 - DNA, 90 bp, Homo sapiens
ttctgtatgctcccatgaccctggcaggtagcctcacagtccacgcagattgtgacggtatctgccagggtcatgggagcattaagtgaa

SEQ ID NO: 6759523 - DNA, 91 bp, Homo sapiens
caaggtagttaacttcacctagaagcacaggttaaaggcattgcaagagtcactgtgctggtagcctagtttctttgaaaaactgcacttg

SEQ ID NO: 6759524 - DNA, 64 bp, Homo sapiens
agcacattctgccttgctttgcatgtaaaagtatagaatccaaacctagggcagtaatggtgct

SEQ ID NO: 6759525 - DNA, 79 bp, Homo sapiens
agcttaagtcttagatttacagtggccttctgaactcagaaaagcaaggcagtctgtctgaggacctaagatttgtgct

SEQ ID NO: 6759526 - DNA, 56 bp, Homo sapiens
gaggtttcactgtgttgtccaggctggtcttgacctcttgggctcaagtgatcctc

SEQ ID NO: 6759527 - DNA, 60 bp, Homo sapiens
agaccgagaggaatcctgactgaggcagggatcgccggtcagccagaggcttcttggttt

SEQ ID NO: 6759528 - DNA, 64 bp, Homo sapiens
gccaaataatgtgatagataagggaaagctaaatatagctttgtttactttcacttatataggc

SEQ ID NO: 6759529 - DNA, 63 bp, Homo sapiens
ttaatggttagcctcctagatccttctgtaccttatgcctttgctccaggaggctgccattga

SEQ ID NO: 6759530 - DNA, 86 bp, Homo sapiens
ggcagcaaagaagtcaggccaagttcattcacacccagactgaggcccttatcatctgggctttaagaactctgtttcttgttgcc

SEQ ID NO: 6759531 - DNA, 89 bp, Homo sapiens
ctttatttgtgtgtgtgttaacttatttaatgtcagatctcatagaatatcacagatattaaatgtgataatacatgtacagtgattag

SEQ ID NO: 6759532 - DNA, 56 bp, Homo sapiens
agaggctgatggagtagtgtctttaaaacttacatgatagtttaccttcagcctct

SEQ ID NO: 6759533 - DNA, 91 bp, Homo sapiens
gccaggatggttttgatctctcgaccttgtgatccacctaccttgacctctcaaagtgctgagattacaagcgtgagccaccgcacctggc

SEQ ID NO: 6759534 - DNA, 73 bp, Homo sapiens
taaggtgcactttggctgggcatctctctccatgtggtaactcattatagagcagtctagaccaggctcctta

SEQ ID NO: 6759535 - DNA, 67 bp, Homo sapiens
ggaccataagattcatgttaaacttagtgccagaaataaccttgggtagccatgttccttatggttc

SEQ ID NO: 6759536 - DNA, 57 bp, Homo sapiens
cctgagtacctgccagtgagtgaactctccagagctttcatctggccgtattccagg

SEQ ID NO: 6759537 - DNA, 78 bp, Homo sapiens
ctttttgctgccagaatgggaaatctgatttaacaaagactagatactgacttcccttgtggcagccctgttgaaaag

SEQ ID NO: 6759538 - DNA, 130 bp, Homo sapiens
tccccaactctgttggggtgtagatgcaggccgcccttcctccattccttcctgccagagactcaatgtgaatagtgtctgggccttggagtggggagaatctgctggcccttcacaccttcgctgtggg

SEQ ID NO: 6759539 - DNA, 70 bp, Homo sapiens
agagcttgttagaaatgcagcttcttgggccagctccacagaatcagaatctgcatttttaataacatct

SEQ ID NO: 6759540 - DNA, 83 bp, Homo sapiens
ccgtgtaataaatgactgttggtgttgattaaatagtgagactcagccgaggcacttaatcaatctccgaagccgtttacagg

SEQ ID NO: 6759541 - DNA, 60 bp, Homo sapiens
tgggcctctgtttcctcatctgcaaagtacccattttccagatgaggatactgaggccta

SEQ ID NO: 6759542 - DNA, 98 bp, Homo sapiens
ccttttttagatgggttgggtggtacaactgggccatgttttatgttgtcataaaaattattcatggcttttggatcaaagttgcctataaaaaaagg

SEQ ID NO: 6759543 - DNA, 116 bp, Homo sapiens
gcatgcggccaatcctagaggctggtggagctgtggccacgaccacacctctccccccatctatggtgagggtcagccccaaatagtttcctccgtcttaagaataggcaacaagc

SEQ ID NO: 6759544 - DNA, 109 bp, Homo sapiens
gaggagaaacggagccatcccccttttaaaatcagccactctgcagcgctttaggccggttttcatgcctgcagactgcgagcgtgctggtgggggtgtatccctcctc

SEQ ID NO: 6759545 - DNA, 60 bp, Homo sapiens
ttgcaggggaaggagcagagctcagaagaatcaccctaggttcaagttcctgctctgtga

SEQ ID NO: 6759546 - DNA, 76 bp, Homo sapiens
tatcctagtggggtttcagtcaccagcaaagaaaatcctaattagtacatttgtatatgagaaattccacaggatg

SEQ ID NO: 6759547 - DNA, 78 bp, Homo sapiens
gggatgcactttaccttgtggtgacttgagcttcctaagggcctcaccaagttctgagcaccaggcaccacagctccc

SEQ ID NO: 6759548 - DNA, 55 bp, Homo sapiens
ttcaccatttcccactaaaccattggagggccaagcggaaggtgacagtggtgaa

SEQ ID NO: 6759549 - DNA, 55 bp, Homo sapiens
cagagggctcagtcctgctggaacccaagggtcatctcgccaggcttgccctctg

SEQ ID NO: 6759550 - DNA, 73 bp, Homo sapiens
tggtggagacagtgatagagcccattttgtgcctagaatttgtaccagtgtccttgttattactgctccagca

SEQ ID NO: 6759551 - DNA, 67 bp, Homo sapiens
agccacagtgggctaccagctcaataatcttccaattgtcccaagctccaaatggcccattgaggct

SEQ ID NO: 6759552 - DNA, 130 bp, Homo sapiens
gtgctgaattagaatctcaaaggctggggtttcggaagttttctggttgatactcttatgcagtcaagtttgtaaatcactgaactaaatgagctttaaggcctttctcacagatctaatatttagtgac

SEQ ID NO: 6759553 - DNA, 92 bp, Homo sapiens
ccgctgtctctacaactccagctccacttccttctgccctcagcccaccctcagagctgagtggaggtgagacaggaggtgtagagctgtgg

SEQ ID NO: 6759554 - DNA, 57 bp, Homo sapiens
gccttgtttttcccttctaggctcggctcccgagctctgcaggagagtgggcagggc

SEQ ID NO: 6759555 - DNA, 64 bp, Homo sapiens
tgagactgtctcctgagccccttctctatgctgactttaggagtgcggcttctgggacatttta

SEQ ID NO: 6759556 - DNA, 60 bp, Homo sapiens
caggctgccgaggctgcagaatagaatctcacaaagccattccagcccaggtcctgcctg

SEQ ID NO: 6759557 - DNA, 59 bp, Homo sapiens
ggtcagagccatggagcaactggcccaaagttacccagtggctcttctgggctttgacc

SEQ ID NO: 6759558 - DNA, 68 bp, Homo sapiens
gacttccctcggggcaccgcggcctgcttgggactgcacagtgcctgggagggtgcctggggagggtc

SEQ ID NO: 6759559 - DNA, 93 bp, Homo sapiens
cagttaggagtgcagcccagcaggtactttgctttgggccttacacgaggccttgtgagaagcagagaacccagttgagccaacctgtaactg

SEQ ID NO: 6759560 - DNA, 55 bp, Homo sapiens
aagcatttgtgaaattcagatggagaaatacaaaactgatgtcacggaaatgctt

SEQ ID NO: 6759561 - DNA, 75 bp, Homo sapiens
agtgtcatgtttccaattttggggctgatgtaagatataagagtcaatcttcaaacactagaaacacaggatact

SEQ ID NO: 6759562 - DNA, 73 bp, Homo sapiens
tctacactcaggcctcattgcccacctgtggaggggccaccatctgcagatgggcgatggggcctgagtggga

SEQ ID NO: 6759563 - DNA, 55 bp, Homo sapiens
ctgttaggacatgcattaggccctaacccaggggctctgggacatttcttagcag

SEQ ID NO: 6759564 - DNA, 76 bp, Homo sapiens
acatctttgaaatgagagcacagaataaaaggtgtcaatgccttttattgtgcatttcatttcatttggaagatgt

SEQ ID NO: 6759565 - DNA, 87 bp, Homo sapiens
ggcacagtcctgttatttttaccagtgagttccacagctaagggtgctggctttctacctgaggtaaggatgatgaggtctgatgcc

SEQ ID NO: 6759566 - DNA, 67 bp, Homo sapiens
gtctagcccatttgttggaagcatgagggatgaagctcccgttctatgtgcagcaggtgggccaggc

SEQ ID NO: 6759567 - DNA, 68 bp, Homo sapiens
gtgataacagggtagtaatttaatacaagtgttttaatttgtatttcaaggcactctcaggtttttac

SEQ ID NO: 6759568 - DNA, 82 bp, Homo sapiens
agtaagagtgagtgagatgagtttttgacttaggaatctgacagatgataagtaggtaaacacattttttaaacactttatt

SEQ ID NO: 6759569 - DNA, 60 bp, Homo sapiens
tagaaaatggccaagcaggacttgaatctaagttcactattctgctgtgccatgcctctg

SEQ ID NO: 6759570 - DNA, 59 bp, Homo sapiens
tcctgaagatgctggagcatgggtggggagaccccacctgaactgtacgttttgagaga

SEQ ID NO: 6759571 - DNA, 59 bp, Homo sapiens
cagtgtgtctcttgtcctggctaggcatagggtcccaagccagagttggggacaagctg

SEQ ID NO: 6759572 - DNA, 85 bp, Homo sapiens
taaagactcagtcatgaaaagggtagatccctaagtcagattgctattttaattactgtctatgttttgcatgaaaaaatcttta

SEQ ID NO: 6759573 - DNA, 70 bp, Homo sapiens
caggtgtttagacagggcccctctgctggtggctactaggaggagagggcgcctttttaaggataagttg

SEQ ID NO: 6759574 - DNA, 74 bp, Homo sapiens
tggcagaggagttaggctagccattaccatttgaaaagaagcaatcataaggccgctgctgagtcctttgtcca

SEQ ID NO: 6759575 - DNA, 90 bp, Homo sapiens
tgactttcgccttgttgcaactgatggagcatgtgtgcttcctctgaggccagcctacaggaggcagctgtttcgcaggtggtgaattcg

SEQ ID NO: 6759576 - DNA, 64 bp, Homo sapiens
gacacagaagtacataaaggaattagccatgaatagaatggagatgaatatgtgtacctgtgtt

SEQ ID NO: 6759577 - DNA, 78 bp, Homo sapiens
tcattgaggtcctgttatcctcagctcacctctagatgcgaaactagaggccgaatgctgagctgggagggcctgtgg

SEQ ID NO: 6759578 - DNA, 80 bp, Homo sapiens
cctactgaaactggctgcttttcttgtatctactgtgctctgccagtctccgaggtatcaaaagccactggtttcagagg

SEQ ID NO: 6759579 - DNA, 77 bp, Homo sapiens
ttggcctgacagcagagagaggtaaggattgggtatttaattccaaggtctgtggccacctctgggactgcagccaa

SEQ ID NO: 6759580 - DNA, 58 bp, Homo sapiens
cagtgtgctacactttatgtgtcggtgaccaggagtcacagatgggatgagcacactg

SEQ ID NO: 6759581 - DNA, 98 bp, Homo sapiens
gttcatctctttttccaagctgaaattttactgagtataagacagtaacccaattatcctaatggtatactcattaatatttcatcaaaggagagaat

SEQ ID NO: 6759582 - DNA, 68 bp, Homo sapiens
tgactagactgggccagtcaaattctctctccagagaatttagatttgggatccaaaagtgctggtta

SEQ ID NO: 6759583 - DNA, 129 bp, Homo sapiens
aacccctagagaacttggtatgtggccttgagagtctttgaacttctccattctgatgctgaagcggcatcccagaacttgggaagcttccatcccaacgtccatacaaatgctacttttctttctttt

SEQ ID NO: 6759584 - DNA, 67 bp, Homo sapiens
ggtctctgtgtgaccataagccagctttcctcatcaatgagagtaaatgtttatcacacagatggcc

SEQ ID NO: 6759585 - DNA, 106 bp, Homo sapiens
gtgttgaggaggaaaatgggtagttcctggcgactgactgcagctgcagaagggaaagaactggagtctccccaggagcgtgactgtgacccgctcctctcaattc

SEQ ID NO: 6759586 - DNA, 76 bp, Homo sapiens
attcatcccacagatttcctaagcatcaatcttgggccaagcactgattgatgctggggaactctgtggaatgaat

SEQ ID NO: 6759587 - DNA, 85 bp, Homo sapiens
gcagctgccttgggcttgctaggacccctgcctgggttttctggggaccgagaggccctggtcaggtctggctggaggcagatgc

SEQ ID NO: 6759588 - DNA, 74 bp, Homo sapiens
ttccatgctaatgatggaagacatgttcgatctctctcaaactcgaggatacatgttttttatcaattcaggaa

SEQ ID NO: 6759589 - DNA, 82 bp, Homo sapiens
cttatgtatgtgtgtttctatttagcagggacaataaacacaaataatgtcataatgctgctagaaattgaacgattcaaag

SEQ ID NO: 6759590 - DNA, 57 bp, Homo sapiens
gcgccccatgcttgtatgcaggtcacaattctgatggccagcagaagcaaggggagc

SEQ ID NO: 6759591 - DNA, 64 bp, Homo sapiens
tggttttccagttcagatgcaacagggatacatttgttctctgttgtatgagaaactgacacca

SEQ ID NO: 6759592 - DNA, 77 bp, Homo sapiens
ttgtttggaaactgagttataactagaggtagacacatcattttgctactttcaaattagccagcatccaatgacag

SEQ ID NO: 6759593 - DNA, 56 bp, Homo sapiens
ggagtgaagtggcgcgatctcggctcactgcaagctccgcctcccggcttcacgcc

SEQ ID NO: 6759594 - DNA, 78 bp, Homo sapiens
gcactgacctgtctgaactgcactgaaagacgcattttatttgcatttagttattctagtgctcagccatttctttgc

SEQ ID NO: 6759595 - DNA, 88 bp, Homo sapiens
ggatccctgtgtccactctctgccgtgcctgtccccatcatcactcctggtgaagcagggacgatagcagagttcccactggaggacc

SEQ ID NO: 6759596 - DNA, 63 bp, Homo sapiens
ctttgatgtcctctcttgttacttttacatgctggctctaaaagtgcagttgaggaatcatag

SEQ ID NO: 6759597 - DNA, 55 bp, Homo sapiens
atggtgccaaagatttctaagcaggtccttgtcttggtgtgactgtggctatcat

SEQ ID NO: 6759598 - DNA, 74 bp, Homo sapiens
tgctgtacttctcagaacttttaatatgctaatgtacattgtacagctctgagagggggaattagtatgcagca

SEQ ID NO: 6759599 - DNA, 75 bp, Homo sapiens
aatagcctagcactaaagaagccaaagttttctctaaaacaatcatggagaaatgctcctttatgcaaagttatt

SEQ ID NO: 6759600 - DNA, 75 bp, Homo sapiens
tctctaatgtggtctgcagaccagttgcatctcctgggaaactcagaaatgcagaatctcagaccccacctgaga

SEQ ID NO: 6759601 - DNA, 99 bp, Homo sapiens
actgagggactttcagagttgggactgcctgatttgaaggaaacatagcagaatttagttgaagtttacttctgcttaggcctctgagatctttgaagt

SEQ ID NO: 6759602 - DNA, 60 bp, Homo sapiens
tcacatctgcaaaatcccttttgccatataaggtaacattcacaggagattaggatgtgg

SEQ ID NO: 6759603 - DNA, 58 bp, Homo sapiens
ctgaagttaatcagaggtacaaatggctggctatgcctctctgacacgtaacttctgg

SEQ ID NO: 6759604 - DNA, 97 bp, Homo sapiens
cagccctagggtcatccttggtgctctgttacccagcaaccccagcagtgacagccctgcttctggagtaacagggtgactgtggtcctggggactg

SEQ ID NO: 6759605 - DNA, 72 bp, Homo sapiens
cgtgttgctgtgtgcacgtccagcctattgcttctgaccacagcatggactctatgatgcgccagcaacacg

SEQ ID NO: 6759606 - DNA, 74 bp, Homo sapiens
gtaaagttttcttagatatgttgatgaagagttagtccttctttgattttacatgtcatatctattagttttac

SEQ ID NO: 6759607 - DNA, 77 bp, Homo sapiens
gcctgactgttcaggagaattccaagaagtattcagagaaaacagaatcacttcttggctccagggaggaatcaggc

SEQ ID NO: 6759608 - DNA, 73 bp, Homo sapiens
gttgtcattacttctcatgcttcatgcccatcacagacatgggggtgtcagcagaaggggcagagatgatgac

SEQ ID NO: 6759609 - DNA, 59 bp, Homo sapiens
tgattcagttagtagatttggtcaatttatgctaattggcaagtaatacaatagaatca

SEQ ID NO: 6759610 - DNA, 78 bp, Homo sapiens
accttcaatcaaacagagagaatctcagttcagccaggtaactgatggaaagagaaactcttgctaattggtgggggt

SEQ ID NO: 6759611 - DNA, 101 bp, Homo sapiens
ggggcagggacaagtcacagtggtggaacgtcgtaatgttggttaatcagttaaggcaggaactggctgttttacttcttttgtggtttttcggctgcccc

SEQ ID NO: 6759612 - DNA, 75 bp, Homo sapiens
tggaatttggcactgggagctgaggctgacgctgcattgctaaggagtgacagggccagcgcccaggcccagcca

SEQ ID NO: 6759613 - DNA, 57 bp, Homo sapiens
cactgagcaagtcagtacagcacaatccacgctagctacaaatggcattgtttagtg

SEQ ID NO: 6759614 - DNA, 57 bp, Homo sapiens
ggctctgcgcggtaaagtgactcactgaaggtcacacagccaagtagtgacagaacc

SEQ ID NO: 6759615 - DNA, 57 bp, Homo sapiens
agtcgtgggtacacgggacagcagacgtaaacctgagctgtccctggtcaccagact

SEQ ID NO: 6759616 - DNA, 61 bp, Homo sapiens
tgttacacggtcttatacaggagctgtcctgtattttgctcaaggtgtgttatgtgtaata

SEQ ID NO: 6759617 - DNA, 60 bp, Homo sapiens
cttttcctttgaccatcatgctagagaggacaaggatagacacagatgggacaggaaagg

SEQ ID NO: 6759618 - DNA, 91 bp, Homo sapiens
attttcatcacctagggatcttgttaaaaagcagattctgattcagggaccaagattctgcatttttagcaagttctcaagtgatgctaat

SEQ ID NO: 6759619 - DNA, 73 bp, Homo sapiens
cttagggaattagaaataaacaaattttccaaaatataaaaggaaggttagtaatatttctatatttttcaag

SEQ ID NO: 6759620 - DNA, 58 bp, Homo sapiens
tggaatcataagatgcccctaattcagtcttagtaaagagactggcttcttatttcta

SEQ ID NO: 6759621 - DNA, 59 bp, Homo sapiens
ctcagaccagccatttgcctcttccaaaaagctggggctaagcatgtgggtggttcaag

SEQ ID NO: 6759622 - DNA, 55 bp, Homo sapiens
cacagcttgggctctgacaatatgaattcagttgtgctgccagggccgaactatg

SEQ ID NO: 6759623 - DNA, 117 bp, Homo sapiens
tgttttcaaatgatagaacgcattaacatgagagctaagacattaagaattccttcggcgtggatgtgtggtgagaccttgttccttatgtaaatgtctttgtgtaatttgaaaata

SEQ ID NO: 6759624 - DNA, 66 bp, Homo sapiens
tgagatacattctgagaaatgcatcctttggtgacttaattgtgcaaacatcatagagtgtactta

SEQ ID NO: 6759625 - DNA, 64 bp, Homo sapiens
gctggcgaggtttcagagagcggctgctctgagctcgcctttttattctgaaattcttatcagc

SEQ ID NO: 6759626 - DNA, 56 bp, Homo sapiens
cagtcagatttaaagctgtttgatgcgcgtgcattaagaaagctcagagctgggtg

SEQ ID NO: 6759627 - DNA, 96 bp, Homo sapiens
ctgctcaaattggcaatgtccgtaacatgacctaattggtactttaaatttatatccaacttaatccaacacgggcatctgtgctagcttaagcag

SEQ ID NO: 6759628 - DNA, 60 bp, Homo sapiens
cactggtgagtccagaagtcataagagcagatgctgcagtagcagtttggatcattagtg

SEQ ID NO: 6759629 - DNA, 78 bp, Homo sapiens
gtcctgttgtggttgctgactcttttcatgcctcctgattgagagaatcaaggtggagatcagggactaaggcaggac

SEQ ID NO: 6759630 - DNA, 58 bp, Homo sapiens
cttaaaaggtcttttttctaacaccatgatgattgtgtgttttaagaggcctttttag

SEQ ID NO: 6759631 - DNA, 68 bp, Homo sapiens
gcctaggtagggaccaccttggggaggaagccaaaatcacactgctcacccgagagcccctgccccgc

SEQ ID NO: 6759632 - DNA, 90 bp, Homo sapiens
ttctcgtccctgacctctctcctagccaagcaagcttcttcaccaagataggataagagagatgtggctgagagaagacggggaagagaa

SEQ ID NO: 6759633 - DNA, 62 bp, Homo sapiens
ggcgcctggctgctagccagaggcagcgttcgaaatacaactgcctcggcggcggcggcgcc

SEQ ID NO: 6759634 - DNA, 77 bp, Homo sapiens
tctcctagatgacctatataaagttattttacaatcccaatgaaagtaacctagtaatagtgtcaaagacaaggaga

SEQ ID NO: 6759635 - DNA, 113 bp, Homo sapiens
aaataagaagcaaaaaccatgattcataagctgtactctataaatgtgagttcctgatactgaaaaactggtttatggtgagtactctaggaattttgactcactttctattt

SEQ ID NO: 6759636 - DNA, 90 bp, Homo sapiens
cacctggtcccatgaacttatttctgaacttttcatcacggaggactgtagggagaagccaacagagctgttttcacaagggaccatgtg

SEQ ID NO: 6759637 - DNA, 130 bp, Homo sapiens
atcaataggcttgtcggtttcatatgcatttaatgcagtgagccattaaatggtgtttagggaagggagaaaggaagatcacttactggctctctgtatcgatcatcaaatgaatgcttagccattagat

SEQ ID NO: 6759638 - DNA, 64 bp, Homo sapiens
ctgaacagattgattgcttgatggttcagagggaaccagctcataattttcaaaactgttttag

SEQ ID NO: 6759639 - DNA, 63 bp, Homo sapiens
tcctcctacacatagatgctttcagttatcaagcaatatttgattagcttggtgtggtgggga

SEQ ID NO: 6759640 - DNA, 59 bp, Homo sapiens
tccggccctgctgagaaatcaagggagtagacatttaccatttttttcagcagtctggg

SEQ ID NO: 6759641 - DNA, 88 bp, Homo sapiens
ctggagctgtacagtggagtcggtgattgctgctgatcataatcaagtattttaggagcttatttagacatgtatctgatagctaagg

SEQ ID NO: 6759642 - DNA, 76 bp, Homo sapiens
ttatcttttgggtagttattctgcacacctttaaaatgcattttacttatttgtggtgggtggagtagaaagatga

SEQ ID NO: 6759643 - DNA, 75 bp, Homo sapiens
aaaagaatgtaactctccttttgatcttcagaaaaagagacccccttctgtggttgaaaggagagatatactttt

SEQ ID NO: 6759644 - DNA, 67 bp, Homo sapiens
tgcagactttactgaactgctagtacaggagtcgctatgtttttagctagcccattcagtttttgta

SEQ ID NO: 6759645 - DNA, 63 bp, Homo sapiens
ggaggggagatgtttgggctcatgaaagccatcgagtcttctaagatttctatgcacccctcc

SEQ ID NO: 6759646 - DNA, 95 bp, Homo sapiens
acctcagtgttttggcttatgggactgtaagctctggaatgtccctgtgttagtttcctagggcttcagtaccaaagtttgaagacattggtggt

SEQ ID NO: 6759647 - DNA, 66 bp, Homo sapiens
cactttggaatgttgggatttaagtgtatgacttaagtgcattgccatcataagcattcaggagtg

SEQ ID NO: 6759648 - DNA, 55 bp, Homo sapiens
gatggaggaaaagttggaatgcagcctctggtgctgtttgagcgatccctctatc

SEQ ID NO: 6759649 - DNA, 68 bp, Homo sapiens
cctgtcctcccccaaagtttgcacggataatcggaaggtgtggtagggtgggcttgggggaagccagg

SEQ ID NO: 6759650 - DNA, 78 bp, Homo sapiens
gctggtgttcttggaaaaacacgatagtggttgaaggaaaaggaaatgcagccatcatttgttccaagggaactaagc

SEQ ID NO: 6759651 - DNA, 80 bp, Homo sapiens
gccccagatccatctggaagccagatactcagtgtgtgggcataaaactgtcttctgttccaggtgctgtctctggtggc

SEQ ID NO: 6759652 - DNA, 80 bp, Homo sapiens
ctgtcttcttctgtggttgtggagggtaagattctggaagcttcttaggatcaggccctctagggtagcagaggtggcag

SEQ ID NO: 6759653 - DNA, 55 bp, Homo sapiens
aggacacttggctattgttccaatttaggacagtggttttcctccaagtaatcct

SEQ ID NO: 6759654 - DNA, 60 bp, Homo sapiens
gtttccactgaaggatctagggaagaatgtttcctttccttcttaccttctagtggttgc

SEQ ID NO: 6759655 - DNA, 62 bp, Homo sapiens
gccggagcctgcttgttgcagctgtgggtgaggacggctctagctaggtgagcggctccggc

SEQ ID NO: 6759656 - DNA, 64 bp, Homo sapiens
gagtgcatggtcaagctaaaccaattattttttaagttgattgtggtagagcagctatgaactc

SEQ ID NO: 6759657 - DNA, 76 bp, Homo sapiens
cactgagctagtaggcttatctttttcaaagagtagttgaaacttgtgattgagaaagtctaaagggggtaaagtg

SEQ ID NO: 6759658 - DNA, 76 bp, Homo sapiens
agaaccagaagtgatcttccagaagaataaagctcatattgtttgttccaattatgaggatcgtttctccagttct

SEQ ID NO: 6759659 - DNA, 63 bp, Homo sapiens
ctggccaatccattaatttgttaatatttatattaatgagtttaggatttatggtttggctag

SEQ ID NO: 6759660 - DNA, 81 bp, Homo sapiens
atgctttggctaggttaagactgggacaagttaagatgaatggatgaagataagcagttctcatgtctttcctacaagcat

SEQ ID NO: 6759661 - DNA, 62 bp, Homo sapiens
ccacgttgctaactgccacattcatcacctgtcatggtttctggtgtgttggttcagcatgg

SEQ ID NO: 6759662 - DNA, 78 bp, Homo sapiens
cctcggtgtgtccaaggcacggatgacggtggagaggagccggccatcccttgaagtcacctgtgccacatactgggg

SEQ ID NO: 6759663 - DNA, 88 bp, Homo sapiens
aagtacattctttgaagtgaagaagcatgaatagccttagcataggctgtaaccttgagtcattcattatgtttcagaacatgtattt

SEQ ID NO: 6759664 - DNA, 57 bp, Homo sapiens
ggcttcacagccccattagtgctcttgctttccggctgaagtgtggtctgtggagcc

SEQ ID NO: 6759665 - DNA, 56 bp, Homo sapiens
ggaggaaatccttagtaaggcagtccggctcgtccaggcctgcgtggatgtcctct

SEQ ID NO: 6759666 - DNA, 96 bp, Homo sapiens
gcgggcccgggcgcgcgcccgtgtcctgcgatccgggcttggtgctgtggggctccggggccgggaagcagcctgggcgcctccgccttggcctgc

SEQ ID NO: 6759667 - DNA, 55 bp, Homo sapiens
gggtagggggcagctgggggtgattgtccagcctcagctgcgtgtcctcccaccc

SEQ ID NO: 6759668 - DNA, 59 bp, Homo sapiens
agatgctgggatgcttggatggggaaagaggtggtctaatccagatgttcataggatct

SEQ ID NO: 6759669 - DNA, 129 bp, Homo sapiens
ggctgttggttgagcccagtaaatgttgaagttcttttatgatgactctagataaagtcccaagaatcccagatgtaagtattagagtttatagcgttcagctgataagggctcattggtacaacagcc

SEQ ID NO: 6759670 - DNA, 78 bp, Homo sapiens
agttgtctaagactttggcacacaggtcataacccttctatgtactccatgccctgctgtgtatcattttagatgact

SEQ ID NO: 6759671 - DNA, 56 bp, Homo sapiens
gcagagagcagtaaagtgaagtggggtctcaagagcccctcatacactctccttgc

SEQ ID NO: 6759672 - DNA, 57 bp, Homo sapiens
ggaagaggtgtcgtagattattctcaagttccactttgaagcctggcaccttcttcc

SEQ ID NO: 6759673 - DNA, 71 bp, Homo sapiens
atgggtcttctttaacctactaaagcctatcaaaatatagtgggttcagtattaatgagatgatttcccat

SEQ ID NO: 6759674 - DNA, 76 bp, Homo sapiens
agttatcataggtgtcataatagcatttgtaaggtgtcacagaagatattgctgtttcctgctacctagatgtact

SEQ ID NO: 6759675 - DNA, 73 bp, Homo sapiens
gggctgtctccatagctgtgtgtcctgcaggacctggccagcctggcatgcttgctgtttgggaatccagccc

SEQ ID NO: 6759676 - DNA, 57 bp, Homo sapiens
ggcaggtggccaagtgtctaagagtttgttatctcctctaagcaccccctacctgcc

SEQ ID NO: 6759677 - DNA, 88 bp, Homo sapiens
atgggaatggcaggataaatgtttgattctatttacctatttttaaattaatgagtatagttccaagcatattttgatgatgacccat

SEQ ID NO: 6759678 - DNA, 108 bp, Homo sapiens
gtgaaccacggtgtccaggtgattctactttctgtctcccatgagtttgactactctaagtactcatgtaagcggaatgtagtatttgtctgtctgcatctggtttat

SEQ ID NO: 6759679 - DNA, 72 bp, Homo sapiens
gtagagacggggttttaccatgttggtcacgctggtctcaaactcctgacctcatgatccgcccacctcggc

SEQ ID NO: 6759680 - DNA, 59 bp, Homo sapiens
cgcctccagtgcctccccttggatgccttcccggggtcttgggacccgcactgtgggtg

SEQ ID NO: 6759681 - DNA, 91 bp, Homo sapiens
cccagagtgttggtaaatgcagattcctgagcctaccccagaattgctgaggtggagcccaggaatcagcattaacaataaaccctctggg

SEQ ID NO: 6759682 - DNA, 89 bp, Homo sapiens
catgggccttgaggcagctcctggctctgctgaggggagagaagccccgtccccatgagagggtcaaccaggagcgtcaggggtctttg

SEQ ID NO: 6759683 - DNA, 59 bp, Homo sapiens
aaggaaaggatgagcatgcattcttattacctatgagaatgaagtgccttcctagtctt

SEQ ID NO: 6759684 - DNA, 70 bp, Homo sapiens
gagcatcatcaagagaaggggaagatgaagctgactccctgcacctgcttcctccccattctgttggctc

SEQ ID NO: 6759685 - DNA, 108 bp, Homo sapiens
tacttcaaaagtatgttcttgacatagatgttttagtaatactgtcataaacaaagacttaggtgatggtactaaaatagtttattcaaggctaaactcttttgagta

SEQ ID NO: 6759686 - DNA, 59 bp, Homo sapiens
gtgagctctcccatagggcaagatcatcataacacaatgtcaccccagggagtgcccac

SEQ ID NO: 6759687 - DNA, 66 bp, Homo sapiens
gattgcagagggaagcagattcctttacttcatttctaaagagtaggggaaaaatcttctgcaatt

SEQ ID NO: 6759688 - DNA, 63 bp, Homo sapiens
gggaatggccagttagaaatcaaaaagtcccataaatggtctttcagttaagtggctagtccc

SEQ ID NO: 6759689 - DNA, 69 bp, Homo sapiens
tctgtaggaggggcttcccaccagctctgatcatagctcagccagctcccaagtgagccccttggcaga

SEQ ID NO: 6759690 - DNA, 82 bp, Homo sapiens
gccctaatcccaatgtgcctgtgtttggagttaagacctataaggaggaaattaagactaaatgaggtcataaggatggggt

SEQ ID NO: 6759691 - DNA, 96 bp, Homo sapiens
aggaagattatctatgtggatttcacctgatcttgtcatcttactatttaataggagaggtccccttgtgaaatgggcatagttttgggtttccct

SEQ ID NO: 6759692 - DNA, 77 bp, Homo sapiens
cagatgaacagcgcttcagggaggagcatgggttcaggtacatgtggcacctgccctccctggccgccctttcactg

SEQ ID NO: 6759693 - DNA, 62 bp, Homo sapiens
ggccctggggaggaaggggcgggccatggcatgtctgactgccccttccattcctgctggcc

SEQ ID NO: 6759694 - DNA, 76 bp, Homo sapiens
catcaatgaaacctgaagtacgttacataatatgtaaaactcaatgtcatgtaaagtgtaggtttagagaatgatg

SEQ ID NO: 6759695 - DNA, 103 bp, Homo sapiens
cccgggccacgtgcgtccccggttcgcgggcagctctgaccctctccaggccagcctggaccgcagggatgcccggcactggctggagactgtggcgcccggg

SEQ ID NO: 6759696 - DNA, 75 bp, Homo sapiens
cctcacttatgtcatccctgtgtggtggcttggactttggtagtccagcactgttatgggatgacttaaggaagg

SEQ ID NO: 6759697 - DNA, 102 bp, Homo sapiens
ggttgattctaccactctctttagtcaacagtaatggcattgccatgactattagtcgtggttggatatactttgctagaaatgggggttattgaattggct

SEQ ID NO: 6759698 - DNA, 76 bp, Homo sapiens
atcactgtcactatccttatcctccaaagtttgcaacaaactgagagacagatacaggaaccatagagatggtgat

SEQ ID NO: 6759699 - DNA, 71 bp, Homo sapiens
catacattttgcatatttaccatagcataagagaatcttgaagaacaattttatagatgtgcaattgtgtg

SEQ ID NO: 6759700 - DNA, 63 bp, Homo sapiens
cagccctgggagttggggccgagctgggtttgtgtctcttcttgccccatccctctcctgctg

SEQ ID NO: 6759701 - DNA, 60 bp, Homo sapiens
ggataccagggaggaggggctgtgtgaaagtcagagctgcgctttttcctggttttatcc

SEQ ID NO: 6759702 - DNA, 64 bp, Homo sapiens
taggttggtttttaaactccaagtctgatgatgagtgggtagaggattttaaaaactgcacctg

SEQ ID NO: 6759703 - DNA, 58 bp, Homo sapiens
ggtgtgtgaggagtcacttagttgatatacattaagtttctgtgactcttggcatact

SEQ ID NO: 6759704 - DNA, 55 bp, Homo sapiens
tccagcatggcacctgagatgagacagggagtcaacatagaggagccattcttga

SEQ ID NO: 6759705 - DNA, 56 bp, Homo sapiens
agtcaggagatattttgatatgtttatttcaaatcaaaatccttgtctccctgact

SEQ ID NO: 6759706 - DNA, 60 bp, Homo sapiens
atatgaagctgttgcttctcaagatgtacagtaagtacactgaaagaagccagcttgtgt

SEQ ID NO: 6759707 - DNA, 57 bp, Homo sapiens
cacagaggcagttgtttctgccacatacaagtcaggcagtcatttaacctctctgtg

SEQ ID NO: 6759708 - DNA, 59 bp, Homo sapiens
agtctgggaacattttgagggcaaagattgtgtttttgtccatctgtatttcccatgct

SEQ ID NO: 6759709 - DNA, 75 bp, Homo sapiens
tggggtatgcagctatattggtaatatttgctcagtttattcatactgatcgcatgcataatatagattgcccta

SEQ ID NO: 6759710 - DNA, 68 bp, Homo sapiens
aatctgaaaaccacttatatcgtgatttgaacaaggaatggtcaagttataagggaggtttgagggtt

SEQ ID NO: 6759711 - DNA, 58 bp, Homo sapiens
acagcaggtagctttgtgcctctgcaatgctcccttgaggttgcaagattcctgctgt

SEQ ID NO: 6759712 - DNA, 72 bp, Homo sapiens
agcctttcagagaactcagaatgtctttcatcacagaaggatgtggtctgttttctgagatgatttatggct

SEQ ID NO: 6759713 - DNA, 70 bp, Homo sapiens
aggcatcagaggcagacatggatttgagttctagctacctataactacagtagtttgcccttctatgctt

SEQ ID NO: 6759714 - DNA, 89 bp, Homo sapiens
ctttgtagtattgagggcagtgatgtcaaacagtgaataaagttatatatctatgtggtgatcttattttaacctcaatattattttag

SEQ ID NO: 6759715 - DNA, 62 bp, Homo sapiens
gtgtggctttctgggtttaatttttattgctgcaaataggaataagatcttaaaggttatat

SEQ ID NO: 6759716 - DNA, 68 bp, Homo sapiens
gaggcgggtggatcacctgaggtcaggagttcgagacgagcctggccaacgtggtgaaaccccgtctc

SEQ ID NO: 6759717 - DNA, 80 bp, Homo sapiens
tggtcttctttttcttctccctggattgtgcacaaaattatgccaatttatggtggggtaaggggatactccatggacca

SEQ ID NO: 6759718 - DNA, 56 bp, Homo sapiens
acattctattgtagcaccctgtaattttcctttacagcatgatcacaatggaaagt

SEQ ID NO: 6759719 - DNA, 68 bp, Homo sapiens
tctgtgttctgtgggtgttgtggcctaaactattataggaaagcctattgcacacatagaaacataga

SEQ ID NO: 6759720 - DNA, 60 bp, Homo sapiens
tgcatttggaaacaattatattcttataggactatataggagaagagatttccacatgca

SEQ ID NO: 6759721 - DNA, 63 bp, Homo sapiens
gcctctcctcttaataccattacattggggataaagtttcaacatatgaatttggagagaggc

SEQ ID NO: 6759722 - DNA, 105 bp, Homo sapiens
gtgtccctgtccccgcccaggaaagggctgccatttctggcccaagactgctccccttggaaaggcctgcctggaaggccagcccttggcggcatctggggacac

SEQ ID NO: 6759723 - DNA, 63 bp, Homo sapiens
gagcttgatgaaatttttcaattgtcttgaaagggcagttatattgttttattcatgtggctc

SEQ ID NO: 6759724 - DNA, 79 bp, Homo sapiens
tggtatgaaaagggctctgttgccatttcaggttgataaacactgagggaaggggtacatggctccttgacatgttcca

SEQ ID NO: 6759725 - DNA, 61 bp, Homo sapiens
ggcctccagggctccccaggactccctgcagcctctgcaccaccctgcagcccaggaggcc

SEQ ID NO: 6759726 - DNA, 55 bp, Homo sapiens
ggctttatattgtttgagcagacctcatttgaggcaagaaaacaataatgaggct

SEQ ID NO: 6759727 - DNA, 61 bp, Homo sapiens
ttttggtcttggatttatcagtggtttctagttgaattgagagagcagatccaggctaaga

SEQ ID NO: 6759728 - DNA, 57 bp, Homo sapiens
tgccatctgcacccacctgcccattgctcttcacagtggtagctgctgcagttggta

SEQ ID NO: 6759729 - DNA, 67 bp, Homo sapiens
acatatgtctatttcatgtaaaataatgttagggagatagcaatagcagatggagtagataatgtgt

SEQ ID NO: 6759730 - DNA, 104 bp, Homo sapiens
atgtgttggcaatagaaacagatttaagaagccaaggtgaagaattttaccagtttttaaattgtgttagttttagatctttttccttgttgggtcctccatat

SEQ ID NO: 6759731 - DNA, 112 bp, Homo sapiens
ggaccccctttcctgcacctctccccttcctgagccccccggctgtcctccaccacagccagagggaactgggcctcattagggggacagtttgttcctcattaggggcacc

SEQ ID NO: 6759732 - DNA, 83 bp, Homo sapiens
ggacaggcagcatttactctgatgaacatagaggctattttcctcttctatccaataattctcagagtacatgtttttttttc

SEQ ID NO: 6759733 - DNA, 85 bp, Homo sapiens
cttgggaatcttgttaaaaatgcagaatctgattcacaggtctgggatggagtctgagattctgcatttctaaaaatctcccggg

SEQ ID NO: 6759734 - DNA, 92 bp, Homo sapiens
gttcatcttccaaagctgtagaggcagtacattttctgggaaaaagcctcagtacagaacatgccagcactgcttttcagagaaagataggc

SEQ ID NO: 6759735 - DNA, 90 bp, Homo sapiens
agctcggtgatgataattagctatagtatgtctgcttttcgcatagtgaacgcatccatttctaatggttcctaattattgtgacatgct

SEQ ID NO: 6759736 - DNA, 68 bp, Homo sapiens
aagatgttgcattagaatacctgttctccaacaattcgtcctggataaaggcatctgagtcacatctt

SEQ ID NO: 6759737 - DNA, 67 bp, Homo sapiens
ccataccattctggtccatactgttctcttaaataacagagagaacagtgtggaccagaattattgg

SEQ ID NO: 6759738 - DNA, 71 bp, Homo sapiens
tgtgacagaactattgacatttttatagcttgacaaaaattaagcataattaaagtgaaatatttgttgca

SEQ ID NO: 6759739 - DNA, 109 bp, Homo sapiens
acaactggcaaagcttgatgttcaggtttgaaaaaagcagtatgtaataagctttcattatttacagcctgcttttttcaaaaaaggatttaaggagatgagaagttgt

SEQ ID NO: 6759740 - DNA, 86 bp, Homo sapiens
agagtgagcaggaccagggcgcgcctttggcaggcgacagtgttcactggcaacttgtgctccctgttttctttccggcttacttt

SEQ ID NO: 6759741 - DNA, 67 bp, Homo sapiens
gccccatagctggagataggctaactcctgagcaggtgctctacagccatcatcctgctgctggggc

SEQ ID NO: 6759742 - DNA, 78 bp, Homo sapiens
gaggtcacacagcaatgggcagagtggggacaggaaccagtgtgtcctgccagctttcccccaccactgaatggcttc

SEQ ID NO: 6759743 - DNA, 75 bp, Homo sapiens
actgtcatgtatggctatagaaatttgtttaactaccccaaagtgtacactttgttgtggcatatacgcttcagt

SEQ ID NO: 6759744 - DNA, 81 bp, Homo sapiens
gcttgagatttttatctcggccctcgaagaagaatgagttaagtttattcattttcccttctaaagggctgagtcttttgc

SEQ ID NO: 6759745 - DNA, 91 bp, Homo sapiens
aaaagattttatctggaagaatatggaagttacctgacttcagccatggctggatctaggggttttcataattttattgggattctctttt

SEQ ID NO: 6759746 - DNA, 65 bp, Homo sapiens
tgaattggagccccagaagcaaggttaaagtgagttactactgagtttctggtgttcctaactta

SEQ ID NO: 6759747 - DNA, 62 bp, Homo sapiens
taggggagggtgtccatttgtgatttgactaatggagattcacaaagtcacccttacacctg

SEQ ID NO: 6759748 - DNA, 66 bp, Homo sapiens
ttaatttaagttgtgaatgttttgcaactgttatcagtgccattgccttcacaattatgaaattag

SEQ ID NO: 6759749 - DNA, 82 bp, Homo sapiens
ggggcgctgggtagctcatttgaaggttgcatgagactaaatttattcctccctcatgcttaattggagcattcatttcccc

SEQ ID NO: 6759750 - DNA, 119 bp, Homo sapiens
tagtaatattgcctattcttgtgtcttaattcccactagactcttactagtgttctctttatgtatggacatttcaggagcagtttcagtggctaaagatgcagtttgctgtaaaacta

SEQ ID NO: 6759751 - DNA, 93 bp, Homo sapiens
tagaaaatcaaatagtgttctttgccagtgatttaatttaataataataatttttagaaatgaaataagtcactgggaggagctcattttcta

SEQ ID NO: 6759752 - DNA, 60 bp, Homo sapiens
tagggacctcatagaggcagaagcccatgggccttctgagcagacctcctggggtcacta

SEQ ID NO: 6759753 - DNA, 71 bp, Homo sapiens
gctcattaggtgatggagaatcagggagtcaggggaattttctgaccctggctcttcaccacctgccctgc

SEQ ID NO: 6759754 - DNA, 80 bp, Homo sapiens
cagacggggtcagggaggccccaccatggcttgtcgagggcacgggcacctgcatggcggcgctctccctgcctcccctg

SEQ ID NO: 6759755 - DNA, 82 bp, Homo sapiens
tggtgctgccttgcttactccactgcaaaagttaatacgcaacataagcagtaattggggagtgaagtatggttgttaacta

SEQ ID NO: 6759756 - DNA, 56 bp, Homo sapiens
attccaggcatgcaggaacaaggggaaagatgacccctccttccagttcctggggt

SEQ ID NO: 6759757 - DNA, 91 bp, Homo sapiens
tctgcatagttctgtgtgcctttcacacactgggatgccttggtttaagaggagattcccagctgtgtggaggagatgacaacagtgcaga

SEQ ID NO: 6759758 - DNA, 59 bp, Homo sapiens
tctccgaatcggctgccggggcttagggatggagggggtccagggcgggcgcacggaga

SEQ ID NO: 6759759 - DNA, 80 bp, Homo sapiens
gaaacatccatgcaataaagtgctataaatccataaaaaagaatgaggtggctctttatgcattaaaatgggattatttc

SEQ ID NO: 6759760 - DNA, 62 bp, Homo sapiens
ttccagtctggcctgtgcttagagaaaaattcacaggataagcacaacacatttttctggag

SEQ ID NO: 6759761 - DNA, 63 bp, Homo sapiens
tccttttcccctcagtactaaacatatatatatatattttttgtaaattgaggtgggagatga

SEQ ID NO: 6759762 - DNA, 77 bp, Homo sapiens
gctgaaaattctttattcagctgtttgcttctactgattccataatcttgatgacaaaggctgaaagggaaaagagc

SEQ ID NO: 6759763 - DNA, 65 bp, Homo sapiens
ctgtaggagtgggaatttattgagcatgagggatgctatcttgtgaaactttctacttcattcgg

SEQ ID NO: 6759764 - DNA, 75 bp, Homo sapiens
gtgtttctgggatgagctatatagaaagtttagttgactgctggaccttggatattcttactcggttcaaaatac

SEQ ID NO: 6759765 - DNA, 78 bp, Homo sapiens
ctcttagcatctacctgtttcttgactgactcatgagcgatccatgcccatggcagtcagagataagagtgacaagag

SEQ ID NO: 6759766 - DNA, 105 bp, Homo sapiens
ccttggagaagagccatgtggcgctggcataggcttgtggggaaagtgcctccttcagctgctgtggccacatctggctctgattttttttttttctccctgagg

SEQ ID NO: 6759767 - DNA, 85 bp, Homo sapiens
gtcgatttgtgtatactgaactcagaaaggagacatctgaatagtcagattctcagttcactagtttcttatgccaaaagttaac

SEQ ID NO: 6759768 - DNA, 59 bp, Homo sapiens
attaaaaagccactcgtcaggaaattgaagctcagaattctaacaagtggcttgttagt

SEQ ID NO: 6759769 - DNA, 70 bp, Homo sapiens
agtcatggagattttatgtaaaatatttaaaataattttttgaggtacaaacatgaggtttccaatgtct

SEQ ID NO: 6759770 - DNA, 56 bp, Homo sapiens
gccacagggattgttttgtgaggggaggctgttttataattaatgatctctgttgc

SEQ ID NO: 6759771 - DNA, 86 bp, Homo sapiens
aaagctatgtgattcatcaagttcaatatttaggggccccggaaaggaatatgggtccctaaactctgaactgattcacattcttt

SEQ ID NO: 6759772 - DNA, 64 bp, Homo sapiens
gatgcagagggctgggggaaaaaatcataaggcttgtggggatcttctagcttttcactgcgtt

SEQ ID NO: 6759773 - DNA, 78 bp, Homo sapiens
gggcaccgattctaccaggccctccagctgcgtggtctccgcagaccaggctctgtgtgggctagaggaatgtcgccc

SEQ ID NO: 6759774 - DNA, 86 bp, Homo sapiens
acctacgtcactgcctataaatttggccaactactgaatatggagtcagcataattttggggaaaattattggtaatgatgtatgt

SEQ ID NO: 6759775 - DNA, 86 bp, Homo sapiens
aggtgctggccaggccagtgggcagcagtgtctcccatcttgcctgtggcactgggtattcactgccgccacctgcccccagccct

SEQ ID NO: 6759776 - DNA, 85 bp, Homo sapiens
gccatttattgtgaggatcaaatgaaatagcaaaaagaaagcatcagtctggtgcctagcatttgattcacactcactaaatggt

SEQ ID NO: 6759777 - DNA, 58 bp, Homo sapiens
gagaagttgtgtggatttaaaggtgccccttctcctaaaggccacactgctctttctc

SEQ ID NO: 6759778 - DNA, 99 bp, Homo sapiens
agtacaagatcaaggtgccagcagggttgatgaccacctcttttttgcctcttgatgttgtcatcatcagtcctctgtgcacatgtgatcctggtgtct

SEQ ID NO: 6759779 - DNA, 73 bp, Homo sapiens
gatcctgctggcagggacagacagatatatttgggtttggaactaataacttgtttctgtttttgcactgatc

SEQ ID NO: 6759780 - DNA, 76 bp, Homo sapiens
cccaattactggccatccctgagtaaggaaaagcttcataatatatttccaaacagggtggcttaattccaaaggg

SEQ ID NO: 6759781 - DNA, 60 bp, Homo sapiens
ggggcgagcctggcactgatctggctggcttacatgactcagccaggctcaagctccccc

SEQ ID NO: 6759782 - DNA, 71 bp, Homo sapiens
gctgcagtttcgggaagctatcagtgagactattggcctcttaggcttgctgcatttcccaaagaggcagc

SEQ ID NO: 6759783 - DNA, 77 bp, Homo sapiens
aaatatttggatcttgctaaagaccaacacatttttttaagtgtgtataattttagggcaatttgatccatatgttt

SEQ ID NO: 6759784 - DNA, 69 bp, Homo sapiens
gaattcaggaagaaagatgatctaatgttacaaaacattatgaagcatcatcttattcctgtgaaattc

SEQ ID NO: 6759785 - DNA, 65 bp, Homo sapiens
tgacatttaagcctctgatttccatttggtacatattctggtgtgagaagtgaggtatagatgca

SEQ ID NO: 6759786 - DNA, 129 bp, Homo sapiens
agggcaggcaggagggtgacatggcagaggaggggctggtggggaaagaggaccatctggtgtgtgccttgatggttagctcccacatccacccactcattgcctgtgttatttgacctccctgagcct

SEQ ID NO: 6759787 - DNA, 56 bp, Homo sapiens
gaaatgtcattgccttcagcccttctcctaaaatggcttgaagactatgacatttc

SEQ ID NO: 6759788 - DNA, 70 bp, Homo sapiens
gctgtaggtaattactagagttatttagacttaattctgtgtctgaatgaattcagtgcttactgccagc

SEQ ID NO: 6759789 - DNA, 99 bp, Homo sapiens
gctgaagtggttgaacatgaaaagacttgggtgaagtaattttatagagaggaaaagtttctttgctgccaagtttgtttatcttgtcatactattagt

SEQ ID NO: 6759790 - DNA, 67 bp, Homo sapiens
tgatagcagagaaaaggttgtgaataaccctccctgggagagccactaacttgttctacctgtttca

SEQ ID NO: 6759791 - DNA, 66 bp, Homo sapiens
ctgtgcaaggcagtgctcttggccaaggtatcaatattcttgggaggggagcattggcctcagcag

SEQ ID NO: 6759792 - DNA, 82 bp, Homo sapiens
atggcagtgtccctggccacagtgtccagcagcagcatggcagccgcagcagggctctgtggtcagacaggggtgctgctgt

SEQ ID NO: 6759793 - DNA, 114 bp, Homo sapiens
gccaggtattaatccagctagctatgccccagtttccttactaagtaatacctacttatgcaggtgctttagtagaatgatacagggcagaaggtggttaagacaatacatggc

SEQ ID NO: 6759794 - DNA, 83 bp, Homo sapiens
agatgcagagagagccccaggggaggtgccctgcagtcccgaactcgactgacatcctacacccctgggtctccccagtgtct

SEQ ID NO: 6759795 - DNA, 64 bp, Homo sapiens
ctttaaaaccttaattctgagctcctttgggggacaagggaaactagaagcagggttataatag

SEQ ID NO: 6759796 - DNA, 98 bp, Homo sapiens
attatcttttcttggatggaatcggttcattgggtcctgatacctctgcaaaacctgtaaaatgggcttcagatccagggacctctaccattggtgat

SEQ ID NO: 6759797 - DNA, 110 bp, Homo sapiens
caaagactgtaaaggtaggccagatgacaatgaaggaaaatgttttgcttgttatttaaggccatatattttaatctcataatttgcctgaacttaattatagtgctttg

SEQ ID NO: 6759798 - DNA, 79 bp, Homo sapiens
gccatcctttagacacttgagctcgggcaatgggttcccccaagcctggcacattggagtctgctgggaattttctggc

SEQ ID NO: 6759799 - DNA, 73 bp, Homo sapiens
cttacctagtaaatactgacttaagaaattgctatgctgaattcagtcaattatctctaggtcatctagtgag

SEQ ID NO: 6759800 - DNA, 60 bp, Homo sapiens
gttgatatgtgtgtgtgtgtgtgtgtgtgtgtgtgtgtgcacacatgcattcatgtgggc

SEQ ID NO: 6759801 - DNA, 73 bp, Homo sapiens
ggaaatagccaccaagttctaattttgcattcaggggattgtcttccatggacgtgaagagactgatgtttcc

SEQ ID NO: 6759802 - DNA, 63 bp, Homo sapiens
agctatgcaaacaaggaactaagatctccaacatgttttcaatcttggccttgtttcatatct

SEQ ID NO: 6759803 - DNA, 76 bp, Homo sapiens
tcgcttgagcccaggaggagaggctgcagtgagctgagatcatgccactgcactccagcctgggtgacaaaagcga

SEQ ID NO: 6759804 - DNA, 69 bp, Homo sapiens
tataggataccttcctaacattgccatgacatttgtaaagtgtcatggtgctgttgggagtgtctttta

SEQ ID NO: 6759805 - DNA, 69 bp, Homo sapiens
tcaccattaaggactttcagctgaggttttcaaactgtgtttctcaaagtctgaggttctgtgtggtgg

SEQ ID NO: 6759806 - DNA, 94 bp, Homo sapiens
acctaaggctatgatgtggttgtctctcactagctgggggaacacaaggcattctgcttccagagcatgaagggcaatgaccagagtcataggt

SEQ ID NO: 6759807 - DNA, 89 bp, Homo sapiens
agttacatttgctacctgggcaccttggacttcttccacccagggaacagcaggcaataaaaggtgtcaccagattggcaggggtaatt

SEQ ID NO: 6759808 - DNA, 56 bp, Homo sapiens
gtttataaggtaaaggagagagagcaaaatctctccctccctttgtctttatgaac

SEQ ID NO: 6759809 - DNA, 88 bp, Homo sapiens
gaaccaatggagaatgttacattaggataatttgctgtaccctagatttgttgtagtagcaaatacatgatgtaatttcagtggcttc

SEQ ID NO: 6759810 - DNA, 67 bp, Homo sapiens
gtttaggaaacatattaatccagtgaaaataacaactattgttattggattaatatgttccctagac

SEQ ID NO: 6759811 - DNA, 89 bp, Homo sapiens
actggagagaggtagggttgggtactggggcaagtttagccaagggaactatacaaacctgcccagactcagatcctagctctgccagt

SEQ ID NO: 6759812 - DNA, 69 bp, Homo sapiens
cttcttgggtcctggctgaagatctctgctgcccccagactcagaagagccactccaggactcagggag

SEQ ID NO: 6759813 - DNA, 126 bp, Homo sapiens
tctccttgttcagagtcagggctcagactcaagactttccaggacgatgagccttctcaggggatatggacttcctgacagttaattgtcctgtaaactgttttctgaagcttgtagcttgggaga

SEQ ID NO: 6759814 - DNA, 128 bp, Homo sapiens
gagttgaattctgcttacgttccttagttgccaatgagttctggttcattttatgctgttttaaggaaaactcacatgaaattatgaactttggattcaggcttggattttcaaatggaaagcaattc

SEQ ID NO: 6759815 - DNA, 63 bp, Homo sapiens
gaaatgacttatgggtgaggagagctgtcaagcagagagttttggccaatctgtaggtatttt

SEQ ID NO: 6759816 - DNA, 83 bp, Homo sapiens
tggaggtctttgtatattctgccaaggtcctggggctttatcctatgggcaacaggagccatgagcaggaggcaatgccatca

SEQ ID NO: 6759817 - DNA, 87 bp, Homo sapiens
attcattgaatagggcaagtatcagagggttttaagcagaaagatgtaataatggaagatcactttgatgctacctggagaatgaat

SEQ ID NO: 6759818 - DNA, 85 bp, Homo sapiens
tgatacaataagtcagaaatatctgccatcaccaattgaatatgaaagtgcatgatgcatgtgtttcatgaaattcactgtgtca

SEQ ID NO: 6759819 - DNA, 60 bp, Homo sapiens
tgttctcagtaattctattttaagggggctatcttttctttctaatgcttaccgagaaca

SEQ ID NO: 6759820 - DNA, 79 bp, Homo sapiens
aatacataatagagcccatgtacccgctattggcctttgcttaccagagtgtacatagggtttttcctctctaagtatt

SEQ ID NO: 6759821 - DNA, 79 bp, Homo sapiens
ggagatggcattgccatcctgtatcacaagatgtaccgttccatttagaacacggttatgcaggaggacaagcaatccc

SEQ ID NO: 6759822 - DNA, 80 bp, Homo sapiens
caaaaaattcgattgatgtgctgctgacttctgtttggtttagcagatgtttgttgagcagctgtttgttgaattggttg

SEQ ID NO: 6759823 - DNA, 68 bp, Homo sapiens
cagttaatgatgtgtgtcaactagactgagccataggatactcagataactggtttacattattgctg

SEQ ID NO: 6759824 - DNA, 78 bp, Homo sapiens
ttttgaactaaggtctatgaggccagaacatcttggcgggcgctgcatgtcatctggtttctaggcagtattttagaa

SEQ ID NO: 6759825 - DNA, 79 bp, Homo sapiens
gttctttctgcctttctatatcatggagtgtttcatttcatttcattctgtttggaaaggtgggtggataggaaagaac

SEQ ID NO: 6759826 - DNA, 60 bp, Homo sapiens
ttgtgtaatgaagttatcatgttttatagaacatgaaaaacttgcttcatttttacacag

SEQ ID NO: 6759827 - DNA, 129 bp, Homo sapiens
aaagaattaaatgaacagaaagggagtatagcatagtagttaagagtgtgagctctgtagctggaatgcttgggtatgaacctcagctctttatactagctgtgtgaccttttgtgtcacaatttcttt

SEQ ID NO: 6759828 - DNA, 62 bp, Homo sapiens
tagagacactggctggattgaggagtagaaggctcaaacaacccaaggttagttggtctttg

SEQ ID NO: 6759829 - DNA, 103 bp, Homo sapiens
ttcaacccccatcacgtgctgagagtgttattgtcaagtacagctacgacatccatgctacaatccaatgccatttttatgtactgcatcactcagggttgaa

SEQ ID NO: 6759830 - DNA, 70 bp, Homo sapiens
cctgtattatgctgagtatataaaacagattgggaactttctttctttgttttcctttgtgctccacagg

SEQ ID NO: 6759831 - DNA, 69 bp, Homo sapiens
gggtggcctcatggaggccaggaaacagcctggagtcaggtgggtcctggctctgccatttacgccccc

SEQ ID NO: 6759832 - DNA, 78 bp, Homo sapiens
cctttgtaagatgtgaagactgcagatctcttttcatcactgagattcacagaataaagttttccatatttattaagg

SEQ ID NO: 6759833 - DNA, 71 bp, Homo sapiens
ggagttataaattattaagcatcacatgaataatttattaatcattcatgaggtgctagtgctgtgtctct

SEQ ID NO: 6759834 - DNA, 80 bp, Homo sapiens
cttcccatctctcctgctggaagagattggagcctcctttgggggctctggctttgccagccctagcggggagtgggagg

SEQ ID NO: 6759835 - DNA, 66 bp, Homo sapiens
ttactgaacacatttctggccaatttagacttaatgtgtatgtttgcattaaatctgttcatgtga

SEQ ID NO: 6759836 - DNA, 66 bp, Homo sapiens
gccacctgcctggtatggagcccatgagctattatctacttggatctgtcccaaggctaggcctgc

SEQ ID NO: 6759837 - DNA, 82 bp, Homo sapiens
gcttgagccatccctggcttcctggagctcacaacctgagagagaaggtggtgctgcgggaacccagggttgggctgtgggc

SEQ ID NO: 6759838 - DNA, 81 bp, Homo sapiens
cagagtagcaggttctgggtgccacctaagacatctgatttaaggtgaagagtgatgtatttagaattggccagtgctttg

SEQ ID NO: 6759839 - DNA, 57 bp, Homo sapiens
gaagtctctttgtataaataggcatcacaatagatgcctttatgataaagtgatttt

SEQ ID NO: 6759840 - DNA, 78 bp, Homo sapiens
ggtcagggctatggccacctggacccactgggcacactttgcatcacagggtgggttcgggctctggccacctggacc

SEQ ID NO: 6759841 - DNA, 91 bp, Homo sapiens
ttctgagagtattaatggctttagtggatggcatttacttagcacttactaaatgccacacgtcaggctcattatcttacatacattagga

SEQ ID NO: 6759842 - DNA, 102 bp, Homo sapiens
cacaaatttgtatttggggaagcagtatcctgacagcaccacaatctgaatttaaaaattggcggtgcgtaggagatacctttcccacagcagctttctgtg

SEQ ID NO: 6759843 - DNA, 67 bp, Homo sapiens
ttcttattcctctgttctggaacatctgtctgcttctgagaaatggaacgagcagcaggatcaagaa

SEQ ID NO: 6759844 - DNA, 59 bp, Homo sapiens
gccatcacttctgtagactaagtcattgaatgtttgggttaaaatgaggaagtggtggc

SEQ ID NO: 6759845 - DNA, 67 bp, Homo sapiens
agctacagagatagtcttgtaggtgagaagttcagctacttttcacttgactccagtttcttctgct

SEQ ID NO: 6759846 - DNA, 58 bp, Homo sapiens
agaaggagacagaaaattcaggatataataactaatcttatatccttctgttctttct

SEQ ID NO: 6759847 - DNA, 58 bp, Homo sapiens
gcctgctgagggaagttgggcatggccctgttccttgcccaagccagccttcacaggc

SEQ ID NO: 6759848 - DNA, 73 bp, Homo sapiens
gcaagtttcctaatcttcaacgtggaacaaggagttacttagttttcaagtggcgagataaggaagcttctgc

SEQ ID NO: 6759849 - DNA, 77 bp, Homo sapiens
ctctgacattctgccaccaacacacaggaagcaaacaggtttttttctactggtgttggtgtactttgtgctcagag

SEQ ID NO: 6759850 - DNA, 56 bp, Homo sapiens
gtgacctggccgcctaaacccagggcagtgcctgattataagtggacacaggtcac

SEQ ID NO: 6759851 - DNA, 55 bp, Homo sapiens
aaatggtgctgtaacaaatgacttcccactactgacagttatagcagcagcattt

SEQ ID NO: 6759852 - DNA, 110 bp, Homo sapiens
tataattaaagcatatgtatatgaagagtttagtgaagacaggtcagattcaaagacttcagatctgacctgtcttcattaaactcttcatatacatatgcttggttata

SEQ ID NO: 6759853 - DNA, 66 bp, Homo sapiens
gaatgtgtcagctcttaaccctctggccttgagggccaaggctgcggtagaaggagctttgcagtc

SEQ ID NO: 6759854 - DNA, 69 bp, Homo sapiens
tctgcttttgccagatatggttgccagatttgtttatgtgttggcaactctattggcaaataatgtaga

SEQ ID NO: 6759855 - DNA, 67 bp, Homo sapiens
agttttagacattgtaacggtggctcttctttcataattttatgtcactgtgaagatgctataaact

SEQ ID NO: 6759856 - DNA, 79 bp, Homo sapiens
acgtgcccattaggttcatttagtgaaggagataccaaaggaaatggccttctcttctctagtgagcaactggccacgt

SEQ ID NO: 6759857 - DNA, 61 bp, Homo sapiens
ggaacaatgaatgtgattaacttcaaggacgggagtccagaagtaatgatgtcattccttc

SEQ ID NO: 6759858 - DNA, 91 bp, Homo sapiens
gtacagctggccttcggtgtcactgggtctttatcagcagctggttgaatccatgcatgcaaaaccggtagatacagagggccaactgtac

SEQ ID NO: 6759859 - DNA, 72 bp, Homo sapiens
atatgaactgcatgttttctactgttgctcaggtgacatctggtggataaaaactgaaatgcaattttatat

SEQ ID NO: 6759860 - DNA, 88 bp, Homo sapiens
gcgatgggggactaactggatcctggatagtttctttcaacgtgaacaagtttcaggatgctcagagtagtctactcacacctattgc

SEQ ID NO: 6759861 - DNA, 92 bp, Homo sapiens
gtttcaatcaatgttatataatgttcagtgacctggaaccctgaggctaagttttgtcccagatactggacatagatatattgtttaaagac

SEQ ID NO: 6759862 - DNA, 77 bp, Homo sapiens
ggactatctaactcatgatatacgggaaattatagttctaaaatgcatatataaaatattctgggttagatatgttt

SEQ ID NO: 6759863 - DNA, 59 bp, Homo sapiens
ttgtaaactggatagacctatttattcaataatataaatgggaatattctgtgttacaa

SEQ ID NO: 6759864 - DNA, 77 bp, Homo sapiens
ctgtgagaaggtcctggtgtggccctgtgacatgagccattggcttaatgtcaaggtcattctagaggagatcatag

SEQ ID NO: 6759865 - DNA, 88 bp, Homo sapiens
cctggtccctgcccccacctggcctacagggaccagccccacggaaggctcttgaggccaggtaaccatggggaggggaggaatgggg

SEQ ID NO: 6759866 - DNA, 65 bp, Homo sapiens
tcactggaattggatggaagtggtgaatttcagccaaagtagccaaagaaatcctgttcctgtga

SEQ ID NO: 6759867 - DNA, 55 bp, Homo sapiens
gtagttagttaagatgagtttattagggtgggacctaaactccgtgactaataac

SEQ ID NO: 6759868 - DNA, 58 bp, Homo sapiens
atctctggtccaaatgttacctttacctcaaatgtggagaatagcatgctttagagat

SEQ ID NO: 6759869 - DNA, 77 bp, Homo sapiens
atcagataagtgaagcaaagtttagctggacaggtatggcaaaatcagcttatacaggacaatgcttcgtatttgat

SEQ ID NO: 6759870 - DNA, 86 bp, Homo sapiens
ttattacattggtgcaaaagtaattgtggttcttgccattgaaagtaatggtaaaacccgcaattacttttgcaccaacctaataa

SEQ ID NO: 6759871 - DNA, 67 bp, Homo sapiens
tgagtgtgtggaggtgttctggtggctggatgtgactggcaattcatagcatcctcatatccgctca

SEQ ID NO: 6759872 - DNA, 69 bp, Homo sapiens
cttacagatgtttcaggaatactattttgaacccaaagggagagtttagtgtgtctgatcacttgtgag

SEQ ID NO: 6759873 - DNA, 55 bp, Homo sapiens
tgggagggcaggcaggggcccaccccggggccacagctgcagctgcaccatccca

SEQ ID NO: 6759874 - DNA, 73 bp, Homo sapiens
ctggctctcttgcatctcctctctgatggtttggatttggagtatcaggaagaagaatgtgttgggagctcag

SEQ ID NO: 6759875 - DNA, 80 bp, Homo sapiens
cacagccttgtgggaaatgtgcactgtgctacgagttgctgagatgtcattacagtgtgtgctttcccttacggcctgtg

SEQ ID NO: 6759876 - DNA, 68 bp, Homo sapiens
tgggaagtgctgggcacttgtcagaggctgtcatcaaactgacccctgaacaaagcccaggctctcta

SEQ ID NO: 6759877 - DNA, 62 bp, Homo sapiens
gtttatcctagtaagtcttctatgtttattcagaggtatggaagataagagattgggaaggc

SEQ ID NO: 6759878 - DNA, 74 bp, Homo sapiens
cagatgtacttctctgtgtcttagtgaagggagcacattctttggtctcttttggccaacacggaaggtgaatg

SEQ ID NO: 6759879 - DNA, 71 bp, Homo sapiens
gcttcagcccatcccagtacatcgcatggtgaccaaaagatgtagtcgtcctggcacagtgggtgtggggc

SEQ ID NO: 6759880 - DNA, 78 bp, Homo sapiens
acatctcgatggaattggaaagaggaatgttagacgttttcctagttttcatcgtttttcttccattccatgaagtgt

SEQ ID NO: 6759881 - DNA, 92 bp, Homo sapiens
tgacaagataagatattctggaatctttggagaatgtgggagcatgaagtcttcatatgacttgaaagttcttgagtaacttatttctgtca

SEQ ID NO: 6759882 - DNA, 61 bp, Homo sapiens
tgattggcagggctggaatctgaacccaggcagtctggggccagagcccactttcttatca

SEQ ID NO: 6759883 - DNA, 91 bp, Homo sapiens
tcacttaactatttacctaatgactttcagtggttcagttttcaaataacctctgagctggctatacttgaaaagtcaaaatgttaaatga

SEQ ID NO: 6759884 - DNA, 75 bp, Homo sapiens
agatgtaagttgtggcagtttgcattttatagtgatagcctgtaagatttttaaaatgtcctcagaaatacgtct

SEQ ID NO: 6759885 - DNA, 73 bp, Homo sapiens
acatttttgagaatcttctaggtcccagtctctctgtccagcactagagcacagggaatagacagataaatgt

SEQ ID NO: 6759886 - DNA, 111 bp, Homo sapiens
ggctcacctaagcagggaagccgatttggaacttaaacaagctcccaagttgtgatcagtcgagcttggcaagcactgtttgagagagtaggcttcccgcaagcaggagcc

SEQ ID NO: 6759887 - DNA, 91 bp, Homo sapiens
ccctggaaagccacaccacctcctctcctggcaaaatgtggtgtcgtcttagtccaggaaggtggggcagaggattgaggacattctaggg

SEQ ID NO: 6759888 - DNA, 67 bp, Homo sapiens
tgagacatataatttgcccacaaaaggaaatgtaacattttagtctgggacagattataagtctgca

SEQ ID NO: 6759889 - DNA, 84 bp, Homo sapiens
gccttggaaggttcgtcctggcctgttcaagcctgttttcctctctctagcttgattccacagccttcgaagtttcttcctggc

SEQ ID NO: 6759890 - DNA, 57 bp, Homo sapiens
tgaggatgatggaaaaagatcagtcaaggataatgcctagacttttcatcaacctta

SEQ ID NO: 6759891 - DNA, 107 bp, Homo sapiens
tttggctaagaactttgggactttttgttggcttaagaaatacagttattatgctagttaactttattttaaagacagttttgcaaaattcagttctatggcacaga

SEQ ID NO: 6759892 - DNA, 63 bp, Homo sapiens
gagacccatcttcccagaccttacatgtgatcctttcagagatgactcatgggattgggtttc

SEQ ID NO: 6759893 - DNA, 66 bp, Homo sapiens
actttcattgttgaaaactacctatatatacggacagctgggtattaggtagattttactgattgt

SEQ ID NO: 6759894 - DNA, 67 bp, Homo sapiens
gttacaaaggcttcatctcagagcagggggcaggctctgctcattgttctggagaggtgtttgggac

SEQ ID NO: 6759895 - DNA, 86 bp, Homo sapiens
tgtatttccacaagcaaattactacaacaaacttgcctgctgagttcaggtcatcagacaattgttgagtactgggctggaagtca

SEQ ID NO: 6759896 - DNA, 61 bp, Homo sapiens
tccaggcctggctccattcagtcaaaacagcgtacggctgtctccagggccaggtgctgga

SEQ ID NO: 6759897 - DNA, 63 bp, Homo sapiens
acaattctaaaaggagcactttaaatacattatagcactaaatgtgcccctgttttgaattgt

SEQ ID NO: 6759898 - DNA, 66 bp, Homo sapiens
tctggatgacagaatggtcatattattgcttgatttgaagaagagcaccattgactatctgccgga

SEQ ID NO: 6759899 - DNA, 75 bp, Homo sapiens
ggcaaggttaagagatagtgctggagtgagtatgtgtagtcttagtgacacctcatctcactcatagcctttgcc

SEQ ID NO: 6759900 - DNA, 65 bp, Homo sapiens
ctgtttcctcacctgtgcaattgaagtcatggtccccatcttctgggtgtggagtgaggacacag

SEQ ID NO: 6759901 - DNA, 104 bp, Homo sapiens
aatatctatacacctgatatgttttaggaattaattgttaccaatgttaagttaaatacagtgtcttggaatttggttttaagagcatcaggttaaaggatgtt

SEQ ID NO: 6759902 - DNA, 66 bp, Homo sapiens
gtgtgaagactcataattttagcccagattgtactgaggatctaattattgggtctgttatcacat

SEQ ID NO: 6759903 - DNA, 124 bp, Homo sapiens
tattttttcccttctataattgaaatgtacaagactgtgctctaagagtggtgtttatttaaatttccattttaaaatagtctatgtttataatcagcatttccaattatgaagatttaaaata

SEQ ID NO: 6759904 - DNA, 77 bp, Homo sapiens
tcatggcgctccacaccagggcctagccagggcgacagagttgtgattcatgccatctggggcctgccgtgctgtga

SEQ ID NO: 6759905 - DNA, 84 bp, Homo sapiens
gtgttaaggagccattatactgggccaagtgtgtctttcaagaggatagacttgaggatataatgaatgatttctccataacac

SEQ ID NO: 6759906 - DNA, 55 bp, Homo sapiens
cagcattgaacacagtactaagagagcaggactttctctctcttgttcactgctg

SEQ ID NO: 6759907 - DNA, 60 bp, Homo sapiens
cgggcgcactccgggcagctgtagcccttgcgagggccgggctctcctgggggcgcctcg

SEQ ID NO: 6759908 - DNA, 121 bp, Homo sapiens
ctgggaggcaagctgcctgagtttgaatcctgattgggcaagaggatatgtcactgatctctattgcagattccttatctgtccaatggggtaatcaaagacctcatagggttgtcctgag

SEQ ID NO: 6759909 - DNA, 65 bp, Homo sapiens
gccaatgtgtggagtggaagtcatctttttcttatcacacccaatgacccattttcagtattggc

SEQ ID NO: 6759910 - DNA, 101 bp, Homo sapiens
tgagagggagtctcactctgtagcccaggctggagtgcagtggcgccatctcggctcactgcaagctccgcctcccgggttcacgctgttctcctgcctca

SEQ ID NO: 6759911 - DNA, 88 bp, Homo sapiens
gagttttgcttttccctttgtcttctgaggtagatttataggcagctcttgttatttacactaaaggaaggaggagagagagagattt

SEQ ID NO: 6759912 - DNA, 91 bp, Homo sapiens
cccaaaggtttgagaagcaattcaaagccttctgtctgtcaccttgtgcacaagaagagacagactggtttgaattggtaagatctttggg

SEQ ID NO: 6759913 - DNA, 62 bp, Homo sapiens
gatgaatccagcaaacagtgaggcgtagcttgatgacctcagattgcatgttcgggttcatc

SEQ ID NO: 6759914 - DNA, 90 bp, Homo sapiens
actttcggagactgaggcgggcgatcacctgaggtcaggagttcaagatcagcctggccaacatggtaaaaccccgtctctactaaaagt

SEQ ID NO: 6759915 - DNA, 74 bp, Homo sapiens
aatgtgagaacctacagtagttgacacaggaattataaaagaatagtggcagcttttccaggctctccagcatt

SEQ ID NO: 6759916 - DNA, 71 bp, Homo sapiens
gaaatgaaccaatgctggataccatctgccattgttaaaaggaagattctagtccagtgggccttcatttc

SEQ ID NO: 6759917 - DNA, 60 bp, Homo sapiens
gagtgtctgtgacagctcatgagcaggtaaaagcatgccccaggagctttaaagacattc

SEQ ID NO: 6759918 - DNA, 79 bp, Homo sapiens
tcctcagctctaacatgagggcttgagtcaaatcagagtgcgtgtcttatgtgactagcccttcatgaccaagtcagga

SEQ ID NO: 6759919 - DNA, 130 bp, Homo sapiens
gatctcacttgataaacttttgattatatttccagttgtcttatcggagcactttgtaaacggggtgatttatccattttctggttgggaaaactgtaactcagaagaatttagtaattcatttgagatc

SEQ ID NO: 6759920 - DNA, 64 bp, Homo sapiens
caggtgacctatggtcactacatatgagttcagaaagttcagaaaggtgaccgtagttcacgtg

SEQ ID NO: 6759921 - DNA, 71 bp, Homo sapiens
ggggggtttacctcagtctcaggagccatccttcagatcaggaaatatggccctgaccttgatgaccttcc

SEQ ID NO: 6759922 - DNA, 112 bp, Homo sapiens
ccaaggtctgactggtgcaggaagctaggccttcatgttttgaagattagaataaacagctgcaatattaggatctcaccatagaaggaagctgggcccaggaaggagctgg

SEQ ID NO: 6759923 - DNA, 71 bp, Homo sapiens
tcctggcaggagcgggggcagggctgcccacagggatgcagactctggccacccccgcagtctacgcagga

SEQ ID NO: 6759924 - DNA, 87 bp, Homo sapiens
ccagtcagtgtgtgctaattgtttcaatcccctgtaaatggtttggcacgagaggaggttggaacacttagctaaattgaagtttgg

SEQ ID NO: 6759925 - DNA, 93 bp, Homo sapiens
cggtatgtaataagatttaagttgtttgccacagggcatttgaaaaatgcagttgggcaggaacagatgcttgaagagttattaattatgctg

SEQ ID NO: 6759926 - DNA, 70 bp, Homo sapiens
gctgtatactataataggaacaaatcttacctctgctaaagatttgataaattcttgatgtagttgaagc

SEQ ID NO: 6759927 - DNA, 120 bp, Homo sapiens
gaaatgtaaagagagttgattttgctcattttgtagtttgaaagaagccagactcccaatacagcacactaaaagcttggctttcgctatagagcacggccaactctagaataaaatttc

SEQ ID NO: 6759928 - DNA, 109 bp, Homo sapiens
tcatcaacattgcccaacagatgcagcactgatctttagccagagaactctctggaatcattaaagagatcgtgaggactgcctagtctgtgggctgtagtgttgatgg

SEQ ID NO: 6759929 - DNA, 56 bp, Homo sapiens
gaggcagttcctgagtgacaaggctatttgtgtatcctgcatataaaaattgcctc

SEQ ID NO: 6759930 - DNA, 80 bp, Homo sapiens
ctggttcatgacttagacagtgctatcccatctgtgagtgagcatactctgtcatggtcagattgtcatcatgaaatcag

SEQ ID NO: 6759931 - DNA, 82 bp, Homo sapiens
tagcaggcaggaatagctttcgacacagctcagttctcataaatgtgaggcagtgtgggccaagcttcccttcctaccgctg

SEQ ID NO: 6759932 - DNA, 83 bp, Homo sapiens
aaatgactaagcagtaagttagttcctgtgttagttttttacataggactgacaatgagattgatttaaatgacctgtcattt

SEQ ID NO: 6759933 - DNA, 82 bp, Homo sapiens
cattttggtcatacagtaaaatctatggattaagttagaaatcatctatcccatatattttgcggtcacgtggcttcaagtg

SEQ ID NO: 6759934 - DNA, 94 bp, Homo sapiens
gcactcgtcacttttgtccaactccacttcagctcagtattggttctgaaatacagttaaacgatgatggggtcaaaggaaggagtggcggtgt

SEQ ID NO: 6759935 - DNA, 61 bp, Homo sapiens
cagcctctccacaatgtgtcctgagaagagctaggggaactggacagagtggacgaggctg

SEQ ID NO: 6759936 - DNA, 81 bp, Homo sapiens
gggagaaggtcagttttggatgagcccagatttctcctccctccgagacattttatctcacccaacacagccccttctccc

SEQ ID NO: 6759937 - DNA, 66 bp, Homo sapiens
gaggagtggctatttgtgctggttttctgaacttacagccttcaaaccttctaaatggctcttctc

SEQ ID NO: 6759938 - DNA, 83 bp, Homo sapiens
gcaaaaatcctaagcatccttttctgcttgattttaaatttgacatgttgggaagaggaggttgctttcatagaaacttttgc

SEQ ID NO: 6759939 - DNA, 63 bp, Homo sapiens
aagcaaggttgttaggttctaagactgaagctgctctttatctcttctcccaacacctggctt

SEQ ID NO: 6759940 - DNA, 89 bp, Homo sapiens
gaagatagactttatcatgacttccagcaatatcttctttctctcaacttcattgctgtttacttaggaagacagaaaagcctattttc

SEQ ID NO: 6759941 - DNA, 78 bp, Homo sapiens
gtctcaacactcttattttgctttgcaaaactctgtaagattataagggatatttgatagggaagtaagaatgaagac

SEQ ID NO: 6759942 - DNA, 62 bp, Homo sapiens
cctactgcatgaccttggacagaacttgcctcttaggcctcagtttcctcaactgcagaagg

SEQ ID NO: 6759943 - DNA, 76 bp, Homo sapiens
gacttatttggttgatggctggaagagtcgaagagtcaaggaggacggacccttagcggccatggaataataagtt

SEQ ID NO: 6759944 - DNA, 126 bp, Homo sapiens
ataatatgtcattcttctgaaaatagttacagttctgatattagtgcaagtaagtgtatgtttttcattctgaatgtatctacactataacagaatgcttcactgttttattttcctttgactttt

SEQ ID NO: 6759945 - DNA, 78 bp, Homo sapiens
gcttcctgtcccatagaatgcagcaggaaagttcccacaatcaagggggcctctcttagtgcattccatgcgggaagc

SEQ ID NO: 6759946 - DNA, 87 bp, Homo sapiens
tcatttaatagtcaatgctttcttataaccactgcgaaattcactatccgtaaatgttagaggaaagtgtagaaataaagttagaga

SEQ ID NO: 6759947 - DNA, 61 bp, Homo sapiens
caggcactatggacatgctgggctggataattccttgttgtgtgccctgtcctgtgcactg

SEQ ID NO: 6759948 - DNA, 59 bp, Homo sapiens
aatgttgttggctcttcatgatttagtttcttctttggtaaaataaggccaataacatt

SEQ ID NO: 6759949 - DNA, 72 bp, Homo sapiens
gctctggttatgcctccgaaacctggagtgtgagataaagcacaaaggtgtgtgggtgtgagaatgcagagc

SEQ ID NO: 6759950 - DNA, 60 bp, Homo sapiens
catgaggggacccagaggtatcatgtaatgaagggactgagagagctgggtatctccatg

SEQ ID NO: 6759951 - DNA, 62 bp, Homo sapiens
tgcagtgtggatttagttgtgcttttttcttgctgggagagcacagccaccatttacaagca

SEQ ID NO: 6759952 - DNA, 81 bp, Homo sapiens
attatacaaggttgtactttctctctaagcatgaaggatttcccatggaaaaagagttcagaaagtgcaggtttgtgttgt

SEQ ID NO: 6759953 - DNA, 69 bp, Homo sapiens
taggccttcggtgtgtgcttggtaggttgatcaatgtgaagcctttttccgagtacacttgagggcttg

SEQ ID NO: 6759954 - DNA, 75 bp, Homo sapiens
gtgccacatgcaggctgggtagccagaccagtgggcagcagaaccaggatgtctctccagcctggagtgtggcac

SEQ ID NO: 6759955 - DNA, 59 bp, Homo sapiens
ttactttgcttcaggaagaggaagtaacaaggcattcttccatccctgagctgaagtgg

SEQ ID NO: 6759956 - DNA, 71 bp, Homo sapiens
agctaactgaaagccctgagtgcctgtgtaagaatactggatttgaacatcactgtagggtgatcaggcct

SEQ ID NO: 6759957 - DNA, 59 bp, Homo sapiens
tgtgacttcatttggtaattgggtctttaaggaggaacctaattgaaaatgatgtcata

SEQ ID NO: 6759958 - DNA, 129 bp, Homo sapiens
ggaatgtttcaaatgtattggataaaaacttagttaggctgacatttgttaagttcttggcctgattaaacatagcagctgtcagtttcacataaggagaaatgaacattgaatatatttgaaactgcc

SEQ ID NO: 6759959 - DNA, 104 bp, Homo sapiens
gtatgaaccagtcccaagtttgatcttgatcaaggctatcatgaaagccaagatttcttttctcctcagaggccttggttatggtatgatgcagtggtttgtac

SEQ ID NO: 6759960 - DNA, 77 bp, Homo sapiens
gtggcagagctggctggtagccctgatcccactctccacttgaaggacagctgattaggctccaagtacctcttcac

SEQ ID NO: 6759961 - DNA, 79 bp, Homo sapiens
ttctcctgcatttagcgccatgtgaggagcagagagggttgcttttccctgtgcctagttggcctaaagtgcagttgaa

SEQ ID NO: 6759962 - DNA, 66 bp, Homo sapiens
taacagtaatgtggtgttgggttagaatattggcacagtatctggaatccagcatcagttctgtta

SEQ ID NO: 6759963 - DNA, 129 bp, Homo sapiens
atttgaattacatgggaacctctttaaaatactgatgccaggccctcccacagattaattgcatttgattctctggggatggggtcaggcccccagtatttctttcaaagttctccaggtgattctagt

SEQ ID NO: 6759964 - DNA, 87 bp, Homo sapiens
ggatgtgcctgatataaatgtgtgtctttcatttcatgaggcattgtattatatatgtccattagaacacgtttcttagtcatgttc

SEQ ID NO: 6759965 - DNA, 67 bp, Homo sapiens
gacagattctttcctgtggacttatgagtgtaagttcagttttatcttggtctttgggaaagctgtc

SEQ ID NO: 6759966 - DNA, 63 bp, Homo sapiens
gggatgtatatgtgaatgcgtgtatgtgtgtttagggtacgcatgcatgttacagtatatgcc

SEQ ID NO: 6759967 - DNA, 80 bp, Homo sapiens
gggcaggtattaggaaagcagtagagccaggattgaaactctggtttctctcgagcctatgcttttccttatatctggtc

SEQ ID NO: 6759968 - DNA, 82 bp, Homo sapiens
gctgtaattaagattttgaatggtttgagttctcactgatgtgctcaattcagaaaaattcactcctaagatcatttatggc

SEQ ID NO: 6759969 - DNA, 91 bp, Homo sapiens
tgttggaatattgagtcatttttttcgtaatagtggctttgctgcctgaaacaaagaatagccaaatgaagggatgagcagttttccagca

SEQ ID NO: 6759970 - DNA, 120 bp, Homo sapiens
ctgagaaacctcgctgagaaagctgatcagagagaaggtcccaagaggctggaagatcctctcatctcaggctgacattgggactccccttggattatctttgtatcaggagggcctcag

SEQ ID NO: 6759971 - DNA, 92 bp, Homo sapiens
ggtaactgagcagtgctggctcccagctttcagggagagaaaattattcctcctcaagctggctgggagctattaaaggtttaaatgtcacc

SEQ ID NO: 6759972 - DNA, 81 bp, Homo sapiens
cattttcttggtttgcatgtggaaaagactgatgaattattagttacatcaaatctttaacatgtgcaaattagtcaaatg

SEQ ID NO: 6759973 - DNA, 66 bp, Homo sapiens
gtccccgatcttgaccagcctgtcgttgtccagcagcacgttgcgcgcggctaggtctcggtggat

SEQ ID NO: 6759974 - DNA, 125 bp, Homo sapiens
atctgaaatcaaggtgttggcaggattggtttcctctgaaggttccgagggagaatgtattccatgcctctctccttagcttctagtggtagccggcaattcttgtcattctctgacttccaggt

SEQ ID NO: 6759975 - DNA, 58 bp, Homo sapiens
agatgagtgtgtgtgtgtgtgtgtgtgtgtgtgtatatgtgtgtatatatagtcattt

SEQ ID NO: 6759976 - DNA, 69 bp, Homo sapiens
agacccgtcctgcctgagccccattctctccctttcccaggatggcagctgaatggctggatgggatct

SEQ ID NO: 6759977 - DNA, 127 bp, Homo sapiens
tgaattgattatcttttagagatcaatagaacattttgaaaattttttctctactaaattacacttttccttaggtttccaggagaagagatttgtgttttattgcaataaaagtgacagcatttca

SEQ ID NO: 6759978 - DNA, 69 bp, Homo sapiens
ttgccttgtggccttctgttcctgagcctcttctgtgtgtgcagggaggcagcaggttgtccagggtga

SEQ ID NO: 6759979 - DNA, 63 bp, Homo sapiens
cctcatatgtgtatatttattgtagtttcttttactaataagattctagaatatattgtgggg

SEQ ID NO: 6759980 - DNA, 66 bp, Homo sapiens
aggtcagcatagttcacacacagtcctgatagctaacagtcggctgtgcccatattctgctgacct

SEQ ID NO: 6759981 - DNA, 79 bp, Homo sapiens
tttgagttataaggtggtgattaggttttcaggtttagagaagtgtgagacaacctaattaaacacctttttgctgaaa

SEQ ID NO: 6759982 - DNA, 123 bp, Homo sapiens
aaggtagcacttgcacgtaatgtagatagtaaacagactggcattctgcctgctgctgacctgacaggaagcatctggcagaaagtcagaagggcatctgcattacctgttatctagctcctt

SEQ ID NO: 6759983 - DNA, 119 bp, Homo sapiens
tctacaaatggggctgtgccctggaggaaacagtgaacttggcaggccatggggaacgcttggcctcaacgcctcttctcttcattttttcctcccagggtgtgtactcattgaacaga

SEQ ID NO: 6759984 - DNA, 56 bp, Homo sapiens
gttttagttgtgctgtgtgaataattgttacttgttcactggaacacagctgtaac

SEQ ID NO: 6759985 - DNA, 62 bp, Homo sapiens
ggcgcctaggcaaggaacccctgagccaggagagctggaccaggggcccttgccaggacgcc

SEQ ID NO: 6759986 - DNA, 56 bp, Homo sapiens
gagaaagctaaataagttgattactgtatctggtatggacttatggagtgtttctt

SEQ ID NO: 6759987 - DNA, 72 bp, Homo sapiens
agggatgcttcaaaataagcacttaactgtatcatcttgatgggaggttctttggtgcttgtagcaatttct

SEQ ID NO: 6759988 - DNA, 60 bp, Homo sapiens
ctgaagcacagatagttttgttaataacatgactgttatttgaaactttcttgtttccag

SEQ ID NO: 6759989 - DNA, 118 bp, Homo sapiens
ggggtgtgaagggtatgagggaagcactgggcagctcccttgaacttctcctggccggccagaggcaggtttgaatgcaggggattgcaagtggtcctagaaatcccattcattctcc

SEQ ID NO: 6759990 - DNA, 99 bp, Homo sapiens
gattctcctcccctagagctactgtccagttgctactggcctccagcaaaacaaacatcagtatggacggaaggagcaggacgcagggcggggagggtc

SEQ ID NO: 6759991 - DNA, 71 bp, Homo sapiens
ctcagcactcactataggacgctgctgcagggcccagcaagcagcccagttgtactgagtggttttgtgag

SEQ ID NO: 6759992 - DNA, 69 bp, Homo sapiens
gactctgcttgtgtcaggcatgctaatttctcactggccaaagcaagtcacatgaccaagcccagtgtc

SEQ ID NO: 6759993 - DNA, 73 bp, Homo sapiens
aataacttgaagatctcttccaaacctgaaattgtgtgtatcacagacattgatggaaggcatctgcattatt

SEQ ID NO: 6759994 - DNA, 63 bp, Homo sapiens
tttatgcctttacccattcaaaggttagaagagctttccagggcagatgggtaaaggcataaa

SEQ ID NO: 6759995 - DNA, 59 bp, Homo sapiens
gtttagctatgtacagaatgccttctggagactacagttgggatggttacgtagcaaac

SEQ ID NO: 6759996 - DNA, 63 bp, Homo sapiens
tcctaacttttggcgggaaatgattgaaattacttttaatctttctagattccagcggtggga

SEQ ID NO: 6759997 - DNA, 57 bp, Homo sapiens
tggcccatcagggagatacttcccaattaaggtcaatggtaagtcacttctgggcca

SEQ ID NO: 6759998 - DNA, 76 bp, Homo sapiens
tgcgtggtgtctttgtggaagcctgtggaagaaatttctgctcttagtagaaaatgggtttcttcaacctcatgca

SEQ ID NO: 6759999 - DNA, 89 bp, Homo sapiens
gtggaaaatgagccatgaaccaaccaatgtgagtaatgtttagtgttgttgttttgaagttgggtggttggttgatggttgtttattac

SEQ ID NO: 6760000 - DNA, 74 bp, Homo sapiens
ttcccatttagcaaatgtctgaaggaatagctcacagaattggcagtggagttcagaacattggtgtatgggaa

SEQ ID NO: 6760001 - DNA, 63 bp, Homo sapiens
agggatccacagaacaacctccccagctattgtctgggcccaggctgcctctgcaggatccct

SEQ ID NO: 6760002 - DNA, 62 bp, Homo sapiens
ttgtttaacgcagatgctgagtgagatttaaaaagaaattagaaaagcatttgtgttaacag

SEQ ID NO: 6760003 - DNA, 70 bp, Homo sapiens
atagaagattgggaatgacacacagcttatataattgtgtgtactgctgtaaatattcttcatcatttat

SEQ ID NO: 6760004 - DNA, 63 bp, Homo sapiens
tggagccaagcaatatacccaacccatgtattgtgaaccatggggaaaggtagcatggctgca

SEQ ID NO: 6760005 - DNA, 117 bp, Homo sapiens
ccacgctgcaggagctatgaggcgtacaggagcatggggaagggatatcaacacacataaacaaagtagttccatccttgccttatgtctgtcttttttatacctccgtagatgtgg

SEQ ID NO: 6760006 - DNA, 67 bp, Homo sapiens
gagacaagcacttcactgtcctctgcgttttacagaagaaagtagggcacagagatgtgctgtactc

SEQ ID NO: 6760007 - DNA, 83 bp, Homo sapiens
ttgttcctgagcctgaagttacttccattgttgctactgttgtagataatgagaatacagtaactatttcaactgaggaacaa

SEQ ID NO: 6760008 - DNA, 71 bp, Homo sapiens
ttcaaatcagcaatgacctaagcaaataacccccagtgcccgggatatttagctggagtcagtgctttgaa

SEQ ID NO: 6760009 - DNA, 64 bp, Homo sapiens
ggaggcattgcagggtttcaatacacaggacatgttctagttacagaagccttgctctgctgtc

SEQ ID NO: 6760010 - DNA, 94 bp, Homo sapiens
ggccttcctggaggttggctgccactgtcataccctggcaatggcattcataccattggcaggcaatggcatgtcatacagcttcatgagggtt

SEQ ID NO: 6760011 - DNA, 68 bp, Homo sapiens
tggctatatatgatttgttgcatttaggtcacttatgaaaattccaatgtcagttcatgtataggcca

SEQ ID NO: 6760012 - DNA, 69 bp, Homo sapiens
catgttgaacttacaaattaaaagacttatttaaatttgagtggctttttcattgtaggtaaaaatatg

SEQ ID NO: 6760013 - DNA, 56 bp, Homo sapiens
ttgataaacttgtggagttttggtctcctagtaggcactctataaatgtttgttga

SEQ ID NO: 6760014 - DNA, 72 bp, Homo sapiens
atgtccctttaagagttaaactttgacctgagtttaaagggctggaggggtcaggaatgactgggaggacat

SEQ ID NO: 6760015 - DNA, 70 bp, Homo sapiens
tgtgagttcttagaaagtcagttggacccttctaattgcctgggtattagggattttgctgaaacccaca

SEQ ID NO: 6760016 - DNA, 64 bp, Homo sapiens
ctggagccccagacagggagagactcagagggccctcaccctgacacctggggtgtatgtccag

SEQ ID NO: 6760017 - DNA, 58 bp, Homo sapiens
tgggcatgagtggacagagaaggctattgtgtcatttttggaaactgcactgctacca

SEQ ID NO: 6760018 - DNA, 74 bp, Homo sapiens
tgttatatttgtgtggtgatatagctatagtttaattacttcctatgtaccggatgccatacaaacaggtgata

SEQ ID NO: 6760019 - DNA, 57 bp, Homo sapiens
tttactgtgcccctggggatctctgtaatgccagagagaaagggataacacgttgaa

SEQ ID NO: 6760020 - DNA, 55 bp, Homo sapiens
gtgtccatgttgttcagggtgagtccatgtgtctctccttgaatcttcatgacac

SEQ ID NO: 6760021 - DNA, 59 bp, Homo sapiens
cgctgcgaggcgcccttgttgctgcccatctgcaggctgacattgagcgtgtcgcagtg

SEQ ID NO: 6760022 - DNA, 69 bp, Homo sapiens
ccaattctggtatagtataaattaatgttcaaatatatgatttacattgaagggctatccaatagttgg

SEQ ID NO: 6760023 - DNA, 57 bp, Homo sapiens
gcttctgcagagccgtcctgaggctctgacatctatgagtcggcggccagcagaggc

SEQ ID NO: 6760024 - DNA, 68 bp, Homo sapiens
tgccttttctgtagctctggaattcccatctgtatacatggaacctcttgagtgtgcagcgtaaggca

SEQ ID NO: 6760025 - DNA, 65 bp, Homo sapiens
tcagaatgcatgaaaagacatcctgcagtataggagatttgtaggtcagtttgttcatgttttga

SEQ ID NO: 6760026 - DNA, 75 bp, Homo sapiens
ccttttaggttaatgggcttcttttggtccatgactaacacaatgaagaaagagttagctcaataacttgaaagg

SEQ ID NO: 6760027 - DNA, 76 bp, Homo sapiens
agccagtcttcggctgttatgcagtgtaattttatgggaatagttttataatgttaacatctgtagactgagagct

SEQ ID NO: 6760028 - DNA, 72 bp, Homo sapiens
ggccccgtcgtggggccagggatgacccacgcagcaggtggtggggcggatccgggggcctcgggcggggcc

SEQ ID NO: 6760029 - DNA, 61 bp, Homo sapiens
agtggactaaagccaggcagcaggagtcagaagggacaggaggctgacctgttagtccact

SEQ ID NO: 6760030 - DNA, 58 bp, Homo sapiens
gtggcagcaggtactcacgcacgtccagctctggggtgcaggtgccatcgctgctcat

SEQ ID NO: 6760031 - DNA, 60 bp, Homo sapiens
ggtggtgggtaaaagcccgggtctgtctggctccagagtccaggctgttgctcatcttcc

SEQ ID NO: 6760032 - DNA, 67 bp, Homo sapiens
attctaatgacatttagaagttagattcaaccggattggtggagtgataaactaagtggattagagt

SEQ ID NO: 6760033 - DNA, 124 bp, Homo sapiens
tgctgtctttgcctgaagccaaggagttggaatttgtatacatgttacatttgaataggaagatttatgtttggaatgcatacaaattctgattcacgttgaaacagtagtagacacaacagca

SEQ ID NO: 6760034 - DNA, 65 bp, Homo sapiens
agctctgggggaaagtctgctccaagttgtttcatactgttggcagaatttagttccttgagact

SEQ ID NO: 6760035 - DNA, 70 bp, Homo sapiens
gccccagagtcaaggtggcatttagctgggccttcagtccggcaccagcaagtgctctttaacttggggt

SEQ ID NO: 6760036 - DNA, 88 bp, Homo sapiens
aaatatgagacatacctcttaattgtactccttcagcaagttgactatgtatttgttgtctcttcagttaagagaaggtcttattttt

SEQ ID NO: 6760037 - DNA, 73 bp, Homo sapiens
gccccaacactgggctgccctgatggtcctcacaacggtgctgtcgagaccatgggggtaacttgggttgtgc

SEQ ID NO: 6760038 - DNA, 83 bp, Homo sapiens
tatcagagttcaagtgtagttttgcaattcagttgaaatttgtacccttaaatttcctgatttgtaaaattcccttggtgata

SEQ ID NO: 6760039 - DNA, 61 bp, Homo sapiens
gcagccttgatcctttccttttctgattcagaaattacctgtgggtgaggaagagcgttgc

SEQ ID NO: 6760040 - DNA, 95 bp, Homo sapiens
gtgactcttgagagatgaattcaagatactcacaatgttctttaaagagaggtggtcaaggtgtgaataccttgaattcatcactcaagagtcac

SEQ ID NO: 6760041 - DNA, 72 bp, Homo sapiens
ttttactaggactgtcagcctgagttgtcataactgcattataatctcttttaggacagagcctaagtagaa

SEQ ID NO: 6760042 - DNA, 116 bp, Homo sapiens
gggctaaaatcaaggtgttgtcagggctgtgtgtctttctggaggctccaaaggagaatcccttttcttactatttccttcttccagaggctgcccagatcccttggttcatatcc

SEQ ID NO: 6760043 - DNA, 75 bp, Homo sapiens
tgtgtctcaagcctgctgagttttggactggtacttataccatcagctctcctggctctcaggcttttggactca

SEQ ID NO: 6760044 - DNA, 129 bp, Homo sapiens
gcaggctttccttaatatatatcacagacagctttctgagttatggtcacagcacaatcagctatcaaattgaaactgtttccctccataacctcagccttgaagttttttcttgatatgaacctttgt

SEQ ID NO: 6760045 - DNA, 61 bp, Homo sapiens
ttctatttgcttgaagcctggttctattttgtagataggaaggcattcacggcaaactgaa

SEQ ID NO: 6760046 - DNA, 77 bp, Homo sapiens
tggatattgatctgacctcttgtttttatttctaagtttgtttggcactgaaaaaggagaggtttgttatcaatcca

SEQ ID NO: 6760047 - DNA, 127 bp, Homo sapiens
tggtagttctcaacagcaccgaagatgctccattgacctgattgttcctggaattcattataaaagaaagataaggataattttcctgggattattgtcaagcatctgattgtgtaagcaactacca

SEQ ID NO: 6760048 - DNA, 67 bp, Homo sapiens
taaatggatggaataatgaccacagaaacactctgacagtgctgaggaataattgttcctgcattta

SEQ ID NO: 6760049 - DNA, 58 bp, Homo sapiens
tcactttcagccattaatactttagcttaggtcagttaatcagatgagttgaaagaga

SEQ ID NO: 6760050 - DNA, 69 bp, Homo sapiens
gtggggatcactggggacaatcttagaggctgactaccacaacccaccctctcattcccagtgactcac

SEQ ID NO: 6760051 - DNA, 78 bp, Homo sapiens
atgtgagccaagcccgtccatcacaggcacagtggtgtgagtgaggcccaatggctggatggagggatgagcccacgt

SEQ ID NO: 6760052 - DNA, 78 bp, Homo sapiens
gatcctgagctggccctcgagagccaattgtacacatgttcccagttccctgtcaagggatccagtgacatcaggttc

SEQ ID NO: 6760053 - DNA, 65 bp, Homo sapiens
tacagattcctgggctcctcctggcgattttaattcagtaggcttaagaggatcagaaatctgta

SEQ ID NO: 6760054 - DNA, 65 bp, Homo sapiens
ggctacttgctgggtgtaattttctttgagctattttataaagatgattaatgacagcatgtgcc

SEQ ID NO: 6760055 - DNA, 60 bp, Homo sapiens
ctgactgggccctatggaagaaaggggtcaagccccttataagttctgaggacccaacag

SEQ ID NO: 6760056 - DNA, 129 bp, Homo sapiens
tatttgtcatttggatggctagtattgtgactcaagtattctagacaagctgtgattaaatatttcaacagaagacctcaaagaattactgatttataattacccacgttacctatgctacaataatta

SEQ ID NO: 6760057 - DNA, 66 bp, Homo sapiens
gctgcattgtaggcatttccttagtgtagttaagtgaaatgcactgaggaacatatataagatggc

SEQ ID NO: 6760058 - DNA, 56 bp, Homo sapiens
acatacagttttccctagatgtgctatgttggaagtagcccagggaggctgtgtgt

SEQ ID NO: 6760059 - DNA, 56 bp, Homo sapiens
ttcctataagtcacactgttgtggaaaattacataacataaaagggcttgtgagaa

SEQ ID NO: 6760060 - DNA, 78 bp, Homo sapiens
ggtttggcatgccttattccaacaatctagcactctcaagagaatgtattttgtattagggatgaaaaatgtgaagcc

SEQ ID NO: 6760061 - DNA, 75 bp, Homo sapiens
ctggagcctgggaagttcaagatcaaggcactgacggaattggtgtctggggatggtctactttctggttcatag

SEQ ID NO: 6760062 - DNA, 79 bp, Homo sapiens
tactttgaatacagtatcttctggcaagcataggggactgcagtcgacaatgctgctgaatatacctgagtacatagta

SEQ ID NO: 6760063 - DNA, 85 bp, Homo sapiens
tcctcctgcaggcttacaacttgtatgtgattgttgggacaaccaaaagatgacacaatcttgctgttgaagccatgtgctggga

SEQ ID NO: 6760064 - DNA, 58 bp, Homo sapiens
tgacaacatcatttttgtgtggagctccttattgcaaatagtcaaatgatgttggtca

SEQ ID NO: 6760065 - DNA, 64 bp, Homo sapiens
cgtgtcttcggcctttccctcgctgtaatttgaatatttaggctgtaggttggtgctggacacg

SEQ ID NO: 6760066 - DNA, 58 bp, Homo sapiens
gcaccttggctttcttggtggctttggtacacccagtgtcccaaggatgcctgggtgt

SEQ ID NO: 6760067 - DNA, 81 bp, Homo sapiens
attagttagatgcactatgcaatatctatttgatggaattccttcagccattgaaagcgatactgtagaggcatagctagt

SEQ ID NO: 6760068 - DNA, 78 bp, Homo sapiens
ggccttatttcacctgtgtctcctctgtgttctcaaatttctctgcttgtaaggacaccagtcataggatttagggcc

SEQ ID NO: 6760069 - DNA, 57 bp, Homo sapiens
gacgagggtgagaaaaggagtagagctgaatgttatgttattctgttaacctttgtc

SEQ ID NO: 6760070 - DNA, 110 bp, Homo sapiens
gaaagccaagggtttgattaaggtttgggccagaggcatggagctattttggcaggtaggagaagcatgtttccatgtatctggtcttcaccgaagagcctcactttttc

SEQ ID NO: 6760071 - DNA, 58 bp, Homo sapiens
tcagtgagctgaagtcctttgaagaggcttctttcctcaaaggactgtagctcactga

SEQ ID NO: 6760072 - DNA, 66 bp, Homo sapiens
tgtgagtctaggtcagggtgtttcaacatgcaaaagcagaccctgagcccttgtctgtggctcacg

SEQ ID NO: 6760073 - DNA, 57 bp, Homo sapiens
gtgtgtatttgtattatgaacctacatacgtgtgtgtacatatacacaaatacagat

SEQ ID NO: 6760074 - DNA, 111 bp, Homo sapiens
gtttccctggaggaagctggtctgatccacctctttcacacctctggacacttctgtttggagccccgtgggaaggagcagtggggagtccatggggccaattggggaagc

SEQ ID NO: 6760075 - DNA, 105 bp, Homo sapiens
ctgcctaaagcctcacatattactatttgctctctcaggctcctgggaggccagggcttctctgagctttctgggaggtagctgagtaacactggggcttggcag

SEQ ID NO: 6760076 - DNA, 67 bp, Homo sapiens
tgtaccagatggaaaacgtgagcactttaaatggaaagtgagttatttggtctttctattttgtata

SEQ ID NO: 6760077 - DNA, 127 bp, Homo sapiens
tcttacatcaaaatagaaagccctggcaaacagtacctttagccactgaagcagaggccagaacaaaatttctttcagtttaagtgtgttgaaggtaataaagactgtggttttagttgaaggaaga

SEQ ID NO: 6760078 - DNA, 70 bp, Homo sapiens
ttggggatgactacttatgggaagtatctacttatgggaagtatgactacttgtgagagattatctctaa

SEQ ID NO: 6760079 - DNA, 69 bp, Homo sapiens
ttccagggcagctgtatctgagcttatttgccccaagtacagactcagaagcaagtaatgccacaggaa

SEQ ID NO: 6760080 - DNA, 68 bp, Homo sapiens
gggagggatgggggtcgttggcagcagcgcacgtgaagtcactgccactgcctggcctttctctgccc

SEQ ID NO: 6760081 - DNA, 62 bp, Homo sapiens
cttgcctggaccatatggtggcctgagttgacttgtaggcagactcaatggctagatacaag

SEQ ID NO: 6760082 - DNA, 120 bp, Homo sapiens
tcatctgcaaataaggataattctgtctttacattttcattattcgtatgtcctaactaggacttccaagagaacatgacgtaatagtggtggtaatagacattcttcatgctgccttga

SEQ ID NO: 6760083 - DNA, 64 bp, Homo sapiens
tctcctcatcactacagggcgggtctgagatggcactcaacatgcatttgtgggatggaataga

SEQ ID NO: 6760084 - DNA, 64 bp, Homo sapiens
accatgtgaattccattgccaaagttttgtgctcccataaaaaaaggagatgcaatttaatggt

SEQ ID NO: 6760085 - DNA, 65 bp, Homo sapiens
gtggcaaaatctagccatgtgaaggattggagtttcttttgattatctaggctagattttgtcat

SEQ ID NO: 6760086 - DNA, 68 bp, Homo sapiens
gcgtgcccaccctcctggtccctgagcgctgtccgggcagctctgggtgacaggagggcctggcacgt

SEQ ID NO: 6760087 - DNA, 69 bp, Homo sapiens
gccccagtgcaaagaaatcagctttgttccttcactggaaaagatgcacgtttctctgactactgtagc

SEQ ID NO: 6760088 - DNA, 91 bp, Homo sapiens
gctgaggctagaagggctcataggtgaggtacaatcagctagtcccaagactccagttaccttggctgagggcccagggcttgcttcatgc

SEQ ID NO: 6760089 - DNA, 67 bp, Homo sapiens
cattgtcaaatccttgtcatctgcctcagtgtctggcatgtagtagatgatcaagggttgatttttg

SEQ ID NO: 6760090 - DNA, 117 bp, Homo sapiens
gtgactgagtgaatgcaaaactctgttgtgtatggcttcaaatcttcttggccttatatcttatttcagccattgctgttatgcataattccatggaggctttgtgcagcttggcac

SEQ ID NO: 6760091 - DNA, 85 bp, Homo sapiens
ttcacttcttaatagaaatttaacttttgatttactccccatataccttggagttcaaaaaggtaaagtttatcaggtgagtgga

SEQ ID NO: 6760092 - DNA, 71 bp, Homo sapiens
ctgagcacagctttcactagaaaggagcaagctaatcaatgatggcaagcctttcagtggtttgtgcctag

SEQ ID NO: 6760093 - DNA, 67 bp, Homo sapiens
gtttcacacatcctgcacatagctgaaaaaattagcagctatgtaacccatggggatgtattgaaac

SEQ ID NO: 6760094 - DNA, 57 bp, Homo sapiens
taagtgaatccttgagaagaaagcaaaggttaccttctttgttcttgtgggtactta

SEQ ID NO: 6760095 - DNA, 108 bp, Homo sapiens
ttggtcaggggtttatccagacacagcagatctggctacaggttaaaggtacaaggcaatctagagtgctaggtctgtgtaaaagtgactgatgaaaattctgaccaa

SEQ ID NO: 6760096 - DNA, 114 bp, Homo sapiens
ggagcccttcctttgtgccaggctggaagctgtgtgcagatgatctcatctcatctttagtaccctcttgcgaggtaaggttactgtcacacagtggttaagcacaagggctct

SEQ ID NO: 6760097 - DNA, 71 bp, Homo sapiens
ccagcaaagtctttctcatagtcacgctcacctgtgcatatgggagtatggttgaagatagatttttctgg

SEQ ID NO: 6760098 - DNA, 58 bp, Homo sapiens
aagggtgttgggcagcattcctggcttctagccactagacgccagtcacaccaccctt

SEQ ID NO: 6760099 - DNA, 57 bp, Homo sapiens
attgttggatggttgtcttccaaagtggctgtaccattttacatccccaccagcaat

SEQ ID NO: 6760100 - DNA, 88 bp, Homo sapiens
ggagtttcactctgtcacccaggctggagtgcagtggcacgatcttggctcactgcaacctccaccttccgggttcaaatgattctcc

SEQ ID NO: 6760101 - DNA, 92 bp, Homo sapiens
gtttctgtatcttgtgtgggcaatttggtcatttgtattgcaaaaatgcaatgctaaattgacaaattcaccatcataaggtaatttttaac

SEQ ID NO: 6760102 - DNA, 105 bp, Homo sapiens
ctgtgacactccatgtgttccttgtatgtactttgtgggcagatgggcttcatatgtatttcaggaagtaagtgagccctcagagtatggcagtgggtggggcag

SEQ ID NO: 6760103 - DNA, 74 bp, Homo sapiens
tcacacagattggtagagctgagatctgatatggcccacctgagtccaaagctcacgctcttttaactatgtga

SEQ ID NO: 6760104 - DNA, 68 bp, Homo sapiens
tgggttcctaactgccctgggcaaggttctaccaatagacactcatgtttccaggcagtggctaccca

SEQ ID NO: 6760105 - DNA, 83 bp, Homo sapiens
ctggccctccccactgggcctcctctttccttacctcactgagagggagccggagggccactggcaggatgatggggggccag

SEQ ID NO: 6760106 - DNA, 69 bp, Homo sapiens
ccctcgggaagtttgtttggactgggatgactgaactaggtcttttttctgagtcctaaacccccaggg

SEQ ID NO: 6760107 - DNA, 62 bp, Homo sapiens
tccttttaaaatgaacctgcagaagtgcagagtggcagtttctgcaaatcatttttatggga

SEQ ID NO: 6760108 - DNA, 55 bp, Homo sapiens
agggcagtgtggtgggactgactcaacagacatagtttcatctccaccctgccct

SEQ ID NO: 6760109 - DNA, 61 bp, Homo sapiens
atgcactgtaggtgccatctgcaccatatattataatacagagtttagcaccatcgtgcat

SEQ ID NO: 6760110 - DNA, 62 bp, Homo sapiens
gctcctgaacttgtgatccgcccaccttggcttcccaaagtgctgggattacaggtgtgagc

SEQ ID NO: 6760111 - DNA, 62 bp, Homo sapiens
ctggagaagaggtagtatgtagtttgcttttgatttcaaaatgccacctcttctgattccag

SEQ ID NO: 6760112 - DNA, 60 bp, Homo sapiens
gtgccaccatagcttctggattgtatttataatccactctaagatctgtggtgctagcac

SEQ ID NO: 6760113 - DNA, 68 bp, Homo sapiens
ttagtacgggctttctgggcctcctgggtcccttacccaagccctgacctgagagtccgtgaaactga

SEQ ID NO: 6760114 - DNA, 72 bp, Homo sapiens
aaggcttttgtagtgacaggaactgaatctctggagacaggcttagtactgtttagctaaccactaggcttt

SEQ ID NO: 6760115 - DNA, 71 bp, Homo sapiens
ctctgtcacctaggctggagtgcagtgacgcaatctctgctcactgcaacctccaccagcctgggctcaag

SEQ ID NO: 6760116 - DNA, 60 bp, Homo sapiens
agtgctcttccctgatagcatctgttggcctgctgagtcacactgcaggtgaagtgcact

SEQ ID NO: 6760117 - DNA, 77 bp, Homo sapiens
gtcatgttatgcttctctttgaaaatatccagcagcaatttattgcttaaaggatagtttaaactccataacatggc

SEQ ID NO: 6760118 - DNA, 71 bp, Homo sapiens
ggcaccagaagttattgcctgtgatgaaaacccagatgccacatatgatttcaaggtatggcttctttgtc

SEQ ID NO: 6760119 - DNA, 73 bp, Homo sapiens
aggaaaggctcactttagatcatgcattccactgctgtgcatggattaatatggctttgaaagggcttttctt

SEQ ID NO: 6760120 - DNA, 66 bp, Homo sapiens
gggcatgggtggccacgggggcatggactggctgacccctgtgcattgaccacactctccatcccc

SEQ ID NO: 6760121 - DNA, 75 bp, Homo sapiens
aactttgttttattcactgctgtgttgggaatgcctagaatcataactggcacatggtactgagtcattagagtt

SEQ ID NO: 6760122 - DNA, 84 bp, Homo sapiens
gaaacgggtataggcattttgattagagtggataagtgtaattattattcaactgtaatattttaagatgtctgtgattatttc

SEQ ID NO: 6760123 - DNA, 83 bp, Homo sapiens
gagatttccttaatttaagcctagaatgcagctttgagttacaagctgcattctaggcttaaatttactttgaaggagtaatc

SEQ ID NO: 6760124 - DNA, 65 bp, Homo sapiens
aaaatctagaggttgacagtgactgtgatgctagtcatcacaggctcagcaatgtctgtgatttt

SEQ ID NO: 6760125 - DNA, 68 bp, Homo sapiens
ttttttgttattgttatgattcgcctggagcagtgaaatgttttctccagctaagcaataatagaaga

SEQ ID NO: 6760126 - DNA, 75 bp, Homo sapiens
ctgcctcggcctcccaaagtgctgagattacaggtatgagccaccatgcctggcctcttcagcacttctgagcag

SEQ ID NO: 6760127 - DNA, 81 bp, Homo sapiens
gcagcatgggtgtgggcaggagcacaagtcaggctcatgtttggtctcctgacgccttctccttgcccactctgaggttgt

SEQ ID NO: 6760128 - DNA, 64 bp, Homo sapiens
tcccaagccataatggctcaacctagtggtttggaagaatccaagccagtcattatgagcggga

SEQ ID NO: 6760129 - DNA, 79 bp, Homo sapiens
ggaagggatgttctgtggtggtcaggaattctggacaacaccttcccagattcaggactggccacagcccctcttttct

SEQ ID NO: 6760130 - DNA, 79 bp, Homo sapiens
aaagagccaaaactgtgtccttagctctcactaggtaaagcaaataggggaggaaagagggctcagtgatttccttttt

SEQ ID NO: 6760131 - DNA, 55 bp, Homo sapiens
agtgccaaggaagtgttgtttgtaattacctacatgataatatttactaggtact

SEQ ID NO: 6760132 - DNA, 66 bp, Homo sapiens
tagaaacagagagatatgcccctcccttcttttgtttgggagtccaaatgtcactcatgttccctg

SEQ ID NO: 6760133 - DNA, 55 bp, Homo sapiens
ctgatatgacaaagtgccttgccaccaatacccagccaggcactgtcccatgcag

SEQ ID NO: 6760134 - DNA, 70 bp, Homo sapiens
gcccctttctctcctgctagagaataacagcacctgctttgagtgggtgtggtcctctagtgaaagaggt

SEQ ID NO: 6760135 - DNA, 55 bp, Homo sapiens
gctgaggccccagggtgatgggagagctcagacttccttcagctggcacctctgc

SEQ ID NO: 6760136 - DNA, 122 bp, Homo sapiens
aacggtaagtcacagataggttccgaattctgtgttcctggtgagccattttttcctgtcgtggaattcgatttgagccagagtggctgccaggaacgagaggtttttattgaccacaagtt

SEQ ID NO: 6760137 - DNA, 76 bp, Homo sapiens
tcgcgaatgaacttccagagcttggtgacccacaggttggcgccgaggtccatcaggtactggatctcgggcgtga

SEQ ID NO: 6760138 - DNA, 63 bp, Homo sapiens
cccagctctttgtcattttaggtgtctgacatctgtcagggatgtgacattacagaagcaggg

SEQ ID NO: 6760139 - DNA, 59 bp, Homo sapiens
gtcacagagttattaattgtgttagtcttcttaatgcaccaatgtttgactttgttgac

SEQ ID NO: 6760140 - DNA, 110 bp, Homo sapiens
agagtggtctagtggggaaggcaccagcttaggagcctggagagctgaactctagcttgggttctgtcagaagctagctcctgggaaatgtacttcacccctgagcacct

SEQ ID NO: 6760141 - DNA, 120 bp, Homo sapiens
gctggctagaggggcccagtggcaggtggtggtgggtggcggggtggttaaccctttcacttccctctaggcgttgaggtccagtctccacccactactgccccagggcctgtcttcagc

SEQ ID NO: 6760142 - DNA, 83 bp, Homo sapiens
tataccccataagtagtgctgagctccagcttagctgagccaagctcagtccttatctggtgttcagccagtgcacaggtata

SEQ ID NO: 6760143 - DNA, 55 bp, Homo sapiens
gagcaccgcctccacgatgcccgccgtgaagctggcgcagttgagcgtgctgttc

SEQ ID NO: 6760144 - DNA, 67 bp, Homo sapiens
gatgatgatctgagagcttgttacataatgctttcaatcctgtgaggcaagtactatcatcattatc

SEQ ID NO: 6760145 - DNA, 56 bp, Homo sapiens
cccacatcccttccccgctgtgccctttgtcacagtgacactcaggtgggatgggg

SEQ ID NO: 6760146 - DNA, 69 bp, Homo sapiens
tcccccaattctgcaggtggaggatggcaggagactagactaccatcctccacctgcagaactggggga

SEQ ID NO: 6760147 - DNA, 76 bp, Homo sapiens
ggaaggtggggatggaatgggaagcagagccatgagtgagcagaggctctaatcccctccacaagctccattttcc

SEQ ID NO: 6760148 - DNA, 56 bp, Homo sapiens
gcggcggcccattgtctggcgtgataggtttgcagatttgacagctgggcgcacgc

SEQ ID NO: 6760149 - DNA, 90 bp, Homo sapiens
ccagaagtggggacctgaatgaaatcaaggactgagtatggtaactacagccatttaattttatttgaagtctcccgtaaaatgttctgg

SEQ ID NO: 6760150 - DNA, 85 bp, Homo sapiens
tgcagggaagctggggatggccttgaactcatcacgtggtctcaagaaactcacctgtctcttctgggtctcagtttccccagca

SEQ ID NO: 6760151 - DNA, 69 bp, Homo sapiens
tttgtcagtggtgagtaacgtcagtttttcttctacacggactagcttttgttaacttactgagacaaa

SEQ ID NO: 6760152 - DNA, 74 bp, Homo sapiens
ctattgctcagagatgtttgggctgtacaatttctgtagatatggcatctggagcagccttttctaagcaatgg

SEQ ID NO: 6760153 - DNA, 55 bp, Homo sapiens
gatgcagtaaagcttggagatctggcattgagcttttctcacaagactgctgctc

SEQ ID NO: 6760154 - DNA, 73 bp, Homo sapiens
acctctttttgtctcacccctttgaggaactttgttatctatacgtttgagttctaaggtgagtagagagggt

SEQ ID NO: 6760155 - DNA, 65 bp, Homo sapiens
gttcagtaggatccacagcctcttggaagacagcaacccaggaagcatgttggatccacttgggc

SEQ ID NO: 6760156 - DNA, 78 bp, Homo sapiens
gtctccaggcttccacaggcatcactttgtgtctctgatatgactcagggctgaagttatggctgagcttttaatgat

SEQ ID NO: 6760157 - DNA, 76 bp, Homo sapiens
agtacaagtctggggatggtgctgcacttgagttacctttaaatgagaggcacagtttcatccccgggcttatact

SEQ ID NO: 6760158 - DNA, 76 bp, Homo sapiens
ttgtttttgtgccaagactatattgtgctttgtcctttgtgaaacatggagcccaatataatcttagcaatagcaa

SEQ ID NO: 6760159 - DNA, 84 bp, Homo sapiens
gggcctcaaggaacagttaatcctaaaggcggtacccaatcttctaatttcctgctcctgagggataaactgcctttctggccc

SEQ ID NO: 6760160 - DNA, 83 bp, Homo sapiens
agttgattattaagttggtgcaaaggtaattgcagtttttgccactgaaagtaatgcacttgtaccaacctaatagttcatct

SEQ ID NO: 6760161 - DNA, 76 bp, Homo sapiens
tggtatcatcaccttgttctctaagaaaagaagcatgatatcagctttgttgggggagggaggatgggggatatta

SEQ ID NO: 6760162 - DNA, 66 bp, Homo sapiens
tctctgccctcagggtaatgatcacatatgcaatgtgagataacaaaattatcttcagggcaatga

SEQ ID NO: 6760163 - DNA, 90 bp, Homo sapiens
ccttgttgaatgtatccccttcttttgcagagggattaatgtacataaacatgcagcttccgtaagagagggagatgacaatcatgtggg

SEQ ID NO: 6760164 - DNA, 87 bp, Homo sapiens
aagggttactgtcaattagtgggggtgtgaattggcatggtgcttttggaaagcaatttgacagtacatatcaaccagcaaatcctt

SEQ ID NO: 6760165 - DNA, 58 bp, Homo sapiens
aggagcagaactgattctgacttaattgaatttaaaagcaggtattacatctgcacct

SEQ ID NO: 6760166 - DNA, 74 bp, Homo sapiens
gtagcttttcttagcacagattctgggaacatgactttgacgatgatgacagtggtctgggctaaatgaggtac

SEQ ID NO: 6760167 - DNA, 83 bp, Homo sapiens
ttcatgtttgcactgaaatcaagctagaagtcatttgtatgtatttctgcaaactgcattctatagcttgatgcatttgtgag

SEQ ID NO: 6760168 - DNA, 68 bp, Homo sapiens
ggcaccatgcacagagcttggtcattgctgcatttcgcaccaactaaggcaactctggccttgctgtc

SEQ ID NO: 6760169 - DNA, 56 bp, Homo sapiens
agatgacatgatggacactcagtgaatacagctattattgttgttcatttgtctct

SEQ ID NO: 6760170 - DNA, 92 bp, Homo sapiens
aaagggaagttcttattttctgtaactatttctatagctgctgcttttctgctgttgtgattatttatagacagtcaaaagagtctctcttt

SEQ ID NO: 6760171 - DNA, 73 bp, Homo sapiens
gctgcttcctgtgaagaatagcactcaattaataatagttgcattgcttggtcttcaagatcagtaaagcagt

SEQ ID NO: 6760172 - DNA, 69 bp, Homo sapiens
aggttcttttttaaaggcagtgattgaaaggcccagatacctatcagacatatttttaacaaagttcct

SEQ ID NO: 6760173 - DNA, 65 bp, Homo sapiens
gcttgaggtttgcagggtaattaaaggcacagtaggcaggtgtcattaacttgttaacctaaagt

SEQ ID NO: 6760174 - DNA, 58 bp, Homo sapiens
tttgaagccttgtagatttacgtagtaaagaaacctgtgtaaatctgtattcttcaaa

SEQ ID NO: 6760175 - DNA, 72 bp, Homo sapiens
ggcaacttggaaaggagattctattgtgtgtggtccctgaagtgggtaagcctacaagaatccccagttgtc

SEQ ID NO: 6760176 - DNA, 72 bp, Homo sapiens
cctagaaagggggaactgcctccagttttgtgaacctgctgccacaagagcatggagttcccctaaagtggg

SEQ ID NO: 6760177 - DNA, 59 bp, Homo sapiens
ctacaagctatatacctcaagcaaggttcttctacatgtattgaaggtgtagtttgtag

SEQ ID NO: 6760178 - DNA, 58 bp, Homo sapiens
cgggggccggccacaggctgctgatccatgcggcccttgtctgtgtggctggctcctg

SEQ ID NO: 6760179 - DNA, 62 bp, Homo sapiens
gaacacctaccccctctgcagcactacatttcaccaaactccagagggtttctcaggtgttt

SEQ ID NO: 6760180 - DNA, 58 bp, Homo sapiens
tttgacctttgccagggataaccagatattctcttatttctgaatccaaaaggtcaga

SEQ ID NO: 6760181 - DNA, 66 bp, Homo sapiens
tctggacagggacacagccagtgaggtggatgacctggagcctgacagcgtgtccctggccctgga

SEQ ID NO: 6760182 - DNA, 57 bp, Homo sapiens
gtctataagtacaattgcactcaggaatcaatgcctggtgctttgagctcatcagat

SEQ ID NO: 6760183 - DNA, 95 bp, Homo sapiens
gtgcggcggcagggcaaggttggcctgggccgcccagaggtcttcagacccaggggcgaagctggccacgacccagccccgcggtgaagccgcgc

SEQ ID NO: 6760184 - DNA, 62 bp, Homo sapiens
actatttgagaaactggaggtatatcagtgaataaaattgatataactcttgttcttatagt

SEQ ID NO: 6760185 - DNA, 92 bp, Homo sapiens
tccaggccgcagtctggctaaactggattaccaggctggtgggcagctcctcaccatgatcctgcaccagttagagcctgctgtagttggga

SEQ ID NO: 6760186 - DNA, 71 bp, Homo sapiens
ctctgtggcagctgtgggacactggtctaaggactacaccctgatgcctggtgagttacagaggccatgag

SEQ ID NO: 6760187 - DNA, 56 bp, Homo sapiens
ctggctctgagtggctctaattcaggttctctgatttttagcctctctgagctgag

SEQ ID NO: 6760188 - DNA, 70 bp, Homo sapiens
aggtctttttccacctggggctctgttgttctaaatcccagacgtctagtctcaagctggagaattacct

SEQ ID NO: 6760189 - DNA, 130 bp, Homo sapiens
ttttagaaatgtaggcagactttttgcacactgggacctgtttgtgtccattagtgactagaaggatcacaaggatagaatggttctggttgtgaaatcatacctctcagcctttcatgcaagaaggaaa

SEQ ID NO: 6760190 - DNA, 55 bp, Homo sapiens
ctagttctagatccctgaggaatcgccacactgacttccacagtggttgaactag

SEQ ID NO: 6760191 - DNA, 68 bp, Homo sapiens
tggggtaagagatgggtgcagcatggtgggaacagagactgttggccactgaactgacccatatccca

SEQ ID NO: 6760192 - DNA, 58 bp, Homo sapiens
catatattttgaatagcctctgtgattttttgggggtgacaggggcagcacaataatg

SEQ ID NO: 6760193 - DNA, 74 bp, Homo sapiens
gtcctttggagaagaatgcatccttaatagatgttcaagacatatttgaagattgctttttttaaaaaagtggc

SEQ ID NO: 6760194 - DNA, 63 bp, Homo sapiens
tcatgtccttggaacacctgaggtgggttatgcccattttctggtgatttcgagagggaatgg

SEQ ID NO: 6760195 - DNA, 77 bp, Homo sapiens
cggttttcacacatgtttacagtcttcagtctctaaattttcatttacactaaggccttggtaggcagtgtgaactg

SEQ ID NO: 6760196 - DNA, 76 bp, Homo sapiens
ctgtgtttaatatcaaagtattcttgactgtttttcaccccttcttgagggacaatctgaacttgtatggacatag

SEQ ID NO: 6760197 - DNA, 65 bp, Homo sapiens
gatgctaagtgcttcaagtttttgcatttcctttggtagcctggacttcatgcattaacagcatc

SEQ ID NO: 6760198 - DNA, 63 bp, Homo sapiens
ggcttcagataatgtactagtgagaagaaatgcattttcaatggtcataaggatttggaagct

SEQ ID NO: 6760199 - DNA, 58 bp, Homo sapiens
taggtcctcatggggcagagataggtgagaaagatggtctccacccacaaggaaccta

SEQ ID NO: 6760200 - DNA, 86 bp, Homo sapiens
tctaataaaggcaaaattcaaggacataatagcatctctaggctcatttttggaatagctgtctttgattttggttgattgttaga

SEQ ID NO: 6760201 - DNA, 56 bp, Homo sapiens
actctggctttattttcatcatcttcattttataggtgaagaaattaaagctaagt

SEQ ID NO: 6760202 - DNA, 71 bp, Homo sapiens
caccactgcccacgatgccggccgcctgcctgcctgaagacctttgcacaggctgttggccttcagaggtg

SEQ ID NO: 6760203 - DNA, 83 bp, Homo sapiens
gaatggtaagcataatagctaacacagagtgcttattatgtgtgagatggtattctaatagctttacatgtgttaaatcattt

SEQ ID NO: 6760204 - DNA, 78 bp, Homo sapiens
ggaaggggaaggggccgggtggtggcgggtctgcgccagcgctctgcggcagcagcctccactcgccccaccctggcc

SEQ ID NO: 6760205 - DNA, 72 bp, Homo sapiens
gtctaagggaagagaactggtcctagcctaggggacttggactgaggtgagaggtccagttctgtcttggac

SEQ ID NO: 6760206 - DNA, 80 bp, Homo sapiens
gtgcttgcctctggttggttgatttgtcctgctttaatacatgatccagacaagaaagaatcaagccaaagccacagcat

SEQ ID NO: 6760207 - DNA, 72 bp, Homo sapiens
tctagaatgtttcaatttgacccaaatctttcttttactagctaagtaaaataagagaagggtcgttctaga

SEQ ID NO: 6760208 - DNA, 59 bp, Homo sapiens
cgcaggctcggttcacagagcagattccatggtggcctcctttgcatacctagcctgtg

SEQ ID NO: 6760209 - DNA, 55 bp, Homo sapiens
gctaataattcctttgtgaactatgaaagaaatctatcactgaggctttgttggc

SEQ ID NO: 6760210 - DNA, 61 bp, Homo sapiens
ccacagcctgcctatctacaaagtgggatcaaataggacctatctcataggacagttgtgg

SEQ ID NO: 6760211 - DNA, 60 bp, Homo sapiens
gccaggcaggccacgctgtgttgacgctgcactcagcacgtgggtgttggctctgccggt

SEQ ID NO: 6760212 - DNA, 70 bp, Homo sapiens
tctttccttgtaggctctgtcacctatgagctgacacagtcaccctcagcgtcagtggccccaggacaga

SEQ ID NO: 6760213 - DNA, 63 bp, Homo sapiens
gttgctaggcttggttccagagagtgaaaattttcccatgatctttgtcattaaactagtaac

SEQ ID NO: 6760214 - DNA, 65 bp, Homo sapiens
atgtggtacagtgtgactttggagtgaagccaaaggttctcaccccagctacactttacaatcat

SEQ ID NO: 6760215 - DNA, 74 bp, Homo sapiens
gcagtcagacctcccagcttcagatctcagcggggccatctgctagctttataatgctgggcggtttactctgc

SEQ ID NO: 6760216 - DNA, 104 bp, Homo sapiens
gtcttactttcccaaacttttacttgtgtataggtgtgtgtgtgtgcatgcatgcacacatgtgtgcattcacatgcatgcctctgacatataaaggtgaagac

SEQ ID NO: 6760217 - DNA, 86 bp, Homo sapiens
acttagaccccctgagaggcagtaattgtgggcaatagctggacttttgtattgtaattgctgctattagtcttaaaagtctaggt

SEQ ID NO: 6760218 - DNA, 60 bp, Homo sapiens
tatgtaagtgagatcatggagtatttgtttttccgtgcctgacttatttcacttagcata

SEQ ID NO: 6760219 - DNA, 71 bp, Homo sapiens
gtgttttcatctctgttgttaatgtactttgccaaatgtgctgagtgcagatgaacagaagattaaagcac

SEQ ID NO: 6760220 - DNA, 57 bp, Homo sapiens
ggaggccgggaggtggctggtggagtggggaagtaaatcagtggcctggaggtctct

SEQ ID NO: 6760221 - DNA, 56 bp, Homo sapiens
ctttcaaagagtaggaggttttttggtctcagaagttctcactagtgctttgagag

SEQ ID NO: 6760222 - DNA, 103 bp, Homo sapiens
ggggaccacagggaggaatggaagctaagttggcttgagacaccatcaggtagggacctccctctctgtgccaggcccagctgacttctagtcctccctcccc

SEQ ID NO: 6760223 - DNA, 74 bp, Homo sapiens
gagccgcccgcgccagcctctccatctcgcaagttttaattaacgctgagggagaggcggctgacgggcgggtc

SEQ ID NO: 6760224 - DNA, 55 bp, Homo sapiens
tactgtctatacacttgattacaaggttgtaaagcaagtgtggatgtggaaggta

SEQ ID NO: 6760225 - DNA, 55 bp, Homo sapiens
gcaatgtgcccgtctctctgcagccagtcaagtgcaaagaaatctgggtcattgt

SEQ ID NO: 6760226 - DNA, 76 bp, Homo sapiens
gtgggcactctgcctagcgccatctgcctctcccaccccaggcaggtgtcaggtggctgctgcgccctgtgtccgc

SEQ ID NO: 6760227 - DNA, 89 bp, Homo sapiens
ggcggtggcagcggtggcggcggtggctgcggcctcgtgttgtctacccatccggcctttgcgtccacgccgcttccggggccgccgcc

SEQ ID NO: 6760228 - DNA, 56 bp, Homo sapiens
agaggggctcatatcctgtcattgtacttaatgctaataaggatgttggcccctct

SEQ ID NO: 6760229 - DNA, 82 bp, Homo sapiens
tgaatccaatctacaaacctgtgagccttagctctctgtcatccactacaggctgctgctctacagttgctattttgtttca

SEQ ID NO: 6760230 - DNA, 65 bp, Homo sapiens
gggaagaagacatggtgaaggcagggcagacctcttctgtgctaggcttcatggtgcttattccc

SEQ ID NO: 6760231 - DNA, 60 bp, Homo sapiens
tttctttcaatgcttgtaagggaattcttacaagctttcccttacaagcattgaaagaaa

SEQ ID NO: 6760232 - DNA, 59 bp, Homo sapiens
cactgctagtgtgttcctgataaaatggtacacattgttcattgtacacctagtatgtg

SEQ ID NO: 6760233 - DNA, 57 bp, Homo sapiens
gcttcactacttgaaatactaatattgaagtttgttcagtacttcagtagatggagc

SEQ ID NO: 6760234 - DNA, 65 bp, Homo sapiens
tttgtctgtaattattaaagaaaggaatagcagcttatgaaatctttttttaatagtcagatgag

SEQ ID NO: 6760235 - DNA, 82 bp, Homo sapiens
ccccgaggtgcacaggctctggggcaggatggctgaagcacaaatctcagctctgtcaacagctagctgtgtgatcttgggg

SEQ ID NO: 6760236 - DNA, 70 bp, Homo sapiens
acttatgttaggcttgaatcaatgattaaatatttatttgagggtcaatgttcaagtatgacaatgtagt

SEQ ID NO: 6760237 - DNA, 81 bp, Homo sapiens
tttgggaagacttattattgtgacctgagaatgtaatttgaatatgtgggacagggacagtgatatttctatagtcccaga

SEQ ID NO: 6760238 - DNA, 121 bp, Homo sapiens
gcaaatagatggctgatgtttttgagagagtataaaaacagaggagagaacaacgtaatagatgtctatcctaaaggctgcttttatattcattacaataaacaattctggctttctctgc

SEQ ID NO: 6760239 - DNA, 81 bp, Homo sapiens
tcctgtaccccagtccagtgtgttctggcagcagggacacctgggccaaggggccatctggaccaaaggtggggtgtgggg

SEQ ID NO: 6760240 - DNA, 82 bp, Homo sapiens
tgttcctccaggaggtagtgcttaatttcccccaccttaagtgtggattgaactgagtgacttccttctaaagaagagaata

SEQ ID NO: 6760241 - DNA, 87 bp, Homo sapiens
atttcctgattatcagcttgttatgttttatcaactttgttagttgaatcctggctaaagtttgttatatgataaggaacaggaaat

SEQ ID NO: 6760242 - DNA, 58 bp, Homo sapiens
aggttcccaggatctgtctgggctggggcagcctggagaggacagattgtggggttct

SEQ ID NO: 6760243 - DNA, 108 bp, Homo sapiens
accttcccatggattaagacattttagagatagggaaagtcactgaggcccgttacaactgtgaattttcttatgatgctgaaatgaattttaatctggccaaaaggt

SEQ ID NO: 6760244 - DNA, 96 bp, Homo sapiens
gccgtcctcccctactctggacagggacacagccagtgaggtggatgacctggagcctgacagcgtgtccctggccctggaaatggggggctcggc

SEQ ID NO: 6760245 - DNA, 66 bp, Homo sapiens
ttgaaacaattaccttaactcttaacccttctttgggccaactgagttgctggtaaatgttatcaa

SEQ ID NO: 6760246 - DNA, 56 bp, Homo sapiens
tcaccatcctcacctagaaatgaccaactctgtggtcaccctaggaggtctggtga

SEQ ID NO: 6760247 - DNA, 78 bp, Homo sapiens
cattgcacagcttcccagacaattatatggacgcactgtgactaagatctggccaaatgaaatctgagcaatgcaatg

SEQ ID NO: 6760248 - DNA, 63 bp, Homo sapiens
tttgcatataagccgtgcttctgaactactttcctttgtgagcagcagcaaggcttaagtaaa

SEQ ID NO: 6760249 - DNA, 57 bp, Homo sapiens
cagcaactggtcattgctctcctgaaggcacagccatatgggtaatggccactgctg

SEQ ID NO: 6760250 - DNA, 69 bp, Homo sapiens
gcagtttgaggctttttcctacatcttcagtgtttctgaggtgaaggagttttaaagtgcttgaattgc

SEQ ID NO: 6760251 - DNA, 75 bp, Homo sapiens
gcatcatagcagcgagacttcatctctacgaaaaatttaaaaattagcccaggaggtcaaggctgcagtgattgc

SEQ ID NO: 6760252 - DNA, 127 bp, Homo sapiens
acccaattcaccgggaaacctccaggttaagctctggtccataaggagatctcccagaatgccaaagggtgatgatcatctctttgtggccaggagaggaaaatggcccttccccactgccttgggt

SEQ ID NO: 6760253 - DNA, 96 bp, Homo sapiens
ccaaacttcacagtagcaatgttgaacactgcgtgatgctcagtaaccattttaaagtcataacacagtagtttgtcattgctaaaccttttatgg

SEQ ID NO: 6760254 - DNA, 66 bp, Homo sapiens
taggttggtgcaaaagtaatagtgattattattatttaaagatgcaactacttctgcaccaatcta

SEQ ID NO: 6760255 - DNA, 86 bp, Homo sapiens
ggcgctggacccggcccctcacctccgcggaccccgaggaacaagccggcaggtgagggagccgcggtctcctcgacgatcacgcc

SEQ ID NO: 6760256 - DNA, 74 bp, Homo sapiens
ttatatgttgaagccctaatacacagtacctcaggatgtgactgtatttgaagttagggccttacaatatgtaa

SEQ ID NO: 6760257 - DNA, 56 bp, Homo sapiens
ctgctttaacaaggctgatcagggaaactcatcctgatcaggcgacctttgagcag

SEQ ID NO: 6760258 - DNA, 67 bp, Homo sapiens
agcatctatatatacgtgtccagtagaagatatatcttctgcatcctatgatcgcatatgtagagct

SEQ ID NO: 6760259 - DNA, 104 bp, Homo sapiens
gtctggtccccacacccctgtgggtggattgctcttgcttagggaggcatttctcttgcattctctctaaagggtagagacaccctggggaatgtgttccagac

SEQ ID NO: 6760260 - DNA, 67 bp, Homo sapiens
gaattgttgaggagactcttcaatgtggaaatcaaaaccagcaattgagggtaaatttcaataattt

SEQ ID NO: 6760261 - DNA, 55 bp, Homo sapiens
tataattagtaaatggcagatttgggacttaaaccatgccatttgactgaatgta

SEQ ID NO: 6760262 - DNA, 78 bp, Homo sapiens
cgttcagctcaagcaataattttcaaatctctatccaattcttttgcatgtcagaaattattgctagagactgcaatg

SEQ ID NO: 6760263 - DNA, 81 bp, Homo sapiens
gcctcatttatctcagtggtagtataaatgggaaatacatggagacccattgtattgtatatggtgctccgagggtgaggc

SEQ ID NO: 6760264 - DNA, 57 bp, Homo sapiens
ccaaccccatgctccatgtcccctccatcttctctggggctggaagtgtgggtttgg

SEQ ID NO: 6760265 - DNA, 67 bp, Homo sapiens
gagggagggaacgagagaaagaagcaaacattttaaattttgttctgtgaatcttttttcccacttt

SEQ ID NO: 6760266 - DNA, 74 bp, Homo sapiens
aaaaccctgaatgtgatgcttttgtttgagaaagttgcattcccaaacaacgatgtacacatttatgaggtttt

SEQ ID NO: 6760267 - DNA, 56 bp, Homo sapiens
gcagaaaggagaccagctctgccccgcatggggtaaaaagcagtgtcttttcttgt

SEQ ID NO: 6760268 - DNA, 70 bp, Homo sapiens
gcagttcctgaggccagctgcagagctctaacctggagaaggggcagagccacggcaggcctaggaaagc

SEQ ID NO: 6760269 - DNA, 91 bp, Homo sapiens
gagctgacaataatatggttgtttgaagaaatattgcctctgtgacaatgatagaggacacatctttcctcaaatgagtttctgtcacttc

SEQ ID NO: 6760270 - DNA, 55 bp, Homo sapiens
acaaaaatgcttggtagctctttctttcagtgtagaggtagctttgcatttttgt

SEQ ID NO: 6760271 - DNA, 56 bp, Homo sapiens
agcagctgatggggaaggagttgctattagcttaacctttcgggactggagctgct

SEQ ID NO: 6760272 - DNA, 70 bp, Homo sapiens
tcatctattggtgtgttttgttaggcagttgaattcaaacctgaagagaaacagaatatgctggttgtgg

SEQ ID NO: 6760273 - DNA, 74 bp, Homo sapiens
gctaggttttccaatttggtagtcatcggactcatgtagctagtggctaccatattggacatcagagctctagc

SEQ ID NO: 6760274 - DNA, 96 bp, Homo sapiens
ttgaaagcattgaaagctgggagcaagtactcatctttgggaatttcatccttgcaggattggggacttagagttgccagatgttcttattttcaa

SEQ ID NO: 6760275 - DNA, 128 bp, Homo sapiens
cttccgtgtgtcgccgccgttgccgcctcagcttcagcctcgttactcctgcggttctgtgactgtgctgctggcgttaacggcgcgaggtgaagggaggtgacggagtgtgcccgcgcgcgcggggg

SEQ ID NO: 6760276 - DNA, 63 bp, Homo sapiens
cacagggaacaactagaacaaaggccttgagatgtggcagtttgtggcaaattgtttattgtg

SEQ ID NO: 6760277 - DNA, 56 bp, Homo sapiens
gcgaaaggggtatatacatgtaggccagcatacatgcataaactacttcttattgc

SEQ ID NO: 6760278 - DNA, 115 bp, Homo sapiens
cttctactagatgggtcagatccgttctctgacttgatgcaatggccactgtcccttcagtctggcccctcagcatctgagtcagtgggaatgtgatgggccccatatgtagaag

SEQ ID NO: 6760279 - DNA, 66 bp, Homo sapiens
gctaaagagtttacaaattaggtaattttctctaaagtgaatttgcctcagctgttgaccttgagc

SEQ ID NO: 6760280 - DNA, 56 bp, Homo sapiens
ctgtgtagcctcatgtgggctttaataaattttggttaaataaatgaggttgacag

SEQ ID NO: 6760281 - DNA, 129 bp, Homo sapiens
tggctttgggtcctggctgtatcccttaccagctgtgcctaggagcagggctcgtggtggcctcttggtgcatggttaggactttagtagggctcttagtgcatggttaggacctccacccagaagcca

SEQ ID NO: 6760282 - DNA, 84 bp, Homo sapiens
cttgggcataaactttctcttcttgtaaggactggtgatagcttattagggctggatgcaaggaaagagacagaaaggctagag

SEQ ID NO: 6760283 - DNA, 58 bp, Homo sapiens
acccattcctttacttcatctggcatggatttaaccaatgaataaaagggttgtgggt

SEQ ID NO: 6760284 - DNA, 89 bp, Homo sapiens
gagtgtcctgctgtgggcctgatgctgccatgagtccctgctgcgcacccgctctgcctggccagccctcgggccacaccgtgaccctc

SEQ ID NO: 6760285 - DNA, 55 bp, Homo sapiens
gatggcagatggctggagcaggtctcccggagatgagtgacatcattatgctatc

SEQ ID NO: 6760286 - DNA, 102 bp, Homo sapiens
ggtgtggtggcagacagctgtaatctcagctgctcgggaggctgaggcacaagaatcgcttgagccagggaggtggaggttgcagtgagctgagatcacatc

SEQ ID NO: 6760287 - DNA, 61 bp, Homo sapiens
aaggtgacattcacagtttccgatggttaggacatggccatctctttttggaggtcagctt

SEQ ID NO: 6760288 - DNA, 88 bp, Homo sapiens
agagtctcacatgctttctccaatctgtagctgtttgttcacctggaataccccacatgtttgttggagacagcactgttggatctct

SEQ ID NO: 6760289 - DNA, 101 bp, Homo sapiens
tattttaatataccacctattttatattgaactttctttgtatagattctgagttggagaattgcaaacagaaagtttattgtggaatgttctttgagata

SEQ ID NO: 6760290 - DNA, 87 bp, Homo sapiens
tctctggctttcgagataaatttttgataaatatgttagccagtttccctcatgttttaaggaaatgtatcatgaaagatgcggaga

SEQ ID NO: 6760291 - DNA, 61 bp, Homo sapiens
caggtgacatcaacaggaccaccgtcagcatgcccatgcccccgcctgtggatgacacctg

SEQ ID NO: 6760292 - DNA, 87 bp, Homo sapiens
aaatgggatggcatttattacccagaaagttctgaaaaaacttatcaggagatacttgttttctagggtgctaaatgaaccctattt

SEQ ID NO: 6760293 - DNA, 129 bp, Homo sapiens
ctcgcccaggggtagcagtgcctaggccacctgcagcattgacatcagcaaactgccagggaggagagtggaggctgcagaacagtcaggtgcaggcaggggcccagggaggaggcgagacctgagcag

SEQ ID NO: 6760294 - DNA, 58 bp, Homo sapiens
tgagtagggaggaaagtgtgagccttgtgtcttggttttctctgttccccactactca

SEQ ID NO: 6760295 - DNA, 122 bp, Homo sapiens
tatcatctgcattagctgtgttgtctaaaatttctacagtacacatgcattattttcacaatcagaaagaaataatatggactctagatgatttttgtggggcagtgggagaggtagaggta

SEQ ID NO: 6760296 - DNA, 74 bp, Homo sapiens
gcctgcctttctgtgaccagagtggcctttcttggctcaggaactgagtgccctctggcacagagatgcagagc

SEQ ID NO: 6760297 - DNA, 70 bp, Homo sapiens
tgtctaaccatattcatgtacagccaatagttgttgagtgcttactgtgtgctggacatgatgttagaca

SEQ ID NO: 6760298 - DNA, 96 bp, Homo sapiens
ggaatcatggttctgcatatcagaagaggaaaatgaagcacttaagcttagctctgggctgcttcagccttcgccgtgctatgcgagcccctctcc

SEQ ID NO: 6760299 - DNA, 58 bp, Homo sapiens
tctgggatgagatcagagacacggagtccacctgtgcctgctgcctttcatcccaaga

SEQ ID NO: 6760300 - DNA, 57 bp, Homo sapiens
gtgggacaggtcaaatcttaaagctccaaaatgatcttctttgactccatgtctcac

SEQ ID NO: 6760301 - DNA, 81 bp, Homo sapiens
gaccattctgcctgtcagcacagccccagcaccagcatgaagccgggcaaagggtaatgtgcactgaagggtggaaaggtt

SEQ ID NO: 6760302 - DNA, 73 bp, Homo sapiens
ttatttgcattctgctcatcctgacatctcttcctcccactcttgatgtttggcagttttagagtgcaagtga

SEQ ID NO: 6760303 - DNA, 58 bp, Homo sapiens
agttcatggaccagttgtgttctattaatttccagaggacatcctggtgactagaact

SEQ ID NO: 6760304 - DNA, 82 bp, Homo sapiens
gaaggacttgattggaagaaggcagagaggcatttaaggaaggcatttagataccctgacttctccaggtcttaactccttc

SEQ ID NO: 6760305 - DNA, 64 bp, Homo sapiens
agcatttgccaacagaaggtgtactactgaatgctaatatcggtgagagcctgtctgtgatgct

SEQ ID NO: 6760306 - DNA, 72 bp, Homo sapiens
gaagcctactagatatttaatgtaatcaccatgataatggctaagatttattaagcatctgctatgtgcttt

SEQ ID NO: 6760307 - DNA, 71 bp, Homo sapiens
gggcagagggccaactagcaccactttgtacccacaagagggtatatggtagtgccagttggccttctccc

SEQ ID NO: 6760308 - DNA, 60 bp, Homo sapiens
ttgctcatgtgtgattacagtttttggtgttcacagaggatgaaagtcatttatgggcag

SEQ ID NO: 6760309 - DNA, 56 bp, Homo sapiens
ttttcttggtttatttttctctattttcttctgtggtagggagaattccaagagga

SEQ ID NO: 6760310 - DNA, 78 bp, Homo sapiens
gcctaaaccttttcagctgaatggagcttttcttctcagtggaattgagttccgcattcagtatcaaaaggtgccagt

SEQ ID NO: 6760311 - DNA, 60 bp, Homo sapiens
tcggtgatggtctgggtacttgctcctcatacaggagatatcctcagggcatcagtctgg

SEQ ID NO: 6760312 - DNA, 57 bp, Homo sapiens
gcatgtcatgtcatgtaggaatggcatacacagaaccactcctacgtgaaggactgc

SEQ ID NO: 6760313 - DNA, 61 bp, Homo sapiens
agagcctgaggccaggaaaatggcatgtgaaagcccttcttctgcagctgcctctggctct

SEQ ID NO: 6760314 - DNA, 63 bp, Homo sapiens
aggacagagtggggtctcagtaggaagtggccatcagaaggctctatgcaagaccctagtcct

SEQ ID NO: 6760315 - DNA, 119 bp, Homo sapiens
taggtcttacttcaattgaatgttcctagtgcaactggagggcttctgcaggttacaggagactgacaatctggacccagtcttcatccaggtgcctaatagtcaatgctcatttcctg

SEQ ID NO: 6760316 - DNA, 71 bp, Homo sapiens
gccacacaaaagtaggaggcaggcggatttggcccactggccatagttgattgattcctcctgctttaggc

SEQ ID NO: 6760317 - DNA, 129 bp, Homo sapiens
tccatccccattccgctgtgtgaccttggacaagtctctctccctctctgagcctcaacggcctcagctgtgaaacggagtcagggaaggtctgctgagagttcgcacagaccgaggtttggggaagga

SEQ ID NO: 6760318 - DNA, 60 bp, Homo sapiens
tgtttgtgtttctcctcctctgaagctggattccaagctcacagggagaaacgaccaaca

SEQ ID NO: 6760319 - DNA, 75 bp, Homo sapiens
actttgccatgttgtatgactagttattattgggtttacatataatttttgattatgcagtcataccatgaaggt

SEQ ID NO: 6760320 - DNA, 66 bp, Homo sapiens
ttagtatctagctggaaccaggtgcacgaagagtccaggatcaccttaatccactctggagactga

SEQ ID NO: 6760321 - DNA, 64 bp, Homo sapiens
gtaatttcccagcagatgagctgacctaggggatgcttctagtacctctcagctgggatcctgc

SEQ ID NO: 6760322 - DNA, 69 bp, Homo sapiens
gaggtaggatttaggacttgggagtgaagattgaacatgtgtgttgacttccagttataggaactcttc

SEQ ID NO: 6760323 - DNA, 65 bp, Homo sapiens
ctgttgcagaggctggctcgccgggttccagctccgctgcctgcggctcggcagtctctgcgcag

SEQ ID NO: 6760324 - DNA, 70 bp, Homo sapiens
tctttttttctctaatgcctttcttttgcccaaatcttaaatcattttggaggcagttagaaggagatga

SEQ ID NO: 6760325 - DNA, 93 bp, Homo sapiens
caatatgaagaaaaagtcaagaatctcagcatctttggctctgacatcatagatggaaaaggcttggttctttgatgacatttttgagtattg

SEQ ID NO: 6760326 - DNA, 56 bp, Homo sapiens
gcaataagttttctcttctgtcaagatagtgctaatggaagggaagtcttggttgt

SEQ ID NO: 6760327 - DNA, 116 bp, Homo sapiens
tgtcaagataaacgctattaaggttgggacaaaagcaattgcgggttttgccattactttcaatggcaaaaaccacaattatttttgcaccaacctaataacatcttcaatcgaca

SEQ ID NO: 6760328 - DNA, 125 bp, Homo sapiens
agctaccttggcaatgcaggatgtcacattttcacggtattcacgaacatggaatgggagcctccaatttctgtaatcaagatatttgagagttgatgtgcccaaggtcctctctttaatcagct

SEQ ID NO: 6760329 - DNA, 60 bp, Homo sapiens
tcccagaatggcccagctgcccagttctagcccttcccttccaggctggcccttttgggg

SEQ ID NO: 6760330 - DNA, 62 bp, Homo sapiens
aggaacacccccttcctaccagcatctcccctcaggctgataggtgggagaggtggtgccct

SEQ ID NO: 6760331 - DNA, 60 bp, Homo sapiens
cagctgttactgaagtaaaatgccactgtttgggtgaagaagtgttgctgggtgacactg

SEQ ID NO: 6760332 - DNA, 91 bp, Homo sapiens
ccacagatgtgtgattaagtacacataaactttgagtttgtcttctgaggctcacagcattgagtgtactagatcctacacttctcaatgg

SEQ ID NO: 6760333 - DNA, 56 bp, Homo sapiens
atgcaggagccctcttgagggccattatgactggccactcttggggtttcctggat

SEQ ID NO: 6760334 - DNA, 62 bp, Homo sapiens
attcaaagattttcccaaagctcacctaaatctttaggaagggctctgactgaatattgaat

SEQ ID NO: 6760335 - DNA, 56 bp, Homo sapiens
aatttaatcaagttctgctctggtcctttgtggccaggcaatcaatgggttaagtt

SEQ ID NO: 6760336 - DNA, 130 bp, Homo sapiens
ggtctcatgtccttatggcatatggccagtgaagccaagggctgcttttcctaattccagtatgaacaataccagataaggacaattagtctggcttggctcaaatgtccatcccttaggcaagtgctcc

SEQ ID NO: 6760337 - DNA, 83 bp, Homo sapiens
gaactctctataattgccaaccttcagtaaaggtctgtttacaacatgcaacagctttagtgtgggtggtgcttcgaaggttc

SEQ ID NO: 6760338 - DNA, 91 bp, Homo sapiens
tatgggtcaacaagaacagaatcacacctgatttctttcctgtcatcacaggcagatgaacctgggttgagatgccagcttgatgacctta

SEQ ID NO: 6760339 - DNA, 55 bp, Homo sapiens
ggtgtctgtggggactctgtagtatgaatttctacttcagggctttggggacacc

SEQ ID NO: 6760340 - DNA, 78 bp, Homo sapiens
ggagggttcgtgcagcagctgttgactggtacatgaagcattcttttatgtttgttgaagctgatgattgacatctcc

SEQ ID NO: 6760341 - DNA, 57 bp, Homo sapiens
tgcgatgaggccaggaccctcctaaaccctaacagcatcctaacgaggcccattgca

SEQ ID NO: 6760342 - DNA, 63 bp, Homo sapiens
acactggagcttctagcccacggatttttttgtgatatggctaaagaaagtttcttccagtgt

SEQ ID NO: 6760343 - DNA, 75 bp, Homo sapiens
tccttctcagccccagctcccgctcacccctgccacgtcaaaggaggcagaaggggagttgggagcagagagggg

SEQ ID NO: 6760344 - DNA, 130 bp, Homo sapiens
cagcagtggtggttgtaaaacgctatgaagtagatggctttgaggaatttgaatctgggaatgccagaagaattccaagccaccttatctagacttttatttttttcaaactccaaaccattgccccctg

SEQ ID NO: 6760345 - DNA, 75 bp, Homo sapiens
atgacaggtcagtatctactatcttgatgaggtaatacagcactcacaaactgagaaaggtcttgatttgtacat

SEQ ID NO: 6760346 - DNA, 68 bp, Homo sapiens
tcatgcagttactgttatgcaaaccctctgccaggtgagctgtgagtgcatctgcatactgcacatga

SEQ ID NO: 6760347 - DNA, 55 bp, Homo sapiens
gaggagctgggtcagggagacaaaagtcttctattagtcttatggatagctcctc

SEQ ID NO: 6760348 - DNA, 72 bp, Homo sapiens
gcacatgaagttgcttagcattgtactgtacttaacaagtactcaggaaatgctgagtattactgtatgtgt

SEQ ID NO: 6760349 - DNA, 82 bp, Homo sapiens
tggcttttccgggaaagagaccgaccagctaggatcttgcttgcttggacctgcctggacagctcttaccttgggggcgcca

SEQ ID NO: 6760350 - DNA, 71 bp, Homo sapiens
gagtcagaaactcactctatagctacataatttttactctttttccatgtaggaacagtgattttggactc

SEQ ID NO: 6760351 - DNA, 83 bp, Homo sapiens
ctgtgtggggacagcgagggcagacttgagtggataggcaccctcccgccacgtccacccaggctgcccaggtcttcccaggg

SEQ ID NO: 6760352 - DNA, 88 bp, Homo sapiens
ggtcagagacctagcaggtgatcgcgtgtgctcccctccaggatcccagggcagcgaagcttgtgatcagttgctgcctcttcttgcc

SEQ ID NO: 6760353 - DNA, 85 bp, Homo sapiens
tgcattcctttccagccctttcttcctgtgtgtgagtctccagggcctggctgctgcacacacggagataggctttggctgtgca

SEQ ID NO: 6760354 - DNA, 73 bp, Homo sapiens
catttctatatggtgatgaacttcaggcttcaggtttcttattgcttgagctctcctcatcaccctggcaatg

SEQ ID NO: 6760355 - DNA, 62 bp, Homo sapiens
ggtgaattgtaccccataggatcatcaataagccacttagatccacaatagggaaattcacc

SEQ ID NO: 6760356 - DNA, 73 bp, Homo sapiens
gatgtactctgtgactgatggaggcttttgagttaacactctgcaggaagctgacagggcacaggttacactc

SEQ ID NO: 6760357 - DNA, 59 bp, Homo sapiens
ggaggtaagaggccctgggccgaggtgcagtgaccctgcaggccagccctccaacctcc

SEQ ID NO: 6760358 - DNA, 88 bp, Homo sapiens
atggggcattacacagtggaagtccaggatcccctcattctgtttacttgaactgttggtttggattctactatgtcctcatccccat

SEQ ID NO: 6760359 - DNA, 55 bp, Homo sapiens
gagagaatgggacgggctcacaccaacttgtatagccccttccagttctcagatc

SEQ ID NO: 6760360 - DNA, 61 bp, Homo sapiens
cacttgtatacagtgtacacattgatgttcatcaatggataaacaaattgtggtataggtg

SEQ ID NO: 6760361 - DNA, 79 bp, Homo sapiens
tctgactgtttcgtttccatatttggtctttgggagcagaagttcttaatataaatcaatggaactaaaggaacacagg

SEQ ID NO: 6760362 - DNA, 63 bp, Homo sapiens
tggaagctgcctgccacgctagatagatcttttttctatcttggggtgtgtagcatgtatcta

SEQ ID NO: 6760363 - DNA, 71 bp, Homo sapiens
aggcattcaccatacataaattacattgttaggataaagtcatcaaactggtttcatgtgggctgaagcct

SEQ ID NO: 6760364 - DNA, 60 bp, Homo sapiens
gatcagggtgttctaatgatcttgacctagcatggtcaggttctggtgagggcccttttc

SEQ ID NO: 6760365 - DNA, 101 bp, Homo sapiens
ctctaccctgaaaaagcctccacaattgtaagtgtgcactaataatgaaaggtgcattgatgatgcacatttataattgtgggggctttgtcaaggtgaag

SEQ ID NO: 6760366 - DNA, 55 bp, Homo sapiens
catatgcaggctcaggtccggcccgacggggctccagaggccttacctgcatctg

SEQ ID NO: 6760367 - DNA, 105 bp, Homo sapiens
ccaaggttcctgtggcacagtgattaagagccagtcttagggagtctgaatgaaggacctggacttgaatcctgactttgccaccccctggcttagggacgttgg

SEQ ID NO: 6760368 - DNA, 65 bp, Homo sapiens
acttacctctgtagaatggcataatgcgtagaccataaaaatgctataataatacagaggtgagt

SEQ ID NO: 6760369 - DNA, 70 bp, Homo sapiens
gggtggcagatggattgggctgtgcaggggctgaaggactcacccgcaggcccagagtcgctggcctccc

SEQ ID NO: 6760370 - DNA, 67 bp, Homo sapiens
gctgattattacatgtctgtggaagcttctggagccagtggtggagaggcagatgtgaataatcagt

SEQ ID NO: 6760371 - DNA, 60 bp, Homo sapiens
gaattcaagtgcaatggtatatctggattttcctgccccagttatttttgccttgatttc

SEQ ID NO: 6760372 - DNA, 67 bp, Homo sapiens
ccgccttgattcctctctacctggttgttagactgctgggaaaatatggagagtgatttcagtgtgg

SEQ ID NO: 6760373 - DNA, 104 bp, Homo sapiens
ataactgcccagtaaatactcattttaccatcctcttttagaattgtgtaccgctaattccccaagagaaggatggatccaaaagagattgtgttggcatttat

SEQ ID NO: 6760374 - DNA, 83 bp, Homo sapiens
tttttgcccttcctaaaagtatggtcatgggcaactaattaccttattagaaatgctcaggtcaacttaagttggggtttaga

SEQ ID NO: 6760375 - DNA, 63 bp, Homo sapiens
tgtaggtctgcagaggagtcagctgagggatcttccacagaggaatgcatcagcagatttgca

SEQ ID NO: 6760376 - DNA, 58 bp, Homo sapiens
agaagccatgtttagtaggatgaaagtcatgacagcatctcctctaccatggatttct

SEQ ID NO: 6760377 - DNA, 83 bp, Homo sapiens
atccaaagatccggcggccaaggtcagccgctctcggagagccgagattcttggtgctggctgggctgctggagacagcgggt

SEQ ID NO: 6760378 - DNA, 64 bp, Homo sapiens
gttccgggagcgccaacccctccaggttaggaatctgagagtacgggctgcgcgcacctggggc

SEQ ID NO: 6760379 - DNA, 104 bp, Homo sapiens
aaaagttattgttgagactagttgcataaagccttcctcataaatgtttatattagatttcacatatgggtaagatcttttgtatttgtctcagtgtatctttt

SEQ ID NO: 6760380 - DNA, 64 bp, Homo sapiens
gccaaagttggttagggatctgctgatatcatctcagtgcctactttgatcaattagtcttggc

SEQ ID NO: 6760381 - DNA, 74 bp, Homo sapiens
tttgccactaaccttgctgattgtagcatgatgatacaatgtatctttcaggcttcagcaagtattgtggcaaa

SEQ ID NO: 6760382 - DNA, 67 bp, Homo sapiens
gacatcactgatacctttattttcatggatttgagtatgtgcatgagaatattgttttagtgaggtt

SEQ ID NO: 6760383 - DNA, 67 bp, Homo sapiens
ggcttaagaacagctgagaagtgatagctgcattcccatcttgattgcagcattattcacagtagcc

SEQ ID NO: 6760384 - DNA, 74 bp, Homo sapiens
gtaagcaatagaagcgctgccttaactaaatgtctctgggggtcattaggacagtgagcggtagtgattgctgc

SEQ ID NO: 6760385 - DNA, 97 bp, Homo sapiens
gtgaagcttctgctctgtattttcatctaagagtcttacatttaatccactttgagttaatttttgtatatgacgttaagtaagggttcagtttcat

SEQ ID NO: 6760386 - DNA, 77 bp, Homo sapiens
gttgctttgggtgttttagtctttatggtatgtatgtgtggtttatatatacaactagattaaaagattctcaagac

SEQ ID NO: 6760387 - DNA, 68 bp, Homo sapiens
gccaaatatgcaggagaccaattggatggtgtaatttgcaaacccattatttatttctgtcatatggc

SEQ ID NO: 6760388 - DNA, 106 bp, Homo sapiens
agagagaaggaaagagatcttttgggggcatagagctcattggtagcagagcagttattggtcttctgttccctatttcaggtctcttttcattatgccactcttt

SEQ ID NO: 6760389 - DNA, 77 bp, Homo sapiens
gacactgaagctcagagaaattataggaattgctcaaggtcacatgaaattccaatctttctctgagctccagggtc

SEQ ID NO: 6760390 - DNA, 111 bp, Homo sapiens
ccactcaccccatcccccagttcactttgcttgtgggatctccctgttgctcctgcccctgggtggagtggcgggccatcctacaagtacccagacacttgacatgagtgg

SEQ ID NO: 6760391 - DNA, 102 bp, Homo sapiens
ccaaagtgtctaaattctagcattgtgaaaatattccaaaaaacaggcagccatattattcctttgtctatattttggcaaatgtctagatggatactttgg

SEQ ID NO: 6760392 - DNA, 75 bp, Homo sapiens
ataactttactttgcaacttttactttcccgaaagtgcctggataagtaatgtgtaaagtgtaaggcaaagttgt

SEQ ID NO: 6760393 - DNA, 56 bp, Homo sapiens
catatgacagtgttcaaagttgtttcagtgacagctgaacaagatagtgtcatgtg

SEQ ID NO: 6760394 - DNA, 68 bp, Homo sapiens
gggtagcaagatgatgaattattcagcctgcaatttgttagcagtgagcaacttgccatctgtttccc

SEQ ID NO: 6760395 - DNA, 56 bp, Homo sapiens
tgtttcctgattgtttttgaagttcaggtagacctgcctcaagacatcatgaaata

SEQ ID NO: 6760396 - DNA, 98 bp, Homo sapiens
ggtgtcctggagcaaatgggcaataacagcagggttacaggcattgccttgtcctggggttgatgtctttgctgttatccactgagttcctagactct

SEQ ID NO: 6760397 - DNA, 57 bp, Homo sapiens
ttgatgtagaaccaagatcttttatttgattaaggatcttcttggggtctacatcaa

SEQ ID NO: 6760398 - DNA, 72 bp, Homo sapiens
caatcattcaagggagatatgatcgtggctgagaccaggttgagtcacagttctgctgtctgagagagattg

SEQ ID NO: 6760399 - DNA, 82 bp, Homo sapiens
tggtgagggctattctgtgcattgtaggatgttatgcagcatccctggcctctgcatcctggatgccagcagcacctcccca

SEQ ID NO: 6760400 - DNA, 98 bp, Homo sapiens
tggtctaaagatttgcaatggattgaagaaggtaaggttatttcctataactttcaagaacttctttaatgtacattttgcaaagcttacagagagta

SEQ ID NO: 6760401 - DNA, 77 bp, Homo sapiens
gtgtggtgaggcccagcattcagggcaggaagaatcgtacaagaggtgtctgtctttgtgctgggatctcattgcat

SEQ ID NO: 6760402 - DNA, 58 bp, Homo sapiens
cctggcacttaatgcatgtgctatgtctctctacagagcactgccccaaggtgttggg

SEQ ID NO: 6760403 - DNA, 79 bp, Homo sapiens
gttgcaatgcagggcctctggaacactgagggctgtcctgtgccacccccagccaccagtggcccctgtgcatggagac

SEQ ID NO: 6760404 - DNA, 58 bp, Homo sapiens
gtcaggtttgttgtctggatacctaacaaaatataggcctccactgatcagacttgac

SEQ ID NO: 6760405 - DNA, 92 bp, Homo sapiens
gaggtaatacatgaaagagaatgtatcaacaaattgtacagtcttttgagtgacaatatgtgctaggtatttgttccatgtaaaattacttc

SEQ ID NO: 6760406 - DNA, 82 bp, Homo sapiens
ttgcagagtttcattctggaattctcaagtcctggagtccactctaggactccatgaattctagaattccaggactttgcga

SEQ ID NO: 6760407 - DNA, 69 bp, Homo sapiens
tgcagcatggtggagctgctctttaaataccgaaatgcacatgcttaaagactagaagccgtggctgca

SEQ ID NO: 6760408 - DNA, 83 bp, Homo sapiens
cttcaaataaggtacagttttaagaataagcacaccaataaacgtttgttcttagtattgagactgccgacctggatgtgaag

SEQ ID NO: 6760409 - DNA, 90 bp, Homo sapiens
ctagctgcctttccattttataattagggtctgtcctttgacaagtctccaaatagacctgaaatatggacctggcttaaaggcaggtag

SEQ ID NO: 6760410 - DNA, 74 bp, Homo sapiens
tgaggttagtttataattcatttctgtctgttgtgcctaaaatcttggctattcagaatgatgacggctcctca

SEQ ID NO: 6760411 - DNA, 64 bp, Homo sapiens
gatcaaacctttcattaaagtctgtagttcttcatgggaactctaaggcctctgagagttgatt

SEQ ID NO: 6760412 - DNA, 58 bp, Homo sapiens
tagggtgactgctcctttcttgactttgtagtggaaaggtataaggaatgtcattctg

SEQ ID NO: 6760413 - DNA, 70 bp, Homo sapiens
gttttcatgttctgtggaaataaggtagatactgttatctcacctgtattaatacagaactctgtataac

SEQ ID NO: 6760414 - DNA, 76 bp, Homo sapiens
agatgcaacactctttccttgttattatttgtcctgatatgtaggcaattatcaaattaggcaagtttgttgttct

SEQ ID NO: 6760415 - DNA, 99 bp, Homo sapiens
ttcgtctgaagacattgttacctaactggtgagtaggatttatatgtgccttgttgcctgtatctttctcacttagtaaacttcattgtcttagctgag

SEQ ID NO: 6760416 - DNA, 129 bp, Homo sapiens
gcagatgatgctgttccccaaactcttcattttcttgtccaaagattgtgtggctaccatatgtgaatggtggccccctcaagtctttgaataaaatgatgttagtgtccctggatggatagtggctgc

SEQ ID NO: 6760417 - DNA, 71 bp, Homo sapiens
tgttggtgcagggagaatcagcccatggacacaacccactcctcctcctctggcttcactctgcaccacca

SEQ ID NO: 6760418 - DNA, 99 bp, Homo sapiens
gtatgccatcccttttgccagtgattaagatacccaggcttaaactaatcagcataaagccttttcctggtgataattacaggtttggagatggcatat

SEQ ID NO: 6760419 - DNA, 81 bp, Homo sapiens
caactttaccagtgtaccaccctaaagtaatggttttcaaatgcagtcctgaaaactgggttgtggtcagtggtggggttg

SEQ ID NO: 6760420 - DNA, 77 bp, Homo sapiens
agttcaaggatgtgtgtaagaatgtgtgtgtgtgtgtgtgcgtgtgtgtactctgtatataaataaacctatgggct

SEQ ID NO: 6760421 - DNA, 94 bp, Homo sapiens
tcttatgaagcaggtgcagaagtaacaattaaagaagctatgatttatgttacctaattattttttacttttgcttcttacctctatatggaga

SEQ ID NO: 6760422 - DNA, 71 bp, Homo sapiens
agctcttgttttatttgcctattactttgaaccatttctgtatcaaagtcatggctagtaatgaaagagct

SEQ ID NO: 6760423 - DNA, 79 bp, Homo sapiens
agtttagccggctaaaacaatacccatgtactggctcatggtcctgtagatcagaacagcagggtgtggctggttctct

SEQ ID NO: 6760424 - DNA, 67 bp, Homo sapiens
gctgtgatgtagtttcttttgttcagggatcagctgtggggattgcatgaagtgctacgtctacagc

SEQ ID NO: 6760425 - DNA, 101 bp, Homo sapiens
cctggaattaagctctgagtttctcagctccacttgcagctaggcttggttaaggctaagccaatgaagtgtgagtagaaatgctgtatggagcttctagg

SEQ ID NO: 6760426 - DNA, 63 bp, Homo sapiens
ttctctaaaattaagtgaggtaagctagaaaagtcaagccaattgttccttgattagagagaa

SEQ ID NO: 6760427 - DNA, 70 bp, Homo sapiens
aggtcctgtcaaagttgtcccccactggaactaaataactctacctccaacagctgttagatatgggctt

SEQ ID NO: 6760428 - DNA, 68 bp, Homo sapiens
gctcattaggcaagcagttctcaagtgttttactcctcggatatacccaacagctgccttgcttgagc

SEQ ID NO: 6760429 - DNA, 98 bp, Homo sapiens
tgttaatgttgtttgttttgctttgttgtttattctaatttcttcaaaagagggaatattaggtaagataaagcagaggatctggatgacaatggaca

SEQ ID NO: 6760430 - DNA, 62 bp, Homo sapiens
tagaattcaggcttatgctgaataattcttgggagaaattcagaaagatatgcctggttttg

SEQ ID NO: 6760431 - DNA, 78 bp, Homo sapiens
ggaaaggaagaagcattctttcattggttggtgtgtattgccttgtcaaccaataagaggatgccatttatccttttc

SEQ ID NO: 6760432 - DNA, 88 bp, Homo sapiens
ggcaggtcgctgcatctctgtgagcctcagtttcctcatctgtgatatggggtgagcagtaacagctcacagggttgtggcgacggtt

SEQ ID NO: 6760433 - DNA, 123 bp, Homo sapiens
ggaagggtgtggtggatggaggagaagaagggggaggaatatgagggttgggtatttaattctgtgctgctttaaatcaatgctttatttcctcccctttttttctttctttctttctttttc

SEQ ID NO: 6760434 - DNA, 78 bp, Homo sapiens
gcggtgactcggggctgtagcacagctgagcgcagggttctcctgctgggcgtcctcggcctcctccgggtccactgc

SEQ ID NO: 6760435 - DNA, 73 bp, Homo sapiens
ataattctcattctaaggaagagccagtaggtgaattgaatctcaccagctgccttttcttagtagggattgt

SEQ ID NO: 6760436 - DNA, 87 bp, Homo sapiens
gtatattgttgcctggactaaaatcttttcttactttattactaggtaagaaaagaagagtagttatcatttaggcagttaaggtgc

SEQ ID NO: 6760437 - DNA, 65 bp, Homo sapiens
tctgaggagtgaccctcttgcacctacattctagagcatttagatttgccagagatactcccaga

SEQ ID NO: 6760438 - DNA, 72 bp, Homo sapiens
ccataataatctcattgcaaatgtctgactgtgatgctccagagttcagctactgcaaatgtgtctttatgg

SEQ ID NO: 6760439 - DNA, 63 bp, Homo sapiens
ctgatgtcttatggtcttgggcttccctctgactttcaggggacagtgacaaatgagacacag

SEQ ID NO: 6760440 - DNA, 61 bp, Homo sapiens
gcctctggggcaaagctcctgcagccgtggagtcgcaggctgctagcaatgctcaggcggc

SEQ ID NO: 6760441 - DNA, 69 bp, Homo sapiens
ttggacaggaaggtacaccaaagttcaagttttgaagagcaaagccattgaatttagtgccttttctaa

SEQ ID NO: 6760442 - DNA, 122 bp, Homo sapiens
ggtcagaaaggcatattatctgcatattagcagcctattcttctcttggagaatatctaagtacgcaaggagatccaagagaagatgggttatcaggatgtgaagagtagttacctgtggcc

SEQ ID NO: 6760443 - DNA, 71 bp, Homo sapiens
gggatgtccaggaggctttgggatccaagtcttggagtttagaagacggatttgggcctcctgcccagccc

SEQ ID NO: 6760444 - DNA, 84 bp, Homo sapiens
gtgtgtgagctgaacgtgcttctgcagcatgtactcggtcacgtacttcttgtcgcacacggagcacgtccactgcttgcccac

SEQ ID NO: 6760445 - DNA, 66 bp, Homo sapiens
ccaaatgtgcctgtttcaacaaagtcaatcagttaaagaacaatgtttggagagaggaacatttgg

SEQ ID NO: 6760446 - DNA, 129 bp, Homo sapiens
accatctccttgtagaaaaacgtctctgacaggtgttcttccaggccggagtcttgattggccataatctaaaatccatgcttggaaagtgaatgccttttcagcagctgtctgcctaacagagatgat

SEQ ID NO: 6760447 - DNA, 65 bp, Homo sapiens
gtttcacccagcagcacttaagactattcttttaatagtttcaaagacagtgtgctgttggaaac

SEQ ID NO: 6760448 - DNA, 76 bp, Homo sapiens
aattagttatgcccagagctgatgacctgcaaaaacttctacttatttagctgttacagtttgggcttgattcatt

SEQ ID NO: 6760449 - DNA, 67 bp, Homo sapiens
ccccagtgcatctgttaagacagtgagtgttgcccaatttgcaagttgtccaaggtatgcactgggg

SEQ ID NO: 6760450 - DNA, 63 bp, Homo sapiens
tgttggtcaaacaaaacccatccctgaggggtagcttcaaagatgggttttgtttgatccaca

SEQ ID NO: 6760451 - DNA, 115 bp, Homo sapiens
ctgtgtcaggctcctaggtaattgacgtgtattaattcatgttctcttcataataaactgaggaggtatgtgctattgttatattatttttacccatgaggaagctgaggcatag

SEQ ID NO: 6760452 - DNA, 70 bp, Homo sapiens
tatgagttagtacaagaaagatgaactgaggtcggctcacatccgtttgcatttcttgaactatatcata

SEQ ID NO: 6760453 - DNA, 60 bp, Homo sapiens
ctctgtgcctctccgggggatttggtcttgacatcccagcacacatcccagaggctagag

SEQ ID NO: 6760454 - DNA, 57 bp, Homo sapiens
ggaggagatgctgttgaaggccagaaacaggtcattcacagattaaatatttcttct

SEQ ID NO: 6760455 - DNA, 95 bp, Homo sapiens
tctccggatggatggaaaccaaaagtagtgaagttgtacataatcttataagaaatgaacgtcattgtttttaagctttctgtattatctgctga

SEQ ID NO: 6760456 - DNA, 82 bp, Homo sapiens
ttcacgctcagttcctcgggcttaggggtggactcctcggttcagaaggcagaagaggtcacactaggtcctagagcgtgga

SEQ ID NO: 6760457 - DNA, 123 bp, Homo sapiens
gcaagttaaccaaaatgcatttctaagggatagaatttcaaggggtgtgagaaagtcaagtgtggaatttcatgcctcttgagaaagatgcttttagccctggaagccttttcagtaccttgt

SEQ ID NO: 6760458 - DNA, 56 bp, Homo sapiens
agcagtccttctttagagagcctctctgatgctggggccctcttagaaagctagct

SEQ ID NO: 6760459 - DNA, 126 bp, Homo sapiens
ccgacgcccttcactcccccccctttttcctccaaaaactacatcagcgaaacgtgaaggtccttagtgtctgatccgtagttacatcttggaaaagaaaagggaaagataaataaaaaatgttgg

SEQ ID NO: 6760460 - DNA, 59 bp, Homo sapiens
agaatctcttgggggctgggacacaggcatccgttttaacaagccctccaggtgattct

SEQ ID NO: 6760461 - DNA, 62 bp, Homo sapiens
cctagaccagctggtcctgtcctgggtcatctcgttgtccccagtttctagctggtataagg

SEQ ID NO: 6760462 - DNA, 58 bp, Homo sapiens
ttgtaagtcaaagaggctaaggttatttgagtaagtaacctgagttttttagatgcaa

SEQ ID NO: 6760463 - DNA, 57 bp, Homo sapiens
ctgagtactttgagtagtgccttagctcagaatgtttgctgacctcaaagtgctcag

SEQ ID NO: 6760464 - DNA, 113 bp, Homo sapiens
tgatttgaaattccctaaattgcaggtgtgctgaattacgtgactgcccaaaggcacccaggcatttatgtgttcagatgcaccctcaccttctattaggacagtttcattca

SEQ ID NO: 6760465 - DNA, 76 bp, Homo sapiens
gtatctgcaggaccacattatggctttcatgggcaataggtacttttgttttgtgggccatgaaaaattttgctac

SEQ ID NO: 6760466 - DNA, 73 bp, Homo sapiens
gactattatttattgactgtcccaaaacgtgatgaaattggtaaatgtgaggagggtcaaactgagttatgtc

SEQ ID NO: 6760467 - DNA, 55 bp, Homo sapiens
gagggtagttgtgtgtgtggatacccatgctatatattcacatacttaggccctc

SEQ ID NO: 6760468 - DNA, 55 bp, Homo sapiens
ctggccaggctctgcaggctggcatctttagcaagcagaaatgccatggcatcag

SEQ ID NO: 6760469 - DNA, 64 bp, Homo sapiens
gagatatttttaagtgtaattgaatttcataaatatgacatttggtaacacttgagcatgtttt

SEQ ID NO: 6760470 - DNA, 109 bp, Homo sapiens
gggcgccatcccgccggcgtgcggagacgtggaggccgcggctgaggcccgccgccggcccatgggggcctcgccgccgcctctgctgccgccgccgccgccttcgcct

SEQ ID NO: 6760471 - DNA, 71 bp, Homo sapiens
cctcctcccctgacctcctggattgacagccctgagtgaggagggtgtggagccaggaggtggggaccagg

SEQ ID NO: 6760472 - DNA, 81 bp, Homo sapiens
cgcatagttattcagaataaagactacatttctgtttgtagaaatgtacaaaccttctttgtagctgggtataaccatgtg

SEQ ID NO: 6760473 - DNA, 99 bp, Homo sapiens
gcaatgtctcctctacttatatggcatttctatagaaatatgagcagattctgccagcatttcaggaatctgtatgaaagtgttagagttttcatttgt

SEQ ID NO: 6760474 - DNA, 80 bp, Homo sapiens
aggtaatatggaggtatggttaatatattatttagtcacatctagaagtcctgttcctcatacttcctcattgattgctt

SEQ ID NO: 6760475 - DNA, 130 bp, Homo sapiens
ttgatggaatatgtgctgagaaatgtatagtgaatttttcctctgatacctgctacaaagcataagatcccctgaaggactttattgcattttatcaccaaaaaagcacattagcactctatcccattga

SEQ ID NO: 6760476 - DNA, 66 bp, Homo sapiens
aatattgtgcaagattgacttgcaaattgtttttgtcttttctatgtcaggttttgtatcaatatt

SEQ ID NO: 6760477 - DNA, 104 bp, Homo sapiens
attgtaaaaggtggtgtgcatgtgtatgtgtgcatgcacatctgtgatatgtgtgtatgtaagcatgtgcatatgtacaggtatatgtttctatgttttatagt

SEQ ID NO: 6760478 - DNA, 130 bp, Homo sapiens
tgacattcctcagtgttgtgagcggggaagagagaaatgctttttggttggctcagattaccttgttctggttaaatgaaaaagtattaacatacgtttcttgtcaccacaattccagctgtccaagtca

SEQ ID NO: 6760479 - DNA, 65 bp, Homo sapiens
attcagcaggcaccggaagtgtttttgggacttcttgggaaatgcttcataggatgctgatgagt

SEQ ID NO: 6760480 - DNA, 70 bp, Homo sapiens
gcttgatacttatggctgtgaaatggtaggtggttaattcagccacatcatggatacagttatgttaagc

SEQ ID NO: 6760481 - DNA, 75 bp, Homo sapiens
gttttatttgacttcttgctatgcttgcattctaccaagactgtgccttcagcttaccgatgagtcagaaaggac

SEQ ID NO: 6760482 - DNA, 93 bp, Homo sapiens
ttgattgcaaagcagaaatgaaagcaaattataggccatctcttagtagagtaatggtcactttttgactgttcatcaatgctttgtcatcga

SEQ ID NO: 6760483 - DNA, 90 bp, Homo sapiens
cagggtacacactggacatttcgcacccttccaaagaagcaagtcttactatgctgggagtacttgtggagtgggggctgtgttgccctg

SEQ ID NO: 6760484 - DNA, 78 bp, Homo sapiens
tggcaaagtatctgtcccagctccatatgaaagaaagacttgtcatcatctgaaccctttgggacacttgctttgcta

SEQ ID NO: 6760485 - DNA, 66 bp, Homo sapiens
taaactgaacacagggccaaacttgagcttagcagccaggcagccaggtttccactgtgttgtttg

SEQ ID NO: 6760486 - DNA, 77 bp, Homo sapiens
actcaagcaacacagttttccaaaatagagcatagtccctgccattagacttattctagaaagactatggtttgggt

SEQ ID NO: 6760487 - DNA, 74 bp, Homo sapiens
gaggtgtcctctttcagagatctcaacgccaacttcgtgggacctctcttgagagagcagagcattaggccctc

SEQ ID NO: 6760488 - DNA, 61 bp, Homo sapiens
tggaggactctgaatcccagctcagtactgttgctgctggaaagggacttatgagttccca

SEQ ID NO: 6760489 - DNA, 91 bp, Homo sapiens
gatctcagtgtctttggaaaaaatggacaatcaataactgctgtaatataacagcacgattctattattttcagagctctatagtgagatt

SEQ ID NO: 6760490 - DNA, 92 bp, Homo sapiens
tttgaggaaattgctgagggccagaaagttattgagataacttggtatttgatggatctcatgaatttttagtgctttctacatttcccaaa

SEQ ID NO: 6760491 - DNA, 71 bp, Homo sapiens
ccggctctctggaggagctcaccctgctggctcagctgagtttaagggggaagctgctcctggggagaggg

SEQ ID NO: 6760492 - DNA, 56 bp, Homo sapiens
agctggtgtcctcctggagctgggctcaaccggccaccttctgctgggacacagct

SEQ ID NO: 6760493 - DNA, 58 bp, Homo sapiens
gaaaggtcaaaatcgtgacattgggagttagcttaatgcacccagagtttgaactttt

SEQ ID NO: 6760494 - DNA, 73 bp, Homo sapiens
ggggcacaggaagccgagggaggtgatggagacggcgaagggtgctctggtcctccctcggcgcctgcgtccc

SEQ ID NO: 6760495 - DNA, 56 bp, Homo sapiens
gacaggcccgagtagctgatgaaattctacgtgggaaaagcttttgagtgcctgtc

SEQ ID NO: 6760496 - DNA, 97 bp, Homo sapiens
gtgtattagatattaaaatatagtggcaattgggttgtagagagcacaaattattcctatgaaatacagttactgcatttctaatagttctaattac

SEQ ID NO: 6760497 - DNA, 60 bp, Homo sapiens
cattagcaggcactaagaaggtcagacttgtgttttagaagggccctctggctgctgatg

SEQ ID NO: 6760498 - DNA, 85 bp, Homo sapiens
tctgattcatctgtaagacattgggagttgggtgactttgcaagtctatctgactgtgcccatctcccagcttgacatgggcaga

SEQ ID NO: 6760499 - DNA, 109 bp, Homo sapiens
cagggctctgtctcagctgtcttggcaacacctggaagacatgggcctctgcaaggtctcatactttcaggaggtgttgatgaaggatatggacagatctgaagctctg

SEQ ID NO: 6760500 - DNA, 88 bp, Homo sapiens
gctcagcctgacatttgaccctggcagcatttttttcagaagcgaccatccttctgaatgagatctgccctagatgtactctgcttgc

SEQ ID NO: 6760501 - DNA, 61 bp, Homo sapiens
ggtgattagctgaggcagcgattctccaggtgtggtcctggacagcagcagcagtgtcacc

SEQ ID NO: 6760502 - DNA, 121 bp, Homo sapiens
ctgctttttcctttaatgatcaggttagcaccatgatggaagagctgcttcaggaaaatgatggctcttgtagctaacatgtgtgagatataattgaggggagtagatagataagaagcag

SEQ ID NO: 6760503 - DNA, 68 bp, Homo sapiens
tctgttgaatggatgctgcttctattatctcttcccagagaaaagaggcaaaaatctatggcaacaga

SEQ ID NO: 6760504 - DNA, 57 bp, Homo sapiens
acagtaattgtgtacgaggacacatttccaatggggtttttgttcagcaggtgctgt

SEQ ID NO: 6760505 - DNA, 58 bp, Homo sapiens
gtccaggcacctcccttgtgctgggtgttacctccatgctgaggggtctgacttggac

SEQ ID NO: 6760506 - DNA, 65 bp, Homo sapiens
gcctgagagacccatggggcaaaggtcagttctctcccaggcctgctccctgcagctctcatggc

SEQ ID NO: 6760507 - DNA, 128 bp, Homo sapiens
ggggcgattacataggggttgagacgccgtgctctaaggcaccactgagcgccctcttttgctgggtagttcaacagtggctgtcttggggattggcttttcttcagcttcctggcatagctgcaccc

SEQ ID NO: 6760508 - DNA, 66 bp, Homo sapiens
tggacatgaaagtagattggatttggaattgggtttcccaggttctgccatttacttgtatatcca

SEQ ID NO: 6760509 - DNA, 60 bp, Homo sapiens
ctcccaggactggctctaactggctcaaattggctgttgagctctgagacctgtgtggag

SEQ ID NO: 6760510 - DNA, 57 bp, Homo sapiens
aggcaaaagaatgtcataaatgtactgtaatctgtatgtctgatgtattttttgcct

SEQ ID NO: 6760511 - DNA, 119 bp, Homo sapiens
ggcacacttgatggggatgcaagggactgaggacagtttgggctctgcctgtggccttccaggtgagggcctcagctcccagcccaggctggccagtccagagcgcctcttgggtgacc

SEQ ID NO: 6760512 - DNA, 76 bp, Homo sapiens
caaaagaagctgcttttggagacatcttaggatatagaaccctataaactatatgttagccagagggctttttttg

SEQ ID NO: 6760513 - DNA, 60 bp, Homo sapiens
ttccgggaagattcccaggaacttccggcgacgagggaattcctggggacttccgtggga

SEQ ID NO: 6760514 - DNA, 64 bp, Homo sapiens
ggaggactgagaatcatagaaggcaactgacttgcccagttcagctttctcgttctagttctcc

SEQ ID NO: 6760515 - DNA, 62 bp, Homo sapiens
taatgagatctacctgtgatgtttgcccttaagtggcaaatactaaacataagattttgttg

SEQ ID NO: 6760516 - DNA, 68 bp, Homo sapiens
gggtcttcatttattctacactcaacaaatatttatcagagcacctactgtgggtcagtgaatggcct

SEQ ID NO: 6760517 - DNA, 69 bp, Homo sapiens
tcagcagtgacccagtgttgggcagaactgtggagccccaatttctgctgagcactgggcctgtgctgg

SEQ ID NO: 6760518 - DNA, 87 bp, Homo sapiens
gtagagaaaaagtaaatcacagaccacaaagcaaattccttgttgggtcattagagcttgcttttgtctcgggtttggattttctac

SEQ ID NO: 6760519 - DNA, 65 bp, Homo sapiens
ggccctcccggtgatgaagagctggcagcactcactctgtggcgggatctgttcctgggagggcc

SEQ ID NO: 6760520 - DNA, 79 bp, Homo sapiens
gtgtctctctacctgaggatgttttctgccacagggtgaactagaagtgcccaggagataacgttcccaagagtgacac

SEQ ID NO: 6760521 - DNA, 73 bp, Homo sapiens
gttggtctttggtttctgagtgtcacctggcttagctctttcattaccaggcatttagagagtaaaaattagc

SEQ ID NO: 6760522 - DNA, 71 bp, Homo sapiens
gatggatataccaaggcactgaaaaattgtgtgtagaataacgctacaactaattttctgggctttccatt

SEQ ID NO: 6760523 - DNA, 65 bp, Homo sapiens
ggccaaggcttgtggaggtctgcctcaaaactggcacaacatgactttgccacattctttaggcc

SEQ ID NO: 6760524 - DNA, 58 bp, Homo sapiens
gcacggagatgaacagtgtggaaaaatcactcctgggatctgtacactcatcttctgc

SEQ ID NO: 6760525 - DNA, 67 bp, Homo sapiens
tggtttggaggtgcaaatcaagagttccatatttagacatgctacatttgagatgccttttaggtca

SEQ ID NO: 6760526 - DNA, 95 bp, Homo sapiens
gcttccagttgagcacctgtcacagcagcgcccgaccacaagaggtttacactggcactggcctccaagtcggctgcagctggatccgactgagc

SEQ ID NO: 6760527 - DNA, 69 bp, Homo sapiens
ggagatacttaaatgtcgtttgaccagctttaaagtcattttagttgcaatctattgacgtttgtctcc

SEQ ID NO: 6760528 - DNA, 58 bp, Homo sapiens
ggcctctgcaggcctcgacaaggcccagcctcctgcctcccgaaggcctgcacaggcc

SEQ ID NO: 6760529 - DNA, 68 bp, Homo sapiens
gtaggtcatcagattgacaagggaggcaaagcaatttggaattagtctctctggcaaaggatgcctat

SEQ ID NO: 6760530 - DNA, 71 bp, Homo sapiens
ggccttagttagcgtctcctcctggcccatgttaatccataggcgccccatgatgagggctagtgagggcc

SEQ ID NO: 6760531 - DNA, 94 bp, Homo sapiens
attccaattaccagtcagtccaaaacactgattttctactctacacttaagcagtaactcaggttttttgcgaactgactgtgtgccagggaat

SEQ ID NO: 6760532 - DNA, 65 bp, Homo sapiens
ggcagtcagtagtggctgtagccaaatcagtccactgatttgtccctgtggccactctgtatgtt

SEQ ID NO: 6760533 - DNA, 67 bp, Homo sapiens
gagtcaaaagagtaaagcaaagcacttgtgtcacaaaacgctgtttgcttattgattcctctggctc

SEQ ID NO: 6760534 - DNA, 100 bp, Homo sapiens
ccttttgtacagtgggtttgtgtaatgaatagctttactgggctttcctctgtttgtttgtttagcaatgcttcattatttaaacttctgcactgaaagg

SEQ ID NO: 6760535 - DNA, 89 bp, Homo sapiens
gccaccacctggccttggcctgggacagagcagcagtggggaggggcctttgtgcatctctgctcctacagctcagggctgggagtggc

SEQ ID NO: 6760536 - DNA, 72 bp, Homo sapiens
ggtggatgggagatgggcagataatcttcactcagatctaaacatggattatttgtgcatatcccatccacc

SEQ ID NO: 6760537 - DNA, 90 bp, Homo sapiens
tcaggacagggaggcagggccaggagcaagccaggctctgggagggacccgggagcaatggcagcttctgatgtggtcccttgcttttga

SEQ ID NO: 6760538 - DNA, 56 bp, Homo sapiens
ttatttccacaatgtggtagggtgatggaaaaacaccctatcataatgtaaaataa

SEQ ID NO: 6760539 - DNA, 64 bp, Homo sapiens
taagtagagttcataccaggcctgggttgatctatccacgcctgggagaatgacctccaacttg

SEQ ID NO: 6760540 - DNA, 65 bp, Homo sapiens
cttctactgtctgttttgggggatttaacgaacatcctggatggttgaaaacgggcagtaagagg

SEQ ID NO: 6760541 - DNA, 74 bp, Homo sapiens
atatatatcactttgccaaagtatataaagatctgtatggtgaaagttaagtgcttaggtcaaaggacatatat

SEQ ID NO: 6760542 - DNA, 115 bp, Homo sapiens
caattgttcctaacttccagtgccacttacagaattgggtggctggttgcagctctagctacctgtgcctgctgcaaacctgccacctggtggacattgctgaagctgacaattg

SEQ ID NO: 6760543 - DNA, 61 bp, Homo sapiens
caccagcttcccatcgcgggtctcgatcttcttcacaaccggggccctggtggagctggtg

SEQ ID NO: 6760544 - DNA, 130 bp, Homo sapiens
tataataaagacaagtattaataactctgcctaacagtcttacagaagtagccacagagtgactaatgtatgagctggttcttgaggcatgaataggatttaggtaggtggagaagagtagaagaggata

SEQ ID NO: 6760545 - DNA, 55 bp, Homo sapiens
ttgagtgactgagagcagtgcttttcaaacggtaatgttcaaacagatcacttag

SEQ ID NO: 6760546 - DNA, 58 bp, Homo sapiens
tgcccatggaccaagcaaggggaaagagcaatagatccttcttgtaaaaccaagggta

SEQ ID NO: 6760547 - DNA, 116 bp, Homo sapiens
tgcactcctttgcatagtaacaaggttgaatattctccagatgtttttaagagaattgcttttgttgttgctaaggcccttggaaaatgcagtattgttagcggcgtgggtgtgta

SEQ ID NO: 6760548 - DNA, 105 bp, Homo sapiens
gcggcattcatgtattattattatttttttccaagccactttttagaattcagtcctgcttttcagcttagctggatccctgtgggagtggtatgatgagactgc

SEQ ID NO: 6760549 - DNA, 69 bp, Homo sapiens
cttgattatttttaactggttagacacatgcatgtcatgtgactacatgataaacatgtctacctcagg

SEQ ID NO: 6760550 - DNA, 77 bp, Homo sapiens
taggttccagcagttcaggctccttcccgttggttctcacaaagtgtgcttctctgggtggagcagcctggagctta

SEQ ID NO: 6760551 - DNA, 101 bp, Homo sapiens
caaatcataaagctatcgttacaccatttaagaaagccaaatttcagttatgctctgaatttggcagtgtcttgaagtaattatctggagttatgtatttg

SEQ ID NO: 6760552 - DNA, 73 bp, Homo sapiens
gcagtctgaattctgtgtaactctatcctcattcataccacattttgggtggcttcggggaatttgagatagc

SEQ ID NO: 6760553 - DNA, 59 bp, Homo sapiens
gggaggtgaaaggtcatgtgtgagtaagaattgatcaatacctgaaccaatcacctcct

SEQ ID NO: 6760554 - DNA, 100 bp, Homo sapiens
ccagagaaaggaaggagggggctgaattcgcaggcccaaggtgttcacacttgtccagacctgggccttgagaatcatgtttcttccctcttcactctgg

SEQ ID NO: 6760555 - DNA, 98 bp, Homo sapiens
gatttttttttttccgtatcatatgggaagggtgtttaagggaagatcttcactttccaaggctctcttcccacaatatccacgtgaaaagatgtttc

SEQ ID NO: 6760556 - DNA, 74 bp, Homo sapiens
gtagtgaagttctcaggaggagaataaatacattagtgtcattttagaggtgttcattctctccattcagctgc

SEQ ID NO: 6760557 - DNA, 57 bp, Homo sapiens
gtggtttgctggtgtacgtttattatatgcagtgaaagtacttaatctgcaaaccac

SEQ ID NO: 6760558 - DNA, 58 bp, Homo sapiens
ctctgctgagccagagtccccaggttcagtttactccgggaaactctgcttaacagag

SEQ ID NO: 6760559 - DNA, 86 bp, Homo sapiens
gggttaagccagtcctccctcacctcagtctgggcctcatcatgcccctcgcacatgacccagacccagagggaggcaggttgccc

SEQ ID NO: 6760560 - DNA, 72 bp, Homo sapiens
agatagatagatagataaaatgttgcagactgttaccttaaatgcactctgatattttctattctgctattt

SEQ ID NO: 6760561 - DNA, 65 bp, Homo sapiens
tggtctaagagcctaactgctggccaaataaattctcaagtctgccagctttagatctttgatta

SEQ ID NO: 6760562 - DNA, 62 bp, Homo sapiens
cagcaggccttcctgttgtgtccaccgtactaatgatgcactaaggcagggaggcaagactg

SEQ ID NO: 6760563 - DNA, 62 bp, Homo sapiens
gattgctgggattggtactgatggaaaaaaatacaaaacaaaagtgctaagcaaccggcatc

SEQ ID NO: 6760564 - DNA, 100 bp, Homo sapiens
gtccgccccctgcagcctcactgaacacacctgcagcacgtgtgtccgcatcatgatgtccacaggggtgttcaggaggttgtgtcaggttctgctggac

SEQ ID NO: 6760565 - DNA, 117 bp, Homo sapiens
ttctctaaattaaccctcccagcagcacttgagagaggattgttattcccattttataaattagaggggagaggtgagcaacttctgtcaaggtcacactgccaatgagtagcagaa

SEQ ID NO: 6760566 - DNA, 122 bp, Homo sapiens
ggactcagttctcattttcctcccgttttctctggattgtggctattgttctctggttgctagatcaagctggagcacagtaaagcagtgtcacaaagctggaaggggtctgggatgagtcc

SEQ ID NO: 6760567 - DNA, 64 bp, Homo sapiens
ggcaggactctcaggaccaagcaaggtagcagaagagaggctcagagctttccttagggtctcc

SEQ ID NO: 6760568 - DNA, 56 bp, Homo sapiens
accacgcctggctaatttttgtagagacaaggtttcaccatcttggccaggctggt

SEQ ID NO: 6760569 - DNA, 58 bp, Homo sapiens
gttatgaactctgggaactgcgctgtgccagaaaagtgcttcccaaggtttcatgtgc

SEQ ID NO: 6760570 - DNA, 85 bp, Homo sapiens
ccccgagtctccagccccctccgccaagtcttcgtctctgggtggattcttcagccccagggaaactttggagtggagaccgggg

SEQ ID NO: 6760571 - DNA, 76 bp, Homo sapiens
ggactgaggctggagagataggcatggggtcttgtgatcaagatagtgaagtcagtctgcttctagagccaagtct

SEQ ID NO: 6760572 - DNA, 68 bp, Homo sapiens
accttctgcagccacagctgaaggttgctgagtgcccaccatgtcctcggctctgtgctgctgaaggt

SEQ ID NO: 6760573 - DNA, 59 bp, Homo sapiens
tttatccagtgttggaatttttcctgctttttagattagttcaagcaatgctggaagaa

SEQ ID NO: 6760574 - DNA, 55 bp, Homo sapiens
tctcctgatagctcccatatgatacaccctgattagcaaggcagcatcaggcaga

SEQ ID NO: 6760575 - DNA, 77 bp, Homo sapiens
gctcacagtctgctgagtgcagatgtaaacaactagatttaatgcaagacaccctgcactatagcagcaatgtgagt

SEQ ID NO: 6760576 - DNA, 63 bp, Homo sapiens
tttcgtcatttgtaaatgatcaagagttcttgtgcagctctgatcagaagacaaatgaggaga

SEQ ID NO: 6760577 - DNA, 62 bp, Homo sapiens
tgcagctttctaagctttattgcacgggatttggaaacttgagcctagagatggaaggcgca

SEQ ID NO: 6760578 - DNA, 58 bp, Homo sapiens
gcttctgtcttagctacctcccgtctgttttggaatggggtgggatatagataaaagc

SEQ ID NO: 6760579 - DNA, 78 bp, Homo sapiens
ctcatgttttgtctaatctaaattctgtcaagcaagcgaaaaaaagagagacagagacagagagagaaagagaatgag

SEQ ID NO: 6760580 - DNA, 83 bp, Homo sapiens
aaattatacattcctgggctccaccctagaacccatgaactagattcattaagaatggggtggggtccagggatctgtagttt

SEQ ID NO: 6760581 - DNA, 89 bp, Homo sapiens
tgggatttcttctagggatgtctgtcattatgctttcttgtgtagagccattaggaaaagtaaacacagtcatccgtggtcaaattttg

SEQ ID NO: 6760582 - DNA, 83 bp, Homo sapiens
tcatcttaaccacatctgcagtcccttctgtatgtaaggtcacatttcacaggttcttgggattgggatgtggttatatttga

SEQ ID NO: 6760583 - DNA, 128 bp, Homo sapiens
tattgaaagtttcttgggaagtcatctagcctcttggtgctcaaagtctgtggatccatagcactggtatcacctgagagcttgctagaaatgtagacttttaggcctctcccaaaatctattgaata

SEQ ID NO: 6760584 - DNA, 63 bp, Homo sapiens
gggtcaggtccaactatttatctgtgtttcaattgcgcaatcaagttttgagacccaccgccc

SEQ ID NO: 6760585 - DNA, 78 bp, Homo sapiens
cctttgttaatcgcaaagagctctaaatcagaccactggtggttggttagactttgagctctttgggattaacaaagg

SEQ ID NO: 6760586 - DNA, 57 bp, Homo sapiens
tctgcatgttggcatccaggtgtattattattcctgtgtggtagccagcggtgcaga

SEQ ID NO: 6760587 - DNA, 66 bp, Homo sapiens
tctgctgttcatagaaatggtctcattggaataattccttttggaacgttactaaggacaccaaga

SEQ ID NO: 6760588 - DNA, 71 bp, Homo sapiens
gtcttgattaagatctagtggatggtgagtggctgagccagcactctacccccatccactgatcccaagac

SEQ ID NO: 6760589 - DNA, 61 bp, Homo sapiens
ctgcttgcttgccatgggcttgggcactacaacttgggcccaaggtcccatggcagcacag

SEQ ID NO: 6760590 - DNA, 79 bp, Homo sapiens
taggagaatatcacaaggtgcatggagtaatttctcaaattttgaggccttagtaaccctgcactggattaatctccta

SEQ ID NO: 6760591 - DNA, 83 bp, Homo sapiens
gccattttcttcagccttcacaacctgaaaatctttcactcaatccagaaaggataggaatgagagggtgaggatttgtgagc

SEQ ID NO: 6760592 - DNA, 66 bp, Homo sapiens
gcctttgttcactggagagtggacctctgtggttggcctgtccacctactgtcagagaccaaaggt

SEQ ID NO: 6760593 - DNA, 90 bp, Homo sapiens
cctctgtagcacacggcccagtgctgagcgtctggcagggcctaatgcacagccctgccaggtggctgagtgactgagggtgctaagagg

SEQ ID NO: 6760594 - DNA, 111 bp, Homo sapiens
tttgtgtgacttagggccttatgccgtggtcttactggagggactctagggtttgtctgatccagccagtcccctcatgaggaaacatgcccgagggagaagaagcacaaa

SEQ ID NO: 6760595 - DNA, 67 bp, Homo sapiens
ggcactgcatggctgtgaggcagctggtcagagagcaggctgctctcagagctcatgctgagtagct

SEQ ID NO: 6760596 - DNA, 78 bp, Homo sapiens
tttttgaatgggaatgtcctttgttctgagggagtaggcttctttaattcctggtgcaaggacagacattgataagaa

SEQ ID NO: 6760597 - DNA, 91 bp, Homo sapiens
agtgcatgcatcattaatcctcaagcctgtacaaccaggacagagcatgtggaaaggtgtgcaggcttgaggattaggtgatgcatgcact

SEQ ID NO: 6760598 - DNA, 56 bp, Homo sapiens
tgggttagcacagtgaggtatacatggatcaagatgccactgtgcacactaaccca

SEQ ID NO: 6760599 - DNA, 72 bp, Homo sapiens
agacacctcacttaaaaattctagttatggaataattgtgatgccataggaagaaaattaagcaagctgtct

SEQ ID NO: 6760600 - DNA, 64 bp, Homo sapiens
ggccttgctgaggagatgataatgtcattttttgctaaaatagacgaagtttttcagattggcc

SEQ ID NO: 6760601 - DNA, 79 bp, Homo sapiens
gtggctgaaaccaggatagtatgagtagggatagcgagaagttgtcagctcttgcatatattttgaagttagaatccac

SEQ ID NO: 6760602 - DNA, 59 bp, Homo sapiens
ggcgcagctggccaatcagggcgccctggactccgggaggcctgcgagccacgcgcacc

SEQ ID NO: 6760603 - DNA, 98 bp, Homo sapiens
ccccggctcctgttttccacgtggttctcactgcggttacacacagcctgtaggatattgtagaatacccatcattctggaagtcaggagacctaggg

SEQ ID NO: 6760604 - DNA, 79 bp, Homo sapiens
tggattcctctcctagttttgaataaagatcacatgcagcaacttcctgttgattctatggctccgggagtggaatcta

SEQ ID NO: 6760605 - DNA, 61 bp, Homo sapiens
aagtctggaagtctcagttttctcatctgtaaaatggagataatatagactttatagactt

SEQ ID NO: 6760606 - DNA, 71 bp, Homo sapiens
cccatggaatagttctgaaatgcttgggaaataatccaaggcacagaggcagggcacttgtattttatggg

SEQ ID NO: 6760607 - DNA, 84 bp, Homo sapiens
ggggccagccaggggcctctgggggaggatggcctagaaaacagggctctgcttcagaaggctcattcttgttggcggggcccc

SEQ ID NO: 6760608 - DNA, 64 bp, Homo sapiens
tttcaggcatggaaactggattaggataatctttaattactaatgcacaggtacctgtctgaga

SEQ ID NO: 6760609 - DNA, 77 bp, Homo sapiens
cctcacctgggcaggctgccgtgaagcaggcctgagactggtgctcaggccctgggcagttctgtagcaccaggagg

SEQ ID NO: 6760610 - DNA, 61 bp, Homo sapiens
agaggtacctagaagtattgctaggctgtgattaggaatgcagaatttgggggtaaccttt

SEQ ID NO: 6760611 - DNA, 75 bp, Homo sapiens
tgtagcttaagtaataaataagttttcgctgtcccaagctcttgagattttaggcttgttttactaaaagcaaca

SEQ ID NO: 6760612 - DNA, 100 bp, Homo sapiens
cacaggcctagccggcccctgttagcattgctgtggtgctttctgttaacgagaggccactgaagctgggcgatgcctcccagcaggggacgggcttgtg

SEQ ID NO: 6760613 - DNA, 57 bp, Homo sapiens
aatagtgaacaggaacatgcttacatccattgtgtcgcagagcaccttttcattgtt

SEQ ID NO: 6760614 - DNA, 114 bp, Homo sapiens
ttctactcctacatgttacgcttttagatctgtcttggaggtacaaagacttctggaattagagaagtttggtccttctaagaagagaaaaatgaataagtagagaagtcagaa

SEQ ID NO: 6760615 - DNA, 75 bp, Homo sapiens
gggggaaaataattttcaacaaatcagcaaaaaaagcaggaagaatgagttgttaacggaaaactgttttccttc

SEQ ID NO: 6760616 - DNA, 56 bp, Homo sapiens
tactgtcagaatgtcaaagcaatgaatttaataatgttttgatagcaaagacggta

SEQ ID NO: 6760617 - DNA, 56 bp, Homo sapiens
gccattgtgcagagacacagcagctcctcaccccgctctgctcagccctcagtggc

SEQ ID NO: 6760618 - DNA, 70 bp, Homo sapiens
aggtctggggcagttactggggcctagatgccactcctcctgggtcccaggagctaactgcctttgttct

SEQ ID NO: 6760619 - DNA, 127 bp, Homo sapiens
atgtaacacttattctcctacagaagtagtgtttgtggaatattctttaagaaacgttgttctagagaggtcttttaatctattccctaaacacctaaagtcttattagctttttactgtgttgcat

SEQ ID NO: 6760620 - DNA, 79 bp, Homo sapiens
ctctggctctctggaggccatggacaggttcttttccttctctggaccctagttcctctgcctgccaagagcagcagag

SEQ ID NO: 6760621 - DNA, 64 bp, Homo sapiens
ttgagggatgagtgagtaaacaatatgtggcatctacatatgatgaaatattattcaccctcaa

SEQ ID NO: 6760622 - DNA, 90 bp, Homo sapiens
tagagtacaaaaatggggagggacacaaagagttccctgtgtagacacggggaccacacttagtgttcctcagcacccttctgccttcta

SEQ ID NO: 6760623 - DNA, 89 bp, Homo sapiens
gcattccttagaatatgtctctgtggttaagtaatggcctgcctgtacttgaactcataattacattgagataagtggtcaaggaatgc

SEQ ID NO: 6760624 - DNA, 70 bp, Homo sapiens
agcaggaggcatatttaaatccaatggtattttttacctccgttgtattgttattctgtgctcttttgtt

SEQ ID NO: 6760625 - DNA, 55 bp, Homo sapiens
gcatttgttgactgaccttccccttgaacttcttgcagagggccgtcagcaatgt

SEQ ID NO: 6760626 - DNA, 120 bp, Homo sapiens
gaggaagtgctgagccctagggcgagggagggtgggtcattcttacatcagtgaatgttgaagagaaggccctgacccaccccgttctgcctgccagctctggggtgtggctctgaactc

SEQ ID NO: 6760627 - DNA, 71 bp, Homo sapiens
acacagtggctgagagtggacactggagtttgactgcctgtgtttgatcccaactctgctatttgctgtgt

SEQ ID NO: 6760628 - DNA, 56 bp, Homo sapiens
gtgcatccactgcgcatccccagtgtccaggcagggcctgcacacagtaggtgcac

SEQ ID NO: 6760629 - DNA, 58 bp, Homo sapiens
gtgcctttgagaagtttctctgaagcttaatcggaatgggaaaatttcagaatggtac

SEQ ID NO: 6760630 - DNA, 57 bp, Homo sapiens
agaaatcagaaccctgaagttctgttcccagctttaggtaagccccttttggtttct

SEQ ID NO: 6760631 - DNA, 60 bp, Homo sapiens
tttccagcttcaaagaacaaagggaggcttaatggcttttatgctgtagtttgaaggaaa

SEQ ID NO: 6760632 - DNA, 130 bp, Homo sapiens
cttcttataaatccgtcctcgctgtagcagattccagttaagctgtccatgattttctgcactatggaagtattatttaacaaatttgtgtccacagtggattaaagttactggactgggtttggagaag

SEQ ID NO: 6760633 - DNA, 63 bp, Homo sapiens
ccgtgctgtgctggttgctggggtggttgcagtcctgccccagtcagagcagcgctcgcatgg

SEQ ID NO: 6760634 - DNA, 60 bp, Homo sapiens
ggtccagaagctggtagggtagttctattgtcctctacacctggcttgcatttctggacc

SEQ ID NO: 6760635 - DNA, 58 bp, Homo sapiens
ggcaccatggtctgataaactatgctcaggagagtcatgggatagaaatatggctgct

SEQ ID NO: 6760636 - DNA, 59 bp, Homo sapiens
gccatctggcattgcagcacctgatccatttgggaagggtattcagcgttgtcgatggc

SEQ ID NO: 6760637 - DNA, 63 bp, Homo sapiens
ttcaggggctgaatccaggaaggcaggaacaataatgcaatgctttggtcaacagtccctgaa

SEQ ID NO: 6760638 - DNA, 76 bp, Homo sapiens
gagtggactttgcccagccctacagtatcacctgtgagatttcacatggctgtgctgctgctgttcaaaccccatc

SEQ ID NO: 6760639 - DNA, 57 bp, Homo sapiens
ggctcttgcccgcccaggctggcacagttgccatccagggtgcctgggcggagagcc

SEQ ID NO: 6760640 - DNA, 58 bp, Homo sapiens
ctcctcctcttgcactgtcccaggggtccctccaacccaggccttgatgagtggggag

SEQ ID NO: 6760641 - DNA, 117 bp, Homo sapiens
cctgtcgcccagcgtatcactgcccaggtgcacggtgtactcactgcgaggagtgacattcacagattcagaagagacactgtgacagagagggtgtgcaaagacctgggggacggg

SEQ ID NO: 6760642 - DNA, 61 bp, Homo sapiens
gtggccttgctcacatgtccagacgttggctggctgttggcaatggtggtgacagggtcat

SEQ ID NO: 6760643 - DNA, 93 bp, Homo sapiens
agttgattttcttcattgtttatgtgaaattgccatacgtttgctttggcaaacagttgttatttttatatgggtggttgagttgatacaact

SEQ ID NO: 6760644 - DNA, 82 bp, Homo sapiens
ggccagaagggcagagaggacatctgaacctagagttgtgctccactctatgtgcttgactactctctattcctgtcttgtc

SEQ ID NO: 6760645 - DNA, 57 bp, Homo sapiens
gggaagcctcagagctcaggcttagctgcggctgtgcccacctggctctgaggtccc

SEQ ID NO: 6760646 - DNA, 83 bp, Homo sapiens
ggaaagagttctctgcgaggctgacatatacaacctgcatctcttcttacagatcatttgtgctgtcagcatgcagtttttcc

SEQ ID NO: 6760647 - DNA, 78 bp, Homo sapiens
gagatcagagagctctttatggccagggtcactataacaaagaatctatgggccaaataggagtcccttatgagtctc

SEQ ID NO: 6760648 - DNA, 62 bp, Homo sapiens
tggacataaaattcagtatttagagtggatcgtgcacataaatgctgaatctttactgttta

SEQ ID NO: 6760649 - DNA, 56 bp, Homo sapiens
aacttttatgaaggaaatcatacatggaatcccaatgtatgaagttgataaaagtt

SEQ ID NO: 6760650 - DNA, 129 bp, Homo sapiens
tttaaattctaaagagcaaaatgcatctgctaacttctgaatagcaatagtaccaaatttggtgcctgctgattgaattcagatgtggttgcagctggaaatcattgtggcctcttagttactagatga

SEQ ID NO: 6760651 - DNA, 56 bp, Homo sapiens
cacacttttctggctcaggctccccatctaccagttcttttgctagactaagtgtg

SEQ ID NO: 6760652 - DNA, 59 bp, Homo sapiens
actaggacacaggctgctgcttcattcacccccggggaaggctttctgtgatcctcagt

SEQ ID NO: 6760653 - DNA, 56 bp, Homo sapiens
tgaccccgccttttgactcataaacatctaatcaggtgagtgatggaggcgggtca

SEQ ID NO: 6760654 - DNA, 83 bp, Homo sapiens
gttccttctgagggccctacctccctgctgggccagccttatgcccagcatcctcagggagcggggctgtcaccatagggagc

SEQ ID NO: 6760655 - DNA, 76 bp, Homo sapiens
ttgcttgaggccaggttgtcaagggtgcagtgagctgtgattgtgtcactgcactccagcctgggcaacagagcaa

SEQ ID NO: 6760656 - DNA, 58 bp, Homo sapiens
gggctgtgtcaaggatgttgcttctcagcaggggcacagaagtctaagacatcagtcc

SEQ ID NO: 6760657 - DNA, 62 bp, Homo sapiens
tagtgggtgtttcagattttagtttagtggtagttatatatgcagaatcccaggccccactg

SEQ ID NO: 6760658 - DNA, 66 bp, Homo sapiens
gtgcccccggctctgcctgtctcatcctgcaagggcgctgaccttggacaaggccagagccagcac

SEQ ID NO: 6760659 - DNA, 81 bp, Homo sapiens
aggcaacatatattttgttttcctgtgaacggggcccatctttaaaggggtaagccaggtcacagggataaatggttgcct

SEQ ID NO: 6760660 - DNA, 65 bp, Homo sapiens
catgcagtgttgttaaaagattagaaactaaaagcagttctagtgtactgttcagcacttgcatg

SEQ ID NO: 6760661 - DNA, 68 bp, Homo sapiens
gctcttttcctccttcagattcagagggctaggaggtcagagtgcagcctttgagggaggggcagagt

SEQ ID NO: 6760662 - DNA, 82 bp, Homo sapiens
ctggtgctattgaaattcttcatgtcctcttgaatgtttacatctatatgagtatggggaatggccaatccaaaggcactag

SEQ ID NO: 6760663 - DNA, 101 bp, Homo sapiens
tgatatttgacttttgaaccagactagatgaggcagagcttcagcacatattttaccagtgtcttcagcaaatgcctttctctttgcaaagctccatatta

SEQ ID NO: 6760664 - DNA, 64 bp, Homo sapiens
ggcacagtctgagaaagcaatagctggtaaataatatcttccttattgacttattaattgtgct

SEQ ID NO: 6760665 - DNA, 65 bp, Homo sapiens
ttctatctcttctgctcatgttaaggtatgaggttactttgcaaacacttaagaagagagatgaa

SEQ ID NO: 6760666 - DNA, 96 bp, Homo sapiens
ctgtccctgtgtgggtggggcctcttccatttccctgacttagaaaccacagtccacctagaacagggtttgagaggcttagtcagcactgggtag

SEQ ID NO: 6760667 - DNA, 60 bp, Homo sapiens
ggcttccacactggctccttgcatggctggcaggctgatgctggctactgatggcaggcc

SEQ ID NO: 6760668 - DNA, 88 bp, Homo sapiens
tccggcttgtttcacgggtgtgtggcctcctcttccgaagtcatttcattcttcggggtctttgacacgctctggcaacaagcgcgga

SEQ ID NO: 6760669 - DNA, 69 bp, Homo sapiens
tgacaactcctggtgctgatgaagagatgggtcaatgagcactctcacacacgcctagaagtcaagtca

SEQ ID NO: 6760670 - DNA, 65 bp, Homo sapiens
actaaggcagtattacttctgttttcatcatcattgtatactcaggagtgaatacagtgcctggt

SEQ ID NO: 6760671 - DNA, 78 bp, Homo sapiens
ttctttatcttttgtggcatttcccaatatatgctcctcagaatactggtcttgtgagatgtctactgaagaaaagaa

SEQ ID NO: 6760672 - DNA, 83 bp, Homo sapiens
gggcagaacatagcctttaagtcatggtcactgattgcctcacttggcagcgtgtccttttagcttcaggtcattttctgttt

SEQ ID NO: 6760673 - DNA, 103 bp, Homo sapiens
cttgcctgtgcctgtcctcctggcctcatagccaagctgtgtccctgagctggggatggcttggggatctgaggtcatataagggctgggtctcccaggaaag

SEQ ID NO: 6760674 - DNA, 55 bp, Homo sapiens
caggcacctgcctctcgtgtccatgcagcattacaggaggggacaggtggccgtg

SEQ ID NO: 6760675 - DNA, 80 bp, Homo sapiens
acttgatggcctcaagcaacagaactgtgagacctcgcttagatttggtcagctatgtctgttgttgaggtggaccaagt

SEQ ID NO: 6760676 - DNA, 56 bp, Homo sapiens
accttattcttgcccttagatgacacatgattccatctaaataggtaaaatgaggt

SEQ ID NO: 6760677 - DNA, 76 bp, Homo sapiens
ctctgcagccagaggcatgaaaactttttaaaaagtatcttcttttcagtttcactcagttggctgtaaattagag

SEQ ID NO: 6760678 - DNA, 95 bp, Homo sapiens
cccattgctgtgaaggatggctaggggactggagttaatcatgttagcattttgtctctgtgtgtcttgttggccaggctttctcagaatgtggg

SEQ ID NO: 6760679 - DNA, 66 bp, Homo sapiens
agtggagttaatgtccttggggtaaatctaatcaaaacaagatgggtccagcatataaactcctct

SEQ ID NO: 6760680 - DNA, 83 bp, Homo sapiens
ttcctgcagtttctggtatgggaaatttcaagaagacagagtttctatttttgaagttcccccatatcagaaactgcaaggaa

SEQ ID NO: 6760681 - DNA, 68 bp, Homo sapiens
tgtctttgagctttggactggatttgcttctgaggttaagagaagtgtgtggcagatgttgggaggca

SEQ ID NO: 6760682 - DNA, 86 bp, Homo sapiens
ggaaaatcaggtggggaagtgagggactggagtaaagaggaaagcgtctttctccaagaaaagatctcagctatccatgtggatcc

SEQ ID NO: 6760683 - DNA, 82 bp, Homo sapiens
gtcaggacagccctgcatgcagcaggcggccacttgcaggcccagaagggcttcctggggtccacctgagcagcagcctggc

SEQ ID NO: 6760684 - DNA, 56 bp, Homo sapiens
tggtaatttcatgcatctaaatttggaccagccacatttcaggtgcccagttgcca

SEQ ID NO: 6760685 - DNA, 62 bp, Homo sapiens
ccagggaggtcgagggcccttggtcaccatcctctcagcaccaggagccaagatctccctgg

SEQ ID NO: 6760686 - DNA, 68 bp, Homo sapiens
gttggagtcccagccgcagagagcagggcatcacggccacctgctctagactctgggaaggttctagc

SEQ ID NO: 6760687 - DNA, 95 bp, Homo sapiens
ctggccgaggggcaggctcctcgcggcctccctgggactccgggcgtgtcgtccagccccgaggccggcgacgggcagatccgcctcacggacag

SEQ ID NO: 6760688 - DNA, 66 bp, Homo sapiens
tccttcctgtgaagccggtggtctcacctttcccgttcaggtggcgttgctggtcatgggaatgga

SEQ ID NO: 6760689 - DNA, 57 bp, Homo sapiens
catcaggataagttccaggtgggtggtgctttgctcaacctggtgtgtgcctgtgtg

SEQ ID NO: 6760690 - DNA, 59 bp, Homo sapiens
ccagcagccagagaaggacctctcaaaatcacccctgacctcctgctccttctgcatgg

SEQ ID NO: 6760691 - DNA, 92 bp, Homo sapiens
ggggccaggtcccaagacaccagctggggctgcagagaacaggctcctcaaaggccttccagaaagcacttagttagtgtcagcctggcccc

SEQ ID NO: 6760692 - DNA, 67 bp, Homo sapiens
agcggttagagaaaggatataacccttttagtattctagcatgtttgaattcctttctttacctgtt

SEQ ID NO: 6760693 - DNA, 56 bp, Homo sapiens
cctcctggaggctccaagggagaatccatttcctggcctttcccagcttctagagg

SEQ ID NO: 6760694 - DNA, 67 bp, Homo sapiens
taaatattaggttggtgcaaaagtaattgcaaaaactgtaattacttttgcaccaacctaatggata

SEQ ID NO: 6760695 - DNA, 85 bp, Homo sapiens
tcctgagtgtgaaagaacttgtaaactgttaaaagccagaattaataagttattttggcacaatttaccggtttaaagttcagga

SEQ ID NO: 6760696 - DNA, 91 bp, Homo sapiens
tcccaccccatcctgtcacccctgcctctcagcctgaccgccatgtaaccctgggggtgctgagaagacaggagaaggggaggggaaggga

SEQ ID NO: 6760697 - DNA, 59 bp, Homo sapiens
gcttcagcacctcagctggagagtcctgggtgccgccctcccgctgaagtgctgacagc

SEQ ID NO: 6760698 - DNA, 64 bp, Homo sapiens
aacagaaaatttccgttgcccaggtgttgggtttatcacctggaagatatgctgattctctgtt

SEQ ID NO: 6760699 - DNA, 72 bp, Homo sapiens
tagccatcttcccaccccatctccacactcactgctcctgaagatgccctgattgggtgaggagggaggcta

SEQ ID NO: 6760700 - DNA, 61 bp, Homo sapiens
gtctctggcagaagccccgtggaacctcagccggacaggaggtgacgcttctccagatgac

SEQ ID NO: 6760701 - DNA, 61 bp, Homo sapiens
gagatgtagggagaagagaggcaccttgggaaggtaccttacctcctttacaagttttctc

SEQ ID NO: 6760702 - DNA, 81 bp, Homo sapiens
ttcttcacaagatttaatgcaacccaagctctacctgaattagtcaggactcttctggttgcagaaatccaagtggcagaa

SEQ ID NO: 6760703 - DNA, 70 bp, Homo sapiens
ctcatctctcttcacctttttgtttcctctgtgaaagcagggatagaatttgaaaagtgatgggaatgag

SEQ ID NO: 6760704 - DNA, 60 bp, Homo sapiens
tagggcgtctcgcttgttgcccaggctggtcttgaactcctgggcaaagtgatcgtcctg

SEQ ID NO: 6760705 - DNA, 71 bp, Homo sapiens
ctaaggccagagtgatgtaacatatatttactttaaatgttgaatagattttattaattaccttgccttgg

SEQ ID NO: 6760706 - DNA, 116 bp, Homo sapiens
gcagggattctttgactcttttgttcgctgatatatcacagcttactgtcacagggcctgatatctagtagatgctgtagaaatacttatgaatgaatgggtagggaacctattgc

SEQ ID NO: 6760707 - DNA, 81 bp, Homo sapiens
actatgaccctttagagatgtcccaaaatgaaggaagagttatccattattgaattggaactatctccagggagatgtagt

SEQ ID NO: 6760708 - DNA, 82 bp, Homo sapiens
gcattgcctttgccccagtacacaagattctgaaattataatctttatttgtaattcatgtgccactggtgaacagggatgc

SEQ ID NO: 6760709 - DNA, 61 bp, Homo sapiens
cctctgcatctggctgctgcagaccctcgtccacctcctgcagctcggccaggtctggagg

SEQ ID NO: 6760710 - DNA, 61 bp, Homo sapiens
ctcgctgtgtccagggccgtgttgtcttgtgtctcggcaggacccgcacagctggagtgag

SEQ ID NO: 6760711 - DNA, 55 bp, Homo sapiens
ccagaaccttttggcactggaattacaactgttatcctcctgtagagggtcctgg

SEQ ID NO: 6760712 - DNA, 72 bp, Homo sapiens
cccccgatatcactgatgtgtaattccgaagaccctgagaccagggcctgggcccacaagtggaatcgtagg

SEQ ID NO: 6760713 - DNA, 93 bp, Homo sapiens
aagcattcttatgtgcccagctcagtggtggtcacttggtggaagaatatgatctatcaccaaggagttactacttagtttgggaggaatctt

SEQ ID NO: 6760714 - DNA, 84 bp, Homo sapiens
gcctcaaatatgtctttattagcagcatgagaatgggctaatacagtgtgtgccctgcagttgttagatgtttatgtattaggt

SEQ ID NO: 6760715 - DNA, 77 bp, Homo sapiens
aacctctagtattcaacagcatcaagacataatatgattaatattattaaatgttatttgggttgtgtttatgggtt

SEQ ID NO: 6760716 - DNA, 78 bp, Homo sapiens
gctggctgtctctccacctcttgtgtgccaggcatcactgtaggcacaggaatctgtgaagtgctagacaaagcctgc

SEQ ID NO: 6760717 - DNA, 59 bp, Homo sapiens
tccatgtctagacactactagtaaccggtgccttctgtacctgctgtgctttccatgga

SEQ ID NO: 6760718 - DNA, 75 bp, Homo sapiens
gctagttatttcaccaccgctgatgaaggttggcctgactctcccaaccctctaagccatgggaaataaattggc

SEQ ID NO: 6760719 - DNA, 89 bp, Homo sapiens
gcgctggggaaggtcgtgatttcccactcaggccgcggcgctaaggagacgcttgtccgaggtcccgtgggatctccgaccctcggggc

SEQ ID NO: 6760720 - DNA, 77 bp, Homo sapiens
aacaatgagattccaatagctcctgcagggcccactgttacctaaatgaagccccagcagcctggaatttcacagtt

SEQ ID NO: 6760721 - DNA, 60 bp, Homo sapiens
tccactggcttggaaaatcatttgtgataaaccgaaacagcaaaagatcaagccactggg

SEQ ID NO: 6760722 - DNA, 58 bp, Homo sapiens
tatttcagctctttggattatctgtggtggaggccatcacgtctttggagtggaggta

SEQ ID NO: 6760723 - DNA, 91 bp, Homo sapiens
gtgaaaatgggaaaagctaccaagttaccagcaatataagtagtcatggtcaacaggtacttgctgtgatttggagctcttcctgagtcac

SEQ ID NO: 6760724 - DNA, 67 bp, Homo sapiens
gaggagtggagttgctgggttgtatggttagtgtatgtctaacttttcaagaaactgccacaccatc

SEQ ID NO: 6760725 - DNA, 79 bp, Homo sapiens
gagcaaagggtattttcataaaaccatggaatctttgagttggctaaatctccataaattttatgaacatattgtgttc

SEQ ID NO: 6760726 - DNA, 84 bp, Homo sapiens
agtcaccactgggttaatgatgtgtttggaagcttgctgacagtgtgaacagctttgtcttctcacatatcccctgtgttgatt

SEQ ID NO: 6760727 - DNA, 78 bp, Homo sapiens
gtgtctctgttgtggcttccaaattatccctagaatagattaagaaattctaggaaatatcaagtcaggaagagacac

SEQ ID NO: 6760728 - DNA, 60 bp, Homo sapiens
catccaaggcactagcatgagtaagtcatcagaccctagatcagctctgtgcctgggatg

SEQ ID NO: 6760729 - DNA, 58 bp, Homo sapiens
cagagctgagaatgttgatgctgaggctttcttgtttcctttccattttctgagcctg

SEQ ID NO: 6760730 - DNA, 60 bp, Homo sapiens
tccattcagcattggcaccatggattgccacaggaggtttatacacagtgttgatatgga

SEQ ID NO: 6760731 - DNA, 88 bp, Homo sapiens
ctggtttccattagaaatatgcctataggaatcaaagagagaaccgtacagttttctagatgcttataggcatattagtaatgatcag

SEQ ID NO: 6760732 - DNA, 64 bp, Homo sapiens
gcgttctttggaaggaagacctttcagatgacctgaccagtcctcctcttcagaacccggatgc

SEQ ID NO: 6760733 - DNA, 63 bp, Homo sapiens
tacagagttaaagtggagtttaaatagttttacttaatgtttaaatttccaattaattttgtg

SEQ ID NO: 6760734 - DNA, 67 bp, Homo sapiens
ttcattctcataagtgttgcagttagtataagaaattatgtgctcaccctatttatggaagagtgaa

SEQ ID NO: 6760735 - DNA, 68 bp, Homo sapiens
tctgctctagttgcttcctgcctgaaggcaaaaagacaggctgtgactcttgcaattacctgagtaga

SEQ ID NO: 6760736 - DNA, 55 bp, Homo sapiens
accgtgtctgacactttgggcgagggcaccacgctgaaggtgttcatgatgcggt

SEQ ID NO: 6760737 - DNA, 112 bp, Homo sapiens
gcacccaatccttctctttggatggtaagcaaattggatgtctgtgagaagccggcaaattttattatgaacacatagtttgctacttaactatccttaagaccccgggtgc

SEQ ID NO: 6760738 - DNA, 78 bp, Homo sapiens
gttagctgccaaaattattcctgattttaaaagaagaggtgaaagcttaaataatttgaaacaggtgattcagctaat

SEQ ID NO: 6760739 - DNA, 55 bp, Homo sapiens
tatactgatcactgaggtcatcttttcctctcatgtgaccacagtgcttaatatg

SEQ ID NO: 6760740 - DNA, 62 bp, Homo sapiens
cccatctagaaccagggctcaggagaacaaaaatgcctgtgcatggccagctggatcgaggg

SEQ ID NO: 6760741 - DNA, 126 bp, Homo sapiens
ccaccctcccactttggactattttgcaccagattctagacatcatatcatttgcttataaatcttttggcatgaatctctaaaagaaagggaatgctatgtagataaggtagtcaaggaaggtgg

SEQ ID NO: 6760742 - DNA, 55 bp, Homo sapiens
ggaaggctttgaggggtgctggtaatattttactggtgcttgctttaagtctttt

SEQ ID NO: 6760743 - DNA, 62 bp, Homo sapiens
tgaaactttttcttaggtatgtctgtattcatatggacataacactttgaaagagaatttcg

SEQ ID NO: 6760744 - DNA, 84 bp, Homo sapiens
gactcctgattttatgattcagtttcttttccatctgaagcagtcttctgtggctgggagcctggcttcgcaggaccaggtgtt

SEQ ID NO: 6760745 - DNA, 77 bp, Homo sapiens
gcagctttggtaatttttgcatttagaaaatggaaacccactttgcattttctacattcaaaaactaccagagttgt

SEQ ID NO: 6760746 - DNA, 65 bp, Homo sapiens
cattgtctgacctctaatgggcaggccctgtgggtgggctgtgtggtccagggtcattaacaatg

SEQ ID NO: 6760747 - DNA, 63 bp, Homo sapiens
ctcccagatgtccgtggtattttgctaagggggaacacttggagcaggctccgggcttgggag

SEQ ID NO: 6760748 - DNA, 98 bp, Homo sapiens
gtctttgagaaaactatggaagacaggctgtattttaaatgattgataatcttaatgttcttttgaaacattacctgtatttccataaaggtcaagac

SEQ ID NO: 6760749 - DNA, 77 bp, Homo sapiens
acatggatctcatttgggcatgccactatggcctatttactgagtgagccataagggctgccacaatggggcagtgt

SEQ ID NO: 6760750 - DNA, 110 bp, Homo sapiens
cctccccgacccaggaaatataggggtctccccattctgggtctggctcagggactgtgtgtccctgactgccctccatgaaggaggccgcccttgggtctgccgggagg

SEQ ID NO: 6760751 - DNA, 59 bp, Homo sapiens
ggagcctgtggccgtcacgactcaacctcagtacatgtggcagtccggccgcacgtttc

SEQ ID NO: 6760752 - DNA, 81 bp, Homo sapiens
actccaagatatttgtagaatcactcaatcttaaatgaaaaaatcaaaatgatcaggaagatctagcgaatgtctcagagt

SEQ ID NO: 6760753 - DNA, 84 bp, Homo sapiens
cagcgcagtttgagggggctcagctcattgtggatccggtctgcgtcatgtagaatcttctggagctccccctggctcgtgttg

SEQ ID NO: 6760754 - DNA, 57 bp, Homo sapiens
gcaactaccaggctcatagtagaccagcctcaagcccctgctgagagcctggcttgc

SEQ ID NO: 6760755 - DNA, 127 bp, Homo sapiens
tctgttgggatacttggatagtattgattcatttcctattgtggaaacatctggaattcagtttctttaatataaaggaatgaattcaatggcatctaaatttttttctattcctaacctactagga

SEQ ID NO: 6760756 - DNA, 56 bp, Homo sapiens
gactccagccagagtgcctctgttcagtagttttaacagtcgtatctgtctgggtt

SEQ ID NO: 6760757 - DNA, 95 bp, Homo sapiens
tccagcaagcgcggctgacctttctctgggtgcttggccggaatccaagcccattcttccgagcacctcagaggggggtcagggcctcagcaggg

SEQ ID NO: 6760758 - DNA, 70 bp, Homo sapiens
gccctgccctcttgggaccctgcacttgggccacggggacccagctccagccaccggggggtgccagggc

SEQ ID NO: 6760759 - DNA, 76 bp, Homo sapiens
gctgtgaccaaatcttttgtgtattttacctttacggcacatttccaggtaaactgcacatgaggctggtgcacgc

SEQ ID NO: 6760760 - DNA, 68 bp, Homo sapiens
atgtgttttagttgtaaaatggaatttgtgtaataaatagcacttccaggaactgccgctaaccacat

SEQ ID NO: 6760761 - DNA, 62 bp, Homo sapiens
ggataactgcatcttttgtgtgatggttttcttttcactgtgtacacaatgattgcagagcc

SEQ ID NO: 6760762 - DNA, 67 bp, Homo sapiens
tttctaatggtgcagtgggtgtaactgtctcttggtggagtaagctatattttctgtcctgcagaga

SEQ ID NO: 6760763 - DNA, 63 bp, Homo sapiens
ccctgtttaagaaacctgtaaaggagctcaaatcaagtaaaatctgatggtttctgagcaggg

SEQ ID NO: 6760764 - DNA, 57 bp, Homo sapiens
ttctctgtggattgggtgagaggcaggagatcagcctcagagaacctaagcggagga

SEQ ID NO: 6760765 - DNA, 112 bp, Homo sapiens
ggcctctagtggagttaggctggctgtcctttcatccccagctatacagggctggatggctgtgggtggaaggaaaccaggcaggcaccttcacccactggggacacaggcc

SEQ ID NO: 6760766 - DNA, 65 bp, Homo sapiens
gcagtgacatggcccaaatgatattttagcagattcaagtggctgctatgttaagaatagactgc

SEQ ID NO: 6760767 - DNA, 62 bp, Homo sapiens
taagtttgtgtctctgttacttgcaaaacgtaacacccagcaaaatacagagactagatttg

SEQ ID NO: 6760768 - DNA, 86 bp, Homo sapiens
gccctctggcggggctcttctggcaatcccagggtctttcttgtagctgagccgatcctatgccagggcctcgctgctcccagggc

SEQ ID NO: 6760769 - DNA, 58 bp, Homo sapiens
gggagcaggcacgggggtgatgctgccacggggcctgtgacacccagagcctcctccc

SEQ ID NO: 6760770 - DNA, 91 bp, Homo sapiens
tactgtaatgttcttgtggtcataaagcatactttgtatgactttaattcttttaaacttatatttgctttatgcttcagaatgtcgtgta

SEQ ID NO: 6760771 - DNA, 80 bp, Homo sapiens
gttcaagttaactctccttgtactgttcatcctgattctcctctttccagattttcagtgtaaggagtataggcttgagc

SEQ ID NO: 6760772 - DNA, 76 bp, Homo sapiens
ggggtccagctgcctcggtttgaattcccactttgtcctggccagtggtgcaaactggggcagcttctgtggcctc

SEQ ID NO: 6760773 - DNA, 75 bp, Homo sapiens
atctacctacttacatttctgtaatcggctcttcagttttaagaagccgaacacataaatgagagaagcatagat

SEQ ID NO: 6760774 - DNA, 66 bp, Homo sapiens
tctccctctcttctgcatgttatgcaaaacctgaactatttttgttactatagcatagagtggaga

SEQ ID NO: 6760775 - DNA, 93 bp, Homo sapiens
tctgttgtcaataactggattcaagttttagaaatatctggatggtgtaaaaatgatttaaatgttgtaaaaccagaaagttaccataacaga

SEQ ID NO: 6760776 - DNA, 57 bp, Homo sapiens
ggaggggcctctgctccacaggatcactcagggacccaggctggcagaggctcctcc

SEQ ID NO: 6760777 - DNA, 58 bp, Homo sapiens
actgtgcgcacttagggtcagagacttctttgttatgaggacctgacctgtgcactgt

SEQ ID NO: 6760778 - DNA, 80 bp, Homo sapiens
taagaatacagatctctgggcacatgccagaaggttaaatttggcagaggctggggtttgctcagttctctgtattttta

SEQ ID NO: 6760779 - DNA, 59 bp, Homo sapiens
tgctcacagcccagaacataataacttttcttttattctggtactattgctgttgagca

SEQ ID NO: 6760780 - DNA, 129 bp, Homo sapiens
gccagcatttcatcctgaggggcagggagcaatggagggcaaactcctgacctcaggctagccactgggaagtgtgcaggccacaggccagggctgccccagctctcaatgcccttgttggagtatggc

SEQ ID NO: 6760781 - DNA, 77 bp, Homo sapiens
cacagatccttagttaagaacaggagtgatatggaaagtgatagactactgttagaatttaactcaggaattttgtg

SEQ ID NO: 6760782 - DNA, 57 bp, Homo sapiens
ttgtatgctgtaggcatgcatttttttaagtaaatgagtaagccccatagcaagcaa

SEQ ID NO: 6760783 - DNA, 96 bp, Homo sapiens
ctttagggttgttaaagtggatcactgttccttggtttgtaaacatattcacctcttcaataccagagacagtgtttacctctaacttctttaagg

SEQ ID NO: 6760784 - DNA, 62 bp, Homo sapiens
ctctgggtcaccatcggggattctgaacccagttgggtgttgtttcccatgctggcccaggg

SEQ ID NO: 6760785 - DNA, 107 bp, Homo sapiens
taggttccgatttagtaggtctggatgagactcagaattgctaacaaactctcagatgctggcagttctacttatccatagacatcgttttgaacaccaatgaccta

SEQ ID NO: 6760786 - DNA, 62 bp, Homo sapiens
cttagaaatgcagattctcaggccccgccctccagccactcgatcagaatctgcactttaag

SEQ ID NO: 6760787 - DNA, 84 bp, Homo sapiens
gctcagcctattgccaggcattcaaagaatggtaattattatcttacatagtttgtatattttgaatgtagcacagtgtcgggc

SEQ ID NO: 6760788 - DNA, 62 bp, Homo sapiens
atcttaaggtaagaggcttagcgtgatgcagctttctcatcaagtgcctttcacctctaggt

SEQ ID NO: 6760789 - DNA, 67 bp, Homo sapiens
attacacaaaacttagtctttcaatttgatatatgtttgcatgtctttgggggacttagtgtgtgat

SEQ ID NO: 6760790 - DNA, 68 bp, Homo sapiens
ttgctctaaaaatgcagcaattaatggataagaaccctggcccaatatggctccattcctttaggcaa

SEQ ID NO: 6760791 - DNA, 92 bp, Homo sapiens
acttcactttcctcatcagtgaaatggggctgagcattgtgtggtattggaaaagaataactgaagtgcttagttccatgctggaatgaagt

SEQ ID NO: 6760792 - DNA, 85 bp, Homo sapiens
atgtccccttagctacactgaggctgcttaattttgatacaggttggacagaatttatcttcagtgaggaaatctgacaggacat

SEQ ID NO: 6760793 - DNA, 62 bp, Homo sapiens
cttcagtatcagagttatttttctctcaggagagctaggaacacttaattcgatactagaag

SEQ ID NO: 6760794 - DNA, 112 bp, Homo sapiens
gtggtggtgcttccaccagtcccagcctgtgtgtttagctctggggctggtgttatgcaacatgttccatgctaagacacgcagggggcattctggggagacacacacacac

SEQ ID NO: 6760795 - DNA, 93 bp, Homo sapiens
gtttgtgtttgttgttttttgaaatgtatcagtataggtgtcaggcattttactgtctattcactcacatttctttatttgacaaatatttac

SEQ ID NO: 6760796 - DNA, 113 bp, Homo sapiens
atgaccgaatatggcagaagtgagaggatgtcacttttgagactaggttataaaaatactgtggcttctgtcttggtgtgatctctctctttccctctgtctttctctctcat

SEQ ID NO: 6760797 - DNA, 56 bp, Homo sapiens
tcactgttttatctcaagagttcaatgcaattgcttgagctgagataaatgcatga

SEQ ID NO: 6760798 - DNA, 78 bp, Homo sapiens
gtcatggaaataagtggtaccaagctcagtgaagagattttctttatgtacttactattactatatttaaaacgtgat

SEQ ID NO: 6760799 - DNA, 105 bp, Homo sapiens
gcaagatggcttatgatctaaggaaagagccagtgtccttcctgcggcaccagaagtcccagaaaggactttggttggcttggcttgggtctcacacccatctgt

SEQ ID NO: 6760800 - DNA, 68 bp, Homo sapiens
ggtcagggtataatcaagtgagaagggaaaacacaaaaaaatctacaccctggttcctaccctggatc

SEQ ID NO: 6760801 - DNA, 87 bp, Homo sapiens
gtatttgagaaacacaaggagtagagcatttagggctgaattttccagtaaaattgctatttaacttttatgtgtagtttcaggtat

SEQ ID NO: 6760802 - DNA, 81 bp, Homo sapiens
atttcttctaatgattctggcaaatttattatgaaaaaactcatggaatttgcaataacaggatgacaaactgggagaaat

SEQ ID NO: 6760803 - DNA, 129 bp, Homo sapiens
ctttgtaatataataaaatacaaaaaatgttgagtgattcacatatatgaaatgaggaattaaatgagcaaaaaattaatggtttttcaggggtcatgatatccacttaatatatgttatattatgagg

SEQ ID NO: 6760804 - DNA, 130 bp, Homo sapiens
tcccctggccgtcgcctcaacaggccggccgctgtcagggagcctggcccctcgcccagctcagggttggccgagaagctgggcgcagtggctggtgagatgtggctgcctgcaatcagagggcctggga

SEQ ID NO: 6760805 - DNA, 55 bp, Homo sapiens
gatctaggctcggctcagatgtgcttgtctcaaagcagtgagttaagtttagatc

SEQ ID NO: 6760806 - DNA, 127 bp, Homo sapiens
tgaggagggcagggaccaagtctgatgcatttctcttcccagtgtagctcaggactgggcacacagtcagtgcctattgaatgtttgctgagtgaattgtagaggacctgggctctttccctcctca

SEQ ID NO: 6760807 - DNA, 62 bp, Homo sapiens
ccacagtttgccagccaggaattgagtttggggtagtgtttttctgtgttggtagggtgtgg

SEQ ID NO: 6760808 - DNA, 130 bp, Homo sapiens
catgatgcaggatgagttttgagagataaaccatgaaggacttaggccttgctaagcattttggcctttttcccaaaagtacaggaaagcctagccattttattattttataccacccatccattacagg

SEQ ID NO: 6760809 - DNA, 85 bp, Homo sapiens
caatttaatatgtttgttatacagcaactgcagagcacagaattttgtactctttggatgtttatgataaggtacacattatttg

SEQ ID NO: 6760810 - DNA, 79 bp, Homo sapiens
aggccctacctacaaatacagtcacattctgaggtcttgggggctaggacttccatggatggattgggtgagggggcct

SEQ ID NO: 6760811 - DNA, 69 bp, Homo sapiens
tgtccacatccatcatgttcacagctatatccccaaggactttgagcaatgtctggaacagtgtggaca

SEQ ID NO: 6760812 - DNA, 130 bp, Homo sapiens
ggcataaaatgacaaaaggccacctgttattctttaaaaatgcagcgcataagctattttgactagatggttagataagtgaatgtgttcagcaaagattaatattttattatggtctttgaccagggtc

SEQ ID NO: 6760813 - DNA, 86 bp, Homo sapiens
agcctgggaaacatggcaaaaccccgtttctagtaaaaatacaaaatattagccgggtgttgtgtcatgcacctgtagtcccagct

SEQ ID NO: 6760814 - DNA, 70 bp, Homo sapiens
tgggcctgtgtgttcaggagcctccaaaccctcagtactgaggggtgtaggccctattcaatggggccca

SEQ ID NO: 6760815 - DNA, 70 bp, Homo sapiens
ttgtgtatttctggaacagactatagagagaagatttaatattatatttgtagactgtcctgaagcacag

SEQ ID NO: 6760816 - DNA, 92 bp, Homo sapiens
ggaagtgacacttctctgagagtacctggtatatgattatgatttctgagatcgtgtcaatgtattatgtatttgagaaacaaaactaaacc

SEQ ID NO: 6760817 - DNA, 66 bp, Homo sapiens
aagtcaaatgatctcctgggtatttgttggagaccacagaaacagaaccaggtgtcatttagactt

SEQ ID NO: 6760818 - DNA, 79 bp, Homo sapiens
acctccatgtggctcagttaacttccatgtagctgcctggttataaattgaggataactgtggtattccactcgggggt

SEQ ID NO: 6760819 - DNA, 77 bp, Homo sapiens
gaattctggttttgaaatgaatggttggaatgcattttctttgataaaatatgcacaaaattttagagctagagttt

SEQ ID NO: 6760820 - DNA, 89 bp, Homo sapiens
ggagtttcgctcttattgccgaggctggagtgcagtggcgcaatctcagctcaccgcaacctccacctcccgggttcaagcgattctcc

SEQ ID NO: 6760821 - DNA, 72 bp, Homo sapiens
aggccacaccattagtgattaaaggcagaatgttcatccccagagcccctttcttttgatcactgtgtgcct

SEQ ID NO: 6760822 - DNA, 63 bp, Homo sapiens
ttttctaccacagcctgtttctttttgttcgcttttcagagaaaataaattgatggtggaaga

SEQ ID NO: 6760823 - DNA, 95 bp, Homo sapiens
gcttgctacatatctaaaaatttgtatgttctaactttgtccatgaagccatagggatcaagaggaatattggcaaatgtagatgacagccaagc

SEQ ID NO: 6760824 - DNA, 76 bp, Homo sapiens
ggtcttataacctacttcagaggcagttaagagaatcattttcttgcctgcttcaggagaaaaggattagaagatc

SEQ ID NO: 6760825 - DNA, 95 bp, Homo sapiens
gtgtgaaatgagataacagaaatagtacagcatagttcttgatatatggtaagagctcaggaaatgttcattattaaatgttagttattttccac

SEQ ID NO: 6760826 - DNA, 64 bp, Homo sapiens
ggatgcctggaggcccagcaggtgcagcaggagccacttgctttacaagcctgcttcctcatcc

SEQ ID NO: 6760827 - DNA, 57 bp, Homo sapiens
tctgtccaacactctctagacatataattacattgtcttctttggagtgggagtaga

SEQ ID NO: 6760828 - DNA, 58 bp, Homo sapiens
ggttgaatcattctttgcaccgtccagttaaggtcctggttcgagggctgaatcaacc

SEQ ID NO: 6760829 - DNA, 72 bp, Homo sapiens
ggaattctagttaaaaatacagattcttgggctctacctcagacctacagagatctgcatttttcttattcc

SEQ ID NO: 6760830 - DNA, 58 bp, Homo sapiens
tgtctgtctgtccttctcattatgtgttcatttctatctggtgaggaagcagaagtca

SEQ ID NO: 6760831 - DNA, 83 bp, Homo sapiens
gagatacatttttaaacctatctaagaaatagccctgatattgaaatggcttctgtggaataggtttgacaggtgtaagtctt

SEQ ID NO: 6760832 - DNA, 66 bp, Homo sapiens
ggcagggacaggggttctgctccttctcacttcaccaccggcacacagcttgcccctgtctttgcc

SEQ ID NO: 6760833 - DNA, 72 bp, Homo sapiens
gttgaaccataggaaattgccaatatatgaccacttttggattattaaaacagtaatttcatacggtccaac

SEQ ID NO: 6760834 - DNA, 74 bp, Homo sapiens
ctccttctttatcagaggaggcatttaaacagaactaggtaacctcctttctggcctcctgtggaagccaggag

SEQ ID NO: 6760835 - DNA, 60 bp, Homo sapiens
aaatactagaattcagagttgacttgtttttcaggttatctgaaatattttttagtgttt

SEQ ID NO: 6760836 - DNA, 60 bp, Homo sapiens
tccagcttttattggatgaggatttgacttctctgagtctttcttaattggtaaaatgga

SEQ ID NO: 6760837 - DNA, 85 bp, Homo sapiens
agctcccagcattatggtatagtcccatagtcctgactggtcagaagccatgtggagactatagccataacaagctgtaggtgct

SEQ ID NO: 6760838 - DNA, 58 bp, Homo sapiens
ggctgtgctgagggggaagcccctctgcccactggatgagtccccctcattcacagcc

SEQ ID NO: 6760839 - DNA, 101 bp, Homo sapiens
gtttcatatttaagctgaattgagaaacttacaaatccagattgtctaacaaactctggcaaactgaattcaagtatccagtttcgactgcattgtgagac

SEQ ID NO: 6760840 - DNA, 74 bp, Homo sapiens
agtcaattttattttgttctggagagcgtgtattttaaaacccgtttgcttttccttaactgttaagattgtct

SEQ ID NO: 6760841 - DNA, 71 bp, Homo sapiens
gcggggatggtctgggcagccactggaggtagggtgcgatccaggaagcagctacagatccacctccctgc

SEQ ID NO: 6760842 - DNA, 79 bp, Homo sapiens
cctgtcttaaaagaagcagctaaggacaaagtaaagtgaagtaatcattcctttaaagaactgtgcttttcagggcagg

SEQ ID NO: 6760843 - DNA, 122 bp, Homo sapiens
tggctttccaggtgcagccgcagctccgtggcctgggtggctactgcctccctgaccctcccaggcctagagagggagtgccacacaaggcggccctgcaggcagcagacctccccaggcca

SEQ ID NO: 6760844 - DNA, 82 bp, Homo sapiens
ttcagtaaaagggaaatatttctcattaagatcttccaagaatgagctgtctttgggaggtaatgagttctctgttgctgga

SEQ ID NO: 6760845 - DNA, 58 bp, Homo sapiens
tctgtgacatcaggaccagatactccatccccagcatccagatgcctgatgtcagagg

SEQ ID NO: 6760846 - DNA, 76 bp, Homo sapiens
ccgccctcagtgtctggggccccagggcagagggtcaccatctcctgcactgggagcagctccaacattggggcgg

SEQ ID NO: 6760847 - DNA, 78 bp, Homo sapiens
atgtaacagaaacatagttgagacactgcttctcacaaatcattaatgaccagtgatgtcacaaactatggtgttcat

SEQ ID NO: 6760848 - DNA, 75 bp, Homo sapiens
catcagagccgtttcaaagcacagctcacattgcaccttctactgcgagccttctgctttggatttgcttttttg

SEQ ID NO: 6760849 - DNA, 64 bp, Homo sapiens
ctgcccttagcagattaaaggctgccaattaggagaggtggattgtgaattctgttagaggcag

SEQ ID NO: 6760850 - DNA, 88 bp, Homo sapiens
gggttgagcctgcctgcaggtgtgcttaacctgggccacagattaaggcaggtaagggagaaacacctgcagaggtaggttttgaccc

SEQ ID NO: 6760851 - DNA, 76 bp, Homo sapiens
ggagtctttcaccccatttgatttgcaggggatgtcaagcagaaacttcaaaatgcacaaagggctagaagactct

SEQ ID NO: 6760852 - DNA, 77 bp, Homo sapiens
gtaggtaacattgaagaaaatatgtaagacttgtagtatttgactgacaagtacataatttcatgttctaagcctgc

SEQ ID NO: 6760853 - DNA, 70 bp, Homo sapiens
cactggaacctggcagccctatatctgcagtgcacttctcagggggacttgttaggttttatatatagtg

SEQ ID NO: 6760854 - DNA, 59 bp, Homo sapiens
ctttttgcccattatgcttctagaatatggtatgttctggaagaataatgggcaaaaag

SEQ ID NO: 6760855 - DNA, 97 bp, Homo sapiens
aagttgcaagaatagggcaaaagaacgcacgttaaactttggctcagattcacctattgttaacaatttgcttcatttgttttatcatttgtttctt

SEQ ID NO: 6760856 - DNA, 84 bp, Homo sapiens
ttatactgtgattatgttatattaaggcatttgtagtgcagcttaagactgaatttatgctttttgtaaacatgatcggtgtaa

SEQ ID NO: 6760857 - DNA, 56 bp, Homo sapiens
ctgattaggctaagcaagagggtgcacgtggtcatttgaaggctttgtctaaacag

SEQ ID NO: 6760858 - DNA, 61 bp, Homo sapiens
tgtaacatggttcttactctcaaggagttcacagatacttactgagtgcttactatgtaca

SEQ ID NO: 6760859 - DNA, 74 bp, Homo sapiens
tctctgttgcctaggctggaatgcagtggcacgatctctgtccactgcaacctctgccttctgggttcaagcga

SEQ ID NO: 6760860 - DNA, 63 bp, Homo sapiens
tcattttttatgtggggaacaacaggctttgtgacaagtcaaatgttccaagctaatgaatga

SEQ ID NO: 6760861 - DNA, 64 bp, Homo sapiens
gctattaggcttccatttcatgcacaaatgaattatgcagagaatgccatagcttagtttcagc

SEQ ID NO: 6760862 - DNA, 61 bp, Homo sapiens
attttctcagcctccttgctggagcactgggcctgggctccagcagaaagggcgagtggat

SEQ ID NO: 6760863 - DNA, 61 bp, Homo sapiens
gaggggctagctaggctgggccaggatccctgtataaatggcccaggagctgtgccccatc

SEQ ID NO: 6760864 - DNA, 81 bp, Homo sapiens
cacatttcttcagagtagttggatttggggaacagggagtaatattttttccacaaatcaattctgctgaaggatggtgtg

SEQ ID NO: 6760865 - DNA, 86 bp, Homo sapiens
gaagcccagagggtcctccttccaggtccagggatgtggacaagtgccgttttgcattttcctagcctggaagatcctctggcttt

SEQ ID NO: 6760866 - DNA, 83 bp, Homo sapiens
ctgtatgggtatgatggtattaagaacaattccaaagacaaattacacttttaaatgttcatgatactgaatttatccctcag

SEQ ID NO: 6760867 - DNA, 57 bp, Homo sapiens
gttcccagttgcaatcccagtcccgtcaaacccacggggagctggaaactgggtgac

SEQ ID NO: 6760868 - DNA, 91 bp, Homo sapiens
gcaaatttagggcttgggtctggcttgttcccctccggctcgaaccacctcttctctgagccgagccagctaccggggctcctggaattgc

SEQ ID NO: 6760869 - DNA, 55 bp, Homo sapiens
ttgtcacatgtagttcattctcagtggtgaatttaggataaactatgtgtgacaa

SEQ ID NO: 6760870 - DNA, 68 bp, Homo sapiens
tcaatgtaagaggagagaagcatgatcttacagtttcttgtaatggttttcttccttctttatattga

SEQ ID NO: 6760871 - DNA, 116 bp, Homo sapiens
ttgcactttccagttgaggtgatgccccgccttgcttcagctcaccctccatgggctgcacccactgtccaaccagtcccagtgagatgaaccaggtacctcagttggaaatgcag

SEQ ID NO: 6760872 - DNA, 63 bp, Homo sapiens
gttgcccacgtgcgaggaccgggcaggggctcagcccctaggccgcccggtgcgtggggcggc

SEQ ID NO: 6760873 - DNA, 57 bp, Homo sapiens
accagtgttgtttcaagtagacaaggtagccctaggttgatttgagaagctgctggt

SEQ ID NO: 6760874 - DNA, 67 bp, Homo sapiens
gcccaggaggctgaattggggttctaggtgtgcagccttggtttcccttttggcctctcctttgggc

SEQ ID NO: 6760875 - DNA, 64 bp, Homo sapiens
gccaaggttggaggatcacgttagcccaggagttcgaggctgctgtgagcactccagcctgggt

SEQ ID NO: 6760876 - DNA, 99 bp, Homo sapiens
tgagctgagtcttcacagacattgcagactgaacccattaaaactgggttgctgtgtcttagtttgcagggtgttcagagtgacaaggcacatgtctca

SEQ ID NO: 6760877 - DNA, 80 bp, Homo sapiens
agggtcaaaactctggtttcagactcacttgctccaattcttatctaggattatgttagtttgtagagtagatgtgcctt

SEQ ID NO: 6760878 - DNA, 82 bp, Homo sapiens
tccattcagcaatactatagcctttcagagctcatgaattaaagacatgggcaatgtagattctgtagattcagtgtgtgga

SEQ ID NO: 6760879 - DNA, 108 bp, Homo sapiens
tcatcctccaggactttgtggtttatcagtgcatacagtgtgtcacctactgacccctggcaaactgagcatttgctggtggacctttagtgagcaccaggagggaga

SEQ ID NO: 6760880 - DNA, 110 bp, Homo sapiens
tgctgactgaggtgtgttggggggttccagggtgacaagtggcaaggagctgggtttgcccttctccccagccctggtattctgatcacctcctatgaactccattggcg

SEQ ID NO: 6760881 - DNA, 82 bp, Homo sapiens
gccgctgctatttcctcagagtctagtaaataataagcaatcaatacctgctgttgacttacctcttgagtgaattcagtgc

SEQ ID NO: 6760882 - DNA, 92 bp, Homo sapiens
tgccccagtgttctggcatgagagatgggggtgtcccagcgtatgttccaaaggatatccctgtgattgtgtgcagaagtacatgttaggca

SEQ ID NO: 6760883 - DNA, 86 bp, Homo sapiens
ccctgaagacagacacccagcctgctgtccccggcacactgcacagtgcctggcacatagtgggcatgcaggactgtatttgtggg

SEQ ID NO: 6760884 - DNA, 59 bp, Homo sapiens
ctctcccccatcacatttaaggggaaggaccacaggcccacctctcattgtgaggagag

SEQ ID NO: 6760885 - DNA, 87 bp, Homo sapiens
cagagaggagcaaggactataagacaaaagctttgagaaaaaccactggctgtgcttggtgtccttggatgattttttcactctttg

SEQ ID NO: 6760886 - DNA, 89 bp, Homo sapiens
cctttagtggttgtggcagtgaaccaaggctccaaacatgcttgcaccaggtgacttggtctcttgtgttcctgtcattcaccaggagg

SEQ ID NO: 6760887 - DNA, 58 bp, Homo sapiens
tctttccagggttttccgtacgctgactaatgcttacagctggctctctctggagaga

SEQ ID NO: 6760888 - DNA, 77 bp, Homo sapiens
ttgtccaagactgggagcagagagcggaagatgcaggaaaaactgctagagtcaaatctctgcccccagactgacag

SEQ ID NO: 6760889 - DNA, 89 bp, Homo sapiens
aggttatgtatctagtaagtagaagagctgtgattcaggcttagagtttgacttgagtcttggtttttgaatactacataacactgcct

SEQ ID NO: 6760890 - DNA, 86 bp, Homo sapiens
gcctgctggctcctgcattgttagtctatgcagatacctgattttgaatcttgaccatgtttgcgactagctgtatgatcttaggc

SEQ ID NO: 6760891 - DNA, 92 bp, Homo sapiens
gtaactagtagcaagcagattagaagatccatgagatcaagtatcatgtatcttcccccttaatcgctgtattaccaatgcaacctagtggc

SEQ ID NO: 6760892 - DNA, 56 bp, Homo sapiens
tacagtgctagaacctgctgtaatgaaagaagtggcagcagagtaatgcattcgta

SEQ ID NO: 6760893 - DNA, 130 bp, Homo sapiens
tgctctattagtaaaatcattttgaacatgcaccacagatatctgcgtatttattcactgatgatgtttatgcaatagtgtgtgtgtgtgtattgtttactgtatttatagtgaaatttctaatagaagg

SEQ ID NO: 6760894 - DNA, 93 bp, Homo sapiens
ctgctggatgaggagttctttcctgctgcctgatgttctggatcctgagcccacacccaggccctggcagggctgagtctcctctccctgcag

SEQ ID NO: 6760895 - DNA, 58 bp, Homo sapiens
ggggaaaattttattaactggatgtagccaacactgttggtgctccaccaatatcccc

SEQ ID NO: 6760896 - DNA, 62 bp, Homo sapiens
tcacttgcaaaaattattgtatattctgaaatagtggatgtaaaatacgcagtgcagtgtga

SEQ ID NO: 6760897 - DNA, 67 bp, Homo sapiens
tctgtattcagtattttccttgttaacttaagaaatattttttgttgatgataatactgatgacgga

SEQ ID NO: 6760898 - DNA, 71 bp, Homo sapiens
cctctatggcctcccattttctcaaatgtaaaatacatctggactagagcagaatgggaggtacaggatgg

SEQ ID NO: 6760899 - DNA, 130 bp, Homo sapiens
gtatggcaattccaagctaagctgtatattgaatgatgcatttgtttcccatcaaggtgcctggcacagcactatcggaagttagagtgtgttattccctcatacatcaaagtctgcttgccagtgtttt

SEQ ID NO: 6760900 - DNA, 87 bp, Homo sapiens
aaagtagtggcagagtcaataattttatggagagaattgggaattttgaatcctctccctttgttgtttcaagaaatgcactgcttt

SEQ ID NO: 6760901 - DNA, 57 bp, Homo sapiens
acaatgttttgaaacatctaggacaatgttagaccagttgtaggtgtttaacattgt

SEQ ID NO: 6760902 - DNA, 78 bp, Homo sapiens
tgtccttagggatataaaatattcaaaagtccaaaaagtggaagtctatgtggttttattttgttgtctctgatgaca

SEQ ID NO: 6760903 - DNA, 87 bp, Homo sapiens
ggcctacggtggggtggggtgtatcggatcctagcaggggaagagctgggatgtggcctctccaccctcctgtccgctttaaaggcc

SEQ ID NO: 6760904 - DNA, 88 bp, Homo sapiens
tgactcttacatgaatctagcaagaggtgaaggtttcattggcagaactctcaagtacctcccatcacccttgttttttctgaggtta

SEQ ID NO: 6760905 - DNA, 59 bp, Homo sapiens
tgtctgttgtgcttatagtcagcataaaatagttttgctgttgctaagtagtgcaggta

SEQ ID NO: 6760906 - DNA, 63 bp, Homo sapiens
gctcaagtcattactgaaatgtcacctcttcagtgaggcctgatcattttaaatggcaaccgc

SEQ ID NO: 6760907 - DNA, 90 bp, Homo sapiens
gtttttagttttgttctggcatctttgtcccagaagctgaatctaccatcagatcccacagttgcaagggtgccatgaacaggatggaac

SEQ ID NO: 6760908 - DNA, 76 bp, Homo sapiens
gccattcatttctgtgtttttctgtctggcctcacccttttggggaatgtacagaggacacaggggactcaatggc

SEQ ID NO: 6760909 - DNA, 57 bp, Homo sapiens
cagaaaacaaacctatcctgagacccgagctgtgtcctaggatgaaagtggtttctg

SEQ ID NO: 6760910 - DNA, 55 bp, Homo sapiens
ggcaggtgcgcatgttgcattagtgtcataaggtggcatgagactgtaccaggcc

SEQ ID NO: 6760911 - DNA, 56 bp, Homo sapiens
tagccacagagcattagatttcagagtacacttgagttctttctgttctgtcacta

SEQ ID NO: 6760912 - DNA, 96 bp, Homo sapiens
cgctggctgagtgcaagctggaggtccgaggtgagggcgtggccatccccaacactggctgacccttgctcgggccctgtgccagcctggccggtg

SEQ ID NO: 6760913 - DNA, 104 bp, Homo sapiens
tttgaatgggggtactggaataaatagctccggataaattttaaaatcactaatgaattttggaatgcccatggactggtcatgttctattaccagaatttaga

SEQ ID NO: 6760914 - DNA, 96 bp, Homo sapiens
tgtcaaaaccccttccctgaatgtgccttccaaggagtgaacttcaaattgacaattctaagaaactctttgggagccattagttgagctttgaca

SEQ ID NO: 6760915 - DNA, 84 bp, Homo sapiens
agaaattagtgggttgcctgctgtcctgtgtgtttacataacagggcacctgaggtaggaagggccctttcaggactgatttct

SEQ ID NO: 6760916 - DNA, 112 bp, Homo sapiens
tcaccttggagcttgttaaaattcaaattcctgggctccttcccgggttcctgtttcagtaggtccagggtggggtccaggaaccactgcgtttaacaagctccccaggtga

SEQ ID NO: 6760917 - DNA, 95 bp, Homo sapiens
gccaagctcttctgagtggcacaaatctagtccctggtgacctgctgccaaaaagcattcaaccaaaggaagctagaccctggccatgaagtggc

SEQ ID NO: 6760918 - DNA, 85 bp, Homo sapiens
gcatccagatcttggtttctaagtaccattatccagtaaaggagctagggcttcttgaagaaatggttggttctaaggcttgggc

SEQ ID NO: 6760919 - DNA, 67 bp, Homo sapiens
gagcttttataccttctctcagaaacacatagtaacattctggttccaaagagatggtgtagagttt

SEQ ID NO: 6760920 - DNA, 109 bp, Homo sapiens
tggacttacctcttttgcagttatcttcctattattagataatctacttggtaaaattgcatggtacaagaggattattaataaataatcattaaaaatggctagttca

SEQ ID NO: 6760921 - DNA, 57 bp, Homo sapiens
cagcttcttcagtcctggagctgaagtccacctgcttcatgattttacttggggctg

SEQ ID NO: 6760922 - DNA, 130 bp, Homo sapiens
tcctaaatctcaatatctcagaaggttactgtatttggagggtctttaaatagttaatttatttaaattaggtcatggggaggccctaatccaatatgactagtgtctttataagaagagaagattagga

SEQ ID NO: 6760923 - DNA, 61 bp, Homo sapiens
gagtggtggagcgcaggcttggatgcagatggcctgggttcacatcctggctgtgccactt

SEQ ID NO: 6760924 - DNA, 78 bp, Homo sapiens
tcacttgaacccaggaggcagaggttgcagtgagccaagatcataccattgcacattccagcctgggtgacagggtga

SEQ ID NO: 6760925 - DNA, 57 bp, Homo sapiens
gaagctcttgttgaatcttgtcatgacacgcatgactcctgagattacagagccttc

SEQ ID NO: 6760926 - DNA, 85 bp, Homo sapiens
taatctataaagttacgatttgtttacttataaatttatttttaataaagttgtgaaaccgaacatgttctgtttttgtgggtta

SEQ ID NO: 6760927 - DNA, 56 bp, Homo sapiens
aggaaggctgatcactgcttgttcttcttttcacatggcagcaaagaggccttctt

SEQ ID NO: 6760928 - DNA, 78 bp, Homo sapiens
cggcacagtcaaaggcatgcatggtctgctccccaggctggctgtaggagtagtgagatgcagtcattgctgttgttg

SEQ ID NO: 6760929 - DNA, 60 bp, Homo sapiens
cgtcctgagaccatggccttagtaaatactcattgctttcagccactgtgtttctgggtg

SEQ ID NO: 6760930 - DNA, 56 bp, Homo sapiens
gctacagtttctttaatcagctggaggtagtttcctccaatttttaagactatggc

SEQ ID NO: 6760931 - DNA, 79 bp, Homo sapiens
gagggatcagcgatggagaggtcctgatagttcccctaatggactttctctcctgcctctctgcctttactgttccctt

SEQ ID NO: 6760932 - DNA, 88 bp, Homo sapiens
ggtgtgtatgatctggtcgaatctttgtaacagtgaggtttgttcatcatgatcatcctcattttgaagatgagcagatctagactcc

SEQ ID NO: 6760933 - DNA, 102 bp, Homo sapiens
cagtctctttgtcccgatagccagcagaggctagggctgcccactcagctgggctgatctcccttttctcacagtgaatggtctatcaggcgacaggcactg

SEQ ID NO: 6760934 - DNA, 73 bp, Homo sapiens
tgttagaatgctctgagtgaaagttggatgtgttcttctacaaataaaatgtgtgaacttcagagcatcgaca

SEQ ID NO: 6760935 - DNA, 59 bp, Homo sapiens
tctggagcattttctgcttctgctagaacaggctagggaaggcaccatggtgttccaga

SEQ ID NO: 6760936 - DNA, 82 bp, Homo sapiens
gatgggagatcttaactgttctcacagtggctggtagagaggccttgggttcagcttttgtcagaaattgtaagaattcatc

SEQ ID NO: 6760937 - DNA, 58 bp, Homo sapiens
tgaactatgtaatgcatgggtagttatatggcgtgcattatatgtataacatagttca

SEQ ID NO: 6760938 - DNA, 112 bp, Homo sapiens
gtatttgaatatctttcattgggcaaaaagaagatggtattcatgatgcttttaaaagtttaaaggattagagataccatgccttactttctgcctaggatgtctttaatac

SEQ ID NO: 6760939 - DNA, 68 bp, Homo sapiens
tttgtattttgggggtagtttagacttgcgttataccaatgcaagtaaccatcactatctcttgcaga

SEQ ID NO: 6760940 - DNA, 70 bp, Homo sapiens
ttcatctcatctgttgattttaagtcttccaaaggttgctggaaagcatgattagatagatgattgtgaa

SEQ ID NO: 6760941 - DNA, 79 bp, Homo sapiens
tggaggatgcctggggaggcctaagggggaggtcagagacccagaaagccccctacacttcccagatgctgcgttccca

SEQ ID NO: 6760942 - DNA, 72 bp, Homo sapiens
gggtaggagccagcgccttgcctctggggcttcgctagagaagcctagggcgcggtcgtttgcatccatccc

SEQ ID NO: 6760943 - DNA, 59 bp, Homo sapiens
agaccaccagggaaaggtggcatgtgttatttatgctcaacctgaggtccctatggtct

SEQ ID NO: 6760944 - DNA, 69 bp, Homo sapiens
aggttgtactcctctttctgctaatagagacaacaccatttcttgggctgagagatggggtatttgtct

SEQ ID NO: 6760945 - DNA, 63 bp, Homo sapiens
gcatttgggttagagtctcagtgacatcaaggctgttgtcactgcagaaattttctcctgtgc

SEQ ID NO: 6760946 - DNA, 86 bp, Homo sapiens
cccttgcagcctctttgggggtgtcctcttttcttattcattcattcaacaaatgtttgtgaagctggatcctggagctgcagtgg

SEQ ID NO: 6760947 - DNA, 60 bp, Homo sapiens
gcctcctgttgtggctctagcctcagtggcgctgagctacagttgccctcagcaggatgc

SEQ ID NO: 6760948 - DNA, 81 bp, Homo sapiens
tcatcaagttagagagtatcagagcgaggattagatccaagacatggttcaatttctggctcgattctctgaccgggctga

SEQ ID NO: 6760949 - DNA, 100 bp, Homo sapiens
gtcaaaggattgagtttgacaaggaagatttacgctgaagtttagttaagctttagaacagatattgtaacttttctatgaaaaactaatgtacactgac

SEQ ID NO: 6760950 - DNA, 77 bp, Homo sapiens
gatattaaatctagagttcccagcataaataagatacgtgttctatttcatggctgtggaacatcagataaattgtc

SEQ ID NO: 6760951 - DNA, 58 bp, Homo sapiens
agccttcactgggaccttggatggctgccgaatgaagccatcacgtttcagtgaggct

SEQ ID NO: 6760952 - DNA, 62 bp, Homo sapiens
gtttggttctgatatagtgattgatttatgacaacataattgtttttatgttagggctggac

SEQ ID NO: 6760953 - DNA, 130 bp, Homo sapiens
aaactgaacctgtaagaagtgtgcctggcaagaactatgtgtcctgttaccggcagctttctatggaagcctggctgcatgtattaggagacatatcaactcaggaggaacttctttaaattgacagttt

SEQ ID NO: 6760954 - DNA, 75 bp, Homo sapiens
gatgctttaaatgtcttttgctttctttccagaactgtttatgaaggcagagagatatgcttttagtagagtatc

SEQ ID NO: 6760955 - DNA, 64 bp, Homo sapiens
tccaaatctctcttctatttgaattctcatttgaactctttcataggatagagtgagatttgga

SEQ ID NO: 6760956 - DNA, 61 bp, Homo sapiens
gatcgcctgctcatgctcctcattggccaaacccaactgggaggcaaagagcaaggaagtc

SEQ ID NO: 6760957 - DNA, 63 bp, Homo sapiens
ttgaataaagtagctttcagtgccaaggttaatgtatcaacttcaggtagttgctttgttgaa

SEQ ID NO: 6760958 - DNA, 61 bp, Homo sapiens
ttactgagagatggtgtgtttataaacaatcgtgtttacaaaagcacatatttctgagtga

SEQ ID NO: 6760959 - DNA, 81 bp, Homo sapiens
accagtgcccagcatcattaaggcagaattaaggcgtctcccactgtggaccctgttagtctttatagtggggcactttgt

SEQ ID NO: 6760960 - DNA, 101 bp, Homo sapiens
gcccaagaagccaactttaaggaggcactcatctcccagtgctagccttgtacttgcaaagccccaagagtgagtgcttccttaaaacatgcatcctgggc

SEQ ID NO: 6760961 - DNA, 114 bp, Homo sapiens
acacaaaagctttatgagaagtttctttaagtctctgcattagaatctattgtcaccttggtaggaattagaatctgaatgtagagctgaaaagaaccttaatgaaagctgtgt

SEQ ID NO: 6760962 - DNA, 80 bp, Homo sapiens
ggtggttttcagcagatgggttgtgttggcatgtggtatgcccgggataaacatttattgattaaaaaataagaaccacc

SEQ ID NO: 6760963 - DNA, 55 bp, Homo sapiens
tgtgacccccgtcacggctgctacctaacggtggctgccattttcaggggtcgca

SEQ ID NO: 6760964 - DNA, 129 bp, Homo sapiens
cctcggattttccatatcccccctcgccccgccccgcttccagtggtttgaaaggggtgtggttttgctgggaaaatggccgaccgctggggctgcgggagggagtgagggccgggggcggggacgggg

SEQ ID NO: 6760965 - DNA, 67 bp, Homo sapiens
gaccaggacagtggtgtgatgacagaagactcagtcagatattcttcttgttcagactattctggtc

SEQ ID NO: 6760966 - DNA, 62 bp, Homo sapiens
ggaggctgggctgggctgggttccaaggcagggcggagcctcccagggaagccgcagtcacc

SEQ ID NO: 6760967 - DNA, 89 bp, Homo sapiens
cgcagctgagccaattgctgggcagaaggaagagccacctgggacgttacttccaggtggatccaattctgcttagggcactcactgcg

SEQ ID NO: 6760968 - DNA, 130 bp, Homo sapiens
cctatcattccagcccaattctttctatggtgatgtccctgctgtcctgtttggtattttgaaggattccgttcaagcagcttttacagaagaggcgacaggtgcagccatctggagcttttagaaatgg

SEQ ID NO: 6760969 - DNA, 65 bp, Homo sapiens
ttttcgtccacagtctatttttagtctattatttagatagaataatatctatcctgtggtgagaa

SEQ ID NO: 6760970 - DNA, 58 bp, Homo sapiens
aggcacctcttaggctgctactgagctcttgaggaaacaacagcggccagaggagctt

SEQ ID NO: 6760971 - DNA, 55 bp, Homo sapiens
gctatgcttttctcaggtacccagggcccaacctctgcctgacttcagcatcagt

SEQ ID NO: 6760972 - DNA, 57 bp, Homo sapiens
gacgcaaccctttctgtaaccatatggccgaatcgtcatggaagaaaggtttgtttc

SEQ ID NO: 6760973 - DNA, 68 bp, Homo sapiens
gaggcagacggattacctgaggtcaggagttcgagaccaacctggccgacatggtgaaacgctgtctc

SEQ ID NO: 6760974 - DNA, 69 bp, Homo sapiens
ggctgggttgggggtccgtgacctggtgtgtttttacctttctcttggctgctgccaatttactttgtc

SEQ ID NO: 6760975 - DNA, 61 bp, Homo sapiens
aagccagtacagggatgtgttcacaagattactattgatgtattgaggctcttgctggctt

SEQ ID NO: 6760976 - DNA, 55 bp, Homo sapiens
gagctgctggaagtggagccctgactgtgagtcggccaaactccccccagcagtc

SEQ ID NO: 6760977 - DNA, 92 bp, Homo sapiens
gaatgcctttctggcttatgagctataatgtgtgcaggctaacttaggtgcatgtcattgctctaggcagaaactatgtgaactaggcgttc

SEQ ID NO: 6760978 - DNA, 62 bp, Homo sapiens
gtgtgattttcaaggtgactcaattttcaatactgaaattttgaatactcagaaaatgacat

SEQ ID NO: 6760979 - DNA, 68 bp, Homo sapiens
acctgactgaggttatgtgttctgtggctcctgtttgaatcacaggcttcattacttcagcgtcaggt

SEQ ID NO: 6760980 - DNA, 89 bp, Homo sapiens
tgtggtggggtgtttctggcatctagtgggtagaagtccaagaaggattcttctaacatcctacaatgcaaacaacagcccccaccaca

SEQ ID NO: 6760981 - DNA, 64 bp, Homo sapiens
tgacagaaagagccaagatccttgtcctgtggaaagcaatacaggtcctggactgctcttgtta

SEQ ID NO: 6760982 - DNA, 69 bp, Homo sapiens
ttatttagagagaatctggagtgcttcgtgctgtctctgaaggtaaccagaatctactcattggaatga

SEQ ID NO: 6760983 - DNA, 73 bp, Homo sapiens
gtcttaagaatgaatgctgagatttagctctagcttactagaatgcctactctctccattatgtcttacagac

SEQ ID NO: 6760984 - DNA, 61 bp, Homo sapiens
gctcacattcttggtcaccttgtggcccttgttgaggcccacagctatagggtagtgcagt

SEQ ID NO: 6760985 - DNA, 97 bp, Homo sapiens
taccatccattattgtgaactctctctaggcatctattttcagggggtagttaatgtagtcttttcctggtagtgatttagggagcattaggaggta

SEQ ID NO: 6760986 - DNA, 70 bp, Homo sapiens
ggattttagtggcatgttgttagtgtttcccattgaagtaaaatcctggcaaagacgctagctaagattc

SEQ ID NO: 6760987 - DNA, 78 bp, Homo sapiens
gaaatacagattctcaggcttcacccaggacctgctgaatctgaaactctctgggtggggctcagcaatctgtgtttc

SEQ ID NO: 6760988 - DNA, 79 bp, Homo sapiens
agggatttatttcatattttgattatttatgcaaacacattcatttagctaaaaataatgaaatatgaggaaggtctct

SEQ ID NO: 6760989 - DNA, 95 bp, Homo sapiens
tagtgcatctcttcattcacttctttcttagcaatctatggtttctaacatggccataccactgggaaaggactgaggaacaaggagatgtttta

SEQ ID NO: 6760990 - DNA, 116 bp, Homo sapiens
cttctgcaggtggttggattacatggtctcaaagctgctgtgaatttactgagagagttaaattatcaaatttcagttacctttacgttcatgtagaatcactatcatcttagaag

SEQ ID NO: 6760991 - DNA, 130 bp, Homo sapiens
cagcaacagaagatcagagcagagatgtggctaaacagtagcaggtatgaaaagacttagaggttctggtttctgtaagcttcaaatatctgtgatgcttgtgccaaaacagcttaagtagactgtattg

SEQ ID NO: 6760992 - DNA, 96 bp, Homo sapiens
caggtgtggctgttcattctacaggtgattcaggctctgggaaggtgtcctcccattgaccttgagtcattatagcaactattctagctacagctg

SEQ ID NO: 6760993 - DNA, 60 bp, Homo sapiens
ttttgtactagtgaggttttgtttggataaattccaagaagtggaatttcttggtcaaaa

SEQ ID NO: 6760994 - DNA, 65 bp, Homo sapiens
ccaagggtgtgagcatctgtaggagctgagctccggatcctgcagctgaagctcatgtgtcctgg

SEQ ID NO: 6760995 - DNA, 66 bp, Homo sapiens
actgagaaggtcacatggtgcatcactgccgctcagtctccccaagcccagtgatttcttcacagt

SEQ ID NO: 6760996 - DNA, 69 bp, Homo sapiens
gttgccggcagacccaaactctgcattcattgagtaccactgaatgccagacgtgtgttggccggttgc

SEQ ID NO: 6760997 - DNA, 68 bp, Homo sapiens
atttggtatctgttccaggcactcagctcctgtgtgcagaagtaagagggcccagaatgaggctaaat

SEQ ID NO: 6760998 - DNA, 65 bp, Homo sapiens
gttggagggcatgtgaaaatatctgcgttttctagctgttagataagaatggcatcttctccaac

SEQ ID NO: 6760999 - DNA, 120 bp, Homo sapiens
ggtccacgtgggcagggaagttggtgaagtcaatggggatgttctgcagctgcccctctcctgccagcctgcccccgtctgcccgactgttcttcaccactttgttgtccagcagggacc

SEQ ID NO: 6761000 - DNA, 76 bp, Homo sapiens
tcactccatcacccaagctggagtgcagtggctctatcttggcccactgcaaactccacctcctgggttcaagtgg

SEQ ID NO: 6761001 - DNA, 85 bp, Homo sapiens
tcaaatggtagtgcaatgttgcagaagcacatgtttacatgtaaagattatttatacacaaggtgtgcatttgtaaactatgtga

SEQ ID NO: 6761002 - DNA, 68 bp, Homo sapiens
cctcacatgcctgaggtggtctgcaaatgtttgtaaatggaatgaatggggattctcaggcaggtagg

SEQ ID NO: 6761003 - DNA, 75 bp, Homo sapiens
gaggagactgacagcagattctaccagcattacctttataaagtctgtgctcccctttctgctgttgtctctctc

SEQ ID NO: 6761004 - DNA, 62 bp, Homo sapiens
ggcctgcggcctgtggacttcatttagcagcctcggtcctgctgtccaggggatcgttggcc

SEQ ID NO: 6761005 - DNA, 56 bp, Homo sapiens
ggcagtcccaggctgcatgttgggtctagagaggctgaactgcagcctgggatgcc

SEQ ID NO: 6761006 - DNA, 111 bp, Homo sapiens
ctattcccctttctcctcctccctccccaccttcgcggtccctgcctctctccttcccatcccacggggcagggactcagtgagggaggctcagttggccccggtgagtgg

SEQ ID NO: 6761007 - DNA, 96 bp, Homo sapiens
tgccaacctcagatgcctggcctgtgcaggaaatgagctagtttttgtaaccccctactactgtgcctggcacacggtggcattcaagacatggca

SEQ ID NO: 6761008 - DNA, 92 bp, Homo sapiens
tttggtgagaagaacaaatgaacatataagcttgaattaaaaataaatataaaatttaaaaagtaagttacatttggaacttttggtccaag

SEQ ID NO: 6761009 - DNA, 79 bp, Homo sapiens
gaagaatgaatagatttctggaaatgcacaactaattggcagaatttctaagttagtgttgtccagactttcatccttc

SEQ ID NO: 6761010 - DNA, 83 bp, Homo sapiens
ccctctcaagaggctaatatggcacatgaacacagacatttcctctggtgtgtatgtggaccatgtgaagatgagggagaggg

SEQ ID NO: 6761011 - DNA, 57 bp, Homo sapiens
ggatttagagttctaaggacgggttgtccagcgcagcccagcagagaacctaggtcc

SEQ ID NO: 6761012 - DNA, 56 bp, Homo sapiens
gcagaggtcctagccaggagtcggcctcagttaacttgaacctctgggatgtttgc

SEQ ID NO: 6761013 - DNA, 65 bp, Homo sapiens
aacaagaacttctgactcaaccgtgagctgttttttccacagcaatctagagagaggttccagtt

SEQ ID NO: 6761014 - DNA, 88 bp, Homo sapiens
cgcctgcgggagcgaagggggcgggtcagggggctgcgggcgccctcgggcagcacagtttctggcccgccgcttcctgctgcaggtg

SEQ ID NO: 6761015 - DNA, 56 bp, Homo sapiens
gctgctctctccctaagttgggcttgagaaacagtttctataggagagggaggagt

SEQ ID NO: 6761016 - DNA, 57 bp, Homo sapiens
atctgaaagatgagtggtccattatcagttgagaatgggtcaaagaatatttcagat

SEQ ID NO: 6761017 - DNA, 125 bp, Homo sapiens
tctgttttaccaatttgcacagacttggacacagcagagctgacagttaaatggggatggtaataactgccttgaaagattgttgagttgatttgtgatcagttttgtgcttattggcacataga

SEQ ID NO: 6761018 - DNA, 71 bp, Homo sapiens
atttactttaatgcatcatggaaaactcagttttaaaaacatgcaaagctatgatgtattttgctgtgaat

SEQ ID NO: 6761019 - DNA, 82 bp, Homo sapiens
cagaaggaaagagctgagagggcgatcagaggaagaaaagaactttttccactgctacaacctcccagaatcccttcctctg

SEQ ID NO: 6761020 - DNA, 76 bp, Homo sapiens
agtcaacagcaaattctagcatgatcttgatgttcatggtcaagatatgtgccaattgttataatatgctgttgct

SEQ ID NO: 6761021 - DNA, 55 bp, Homo sapiens
gctagaaactgtttaatctcttttatatgaaagtaggattgaactatttctcagc

SEQ ID NO: 6761022 - DNA, 84 bp, Homo sapiens
ttattgtcccattttgcagatagagcatcaaggcaaagattaagtaacttgtccatggtccaatctagtaagtggtggcagtga

SEQ ID NO: 6761023 - DNA, 119 bp, Homo sapiens
aaatgaaaaggtgaccctacaaatctgagggttttgcatcccacagatgttgtattttctattcacattttgtggcagatgcagaacctgcagatacagagggctgaccatatttattt

SEQ ID NO: 6761024 - DNA, 79 bp, Homo sapiens
ggtggatgactatgtttcaagggatgagctgttgcatttttttactcagagcacctcaaatgaacataaatatcatacc

SEQ ID NO: 6761025 - DNA, 55 bp, Homo sapiens
ggacagattgagctaggcgtttctgaaaatgaaaaaccatggtgagcaatctgcc

SEQ ID NO: 6761026 - DNA, 77 bp, Homo sapiens
cttttacccaggggccatttgctagtctaaggggagcagctgaaaatgagtagcttcatggaacctgaggctagagg

SEQ ID NO: 6761027 - DNA, 98 bp, Homo sapiens
cactgaaattgccaatgatgtcaaatgctgcaaactcatcaaggaaaatgaagactgagaatgagttcattgcatttgacagttggagatctttggtg

SEQ ID NO: 6761028 - DNA, 88 bp, Homo sapiens
gaccaactccactaaaccctgtcctctcttgctcatcccgtacccctcaagaaatagaggaaaggtttgacttctgtgaaggatggtc

SEQ ID NO: 6761029 - DNA, 65 bp, Homo sapiens
ggaagctggagatgtccgggtgctgttgagcattttggacgaaaacttggatatctcctgtggcc

SEQ ID NO: 6761030 - DNA, 86 bp, Homo sapiens
aatttgatcaacctgggcctgatgcctgaaatatagccaaagagacagaatggggctgcggggagagaggtccaggatggaaagtt

SEQ ID NO: 6761031 - DNA, 98 bp, Homo sapiens
ctttctctgtctcctttgattttccttatagctagacccacctaaaagtgaagttacatatgtggatgtttatatgaagaataaaggacacaagaaag

SEQ ID NO: 6761032 - DNA, 67 bp, Homo sapiens
gaggccaggaccacacgacaggagagtcctgcaaagggaccctccacagctgtgtgtctccttcctc

SEQ ID NO: 6761033 - DNA, 92 bp, Homo sapiens
gacctgggcagggtggtagcaatgatagattttacaaattaaggcattgttctttatttcaaaattttcatttacctatattttccttggtc

SEQ ID NO: 6761034 - DNA, 58 bp, Homo sapiens
tcctggtaaagcaatctcaaaataccttattccgggtattgttctagctttaaaggga

SEQ ID NO: 6761035 - DNA, 74 bp, Homo sapiens
actagttttcaattgactttggaagaaagatttttgaatcatttcattcatgtgttaaaggtgaagtctctagt

SEQ ID NO: 6761036 - DNA, 78 bp, Homo sapiens
cacagctacaggagagctgggatgatccagtaccctgttcagaaggaccttgacccagctttccccacaatggctgtg

SEQ ID NO: 6761037 - DNA, 71 bp, Homo sapiens
accccgtagaatatgtcatgtcttagagaatgagctcacagtgattcattcctaacatggttcttaggggt

SEQ ID NO: 6761038 - DNA, 79 bp, Homo sapiens
gggggcagtcccattgctctgcaatcctccccaaagtgtttcctcttgggtggctatttcagagcctgggtgtgccccc

SEQ ID NO: 6761039 - DNA, 71 bp, Homo sapiens
ctgtgctttagcaagcattccaggacatttggcacagctcaagtccagcagtgcttgttgatctaagacag

SEQ ID NO: 6761040 - DNA, 60 bp, Homo sapiens
gtctttgcaaatcagcatggctatggatcccctgccaatagttatgctgcatgcatgtac

SEQ ID NO: 6761041 - DNA, 69 bp, Homo sapiens
gcttgtaggaagactcatcttggagaaaatgtgaagtaatcaaattgcttgagattagtctcctattgt

SEQ ID NO: 6761042 - DNA, 56 bp, Homo sapiens
agaagctgcctacatgaccagcccccaataaaagccttggttatttctaagcttct

SEQ ID NO: 6761043 - DNA, 73 bp, Homo sapiens
ctgcagaggaggcggtatacactgcacaccctcccaagtccatgcagtgccccgtgctgtcctcctcccacag

SEQ ID NO: 6761044 - DNA, 64 bp, Homo sapiens
gagtcaccatgatgtagtaaaaagatcaagatcaagaccttggatctggtttcatcatggactt

SEQ ID NO: 6761045 - DNA, 71 bp, Homo sapiens
tctagaagtttcagaaatcaaaaccagggtccaaaaccctgttctgtttttagtttctggcactgacatga

SEQ ID NO: 6761046 - DNA, 64 bp, Homo sapiens
attttcagttatagaatggtagagaaaagtgcattttcccatctacatcttgtggcctgaaaat

SEQ ID NO: 6761047 - DNA, 72 bp, Homo sapiens
gtcgtaggcctcctggtactccttgtggggcttgaccattatcacacaggtggggcacttggagcctgcggc

SEQ ID NO: 6761048 - DNA, 66 bp, Homo sapiens
gtgctattttagacatactttgtatgtttgagggacaactaagagcacaaagtgtgtggagagcac

SEQ ID NO: 6761049 - DNA, 64 bp, Homo sapiens
tagaacaggaagtgagaagcagcacagacaagacactgcttctccagaccactgcctctgtctg

SEQ ID NO: 6761050 - DNA, 104 bp, Homo sapiens
tggaactatcagctcttatctcagtgatcaacttgtccttgatgttaaaggtgggcctttgatgatacccaatgttgtgtccctggatattagtttcagttcca

SEQ ID NO: 6761051 - DNA, 71 bp, Homo sapiens
ccctggggcgcggaggacaggaatgcgggcggaggctattgaggcacgcctgcactgtcccgcctgcgggg

SEQ ID NO: 6761052 - DNA, 59 bp, Homo sapiens
aggcagcttttacttatctatgctgcccacgcttaacatggaaaactgaaagctgacct

SEQ ID NO: 6761053 - DNA, 63 bp, Homo sapiens
gcagtaccttatgctcatgatccatccatttatctatctaggtcatgaacattcactgactgc

SEQ ID NO: 6761054 - DNA, 71 bp, Homo sapiens
gggcttatatagctattccagccaagtgtgggagagatgtttctgcctggaatgagctggctaataacctc

SEQ ID NO: 6761055 - DNA, 58 bp, Homo sapiens
tcttgctgcctttcaatgttgtcatatttagatatgactcttagctaaaggtaagaga

SEQ ID NO: 6761056 - DNA, 55 bp, Homo sapiens
ggtgaatggtgtcctgactctagctttctaggatcttgggaagcccatttccacc

SEQ ID NO: 6761057 - DNA, 79 bp, Homo sapiens
gctgttaggcaaatcagttctatatttaaatatcattctgtccttttgatggttgaattcaaattgtgcctattatagc

SEQ ID NO: 6761058 - DNA, 83 bp, Homo sapiens
tctgctattctctgggctgtgggaattcaacagtgagcaagatgcgaactgtaccctttagaagctcatagtccaatgggagg

SEQ ID NO: 6761059 - DNA, 110 bp, Homo sapiens
acctgaagagcttgttaaaacacagattggtaggcctcactctcagagcttctgattcagtaggtttgggagggtgaggcccgcaaatttgcattatcaagttctcaggt

SEQ ID NO: 6761060 - DNA, 63 bp, Homo sapiens
tgtggctcccgcttgcacctaagatcaccttctccattgtctaccaggctagcgtgagccaca

SEQ ID NO: 6761061 - DNA, 123 bp, Homo sapiens
caggtctgctattgaaaaccttattagagccaatctttgggctcttggttgagagcttgtattacccgggaactagagacttggcagggatgggacagggaaaaattcaatgccatagacttg

SEQ ID NO: 6761062 - DNA, 64 bp, Homo sapiens
ggagggagatgggtactcgttggactgagggcacatctcaccaactctagcacctagtaccttc

SEQ ID NO: 6761063 - DNA, 85 bp, Homo sapiens
catatgttgatgcactatgttttctccatgttatgcttttgaaaaggaaagttcatcaaagagtaaatatttgtcaaagcatgtg

SEQ ID NO: 6761064 - DNA, 64 bp, Homo sapiens
gcagatatgcccataattatgtgtctataaataagaccatttccaccatgggcacattatttgt

SEQ ID NO: 6761065 - DNA, 79 bp, Homo sapiens
ggtttttcttgtttgctaaatccctataatattccttttcccatcaaggggatatgtgtgggtttgtgctagaatcact

SEQ ID NO: 6761066 - DNA, 79 bp, Homo sapiens
cattttactcctgactgattacattacatattgatattagtgagcatcagtatgtagtgcaatcagtcaggagaaaatg

SEQ ID NO: 6761067 - DNA, 73 bp, Homo sapiens
ttggctcaggcatatactctcagaaaaaaattttcccatagttttcttttctctaaggtattgaatgggccaa

SEQ ID NO: 6761068 - DNA, 66 bp, Homo sapiens
ctgggcgtggcagcggagctgggccagcgaagggggcatgccctggtagtgccgggtggcgctcag

SEQ ID NO: 6761069 - DNA, 55 bp, Homo sapiens
cagcatgtggtgattgggactgaacattttcagactgagggcatcacatacgttg

SEQ ID NO: 6761070 - DNA, 80 bp, Homo sapiens
ctgtgatgtctagtacatacaagaggcagcagtgggaccatcatcagatgaactctgtgtttactggacatcattcacag

SEQ ID NO: 6761071 - DNA, 79 bp, Homo sapiens
tacattttctacttttattatcactcccgtgtatattccagatgcaagaggtaaaatgaaaggagaaagcacacatgta

SEQ ID NO: 6761072 - DNA, 69 bp, Homo sapiens
gtggccttataagaagagacatgagggactttgcttatttcctctctgctctctgctctatgaggatac

SEQ ID NO: 6761073 - DNA, 74 bp, Homo sapiens
ttcggagagaccaagatttggcaactttgtcattctgcagaggaaagagtctgccagatccctttattccagaa

SEQ ID NO: 6761074 - DNA, 63 bp, Homo sapiens
cagcatgtgccttcggctcctggagcagaggatccctgtctctcagtgcacgcaccatgcctg

SEQ ID NO: 6761075 - DNA, 66 bp, Homo sapiens
tctgcaatctcattgttccctggggacacagagtgagtccaagagccagtgggaaaacattgcaga

SEQ ID NO: 6761076 - DNA, 69 bp, Homo sapiens
aggggctaggagtgacacaatggggcagagccagtaggctgtgtccccagcactcactctccagtgtct

SEQ ID NO: 6761077 - DNA, 57 bp, Homo sapiens
aggatggatgagtttggtccttatattatgaaagtgaccaaagaagccacccgtcct

SEQ ID NO: 6761078 - DNA, 61 bp, Homo sapiens
gggatttgtgtagttttgtccgtgctgttatatggtgcactgggcagagccagccagtccc

SEQ ID NO: 6761079 - DNA, 77 bp, Homo sapiens
tattactcaggccagagtccaactccagaaattctgactccgttggtctggagtgggactttgcatctttagtttta

SEQ ID NO: 6761080 - DNA, 75 bp, Homo sapiens
tgtcttcttcaaatctatatgttgatattctgattcccaatgtgaggatattaaaaggtggggccttaggagata

SEQ ID NO: 6761081 - DNA, 81 bp, Homo sapiens
tgaaaataaagtgtgccaccagtcaaggtgaataatgtctatagatttttcacctgtgttttgtggctgaatttatttaca

SEQ ID NO: 6761082 - DNA, 72 bp, Homo sapiens
catgaatatggtacaattttcatttgtggaggtcttctttaatggctttcaataatgttttgtgattttatg

SEQ ID NO: 6761083 - DNA, 80 bp, Homo sapiens
gcttgaaactgagatcaaggtgtcatttctctgcaggtgctaatattgcccatgatggggaaagataccatctaccaagc

SEQ ID NO: 6761084 - DNA, 56 bp, Homo sapiens
atctcaaatgattacaccaagcagccggcaagacccgctttgggtcatttagagat

SEQ ID NO: 6761085 - DNA, 79 bp, Homo sapiens
ttcctaaataagagatgtggaatcatttacaaggagaattatcacattgtgaagatacgccatcttcattattgaggaa

SEQ ID NO: 6761086 - DNA, 85 bp, Homo sapiens
aatcagtttggtcagtgatgcagatttaattagtatagggtaaggacctggtatttttatagtttgtaaagctccccagatgatt

SEQ ID NO: 6761087 - DNA, 70 bp, Homo sapiens
gtggatgggttatctctacaggaatataatcaataaggtgtgtattcaggtcgagctaactgcttgtcac

SEQ ID NO: 6761088 - DNA, 79 bp, Homo sapiens
cttaattttatctcaccttccaatacagcctgagataagaacttgtgtctgggctttgtaatgggaggtagattatagg

SEQ ID NO: 6761089 - DNA, 78 bp, Homo sapiens
tgtgagtttggaagctgggttacttgggctttgaagtcttacttagtccaccacccatgctcctctatcttgctcaca

SEQ ID NO: 6761090 - DNA, 106 bp, Homo sapiens
gtgggaagccggtccccctggtgggttactcatgtccatcccccgtttgcaagcactgatggggatgagaagtgagcagagaacagggtgggccacgaagtccagc

SEQ ID NO: 6761091 - DNA, 58 bp, Homo sapiens
tgccctggaggggcttacagtccagcagacacatggctctgtgagccacttgggggca

SEQ ID NO: 6761092 - DNA, 57 bp, Homo sapiens
catagaaacttgcagcaagcacgctttcttcctgtgtgtttgtctgcaccttccatg

SEQ ID NO: 6761093 - DNA, 56 bp, Homo sapiens
ctgctggctagataaaaccagccaaggcctccttggctcacctgtctacccagaag

SEQ ID NO: 6761094 - DNA, 68 bp, Homo sapiens
aaaaagtaatcatttttatttgcattggcatttttgtcaattcagactgagaaatgatgagccttttt

SEQ ID NO: 6761095 - DNA, 55 bp, Homo sapiens
taccaaaagcttgtttcatacaaaattttagtttgtatgaagtgttcttctggta

SEQ ID NO: 6761096 - DNA, 56 bp, Homo sapiens
tcaaagatttccatttctagctcattggccattcccatgtgcagggaaatctgtga

SEQ ID NO: 6761097 - DNA, 61 bp, Homo sapiens
agcttccatactaagacaaaagggtgtaattatgtgatttttgtctttagctatggatgct

SEQ ID NO: 6761098 - DNA, 61 bp, Homo sapiens
gagaaaaagcaaaatatactcagaaaaaacattccttttcgtgagtgggtagcttattctt

SEQ ID NO: 6761099 - DNA, 83 bp, Homo sapiens
gtgaagccgagcgggtgtccccacgaggtggtcagtcctgcccctcttgtagaccacctgtgggaaaggtctgctctctttac

SEQ ID NO: 6761100 - DNA, 71 bp, Homo sapiens
gtaactgagagtgtggcttccaggcccgcactgggagggaacagtgggtggtttggatgccatacctttat

SEQ ID NO: 6761101 - DNA, 85 bp, Homo sapiens
tagatatagacatgtggtataatcaggggactagatcgtgcatagaaatgcatgtacaaacccttgattgtctataggtcttcta

SEQ ID NO: 6761102 - DNA, 67 bp, Homo sapiens
tgtggactttgtaatagtttaaggtcaagtaaagtttccactttccttaggctgtttgcagtgccca

SEQ ID NO: 6761103 - DNA, 69 bp, Homo sapiens
tgagtactttggagattgcgtaagttgccttgctgcatgcctgttaacttagttcaatatcagtgctcg

SEQ ID NO: 6761104 - DNA, 56 bp, Homo sapiens
gtaacagaagagcaggcagccctcagtttccgaaagggttgtattctcaatgttac

SEQ ID NO: 6761105 - DNA, 74 bp, Homo sapiens
aaggctaaggtttttcaggttgttaattccaaagtcaaataatttgaaacaaatttggaaaatctaacagcttt

SEQ ID NO: 6761106 - DNA, 87 bp, Homo sapiens
agtgaccaatatacaatgctctctttcacagaggtaggatccatggattcagcaaagctgtgtgagatgggagttattcctttcact

SEQ ID NO: 6761107 - DNA, 55 bp, Homo sapiens
ccaagtgtcttcaaaggctaaaacaccactattgtttcaagcataaggcacttgg

SEQ ID NO: 6761108 - DNA, 61 bp, Homo sapiens
acttctgcaggccctgtctgaccgtgactcagagtcaggtcgatcagtcatctgcagctgt

SEQ ID NO: 6761109 - DNA, 83 bp, Homo sapiens
caagcagtgagtgaatcctcctgggtgccaggtattgggctaggaacttcagccctgggcagccaaggaagcatgctggattg

SEQ ID NO: 6761110 - DNA, 58 bp, Homo sapiens
gtattctgttgcagccaagtcgcacagaaatagacagggcctggctgctgtgggatgc

SEQ ID NO: 6761111 - DNA, 70 bp, Homo sapiens
agcctgccttgggctgcttgagaacctctgctgagtcagcactcactggggcagcggcccagccagagct

SEQ ID NO: 6761112 - DNA, 64 bp, Homo sapiens
cttatagaatctccagcattggttgtcgtatctgtaaaagacaggcagccgtggagactaggag

SEQ ID NO: 6761113 - DNA, 120 bp, Homo sapiens
gatgcagttatatcagataaacccattttaagctgaaaatatggtgaagttgaagaagcacttctgccttacgatattttcaatttataatggatgggtttattcagacataactccatt

SEQ ID NO: 6761114 - DNA, 64 bp, Homo sapiens
gccaagagctcagaaacccttgctgtgtgccccacagcagcagaaggtaaatctgagcctgagc

SEQ ID NO: 6761115 - DNA, 55 bp, Homo sapiens
ccagatgtatgtatgagtgcataatcatggttatgtgattagctgaatacactgg

SEQ ID NO: 6761116 - DNA, 61 bp, Homo sapiens
gcagctgatgaaaatgttgttacactcttgaagaacaagggctgttatgtttttatactgc

SEQ ID NO: 6761117 - DNA, 63 bp, Homo sapiens
tgagtttcgggctctagatggaattgagaaggtccaacttgctcagagggccctggaggctca

SEQ ID NO: 6761118 - DNA, 72 bp, Homo sapiens
taggctgggggattcgctggtgctgggactctcatcctacaacttggattccagttaatggttcccagtctg

SEQ ID NO: 6761119 - DNA, 57 bp, Homo sapiens
tgccaaggagccctggcctctcacttccttgatactgaccaggccccgggccctgca

SEQ ID NO: 6761120 - DNA, 112 bp, Homo sapiens
ctcctcccaggcctgtgtgtggtgggccatgccaggctgcctgggaggaggaaggtggggagctcctcccaggcctgtgtgtggtgggccatgccaggctgcctgggaggag

SEQ ID NO: 6761121 - DNA, 75 bp, Homo sapiens
caggttgtgtgaaacaatggttctgtcagttgtcaaaattattttcttacaatcattggcttcattacaacactg

SEQ ID NO: 6761122 - DNA, 87 bp, Homo sapiens
gaccgtatctcttctcttttgatgaccagcatgctctaggttctctcctgctggcacgtggaccaggagaagttagcagatacggtc

SEQ ID NO: 6761123 - DNA, 65 bp, Homo sapiens
gggaagcattcctgatgggttttttttggggatcagaactagcaaaagctcaacaggaaggtcct

SEQ ID NO: 6761124 - DNA, 70 bp, Homo sapiens
ttctccaagtctgacagccttatcagtaacaattgtctatgtctctaaggctaatcaggcttaaaaagaa

SEQ ID NO: 6761125 - DNA, 82 bp, Homo sapiens
cactgaggcccaggaaggtggtctgtggctcgtgtgttgttgctggctgttgagctaggcctgctttcctgccccctcagtg

SEQ ID NO: 6761126 - DNA, 68 bp, Homo sapiens
ggttttaagaagagcagcagccattgaaaccagcacgaaggctgggctgactgtgaaattctggagct

SEQ ID NO: 6761127 - DNA, 59 bp, Homo sapiens
cagagcagaaacctgggtgattcttttactcccagagagagatgcccaactctgttttg

SEQ ID NO: 6761128 - DNA, 74 bp, Homo sapiens
tctctaaagaggcagacaaggctggcttccataaagagcaagggaagaggccttggtctgacctgaggaagagg

SEQ ID NO: 6761129 - DNA, 76 bp, Homo sapiens
tcttctgagtgggaagaattctgcaacaccctgtagcttgtcgctgcaatgaattacttcccaaacttcacaaaga

SEQ ID NO: 6761130 - DNA, 63 bp, Homo sapiens
ttgagttttgcatagagaagtgacataaaacgtgatcacttataaaatgcaagatctgcttaa

SEQ ID NO: 6761131 - DNA, 71 bp, Homo sapiens
tccaggtgcctttgttttcatctcactttctggcataggatgctctaaacttgtaaacaagcatatctgga

SEQ ID NO: 6761132 - DNA, 83 bp, Homo sapiens
tgagatccacaggtccagtgtgtttatcttggattataaatctactttttggctggacacagtggctcatgcctggaatctca

SEQ ID NO: 6761133 - DNA, 77 bp, Homo sapiens
gcagtgcctactttaaatgcaaatgtaagggtgggatcatagaaattatccaatttgcattttctagttcatgctgt

SEQ ID NO: 6761134 - DNA, 85 bp, Homo sapiens
gcctacctcataagattacagtgagaaataaaatgctttattaacattgttagtgtctgtgctgttgtttaaaagagggttgggt

SEQ ID NO: 6761135 - DNA, 70 bp, Homo sapiens
ttggattgttaacttgcaagctgaagaatgaaggataattacattcttgagtttgcaagttaatgtccaa

SEQ ID NO: 6761136 - DNA, 82 bp, Homo sapiens
gcagcgtgggggtgaggcagaggcccctgcccactggtcccagagacagagctggcagggaccttgcccaccctcctcctgc

SEQ ID NO: 6761137 - DNA, 106 bp, Homo sapiens
agaagcctctggaaattcaatcagatatgtgacatatttgtctgaatcatcaaagctaagaaaatgtaataaatatggtcacttgattgaaggacagttgcattct

SEQ ID NO: 6761138 - DNA, 59 bp, Homo sapiens
ccaaagtccacagtttacattaggattcactcttggtgttgtatattctatgggcttgg

SEQ ID NO: 6761139 - DNA, 87 bp, Homo sapiens
gcggcggcaaagactgagacagctccgctgcccgctgaactccatcctcccggcggtcgggcggcggcggctgcggtcggtcgcggc

SEQ ID NO: 6761140 - DNA, 101 bp, Homo sapiens
gtaatatcatttcattaatgaacatatgacaaagtgattttggtagagatatgcttgccattgtcattccagtcattgttaatgccagaaaatgatgttgc

SEQ ID NO: 6761141 - DNA, 57 bp, Homo sapiens
ggctgtatcttgtgtcagtcatttttgcaaatgcagcattttgaccaaaatgcagcc

SEQ ID NO: 6761142 - DNA, 66 bp, Homo sapiens
gtgacctctgtcctgcagtctggaaactgccttcaagcagtaagttagggcagtgatagggcccac

SEQ ID NO: 6761143 - DNA, 129 bp, Homo sapiens
ctgacagccctgtgtcttttcaaagtcaataagtggatttttgtgcctctaatggagagagcctcttctgaggaggagcaaaaactctagaagctttgatctctggaaatacaggataaaagctctcag

SEQ ID NO: 6761144 - DNA, 63 bp, Homo sapiens
cagggaaactaggaaataagctctctgggactgacccaggcacagctaaccctactttctttg

SEQ ID NO: 6761145 - DNA, 68 bp, Homo sapiens
tgatgcacatacacatgtatgactttgtaacaagtgaattgagtcattaaatgctgtcatggcactca

SEQ ID NO: 6761146 - DNA, 65 bp, Homo sapiens
aaaaccacttccttgctattgggctgttgcaaaagataatagataatagtttcagaagttgtttt

SEQ ID NO: 6761147 - DNA, 70 bp, Homo sapiens
gaccagtcttgggggtgtcagcaccagcccctggccccctgcctggggctggcatacccctcctgctgtc

SEQ ID NO: 6761148 - DNA, 66 bp, Homo sapiens
gggggtggatcacctgaggtcaggagtttgagacaagcctggccaacgtggtgaaaccccatctct

SEQ ID NO: 6761149 - DNA, 94 bp, Homo sapiens
cctgtcatctctagggtttattaattctctggaattctagtaaattgctaatttatcagaagttagagaaagactttagtcaaaaagattcagg

SEQ ID NO: 6761150 - DNA, 93 bp, Homo sapiens
actgaggcttaaagaacttggggttgtgggtggcttattaagacattctaatgccattttgaaaccaagttatttccttcaaaaaccctcggt

SEQ ID NO: 6761151 - DNA, 82 bp, Homo sapiens
aactgtagcaattattttttccattcatcagtgacaaaaatatgttagtggaacatgaattgaaagaagaatatctaaagtt

SEQ ID NO: 6761152 - DNA, 65 bp, Homo sapiens
tttctctggcattaggtataaaagtcattctgtgtaacttggctccaatatcacttgtagagaaa

SEQ ID NO: 6761153 - DNA, 56 bp, Homo sapiens
gggctctgtttagaccagagatcagcaaactatggtctgtgggccaaatacagccc

SEQ ID NO: 6761154 - DNA, 67 bp, Homo sapiens
ctcaaggtttctctcaggccccattcctgttgcaaagtgtatattgcaaacagaactgagatttgag

SEQ ID NO: 6761155 - DNA, 81 bp, Homo sapiens
agcacagctgcatccatgaccctctcaacaaccctctggagagcgggtgctctaggggttggaggtacagggtcagcgtct

SEQ ID NO: 6761156 - DNA, 81 bp, Homo sapiens
gctgtacccacgctgccgcactcggctcctgatttcctcctcgggagatcagggctcagtgggccttgctggtgtatttgc

SEQ ID NO: 6761157 - DNA, 85 bp, Homo sapiens
gtctaagttctgataagctgctcattaagccataacagtttgttatggcttaggagagtttaactgtacattcaggttcttaggc

SEQ ID NO: 6761158 - DNA, 55 bp, Homo sapiens
gtccttagcaacaggcaggagacagcaaagttcccagtgcactgtgctgagtggc

SEQ ID NO: 6761159 - DNA, 129 bp, Homo sapiens
cagtaaagctttggtccctttctctcacttatttgcctggaaagagagagctgtcctgggacaccctgatccaggtcagggtgggcggtttatctctggtgaaggagaggagctaaagagataattctg

SEQ ID NO: 6761160 - DNA, 65 bp, Homo sapiens
ctggcattaaaagatctgtgttaactcaaggaaggtggctccattcccaggtttgattgagccag

SEQ ID NO: 6761161 - DNA, 77 bp, Homo sapiens
ggtatgactaaagggatagatttatgtctttgagttaagttggctaggaaggcattttatgccttatagttcttgcc

SEQ ID NO: 6761162 - DNA, 56 bp, Homo sapiens
cccgggaggaggaagttgcagtgagccgagatcatgccactgcactccagcctggg

SEQ ID NO: 6761163 - DNA, 70 bp, Homo sapiens
tgtagctactgtttactgtgtaatataaccctgaagattaggttacagttaccacttagcagttactaca

SEQ ID NO: 6761164 - DNA, 57 bp, Homo sapiens
agattatgctggctgctacaagtaaacagaatatgggaagtgggagttagttagtct

SEQ ID NO: 6761165 - DNA, 86 bp, Homo sapiens
actatgaaatcgacgtgtaatgagtcacttaccttaaagagctagaaatgcttttaagccaaagggaccattactgattaaatggt

SEQ ID NO: 6761166 - DNA, 59 bp, Homo sapiens
cccagtccagaccatgacctcaggcccaggctggggctggggcttgggctggggctggg

SEQ ID NO: 6761167 - DNA, 70 bp, Homo sapiens
tgcagtggaagccatgataaccagtgtggaagaacttcatctacatttacacagttaggcttaaacttca

SEQ ID NO: 6761168 - DNA, 83 bp, Homo sapiens
gggaatatcgttgctcatgtagtatgtagggttggagagcacaaccactgtctggtctgtcccactctgcccttgagcttcct

SEQ ID NO: 6761169 - DNA, 56 bp, Homo sapiens
ttgagtagaaagggttgtatagtgagcaaattattcccagcctctttctatctcag

SEQ ID NO: 6761170 - DNA, 56 bp, Homo sapiens
ctggtggaatagcatatcagttacagcatatgactgtaactgatcattttcaccag

SEQ ID NO: 6761171 - DNA, 63 bp, Homo sapiens
gagacaacccaagtgaaagtgctacgtaaattctagaatgccgtagacttttacttatgtttc

SEQ ID NO: 6761172 - DNA, 86 bp, Homo sapiens
atagagagtgataaaatagaaacagtggtccagaattatctactctaaatgcccttgaatttctgtctcccatttattgcctctat

SEQ ID NO: 6761173 - DNA, 59 bp, Homo sapiens
tggggtaggtatgaaaactagggtaataagatgcttgattgttttcaggtttgccacca

SEQ ID NO: 6761174 - DNA, 58 bp, Homo sapiens
ggcagctcccagcaactcactgagaactggaaagtttccaggaagggttgggagggtc

SEQ ID NO: 6761175 - DNA, 61 bp, Homo sapiens
cccaatatattcttaaagaatctgacccatacctgggcagtaggagaagaggatgcttggg

SEQ ID NO: 6761176 - DNA, 64 bp, Homo sapiens
gcattacatgctcttcaaggactcatatctatttggtgtgtgtgcttgtgggcatggtctgtgt

SEQ ID NO: 6761177 - DNA, 80 bp, Homo sapiens
ttcccactcttggatctcgaagactaagcatctctgatcaagcatctctgatcaagcatcttggtctacgatcctgggag

SEQ ID NO: 6761178 - DNA, 58 bp, Homo sapiens
gaacctctttagtgcatccttcacgttcttgttcctgaggctgtagattagagggttc

SEQ ID NO: 6761179 - DNA, 71 bp, Homo sapiens
gctgctcactggtggatggactctcgggggccctgctggccaggacacccccgggcatccacaagggcggt

SEQ ID NO: 6761180 - DNA, 69 bp, Homo sapiens
gtggaatcgtattacctttgggattaggacatttcattgtcattattcaccagtgtaaaacacttttac

SEQ ID NO: 6761181 - DNA, 73 bp, Homo sapiens
accccgaccctacagacagtgctgagctgcctctgaagacctggggcttggctttgggaagtaggggggaggt

SEQ ID NO: 6761182 - DNA, 88 bp, Homo sapiens
gaggaatgaagtttcaccgtgaaccgattcctcaccaaagaaacaaaaactggtggcatcgagacgcacgggaggacttcaagtcctc

SEQ ID NO: 6761183 - DNA, 60 bp, Homo sapiens
agcgtccctgactttcacctggcatcagcaaaatggtaaatggagaaagcagggaatgtt

SEQ ID NO: 6761184 - DNA, 76 bp, Homo sapiens
gccctgggaagggcagaaagggacgctttgtattagtaggacaaagctgtgacttttagcctttcaaaatgagagc

SEQ ID NO: 6761185 - DNA, 62 bp, Homo sapiens
attataaatggcaatttagtttatttagacaatatctttggatgaaatattgcatttatgat

SEQ ID NO: 6761186 - DNA, 64 bp, Homo sapiens
cggattttagtagtctttagagatcatttaccgcaatgatttccaaaaggcttctaagggcctg

SEQ ID NO: 6761187 - DNA, 69 bp, Homo sapiens
attttgaaatacttgaaggaaaaaggttaagaacgtagtttcacaaaccagtctttaagttgtcagagt

SEQ ID NO: 6761188 - DNA, 84 bp, Homo sapiens
gttagaaatgcaaattctaggcccctctccagacctactgaatcaggaactctggaggtggtgcccagcaatttgtgttctaac

SEQ ID NO: 6761189 - DNA, 70 bp, Homo sapiens
tgggaatctggctctctcatttacaaaaggaaaactgtcctttagtttttgcaagatgttaggtttccca

SEQ ID NO: 6761190 - DNA, 56 bp, Homo sapiens
tatatactatgcgattcctgccttaaaaactgcaggaatggcaccattagcatata

SEQ ID NO: 6761191 - DNA, 90 bp, Homo sapiens
tgggtgagtgagtgagggcttgaccgtgatccaagagtctactccacaagctcgatgcaggccttgggacacccttcacttgtttattca

SEQ ID NO: 6761192 - DNA, 73 bp, Homo sapiens
gcagcagagctctttgaacctgggcagtctgctcctgacacacgtcaccactcactaggttgagggcctgggc

SEQ ID NO: 6761193 - DNA, 76 bp, Homo sapiens
tcaccctgagcagctgttacagagtgtctctgatattaatcacacactccctccaatggcagtgaccttagggtga

SEQ ID NO: 6761194 - DNA, 60 bp, Homo sapiens
gcagagggtggggcatgccagtttcctgagctaaaaggaaatatatgcaatgctttctgc

SEQ ID NO: 6761195 - DNA, 119 bp, Homo sapiens
ggagaagaagactgaaaggataattgagaggattgaaggatttgttgatttctagtgctggtggaatttacgtatgcccttcaattttgtattgtttaaaaattttcatcttccttttc

SEQ ID NO: 6761196 - DNA, 55 bp, Homo sapiens
ctcctaggtgctcactggggtccggggaggtacagcccccatgagcactggggag

SEQ ID NO: 6761197 - DNA, 98 bp, Homo sapiens
gacaactgtttttgcattttagagacgcatactgaagtatttagggtaaaacgtgtgtcagtaatattctttaaaatactcaagcaaaaaaaaaagtc

SEQ ID NO: 6761198 - DNA, 65 bp, Homo sapiens
ggttggatggtcttggctcggagtctccatgaaattacagttagatatcagctggggctgcagcc

SEQ ID NO: 6761199 - DNA, 67 bp, Homo sapiens
ggctgatatttgcccaactgccctcccactagtctaaactcttgagggtaagggctgtgtcttagct

SEQ ID NO: 6761200 - DNA, 77 bp, Homo sapiens
agggagcttctaattcactttgggaagccactggaaaaggctttcccagaaatgttgaatatattgtagaatgcctt

SEQ ID NO: 6761201 - DNA, 95 bp, Homo sapiens
tgtatatgaaggtgagattgcatttaggtaaacacttttgtttctttaggggtgacctcagttagtgtttagttaagatttcaaaagcttgtgca

SEQ ID NO: 6761202 - DNA, 88 bp, Homo sapiens
ctacctctgaagtttttcccagagaagtgaagatgtaattttattcactcgaatgatgtgagtttttattctcagctctcagaggcag

SEQ ID NO: 6761203 - DNA, 75 bp, Homo sapiens
gattacttttattgatgcttggattgggccatctctggccagttggctctttctgacacagccctaagagtgatc

SEQ ID NO: 6761204 - DNA, 85 bp, Homo sapiens
tagagctttccatagaactctgaggccagagcctgctagactctagggccagccctggccttgtggttttaaatggaaagctctg

SEQ ID NO: 6761205 - DNA, 83 bp, Homo sapiens
ttactgcttgccaaagataatattcattaactagagttcacatctcatgctctggattaaagaaattatttgcaagcaagtaa

SEQ ID NO: 6761206 - DNA, 69 bp, Homo sapiens
tgccattacttggggaggataaaaggagagggaagaaaactagcttccttaaatatctaccctgtggca

SEQ ID NO: 6761207 - DNA, 55 bp, Homo sapiens
ccccagaacacatggacatgaatctacctattctgtgattctctgagttttgggg

SEQ ID NO: 6761208 - DNA, 78 bp, Homo sapiens
tggccttttctttagtaatgtagcagtttatatgttctagattacattatagactactgctacttgaagggacagcca

SEQ ID NO: 6761209 - DNA, 124 bp, Homo sapiens
tcctgtttgtttcttatcatcacacagactcagaatctgccaagttcaggaatccacttcggctgtctgggttgtcttggtgaggatgatgatggtcatgttaaaggtgaaagagacagctgga

SEQ ID NO: 6761210 - DNA, 70 bp, Homo sapiens
aagcttcttgaccaagcctgtaacttgaaaatcgcttcagaatttgccaactgtttggttaagtgacctt

SEQ ID NO: 6761211 - DNA, 59 bp, Homo sapiens
cctgagctgactctcctttcagacagctaaagaccttgaaagcaagaagccagcacagg

SEQ ID NO: 6761212 - DNA, 62 bp, Homo sapiens
cttactaaatgctttctatgaaagaggcctcggattaagggtttcttacaaaggcaggtaag

SEQ ID NO: 6761213 - DNA, 102 bp, Homo sapiens
acttgagcaagaaaatcaatatttttgcatttcagctatttatttgcaaaacagtatagtgaaatgaatctggaaatattgtaagactaatgcaaattaagt

SEQ ID NO: 6761214 - DNA, 91 bp, Homo sapiens
gttttctggtgtgtttaattgggccaacagcggagatgcctctctcttgaggttgctgcatggttcaaatgagctaaatgcaaatgaagac

SEQ ID NO: 6761215 - DNA, 76 bp, Homo sapiens
tagtgtactagtccagtagtgtttgcatgtggatgtctgtggatgacagttattgtagcactttggcagtgcacta

SEQ ID NO: 6761216 - DNA, 60 bp, Homo sapiens
cttagtctcaaggtatggaaatgttttaaaactttttcatattattccttgagtctttag

SEQ ID NO: 6761217 - DNA, 88 bp, Homo sapiens
gggagccagagcctcctagcctgtcccttgagctgggtccccactggggctgtgtgccaggggaaggctggcccgaaatctgggtccc

SEQ ID NO: 6761218 - DNA, 83 bp, Homo sapiens
tcatgatcctggttccatgacttccacagcattttcatttcccagcccttctgtggtggggacagtcgatctagtgattgtga

SEQ ID NO: 6761219 - DNA, 62 bp, Homo sapiens
gtgatttgaaatcccttctactgtagggcacagtctactagacaaaagggagtttcaaagac

SEQ ID NO: 6761220 - DNA, 59 bp, Homo sapiens
atcaatagtatttattgaacacctgctatgctacaggcactctgctgaatactgatgat

SEQ ID NO: 6761221 - DNA, 114 bp, Homo sapiens
ctcacagagcttggggcaggggagaagttagtgtggatgcagggaggaggggctccttcactgcttaggggtccatacctgagatgacgcctcgcctgaatcatcctctgtgag

SEQ ID NO: 6761222 - DNA, 86 bp, Homo sapiens
gcttgacttgatagtgttgtatgtacagtctgaaatgtcaagaaaatctgaaatgtcaagaatataaatactttcaaaagacaagc

SEQ ID NO: 6761223 - DNA, 67 bp, Homo sapiens
gatgcgagctgtcctgacccaggcacttctgcaacccagcagagagcccgggccagggcacagtgtc

SEQ ID NO: 6761224 - DNA, 99 bp, Homo sapiens
gaaatgtagctgtgtagaaatgacagagtccttgaaaaatattcgggttataagatatgacatcaagttacctggtcattactataacagtcacatttt

SEQ ID NO: 6761225 - DNA, 80 bp, Homo sapiens
cagccttccagaaatacttgccttttagaagtcatgttccaagcaggcctcgacaggcttcatgatggcaggaagagctg

SEQ ID NO: 6761226 - DNA, 69 bp, Homo sapiens
gtaagtcttggttacttaagttggtgcgattttagaattgtttccagagaataaccttgaaaatcttac

SEQ ID NO: 6761227 - DNA, 90 bp, Homo sapiens
ggattcagaaaaatgtaaatatgcgtgtttgtctagagaaagagagaatgataaagtaaatgtgctaaagtattaacatttggagaatct

SEQ ID NO: 6761228 - DNA, 91 bp, Homo sapiens
agtatgggtggcatactgaggacattgatgaggcaatgttttaaaaaacagctaacatttttggtgtcctcactatatgccagcacatatt

SEQ ID NO: 6761229 - DNA, 75 bp, Homo sapiens
gcttatccagaaagtttaggtagcctgttcaagttcataagggctgaatgcagcctcctggagtttctgggatgc

SEQ ID NO: 6761230 - DNA, 63 bp, Homo sapiens
ggcctgtggatctgatgaaccatcctagtctatattacagctatggtgaaaggtccaaaggcc

SEQ ID NO: 6761231 - DNA, 65 bp, Homo sapiens
atggcccctctagaagtttatgttaggtttttaaggccagaccagactgacttgagcccagccgt

SEQ ID NO: 6761232 - DNA, 129 bp, Homo sapiens
cacccaccccctcagatcctggaggaagctaccactgcaactggttgacttctaggccctacaactgactgaggcctccagcagtcctgggagacttacccagccatggtgcttccaataggatgatgg

SEQ ID NO: 6761233 - DNA, 59 bp, Homo sapiens
tccacacccagcctggcacacatcctgtgtgtgtctctgtctcccaggttgtggtggga

SEQ ID NO: 6761234 - DNA, 58 bp, Homo sapiens
gggcagggtgcagagctagggtagtgggtgaatgttcacacaagctgtgcactttcct

SEQ ID NO: 6761235 - DNA, 70 bp, Homo sapiens
cagttctattgatctaacatttgtgtttgaactagaacatgcactgaaaatgttggattccatattactg

SEQ ID NO: 6761236 - DNA, 56 bp, Homo sapiens
agtggcttatgtttagaatcatgactctggggccatgtagaagaagctaggtcgct

SEQ ID NO: 6761237 - DNA, 72 bp, Homo sapiens
gtgccactcttagactgccagactccctgaggacatgcagtttcagggagtctggtagtctaagtgtggcac

SEQ ID NO: 6761238 - DNA, 92 bp, Homo sapiens
cccaaaatggtgtgttgaagtcctagaactcctggtacccgtgaaggggactttatttggaaatagggctttgtaaatatcattaagatggg

SEQ ID NO: 6761239 - DNA, 97 bp, Homo sapiens
ttgttcctgtgactaatagtatgcatttgatttgcaatttttcagctgggatcacagtttatggccaacaggcatatttctagattacaagggataa

SEQ ID NO: 6761240 - DNA, 65 bp, Homo sapiens
ccagaggggctgagcaggtcactgccgggtccctgtgaggtgatgactctgtgtggcctctctgg

SEQ ID NO: 6761241 - DNA, 106 bp, Homo sapiens
cagaaaacacacacagacacacatatacacacatgctccggccttcctgggaaatcaagtctgcaggtcagggcagcggtgcttgtgttatgggtgtttgtttctg

SEQ ID NO: 6761242 - DNA, 85 bp, Homo sapiens
gagaaaaagatcagaagaaagcacttcaaaaagccagcatttgtctctgggttctggggttatgggtgattcttatcttcttctt

SEQ ID NO: 6761243 - DNA, 78 bp, Homo sapiens
cttagctgctttacaggtgggggagctgaggccccaaacgggtaaatgctcacagccacctggtaaccagcgcctgag

SEQ ID NO: 6761244 - DNA, 59 bp, Homo sapiens
cctgaggaatgagtgaggagccaattgttaagattattcctttgcctacatttttcagg

SEQ ID NO: 6761245 - DNA, 59 bp, Homo sapiens
ctcctggctctctgtttagtgtttggacgttcaaagatccctagactaggcggcgggag

SEQ ID NO: 6761246 - DNA, 86 bp, Homo sapiens
gtcaaatggacagagatcatttaggcctgagatttaggcaaaggcactgcatagaaagttctagaagacttttccatttttgtggc

SEQ ID NO: 6761247 - DNA, 73 bp, Homo sapiens
cctacctcggctgggccttggccactgcaacagggtctccattggcatgtgagctggggcccggccagcaagg

SEQ ID NO: 6761248 - DNA, 67 bp, Homo sapiens
gatcttgacatgagcataaatcagtcacgagcaaatgttatgtgctatcaaatgctcatttcagatt

SEQ ID NO: 6761249 - DNA, 58 bp, Homo sapiens
catgaaccaaaccaaagtgtcccaaagttaatcaaaggggacgcttttaagtatcatg

SEQ ID NO: 6761250 - DNA, 64 bp, Homo sapiens
gttgtgttgccaggaagatgacactgccatttgacatcccaataatttccttggtaacatatgc

SEQ ID NO: 6761251 - DNA, 68 bp, Homo sapiens
cacaggctagtggaggagcatgagcttgggcccttgtccctgactcagctcctatactttgtcctgtg

SEQ ID NO: 6761252 - DNA, 82 bp, Homo sapiens
taagctattaagtagacttggccaaagacaaatttgaaatcagtttacatttacctagttaagtcaatatttggtggactta

SEQ ID NO: 6761253 - DNA, 88 bp, Homo sapiens
tgaaaacagacatttatactcaaattcctgaatcatttctgatcactaccctgagtgacaggatgatgagcagggggaatgcttttca

SEQ ID NO: 6761254 - DNA, 56 bp, Homo sapiens
attatctccagtttctgagcctcagaaatctgagagtggtttagctgggtgatagt

SEQ ID NO: 6761255 - DNA, 55 bp, Homo sapiens
cagtgggcacagatctctgcaagacatttccaggtcagacttctgtgcccctctg

SEQ ID NO: 6761256 - DNA, 65 bp, Homo sapiens
agaaggtatagctaattgagccctgaatgcatatagactggggtttactttagaaattgcctttt

SEQ ID NO: 6761257 - DNA, 79 bp, Homo sapiens
ggtgaccttttgcctttccagggttaatttatatggtcattaaagattttatgaaattgagcctggtgcttcaaatccc

SEQ ID NO: 6761258 - DNA, 100 bp, Homo sapiens
gcaggtgcatgtatgtgagcatgtgtgtacaagtatattgtgtgtacatgtgtgtgcacgtgtgtatgagtgtacatatgccacaagtacatgtgcgtgc

SEQ ID NO: 6761259 - DNA, 87 bp, Homo sapiens
aagggagtaattgatagaacttagcactagacttgttgtgggatttgagaccacttacaatttggaagcttgggctgatccttcctt

SEQ ID NO: 6761260 - DNA, 67 bp, Homo sapiens
ggatctgtgaggcgcaaagaaagtccagaaaactcaccaccatgtgctttctccggtcttgagatcc

SEQ ID NO: 6761261 - DNA, 130 bp, Homo sapiens
ttgtacaatttgcatttataaaaccgtgattataacttggtatgctatgagatacagagatttattgttttaataagatttcaggtaagaaaactaagaactataaattggtaataatgtagaaaagcaa

SEQ ID NO: 6761262 - DNA, 78 bp, Homo sapiens
caggaatttagagtccctgggttttaccgagtctccactgactagcagtgcagctgtgggagaatctctgggtttctg

SEQ ID NO: 6761263 - DNA, 59 bp, Homo sapiens
gtgcctagacattttggtttgcccaggacaggtcgggtttacgccagttgtcttggcat

SEQ ID NO: 6761264 - DNA, 70 bp, Homo sapiens
agagcatgaattgtgtagttgaaggatttgtcttatcaatttagtactaattatacaattgtcaagttct

SEQ ID NO: 6761265 - DNA, 67 bp, Homo sapiens
taggccatgagcagcgtgagagaacccattgcctggaatgtgttctccaatagctgctcatggccta

SEQ ID NO: 6761266 - DNA, 66 bp, Homo sapiens
taattgtacaacaggattgatgtaccacctctgcctatgagagtggttcagtatgttgttaagtta

SEQ ID NO: 6761267 - DNA, 57 bp, Homo sapiens
ctgtcgtctgtgctgtaggatgtttatcagcatccctggcaacgcactagatgccag

SEQ ID NO: 6761268 - DNA, 76 bp, Homo sapiens
ccgaggtagggcagagcaggggctgaacctggatccaactcccaagtgtaggacttgctctgtgaagccttcttgg

SEQ ID NO: 6761269 - DNA, 66 bp, Homo sapiens
tcagaggcaggaagatgggcagtagctatgttttcctgaattactgttcatttgtcctgtatctgg

SEQ ID NO: 6761270 - DNA, 91 bp, Homo sapiens
gttagtggctatgcttatgggcttgctgatttgggcaggattactgttcagtccctccttcatgggtaggcccactttggcttgccaagac

SEQ ID NO: 6761271 - DNA, 75 bp, Homo sapiens
gagtcacctttcccagaagccaggccattctctggttcctcctgcaggctcagagtggcctggctagggtggagc

SEQ ID NO: 6761272 - DNA, 57 bp, Homo sapiens
ttgctctgacagtggtgtcattgagaacgatggtgacaaggacaggttgcagggcaa

SEQ ID NO: 6761273 - DNA, 70 bp, Homo sapiens
caacatgtgtggataatgcactatccatatgggtgtgtgtttatatatgtgtatgtgtccacatctgttg

SEQ ID NO: 6761274 - DNA, 64 bp, Homo sapiens
atactgtgtgtgctcaaggaatgaatggggcttcataaacatctattccaagagctatcagtat

SEQ ID NO: 6761275 - DNA, 56 bp, Homo sapiens
aaactgagattgctgctgtctgtggtaatattcagactgtaacgcttttttagttt

SEQ ID NO: 6761276 - DNA, 103 bp, Homo sapiens
gaatttaggatatttattgggatagaatggtaccttgagaattgaaaaccaagcctcaaaatctcagagcatcattttcttagtagaattagacccttctttc

SEQ ID NO: 6761277 - DNA, 57 bp, Homo sapiens
tggaagagaaaatccacccttactccatcagggtattggccttctgttttctctcca

SEQ ID NO: 6761278 - DNA, 82 bp, Homo sapiens
tcaaggccttgaaagccttgagatcctatagttgtttggacacagttaaaactcagactcaaggccaagttcatgctcttga

SEQ ID NO: 6761279 - DNA, 79 bp, Homo sapiens
gctcatggctcagatttttgtaggctttgcaaatcctccattctgtcccagcaggtttccgatcatttgagacgagagc

SEQ ID NO: 6761280 - DNA, 68 bp, Homo sapiens
tctttcgtgccagaaggttcccgctgcagctctcctgctagtttagcttagccttctggtttgaggga

SEQ ID NO: 6761281 - DNA, 75 bp, Homo sapiens
cggagcagctgcagagggctcccccttcctaagcttcttctcattggcagggtggcatctctctgagctgttctg

SEQ ID NO: 6761282 - DNA, 58 bp, Homo sapiens
tcaggagatggtctttataggcttaatttttaggaaggtccagagagccggctcctga

SEQ ID NO: 6761283 - DNA, 83 bp, Homo sapiens
gcaagcctcagttatcagcagcttctttcactcctggataaattctgataattcaggaaggactgtccatggctgttgtttgt

SEQ ID NO: 6761284 - DNA, 101 bp, Homo sapiens
ccaggtatgtccttcacatggcaatagagagggaaagagtgaagaagcccaagagcccttctaaccctccttttgtgtgatgcctgttaagattcacttgg

SEQ ID NO: 6761285 - DNA, 55 bp, Homo sapiens
ccagcacagggcggtaatcagagttcatggctatggcctcaaatcctctgtctgg

SEQ ID NO: 6761286 - DNA, 67 bp, Homo sapiens
gcgcggaggtagctggatgcggccctctctccccgcaggagacgcggctgttcggcggccctcgcgc

SEQ ID NO: 6761287 - DNA, 68 bp, Homo sapiens
tcctctttttttctgtggctgccttggaggtcacatggtgaagatggcagtgccacaagatgggagga

SEQ ID NO: 6761288 - DNA, 124 bp, Homo sapiens
tgtggagggaacaagaaggctcttctttggagaggtttaaggaggagatgaaaatacataagtccaagagatcctgaagctctcttaaggaaagaggttaaaaaaagaaggttcttaatacaca

SEQ ID NO: 6761289 - DNA, 58 bp, Homo sapiens
ggcttagaaggcaaatgacttgtccacgatcgcgaggcaagtcagacccttcagagcc

SEQ ID NO: 6761290 - DNA, 64 bp, Homo sapiens
tgctgaatttcctctaaacccctgagccaggatgaggcaagtggtttatgggagttccaatgca

SEQ ID NO: 6761291 - DNA, 73 bp, Homo sapiens
aggatttttggtaaccctttaagatttaaatttttaaactccttttaagacttaaggcatttccaagaatgtt

SEQ ID NO: 6761292 - DNA, 70 bp, Homo sapiens
cagaaaacatttgcttatgaagagaagagcttatattctgtgagagcttcactggagagcacattttctg

SEQ ID NO: 6761293 - DNA, 59 bp, Homo sapiens
cccggctgtctctggcagctcagcggtcagcagcgatgagaagccaggggagcgtgagg

SEQ ID NO: 6761294 - DNA, 56 bp, Homo sapiens
tcatttctgagccttccatgatttttgagcctgatttgctggtatctcaggaatga

SEQ ID NO: 6761295 - DNA, 104 bp, Homo sapiens
aggctaaagaggggagccccagaaagctttgctggaaggaagagaaagacaaaagccttgccttttctctcggtagaagctgtcggtcatggctcttctagcct

SEQ ID NO: 6761296 - DNA, 78 bp, Homo sapiens
gcaattactcctttggtcacctccactcttattctcattagcaattgaagtaagggccagtggagagggaaaaattgt

SEQ ID NO: 6761297 - DNA, 84 bp, Homo sapiens
gctcaggagggagaactgaatgggggcaactgtgctgagaggggaaatgatcttctctttggctttgactcccattccttgagc

SEQ ID NO: 6761298 - DNA, 91 bp, Homo sapiens
gatgctttaaaaagagagagagattgtttaattctgggatcttctggactccgaaatcccaaaatacttttctctcctattttgaaaagtc

SEQ ID NO: 6761299 - DNA, 83 bp, Homo sapiens
gctcctctttctcttctcagcacggcattcctccttccctctcgctcactgagggagacaatctggctcagaagaagatgagc

SEQ ID NO: 6761300 - DNA, 71 bp, Homo sapiens
ctctcaatgaatggcttaccctggattgtgtctttatgccgtaggcattatcactgtaagtatttgtggag

SEQ ID NO: 6761301 - DNA, 76 bp, Homo sapiens
gtatctcttggctgaatgccctggctggatctgccgttgggcctggctctccagctggcttcggaagtggaggtat

SEQ ID NO: 6761302 - DNA, 87 bp, Homo sapiens
gagctggatcattttaatactgcgtagaatgccatggtttgaataaacacgtcattgagtaatactgtagtgttggccatttaggtt

SEQ ID NO: 6761303 - DNA, 63 bp, Homo sapiens
gatgcagtcatagtgcttccaggaaattatattcgacatcctagaataatctttgactgcttc

SEQ ID NO: 6761304 - DNA, 89 bp, Homo sapiens
ctgcctgctcgcttccccagggcaggcctgacccttagccccattccccctacagagccaggatctgttttggggaaatgaacaggcag

SEQ ID NO: 6761305 - DNA, 59 bp, Homo sapiens
tgctggccaatggcagaggcggaagctgtttatgggggcggagcgtcgccatggcagca

SEQ ID NO: 6761306 - DNA, 69 bp, Homo sapiens
agaggagagggagagatggaaaagggagaactcacctttgttaacatactgctttctaataactctttt

SEQ ID NO: 6761307 - DNA, 67 bp, Homo sapiens
tttcacatccatcagaagggcaaaatttagaagtctgagaagcccaagtgttggtaaggatgtggaa

SEQ ID NO: 6761308 - DNA, 62 bp, Homo sapiens
gacgcacatgagagactgtttgggagcttctggggagccctgctagttgtctcagtgatgtc

SEQ ID NO: 6761309 - DNA, 88 bp, Homo sapiens
agccactgacaactcggtgggctattaggaccaggccatcttttcccaatgtggtactcttctaatgggcacgctgggctcgggagct

SEQ ID NO: 6761310 - DNA, 92 bp, Homo sapiens
gatgggcctgggaggcagcagagctttgtcctggctccattccttgctggcttgcagtggacaaggcccttagctctcttcaagctttggtc

SEQ ID NO: 6761311 - DNA, 70 bp, Homo sapiens
tgactctggctgaaattagaaggttcaatggaaatggaactacaggatctgctatttacagtcacagtta

SEQ ID NO: 6761312 - DNA, 78 bp, Homo sapiens
aggttcactttatactcagtttcctgctaaaagtcctggcttggagtcagcagggcctgagtgacctaactgtggcct

SEQ ID NO: 6761313 - DNA, 68 bp, Homo sapiens
ttctccatgctttggctgacacgctcctgggtcgtaggcacaggagtggggacggcaaagggtgggaa

SEQ ID NO: 6761314 - DNA, 77 bp, Homo sapiens
aggaatgtttttcattgctctctttcctgccctgaatgaggaatagacacttggggtagagaacgaagaacatttct

SEQ ID NO: 6761315 - DNA, 57 bp, Homo sapiens
ccacattggcctcagaggttagacttcctccttttcaaacctctgtcccacatgtgg

SEQ ID NO: 6761316 - DNA, 59 bp, Homo sapiens
ccagctccttctgtctgtggagtctcatagggagactaggtcgaggttgaagtagctgg

SEQ ID NO: 6761317 - DNA, 103 bp, Homo sapiens
gacccaggccacgctggccccggggtgtcctgtgccaagctgggatagagcctctctcccccagcaagtggacggcccacgctagggctcgggtgctgaggtc

SEQ ID NO: 6761318 - DNA, 62 bp, Homo sapiens
gccagaggttcaacaactgtctgtattgtgccatcacaggaggtcagagtggatttcatggc

SEQ ID NO: 6761319 - DNA, 67 bp, Homo sapiens
tcatatctttgtctaccaggaaatataatcattaaaatgaacgtcctggaacatggataaagaatga

SEQ ID NO: 6761320 - DNA, 63 bp, Homo sapiens
gtgggtcctttgaaaggggtgtgtcagtgggggagaacttgacaccccatggggaggggcaac

SEQ ID NO: 6761321 - DNA, 62 bp, Homo sapiens
aggatattgttgtatttagcacatctgtttttcagatgctgaagctgaggcaacaaaatgct

SEQ ID NO: 6761322 - DNA, 79 bp, Homo sapiens
ctgattgtagctcacactatttaagggtaagggttgatcctgtatgcctgctacaaaatggaatgtgtttataattcag

SEQ ID NO: 6761323 - DNA, 56 bp, Homo sapiens
atttcccaggactagaaatatactcataattgcaggcatctggtttctaggggagt

SEQ ID NO: 6761324 - DNA, 92 bp, Homo sapiens
gccagttcagttaatcatcaggaaaagtagtctatatggattgagtactaaatatgacgatatttttcgatgaagtgactggatattttggc

SEQ ID NO: 6761325 - DNA, 93 bp, Homo sapiens
agcattaatagtggcttgctatgggtataaacaggtcctaaatcctttaaacaaatggttacaatctgattgtctcatctacttattggtgct

SEQ ID NO: 6761326 - DNA, 68 bp, Homo sapiens
gcctcatcgctgctcggcccggaaggcttcttccttggcaagatgggattccgggaggcggtggcggc

SEQ ID NO: 6761327 - DNA, 68 bp, Homo sapiens
tgtaaagactgaagcaattcaaccagtgtttatatatatatttatagggaattgcttaagtctatata

SEQ ID NO: 6761328 - DNA, 73 bp, Homo sapiens
ttgtgatcccatttcctagtacatcatcaatgtcctactgtgctccatgatcctctagaaaagggtatcacag

SEQ ID NO: 6761329 - DNA, 128 bp, Homo sapiens
agcagagagacgagggaaagaaggagtgttcaggggtagttatgtattgggaaatccaagcctttgtgtgggtatctcctagttcatatggaacccaagaattctcaactattctcgaggactctgct

SEQ ID NO: 6761330 - DNA, 58 bp, Homo sapiens
cgccgccgcttccctcctccggggccgctcgctcccaggaaagtggaggcggctggcg

SEQ ID NO: 6761331 - DNA, 69 bp, Homo sapiens
ctttgtattgggatgtgctttgaatcttgaaaaatgcttttcacacttggagcaacacttatggcagag

SEQ ID NO: 6761332 - DNA, 62 bp, Homo sapiens
gagttattttgagcagatggttataggtggttcttgctcaggaccgtcgttcagacggactc

SEQ ID NO: 6761333 - DNA, 65 bp, Homo sapiens
accacgcctggctagtttttgtgtttttagtagagatggggtttcacaatgttggccaggttggt

SEQ ID NO: 6761334 - DNA, 99 bp, Homo sapiens
actcacatggttagcttgtccactctcctgggagcaccatacttgtttcttcaagaactaaagaaaagggaagtgctgccccagaggctgactgtgagt

SEQ ID NO: 6761335 - DNA, 104 bp, Homo sapiens
cactgataataataatcatagcaatcatttgtcatatataatactcttccatgtcctatagaggagttatggtattggttgatgcatgaatattattttcagtg

SEQ ID NO: 6761336 - DNA, 59 bp, Homo sapiens
cttcccatttaaggcacatatgtcttaccttcctggctgtgttcatctttaaagggaag

SEQ ID NO: 6761337 - DNA, 63 bp, Homo sapiens
gatgttagatgttagatggcttacagatagctttatttctgattgctgtctgatgctgaggtc

SEQ ID NO: 6761338 - DNA, 79 bp, Homo sapiens
tcttttcttcatcttgccctacacatttatccaaagaaaatatttaggatgtgaaagaaggggtgtagataagaaatga

SEQ ID NO: 6761339 - DNA, 56 bp, Homo sapiens
tttcaaggtgctgacatagcatgtgcaaacacatggcagaatcatgcatctagaaa

SEQ ID NO: 6761340 - DNA, 60 bp, Homo sapiens
tatggctttgggccaaatctactgtctgttcttataaagttttattggaacaaagccatg

SEQ ID NO: 6761341 - DNA, 70 bp, Homo sapiens
gttcattactccctgacaggccatgggcttcgtgacatatgaatttcattattgccagggattagaaagc

SEQ ID NO: 6761342 - DNA, 95 bp, Homo sapiens
aaatactattagagcacaatggaaaaggcagtgtgtctatgtgtaatatggcgtaatagacatggtcttttgtcattgaaataataatactgttt

SEQ ID NO: 6761343 - DNA, 78 bp, Homo sapiens
gatgtcatcacatttatgagcaccttggcccagagcatgggctctgacaccagacagccatagttcagtcctggcatt

SEQ ID NO: 6761344 - DNA, 88 bp, Homo sapiens
ggtaaagaaagtttatttcttgatggaggaactacaaaatattgtggccatttttgcaatctatcaggactgcgtgaagttttttacc

SEQ ID NO: 6761345 - DNA, 66 bp, Homo sapiens
ctcctctttacccgcatggtcttaaggtgacttttagagagaggacacaggcaatgtgagtgggag

SEQ ID NO: 6761346 - DNA, 87 bp, Homo sapiens
gtgggccgcgcccggggcgcggagggcggcggccgggcccgggttccggtcgcgctgcctctctggggccctgggggcatcgcttgc

SEQ ID NO: 6761347 - DNA, 70 bp, Homo sapiens
gcagatactccaagatattagaaaacatgttttcctatcttagcaaacatttggtctagtgtgtgtttgt

SEQ ID NO: 6761348 - DNA, 55 bp, Homo sapiens
caggctgagggttaggccttagaactccacctatttgctgcaactcctctgtctg

SEQ ID NO: 6761349 - DNA, 62 bp, Homo sapiens
gaagaaggtgccagaggcttactgtttgcttaaactcacagaaggccctgtgcatcttgttt

SEQ ID NO: 6761350 - DNA, 58 bp, Homo sapiens
gtgaggtccagggaggatacgaagcatttgaaaacatgttccctccctgtaatctcac

SEQ ID NO: 6761351 - DNA, 74 bp, Homo sapiens
ctgaacacccagctcactctcgccttcttcctctggagagaggaccagaggccagagtcagctctggggtatag

SEQ ID NO: 6761352 - DNA, 68 bp, Homo sapiens
ggtaataaacgcacccagatcccttgccagcagtggtctgtctgctgcttggaggcctgggtgctacc

SEQ ID NO: 6761353 - DNA, 114 bp, Homo sapiens
caaattgtccattggatctcattttctagataatggctttagggttttatttgcatctgtgcaaagatgtgtctattcaacatgaaaacattagtgagttcagtcaatagtttg

SEQ ID NO: 6761354 - DNA, 97 bp, Homo sapiens
actgatgcaattccttcattgagttactgcctgggccactgcctgattagtttgctgtggcattgcctagaagcagttaatgaattgcttgttcagt

SEQ ID NO: 6761355 - DNA, 73 bp, Homo sapiens
cttcttatcttacttgaaattccaagcaggagacctcctcctctgggctggaaaattaatgttttataagagg

SEQ ID NO: 6761356 - DNA, 96 bp, Homo sapiens
tgttttaattgatggtagaaaattattgaaaatggctctaaaaataaattcagtagagttcataataattttaaaataagcattaatgataaaaca

SEQ ID NO: 6761357 - DNA, 59 bp, Homo sapiens
gatgtaggagtgaattaattcatccaaatttatggctagaattatataactccaacatt

SEQ ID NO: 6761358 - DNA, 58 bp, Homo sapiens
ggagccatatttgcattgaattgtgtcaattctcagcacatttaagcagatgtggacc

SEQ ID NO: 6761359 - DNA, 58 bp, Homo sapiens
ggttcatggaaggcaaaagacacagatggggatattaatactctggccttcctgaact

SEQ ID NO: 6761360 - DNA, 80 bp, Homo sapiens
cctggatccaggcccaggaagtgactcagatgtggcaaagaagccatgttgttgaagaacatcccggggctggatttggg

SEQ ID NO: 6761361 - DNA, 67 bp, Homo sapiens
ccagccaggcaccccagggcctttgaggccagaggtggttaaggcacctgggggtgaacttgggtgg

SEQ ID NO: 6761362 - DNA, 91 bp, Homo sapiens
gggttccagagaatggggtagtgggcagcctggcaggcagggtgccaggcacagaggccgaaacccaggcagcctgctccattctgagctc

SEQ ID NO: 6761363 - DNA, 89 bp, Homo sapiens
aggctttggcaggactctgtgcagggtcttagacattatacttgtgccctcagccctgtgctaagcaccctcaccccccaccaaggcct

SEQ ID NO: 6761364 - DNA, 92 bp, Homo sapiens
atcacctgggagcttgttggacatgcagaatctcagacctcaccaagacctactgactctgaatttgcattttaacaagctctacaagggat

SEQ ID NO: 6761365 - DNA, 76 bp, Homo sapiens
gtggatctccacctaattgagaagggctttgaggctttggactctggcttttattcagttggcagtggggaaccat

SEQ ID NO: 6761366 - DNA, 85 bp, Homo sapiens
ttcactttatcttggcctttattctgtacttctgtagctaagatggagtcagagaggtggggaatgaggagcagagagaggagag

SEQ ID NO: 6761367 - DNA, 99 bp, Homo sapiens
tggagaagccagaaattgagtgcagccagcccagtgccagaacccaccctcctcacctctgcactgtgctgcctccaccaacagggctcggtttctcca

SEQ ID NO: 6761368 - DNA, 59 bp, Homo sapiens
gggcttctagaccagcagtgaggcccttaaaagccacagcccactgacacaaggagccc

SEQ ID NO: 6761369 - DNA, 81 bp, Homo sapiens
gagcagattggcacttttaggcagtaccgaattaacatcaaaatgtcattgctgagccataaggttgcccccattttgttt

SEQ ID NO: 6761370 - DNA, 77 bp, Homo sapiens
gtgctgccaggatccccaggtcgccgtcctgacccctggctgggcttcttggatgagttgcctggggtcctgcggcc

SEQ ID NO: 6761371 - DNA, 55 bp, Homo sapiens
gtctaagggcttattggagctgtagcatgctgtagttccttgatgttctatggac

SEQ ID NO: 6761372 - DNA, 72 bp, Homo sapiens
agtggtactttctttgaggaaaaagattccaaacaattcctggaaactctacctctctaagaagatggcatt

SEQ ID NO: 6761373 - DNA, 65 bp, Homo sapiens
ccctgacgggtggcagttcagggcttcgtcgatggattcagccagagactttacctgtgcaaggg

SEQ ID NO: 6761374 - DNA, 87 bp, Homo sapiens
ttttgagcatctcctatttactcagtgctatgaagaatatgaaaatgagtaagattcaggcagctgaggagaaagtagatgtcaaaa

SEQ ID NO: 6761375 - DNA, 57 bp, Homo sapiens
gcagagggtcaggtagtgaagtcgaggaaactaaaccagctgccctgaactttgtgc

SEQ ID NO: 6761376 - DNA, 59 bp, Homo sapiens
tttaggacagagtaaactcataattctgtgtgtagaaggcaaggctgcactgtcttaaa

SEQ ID NO: 6761377 - DNA, 84 bp, Homo sapiens
ttgaagaagagggttagattttaagaaagaaagtgtgcttatttcactcatgtctttgcagaatttaactttgctttactttaa

SEQ ID NO: 6761378 - DNA, 57 bp, Homo sapiens
cagtggcctttcctgctgctcagcatgaaatgagccatgagcagcatgaaatcactg

SEQ ID NO: 6761379 - DNA, 63 bp, Homo sapiens
gcatttgcagtctggcctgctttgggcttgttggacacaccccagggcagccaacccagatgc

SEQ ID NO: 6761380 - DNA, 59 bp, Homo sapiens
gtctaaactttacagagtcaaggctgtgtggaaaagtaagctattctgtaaggttggat

SEQ ID NO: 6761381 - DNA, 62 bp, Homo sapiens
gcttgcttacattgcatctgtgcctacaactgtcctaggtcagttggagtggataaggaggc

SEQ ID NO: 6761382 - DNA, 103 bp, Homo sapiens
cttccccaatagatatgctctctcggtttcctaattgtctagaggctttgatttatctggcagaggaaggaggcctgagatatctgggcaaagttctgggaag

SEQ ID NO: 6761383 - DNA, 86 bp, Homo sapiens
ataagtgtggcacagaagaaagagaggaaaacagtgataagttgaaatcctggttctgccaatttatttcttctgtgtgcatttat

SEQ ID NO: 6761384 - DNA, 74 bp, Homo sapiens
gcgtcgcccccctcagtccaccagagcccggatacctcagaaattcggctctgggtctgtggggagcgaaatgc

SEQ ID NO: 6761385 - DNA, 68 bp, Homo sapiens
tcctgtggaagacagtgttggggtcctgcctatatcccctgggcacttaacattttcttatgcatgga

SEQ ID NO: 6761386 - DNA, 89 bp, Homo sapiens
cttctgaaattttacaagcagtgggacatgccagcagctcgtggaacatggtcctggagagtgttccataaagagtgtaagctcagaag

SEQ ID NO: 6761387 - DNA, 76 bp, Homo sapiens
tctgtttctcatcatcactctggcaagcatcaagcagcaagcaatgtttgctttcagagatggccagaatcacaga

SEQ ID NO: 6761388 - DNA, 124 bp, Homo sapiens
gctccctccccaaggcaggtgatctaattggtctgggtgtgacctggacatcaggaccttcaaattttcccagtgatttccacgtgcacccaggttgagaacgctgcggcccataaaagggagc

SEQ ID NO: 6761389 - DNA, 74 bp, Homo sapiens
tccaagagacaggatgtattggcaagaggaactattaagaccattgttacttctgtttaagcatctgtcctgga

SEQ ID NO: 6761390 - DNA, 60 bp, Homo sapiens
cctggtgtcatgttagtaaggtcaactattttcatgtttggactgctgcaggcactcagg

SEQ ID NO: 6761391 - DNA, 97 bp, Homo sapiens
agtcatttggcatatgtgagaaaagaccagaagacagaaatattattcatggaaggataggccatcttgtcatttgttttcactgtgccagaagatt

SEQ ID NO: 6761392 - DNA, 55 bp, Homo sapiens
agtcttcctgggggaagaccacgggagtccacaagaggctgcctcctgggagatt

SEQ ID NO: 6761393 - DNA, 64 bp, Homo sapiens
gtcatttgaagaagaaacgtactaataaaaatatatttcttaagtactttagtctgcaagtggc

SEQ ID NO: 6761394 - DNA, 130 bp, Homo sapiens
caatcttggcatggttgccattttggaccagatcgttctttgttgtgggggctgccctgtacggcaaagaatgccgagcagcacttccagtctccacccacaggacgccagtagcaccctctaagttgtg

SEQ ID NO: 6761395 - DNA, 95 bp, Homo sapiens
ttctgggaaagatgtcgtgtttcagtaaggatacagaggcaggccaatcccgttctacctctggacattgtggagcatggctataatacctggaa

SEQ ID NO: 6761396 - DNA, 56 bp, Homo sapiens
cccaggctggagtgcagtggcgcaatctctgctcactgcaagctcagcctcccggg

SEQ ID NO: 6761397 - DNA, 120 bp, Homo sapiens
aggaaggacagagtgtttccagactccatactatcagccacttgtgatgctggggaagttcctctacacaagttcccctggtgccacgatctgcttcacgagtctgggcatgtcctgact

SEQ ID NO: 6761398 - DNA, 59 bp, Homo sapiens
aatgcacaggtctcgtaatgagtagcccattgtcccaggctacttgggacttttgcatt

SEQ ID NO: 6761399 - DNA, 74 bp, Homo sapiens
cgagcccaacgtgcattaggacctctccagggaagtgacaggtccacctggagggctctttcacctggtactcg

SEQ ID NO: 6761400 - DNA, 61 bp, Homo sapiens
gggaggctctgccatctgtcacaggtgcctttcaaatttgtctcagactgaggggtttccc

SEQ ID NO: 6761401 - DNA, 79 bp, Homo sapiens
caaagcagtcatttggcacctactgtatgcctcgacaatgggatggatgctatttgggggctacatgatatttgttttg

SEQ ID NO: 6761402 - DNA, 92 bp, Homo sapiens
ggtgcaatctcatgttgggaagtgtagctccaccttcctccagacataggggcgtgggcggcttggaactgcatttcccaggaggctgcgct

SEQ ID NO: 6761403 - DNA, 66 bp, Homo sapiens
ataatctggtttggggatccttgtgactgtttcaagtgtctacatttattctctaaatcagtttat

SEQ ID NO: 6761404 - DNA, 92 bp, Homo sapiens
tagccagagcctgtttaaaatacttgtggccaatgtttgttatactgtggttcccctgtagcatgtaaattggttattaagtactgtggtta

SEQ ID NO: 6761405 - DNA, 92 bp, Homo sapiens
tatctactgccagaaaactcacaacacttatgaaatgtaggttgctttattcaagcacttgattacattagtgcctgcctggtccaaagata

SEQ ID NO: 6761406 - DNA, 94 bp, Homo sapiens
gacaggttagtcttttctgccatttattggagataggcatataaaacactgagttttattgagcacatagtatgtggcaggcactagcactttc

SEQ ID NO: 6761407 - DNA, 58 bp, Homo sapiens
ctgcgttgcccagtgccacggccactatgacatgtggcttctgagcattgaaacgtgg

SEQ ID NO: 6761408 - DNA, 64 bp, Homo sapiens
aaacagagtgaaagtattcacaaagttcttgatggtgaccaccatttcaatgcttgctctgttt

SEQ ID NO: 6761409 - DNA, 87 bp, Homo sapiens
agtagcagtcacggagcagccctagggcataagcactggagtgggagtcctgttttgcttcgtggccttgggcaactctcttctact

SEQ ID NO: 6761410 - DNA, 56 bp, Homo sapiens
caggtgattctaatatgtatccacggctgagaactcatgcacgttggaatcacctg

SEQ ID NO: 6761411 - DNA, 68 bp, Homo sapiens
gcaagtgcaaggctattcacatgtattatctatataataatgcttcatttgcatagctttttatatgc

SEQ ID NO: 6761412 - DNA, 68 bp, Homo sapiens
caggggttgcttgcttctattttatacatcatataataaggttggttatattgtttccaagccccctg

SEQ ID NO: 6761413 - DNA, 78 bp, Homo sapiens
acagggatttgagagtgacaattttatgaataggtccttaatacctgcttctgtattgaaattgttattttccactgt

SEQ ID NO: 6761414 - DNA, 64 bp, Homo sapiens
agccattgtcccattgcgaatgtgagtggacccctccagactcactttgccatggtatagggct

SEQ ID NO: 6761415 - DNA, 84 bp, Homo sapiens
aggatctctgacaacacctctactctccatggctgtcatgactgaggccaactagggagatggaaagtggtgtctagaggtcct

SEQ ID NO: 6761416 - DNA, 59 bp, Homo sapiens
cagctccagcctgacaccaagatatttcattctcagtggcgttcctgggctggaagctg

SEQ ID NO: 6761417 - DNA, 80 bp, Homo sapiens
ttctatttcttggagtcagactttgattagtagaaggagttttactgtgattgaggtttggtcaagcaagtacagtggaa

SEQ ID NO: 6761418 - DNA, 64 bp, Homo sapiens
ctgagaggcatgcacagatgtgctgtgggaaccctaacataggacacttagctgagcctcaaag

SEQ ID NO: 6761419 - DNA, 57 bp, Homo sapiens
agagttaggtccagaatgttgcttagtttctattctgaaagcatctctgccaactct

SEQ ID NO: 6761420 - DNA, 55 bp, Homo sapiens
gagtggtttcatacccagctccattcttgagtctggagttttctgtgatccattt

SEQ ID NO: 6761421 - DNA, 129 bp, Homo sapiens
tagttggtgctgtttgagtgcagtaatggtggtcagactgatttgctataggaagataatgtaattatccatagtttatagatcaagaatctgaggcacaaggaagttacttgtaaaacagctcaccta

SEQ ID NO: 6761422 - DNA, 57 bp, Homo sapiens
gtgaattgtgtgaagtgtgatgcattttcagcaggtggacacatttgcacaatccac

SEQ ID NO: 6761423 - DNA, 78 bp, Homo sapiens
cggaggctggaattctgcggctggggacagctgttgctgcaattgagctgcactgacttccccggctgcacagccacg

SEQ ID NO: 6761424 - DNA, 80 bp, Homo sapiens
tttggtgatgcatttctgcaaacttccacgtctcgctctggggccaggagactggtgtttgctgggctgtttcttccaag

SEQ ID NO: 6761425 - DNA, 63 bp, Homo sapiens
gtaatacttgaagaattcagagggctccagcttattgaggactctggaagaaaaaagtattat

SEQ ID NO: 6761426 - DNA, 66 bp, Homo sapiens
gtctagaataactgctatctttctggcctaaggaactgggtggaaggtaatgcagcttactgagat

SEQ ID NO: 6761427 - DNA, 63 bp, Homo sapiens
ccagggaaaggaggttgacttgtttgggactttttcactccagaattccgcccctattcttgg

SEQ ID NO: 6761428 - DNA, 55 bp, Homo sapiens
gggggaggaagtgtggccaggtggctgagaagccatctgtccaccagcctcgcct

SEQ ID NO: 6761429 - DNA, 93 bp, Homo sapiens
ggtttgtagaggaccaaaaatgtcaggagagtgaggggagaggctcttactctgagtctagattcctcctgcatcctgtggtccctaaaaatc

SEQ ID NO: 6761430 - DNA, 130 bp, Homo sapiens
gtttctgtggttacttggcctcctttcctggaggacagcacaggcaggggaactataggtgtgatccacctatagatcccccgtatgtgtgataaagaggaaaggcagtgataaggcctggacccagtcc

SEQ ID NO: 6761431 - DNA, 56 bp, Homo sapiens
tctggaatctgtgggccaagcctgttattccttcccaggtccagcacagttccagg

SEQ ID NO: 6761432 - DNA, 55 bp, Homo sapiens
cagagtgataaatatagaaatttcatcaaggaaaagactatatcctgtcattctg

SEQ ID NO: 6761433 - DNA, 124 bp, Homo sapiens
tttttccattcaggaggttttgggccatcttcagccaccctaccagccctgaaaaggatgtgactcctgtttctgggaagtgtgtggtgtgttaggtgggcctacagccctggttgtggggagg

SEQ ID NO: 6761434 - DNA, 93 bp, Homo sapiens
ctttggattcatcatggagaatataccaaatgcttaaaagattcttactttgcttatagctttggatgatctttgatactgagaatcacaaag

SEQ ID NO: 6761435 - DNA, 75 bp, Homo sapiens
gggaaatagtactgtttaaattgtcatgccagcaataggacaactgaaaatgacacccccacagcattgttttct

SEQ ID NO: 6761436 - DNA, 72 bp, Homo sapiens
gcatatgtgcacacatatatatgagcatgtacatgtgtgtgggtgcatgtatgtgtgtgtgcatccatgtgt

SEQ ID NO: 6761437 - DNA, 98 bp, Homo sapiens
gatcataaatcaagacaatatatgattcaaacagctgcctgggtgtgatataaagcaaactgtggctgcctgttgagtatgtcccaatttgtatgatc

SEQ ID NO: 6761438 - DNA, 57 bp, Homo sapiens
gagcctagtgagatggcggtagctgtggacacagtggcagccttgttcattatgctc

SEQ ID NO: 6761439 - DNA, 76 bp, Homo sapiens
agtaacaattattttagctactgtcaagataaaatgaattatatttgactgttttatgaggtggtttaaagttact

SEQ ID NO: 6761440 - DNA, 57 bp, Homo sapiens
atgattctttcattctcttactttatgacaagacatgatggagagtgacagagtcgt

SEQ ID NO: 6761441 - DNA, 95 bp, Homo sapiens
ccccatcgtgacatccagtccaggctttcaggacagcgagcccggtttccaggcaggtgcttgtcgaaggcctggctggctgtaccgacaggcgg

SEQ ID NO: 6761442 - DNA, 77 bp, Homo sapiens
tcactctcaagcaaagtatgtgctgggagcttaaagagaaaaaataagcttaagccaaatactttggtttccagtga

SEQ ID NO: 6761443 - DNA, 65 bp, Homo sapiens
gtccaataagtcagagaaataaccaggtacaatttggtacttatagtttctctgactcattctgc

SEQ ID NO: 6761444 - DNA, 110 bp, Homo sapiens
cagtgaaactttccgagatgatataaacgttctataatctaagccatccagtatggtggccacagccacatgtgggttattgggttctagaaatgtggattgtgtcactg

SEQ ID NO: 6761445 - DNA, 55 bp, Homo sapiens
ccaaggctggagtgcagtggcgcaatcctggctcactgtagcctctgcctcctgg

SEQ ID NO: 6761446 - DNA, 81 bp, Homo sapiens
gtttctctcagagagtggcaggctcagtagggagggggcaggaggctcacctctcagccggactgtcaggctcgatgaagc

SEQ ID NO: 6761447 - DNA, 66 bp, Homo sapiens
tgccagttgggcccaggaaatagccaggaggtggggagcaccaggtcttgggttttctgggaggca

SEQ ID NO: 6761448 - DNA, 65 bp, Homo sapiens
ccatttaaatgacttttattattctcatatgagttaagatgggagaagatttggcatttaaatgg

SEQ ID NO: 6761449 - DNA, 111 bp, Homo sapiens
tcctgtcaacatattccatgaacatcctatccgtgttcagctgttaagtatattaactatttcagggagtgatgtcagcaagaataggaataggagtttgtcagaacagga

SEQ ID NO: 6761450 - DNA, 80 bp, Homo sapiens
agcaagcaagtggctgagcagagatttgaactcgaaagtctagctccaaagctcatgctcttagccatgttacgtttcct

SEQ ID NO: 6761451 - DNA, 62 bp, Homo sapiens
atgggagtagatgtataacttggagtaagaggccccacataattaggcacctatcctcccat

SEQ ID NO: 6761452 - DNA, 69 bp, Homo sapiens
ttaatgctgtgaaaaatccaacttgtagcagtgaactgtttatagaaggagcattcacttagcagttaa

SEQ ID NO: 6761453 - DNA, 80 bp, Homo sapiens
taaaatgtagattctcggcccatgctccctgaaagtgctgacacagtaagtctgggctgggcttaggaacccttatttta

SEQ ID NO: 6761454 - DNA, 60 bp, Homo sapiens
ccaaaacagtaagagatgttttatcttgtaggggatattattgaattttttctgttttgg

SEQ ID NO: 6761455 - DNA, 86 bp, Homo sapiens
cagagagaggcctcacagcacaggtgtcctcacagggggtgcctcacagggcttccctaacacacctgctggtagcttctgctctg

SEQ ID NO: 6761456 - DNA, 77 bp, Homo sapiens
gagctcgccccctcatctgtgagtgcagaagcctggaagcctgagctcatctgcctggatgatggcagggcgagctc

SEQ ID NO: 6761457 - DNA, 57 bp, Homo sapiens
ttcacattaagcctcctcctacatggacaacccctatgaaggggcagcttgtgtgga

SEQ ID NO: 6761458 - DNA, 81 bp, Homo sapiens
tttcattgtccccaggcaagacatagatagcgggccagacgctcctttcccctttcctgggactctgataaggcaatgaaa

SEQ ID NO: 6761459 - DNA, 83 bp, Homo sapiens
tgccgcgcacgatggccttgtagaagagcttgcgggccttgcccttcatgccacgccgctgcaaggacacgtgtgtcacggca

SEQ ID NO: 6761460 - DNA, 55 bp, Homo sapiens
ttccaacaccagcacagggctccccagggacactgggagcaagctggtgctggag

SEQ ID NO: 6761461 - DNA, 67 bp, Homo sapiens
agacaatgtgagccaatgcccgtgggagccacaccaccaacctccaccaagccggggccacttctct

SEQ ID NO: 6761462 - DNA, 63 bp, Homo sapiens
cagattagtgcttctaccctaggcagggctttcttggtctaatggtaataagcaccgacactg

SEQ ID NO: 6761463 - DNA, 110 bp, Homo sapiens
gtgttatgaggcacatccagacgttaagaaaggtgttgccttggagacctggtacaaatgccgggtcctcgggatgacgctgcacacttgacaacatggagcccaagcac

SEQ ID NO: 6761464 - DNA, 80 bp, Homo sapiens
tagtggctacccttcctagctttcccttggggcttcccaaattcagatacccatcagaggttggtaatgggtagccccta

SEQ ID NO: 6761465 - DNA, 78 bp, Homo sapiens
tttgacacagcagactggagtaggcagtgctgtttttccctagccctggcattctgcttgagtctcaactgttacaaa

SEQ ID NO: 6761466 - DNA, 78 bp, Homo sapiens
tttcaaggtagtaagatgggggaaagaaatagtttattcccatttaaaatgtttttttacttttttggtactttgaaa

SEQ ID NO: 6761467 - DNA, 97 bp, Homo sapiens
gtgccctgtctagggcaggggtatttttagagctggctgcacactgtttacaaggaagccagtcccttgagcgtgccctcgccctacagggaaacac

SEQ ID NO: 6761468 - DNA, 56 bp, Homo sapiens
gctctgggccatcctggccgggatccacaggctgccccgcccgggagccattgagc

SEQ ID NO: 6761469 - DNA, 85 bp, Homo sapiens
cagtgaaatcagaggtcagctgtaccacaggaaacactgagaagtcaagacaagatcagtatggtcatctgacctttgttctctg

SEQ ID NO: 6761470 - DNA, 62 bp, Homo sapiens
gaattctgagggaccccatcatttctatggtgcctcctaaatgctgtgtcaccttaggattt

SEQ ID NO: 6761471 - DNA, 55 bp, Homo sapiens
ccaccggcgtctttcgacctggagaacatcatcttcaggatggcggatgttgggg

SEQ ID NO: 6761472 - DNA, 56 bp, Homo sapiens
tgatgggaggtgctgcaggaccaccactgcggtaaggtttctgcaaaccttgtaca

SEQ ID NO: 6761473 - DNA, 88 bp, Homo sapiens
tgttggccaggattgtcttgatctcctgaccttgtgatcggcccacctcggcctcccaaagtactgagattacagacgtgagccacca

SEQ ID NO: 6761474 - DNA, 64 bp, Homo sapiens
ctgggccctggagggcgccgcacagtccaggggatggcgtgggccaaggcccccaagagcccgg

SEQ ID NO: 6761475 - DNA, 59 bp, Homo sapiens
ctgagagcaggaccaggtctaatgaagacactggtgacatgtgcctggcttgctttcgg

SEQ ID NO: 6761476 - DNA, 130 bp, Homo sapiens
aagaactccctcctcccaggaactctggggaacctagggcaggatgggtggggcgtctgaagtgcccaaacctctcctagctctcctcctggtccctcggcctcccacctggcttcctacaaaatccctt

SEQ ID NO: 6761477 - DNA, 71 bp, Homo sapiens
ttttgcaggagaatgttatggtaaggtaggtgcactttgctggagtcatacataccattctctaagcaaaa

SEQ ID NO: 6761478 - DNA, 57 bp, Homo sapiens
agacagacattctagagccaccacatttctgtcttcgtgactttggaaatgctgttt

SEQ ID NO: 6761479 - DNA, 66 bp, Homo sapiens
tgtctgtgcttatgtttccttatagggaaataatattatttgccacaggaagttatgagtactaca

SEQ ID NO: 6761480 - DNA, 87 bp, Homo sapiens
gaccatagcagtagggaaatgtgggctgtttctgtagctattcttgtaaaggttacagagcatctcatttcagaatttgcagtgttc

SEQ ID NO: 6761481 - DNA, 55 bp, Homo sapiens
gagggaggaatccatcctttaccaaataagtggccccaggacacattcttccctc

SEQ ID NO: 6761482 - DNA, 85 bp, Homo sapiens
ggtgtcctgggagacagaagacctggattccaggcttagctctgtgctgggtgccctgggtaggtcagttcccctccctggaccc

SEQ ID NO: 6761483 - DNA, 113 bp, Homo sapiens
ctcttcacttactcaagttacttttccccattattactcgaaatcagagagaataacaaatgctattgttttctagtgttttgaataagggaagtgtttgaataagggaaggg

SEQ ID NO: 6761484 - DNA, 61 bp, Homo sapiens
tctggaatgatttccttccccttctagatcggcaggattgggagaagggtatttttctaga

SEQ ID NO: 6761485 - DNA, 69 bp, Homo sapiens
tcgtaaaaacaggaaatctagcatatatcagaatctgaaagcaatgcatgatttgctgaacttttatga

SEQ ID NO: 6761486 - DNA, 78 bp, Homo sapiens
ggagcaggacaatgaggctgcagtgaggatgggctccatccttgaatgactctgccctccttgaaatttttctgctcc

SEQ ID NO: 6761487 - DNA, 65 bp, Homo sapiens
ggcactgccggcctgggtgtcccgcggacaggtgcccgtcggcgggcgctcaggctgcagctgcc

SEQ ID NO: 6761488 - DNA, 55 bp, Homo sapiens
gctagaagttgggcctggtgctgggacagtcccagttcaggcatgtcctcctggt

SEQ ID NO: 6761489 - DNA, 60 bp, Homo sapiens
cagggagagtaatgagagtgtagccagagacttgactcattctgcatcactcttgctctg

SEQ ID NO: 6761490 - DNA, 69 bp, Homo sapiens
gatgatgactttggagcactgcctgcctctctttttgccaagattcaaggagagtgtttccttatcatt

SEQ ID NO: 6761491 - DNA, 57 bp, Homo sapiens
cctccactctggcctctcaggttcagacaccattcaggcagcacacagcagtggagg

SEQ ID NO: 6761492 - DNA, 103 bp, Homo sapiens
agtatgttttatttcttctaattattctagtcacatagcatttaatcacatgatcccacttttgtctgctttgtgtttgaatagataatggaatgatcgtact

SEQ ID NO: 6761493 - DNA, 55 bp, Homo sapiens
gttcctatctgctatccaaggcatatcaaggtgtctagaaagccaaattaggaat

SEQ ID NO: 6761494 - DNA, 130 bp, Homo sapiens
gttaaaaaaaaatcccagcttacaaatgagttctgccttatctcgttaagttctgcatatctgattccaataaggagtttttgcttgatttacttaattagggagaatacattagggagttgttttttgc

SEQ ID NO: 6761495 - DNA, 59 bp, Homo sapiens
gtgagtttctgtgcacaatatctaaaattaatatggaccctaggtgcagagcaattcac

SEQ ID NO: 6761496 - DNA, 61 bp, Homo sapiens
actgcctttgtaactcttttattgtctagtaatttggaagaagaggagcacaaaggaatgt

SEQ ID NO: 6761497 - DNA, 74 bp, Homo sapiens
cctgggactgaccgggaggctctgaccatttacccaccacaggtaggttgtgttctgaacctcaggttcacagg

SEQ ID NO: 6761498 - DNA, 71 bp, Homo sapiens
aggcagtgtggctggtgctaagtcaggtcctttcccgtgtcctcacctggtttgtctcatcaccaccgtct

SEQ ID NO: 6761499 - DNA, 55 bp, Homo sapiens
cctctggatctttctccacactcttctgaggtgtgcagtagagaaagagcagggg

SEQ ID NO: 6761500 - DNA, 79 bp, Homo sapiens
aggtcatagaaagacatagttgcaagatgggattagaaaccatatgtctcatcagcaccctatgtcctttctctgccct

SEQ ID NO: 6761501 - DNA, 88 bp, Homo sapiens
tggcagaactggaatctaacactgtaaactgtctttgtctttgacaaagttgcataaacaatagtggtagaaaaggccagtgttgtta

SEQ ID NO: 6761502 - DNA, 66 bp, Homo sapiens
tcaaatctttcacgtatggtcatgtctgccacattcaaacagacaagaaccaaagaaggatattga

SEQ ID NO: 6761503 - DNA, 130 bp, Homo sapiens
agtagtagtgacactgggtaaacatttctacagatggtaattggctagcggagggtggtgctgccccctttaaaatagcataggttttccggtgtgccatagtccccatcgctcccattgtgctgcatct

SEQ ID NO: 6761504 - DNA, 84 bp, Homo sapiens
atctctctggagtctagacctggggcaaacgttttctggaaagagctagataataaatgttttaggttttgtgggccaagaggt

SEQ ID NO: 6761505 - DNA, 59 bp, Homo sapiens
tagttgacgcaagattgtgtatgttaagctctggtgatcatgcagtcttgtggcaacta

SEQ ID NO: 6761506 - DNA, 60 bp, Homo sapiens
gctgctgttcctccagtggatccaccatttggctgctgtccctgcttggaactggccagc

SEQ ID NO: 6761507 - DNA, 77 bp, Homo sapiens
agagaatatattggaaggaaattggggcagttgttctgagtgatggaatatcaggtgacattttccttccaatcttt

SEQ ID NO: 6761508 - DNA, 95 bp, Homo sapiens
aaatgtttcacagtttagtctagggaatactgaaaggttgcttttacttaatgaaatttaccctttaaagtttcctggagctaagacgaacattt

SEQ ID NO: 6761509 - DNA, 100 bp, Homo sapiens
tcctttctgttgacagtgcatagaaaagctcaactcagccatgcagtgctgtacacaatgaggaggggcttttctctctagcactgataacagccccgga

SEQ ID NO: 6761510 - DNA, 130 bp, Homo sapiens
aacgtgggacaggagcaagcatgtaacagacaccaatgcactttgtaatctgttcaattacattaattgatagattacaaggtgcattggcgacactgagtaggcatgctcagctctacctagaaaggtt

SEQ ID NO: 6761511 - DNA, 63 bp, Homo sapiens
tgaggccatggtcttcccagtcatctcattgggcatgcccgggttggggatggccaggcttca

SEQ ID NO: 6761512 - DNA, 88 bp, Homo sapiens
gttcactcaagatacacagcgatgagaggaggcgccaaaattcaaacccaggtttagccttctccaacgtctgtgtccttagaggaac

SEQ ID NO: 6761513 - DNA, 76 bp, Homo sapiens
tgttttgtttggcttgggcactacatgtcatggttaacccatgtcatttttactgtaggctaagtcccataaatca

SEQ ID NO: 6761514 - DNA, 56 bp, Homo sapiens
gtctcaagggggaactcactgtagtgcagtccacactccagtgctccccttggggc

SEQ ID NO: 6761515 - DNA, 62 bp, Homo sapiens
ggaaagggcagcccagaactgctgcaggtgctgtcctgtggggaaagggtcctgctctctcc

SEQ ID NO: 6761516 - DNA, 66 bp, Homo sapiens
gtgggattgtggtgagaaactggtagattggtaactcccagatccctcagtttctcatccttccac

SEQ ID NO: 6761517 - DNA, 81 bp, Homo sapiens
gggggtcgctgctgaaaacaataatgatgagactgtaaaatgtataagaaaatcacattataatttctagttgtttccccc

SEQ ID NO: 6761518 - DNA, 55 bp, Homo sapiens
agaaatagcagagtcaggcggggccggttggacaccccctgatctgtttattttt

SEQ ID NO: 6761519 - DNA, 62 bp, Homo sapiens
tcaaagtcacaactctctaattaatgaactgcgagcttcagtttggacaagttgtggtttga

SEQ ID NO: 6761520 - DNA, 96 bp, Homo sapiens
gatgtggtgatgcatgtctatagttctagctacttgggaggatggcctgaacccaggggttctagaccagcttagacaacatagcaagaccacatc

SEQ ID NO: 6761521 - DNA, 78 bp, Homo sapiens
ggttctataagcaaattctggaggtgaggtgcagttgtttcaaatacatcctcctccttcagagtatttatctgaatc

SEQ ID NO: 6761522 - DNA, 70 bp, Homo sapiens
gctcttactacatgcacaattaggatatagcttctcttgtgagcaaaggctgtttattggtattaggagc

SEQ ID NO: 6761523 - DNA, 59 bp, Homo sapiens
ccttaggagttcacttgaatagtcatttttatatttgtgactgcaagtcacttttaggg

SEQ ID NO: 6761524 - DNA, 68 bp, Homo sapiens
aaaagtacactatagacagagcatttttgaaatgattgtttggaaatgttccattattgtgtaatttt

SEQ ID NO: 6761525 - DNA, 68 bp, Homo sapiens
gcaggcccttggaaggtagctggcagtagctgcaattggttaagcaactgccacgttccaggcttagc

SEQ ID NO: 6761526 - DNA, 57 bp, Homo sapiens
tggcagagtcaggattccatcccaggctgagcactcctggatctctgctctgagcca

SEQ ID NO: 6761527 - DNA, 74 bp, Homo sapiens
gacgatgtgcatgtattggggtagggaagccagtgggtcccaccttggcttctttttagtaaatgtcagttgtc

SEQ ID NO: 6761528 - DNA, 64 bp, Homo sapiens
gcatatttatgtctctgcagagaataacctgaccttatttgctgcagtgaccatgaaacagtgc

SEQ ID NO: 6761529 - DNA, 82 bp, Homo sapiens
gtatcatactttgaaaaacactgtgctagtcaaatgcctttgagctacttgtcatgcttgctggtggtgttttctatgttac

SEQ ID NO: 6761530 - DNA, 63 bp, Homo sapiens
tttgtgtctatttttactggaccatgctgtgatatttagtatgcacttaaagtggacatcaaa

SEQ ID NO: 6761531 - DNA, 59 bp, Homo sapiens
ggctcaaggcaggcgcctcaaagactgtaaaactggatgctgatgccctgacctgagcc

SEQ ID NO: 6761532 - DNA, 81 bp, Homo sapiens
caagccatttgaattgttctgtgggaaataaactctcttccaaaactggctgtctcatttccccaggttagatgcgttctg

SEQ ID NO: 6761533 - DNA, 56 bp, Homo sapiens
ttctggcatctgttttcatatttattttattggtaggaactgagctgatgtcaggg

SEQ ID NO: 6761534 - DNA, 129 bp, Homo sapiens
tcctctagggctgccagtttgcatgagggcctcatgtctctccactggcaggggctggtgagcatccagtccatctgtaggagggacacacggtggctgtcttctgcagtgtgggcaggcctggagtga

SEQ ID NO: 6761535 - DNA, 60 bp, Homo sapiens
ctgccctgggccctatccgctgtcagctgcctgagctgaagagagatgcgtccagctcag

SEQ ID NO: 6761536 - DNA, 75 bp, Homo sapiens
tgcatggagggccccctttgccaagtgcaggggtctgggtcccccactccctgtgggcagaggctgcctccagta

SEQ ID NO: 6761537 - DNA, 66 bp, Homo sapiens
tcctttaacaaattggttgcttcaacatgttatgactgcgatatgttaaatagccatttgtttgga

SEQ ID NO: 6761538 - DNA, 83 bp, Homo sapiens
tggcagtgactgctagctgtcctccaatgcatgctgcccctgccacggtatggaaatgtcactgtgaggcagctgtcatgcta

SEQ ID NO: 6761539 - DNA, 77 bp, Homo sapiens
ccagctggtggtgcaggtgttgatgcaggacttttcagaagagcgcttctgtgggagaaacgcctgctgtccagtgg

SEQ ID NO: 6761540 - DNA, 70 bp, Homo sapiens
agaggcaagggacctttctgggatctcttttacaagcacactaattccattcaagaggactctggcctct

SEQ ID NO: 6761541 - DNA, 55 bp, Homo sapiens
ctttagtccttggcaggtaccctgacacctccccaggagctctccaaggacaaag

SEQ ID NO: 6761542 - DNA, 56 bp, Homo sapiens
cagtctgaacactgggctactcctgcgggattccaggtaagacccaggataggctg

SEQ ID NO: 6761543 - DNA, 58 bp, Homo sapiens
ggcagggcaggaaagtcaggaagccagaacaggctccctccccttccctgcctctgcc

SEQ ID NO: 6761544 - DNA, 79 bp, Homo sapiens
gagggactgaggggctttcaggcccagctttgctctgcaaaaggtttactgtggctgtgaaacttctcagtcacccctc

SEQ ID NO: 6761545 - DNA, 59 bp, Homo sapiens
cttttagtgcatcagacaccctctctcactgttcagaaatgagaggatgcatctaagag

SEQ ID NO: 6761546 - DNA, 55 bp, Homo sapiens
cactgaaggacagtaggaagggagataccttccccagccttactgcccttcagtg

SEQ ID NO: 6761547 - DNA, 129 bp, Homo sapiens
tgcacacatgacttataatacatatatacgtattgcatgcatatatgctacatgcaacatatgctataaacattttgcatgtgtgcatatatttgcatcacatatgtgtacatgtatacatgtgctgca

SEQ ID NO: 6761548 - DNA, 68 bp, Homo sapiens
ttcgtttctgcccccttgatggacttttcccactgtaaacataagcctctgggtgggcagcagatgga

SEQ ID NO: 6761549 - DNA, 94 bp, Homo sapiens
cagtgtgatttgtttttattgttcatgtatgaataaatattaaaatgtaatcatctgtttatgccgagcatgagctgaaatgcctgtgacattg

SEQ ID NO: 6761550 - DNA, 84 bp, Homo sapiens
gaggctgttaggtggtccgtggctcggcagctcctggcttcccaacaggcatctgtccggtgcccgggcctccccggcagcctt

SEQ ID NO: 6761551 - DNA, 109 bp, Homo sapiens
gaatgaccggtggaagccaagtattgctggatccacaggagggtttggaaaagcaggagaatgtttgcttcaccccaccttgttgccagtttttgtccaccaatcaatc

SEQ ID NO: 6761552 - DNA, 56 bp, Homo sapiens
tttgtctgcttgttcagatggaacgcacccctgtcccacactgacaaggcaacaaa

SEQ ID NO: 6761553 - DNA, 75 bp, Homo sapiens
ctgttgcatgactgtgcatgctacttaatcattaaattccgtaattacaacagcaagcacacttcatgtgaacgg

SEQ ID NO: 6761554 - DNA, 63 bp, Homo sapiens
ccagaatttagcacaatgtatggcacttagtagttgctccataatcgtgtgttaaataattgg

SEQ ID NO: 6761555 - DNA, 86 bp, Homo sapiens
atgctgactaatgggaagtcgtagagttcatgtacaccttctaatatttggctttgcaaatgttctgtgtgacttctgctcagcat

SEQ ID NO: 6761556 - DNA, 75 bp, Homo sapiens
ttttttaaatatctatctgctgggaactatttaaatatatattgtttctaatgttctcagggattgagtagaaaa

SEQ ID NO: 6761557 - DNA, 113 bp, Homo sapiens
tggcaaacagctttaagaaataaatgatgctctaaagtctccatttttatagcatgttttgatgtaatgatgtacttagaaggatcaaatgtaatttcttaatatgtaggtta

SEQ ID NO: 6761558 - DNA, 56 bp, Homo sapiens
ctgttctctgttctattgtgatttctaggtagaagaataagtagatgggagaaggg

SEQ ID NO: 6761559 - DNA, 55 bp, Homo sapiens
tttacaagtcagggactgttctggatttaattcccccagtccgatgtgttgtaaa

SEQ ID NO: 6761560 - DNA, 75 bp, Homo sapiens
tgctgtacctccaggatgttagacgtccagaatgcactgccctttggatactatatatacctcaaggaggctgta

SEQ ID NO: 6761561 - DNA, 68 bp, Homo sapiens
attagttgatactatctgtacagggttacaaattaaccactttcaagtttcagaggatatgaactagt

SEQ ID NO: 6761562 - DNA, 61 bp, Homo sapiens
gcttctgtaatttcagcttgagtgtctgccattgacctgcagcagctgaaatcacaggtgc

SEQ ID NO: 6761563 - DNA, 80 bp, Homo sapiens
ggctctgggtaaggcgtttgaccctggcaccttcattgtctatcaaatggggaccctgttagactcagcctcccagagtc

SEQ ID NO: 6761564 - DNA, 123 bp, Homo sapiens
tctatctttgaaaatgctttgtcatgtgtggattcatctcaaagagataaacctttttctaattcagcatgttggaaatgctctttggatagaattacaaagggaaagtttggagcatataga

SEQ ID NO: 6761565 - DNA, 59 bp, Homo sapiens
atcttagaatatacactacagcttaattcatggaatataagatgtgtatatattgggat

SEQ ID NO: 6761566 - DNA, 69 bp, Homo sapiens
ccacttccaatagagatgctagctagcagggtaaggagcttactctgagtcatgcactccttggagtgg

SEQ ID NO: 6761567 - DNA, 88 bp, Homo sapiens
agatcaataaatacaggaaaaacatagaagatggttaattgtaggatttatgtatgcctcttaatctgtggttttgtattaaagattt

SEQ ID NO: 6761568 - DNA, 62 bp, Homo sapiens
ttgatttcttttggccatttgagttgacaggctgtgcaaatttacaggttaaatgaaatcag

SEQ ID NO: 6761569 - DNA, 112 bp, Homo sapiens
gtagagacggcttttcatcgtgttagccaggatggtctcgatcggcaggaggatctcttgaggccagaattttgagactacttgggcaacatagcaagaatcccgtctctat

SEQ ID NO: 6761570 - DNA, 66 bp, Homo sapiens
ccagagtactgctgctgggtactgagtgtttgtccctcacataggattccagaacagtgctgctgg

SEQ ID NO: 6761571 - DNA, 84 bp, Homo sapiens
cctcaggaagtccctggttcctagcaaaaagtccattagctcaggcttaatgctatcctaaagccagtggccttctttatgagg

SEQ ID NO: 6761572 - DNA, 61 bp, Homo sapiens
aggtgggtgcagggggcttcttagggctctccaaatactccttagccacccctgacctcct

SEQ ID NO: 6761573 - DNA, 76 bp, Homo sapiens
gttagaggtaaacactgtctctggtattgaagaggtgaatatgtttacaaaccaaggaacagtgatccactttaac

SEQ ID NO: 6761574 - DNA, 65 bp, Homo sapiens
acttatggcgggatgctgcttatcttagtttatttcagacagttggcaaggtctggccagcgagt

SEQ ID NO: 6761575 - DNA, 81 bp, Homo sapiens
gcccaggctggagtgcaatggcgtgatctcagctcactgcaacctttgcctcctgagttcaagccattctcctgcctcagc

SEQ ID NO: 6761576 - DNA, 59 bp, Homo sapiens
ttcaggactgtggactctgcttgaatgattcatatcgtgacagccattacagacttgaa

SEQ ID NO: 6761577 - DNA, 56 bp, Homo sapiens
gtggtaaagctgattgaattgaagttttgcaagtctttgaaatcagctgttgccat

SEQ ID NO: 6761578 - DNA, 65 bp, Homo sapiens
cagatttagggccagataggcttcttgatttttgtcggatgtctacaagcctggcctgtagtgtg

SEQ ID NO: 6761579 - DNA, 80 bp, Homo sapiens
gggaccccttccctgctgtaccctactcggagttctaggtcccccttatgctttctggtttgtgctacagggaagggccc

SEQ ID NO: 6761580 - DNA, 56 bp, Homo sapiens
tgtgggacagggacagcaagagaagccactgctccctgcacttgtctttgcccaca

SEQ ID NO: 6761581 - DNA, 84 bp, Homo sapiens
aggctctttcctagagggtaaaacaagatcaagtggtatttgattgaaaataaggccagaaacaaaaactctaagaaacagcct

SEQ ID NO: 6761582 - DNA, 81 bp, Homo sapiens
tggcatggatggcctgagcacagctggcatggaggtcaggccaagctaagctgagagcccaggccacagggagtcctgcta

SEQ ID NO: 6761583 - DNA, 58 bp, Homo sapiens
taccccggctttcagttgggtttgaccaatgataaacaccagcagaagactgagggtg

SEQ ID NO: 6761584 - DNA, 76 bp, Homo sapiens
ctctgagcagcactgagttagcagctccagccagactagaagaagggaagcaggtcaactgagagctgacacagag

SEQ ID NO: 6761585 - DNA, 82 bp, Homo sapiens
agtgaagtggtagtcactgctatattggatactgaggctttacaactgcatcatgtctgttagtaatggtcatctcttagct

SEQ ID NO: 6761586 - DNA, 118 bp, Homo sapiens
ctttcatcgtcttctaatgaccaaacactttgttctagagctatttagagcattttaggttttcccctaacatctttagcagctcgaacttggaagaagtcattacgaatgatgagag

SEQ ID NO: 6761587 - DNA, 107 bp, Homo sapiens
tcataggttggtgaggacaaggaaaggtgggacacatagaaaaataaggtatttctacttgtgatcttgttgtctagtgtgtctacaagtcctaattaacactttga

SEQ ID NO: 6761588 - DNA, 89 bp, Homo sapiens
aatcattttgggctgctagcctaaggttgttaagcagcacatgttgatcataggagtaattactaagggctgcataccccagaatgatt

SEQ ID NO: 6761589 - DNA, 114 bp, Homo sapiens
ggggcccatgtgtgtggcatgggactgggattgctgggctcttcaacacacagtttctgggagcctgtggctgttgaggaccccaagtgccccagaatggcctcgcttggctcc

SEQ ID NO: 6761590 - DNA, 81 bp, Homo sapiens
gggtgctgggctgcaagtgccaccatcacgtctgcccacagggcacaccttgtctgagcacaggcaggttctgagctgccc

SEQ ID NO: 6761591 - DNA, 115 bp, Homo sapiens
gcaataagccatattcacattgtaattgttctttccacattctctgtttagggatgtattctagcatgtttaaatgaggctgatgtagattaatttctctgtaggagtttgtagc

SEQ ID NO: 6761592 - DNA, 65 bp, Homo sapiens
gggagctgagggacctctgtggtcaggctgcttcactggccaaccagggaccttgtgccattccc

SEQ ID NO: 6761593 - DNA, 65 bp, Homo sapiens
tcagaatgatatattagcagattttagatacagctttacaaatgctgactgatttatcagactga

SEQ ID NO: 6761594 - DNA, 60 bp, Homo sapiens
ggttttagctttgaattccatggaggtctgttcagattactcctaggatttaagctctcc

SEQ ID NO: 6761595 - DNA, 128 bp, Homo sapiens
aaatgttcatttcctttgcttttacttacaattccaacatagtacccagataaatgacagggctttaggtatactttcaggtctctttctcatattactgatcaactggaataaggagatgggcattt

SEQ ID NO: 6761596 - DNA, 55 bp, Homo sapiens
agaagctgaatgtgggctttggagctggtcagatcggagctggcatccagcctct

SEQ ID NO: 6761597 - DNA, 64 bp, Homo sapiens
ttcctggctaatcttaaggcttttgctaaatttaattagcacatactgcaaagattactaggaa

SEQ ID NO: 6761598 - DNA, 58 bp, Homo sapiens
ttttgctgagggagagcctcactggggtgtcctgatgctggcagtttcctcaccgagg

SEQ ID NO: 6761599 - DNA, 60 bp, Homo sapiens
agtatcatgacggatggaatctccattaaaaggagatcttagtggccaatgtcagatgct

SEQ ID NO: 6761600 - DNA, 88 bp, Homo sapiens
gctcttataaataactcatttgcatttttcctgtcttccaacataagaatgaggattcaaagaccaacaaatgaaagtctatgggggt

SEQ ID NO: 6761601 - DNA, 58 bp, Homo sapiens
tgactgttatctgcacgtagagttttctgcttcagaaaattaggctagatgacattca

SEQ ID NO: 6761602 - DNA, 73 bp, Homo sapiens
caaaaatcagctttcagtggtggattgctgttagagttgtttaagtaataccttgctcatagggctgatgctg

SEQ ID NO: 6761603 - DNA, 87 bp, Homo sapiens
gggtgaggtggaaattactgcatcattttcagacaatgggggcattctagtctttattaggaagcaatgtgcatcttcttcaagccc

SEQ ID NO: 6761604 - DNA, 72 bp, Homo sapiens
ttcaaaattcaggcttttgcagtcaaatcttcttccgccaaatagtaaagaggctcaagagcccattctgaa

SEQ ID NO: 6761605 - DNA, 71 bp, Homo sapiens
tttggatgctgtcatatgctgctttgagtgaaccagagaaacagccatttgcagcatgagaaagccccaaa

SEQ ID NO: 6761606 - DNA, 59 bp, Homo sapiens
ggcctgtaccctggctgttatgagaaccagaggggttctcaggtcaccagggtgccacc

SEQ ID NO: 6761607 - DNA, 76 bp, Homo sapiens
gcccaggaagtggccttcaggcactggggtttagatgcaggaacctctgtatagttgcctgtggccacatctgggt

SEQ ID NO: 6761608 - DNA, 62 bp, Homo sapiens
ctttgcagggcaaatggtcagatagcatcaggctgctctctgagacagtagcctctgcttag

SEQ ID NO: 6761609 - DNA, 72 bp, Homo sapiens
cccaggccagcaccattttcctggtcagctctggacaggcaggtgctggcacaggtggatgctggccatggg

SEQ ID NO: 6761610 - DNA, 97 bp, Homo sapiens
ttggtttctggtagggttttcctttagtggtattttagcaagtaatacaatccagttatttttaaaagtatattagtagaaactcaccagaagtcaa

SEQ ID NO: 6761611 - DNA, 56 bp, Homo sapiens
gggctctgtttagatcagagatcagcaaactatggtccgtgggccaaatacagccc

SEQ ID NO: 6761612 - DNA, 60 bp, Homo sapiens
cagaattcttaaaacttatggacaggttgaaataactttccatttgtattaggagttctg

SEQ ID NO: 6761613 - DNA, 67 bp, Homo sapiens
gaggtttctctagggctgaccagttctgattttccatcagacactgtaaaactgctttggaaacttc

SEQ ID NO: 6761614 - DNA, 63 bp, Homo sapiens
ttagggaagcaggaatgagtgatactaatatcagttttattttacatcatgctacttctctga

SEQ ID NO: 6761615 - DNA, 55 bp, Homo sapiens
atactgagggtcaacttgattgtattgaaagatacaaagtattgatcctgagtgt

SEQ ID NO: 6761616 - DNA, 55 bp, Homo sapiens
cccccattctggccagcccagctgacatcccagctaacagcagccacatggaggg

SEQ ID NO: 6761617 - DNA, 55 bp, Homo sapiens
atgagataggaacaaacttacaggatgcttatctggaccttgtgttctatctcat

SEQ ID NO: 6761618 - DNA, 62 bp, Homo sapiens
ttgtgtccccctttgagagccagaaactgttaacctatggagcttagaggtacagggaccag

SEQ ID NO: 6761619 - DNA, 79 bp, Homo sapiens
gtgtaagagtttgtattttttcatgtgtttttatttaccttttgatgtctatacatgtaagacatgagactctttacat

SEQ ID NO: 6761620 - DNA, 78 bp, Homo sapiens
cggaaccagagtcaggggctattcagactggcacagccaatgtgtcctactgaggagctcctttgctgctgtgttttg

SEQ ID NO: 6761621 - DNA, 55 bp, Homo sapiens
gacaaaaggaagagggaagatatttcatgagtagcaacttccctcttcctttgtc

SEQ ID NO: 6761622 - DNA, 75 bp, Homo sapiens
ggaatctgagtcctgttgtcccagatggggtttgaattccccatgccttctgactcacaggtattctaagattct

SEQ ID NO: 6761623 - DNA, 100 bp, Homo sapiens
tgaggcaggagaattgcttgaactcggaggcagaggttgcagtgagccgagatcacaccactgcactccagcctgcgcaacagagcgagactctgtctca

SEQ ID NO: 6761624 - DNA, 82 bp, Homo sapiens
ggtgtggttagggtatttgttgagttgttatgtcttctatcataagtagacatggaagtttaatatattttttaaacacatc

SEQ ID NO: 6761625 - DNA, 65 bp, Homo sapiens
gtctttgcaaatgctctgcagagctggcccttctcgcaggagtggtgtggattatttgcaaaaac

SEQ ID NO: 6761626 - DNA, 72 bp, Homo sapiens
gtgttcccacctaggagtgttaggaagttgtgtttgtgtttcaagcagaaaaactgagctccaagtgagcac

SEQ ID NO: 6761627 - DNA, 88 bp, Homo sapiens
gaagctaaagagaatttgtaagaatccagcgcaattcagaatcagaggttttagagctgggatggattttccagaaatcttctgtttc

SEQ ID NO: 6761628 - DNA, 99 bp, Homo sapiens
gcctcctgtgcccagcctgggctgcccgaggccaggacgactccgagggacccaaaaaggagagtcggaggcaggagacctgggccgggtgcaggtggt

SEQ ID NO: 6761629 - DNA, 125 bp, Homo sapiens
ggtaaagtttcagtttttctttagatgtaaattttcttagcaatcctaggctggatcagccttttggtatgtttatgattttctatgattgctcagaaactactcatagtggctgagatgatacc

SEQ ID NO: 6761630 - DNA, 71 bp, Homo sapiens
agggttggtgactaggtggcccacagggtgaacacagtgcatgcccctctggtcaaccagtcacacaccct

SEQ ID NO: 6761631 - DNA, 56 bp, Homo sapiens
tttgacaaataggggaataaggctcaattactttgcctatttgtttatttgttaga

SEQ ID NO: 6761632 - DNA, 89 bp, Homo sapiens
tataaaatgaaaatggatgtctacatgtgttcttaagagagataatttctgttcagacactttacatgtatatattcagacattttata

SEQ ID NO: 6761633 - DNA, 72 bp, Homo sapiens
aaattaactaacctgttgaaggaattgctatgtgaagtatatatgagcacttcccttgcaggttatgaattt

SEQ ID NO: 6761634 - DNA, 107 bp, Homo sapiens
aggtaaacgtggacatgaaagaagccagggtgaggcaggcagcttccagaagcacacactgggctcagctccttccttcctaacctctattttagctccacgtacct

SEQ ID NO: 6761635 - DNA, 68 bp, Homo sapiens
ccagtttctttagatagaaagttcaattattaatttgagaacttttattttctaaagtaagcatttgg

SEQ ID NO: 6761636 - DNA, 55 bp, Homo sapiens
gccctgtgctccctatgtatctggttcagtttcagagattccgggacgcagtggc

SEQ ID NO: 6761637 - DNA, 62 bp, Homo sapiens
gccattatactcagtctcattgccagttcccttgctcaggagactgaggctgaatatggggc

SEQ ID NO: 6761638 - DNA, 62 bp, Homo sapiens
acatactttgggataagagtggatataattaatgctttgttctgattcattccagagtgtgt

SEQ ID NO: 6761639 - DNA, 66 bp, Homo sapiens
ttgccatttcccatggacctgcctcaccaacccacagcggacaggcagtccccaggggtgttgcaa

SEQ ID NO: 6761640 - DNA, 68 bp, Homo sapiens
ccatctcgtagtctcagctctcacgagtgcccaactgctgccctctctgagtatcctgaactgcctgg

SEQ ID NO: 6761641 - DNA, 83 bp, Homo sapiens
ttctcactttacagtttgggatactgagtctaagagaggcccagtgcttctttggatgcgttacttttactgctgtaggagga

SEQ ID NO: 6761642 - DNA, 76 bp, Homo sapiens
gaaaatacaaggactacacccacattgagcatgggacatggaaaaatctgatgtgtgtgtgtatgtgtgtgttttc

SEQ ID NO: 6761643 - DNA, 80 bp, Homo sapiens
gggatgttttatatccagaacacctgtatcaccagatgtgcactagttacaatgggttctgtgacttgttaaaacatccc

SEQ ID NO: 6761644 - DNA, 57 bp, Homo sapiens
tgggagatggttctgagactttgcatcaccagggatctctttttaaaatctctccca

SEQ ID NO: 6761645 - DNA, 85 bp, Homo sapiens
ggtcctcgggtttttcagttgggcaattacagtatgcttaggagtagcttcagctttttggattgcccaagtcagccctgggatt

SEQ ID NO: 6761646 - DNA, 70 bp, Homo sapiens
gcacagtaagtcaacaaacatgggggcggaggtacaagactgaatactcccatgtttgttgttgctgtgc

SEQ ID NO: 6761647 - DNA, 75 bp, Homo sapiens
aggaaagagcccagagttaggaggtggaatgtggggtcccacagctgccccctctctaactccctgcttcctcct

SEQ ID NO: 6761648 - DNA, 65 bp, Homo sapiens
agtaccagtgtttgttgagaaaggcaactaagcttttggttggctttagcccaaatgactggact

SEQ ID NO: 6761649 - DNA, 58 bp, Homo sapiens
cctctgctccctctgccctgccccactactgtgacaggctgagctcaggggcagcagg

SEQ ID NO: 6761650 - DNA, 69 bp, Homo sapiens
ccaggaaagaaaggaggtgcatttacaagagccagagaatcctgaaaaaacacaactgtctttctctgg

SEQ ID NO: 6761651 - DNA, 58 bp, Homo sapiens
acggaggtcaacttggtcaccaagcgtggcttggtgcccactctggacccagctctgt

SEQ ID NO: 6761652 - DNA, 55 bp, Homo sapiens
gccacagcttagatcacagcctggtgagtaaacacaggttgaagagaggtgtggt

SEQ ID NO: 6761653 - DNA, 72 bp, Homo sapiens
gttccaacacggaagccaaggggaagggaggatatattttgcatgttgttcagtctttgctggctttgggac

SEQ ID NO: 6761654 - DNA, 60 bp, Homo sapiens
gtttcctgaccctggcccagcaggtaggattgctggctatgttatctaggcctaggaagc

SEQ ID NO: 6761655 - DNA, 57 bp, Homo sapiens
gaggaggcacttgagcagatgttagctattctccctagcctgtgcacatgtgtcctt

SEQ ID NO: 6761656 - DNA, 75 bp, Homo sapiens
aatttcgtatatagtatgtcctccagaattcttaccaatgctaggacattagggaatactgctgtgtgctaaatt

SEQ ID NO: 6761657 - DNA, 59 bp, Homo sapiens
tcagtaaattaaagttgggccattcgtcatcactgacaaattgccccattttgaactgg

SEQ ID NO: 6761658 - DNA, 73 bp, Homo sapiens
ccatctgcttggcagaaaaggtcgggggtttgcaaagggagtagcctctggtccttttttcccttaggcgtgg

SEQ ID NO: 6761659 - DNA, 64 bp, Homo sapiens
agcagaggcaggcaggagctggaacacaatcccagcattttagctcctgaggccagcctctcct

SEQ ID NO: 6761660 - DNA, 58 bp, Homo sapiens
ggaaagtacagccagcacccagactcaggtgagtcccaagcgcgtgggctgtgcttcc

SEQ ID NO: 6761661 - DNA, 104 bp, Homo sapiens
caagtttgacctcccggtccctgtgccattctccctgcactttgcggttagccaggtcaggctggctcgggaagcaggggatctgggaaggaggcactaacttg

SEQ ID NO: 6761662 - DNA, 63 bp, Homo sapiens
gaagactcacaagtgatgtgaatggcaaagcttggcttgaagctgttcccttgtgcctctgtc

SEQ ID NO: 6761663 - DNA, 59 bp, Homo sapiens
ggcttatgtgttcaacactaaggaacatgccatgtttcttcagtgacaaaggcaaaacc

SEQ ID NO: 6761664 - DNA, 105 bp, Homo sapiens
ccaaccatgtattctggtttgttgttgttgttgttgctgctgttcagaaaataagatccccagagccacagcaagattaagggcagaaaattacattactggtgg

SEQ ID NO: 6761665 - DNA, 80 bp, Homo sapiens
gggtctttacctatgtctgtatcccccgtttgctgtttaattggctattagctagaactgattgatagacataaagactt

SEQ ID NO: 6761666 - DNA, 61 bp, Homo sapiens
gggaggcagcttagggtactgactaagcccataggagtcagactatcttggttgagatccc

SEQ ID NO: 6761667 - DNA, 76 bp, Homo sapiens
gatacacgttctgaagaataggatgttgtgtggtggtcactcattcattcattcattcattcagcaggcatgtatc

SEQ ID NO: 6761668 - DNA, 72 bp, Homo sapiens
gacaagagaatgacaaggagaacctaaatttggagaatcacagggaccaggagctcctgcatgcttcctgtc

SEQ ID NO: 6761669 - DNA, 78 bp, Homo sapiens
ttgacaagttcttgaagactttaaatagcaagcaagggagaaatggttttctgtagtatatagagttagaacttgcag

SEQ ID NO: 6761670 - DNA, 67 bp, Homo sapiens
agggtatgttttaggctgagttgaagagaaaaatagtctattagaaatagtctaatgcataagccct

SEQ ID NO: 6761671 - DNA, 100 bp, Homo sapiens
gttctttccttctcaaaatatggagctctgggagggggcactacatgggcctggaatctgtgtggtccctgagacctttgggagtgtgtgaggcaagaac

SEQ ID NO: 6761672 - DNA, 117 bp, Homo sapiens
cctcagcgagtgcattgagtgatattggtgtgaggtgggggcagctggggtggctccaaggcacagtggccctgccagctgttcccacccaaaaccatcaccatgaaggagctgagg

SEQ ID NO: 6761673 - DNA, 67 bp, Homo sapiens
actttatgtttgtgtataatacacatatcagaaattcaagacgtgtgtgtgtttataaatctaaagt

SEQ ID NO: 6761674 - DNA, 75 bp, Homo sapiens
tgcattatacatggatctaaaggtaaacactatcacctgagtctcattaccagcattggatactgtgtatatgta

SEQ ID NO: 6761675 - DNA, 81 bp, Homo sapiens
agtaccagctgagttggtttcatcgttaagtaggaatggtgtcttgcttcccctactctgtgagccactttgcttagtact

SEQ ID NO: 6761676 - DNA, 56 bp, Homo sapiens
gggtggctttacttacctctatcttaatgccaaccagatgggtattgaagtcacct

SEQ ID NO: 6761677 - DNA, 63 bp, Homo sapiens
aataatagcagagtttacaatcactgaagctaggagactggccacggagactcgttacttgtt

SEQ ID NO: 6761678 - DNA, 57 bp, Homo sapiens
gcctgctttctgactttgaagggttggtatgcttccatttttcattataaagcaggc

SEQ ID NO: 6761679 - DNA, 61 bp, Homo sapiens
tttgctcttgagctaggcctggagtctgggtcccactttctgggctgagctcgagtgtaga

SEQ ID NO: 6761680 - DNA, 121 bp, Homo sapiens
gggtgtggggtgggagtgtgttttttgctggggaggggattgcaggctagtttagggctcacaaagaggccagagagggagcagtagtctctcccatcattggttcctccctccccaccct

SEQ ID NO: 6761681 - DNA, 57 bp, Homo sapiens
gagatggggggcaagggctggccgaggagtcctgaggcagtcaccccctcctgcttc

SEQ ID NO: 6761682 - DNA, 57 bp, Homo sapiens
ctggtacagtgttacaaaatggggagagtgaccacagggttggggcactggacgcag

SEQ ID NO: 6761683 - DNA, 56 bp, Homo sapiens
gaggtcagggcatggactaacacctctgcctgtggctctctccaaagcccgacttc

SEQ ID NO: 6761684 - DNA, 73 bp, Homo sapiens
ggtatcgcacactaggaacaaccatcatttatctaactgtgatgtacatgttggttgtttccagtcttttacc

SEQ ID NO: 6761685 - DNA, 82 bp, Homo sapiens
tttcatctccaaccctctgccagtttggcccctcagagcttggtggctcaagactgttagcctggcagagccaggggtgaag

SEQ ID NO: 6761686 - DNA, 88 bp, Homo sapiens
ccactagaggaagagtaacaggaggtggaacccagggatggccacatgcaacctgtttgtcccacctcatgcctcttcccagctatgg

SEQ ID NO: 6761687 - DNA, 87 bp, Homo sapiens
ttagttgcttttgaaggggctgggaatgagcatgtgggaagagggatagacatgcatgtcatcagccctttaataatgagtaggtga

SEQ ID NO: 6761688 - DNA, 62 bp, Homo sapiens
ggagtaggttctctcagcatcccaccacgttgctggtgtggcagtgtgaccgagcttgcttc

SEQ ID NO: 6761689 - DNA, 66 bp, Homo sapiens
ctgaattagatgaaaaaggctctgcttgatgtaatattgcgagtctttaatgatcatgtatttcag

SEQ ID NO: 6761690 - DNA, 65 bp, Homo sapiens
ctggagaagtactgagacatttagaggttaaactaaactcagagtgccataaagtccttcttgag

SEQ ID NO: 6761691 - DNA, 68 bp, Homo sapiens
tgtaaacacttaggaactttgggttgctggatacaccagttccaggctacttggattcctggtctaca

SEQ ID NO: 6761692 - DNA, 130 bp, Homo sapiens
tggaaaactgtcaaccccactcccctggagtatcaaaggacttgatgagacgtcggacacccagaggttgtctgtctccctgtgggcccctgagacagaggggagactggggtcaggggcaggaggttta

SEQ ID NO: 6761693 - DNA, 64 bp, Homo sapiens
gttctatgcaagggtaaccccagacatatgcagctccgtcataactgactcctttgtctggaac

SEQ ID NO: 6761694 - DNA, 63 bp, Homo sapiens
agtttggcagaggttgtcaggccactgtttctgtcccttggtctctctcctctggccacaact

SEQ ID NO: 6761695 - DNA, 63 bp, Homo sapiens
taacaagatgatccaggaaagctcctgccaatttggttgtggagtgtcatttgatcattgtta

SEQ ID NO: 6761696 - DNA, 68 bp, Homo sapiens
gttgctatagcaaagtgcaggggcagcaaatatctgttttctgttttgacactcttgtctctagcagc

SEQ ID NO: 6761697 - DNA, 68 bp, Homo sapiens
tacagtgggcagattatagatgatgcccttagggttgtggggtaaacattttcatctgtgcccttgta

SEQ ID NO: 6761698 - DNA, 56 bp, Homo sapiens
aagccagtgggcatagcagttgaatttatgcagctgtttctgatattacatggctt

SEQ ID NO: 6761699 - DNA, 126 bp, Homo sapiens
caactctgagatcatttgcatcgtcctttctggtgtcatgtcatactgttcttcccaggaggacagcctcctcctggctcagagtatgtcatcgcctgggagggggaaggcagttggaagggttgg

SEQ ID NO: 6761700 - DNA, 55 bp, Homo sapiens
gcagtcctgggattctgtccttattataaaaggccatgggtctttaaaggattgt

SEQ ID NO: 6761701 - DNA, 76 bp, Homo sapiens
attttgttatctttaccagaaggaccagaggcaaggatgaaactaagaagtcacctttgctccttctggtcaaaat

SEQ ID NO: 6761702 - DNA, 79 bp, Homo sapiens
cagctcccccactcccatctctacctgctccatagccattcttagtggaagggctcgtgggagagagagaggtgagctg

SEQ ID NO: 6761703 - DNA, 61 bp, Homo sapiens
ttgaggcccagagaggttgcatgaccttcccaaggtcaatgagagccactctggggttcaa

SEQ ID NO: 6761704 - DNA, 77 bp, Homo sapiens
tctgcagaggacaggttttccatgggcttttcccctgggtgagaccagtggcatgcctggaaagccctccctgcaga

SEQ ID NO: 6761705 - DNA, 73 bp, Homo sapiens
ggtagagtctgggagaggcttggcccagcctggggggtacctaaaactctccggtgcagcctctggattcacc

SEQ ID NO: 6761706 - DNA, 57 bp, Homo sapiens
aaagaaaactgtttaggctgcactcaaaggatcaggtgtggtcaacaggatttcttt

SEQ ID NO: 6761707 - DNA, 62 bp, Homo sapiens
ctgcatgtcaaggcactcaggatattgcacattcttggcaatcttgttgcctgtgacatcgg

SEQ ID NO: 6761708 - DNA, 89 bp, Homo sapiens
agggagcactgaagatgaggctgctggggggtcttccttcattacacatgctgggccggttgccccagctgccccgcatctctgtccct

SEQ ID NO: 6761709 - DNA, 60 bp, Homo sapiens
gggcacctgggagggggcaataatgtgttggagccagcccatgccagctcacaggagctc

SEQ ID NO: 6761710 - DNA, 126 bp, Homo sapiens
gctcaggaaacactaagcaaattccaacagattagcaaaggtgatttagatatattatgttgatttagatatcaacatgctatgagagattacttctactgatcacagcagctaagaagactgagt

SEQ ID NO: 6761711 - DNA, 71 bp, Homo sapiens
tgatgttggagtcgtaaggcatggagctgcagaccatgatgtagaggatcatgcccaggctccagatgtca

SEQ ID NO: 6761712 - DNA, 105 bp, Homo sapiens
gttacagaaatttttaaatggaatcgaaactgtcattggatgcatttggttcatcagatccagattcagttcgatgtgcagttctggttccttatcagatgtaac

SEQ ID NO: 6761713 - DNA, 66 bp, Homo sapiens
ggagtaagacccacaagatttaataggctggaaaagacctgggaggctgtgggtctgctgagctcc

SEQ ID NO: 6761714 - DNA, 60 bp, Homo sapiens
tacacccacatgcctaggagggagaaccattttcctccacgtgagggcatacagggtgtg

SEQ ID NO: 6761715 - DNA, 63 bp, Homo sapiens
tggcaagccgctggctcccagaaatgttttggttccccctcagctctgggaagccgggctcca

SEQ ID NO: 6761716 - DNA, 76 bp, Homo sapiens
gctccttttccttgggttctgatgtgtttggcaccagtggaatatcttatgattacctctagggaaagtttagagt

SEQ ID NO: 6761717 - DNA, 93 bp, Homo sapiens
gtagtgccaggggcaggaatggcctgctgcagtgtgacagttctgtcataggagagctgctttgctgggcaggcccttgactcaggataatac

SEQ ID NO: 6761718 - DNA, 82 bp, Homo sapiens
ggaaccaggttgaaatcctgccattgccttgtgcttgctttatgatcacagaagcaaaagcaggatctttattctgagtttt

SEQ ID NO: 6761719 - DNA, 57 bp, Homo sapiens
agatctggttggagtcctgacatgctacttacttgctgtttgaccttggccaaatct

SEQ ID NO: 6761720 - DNA, 75 bp, Homo sapiens
cagcaggtgctgagatggtgctggagatggcacacctgccctatcagctcagtttcccaccctctctcattgctg

SEQ ID NO: 6761721 - DNA, 77 bp, Homo sapiens
ggttgagggaaggtagaggtcaccggcacatagttcatttgcaaatatatgctgatgacatctatcttccctcaacc

SEQ ID NO: 6761722 - DNA, 70 bp, Homo sapiens
ttggaagtgatagatccatattttggtaaaaaactatggtgccatctatgtctagttaaaaaacttccaa

SEQ ID NO: 6761723 - DNA, 61 bp, Homo sapiens
gcatatggccttatcactatgctgttggacaacagatacgatgaatagagagcacatatgc

SEQ ID NO: 6761724 - DNA, 71 bp, Homo sapiens
tgccaatttttctgcagatggcagtgtaactgcatttttatgctaatgtttgtggaagatacttgaatgca

SEQ ID NO: 6761725 - DNA, 61 bp, Homo sapiens
ggaagttattgcagcaatccaagtaacagataacagttgccagggttgtagttgtaaagcc

SEQ ID NO: 6761726 - DNA, 63 bp, Homo sapiens
ctgcgtccagccctaagctgaaccttctgtgggctgcagaagacgcctgggtgctgtactcag

SEQ ID NO: 6761727 - DNA, 75 bp, Homo sapiens
tagcgcggcacttacctctctctaatggtgggataaagaccctgccagtttggggccgggataaggttgttgtta

SEQ ID NO: 6761728 - DNA, 60 bp, Homo sapiens
aggcaggtttcgggaaggggggtggccaggggagggccaaaccccttgtgtaactagcct

SEQ ID NO: 6761729 - DNA, 76 bp, Homo sapiens
cccaaagtttttatagttagcattaagaatattaataggcaactatgaactaagtggtagctgctaagattttggg

SEQ ID NO: 6761730 - DNA, 95 bp, Homo sapiens
ttagttttgttttcagtcactttattaaattatggatttaggagataacgtctcatgcatactagatatttattcagtgacttcacaagtgctag

SEQ ID NO: 6761731 - DNA, 64 bp, Homo sapiens
ggctgccttccaaagagttttataagtaggaattatgaaacttgagggagggtgattgaaagcc

SEQ ID NO: 6761732 - DNA, 56 bp, Homo sapiens
gaagcttcaccttgctgaaaagtttaggctggcatcattcagcaggctgaagcttc

SEQ ID NO: 6761733 - DNA, 69 bp, Homo sapiens
cctactctggtcattttcactttcaagttatcaacatgaggtcactgtagatggaggtgggaagagagg

SEQ ID NO: 6761734 - DNA, 130 bp, Homo sapiens
gtttacagaaacattacacagactctgatgtcagtcatgatgtttcagcctctgcccttttcctgtatcaaccctgatggataatagggcgtgggttctgtctgttatcagggtgtggtcccctgtgaat

SEQ ID NO: 6761735 - DNA, 92 bp, Homo sapiens
tggctcaggacaggtgttctagatcagctgacagctctgctccacaattcaattcagagaactggtctaaagatacttggccttcaaagtca

SEQ ID NO: 6761736 - DNA, 94 bp, Homo sapiens
ctggggttccttccaccctcaggcctgagtggcagtccccctttaaggtcatggtaccttgggaggccatggtctgagagtctagaaacctggg

SEQ ID NO: 6761737 - DNA, 55 bp, Homo sapiens
tctctaaatgattgtgtactccctgataatttggggagctgctaacatttatgga

SEQ ID NO: 6761738 - DNA, 63 bp, Homo sapiens
ccactgcttttttcccccgagcctgtaagggcatgtccccagcagccagggagagaaccaggg

SEQ ID NO: 6761739 - DNA, 61 bp, Homo sapiens
ctgcttatggagatgagtaagagcaggtgaaatgtttctatttctattcatacatgagcag

SEQ ID NO: 6761740 - DNA, 112 bp, Homo sapiens
gtcatgaagcctgagctgtcctgggaacaggcactacctctctctgagggagagcagcttgacctagttcctcttctcagggccatgctgtagttttccctgcttttgtgac

SEQ ID NO: 6761741 - DNA, 61 bp, Homo sapiens
gaacatttccagaaaggaactaggcattgctttctgttcatttgttcctttagaagtgttc

SEQ ID NO: 6761742 - DNA, 70 bp, Homo sapiens
ggaactctcatatattgttggtgggaatataaaatggcaaaaccatgttgtaaaacagtgtgacggttcc

SEQ ID NO: 6761743 - DNA, 95 bp, Homo sapiens
aacaaatttttatcatccatttgccgtgctatgtgccagatactattttaggtgctagagatacgggagtggataaatcagataaaaattctgtt

SEQ ID NO: 6761744 - DNA, 55 bp, Homo sapiens
gctctatgtcagagagcttgggccagctgatgcaccaggcatgactgcagagagc

SEQ ID NO: 6761745 - DNA, 59 bp, Homo sapiens
ctctgtcttagcatctttgctcagggaactcatcctgagacatctctcctgagacaggg

SEQ ID NO: 6761746 - DNA, 60 bp, Homo sapiens
gctccctggtattgctgccactctccctgtgctcgggaaagctggaagaagccagtaggc

SEQ ID NO: 6761747 - DNA, 59 bp, Homo sapiens
gcctctggccacatgggacatagggaggagtgaggccctgtggacaggggcgcagaggt

SEQ ID NO: 6761748 - DNA, 74 bp, Homo sapiens
tcacttttcaccaagagaagactcagagtttatcatattcactctcatttgattcttagctggtgataatatga

SEQ ID NO: 6761749 - DNA, 65 bp, Homo sapiens
tgctttgcctcaagataatgacaaaaagagtcattgactcaatttgcacttttgagccatctgca

SEQ ID NO: 6761750 - DNA, 81 bp, Homo sapiens
actcacctgctagccaagatgggtcacaaactaagctgtgcatgcagagcttttgagaaaccccaggttaccaggaatagt

SEQ ID NO: 6761751 - DNA, 119 bp, Homo sapiens
tgtgcttggttgcttcactcttgacagaggtaggactcctcagagagcagcttggggtgtctctgtgcctggactgtgtcctgtggtcagagccctgcttccaggaaagggccaagcca

SEQ ID NO: 6761752 - DNA, 56 bp, Homo sapiens
agcaggagtacagtatttttaaacaaaaggacaacctgagtcctgtgctccttgtt

SEQ ID NO: 6761753 - DNA, 88 bp, Homo sapiens
gaggacactgcacgccccctgaggctggagtgcagtggtgcaatcatagctcactgcaacctcagtctcctgggctcaagcaatcctc

SEQ ID NO: 6761754 - DNA, 57 bp, Homo sapiens
cctgcacaggttgggacaggtaagatccctggatctgtctttagaggcctgtgctgg

SEQ ID NO: 6761755 - DNA, 65 bp, Homo sapiens
aagactataccatcttagttaccatagctttatcataagtcgtgaaattaggctgtgtaagtctt

SEQ ID NO: 6761756 - DNA, 116 bp, Homo sapiens
caatgccaaaagagagacaattaggttaagagcaagaagacacatttataagtctttccttttgtacttcttgttctttctaacttaagatgttgttacccatgatttgtgcattg

SEQ ID NO: 6761757 - DNA, 79 bp, Homo sapiens
gtcaactgatggagtgatggagaaattctggtttcaacatagagatggtaaatatctccattctccaacttagtgagac

SEQ ID NO: 6761758 - DNA, 63 bp, Homo sapiens
gggggtcgtggctcatatggtaatcttggtggacttattattactacacaagtaacgattccc

SEQ ID NO: 6761759 - DNA, 56 bp, Homo sapiens
atcagcagaccattttccaaatgtcgatcatctgctttaattgtggttgtgctgat

SEQ ID NO: 6761760 - DNA, 72 bp, Homo sapiens
ggggcaggcctcacagcatggaattttctggccccaaatgtcagtagggctgtgtttgagaaacgctgccct

SEQ ID NO: 6761761 - DNA, 80 bp, Homo sapiens
ctctgtgaatccattgcctcccctctgtgatgtatggggactgagcgagatcacagaggaaaggcagttggtatgcaggg

SEQ ID NO: 6761762 - DNA, 64 bp, Homo sapiens
gacatgaagggaaaagggctgtgttcgtgttctctagaggactctaacctttctctttcatctc

SEQ ID NO: 6761763 - DNA, 57 bp, Homo sapiens
tggtgggtagagctcactgtagtgggtctatcccaggcccagctgcctctcccacca

SEQ ID NO: 6761764 - DNA, 71 bp, Homo sapiens
tcacaggaagggtaaatatttaacatttattatgtatttttatttgttcaaatgttgccctttattgtaga

SEQ ID NO: 6761765 - DNA, 70 bp, Homo sapiens
gagtttgaacccttggcttctatgggttttctccccaaactggagtaaaaagatgtcaagggtttgactc

SEQ ID NO: 6761766 - DNA, 68 bp, Homo sapiens
gtggatgtctatgtgtatttgtaaacattacgtgttttaacttaaaatacatagatgtgtttttccat

SEQ ID NO: 6761767 - DNA, 81 bp, Homo sapiens
atacagtattttgatttctcatagatgctatagacagcagactcgtctcttctggccatctttgagatttcaattctgtgt

SEQ ID NO: 6761768 - DNA, 62 bp, Homo sapiens
catcctgcctcagctgaggccgctccacacaggtgagcaggcgcagcaggaggtccatgatg

SEQ ID NO: 6761769 - DNA, 97 bp, Homo sapiens
gggcagtggttgggcaaggctgacaggattagcaagtaatcaggaaggatcagatgtcttctttctctttcaattttgtagcctccctctagtgccc

SEQ ID NO: 6761770 - DNA, 74 bp, Homo sapiens
aggtacttcgtgtaagtggaatcatatagtatttgtcctttggtgtctggcttatttcacttagcttagtgcct

SEQ ID NO: 6761771 - DNA, 90 bp, Homo sapiens
gcaggtttgttctgtagcattgatttgtgaccaacaaaggaaatgtctacttgtgagacacaaatcaatgcaaccagactgcgaaagtgc

SEQ ID NO: 6761772 - DNA, 78 bp, Homo sapiens
ggccctgctcactaagccctggagcaaaggtgtcttattctcaagaacacaaagttctcatgggtgctagcagaggcc

SEQ ID NO: 6761773 - DNA, 64 bp, Homo sapiens
gtgtccttataagaagagatgccagagaattgaaacgctctctctcttcaccatgtaaggacac

SEQ ID NO: 6761774 - DNA, 55 bp, Homo sapiens
acaggcaggtcctgtcccagctgcagagcagagtggtgggacacgatctgcctgt

SEQ ID NO: 6761775 - DNA, 79 bp, Homo sapiens
aagcgtatacatacatatgtacacttacgttacaaatagttttatattatttctgtgtgtgtgtgtgtgtacatgtctt

SEQ ID NO: 6761776 - DNA, 83 bp, Homo sapiens
tctgggctataggagtaattggggtgacactgaccatgcaactggcacatataccatagctctgttatcctctatatcctaga

SEQ ID NO: 6761777 - DNA, 57 bp, Homo sapiens
atttcagtgttggttagcaagctgtactggtgagagttatgggacagacactgaaat

SEQ ID NO: 6761778 - DNA, 83 bp, Homo sapiens
atgagtccattgcatttgtggcatgggtgttgtcttagccactcaagctactataacaaaatgccatcagctgaatgacttat

SEQ ID NO: 6761779 - DNA, 63 bp, Homo sapiens
tctgtttttgcatgaaccagttcattctccgcctgttaaggcaactggttcaattcaactaga

SEQ ID NO: 6761780 - DNA, 73 bp, Homo sapiens
ccaagttcattgtagcattattgacaatagccaaatatggaatcaagttaagtgtctataagtggattaatgg

SEQ ID NO: 6761781 - DNA, 88 bp, Homo sapiens
actgaaaatcacttgtaaggaattcaattcaatttctttaatctttgaactcatgaaattaatgcaggtgaggttatttgttttcagt

SEQ ID NO: 6761782 - DNA, 66 bp, Homo sapiens
atgtctgttaatcgaccctaatccatcatgctgttagtagttactgggagtcctgttgacagatat

SEQ ID NO: 6761783 - DNA, 69 bp, Homo sapiens
tacattaggataaaatatgtggcctttagttcccctggaaggtgcctgagtgttttttccactggtgtg

SEQ ID NO: 6761784 - DNA, 68 bp, Homo sapiens
gtcatgcccagggctggtgaggtcctcacagacctctgggcctggacccagcagcactctgggaaggc

SEQ ID NO: 6761785 - DNA, 55 bp, Homo sapiens
aagtttagcgctctctcaaggagttcaagagcttcagagccagactgctgaattt

SEQ ID NO: 6761786 - DNA, 57 bp, Homo sapiens
ctgtgtgtggctggagctgttgagcttgatgtcagatgatgctgcagcggtaggcag

SEQ ID NO: 6761787 - DNA, 68 bp, Homo sapiens
tgaaccaagtgaaattgccattcttataagtcaaaaatggttgtctaatggcaatttcatgtggttca

SEQ ID NO: 6761788 - DNA, 74 bp, Homo sapiens
cagagccgtctgtggctgcctcacctacaggatccagtttaaactcagcctgtgagtgctggcctcagaatctg

SEQ ID NO: 6761789 - DNA, 66 bp, Homo sapiens
catgtgcttggggaacgtcaaggccagagtcagcatgcctggagcagacgtgtcccggggtcaatg

SEQ ID NO: 6761790 - DNA, 60 bp, Homo sapiens
aggatgcagttgtggttttatctctagaaagggcatgtgtccctcagtctgtgcaatcct

SEQ ID NO: 6761791 - DNA, 102 bp, Homo sapiens
cactgtaattatgcctacatgttattagtatttcatttagcatatatacgtgcttcagtgagatattagctaatgtgtcctgtacctggtttatctacagtg

SEQ ID NO: 6761792 - DNA, 63 bp, Homo sapiens
gtgtttgtggggagggagggaatctttgagacactgtcagttctcagtcctgcccagggaggc

SEQ ID NO: 6761793 - DNA, 85 bp, Homo sapiens
cagtatctgtcctttgtgactggctgacttcacctaacatgatgtcctcatgccttcatccatgttatagtgtggatcagaattg

SEQ ID NO: 6761794 - DNA, 59 bp, Homo sapiens
gggagtggggaggggtgggcctgtggctgcaggtgcagtgggctcagtcctccaacccc

SEQ ID NO: 6761795 - DNA, 71 bp, Homo sapiens
aaactttagagatgttggacccatagagttagtggacaaacaagcactgtggtggaagcatcaagaagttt

SEQ ID NO: 6761796 - DNA, 78 bp, Homo sapiens
gaggtggactattgacccagtggacttgatggtacccagaagagggtttacagggacagggctggctgtcaccatctc

SEQ ID NO: 6761797 - DNA, 63 bp, Homo sapiens
agctagagcatgaggagagattgtactgggccttactcttctccttcctccatggtcttggtt

SEQ ID NO: 6761798 - DNA, 95 bp, Homo sapiens
gtttcaatttttaaatgaaaggataaatggaaggataatagcatagaaaaacatgtgattaactgtctattaatcatgtctggaaagtaagaaac

SEQ ID NO: 6761799 - DNA, 59 bp, Homo sapiens
ctgtttgactgatgtgtcaagttcaagatggatgcacatgaagtggtcagatcaaacag

SEQ ID NO: 6761800 - DNA, 74 bp, Homo sapiens
tccctggttctttctgagggcaaaggtctctgttttcttgctggaaactctcttttcttcagtagggttagggg

SEQ ID NO: 6761801 - DNA, 80 bp, Homo sapiens
ggcttttgatgtttattggatttgaacctgctggaagcatctgttaaagtctaatgaaagaaaattatatccaaagagct

SEQ ID NO: 6761802 - DNA, 77 bp, Homo sapiens
ttcccttcaaagcaatgtttttccttccatattggttcctttgataaacagtgttgagagagtattgctaaagggaa

SEQ ID NO: 6761803 - DNA, 57 bp, Homo sapiens
tgtgtgatgaatcacagaagcctgggttcaaagcctggctttgcggatttacaggca

SEQ ID NO: 6761804 - DNA, 68 bp, Homo sapiens
tgcaggtatggaagaataattttgacattaaagccacgccattcagatttatttgctctttatctgca

SEQ ID NO: 6761805 - DNA, 80 bp, Homo sapiens
tagaacataacttcctttgatcaaaagcatttgatgtaaatttctatatggaatgtggataagggtgtctatatggacta

SEQ ID NO: 6761806 - DNA, 65 bp, Homo sapiens
agtgtaggtcgagagaggtagcctttgtatgcattcagtgctgggtgaggtgccctccttacact

SEQ ID NO: 6761807 - DNA, 66 bp, Homo sapiens
gtctttggacctgaaggaaagccacttaaataaaccttgaggcttagttttcatgtctgaaaagac

SEQ ID NO: 6761808 - DNA, 71 bp, Homo sapiens
gttttacaaggctcgtaacatttctctgcagctctctgcacttgtggcagaaagtttgtgccttgtgacac

SEQ ID NO: 6761809 - DNA, 78 bp, Homo sapiens
gaacttaaccgttgttttcctgggataccaacctggaggtgtttttgaggtggcccaaagaaatacaaagagaagttc

SEQ ID NO: 6761810 - DNA, 77 bp, Homo sapiens
cactatattcatgcctggttatgaaacaacaaacaaatggtatgttcatattctaagtaactggcattctgatagtg

SEQ ID NO: 6761811 - DNA, 86 bp, Homo sapiens
gtataattaagagtcaattaagggccattatggatgggtgcttaaagcatcaagtgaagggctcttgaaggttgctttgtttgtgc

SEQ ID NO: 6761812 - DNA, 74 bp, Homo sapiens
gcagttcctccccagggctctgacccaggcattgatatgggccctggaaggtagggcagctgggagggacatgc

SEQ ID NO: 6761813 - DNA, 80 bp, Homo sapiens
gtgggggcgtccgctggctgggtgctccaggggtgctcggaggagcagcttctgtttctagcccctgtgaacgtgtccac

SEQ ID NO: 6761814 - DNA, 74 bp, Homo sapiens
cgaatgaagaaatggacatctttatggccttgagcaaatctttcaacttgtgtatgactccgtttcctcatccg

SEQ ID NO: 6761815 - DNA, 111 bp, Homo sapiens
tcacctggagggcttgtcaaaacacagatttcttggcccactctcagattctgcttcagtagttctgtggtgaggcctgagaaattgtgtttccaataagttcccaggtga

SEQ ID NO: 6761816 - DNA, 64 bp, Homo sapiens
gggcaggttccttgacttctctgctactcaaggctcttcagtagatgtttggggaactttgccc

SEQ ID NO: 6761817 - DNA, 59 bp, Homo sapiens
tggctggtgcctactgtactgacaaagcagatccaggctgtcagtctaggaatgagcta

SEQ ID NO: 6761818 - DNA, 78 bp, Homo sapiens
gctgtaaagttatcccatgtgactcagctgcctgctgtactgccagttgatagagtcacatggtcaattcctatcagc

SEQ ID NO: 6761819 - DNA, 119 bp, Homo sapiens
aaagattgaactgtttcacgtggagaatttgacctggctttctgacatgttactgtggttgagtttctgcggtgctcatgttgaaacctgttgtttgctaacatactgttcttttcttt

SEQ ID NO: 6761820 - DNA, 57 bp, Homo sapiens
gcaatgtcttctaagctctaagctggctacagactgtggctgagcagtagaagatgc

SEQ ID NO: 6761821 - DNA, 130 bp, Homo sapiens
gaagtggtgttttttgttttgtgtttaagattacagcttgctcagtttgcacacatgcctacagctgggcttggtttttgcaggtgcagcgatactgtgagaagagcatgatcagcagaaaggtaactgc

SEQ ID NO: 6761822 - DNA, 56 bp, Homo sapiens
gcttgcttatgaatatcttatgtctcagctgattcaaagaagttggtaagcagtgc

SEQ ID NO: 6761823 - DNA, 66 bp, Homo sapiens
atctctctgcccaggggctgtggatgtcatccatcctggcctaactagcctactgagctgagagat

SEQ ID NO: 6761824 - DNA, 63 bp, Homo sapiens
acattatagctttgagtttggaaatgtgtagggtgaaatctcaaattttcttggctgtagtgt

SEQ ID NO: 6761825 - DNA, 64 bp, Homo sapiens
ttcaaggacttaggcaggtccttactgcaggcttggagcctgtgggctctcctgaggccatgaa

SEQ ID NO: 6761826 - DNA, 71 bp, Homo sapiens
ccagccagatcccctgtaggtctaacccaaggtttttctgtaggacaccttggcctacctgggaatgctgg

SEQ ID NO: 6761827 - DNA, 74 bp, Homo sapiens
cctcccgggtctggatcccaccgccacacacgggtcccgtcacatgccagtggggatcctgctgctcgaggagg

SEQ ID NO: 6761828 - DNA, 59 bp, Homo sapiens
ctggagtgcaatgaacaaggtcacgaaggatgcaaaggtgaccaactcagcatttctag

SEQ ID NO: 6761829 - DNA, 59 bp, Homo sapiens
ggtggacagtgctgcatctccatgccagccaagtgtgtgacaggagagtcacttctgcc

SEQ ID NO: 6761830 - DNA, 129 bp, Homo sapiens
gaggctccttactctgtgtgtttaaacaaattgttgctgggattctgcattgctcacaaagattttaccaaaattgttttgatttgattcagatttggcaatgtgtaaatttcactttgaggttccctc

SEQ ID NO: 6761831 - DNA, 61 bp, Homo sapiens
ggctgtagagaggctttgtcagctggacccagtaggactcagctgcttcctcctgcctgcc

SEQ ID NO: 6761832 - DNA, 60 bp, Homo sapiens
ttataggcttagttctgtgtgtttttctattatagaattaaacataagtctggcttgtag

SEQ ID NO: 6761833 - DNA, 71 bp, Homo sapiens
ctcccaaatggagaccctccccctgcttccacctctggatgtggggcaggtggaaggtctccattcaggag

SEQ ID NO: 6761834 - DNA, 88 bp, Homo sapiens
ccaggctccctgaagagttatggctgtgtgactgagttctagtcaatggaatgtgaacatacaaggtatatactactttcaggcctgg

SEQ ID NO: 6761835 - DNA, 92 bp, Homo sapiens
tatattttagttttgaaaatgatgctgtaatttggcaggtttataacttaccactaattgaagcaatatttatcaactgcacgtgaaatata

SEQ ID NO: 6761836 - DNA, 57 bp, Homo sapiens
tggttttcattgctaaggttttattccttatacaaagggagttagaaatgaaggcca

SEQ ID NO: 6761837 - DNA, 68 bp, Homo sapiens
tcaatcacagagattgcttttaaaaacaaacctcggttttgaaaggtagattctctgctactgattgg

SEQ ID NO: 6761838 - DNA, 78 bp, Homo sapiens
tctagggaaattggtttcacataattttaaattgtggacactctgcaccacatgtttaagtttaatgaaaaccttagg

SEQ ID NO: 6761839 - DNA, 63 bp, Homo sapiens
tggaatctctttgtccctgagtttcagaagcaaatagtgaagctttgggcagaagaggattca

SEQ ID NO: 6761840 - DNA, 60 bp, Homo sapiens
aaacatcttggttcaatttcttcattttcacgatgatgaaactaggaactagagaagttt

SEQ ID NO: 6761841 - DNA, 112 bp, Homo sapiens
ctggcaccaactttattttctgggagcccagtctgcttaggaaaggaaaagtcaccaaagttcattgttttcctaggcagttggtgctccatgagtttaaagggagctccag

SEQ ID NO: 6761842 - DNA, 74 bp, Homo sapiens
tctcttaggccaagctgctgccataattaactgctcactgggcacttgagccaatgctagtagatagttagaga

SEQ ID NO: 6761843 - DNA, 61 bp, Homo sapiens
gaaatggccagtagagctcagatagtttctcattacaaagaaattctttggtgtccatttc

SEQ ID NO: 6761844 - DNA, 88 bp, Homo sapiens
tcctttcactggaattttcttggttaggggaaataggcagtgtaatcatttttcctgtctgacctcaaccaggggtaaactaaaagga

SEQ ID NO: 6761845 - DNA, 59 bp, Homo sapiens
gccaatagcaatttctaggcccaccttcaccaaggcaggtcctagatgtgttgctaggc

SEQ ID NO: 6761846 - DNA, 110 bp, Homo sapiens
tcatattttaaagccctaacccccaatgtcactgtgtttggcaatagggccttaaaggaggtcattaaagttaaatgaggtaataggggtggggccttaatccaatatga

SEQ ID NO: 6761847 - DNA, 62 bp, Homo sapiens
tctaggatgaaaatccagcttataatctatcttcaatttttatgagcttatttatcctgaga

SEQ ID NO: 6761848 - DNA, 76 bp, Homo sapiens
aacctttcctgtgaatttataacatcatagagtcttagaacctgagatcatttgactttataaggctttaaaggtt

SEQ ID NO: 6761849 - DNA, 55 bp, Homo sapiens
cagtgcctggcatagaggcggccatagctggactcctaccctgttccaggcactg

SEQ ID NO: 6761850 - DNA, 121 bp, Homo sapiens
ggctgcattaggggtggctgctggtttgtaacgtgcgttgttgggggctggggaggatttacggctctaaagccttccatataacgctttaacggtgggcagagcggtttctgttgcgtcc

SEQ ID NO: 6761851 - DNA, 86 bp, Homo sapiens
aacaatgctgactgtgtttctgaaacaagaggtcccaaacattgggatatggtttcctcttagtctattaggaagttttcattgtt

SEQ ID NO: 6761852 - DNA, 70 bp, Homo sapiens
gcagttcctgtgccctgttctttccggggctgccccctgcttttcgggagccagcagggcatggagctgc

SEQ ID NO: 6761853 - DNA, 62 bp, Homo sapiens
tgtatggctagactgttgtgatctacatcctcataaaatttatcacaatatgagctcataca

SEQ ID NO: 6761854 - DNA, 71 bp, Homo sapiens
gactcttgattatgggatggaagaaattagcattatgaattttctctgtgccatttccataattaattgtt

SEQ ID NO: 6761855 - DNA, 59 bp, Homo sapiens
ccatgacaaataaacctttgccattttaatctccttggattgtgggtgttttgttatgg

SEQ ID NO: 6761856 - DNA, 82 bp, Homo sapiens
acatcgccgcactcatcctcgatgggcaggaagatctcagggaccacgatgaggatcctgcgctttgggggaggcgcgatgt

SEQ ID NO: 6761857 - DNA, 99 bp, Homo sapiens
catcgggagaagctgtgtgaatgcagggtaagtgttaacagaagtgggacagaatttctgaagattcgcctttgtttatccagtcccctctgcctgatg

SEQ ID NO: 6761858 - DNA, 57 bp, Homo sapiens
gacaccaggtagcctggagaaggtagaggaagctgtcctgccaggaaactgagtgtc

SEQ ID NO: 6761859 - DNA, 94 bp, Homo sapiens
gtggttgctgcggtcccgccagggctgcaccggggcttcgcgcagacgttctcccgcgatctgctgcagcccaggcggtggcggtggcggtagc

SEQ ID NO: 6761860 - DNA, 91 bp, Homo sapiens
ggggaggcatgtgttaaataacagagtcttcaagatagtgaaaactatgcatcatttctagggtcctcttttgtgtagctcctgtctcccc

SEQ ID NO: 6761861 - DNA, 63 bp, Homo sapiens
ggcataaactcttgagattcttgttgggtcaatacccaaaacattatccaggagagtttaccc

SEQ ID NO: 6761862 - DNA, 65 bp, Homo sapiens
agctgtacgtgtggccgtgtatccatggctctgtgtgagtttgtgtgtgcggccgcgtgggagtt

SEQ ID NO: 6761863 - DNA, 124 bp, Homo sapiens
caccccctctggccacctcccagggtgagggctgaagattgtggcccctcagagcctgcccactccaggcacttggggcccagctcagtccttgctctcgacagggactggcaggtggtgggtg

SEQ ID NO: 6761864 - DNA, 56 bp, Homo sapiens
gctggggatcaggagggcggcgaagtgagagagtttgctgcgatccgtttcacagt

SEQ ID NO: 6761865 - DNA, 83 bp, Homo sapiens
ccccttttccacttgagggtctctgggctacaaattgacaagctgagcagcctcagagcctgaggccctgagaggggaagggg

SEQ ID NO: 6761866 - DNA, 62 bp, Homo sapiens
ctaggaagcagcttccctggctcctggtgcatcgcatgaggagtggcagggctgctccctag

SEQ ID NO: 6761867 - DNA, 71 bp, Homo sapiens
gccacagggcagatgcgcagagtaactattattcattttgcaacctgcactctgtctttaataactgtggt

SEQ ID NO: 6761868 - DNA, 83 bp, Homo sapiens
actattttagtctgggccctgaagatgagacttcagttaagtatgactcttgtttgtagagcccacctgactaaggatatggt

SEQ ID NO: 6761869 - DNA, 60 bp, Homo sapiens
tttctttcaatgcttgtaagggaaagcttgtaagaattcccttacaagcattgaaagaaa

SEQ ID NO: 6761870 - DNA, 59 bp, Homo sapiens
gatccttgtttagtgactgcagccagaccttgtagacagctgcagtgactatggggatc

SEQ ID NO: 6761871 - DNA, 100 bp, Homo sapiens
tgcacagcatgctccgagcatagtatctgtcatatagtctaagcgctcaaatgtgattgcgtattttagtctatgtgcatgcagttggggatgctatgca

SEQ ID NO: 6761872 - DNA, 64 bp, Homo sapiens
tagtctctgtggtcctgaggaaggtgatttggtttcatcctcacatggtgagccacacaggctg

SEQ ID NO: 6761873 - DNA, 129 bp, Homo sapiens
attggactgggctcctgggagtctttgtggtgcttcatgtgccagagctgaaaataatgctgtaagagctgattggtcaagtcttgcaggtgacagcccaaggaatcccagtcctctatcccatccact

SEQ ID NO: 6761874 - DNA, 59 bp, Homo sapiens
gcccgtgtgcagagtgggagctgggccaaaaggaagccaattacatctgcaacactggt

SEQ ID NO: 6761875 - DNA, 78 bp, Homo sapiens
gtggggcctctgcagctgtgagtgctggatgcctccgagcaggacactgggacctatagctgtcagggctcaccccat

SEQ ID NO: 6761876 - DNA, 63 bp, Homo sapiens
ggtagccaaagagcctgggccctggagccagaccacctggagtcaaatcctagctctgctact

SEQ ID NO: 6761877 - DNA, 66 bp, Homo sapiens
gttttgtgtattgctgtatttctggcacctagtagagtgcctggcatatagtagttgtgcaataac

SEQ ID NO: 6761878 - DNA, 60 bp, Homo sapiens
gatttcactatcaacatcattgctctagaattctgaatggctttggtgtgatgggggatc

SEQ ID NO: 6761879 - DNA, 70 bp, Homo sapiens
agctcctgggctgacctcgcccctacatctgccacttggcagtgggtatgaggaacagctggacagagct

SEQ ID NO: 6761880 - DNA, 70 bp, Homo sapiens
gactgcactccaggttttttcactgaaggggcaatacacctttaatgtgagacaaacctggcttccaatc

SEQ ID NO: 6761881 - DNA, 78 bp, Homo sapiens
gactttttccaaaatgtcagaagctttacttctgaatgtgacacttcatcaggaggcaaaggtctctgataaaaagtc

SEQ ID NO: 6761882 - DNA, 65 bp, Homo sapiens
gcccgaggtccagagagataaagtgactttccccaaattttagagttttctgttcctctaagggc

SEQ ID NO: 6761883 - DNA, 96 bp, Homo sapiens
gctctcagcgccgccctcccagaccccagagacgtcggtcagggcgcggcgccccgggccactgcgggctctttccgggcgggcgacgtggggggc

SEQ ID NO: 6761884 - DNA, 94 bp, Homo sapiens
gcattttaaggctattgtctcttcatgtgtttaatttttacataaaataatgataataaaaaatgaatatgatggaggattctctgtaaagtgc

SEQ ID NO: 6761885 - DNA, 63 bp, Homo sapiens
gctcctgtcatcaaacaatcctactgcccaacctcccaaagcactgggattagaggcatgagc

SEQ ID NO: 6761886 - DNA, 63 bp, Homo sapiens
gcccactccagcttctcccacacagccctcagatggagcaaggctgggcctggccgggtgggc

SEQ ID NO: 6761887 - DNA, 88 bp, Homo sapiens
ggctctgctccccaggctgcctgaggctgaggcccgtctgcccccgctgctgcgtgggctccccctgaggcagcgagggggcggcgct

SEQ ID NO: 6761888 - DNA, 82 bp, Homo sapiens
ggaatctcactgtcgcccaggctggaagtgcagtggcatgatcttggctcactgcaaacgcctcctgggttcaggtgattct

SEQ ID NO: 6761889 - DNA, 67 bp, Homo sapiens
acttttaaaaatagcatattgctttctttcgttcccacaaaggaggaaaagaaaatgctgtgaaagt

SEQ ID NO: 6761890 - DNA, 63 bp, Homo sapiens
gttattcgtgttttgtaaaatgtgttaaatgcttgttaaacacattttgttaaaccctgtgac

SEQ ID NO: 6761891 - DNA, 59 bp, Homo sapiens
gaaattttgtgatacctttctctgatgttgagaacgtaagagtgaggtcataaattttc

SEQ ID NO: 6761892 - DNA, 57 bp, Homo sapiens
caccacgtagctctggactacaaagacaaaggcaggtagtccagagctactgtggtg

SEQ ID NO: 6761893 - DNA, 85 bp, Homo sapiens
ggccggcgtgcttgtcacggactggtcctagagtctctacttgaaaggccttggcgaaaccagctctggacaggcatttcccgcc

SEQ ID NO: 6761894 - DNA, 121 bp, Homo sapiens
ggacccagagggcctgctttggccggggtgaattctctggcttcagtagggttcacttcctttcctgacagtggcttctctggggtcaagagagagcctgggcctaggagatctagggtct

SEQ ID NO: 6761895 - DNA, 57 bp, Homo sapiens
cctcggcaccccagctgccctgggccagtgccacagagcaggaatagggtgttgagg

SEQ ID NO: 6761896 - DNA, 89 bp, Homo sapiens
ggaggttgggcgttttgtctttctctggaacagtaaaacgttagaaaaccattttccttttacagagaaagaacaagactcttacctct

SEQ ID NO: 6761897 - DNA, 106 bp, Homo sapiens
acggacggacagacagatggacaacagctggaggcttggcccggccatagggctctctgcgggacagtcccagctgctagtgtcgctgttgctgctactgacccgt

SEQ ID NO: 6761898 - DNA, 55 bp, Homo sapiens
acactgacgcttgacagtcacctgcccaaggtcgccggctggcaagtgacagtgt

SEQ ID NO: 6761899 - DNA, 58 bp, Homo sapiens
gctgcctgcagtgttttcccagtacacatgctgctggggtgaatgtctgcaggccagt

SEQ ID NO: 6761900 - DNA, 57 bp, Homo sapiens
ggaagagagtaaaaacagaaaatgggcattttttgccatttgctgagctttttctcc

SEQ ID NO: 6761901 - DNA, 101 bp, Homo sapiens
tctctctctctctctctctctctgtctctgtctcattagctctcatttcttctcttgcaaagctgaagatccagggttggggagagaggatgtgggacaga

SEQ ID NO: 6761902 - DNA, 98 bp, Homo sapiens
cagaagcatataaggtaacttcctggccattgccatggcaagttgacatggcatttataaactgtcatggcactggtaggagtgtctttatgctaatg

SEQ ID NO: 6761903 - DNA, 61 bp, Homo sapiens
gtggcctcctccgtccgcctctcagagctttgctgtggccttggggaccgaggcttgtcac

SEQ ID NO: 6761904 - DNA, 60 bp, Homo sapiens
tgcattcatttgacatcctggtgcatggggaagctcaggaagccggttaaatagattgca

SEQ ID NO: 6761905 - DNA, 58 bp, Homo sapiens
gcccaggaattggaggctgcagtgagccgtgatcatgccactgcactccagcctgagc

SEQ ID NO: 6761906 - DNA, 65 bp, Homo sapiens
acacaatgcagcatgtaaatgcatctacttaaagtgtatgtgtgtgtgtgtgtgtgtgtgtgtgt

SEQ ID NO: 6761907 - DNA, 68 bp, Homo sapiens
cttctcaaaactctgcccttctcaacccctgcgctagagtaggcagggcagaaggtgctgaggagagg

SEQ ID NO: 6761908 - DNA, 63 bp, Homo sapiens
agcaacagcaggtttgcactcctaacatagcaaccccatggagggtgcaggtaacgctgtgct

SEQ ID NO: 6761909 - DNA, 70 bp, Homo sapiens
cccagtctcaggtatttcttttagctgtgtgagaatgaactaatacaaaaaattgatactgacgagtggg

SEQ ID NO: 6761910 - DNA, 59 bp, Homo sapiens
cactggggcaaagtaggtatttagtaagtttttactgtgatactttgatcccatttgtg

SEQ ID NO: 6761911 - DNA, 58 bp, Homo sapiens
agagttggggcaccaccgtgttccttgtagtacaaagcacctgtgatttcctagctct

SEQ ID NO: 6761912 - DNA, 73 bp, Homo sapiens
gagaatacagaggaaacatttaatacaagatattctgatttttttccattgtatttgctttcttctggttttc

SEQ ID NO: 6761913 - DNA, 64 bp, Homo sapiens
catgggtggaaggccaacagtgtcactggatgtctactgctggttctttccttcccttcccatg

SEQ ID NO: 6761914 - DNA, 57 bp, Homo sapiens
agggctcagcatctcattctgtttagcaacagttgagagacatgggatctgggttct

SEQ ID NO: 6761915 - DNA, 63 bp, Homo sapiens
gatatttgctcgcactctcattgatcaaagacaaataagtgaagaaagaggctggcagatgtc

SEQ ID NO: 6761916 - DNA, 87 bp, Homo sapiens
caggtgtgagccactgtgccgctggagctggaattgaatccttgtctgttggactccagtgttagccactgtgcggctctgcccctg

SEQ ID NO: 6761917 - DNA, 69 bp, Homo sapiens
ttctctgaggacattgagactggagactaagatcaacaggatgtttccacgtctcagttccaaagagag

SEQ ID NO: 6761918 - DNA, 68 bp, Homo sapiens
cttttctttatggtatctgcctcaaatccacctcccctaaagagctgggagggtacacgagagaagag

SEQ ID NO: 6761919 - DNA, 130 bp, Homo sapiens
tttgtaaaatttctctccaggataaatactgtggtgttctctgaggtgtatattttggacaaaagtctttccaaaattattacatttgtagggtttctatccagtaccgattctttaatttttagtaaga

SEQ ID NO: 6761920 - DNA, 85 bp, Homo sapiens
tttattgaactattggtcatctttaacaatttacaatgtattcattataaagtggaagtgttaaaggggtttttggaggaataag

SEQ ID NO: 6761921 - DNA, 76 bp, Homo sapiens
ttagagacccagatgctgtgattgtacaacctgatttcttaatctgtcacctgcatgcagcatatgaggcctctga

SEQ ID NO: 6761922 - DNA, 72 bp, Homo sapiens
gcagagtaggcaggctcttggccttatgagcacaggactgttcctcagacccccagagctgctaacagctgc

SEQ ID NO: 6761923 - DNA, 72 bp, Homo sapiens
agatgggactgggtctagcagtggctgcagacagtcccaatgtctgtgtcgcaccctacacccaggctctct

SEQ ID NO: 6761924 - DNA, 68 bp, Homo sapiens
acccactctggctcccttctagtttgagcaaaggccctggttcttattgaaggagtaccagagtgggt

SEQ ID NO: 6761925 - DNA, 127 bp, Homo sapiens
gtgttaggggcgccagggaaactgcatgggtgggttctgggagcatagagtaggatggcccgcccacaatccatctgtctctgtcccagacccacctctcttgtgtcccagaatttatctctaacat

SEQ ID NO: 6761926 - DNA, 58 bp, Homo sapiens
atttcattggcccaaactagtcttatggctctgcctaactggaagtgggtcaggaagt

SEQ ID NO: 6761927 - DNA, 62 bp, Homo sapiens
agcagatggttactagtgacttggggactcagtcttaggagtccttcctctgtaatcctgct

SEQ ID NO: 6761928 - DNA, 109 bp, Homo sapiens
gctctcaccttgcactttgttgctggcccgctggcgaagccctggtgcccgtgaggggctctggtccttggtgtcatgggtcagcagctcctgcaactcctcaaagagc

SEQ ID NO: 6761929 - DNA, 91 bp, Homo sapiens
tctttcccacagtcagtgatcctgacatcctgacatggatcaaccaatattctcttccattccgtgactgtcaggatagactcaaagaaga

SEQ ID NO: 6761930 - DNA, 57 bp, Homo sapiens
cccagtggaaggagtagaagaccaatgaactaaggggcgtatgcctccttccacggg

SEQ ID NO: 6761931 - DNA, 106 bp, Homo sapiens
gacctgccagttgtccagtgttaagttatctgtgttgttatcagaatcaaacattaaaaacatacagcctattcttaccattgttttggagaactgagaaagggtc

SEQ ID NO: 6761932 - DNA, 70 bp, Homo sapiens
gggaccttgcagatgtgactaaattaatgatctagagatgaggagattattttaggttatccaggggccc

SEQ ID NO: 6761933 - DNA, 68 bp, Homo sapiens
ggtaacatatactatcaacctttgccaacctaatatggagattggaaaatgcatggtaaatgattgcc

SEQ ID NO: 6761934 - DNA, 67 bp, Homo sapiens
ccctaccaggaggctcccaaggggctaggccaggttttggcaaggccctggtgtttcagatgtaggg

SEQ ID NO: 6761935 - DNA, 69 bp, Homo sapiens
gtgtgacttttcagtaacaagccacagttgtatttcatgtgcaattgcccgcacattgagaggtgacac

SEQ ID NO: 6761936 - DNA, 84 bp, Homo sapiens
agggaagttctttatagcagtgtgaaaatggaccaatacactcccccaaatttcttcacactctatgatcagaaatcctttcct

SEQ ID NO: 6761937 - DNA, 61 bp, Homo sapiens
gcctgaaggagtcagagagggcctcaaaacagaggcattgtctgagctgagtcctctaggt

SEQ ID NO: 6761938 - DNA, 60 bp, Homo sapiens
atgtacatatatgtatgtacgcatgtgcaaatatgtttgtgtgcatatatatctgtgtgt

SEQ ID NO: 6761939 - DNA, 56 bp, Homo sapiens
gggggactgggggtgagcaggcccagaacccagctcgtgctcactctcagtccctc

SEQ ID NO: 6761940 - DNA, 72 bp, Homo sapiens
gggatggctgggtctgtaatcggccagggatcctctacccccacgacccctggtggcatcactcagcctccc

SEQ ID NO: 6761941 - DNA, 82 bp, Homo sapiens
ccagggggcgctgagaaccaccagggggtgctcaggacatgaccggccctcaggaccaccaggggattttcagaacaccagg

SEQ ID NO: 6761942 - DNA, 61 bp, Homo sapiens
gcgcagggaagacccggagcagcggtttacctaaggaacgggccgcgcggtcttgctgcgc

SEQ ID NO: 6761943 - DNA, 56 bp, Homo sapiens
ctggccagactacacatgtgtgcctttaggtcaggtgtccactcgtggtctgtcag

SEQ ID NO: 6761944 - DNA, 77 bp, Homo sapiens
gcgtttctgatatctaagaaattctaccactgcttctgctttttgggttttggtagttcttggatgtttacatttgc

SEQ ID NO: 6761945 - DNA, 60 bp, Homo sapiens
tgggctctggggaaactgtgatgaacagaacagacaaaaattccagttttcttgagctta

SEQ ID NO: 6761946 - DNA, 107 bp, Homo sapiens
gtgcttcattttcccagttgatacacatcaacctggctttggccataaatatggaatatgctgattggccaggcctaggtcatgtgccttcccttggaactgaggac

SEQ ID NO: 6761947 - DNA, 95 bp, Homo sapiens
atgggaagcaatggtttggttgggaatttattccttttctgctgtaacgaaagtttgcaataggggattgcttaagtaaattattgtatctccat

SEQ ID NO: 6761948 - DNA, 61 bp, Homo sapiens
gaaggcctcactctgcagcataagggtattttatacttagctgacaagtccagagcccttc

SEQ ID NO: 6761949 - DNA, 58 bp, Homo sapiens
gtatttagttaagtgttgttataaatgtaagtatttctgcatgcatttaattaaatgc

SEQ ID NO: 6761950 - DNA, 72 bp, Homo sapiens
cctggtcccttttatgtgctggagcaccaccctaaaaactgttggctggctacatcacagagaattcccagg

SEQ ID NO: 6761951 - DNA, 84 bp, Homo sapiens
cctttgcgttttaggtcatcttaattctcagtatctgacggaatgtcagctattgataaatgttggggaaatttggagtaaggg

SEQ ID NO: 6761952 - DNA, 59 bp, Homo sapiens
atgcgttagttactgaaagcatatatttgtccacatgttttctaagtaactggcagcat

SEQ ID NO: 6761953 - DNA, 79 bp, Homo sapiens
gttgactctaagagccttccctccacacctcaaagaccttagttagggtcccatgaaagagggaggccttgatttcaat

SEQ ID NO: 6761954 - DNA, 112 bp, Homo sapiens
tttggaaagcatggtttagaaactacaggcattgtcaagtggccgggtcttttataatttgaataggcataacactgatgtcctctgtgtttccaaaaacatggtttagaaa

SEQ ID NO: 6761955 - DNA, 60 bp, Homo sapiens
tccatgcccccatctctgttggctcctcagggctcactcctggaggtggtgggcaaagga

SEQ ID NO: 6761956 - DNA, 77 bp, Homo sapiens
gaggacatattttgaaagctttctaatccttgctatgacaatgactgaacttttagagggctcagagttagagcttc

SEQ ID NO: 6761957 - DNA, 72 bp, Homo sapiens
ggggtaacggccaggacagtgcaggtccatcctctgcagatggaagacaggcacgtcctttgccgctgtccc

SEQ ID NO: 6761958 - DNA, 64 bp, Homo sapiens
agtgtcttacaagaccaaagaaaggatacagcaagtcaatgaagctgtgtgctggtctgttact

SEQ ID NO: 6761959 - DNA, 66 bp, Homo sapiens
gacttaaaagacctcagagtaggtctcagctgtgtcatccactagcttggtgcctgtctggaagtc

SEQ ID NO: 6761960 - DNA, 77 bp, Homo sapiens
agtatcattatctagtaaaattagggaagaagttaaagaaagaattctctaaacatattggatctgagatggtaact

SEQ ID NO: 6761961 - DNA, 57 bp, Homo sapiens
gaatgcattctaaagtgttttatacctatatattgggtcctctttttgaatgtattc

SEQ ID NO: 6761962 - DNA, 91 bp, Homo sapiens
agtagtgcctctgttttacctgcttagttatcaggtgttttcatggaacattgttccaggaactgaagccaggtgttttcagaggcatgct

SEQ ID NO: 6761963 - DNA, 79 bp, Homo sapiens
ggaacagaatgcctatgagtttgttgtaaacacctgaagtaagagggtttacactgacagcacataaggaatcttaacc

SEQ ID NO: 6761964 - DNA, 85 bp, Homo sapiens
cattctagtacacatttcaagcattgacttctatgtccagtggacaaatgtagttgaaaagttaaggtgtggatgtattagaatg

SEQ ID NO: 6761965 - DNA, 55 bp, Homo sapiens
actgcccagctctgcaaacattctgtggagagaaggtggagaagagatgggcagt

SEQ ID NO: 6761966 - DNA, 65 bp, Homo sapiens
gactctggggcagctccatctattccaaagcaacaactttatgtgattatgttagtcccaggctc

SEQ ID NO: 6761967 - DNA, 78 bp, Homo sapiens
cagcctttgtctgtggacctatcagtcattccacctcttagcatgtgctgtcagccccaaagacaaagctctcggctg

SEQ ID NO: 6761968 - DNA, 57 bp, Homo sapiens
acccacagccgctgtgcgtccctctctccgggtgtcagtgcgcgcggcgggtggggt

SEQ ID NO: 6761969 - DNA, 61 bp, Homo sapiens
gctttgtgcaggtgtgtcagatcgttaagactcgtgttcaatatgatggccactgcaaagc

SEQ ID NO: 6761970 - DNA, 69 bp, Homo sapiens
taagatttggtgttgtgagttacacacatatgaaatggcatgtatgacagaaacaccgaaatactctta

SEQ ID NO: 6761971 - DNA, 103 bp, Homo sapiens
cctcatcttagcttccaataagagattttgtatttgtttctcatccagctggtcattgttggtgaaagctaaggagcaagtaggagttctcaagatgaaatgg

SEQ ID NO: 6761972 - DNA, 129 bp, Homo sapiens
atttcctgaccactaaggtttagaacattgccttcatgcataagtgctgattagctcttcaagggttctgaaggtcttagtaccatttgttgcatgatgctgttggaatctaggtggctgtcaagaaat

SEQ ID NO: 6761973 - DNA, 79 bp, Homo sapiens
ttcatttacatattctgccagtgatcaataattggacttatttccaggttttggctatttggtacaatgctgctatgaa

SEQ ID NO: 6761974 - DNA, 76 bp, Homo sapiens
gacagaggatgggggcggctgaagcccagggaggggctccccatcttctcggctcccaatgctcgccttctctgtc

SEQ ID NO: 6761975 - DNA, 75 bp, Homo sapiens
tgggataaagtgcctcaggtcctgggtggtcactactcaggaggcaggggcactttccttcagtactccatccca

SEQ ID NO: 6761976 - DNA, 63 bp, Homo sapiens
atgcagctcatttgtttaaaagttcattcgcttcagtgtgatttagacagatgtgaggtgggt

SEQ ID NO: 6761977 - DNA, 69 bp, Homo sapiens
gggggcactgctgtttttaccacactgagtttcccaaagaacacagagcaagtttaaatgtagtcccct

SEQ ID NO: 6761978 - DNA, 64 bp, Homo sapiens
tcttccaaattacctatttcattttctgtccatcacatgggcataggcactttaatttggagga

SEQ ID NO: 6761979 - DNA, 76 bp, Homo sapiens
tcctagaagcagacctctttttagcactccctaattgagtcaccatcctgggtgtgctgggaaagtatctgtggga

SEQ ID NO: 6761980 - DNA, 58 bp, Homo sapiens
gtctgtcctcgcggagacggtgatgggcctttccctctctgtacagatgaggacacac

SEQ ID NO: 6761981 - DNA, 62 bp, Homo sapiens
atgcttgatcttcatagcatttaaagttgtttcagtcctgatgatgtgctgtgaacaggtat

SEQ ID NO: 6761982 - DNA, 86 bp, Homo sapiens
cacctggttgtgttatatgcattgttgcagagaaatttaatctaattttttttagcttcctgtgcaatgcctaatcacaaaaggtg

SEQ ID NO: 6761983 - DNA, 57 bp, Homo sapiens
gacctacatggatgcacagaagtggcttagcccctattctcagtgtccatgttagtt

SEQ ID NO: 6761984 - DNA, 68 bp, Homo sapiens
acttctttcttcttaaatagtagtagatggtggataagctatgtgtatctgttagagagcaatgaagt

SEQ ID NO: 6761985 - DNA, 91 bp, Homo sapiens
aaagagttcatgtatgtgtgcgggaaggaaagtgatatttgggggttgggaggtgttactgagggtaccgaatacatataaacaactcttt

SEQ ID NO: 6761986 - DNA, 68 bp, Homo sapiens
aaagggagaatgaccaaggtatattgaactcctatgcacccttcaataccctgttccatttacccttt

SEQ ID NO: 6761987 - DNA, 78 bp, Homo sapiens
aaccaccgcatccccgcccctttttgtcgaccacttacaggccctttgaggtcgtggagagcaggggatgcgggcgtt

SEQ ID NO: 6761988 - DNA, 75 bp, Homo sapiens
gggctggctcatgcatctgggctggctggtgaggatggcactggccagctgtaagctggggtgatgagcctgccc

SEQ ID NO: 6761989 - DNA, 56 bp, Homo sapiens
aagagcccagccactattaaatgttggtcaaagtttggcaacatggttgagctctt

SEQ ID NO: 6761990 - DNA, 90 bp, Homo sapiens
tttaccgtgacgtcctagagcagggttggggcagcgtgcactagcagaagaagtgtgggtgctgcctccttcctgccaggagaaggtaga

SEQ ID NO: 6761991 - DNA, 58 bp, Homo sapiens
actctctgtatgaatcatatggagtgaaaattgctactcagtgaagcaaacagatagt

SEQ ID NO: 6761992 - DNA, 57 bp, Homo sapiens
tctactaggtgtactactgcaggaatatcatgctcaggtagttaacagtcaagtaga

SEQ ID NO: 6761993 - DNA, 58 bp, Homo sapiens
gagtgcacattttttctgctgcatgagtggataatgagcagcagcagaagtgtgcctt

SEQ ID NO: 6761994 - DNA, 55 bp, Homo sapiens
tgcaaaggaggccaaaccaagtaggcatccaggccacaaggttgcaatttttgca

SEQ ID NO: 6761995 - DNA, 65 bp, Homo sapiens
ggcacggaggtggcttagtctctggacaagaggccccctgacttgtctggctttctccatgtgcc

SEQ ID NO: 6761996 - DNA, 58 bp, Homo sapiens
tgaaatagcactttgtatccttgttgcccagatgcctcacaggatgcctgccatttca

SEQ ID NO: 6761997 - DNA, 67 bp, Homo sapiens
cacaatagtatgagccttttagagagatctttatatttttctttcctatatgggctactgttaggtg

SEQ ID NO: 6761998 - DNA, 68 bp, Homo sapiens
tttccagatctgctcctctgtccatgtagtcttaaagagaactggaaagagatggcagggtttagaaa

SEQ ID NO: 6761999 - DNA, 79 bp, Homo sapiens
ttactgaggtataaattacagcaaagtgcgcagacctaggtatctaggactgtgaggttttcctgtgttacctgtgtaa

SEQ ID NO: 6762000 - DNA, 55 bp, Homo sapiens
ctggaaggggcagtctttgggcaactcattcacccatgtactatctcccttccag

SEQ ID NO: 6762001 - DNA, 86 bp, Homo sapiens
ttcttggtctggaccctggaactttcagcagagttttaaacaaaaactacacgctgcttgtttccatggctcccctcaccaatgaa

SEQ ID NO: 6762002 - DNA, 77 bp, Homo sapiens
ctataacatgcattttctattcactcagtagtttttaaatctgttgggttaataaatggtagagtgtagctgtgtgg

SEQ ID NO: 6762003 - DNA, 68 bp, Homo sapiens
gagaccatcctggccaacgtggtaaaaccccgtatctactatcttgctatgttgcccagggtggcctc

SEQ ID NO: 6762004 - DNA, 123 bp, Homo sapiens
ggggtggtggggtcccccctgctggccgcaggtgctctgacgaggttgcactactgtgctctgagaagcagtgcaatgatattgtcaaagcatctgggaccagccttggggatctccctccct

SEQ ID NO: 6762005 - DNA, 88 bp, Homo sapiens
ttgagccccttgaaatgacaggagcacatcaaggcaaccaaactcctttttcactgtggtaagcttaaattattttaagggagcacaa

SEQ ID NO: 6762006 - DNA, 63 bp, Homo sapiens
tcctggggaaagccagccctgcttcctctcccaggtgggggctctgggcctggctgcgcagga

SEQ ID NO: 6762007 - DNA, 55 bp, Homo sapiens
gtatgggctgagtggctgggtctagtttcttagtgaaattccactgggcttatac

SEQ ID NO: 6762008 - DNA, 74 bp, Homo sapiens
gtattttactgaaattccatttcagccacagaaatgccgaatgcctgccggtgaaatgtaatttcttgaagtat

SEQ ID NO: 6762009 - DNA, 90 bp, Homo sapiens
cttggcttctgttgttggacagaatgatgcaggctccatatgacagtgtgtttgcaaagatcattttctccatctgcagaacaggcccag

SEQ ID NO: 6762010 - DNA, 59 bp, Homo sapiens
ggtgggagtgtggtcatggagggctggctgttgttgccctctgagaccagctctgcacc

SEQ ID NO: 6762011 - DNA, 124 bp, Homo sapiens
ggaccacttggtcactcatggggcaatgcaggctctcccaggtgggtgcctggagcagcagtgactatctatgacttcacatctctgccctcacttggggcctgttgcctttggcccttggtct

SEQ ID NO: 6762012 - DNA, 58 bp, Homo sapiens
tggaaacaaagtcataagctcagagttctcctttgttccattctgtacttagtttcca

SEQ ID NO: 6762013 - DNA, 63 bp, Homo sapiens
ctattgatggcggcctctccatatcaccctctgagagcatgtgggaaaagtggccatctttag

SEQ ID NO: 6762014 - DNA, 62 bp, Homo sapiens
catgtatgacagtaagagtgtctgggttccaattttggctacccactttctaactgtggctg

SEQ ID NO: 6762015 - DNA, 77 bp, Homo sapiens
gctttgcaaggacgggctccaggtagtgacggcaaccagccccctccacgtgtcctggctctgtcctcgcgcaaagc

SEQ ID NO: 6762016 - DNA, 72 bp, Homo sapiens
caaggtctcaaaggaggtttggagaccaaatggggcttcagttccccaggctctgccaggcccttgaccatg

SEQ ID NO: 6762017 - DNA, 121 bp, Homo sapiens
ggccccacctgaggcacagcgctgactcatcacggtggtaccagtaggtcagccatctggaaacagaagtggccctaattgggccaaaatgtggtaagactcgctggcctcaggcagggcc

SEQ ID NO: 6762018 - DNA, 62 bp, Homo sapiens
ttttaaatggcttttacttttctaagtcactgaaacaaggaagggccacatgccatttaaaa

SEQ ID NO: 6762019 - DNA, 74 bp, Homo sapiens
gcaaaacaaacacacagcaacaagaatagccaaagaaaccatttggcttgcttcttctgctgtcgtcttcttgc

SEQ ID NO: 6762020 - DNA, 129 bp, Homo sapiens
ccggctacccctccagcccgttgagcccaggcattttgtaacataagtggcactttgcccagattaaacgtctatggcagagacacttatcaccttagatcttggggtcagagctgctttgaaagccag

SEQ ID NO: 6762021 - DNA, 60 bp, Homo sapiens
gcatcccgaggagctgggattacaggcaccttacaggcctcccagagtgcttgggactgc

SEQ ID NO: 6762022 - DNA, 101 bp, Homo sapiens
tgaggtgggaggattgcttgagcccgggaggttggggctgcagtgagctgaggtagcaccactgcactccagcctgggtgacagagcaagaccctgtctca

SEQ ID NO: 6762023 - DNA, 76 bp, Homo sapiens
tgaacatgcgggttccaggctgcactctcagagatttgactgagcaggtgccatttgcctgtcacttgtctcttca

SEQ ID NO: 6762024 - DNA, 59 bp, Homo sapiens
atttacttttggtaaggtcatttcagaactgggttttgaggtggttccaataagtaggt

SEQ ID NO: 6762025 - DNA, 102 bp, Homo sapiens
ccatttgggttttctgttatatgtggccaacttaatcctaagcagcatagctggctgttggccatcgctatgacaagaagagcaaaattttaactcaagtgg

SEQ ID NO: 6762026 - DNA, 105 bp, Homo sapiens
aatcaagattaattttaggtcatatgtggtcccaaggcaactggaagacagaaacttctgtgtatgtttcagctgctttggcaggactaggatggtcccttgatt

SEQ ID NO: 6762027 - DNA, 57 bp, Homo sapiens
gagaagttgttgggtgccatggccttatgtagggctaaggcacaaatagctttgctc

SEQ ID NO: 6762028 - DNA, 65 bp, Homo sapiens
agaaagccatgggtctttggcatatttatcttatgattagctatgtttctggactcattatttct

SEQ ID NO: 6762029 - DNA, 57 bp, Homo sapiens
atccttgggaactaaatgtaagtggaaataaccaaaagttgtttagtgcccaggtgt

SEQ ID NO: 6762030 - DNA, 74 bp, Homo sapiens
ttaggtgataatgtctgtgtttcagtgcagcgagtaggtggagctcctgctgcatctgttagattatcacctgg

SEQ ID NO: 6762031 - DNA, 68 bp, Homo sapiens
ttgctggtcatttagatgtggacttatgttattccaggcaactggaaatcatacatattgatctgtaa

SEQ ID NO: 6762032 - DNA, 79 bp, Homo sapiens
gcttctcagtacacaggaatagcatgcctcaaatctaagacaaattttgaaatgagcatttattctttatctgaatggt

SEQ ID NO: 6762033 - DNA, 91 bp, Homo sapiens
gagggtcagtgtttgatctctgctctggtgctgggcaggggcttaggagttgagccaaaggcaccagagacacttggcagaaatggctctc

SEQ ID NO: 6762034 - DNA, 84 bp, Homo sapiens
gttcactgaagtcctcaagaatttccagacaacctggcataacagcagaaaccaggaggtctgtgttttcaggcctttgtggac

SEQ ID NO: 6762035 - DNA, 126 bp, Homo sapiens
ggctggagtgcagtggtggatcacaactcactgtaacctcaaactcttgggcttaaggaatcctccctcctcagcctccgaaagtgctgggattacatgtgccaccctgcctggtcactcttagct

SEQ ID NO: 6762036 - DNA, 69 bp, Homo sapiens
attcctaatcagattagaatcacaaatgtggttcatttctaccgggtggtttatgatatgtatgggaat

SEQ ID NO: 6762037 - DNA, 69 bp, Homo sapiens
ggaaccagatgctaaacaaaggactttgtaccccacagttttaaacagagatcctatgaagcatcttcc

SEQ ID NO: 6762038 - DNA, 93 bp, Homo sapiens
gcagaatttatcattgctgatgtgctgagattcaaggaaaatactctccaccatgcttctattttctacatgtcagtaactgataataactgc

SEQ ID NO: 6762039 - DNA, 89 bp, Homo sapiens
gggaacagaaaaacgagttcatctgctctgtggtccatgagacagcgactggctcacagaccgtcaagtaactgttgtctgtaaatccc

SEQ ID NO: 6762040 - DNA, 63 bp, Homo sapiens
gtggactatttgtatcaaagacactggatgggggaaagcttattagaaatgcagatagtctac

SEQ ID NO: 6762041 - DNA, 61 bp, Homo sapiens
gtcatgattgggggtgggcaggagccagggatgctgctgaacatcccgcagtgcacgagac

SEQ ID NO: 6762042 - DNA, 76 bp, Homo sapiens
ggtaatgaggattccaagatgaaggaagcctatgcccttccctgggcctcttcataatcttgggattgagattgcc

SEQ ID NO: 6762043 - DNA, 66 bp, Homo sapiens
taatcaggaatcttttgtcagacagtcagaatttttctctgagatgctctgtatggatcctaatta

SEQ ID NO: 6762044 - DNA, 64 bp, Homo sapiens
tttcagtgttatgactttcattcctgaagggaaaatgtaggagctgggtagtaatacactggaa

SEQ ID NO: 6762045 - DNA, 60 bp, Homo sapiens
ggtgtgggtccttgtgcttgcttttggcaagtttctgagctacacagggcctccattacc

SEQ ID NO: 6762046 - DNA, 74 bp, Homo sapiens
atttagtcatcactcatgtgttcctaatagatacttggtaagagctggttgaatgaatggatggatgactgaat

SEQ ID NO: 6762047 - DNA, 68 bp, Homo sapiens
gctgtgtttctccaggctttttgtgaattgtttgatgtaaggcaacactacagtttggaaggcactgc

SEQ ID NO: 6762048 - DNA, 61 bp, Homo sapiens
gccttcagtagtatcctcatgaacctgcgtcatggtgttgttaggtgtaattaatgaaggt

SEQ ID NO: 6762049 - DNA, 75 bp, Homo sapiens
gcttttcttttggacatatctgatgctgggaactctttaactgtcccaggcttcctaatgtgtgcagtttaaagt

SEQ ID NO: 6762050 - DNA, 86 bp, Homo sapiens
tttatttgatagttaatgatagggagaggggtgatagaacaaatgggtattatcttttcttctttcctataattaattaaaatgaa

SEQ ID NO: 6762051 - DNA, 69 bp, Homo sapiens
aaaaacatcaaattaggccatgaagcagaaatcctatgtttgagctatgggcttggatttgttgtcatt

SEQ ID NO: 6762052 - DNA, 71 bp, Homo sapiens
tcagacttgcctttttataaaaatcactccagttacagtgtggagaatggattagagaagggcaaggctga

SEQ ID NO: 6762053 - DNA, 118 bp, Homo sapiens
gtattttttttaatattcacaggaaatctaatgtatggcaaaataggaatcattatctaaatcagtgttcttcttgtgcccatacgttagaatcacctggaagccttatgaaaaatac

SEQ ID NO: 6762054 - DNA, 76 bp, Homo sapiens
gtgaactgcaggacctataaatatattttaaacatgtttttaaaatgtagcttctaggctgggtgcagtggctcac

SEQ ID NO: 6762055 - DNA, 87 bp, Homo sapiens
ggatcctagctctcctgattaggtttccatagctggtagagaagattcagttacacatgggaacctgatcaggaaattggcaggtcc

SEQ ID NO: 6762056 - DNA, 84 bp, Homo sapiens
aagatagtgttttttaaaatccaggagaatttccacttggatttttttcaagtggctgttagactgaggtgattatattgtctt

SEQ ID NO: 6762057 - DNA, 58 bp, Homo sapiens
tgttccagtgcagagggctctttatgaaacatgctacagtgtccttttactgtgaata

SEQ ID NO: 6762058 - DNA, 77 bp, Homo sapiens
ggggatggatcacctgaggtcaggagttcaagctggtcaagagactagactggccaaaatggtgaaactccatctct

SEQ ID NO: 6762059 - DNA, 56 bp, Homo sapiens
gggcttaaggtgcaaagtcataggcagtgccttatgattagtcattttaccagccc

SEQ ID NO: 6762060 - DNA, 56 bp, Homo sapiens
cctcgtggatgggactagtcaggacacagccaaaagacagtcgcctatcaaccagg

SEQ ID NO: 6762061 - DNA, 90 bp, Homo sapiens
ccaatgggaagaccagtggaatgtaaaattgcttcagctgtatgtactgttcaatttcagcatccattgacatctgtgtcttctccatgg

SEQ ID NO: 6762062 - DNA, 117 bp, Homo sapiens
gaactatttagcttttgtggattctagcgcagaatacatgattaaagtttgatttgtctggacaaacttccatcatgaattttaatacagttatgaggaaaaatactaaataagttt

SEQ ID NO: 6762063 - DNA, 61 bp, Homo sapiens
agcaggcactatgccaggatctagtgatagaagggtaaatgaaattggcattgtgtctgct

SEQ ID NO: 6762064 - DNA, 72 bp, Homo sapiens
cagaaggcttattttgatatctgagtatggcctgaaggctatgctgagtgagtgaaacccagagcacttctg

SEQ ID NO: 6762065 - DNA, 72 bp, Homo sapiens
ctagagtactgttatgttattacccatgtggcgttttgaccacaggattattagtctgacaggttgtcttgg

SEQ ID NO: 6762066 - DNA, 75 bp, Homo sapiens
gcctattttgtacttgtttgtgttaatcaatgttaattacaaagcaagcacaggggttaacgaattataatgggc

SEQ ID NO: 6762067 - DNA, 56 bp, Homo sapiens
ggcacttttctccccggtcatggaagaaaagcagcacttaggggagaagcagtgtc

SEQ ID NO: 6762068 - DNA, 60 bp, Homo sapiens
ggccggttcaagggcagtcagatgaatcgacccttcttacaggctgtctacgaaccagtc

SEQ ID NO: 6762069 - DNA, 68 bp, Homo sapiens
ggtaaacacaagatggcctcttctgtgattgcttatacttccaggaaacggctattcttttgtatatc

SEQ ID NO: 6762070 - DNA, 70 bp, Homo sapiens
caggtttccaggagtttgacctgtgggctgcttccctttcagccccatagctgcccacctcctcaacctg

SEQ ID NO: 6762071 - DNA, 69 bp, Homo sapiens
ttgtaagattcagggaacatgaaagctatcatactcacattgactggctgcgttcctgtgagactgcag

SEQ ID NO: 6762072 - DNA, 55 bp, Homo sapiens
tttcccagttagtgaagacatgaaaatggactctgtaagcacttaatctggggag

SEQ ID NO: 6762073 - DNA, 90 bp, Homo sapiens
cctaattcagaacctggcatatagtaggtgctcaattgatgttggattaatgaatattgattgctctctatgtgtcggacactggttagg

SEQ ID NO: 6762074 - DNA, 73 bp, Homo sapiens
gtcattactctctaattgatgcctggggtagctctcttccctgaagcaaggcccagagcatcagcagaatgac

SEQ ID NO: 6762075 - DNA, 77 bp, Homo sapiens
tccaaatagaattcatgttactgttagcacaaataatgtgcctaaatacctttgtaactgggttccctaagtttggg

SEQ ID NO: 6762076 - DNA, 105 bp, Homo sapiens
ctggcccccgcagaactacaagtcccagcagcccctggggctaaccaccttagcataggcctggcttcctcctggggctcatgggatttgtagttttatggccag

SEQ ID NO: 6762077 - DNA, 59 bp, Homo sapiens
ccacataatcctgtcctggattcttctcctacaaaggaaggggtctgaggattaggtgg

SEQ ID NO: 6762078 - DNA, 63 bp, Homo sapiens
gaaagtatgccatctacctctttattctagaagagtttatgtagaattggcaataattctttc

SEQ ID NO: 6762079 - DNA, 70 bp, Homo sapiens
agtcttttgtaagtgagggctaattcataattttttaaaaaaagtttatggtctgcatttattcaagact

SEQ ID NO: 6762080 - DNA, 64 bp, Homo sapiens
ggtagcagctctgagcatgctgctagttccccatagtgcctgcagatggccccagagtgctgcc

SEQ ID NO: 6762081 - DNA, 57 bp, Homo sapiens
catctcctttctggagcctgctcagggacagattctggaaggtggaaatgggtgatg

SEQ ID NO: 6762082 - DNA, 64 bp, Homo sapiens
cacacagtaggcactcattaataatggtaatatcaactaacatttattgaatgtttaccgtgtg

SEQ ID NO: 6762083 - DNA, 57 bp, Homo sapiens
taactccacacccctcttggtgctggtcatgattagtttaggagaggagtggggttg

SEQ ID NO: 6762084 - DNA, 57 bp, Homo sapiens
gagaggcttggcctcagttctgtaggcatctggggagtcattgaagtcaggcccctc

SEQ ID NO: 6762085 - DNA, 70 bp, Homo sapiens
aggatgctgccgaggatgaatgacagctgcaagaagcagtccccagccctcaggtcctcagcagcctcct

SEQ ID NO: 6762086 - DNA, 60 bp, Homo sapiens
gggaatgagttttagggccattaaaggacatgacctgaagtttcctctgaggccagtccc

SEQ ID NO: 6762087 - DNA, 62 bp, Homo sapiens
ggctgatagacaatcaccatgggaataggaatgtctctctcccatctattgtgatcaatgcc

SEQ ID NO: 6762088 - DNA, 58 bp, Homo sapiens
tgaacacagcatattttgttacctcatcaagaagcagaggaagattatgttgtgatca

SEQ ID NO: 6762089 - DNA, 67 bp, Homo sapiens
aagatgaatgctgctctcataattatagcttcaaacctgtgattcaatgggctgccataatcatctt

SEQ ID NO: 6762090 - DNA, 61 bp, Homo sapiens
ctcagttttaccttgcagcatatagagtccctatcagaatgggggccttgcagagactgag

SEQ ID NO: 6762091 - DNA, 64 bp, Homo sapiens
tgtcctcagggagtcccagtcatgatttgagcatgatgacagaaggcctccctgacacaggaca

SEQ ID NO: 6762092 - DNA, 57 bp, Homo sapiens
ggactccatatctctgtctctgggcaaaatcaaaccataatcagggttgtggggtcc

SEQ ID NO: 6762093 - DNA, 61 bp, Homo sapiens
ctcagtctttccctccctcagttggccttaaattggtccgatctggaatctgaaggctgag

SEQ ID NO: 6762094 - DNA, 92 bp, Homo sapiens
ggatctgctcaggcccctctgtggtgggaaccccccggcccccctctccctgctgtgggtctctgtcactgagtggccccgtgagcatctct

SEQ ID NO: 6762095 - DNA, 73 bp, Homo sapiens
tgcagtagttactctgagtatgtgcgctagacaggaatgtgtatatgtgcgcacatgttcagatgtgtgagca

SEQ ID NO: 6762096 - DNA, 55 bp, Homo sapiens
gtgccagaggccccaaacaagtccatacttgggcttcgggcttggattttggcat

SEQ ID NO: 6762097 - DNA, 56 bp, Homo sapiens
tcggtgctgctgctgaacccagctctgggggaccggctggtggcgggcagcacaga

SEQ ID NO: 6762098 - DNA, 64 bp, Homo sapiens
accctcatttctgttacttttatgtttttaatgatagaagtatgaagaatacatagatgatggt

SEQ ID NO: 6762099 - DNA, 56 bp, Homo sapiens
tttgattttggctgctccaagaactactggaagcaggaaagagtgctagaatcggg

SEQ ID NO: 6762100 - DNA, 101 bp, Homo sapiens
gaagaaggtggcgccataacaggggattgattggaagtctcttgagttcaattgcaagatcctacagtccattctttgtggccaggcaatcatctttcttc

SEQ ID NO: 6762101 - DNA, 67 bp, Homo sapiens
gggcagacggaggtctgggagtgcccccccaactgcccctgtggagccctaggccctccggctgccc

SEQ ID NO: 6762102 - DNA, 64 bp, Homo sapiens
cagagctggacttaaatatatttgggagaggtcacattgctttaatgtctttgtccatgctctg

SEQ ID NO: 6762103 - DNA, 56 bp, Homo sapiens
gtggccggcctgtttgcactcacagcatagcacttagtgcagccaagctgagccgc

SEQ ID NO: 6762104 - DNA, 128 bp, Homo sapiens
gctgagttggctctgtcaatcctatacaaatccctgcgtgcattaatatttccttgagccagagcaaaggaattctagaatattggcattctgagggtgaatagtgatggatatagtaaacttttagc

SEQ ID NO: 6762105 - DNA, 109 bp, Homo sapiens
gctctctggcagtcaaggcgggaggactgaaggacaatctggttccaacaccacagtgtggctgccgttggctcttcaggcctcctcacctcccaccctctgcctttgc

SEQ ID NO: 6762106 - DNA, 55 bp, Homo sapiens
atttcttggccaaaggaacagcagaactctcttaagtaactctggctaagtaaat

SEQ ID NO: 6762107 - DNA, 76 bp, Homo sapiens
gaattggggtttgaggggagaaattcagagccgtcaagcctgactgagcctctcttcccacctcctccctcacttc

SEQ ID NO: 6762108 - DNA, 82 bp, Homo sapiens
gcgccccacgggtcacccctccgcgcgctgcctcctgacatcccggcgctctcagcccactgaggggaaacccgggcggtgc

SEQ ID NO: 6762109 - DNA, 73 bp, Homo sapiens
ctccctcccttggaaagtagcctcacagctgtcaggaaaaaacagctgtgtggcttcctttcaaagaagtgag

SEQ ID NO: 6762110 - DNA, 84 bp, Homo sapiens
ggagtcctgtaattgtgagttaaccccaaatgcattaccagtatggaaccattttatatgttaatttttcagttaaagggctcc

SEQ ID NO: 6762111 - DNA, 79 bp, Homo sapiens
ttgagataattactgaaggtggatagtgagtacatgacagtttcattatactatgctgtctacttttgtatatgcttga

SEQ ID NO: 6762112 - DNA, 69 bp, Homo sapiens
tctttctagtaaaccacactatcttcctatcctggccctagggctaaatgaagtatagtgggagaaaga

SEQ ID NO: 6762113 - DNA, 105 bp, Homo sapiens
tccatcccttctccatttccactggtcctgcagtaatagacatctcaccatttttcaagtggattactatgctataggactctgtgtctgtggacttaaaatgga

SEQ ID NO: 6762114 - DNA, 70 bp, Homo sapiens
ggggatttaagatacaccaagagcctagtagaaatttgcccaggattcttgggtattaacagccttcctc

SEQ ID NO: 6762115 - DNA, 71 bp, Homo sapiens
ctccttcattcattcattaattcattcagtgactgttatgtagtaggtgctgagctttaaaggagaaggag

SEQ ID NO: 6762116 - DNA, 83 bp, Homo sapiens
ggctccattagaagagaaatgtggcatgaccctgtgggacaattgctggtccctgccctacattttcttagaggactggagcc

SEQ ID NO: 6762117 - DNA, 79 bp, Homo sapiens
gggcctgtggggctggcacaggaccaaacagcttttcattttgtttaaggttgaaacccctgtgctccacacagggtcc

SEQ ID NO: 6762118 - DNA, 78 bp, Homo sapiens
atggattgtgagtagaagtggcatatgtcactcttggaccaaagcatttaagagctagtatgtcatttcacagtctgt

SEQ ID NO: 6762119 - DNA, 72 bp, Homo sapiens
tttgctttctggatgatccatttacagagtgataagcactgctgtggagttaatatcatttccagaagcaga

SEQ ID NO: 6762120 - DNA, 86 bp, Homo sapiens
aatgccaccgtgtgccaggcacagtagtagggggttacaaaaactagctcatttcctgcacaggccaggcatctgaggttggcatt

SEQ ID NO: 6762121 - DNA, 92 bp, Homo sapiens
gatgttccaggctcctccttcttcccccagccctgctccaacaagtttcccaaactacagcaggcccaagctggggggaaggagggaacatt

SEQ ID NO: 6762122 - DNA, 95 bp, Homo sapiens
taggttccattttttttctacattatattgggacttcaggacttttgtagctacttaggaagtgtcctgtcagtgctaatagagggtgttaccta

SEQ ID NO: 6762123 - DNA, 87 bp, Homo sapiens
atccgcactggccaggctgggtggagggaggactccagacagaccctgctacctgccgccctccacacagcccctggcctgcagggt

SEQ ID NO: 6762124 - DNA, 130 bp, Homo sapiens
tgaggagtttccaggggcttttgggctgggagttgttccttcactggcttggtcaggacgggtccgtatactcaagttctccgtgccgtgggaggctcccaaacaccaaaggctcgtggaaatgaactga

SEQ ID NO: 6762125 - DNA, 76 bp, Homo sapiens
gggaggtgccacctggccagggtctgggctgctccaggaagacggtggcaggagaggacccggccaggggcctccc

SEQ ID NO: 6762126 - DNA, 69 bp, Homo sapiens
taaagcctcttttgaatgttttaaatagtcagaatctcaatagctatcaacttttcagaaggggcttta

SEQ ID NO: 6762127 - DNA, 75 bp, Homo sapiens
gtatacctgatgatcatctgtaaagttagagtatatctttttgctttctttggagttagtgttattccaggatat

SEQ ID NO: 6762128 - DNA, 58 bp, Homo sapiens
gatggaatatgaattacagtatatgagcaaggctattatattgtgataggtgttaatc

SEQ ID NO: 6762129 - DNA, 93 bp, Homo sapiens
gggctgttcccagctccaggggttgctgagatcgggagacggtcttgggaggctgttttccggcctcagcacgccctctggtggtcacttccc

SEQ ID NO: 6762130 - DNA, 69 bp, Homo sapiens
agagcgaaacactttgggaatggggcgttttcgtaacgtcatttatttagtctagatgaattttgctct

SEQ ID NO: 6762131 - DNA, 63 bp, Homo sapiens
gtttggcactatgatgaggctatcacttctgtgcatatttgatccctcagaaggtagccaagc

SEQ ID NO: 6762132 - DNA, 76 bp, Homo sapiens
gaagctctgcagggaagggtgtggggagtgatggacccattcttctccagttcatcctaccatttgttgagggctc

SEQ ID NO: 6762133 - DNA, 74 bp, Homo sapiens
aatgcagatttcttggctcctctcacagactcagggaccaaaaattttgtgatgtggacctggcaatctgcatt

SEQ ID NO: 6762134 - DNA, 80 bp, Homo sapiens
atgatttgttgccccatttaagtaatgataaactgaaataaaatcagtgattaaaattgaagtggggaagaaaaattcat

SEQ ID NO: 6762135 - DNA, 87 bp, Homo sapiens
gtgatgatgcatttcccctacattccaaaaactagcagatatctgcaatatctgctagcttttggaacgtagggaaaatgcagtcac

SEQ ID NO: 6762136 - DNA, 75 bp, Homo sapiens
caatgtgggagaggactctttgagtctgacattttgagttttcaaggtgtttcatttgaggcagccatccacttg

SEQ ID NO: 6762137 - DNA, 92 bp, Homo sapiens
gcctttgacattaacctgttgtttactgcagtgagtgtttgttgcctcagcattcgttttgaatacaggtttagctttctcatgacagaggc

SEQ ID NO: 6762138 - DNA, 66 bp, Homo sapiens
cagggcctttgttccacaagtgtaaacagcgatgcacaaagctggttacattcaaaacaaactctg

SEQ ID NO: 6762139 - DNA, 74 bp, Homo sapiens
ttacaggtagagagggaccattcctgtgccaaataggttaatttttggcagagagactctccttgatctagtaa

SEQ ID NO: 6762140 - DNA, 60 bp, Homo sapiens
gcagcaggagagtttgtcctgccagtgttctgaggctggcatggcacctattccagctgc

SEQ ID NO: 6762141 - DNA, 88 bp, Homo sapiens
tgctgagggcccttacgcaggcccttccccattctaggctcaggcttgccactgataatgaagggcttggctgggaggccactcccca

SEQ ID NO: 6762142 - DNA, 57 bp, Homo sapiens
ctttgtaggcctggcggcccgtggcgtgcgggcggcttcttcgaggtgtctgcgagg

SEQ ID NO: 6762143 - DNA, 63 bp, Homo sapiens
tacattctgctagaggaagaaattgaggcccactgagagtctgttcctcttgcaggttttgta

SEQ ID NO: 6762144 - DNA, 95 bp, Homo sapiens
cccctaagagctgtgcagagaaactcagatagctgatggtcaatggactaaatgagcttcactgtttttctaatgccagcacagactcttatggg

SEQ ID NO: 6762145 - DNA, 115 bp, Homo sapiens
taagcattataacttaacctaaagaatggctttggcaggaatttcaagcacagacagacttgatattcctcccaaagccgttctttaggttaagttggtaaaaaagagatggtta

SEQ ID NO: 6762146 - DNA, 71 bp, Homo sapiens
tgattacagtcagacagttaataacctagacttagaaaaatctgaaggttttaaaactgtctggccagtca

SEQ ID NO: 6762147 - DNA, 72 bp, Homo sapiens
catgggtcatattgcctgtatatcactctcttctgcagtctaccaagcgttataaacagcatgtgatccatg

SEQ ID NO: 6762148 - DNA, 66 bp, Homo sapiens
tgaaggtgggaattcaccaggtatccacccctttctgtccaggaacctgtctgcctcccaccatca

SEQ ID NO: 6762149 - DNA, 77 bp, Homo sapiens
gccgaaagcagggtcaacattctaaaatctgactgcctctgggtggcagttctgttgagtgtagaccctggtctggc

SEQ ID NO: 6762150 - DNA, 98 bp, Homo sapiens
tgataagaggaaataaaactcttgtaattaactagaaagatataatgtattgatctgtaaattaaagaattttaaataatgagtgttttctctcttca

SEQ ID NO: 6762151 - DNA, 107 bp, Homo sapiens
ccgaattattgccatgcaaatgtcaagtagccaatgcttcctgttttagtagaggcagtgtccgagaagcaggtagaggcttgagggtgcaatgatggtgattttgg

SEQ ID NO: 6762152 - DNA, 66 bp, Homo sapiens
attgaggaagaacaaatgaaactggcaatatttcagatttacagtttagtttgttcttggctcagt

SEQ ID NO: 6762153 - DNA, 76 bp, Homo sapiens
actttctcatttagctttctctcactggtgatgagaaaatccttagtccactactctgtgaaaagctgtagaaagt

SEQ ID NO: 6762154 - DNA, 56 bp, Homo sapiens
gccatcccgacggcgggcatggcctttggaggcggtggcgccgtcttgggactggc

SEQ ID NO: 6762155 - DNA, 76 bp, Homo sapiens
tgaggcctccaggctgctccagggtaggaaagaggcagagcgtctgctcctcagccaggatagccaggaggcccca

SEQ ID NO: 6762156 - DNA, 84 bp, Homo sapiens
ccagtgtggctggagcttagtgaggtgcaagacacagtgggtgaggtagttgatgtcttgttgatttcattctagatacactgg

SEQ ID NO: 6762157 - DNA, 72 bp, Homo sapiens
ctacagctcccagaaggccctgcgccaagagtacacggcgggccgcggcgcgtggcctgctgggagttgtag

SEQ ID NO: 6762158 - DNA, 71 bp, Homo sapiens
tcccaaattcctctgatcataagaatcacctgggctgctcatcttgtaattctgagtcagaaagtttgggg

SEQ ID NO: 6762159 - DNA, 125 bp, Homo sapiens
aggaaaactggtatcaatccttctaatagatgcactataaaagcatctttttaaaaagacaactctgtgaagaatgcttttatagacactgaggaatgaaaatgaaaaaaaaatccagtttgcct

SEQ ID NO: 6762160 - DNA, 59 bp, Homo sapiens
tatgtacatgttaaagggcaaaagcacatccaacgtttggctgccttgagatgtatata

SEQ ID NO: 6762161 - DNA, 60 bp, Homo sapiens
ggtggagggaaccagcccctactccaaaagtagcatggctgtggtttcttctgtaatacc

SEQ ID NO: 6762162 - DNA, 65 bp, Homo sapiens
gacagtttggatgggggtttgcatccgttaatgagcgggaattcagagcttcattcctaactgtc

SEQ ID NO: 6762163 - DNA, 68 bp, Homo sapiens
agtagagggagtttcaccatattggtcaggctggtctcaaacttctgacctcaggtgatccgtctgct

SEQ ID NO: 6762164 - DNA, 63 bp, Homo sapiens
gcacagtcttgagcatcagccagaccagtgttcacatcctggatctgcctcttaggtctgtgt

SEQ ID NO: 6762165 - DNA, 63 bp, Homo sapiens
gaagaggggtgatgctatcacagagttttaaaaagcttccgagtatatgcatcctcgcttttc

SEQ ID NO: 6762166 - DNA, 55 bp, Homo sapiens
gatttttacctactctactgctcaaagttgtgagacccagggtcaggtgaagttc

SEQ ID NO: 6762167 - DNA, 71 bp, Homo sapiens
aaaagatctttgcctttaaagttagagtagaagcaggacctggcataggcttctaccaaaggctttctttt

SEQ ID NO: 6762168 - DNA, 66 bp, Homo sapiens
ccgcccccgcctttccgccggcctgctgggtccagcttgccttcatctggcagacgcgaggggcgg

SEQ ID NO: 6762169 - DNA, 93 bp, Homo sapiens
caggggaaacaggtatacagagtgtttaccacatggttaaatggatcatttagcagatttcatgtacatttcatgtatttgtacattcccctg

SEQ ID NO: 6762170 - DNA, 68 bp, Homo sapiens
tgcttaaaattgagagttatagatggtttcatctttagaccgtgtcttccatgacctcaattaccgca

SEQ ID NO: 6762171 - DNA, 74 bp, Homo sapiens
cccagccggcagctgtctggggagtgctcgcggatggctcctcggagcgctggcgccctcgcggcctgtctggg

SEQ ID NO: 6762172 - DNA, 93 bp, Homo sapiens
agaaagcccaatttggaaaatagaaaggtagatcaactgtctaatggaacctctatttaagtgctatttttgctcatgaactaaaggcattct

SEQ ID NO: 6762173 - DNA, 88 bp, Homo sapiens
gaatatgtgagtatatacatgtgtgagcgaagatgtgagcacgtaagcatatgtgagtgtctcaatatgtgtgtaagttcatatgttt

SEQ ID NO: 6762174 - DNA, 55 bp, Homo sapiens
ttcatcaccttggtagcactcctggactgcaggactttgctcagctggtgctgaa

SEQ ID NO: 6762175 - DNA, 115 bp, Homo sapiens
gcctgctgggaccccaggggcacctgatctgcctttggggctttggggcacccctcctcctggggctcttggaccagggtcccagagtatgacaggggtgcttggggaagcaggc

SEQ ID NO: 6762176 - DNA, 59 bp, Homo sapiens
agaaaagtctgctttctattatcatcttgtcttggtgagattagtttgcaaatttttct

SEQ ID NO: 6762177 - DNA, 67 bp, Homo sapiens
ctttgagagatgctttctgcccttggtattctgaattcagtgcctgggaggagaagcacttttaagg

SEQ ID NO: 6762178 - DNA, 65 bp, Homo sapiens
gcagtgattcagggacctagatttctgccatattgtggctcttccagtcccctaaatctcactgt

SEQ ID NO: 6762179 - DNA, 86 bp, Homo sapiens
tgcaggcttgacaactaagggttccctagcatatctgtagcttagtaactggtcaaatgtgtagagcttttggggactcacctgta

SEQ ID NO: 6762180 - DNA, 57 bp, Homo sapiens
tctgttctgggccaggggacactgtattctggggtatccagtagggcccagagctga

SEQ ID NO: 6762181 - DNA, 87 bp, Homo sapiens
cttgaattttggtcacatttgtttcaattaaagatctgtaaaatttccagttctacataatgtgagaaaagtcagccaaaattgaag

SEQ ID NO: 6762182 - DNA, 64 bp, Homo sapiens
tttcctggagtggagtctgttgtttgcaactaagaacaataattgatatgccacccaaaggaag

SEQ ID NO: 6762183 - DNA, 55 bp, Homo sapiens
atatcaggctgtaagggctatattttgacccaaaatttagcccccaacctgatgt

SEQ ID NO: 6762184 - DNA, 82 bp, Homo sapiens
cacttattttaaagattgaatatagagattcttgtggcaaacctaagctactggtagccactctttactatcaaaataagtg

SEQ ID NO: 6762185 - DNA, 88 bp, Homo sapiens
tagatcctggtgctattctttcaggcatatcaagtaaaagacatttaaatggtttttgtccttcctgaaagtagtaggttgagatctg

SEQ ID NO: 6762186 - DNA, 77 bp, Homo sapiens
ggtcagtagggcgcggcctctgggtcggttttctcttctatttgaaaacccagccgatgggggcccgccctgctgcc

SEQ ID NO: 6762187 - DNA, 58 bp, Homo sapiens
cctggcacagatccttcatacagtaggctgactggatggataggtggatggtggcagg

SEQ ID NO: 6762188 - DNA, 58 bp, Homo sapiens
tgcatggtgggtgtagtttccgccaaaaatgatgacgagagactccatccaccacaca

SEQ ID NO: 6762189 - DNA, 73 bp, Homo sapiens
tcccatttcaatggaaagcttttaccgaatctgaaatgcaatgagattccatctggtaaaattcattgaggga

SEQ ID NO: 6762190 - DNA, 68 bp, Homo sapiens
agcgtggcctgcagctcccaggatccctgcagggacagggagaggagctattgggggctcaggaacct

SEQ ID NO: 6762191 - DNA, 116 bp, Homo sapiens
acctcgctacctgtatgattttgagcaagtcagtctgcctgagcttgtttcatctgtaaaatgagagaaataatgcggactttgcagaggattgtgaggattaaataacgtatggt

SEQ ID NO: 6762192 - DNA, 58 bp, Homo sapiens
gggatgcaggggagatggagaggttccttttcactacaaaagtctccctttctttctc

SEQ ID NO: 6762193 - DNA, 56 bp, Homo sapiens
agcctggaagccaggacaccgtccgttccaatgagcggcttctgcattccagagct

SEQ ID NO: 6762194 - DNA, 78 bp, Homo sapiens
gggctctggtgtgtttctggctgcggcccagggtgagcttgttaaagaggtactctgccaggcctgcttccggggccc

SEQ ID NO: 6762195 - DNA, 70 bp, Homo sapiens
gtgaatgtgctccactccaggctgccaaacagctgagcttggtagtcagcggccaggaagtggcattctc

SEQ ID NO: 6762196 - DNA, 61 bp, Homo sapiens
acctcagcctgtgcacccagccgctctgactggtggccagaacctgcagtaggccagaggt

SEQ ID NO: 6762197 - DNA, 66 bp, Homo sapiens
ctgggcttcagcctcacactgatatcttccaaccagggtggtaccatggggaggcagaggtgccgg

SEQ ID NO: 6762198 - DNA, 69 bp, Homo sapiens
gctttttggttttattgagatcgaagtgatggacacagaagccagattgtagtgggactgggacttagc

SEQ ID NO: 6762199 - DNA, 61 bp, Homo sapiens
tctgtcagcccctcagctgtcactctgctcccaaaaatagcaatggttgaggggagggaga

SEQ ID NO: 6762200 - DNA, 64 bp, Homo sapiens
gtcccactgtcctcgcaggggatgggatcaggtgtcagcacctccccatggagtacagttgggc

SEQ ID NO: 6762201 - DNA, 57 bp, Homo sapiens
ggatgcaaggggaaagactgtttagactaggctacacaacagtaccccccttgttct

SEQ ID NO: 6762202 - DNA, 62 bp, Homo sapiens
ccccatctctgaattcatattctgaaatctaatccctaatatgatggtatcaggagatgggg

SEQ ID NO: 6762203 - DNA, 97 bp, Homo sapiens
acatttttgtgtctatatatctgtattacatttctgtacacttctgagctatattctaaagttcaatgaggatagaactggatatacacaaaagtgt

SEQ ID NO: 6762204 - DNA, 67 bp, Homo sapiens
cctcctctactactgcaggagtttcttgtttgccaggacagggctatattcctcagagttgaggagg

SEQ ID NO: 6762205 - DNA, 58 bp, Homo sapiens
aactgtgcctttctgtcttctgggtgttttcagtcaagtgcaagtgaaaggcacagtt

SEQ ID NO: 6762206 - DNA, 59 bp, Homo sapiens
gtggtgccatttatgttaatgaacattaaaggattaatgaaacatcacaatggtaccat

SEQ ID NO: 6762207 - DNA, 82 bp, Homo sapiens
gcttgaagataggcccctgaattatcatggaccttcttctaggacagaagagagaggccagttgttcagtgggccgtcaagt

SEQ ID NO: 6762208 - DNA, 55 bp, Homo sapiens
cttcacctctaggctattatgagtctttgaagctttgatatttctggaagtggag

SEQ ID NO: 6762209 - DNA, 55 bp, Homo sapiens
cccagcgagcagacctgcctagggcattcatttgcatgcaggccctgtttctggg

SEQ ID NO: 6762210 - DNA, 66 bp, Homo sapiens
ctggtagcagtgaagctgttgattatgtttgtcgttgttgcatttcagttacacaagtgttaccag

SEQ ID NO: 6762211 - DNA, 74 bp, Homo sapiens
gcatcaagagttgctggatgtttacatgtctatcccccatcagtaagactcaactaccacaactcttgagatgc

SEQ ID NO: 6762212 - DNA, 81 bp, Homo sapiens
aacctgtaaatccaaacaatctcacagttatgaaatggaaaatttgtggggaaaaacaaatgctttggttattacagtgtt

SEQ ID NO: 6762213 - DNA, 64 bp, Homo sapiens
cttttcagcagaaattactcttgatgacaccagccccgctgtcagagtaattcctgctggaaag

SEQ ID NO: 6762214 - DNA, 73 bp, Homo sapiens
catacgaacctagggtgaaattttggttcggctactttactagctgtgttatcagtcggcttaggttatgttg

SEQ ID NO: 6762215 - DNA, 67 bp, Homo sapiens
gactcagtggctcatgcctgtaatcttagcactttgggaggctgaggcaggcagatcacttgaggtc

SEQ ID NO: 6762216 - DNA, 57 bp, Homo sapiens
aatagatggtatttagactagcgctactcaaagtatagtgctggtatattaactgtt

SEQ ID NO: 6762217 - DNA, 69 bp, Homo sapiens
agcgtctaggccgtgccctgaggtctggctgtgactcagtttccgcaccagaggcctggcctaggccct

SEQ ID NO: 6762218 - DNA, 80 bp, Homo sapiens
agagacaggtgaccacaggcattggttcggccactcaatgaggttagaactggaattttgtggttttcttgcctttctct

SEQ ID NO: 6762219 - DNA, 72 bp, Homo sapiens
aagcgtagtagggcaatatttcccagaaaaatctatgaagtgatttgttttgtcctgccctttctgcagttt

SEQ ID NO: 6762220 - DNA, 87 bp, Homo sapiens
gtgcaacagtgtcatttcaattatttgctcttcttgggcttaaaccattaaatagcagaggggcgtaatgaggggttttgagtgcac

SEQ ID NO: 6762221 - DNA, 79 bp, Homo sapiens
cagggccctgtggcattctcggcaccatctgccccgtgcctgtgcgctgctgctgccaagggtgccacaggcagcactg

SEQ ID NO: 6762222 - DNA, 55 bp, Homo sapiens
gatgtgcttagtacagatgtgttatgagagggtgacataagtgtgcaagggcatc

SEQ ID NO: 6762223 - DNA, 84 bp, Homo sapiens
gagagcagtagcagacttctccagactgcctggtaactcgaaagattagtgggaagacagaggaaaggatgtgaactgcatctc

SEQ ID NO: 6762224 - DNA, 71 bp, Homo sapiens
tcagcagtcacatgttgtcccaagtgttaggaatttgggacaaatgccatgtgacctaccagtgatgctga

SEQ ID NO: 6762225 - DNA, 91 bp, Homo sapiens
tggcttgctcacatagttgatgacaccatgggaccagaaccctggcatcaccagacagcctggcttcatggctgtgcaatctgagcagcca

SEQ ID NO: 6762226 - DNA, 56 bp, Homo sapiens
aggaaggcatgaggtgttcacagtgggcttcgtgagttttgcttcatcccgatcct

SEQ ID NO: 6762227 - DNA, 104 bp, Homo sapiens
taaggaacttgggtaaaatgttcctaatgtgcttttcatagataaaattctattattcaataggaagtactgaaaggcgtacttaggattgcttatttctctta

SEQ ID NO: 6762228 - DNA, 78 bp, Homo sapiens
ttaccaggatggctgccccaaattgttgctggtatcattaaaatagtcaacaaaaatgtggagcctacagccttgtaa

SEQ ID NO: 6762229 - DNA, 75 bp, Homo sapiens
tcaacaggggaaggatctgcttccaaggtcactcatatagttactagcaggattcagattcttgaaagttgttga

SEQ ID NO: 6762230 - DNA, 55 bp, Homo sapiens
ggctatgaatggctgcatttgtatctacatacaaacttcagtagtgtcatcagcc

SEQ ID NO: 6762231 - DNA, 59 bp, Homo sapiens
gagctttaagggcactggtcttacagagcctgtggggctagaccgtgtgctctcagttc

SEQ ID NO: 6762232 - DNA, 85 bp, Homo sapiens
tggtctcctaaaatatggtactgacttactggtaatcaaagaaatgcaaattgaagcagtaatgaggtactatttgggcttatca

SEQ ID NO: 6762233 - DNA, 69 bp, Homo sapiens
gggcaattaaggtcccgtttccttggagaactccaagagatagtgccaaacggacctcagaattgaccc

SEQ ID NO: 6762234 - DNA, 66 bp, Homo sapiens
aggggcaagtaggtcagcagcaaatttaagtgagacccactgtactgtaaatacctgcttgcttct

SEQ ID NO: 6762235 - DNA, 67 bp, Homo sapiens
ttgcatgtccagggtattgtggatattgtggttctgtcattgctaatcctcaacttttggattgcag

SEQ ID NO: 6762236 - DNA, 101 bp, Homo sapiens
tgtaaacttaaaaaaggctgtttattagaaaaagtattgaaattgtgtgtatgtctagattcacatagcatttttttggcaacagtctaaggtagtttata

SEQ ID NO: 6762237 - DNA, 56 bp, Homo sapiens
aattctgatgaataaatcatcctgataaattccagggctggtttgtcatgagaatt

SEQ ID NO: 6762238 - DNA, 61 bp, Homo sapiens
ttgccttccaggacttggcaggagatgacaacaacagtcacttctgaagtgtcttgggcaa

SEQ ID NO: 6762239 - DNA, 76 bp, Homo sapiens
cagccagacatctccagggaggtagcccagtgctatggttaagagcatgggctctggccttggacctacctgggtg

SEQ ID NO: 6762240 - DNA, 67 bp, Homo sapiens
cagaaatgggtttgattctcagccaagggacagcaggactggtagagagtgtcaggccacacagctg

SEQ ID NO: 6762241 - DNA, 65 bp, Homo sapiens
gtgctggggcataatgggaccaggaccgggctctgtgcccgatggtcctcctgctgcctctccac

SEQ ID NO: 6762242 - DNA, 58 bp, Homo sapiens
gagtttctaggatggaggtgagataaacatgtgagctcatatctccgtcttgaaactt

SEQ ID NO: 6762243 - DNA, 78 bp, Homo sapiens
tagcatctaggaggaaaatctagacatgcacatgtgtaattataccatgtagatgcaatggatgtcctaatagagtta

SEQ ID NO: 6762244 - DNA, 56 bp, Homo sapiens
tcccaccactgccttctctgggacccaacctccagacatcaggatggtggctggga

SEQ ID NO: 6762245 - DNA, 126 bp, Homo sapiens
ttgcatgggggaggcaggatagtagagtggatgcagctttctctggtttcaagatagctactctcaatagctatttggcctgagatggtgcatttaatctcccctaagcctcagttttcctatcaa

SEQ ID NO: 6762246 - DNA, 71 bp, Homo sapiens
atttctggcccggacccactcggatcccagccgtcgtccggctgcatttccagtgcgttcgggcttcgagt

SEQ ID NO: 6762247 - DNA, 58 bp, Homo sapiens
cagactgtggcgtcaggaagaaattaccctggtacattaattactggcccatggaatg

SEQ ID NO: 6762248 - DNA, 80 bp, Homo sapiens
ctctgggcacctctagctctctctcagggccctggggccacactggtggtcaggcctcgaggagacagctacagcctgag

SEQ ID NO: 6762249 - DNA, 78 bp, Homo sapiens
gctcagagctggctgcaggggtgtctgacataggtccccacatgtccttgagaccctcctcggtacctgcttcctagc

SEQ ID NO: 6762250 - DNA, 55 bp, Homo sapiens
gggtggagctggaccaggagaggagtaaccaagactcactccctcctgcccaccc

SEQ ID NO: 6762251 - DNA, 71 bp, Homo sapiens
cttggcaatagagctgttcagtgtaatgatccaagaaggtccttagaaggctgaataattctgaggtcaag

SEQ ID NO: 6762252 - DNA, 77 bp, Homo sapiens
agttagaccaagaaaggggtgtttagagacttccaagcaatcatgaaacattccatttctatgtaagccgtttgact

SEQ ID NO: 6762253 - DNA, 77 bp, Homo sapiens
gccttgaaagtgctgaccagggtcactcacagggctgttaaacagctgctgcgcctcaccctggcagcaaacaaggc

SEQ ID NO: 6762254 - DNA, 56 bp, Homo sapiens
ggaggggccggctgcctgccaccagccttcacatttggcccctgtcggccccctcc

SEQ ID NO: 6762255 - DNA, 80 bp, Homo sapiens
gaagagcagaaagaaagtttcccccttcacagcttaacaaggtatgctgttaagctcccagaagagggagaatggtcttc

SEQ ID NO: 6762256 - DNA, 64 bp, Homo sapiens
ctgaacaaagttcttttgagctctactatgattgtagagaagatccaataggcactctgttcag

SEQ ID NO: 6762257 - DNA, 106 bp, Homo sapiens
ccccttgctgccagccttgagaggagctgatatttataatgaatgtattatactttatgctcattataaataccagctccctatgaccttgagatggcagatgggg

SEQ ID NO: 6762258 - DNA, 77 bp, Homo sapiens
gatagaattaacacaaggtgtgctttgagcttctggctatgcccagtatttttaagctgctttgtaacatttttttc

SEQ ID NO: 6762259 - DNA, 57 bp, Homo sapiens
ggtgacagcatcgagggaacacaggaaagtcctcactcttccctccctgctgtggcc

SEQ ID NO: 6762260 - DNA, 60 bp, Homo sapiens
gcccccaacagagcctgaatgccattttgctgcctgaatgtgcagaggaatgtagggggc

SEQ ID NO: 6762261 - DNA, 64 bp, Homo sapiens
agagaacgtggaatgtggctccttggtcccattcagcctgtaaggggatacttccactttcttt

SEQ ID NO: 6762262 - DNA, 62 bp, Homo sapiens
aaggcatttgttggatttctcaccaatttgaacatctctggtttggaatacggtgaatcctt

SEQ ID NO: 6762263 - DNA, 80 bp, Homo sapiens
agggcccccaggcccggccctctgccctcagaactcagcccagtgtgatctggtgacacgaggagctgggatggggccct

SEQ ID NO: 6762264 - DNA, 73 bp, Homo sapiens
gggcccaggtggcgggaggggcggggcacagccagggctctgcctggcggactcccggaacatcacttggccc

SEQ ID NO: 6762265 - DNA, 65 bp, Homo sapiens
gtggctcccaacacagaacccagcactccaggtgttgagtgcacagcgtgatgtattggggccat

SEQ ID NO: 6762266 - DNA, 94 bp, Homo sapiens
tctttaaatagcatctcccctagtgcattaaagtgtttatttatagatcattaactacttgaccaagatgctgcagggcagagtagcttaaaga

SEQ ID NO: 6762267 - DNA, 87 bp, Homo sapiens
ttgcctacttgcgtgatgttatgcccaatcaaaatctcagaacaagaagaggtaaagaaaggtgtaacattaaaaagagtaaggtaa

SEQ ID NO: 6762268 - DNA, 87 bp, Homo sapiens
gccgcatcccagctggttgccatggtgacccggctctggcctctccgcagcagagatgagcagttaccaaggaacctggtgcgcggc

SEQ ID NO: 6762269 - DNA, 81 bp, Homo sapiens
aaagggcaagaaaattcttacttgcctactatgtcctaagatggcttcacagtctggcaggtgttgaaagctgagtctttt

SEQ ID NO: 6762270 - DNA, 74 bp, Homo sapiens
agcttgtctttcaaaggagtttgttcacgtattgagtgctccaacttttatagctcctacatgagggattggct

SEQ ID NO: 6762271 - DNA, 70 bp, Homo sapiens
gttcagatagtgggttttttggaggctactttggacatgggtgatggctccaaggcccaactgtctaggc

SEQ ID NO: 6762272 - DNA, 74 bp, Homo sapiens
taggaagcaggctatgtaaagactagcttggtgattaaactagatattgtcttcatagtccacgagctgtcctg

SEQ ID NO: 6762273 - DNA, 83 bp, Homo sapiens
ggaaataggttcagagaaggctaaatagttttccaaagatcacacaaattggattgctgagtctattttctgatcactgttct

SEQ ID NO: 6762274 - DNA, 71 bp, Homo sapiens
ggatttggtttgccagtattttattgatgatttttgcattgatattcatcagggatattggtctaaaattc

SEQ ID NO: 6762275 - DNA, 112 bp, Homo sapiens
gagcaaacctgcaagaaccacagatggttatgggaggatggggggattaaagaagtggcaaatttagtagtagcaaaactcatctctttggctctctgtggcaggaaagctc

SEQ ID NO: 6762276 - DNA, 82 bp, Homo sapiens
gcacggtgaaattccttgtggaaagtggtaattagactggctatgaggctattttctcatgttagggatctcaccgactagc

SEQ ID NO: 6762277 - DNA, 107 bp, Homo sapiens
gcgggacctctgtcaacctcaccctagcacttgacccccagagctggtccctgtccccaaaggagacagtgatgggggtgcaggaagcaggagctcagagtcccagc

SEQ ID NO: 6762278 - DNA, 78 bp, Homo sapiens
agggcctctgcctgggcctctgaggaaggcctggctccgctccccccttgcctttctctacccccagctcaaggtcct

SEQ ID NO: 6762279 - DNA, 74 bp, Homo sapiens
ccattttcagtatgagtgacttccaggggttcagtcggttgctctgaacatcagtattctcatctgtaaaatgg

SEQ ID NO: 6762280 - DNA, 57 bp, Homo sapiens
cagtcctctctgaaaaacgactaaggtggtagctttctaacgtagacagggaggttg

SEQ ID NO: 6762281 - DNA, 82 bp, Homo sapiens
cagactacatggatgccccgaaggcggccccctgagcatgccctggcctctctggctgccacttggtcatgtcatgtgtgtg

SEQ ID NO: 6762282 - DNA, 86 bp, Homo sapiens
ttttgttctggaccatttgctagtaaattgcagaggttgcaaccctttaagctatgtagtttagtatgtgtcccttaagaacaaag

SEQ ID NO: 6762283 - DNA, 65 bp, Homo sapiens
gacgggagtcagagaaaacagccctgtggccttcagagccgcttaagttgtctgtgacttgagtt

SEQ ID NO: 6762284 - DNA, 64 bp, Homo sapiens
tttttgccagagtggtattactcagtttggtgacccaggcttattaatatgattctgctgaaaa

SEQ ID NO: 6762285 - DNA, 56 bp, Homo sapiens
cggacgtaacgccacacacagcctgcggggatggcgtgaggggggtaaggcgtccg

SEQ ID NO: 6762286 - DNA, 89 bp, Homo sapiens
tttgataatttcttccctcattagagataatcagtgtctagaaactagattgatagatgtttctaaaattttggctagaattgtacaga

SEQ ID NO: 6762287 - DNA, 78 bp, Homo sapiens
gcagccctgcacaggtctgtggctggtgattttcatgaaagggagcaagagccacactgacctgttgttggaagctgt

SEQ ID NO: 6762288 - DNA, 59 bp, Homo sapiens
atgtgatgtggtgagaagagtactacttcacctccatggtattcttctcaaatatccat

SEQ ID NO: 6762289 - DNA, 81 bp, Homo sapiens
gtgaaggacagggcagcctctcagcctaggtgacagagggacagtgtcgctggggaccacactgagctgcgctgctggcac

SEQ ID NO: 6762290 - DNA, 69 bp, Homo sapiens
gttgagcacctttgttcattgccttcagtctgaaacttagctgaaaggatctgacaaataatgctcaac

SEQ ID NO: 6762291 - DNA, 74 bp, Homo sapiens
aattagtgtgttgttgtgggcgatggtgctgttggtaaaacatgtctccagatatcctacacaacaaacaaatt

SEQ ID NO: 6762292 - DNA, 85 bp, Homo sapiens
atgggaagaaggctggggccttctcatctccctttggcaaatgtggctgacaggtgtggactgagaggagcctccaacctcctat

SEQ ID NO: 6762293 - DNA, 57 bp, Homo sapiens
gaaggaaatctgtgatttatgctctgtaacttctgggtggtacacagtaattccttc

SEQ ID NO: 6762294 - DNA, 61 bp, Homo sapiens
aacacaacacaggggttatgccatggttgcagctagcccatagagtacctctgtgtgagtt

SEQ ID NO: 6762295 - DNA, 76 bp, Homo sapiens
tctattgaatttagaagggatatgactgtttttgaaaacttaaggctatcagtcctctctgggtttcttatttaga

SEQ ID NO: 6762296 - DNA, 76 bp, Homo sapiens
cggcagtcccagcccagaggcgccggcctggcggctggaagattgcactgtgggcacatctggggagcagctgccg

SEQ ID NO: 6762297 - DNA, 74 bp, Homo sapiens
ttgttctcttttcacttggcgtcaagggattgactgaaaataactatccttttgttacaaagaaagaagagcaa

SEQ ID NO: 6762298 - DNA, 72 bp, Homo sapiens
cctgcatgtatatgcatatagatgcacacacatatggatgagtgtgctaactaaatgtattagctaaatagg

SEQ ID NO: 6762299 - DNA, 129 bp, Homo sapiens
gcagggtgaaggatggatttgaaaggccagagtgatactgaaacagaggctccctgcacttgtcttgaagtgcttgttacaagagtagacagccttctttagtgccctttaaaccgtaatagaaaatgc

SEQ ID NO: 6762300 - DNA, 70 bp, Homo sapiens
tggggcaacctagagggagcggaacctggtcatgtttacaggaaagggctcagtccctgggtgtgtccca

SEQ ID NO: 6762301 - DNA, 64 bp, Homo sapiens
cgatgaggcagctggctttctccctggcaccagccccaagggagccagcctttgcctataattg

SEQ ID NO: 6762302 - DNA, 79 bp, Homo sapiens
tgcagcacagctgaggggctgtctttgcacacgggctgtgcgagggaggtgggcagcctcctcatgctccgtgtgagca

SEQ ID NO: 6762303 - DNA, 68 bp, Homo sapiens
acctgagggcccaaacttggtagagtttacttaacaaacactgcgcttccaaggccaggccctgaggt

SEQ ID NO: 6762304 - DNA, 58 bp, Homo sapiens
gctgatcattcaggttgggcaagtgtcacagtcctggcaattgagacctgagtgaagt

SEQ ID NO: 6762305 - DNA, 75 bp, Homo sapiens
cagttaggacccacacccaccagccgcaacagattcatgggcaaaacatcggttgtagtggatgtaggatagctg

SEQ ID NO: 6762306 - DNA, 61 bp, Homo sapiens
tggaccttggcatcctctgaagaaatgatattttttattctagcattgatgccaaggtcca

SEQ ID NO: 6762307 - DNA, 129 bp, Homo sapiens
ccttatgagtgtggaggaatgagggctctcatgaaaggaagagggctactcctacctctctctgccatgtgaggatacaaggagatagctgtctaccaatcagtaagagagcccttaccagacatcggg

SEQ ID NO: 6762308 - DNA, 55 bp, Homo sapiens
tccttcatttctcctgatttgtatgttttattttcaggtctatagaagaggaggg

SEQ ID NO: 6762309 - DNA, 84 bp, Homo sapiens
ctccactgtttctctgaaagtggcttctctgtgcttttagtttttctaggagttgagagaaagaccactccagaggacagtgag

SEQ ID NO: 6762310 - DNA, 58 bp, Homo sapiens
tacctgctttttaggcatatggggatttaatgagctaataggtgcagagagcatggtg

SEQ ID NO: 6762311 - DNA, 68 bp, Homo sapiens
ctgtctgtggcctgttataatgagaacaacctatatatatcttgctattagcaattcccacagagcag

SEQ ID NO: 6762312 - DNA, 68 bp, Homo sapiens
gaaggcagctaagatggataatgaacagtgatgataattcaggtcatttagccgttcttagttctttt

SEQ ID NO: 6762313 - DNA, 55 bp, Homo sapiens
ggtggttcacgcctataatcccaacactttgggaggccgaggcaggtggatcacc

SEQ ID NO: 6762314 - DNA, 92 bp, Homo sapiens
cactcccatgaaggcagccaagggtgctcccgcagcttgaagaggggtacctggctcaggcttgggaggcccagggcttgccagagggagtg

SEQ ID NO: 6762315 - DNA, 56 bp, Homo sapiens
tggcagatagagctcctgaagatggcttgcagctttctttccgggccttctgtcca

SEQ ID NO: 6762316 - DNA, 75 bp, Homo sapiens
tatctttcctgttagcatgctgatcatacttggaaactatgagtcagtgaaatgcagccgctagcagtgggggtg

SEQ ID NO: 6762317 - DNA, 84 bp, Homo sapiens
gagggtccaggctgagggcggggatccctggctttgggaaaccctcctcagacagggctccccgcaccgcagccctggcccctt

SEQ ID NO: 6762318 - DNA, 59 bp, Homo sapiens
gaccatttcaggggcagggactctgttaaacattacagagatgtcctctccaaatggtt

SEQ ID NO: 6762319 - DNA, 85 bp, Homo sapiens
gggacatgtttgtgggcgctaacagcacttattttctccaaagggcaaatttcaaacaattcctgtgctgagtgatcccattcct

SEQ ID NO: 6762320 - DNA, 82 bp, Homo sapiens
ctctgggagctgggaggtgggcagtgagatgggacagactcagcacccaccccattttgcctgcttgttccctgcctcagag

SEQ ID NO: 6762321 - DNA, 86 bp, Homo sapiens
agaagccacaacccagccccagcacaggctcctcagatttatctggagcaaggatttagggacactgttctgggggtgaggcttct

SEQ ID NO: 6762322 - DNA, 108 bp, Homo sapiens
ttaagatgtgtcttcaatttgtataaaatggtgttttcatgtaaataaatacattcttggaggagcaccattgtgctggtgtgaatgattccatagtaacaatcttga

SEQ ID NO: 6762323 - DNA, 71 bp, Homo sapiens
cagagcattcctattactttgaccctgctagtgaacctggaggtcttgtctgatagggaaaagtgtctctg

SEQ ID NO: 6762324 - DNA, 56 bp, Homo sapiens
tccttgtgccatcagcagtgagggaaagaacatttctgccttgaatggtactggga

SEQ ID NO: 6762325 - DNA, 72 bp, Homo sapiens
ggaaagataagtagggcaatttgtgggagcctgtacactatttaacttcccagggagtgctactatcaagcc

SEQ ID NO: 6762326 - DNA, 108 bp, Homo sapiens
ctagccagctggctgccaatggtgatgtatagagatgacttgatttgaccttgaagggaagaaacaaattaatgtgtctcaaaataaattccggcaatcggtggctgg

SEQ ID NO: 6762327 - DNA, 67 bp, Homo sapiens
tgggtccctcaggaaacagaaatcttattgtttggtagaaaacatctttttgtttgctgaaatccta

SEQ ID NO: 6762328 - DNA, 79 bp, Homo sapiens
cgggaagctgtgcctattcgtggcaagttcaagataaaatgcatatgtccttgcaatgaaggcacacttatttatcccg

SEQ ID NO: 6762329 - DNA, 62 bp, Homo sapiens
gcttacatgcatatgtcaaaaaagctacatatatgtgtttgtgtgtctatgtgcatgtgtgt

SEQ ID NO: 6762330 - DNA, 82 bp, Homo sapiens
ctatcgcttcctggcctggggaatagagtcaagggggccaccctcagtcaccttcctttgactctccccacagaaacaatag

SEQ ID NO: 6762331 - DNA, 99 bp, Homo sapiens
gttggcccggatggtctcgatctcttgaccttgtgatccccctgccttggcctcccaaagtgctgggattacaggtgtgagccaccgtgcccggcctgc

SEQ ID NO: 6762332 - DNA, 57 bp, Homo sapiens
ttttgcagccactgatgatcattgcttagatacattatttcattagggattgcaaag

SEQ ID NO: 6762333 - DNA, 62 bp, Homo sapiens
acagagtacattcagagactatgcccacttggcatggttagagcatagaatgatactagggt

SEQ ID NO: 6762334 - DNA, 63 bp, Homo sapiens
cctctgaggttcctgggggtgtgcacaactaccgggtgcatcttcagtaggaactctcagagg

SEQ ID NO: 6762335 - DNA, 56 bp, Homo sapiens
cctaactttcattaggccccagggactgcatcctagggcctaataagaaggatggg

SEQ ID NO: 6762336 - DNA, 76 bp, Homo sapiens
ccctcccctgcactcaccctgatttttttctccctctaattgagggagcaaaggtttcagggttgtggcctctggg

SEQ ID NO: 6762337 - DNA, 80 bp, Homo sapiens
ggggagctggttaaaatgcagatttctgggtcaaaatcaaaggtgtgtggcacaggaatctgcattttgaccggtaccct

SEQ ID NO: 6762338 - DNA, 68 bp, Homo sapiens
actgcagacactcacagagcacccactctgaggcaggctacagcagaggcacgtctgtgaatggcagt

SEQ ID NO: 6762339 - DNA, 88 bp, Homo sapiens
ggctggtcttgaactcctgacctcatgatccaccgatgtcagcctatcaaagagctgggattactggcatgagccaccaagtccagcc

SEQ ID NO: 6762340 - DNA, 63 bp, Homo sapiens
aaactaactaaaaaccttgccctgtgaaaacaggcatatggcagaggtttttcagtatggttt

SEQ ID NO: 6762341 - DNA, 77 bp, Homo sapiens
ggctgtttgtctctgtgtggcttccctagggctcacctggaagccctgggaagactcctcaggaggcgtgctgagcc

SEQ ID NO: 6762342 - DNA, 58 bp, Homo sapiens
aggtcacatggataatgatcagaggacaagagtttcctgactcctatcacagtgttct

SEQ ID NO: 6762343 - DNA, 82 bp, Homo sapiens
agcaattgatggcagcagtttggagtctttggtgaattcagtcaagaaagaaatccccagctgtctaccattgcagttagct

SEQ ID NO: 6762344 - DNA, 83 bp, Homo sapiens
gatccccttgatgacttgggcttgggcgtgggtttagtgagcacccgaacctaccgggttcaggttgtttgaggccatgggtc

SEQ ID NO: 6762345 - DNA, 83 bp, Homo sapiens
gtcagatctgaccacatcaggggctcctgggccctccagatgctgctgcctcatgtccaaggcccctgtggtctagccctgac

SEQ ID NO: 6762346 - DNA, 66 bp, Homo sapiens
ttgccagtattaatagcactttagagaaaccaagccgtcactccttaggttttattgtgctggcag

SEQ ID NO: 6762347 - DNA, 58 bp, Homo sapiens
tagcagagtaatactttggagccagatatctggatttcatttctgtgttagtttgcta

SEQ ID NO: 6762348 - DNA, 60 bp, Homo sapiens
agtccttatgtggtggagagagtgaaagcaagtctctttctcctctttttataaggcact

SEQ ID NO: 6762349 - DNA, 59 bp, Homo sapiens
tggaaattcctaattaacatggagagaatattttctctttactggaatggaactttcta

SEQ ID NO: 6762350 - DNA, 83 bp, Homo sapiens
ctttgggcagccacaataacttatgcatgtctcatggcaattgccagaaggtattgtaattatgacagctgccatgaacaaag

SEQ ID NO: 6762351 - DNA, 63 bp, Homo sapiens
gaagaatggcatttagaaaacaacatgtttgtaggatattgttgcctctaggtgccctctgtc

SEQ ID NO: 6762352 - DNA, 59 bp, Homo sapiens
gcctgcgtgccacagaccaccgtgctggttatatgagtaactagggcttggcagcaggc

SEQ ID NO: 6762353 - DNA, 89 bp, Homo sapiens
atctcaggccatttgtggcaagtgcttccccaaccacagttgttatacaacactacaactctgtgtgcacttgttagatctctgagcat

SEQ ID NO: 6762354 - DNA, 75 bp, Homo sapiens
ggggaggcacaacctgggagagcctttcctgagtccagctggagccagagataaaggaggcctccctgcttcccc

SEQ ID NO: 6762355 - DNA, 59 bp, Homo sapiens
aggccaagtgtgggcattaataattaattaattaattgatgatacccacacttatgttt

SEQ ID NO: 6762356 - DNA, 95 bp, Homo sapiens
aatatctagaaattaggcctacatcataaactgggtatttagggaacttccctgttccacactttgagatgactaggaaacccctttctgatatt

SEQ ID NO: 6762357 - DNA, 81 bp, Homo sapiens
gagggctttagatgtgtatatacatgtcaatacttgtaaaactgcacactttgaatatgtgtaatatgtctattatacctc

SEQ ID NO: 6762358 - DNA, 62 bp, Homo sapiens
gtgtgtgtgtgtgtatcctcccatggacatttatggatatgtaggtaaacacagacatatat

SEQ ID NO: 6762359 - DNA, 55 bp, Homo sapiens
gttcctatcttattggcaaaggcaggtatgtacataatgtagaaaagataggaat

SEQ ID NO: 6762360 - DNA, 76 bp, Homo sapiens
atggaaagattttcattcttatttgtgatctggacagtgggtggactagttcagatccatagagaaaaatctccat

SEQ ID NO: 6762361 - DNA, 66 bp, Homo sapiens
aggaattgtaatgagaaagagagtgaattgggtcataatttctcttcgttttcattaaatatgact

SEQ ID NO: 6762362 - DNA, 55 bp, Homo sapiens
tggaagcatctgtagatattaggccccctgggattatgtatgcaaatgtcttcca

SEQ ID NO: 6762363 - DNA, 65 bp, Homo sapiens
ggaggtctcttcaggttctgtttgtttttgtctgattataaactctattttgaggagatgccttc

SEQ ID NO: 6762364 - DNA, 130 bp, Homo sapiens
ccgctcctgcttgatctcctccaggatcttctcatgcagggacctttgctttggtggcaacgggcgcagccgcctctcagagacctgcggtggggaagcgagacctgcggtggggaagcaggacctgcgg

SEQ ID NO: 6762365 - DNA, 65 bp, Homo sapiens
tgcacaacaccaggaagctcatttcacatagaccatgatgtagatgtgttgcctggagttgtgta

SEQ ID NO: 6762366 - DNA, 55 bp, Homo sapiens
ttctggaagggtggagtagcttctttatattctagcctctaaactcttctcagag

SEQ ID NO: 6762367 - DNA, 129 bp, Homo sapiens
ataacagcattttgtaatactattttttattggaagaatataaagataattctgttttcctctagaggggccgattgatacttttttgtgtttttgataataataaatatatagacatactctctgttt

SEQ ID NO: 6762368 - DNA, 56 bp, Homo sapiens
tcagtgtggcccagggaagcagagcttgcaccgcctgccagttctgagcccactga

SEQ ID NO: 6762369 - DNA, 71 bp, Homo sapiens
gttctgagaggtttgcattttcatttaatgctgtaggagtgaagcagatgaaaatgcaaaactcccagaac

SEQ ID NO: 6762370 - DNA, 71 bp, Homo sapiens
tcagggatgggttttgtgaccatagattatggcggaagtgatggtgtgtgacttccgaagcttgttgatga

SEQ ID NO: 6762371 - DNA, 89 bp, Homo sapiens
tgtttcacggcagtcagaagaaccactactttcagggccttcgttttcattaccttcggaatgtagtaaatctttctcagcttgagaca

SEQ ID NO: 6762372 - DNA, 55 bp, Homo sapiens
attattaggactactggggttggtggtaggttctgctttaccaggttctgatgat

SEQ ID NO: 6762373 - DNA, 57 bp, Homo sapiens
cgtcactttggtcacactgggcactgggaaggatgttctgcaggtgacctggtgatg

SEQ ID NO: 6762374 - DNA, 58 bp, Homo sapiens
tttatgtccttgttttggtgacactatactagtggctccctcagacaaggtatataaa

SEQ ID NO: 6762375 - DNA, 61 bp, Homo sapiens
taatgcacgttaacatttgagaagtgcttgtttgaaagatgaatttgttagctgtgcatta

SEQ ID NO: 6762376 - DNA, 73 bp, Homo sapiens
aggagcattgggtgaataacctactccaggccttgcagccaactagccaaggcaggtctgtatctagtctcct

SEQ ID NO: 6762377 - DNA, 114 bp, Homo sapiens
cctaaagtatttttagaaaatagcattgaatttttgctgttgatattgtgaattataattgagacacagtacagctgaaactttagtgtgaattctaaagttggctgattaagg

SEQ ID NO: 6762378 - DNA, 74 bp, Homo sapiens
gacggagacaaggctgaacagtgaagccggcctcagagggcacagtggctggggagtttgtgctttgtcctgtc

SEQ ID NO: 6762379 - DNA, 58 bp, Homo sapiens
acccaggctggagtgcagtggcaccatcttggttcactgcaacctccgcctcccaggt

SEQ ID NO: 6762380 - DNA, 64 bp, Homo sapiens
ggaggtatggcaagatgacatgttctccctgctgcttggtgggggaaatgtggtctttacttct

SEQ ID NO: 6762381 - DNA, 64 bp, Homo sapiens
tgtatttccatgagctctgagttcacagttgggaacttgaacttaaactgggatctgggatgca

SEQ ID NO: 6762382 - DNA, 102 bp, Homo sapiens
cagccactgaactgggcctggggaggcaaaggcaagtctgtcttcattactagagaggctgtgtaaagtgctttccccttcccacccagcatcatgtggttg

SEQ ID NO: 6762383 - DNA, 64 bp, Homo sapiens
tgggtagacatttggcatggttttcaaagcctcctttttagagccagttacaaggtcaagccca

SEQ ID NO: 6762384 - DNA, 70 bp, Homo sapiens
tctttcattgtgtctatttttatcttaagtttccctggagatatagatgatagatagatagatagataga

SEQ ID NO: 6762385 - DNA, 63 bp, Homo sapiens
cctcctggcagttccccttgtcactggcgccaccctatgagaaggtgactgcctggcattagg

SEQ ID NO: 6762386 - DNA, 58 bp, Homo sapiens
ttatttggaagatcaggcagattacatagcattttgtctgcctgaaattcacatgtaa

SEQ ID NO: 6762387 - DNA, 81 bp, Homo sapiens
gctataattccatagtacagatccattaattatgcctcccctgaaagcataattaatggatctgtcctatgggattaaagt

SEQ ID NO: 6762388 - DNA, 70 bp, Homo sapiens
acatgcagggctttttgcctctgggggatgaggctggtctgaggaggggaggtgaggaccctgagcatgt

SEQ ID NO: 6762389 - DNA, 64 bp, Homo sapiens
attgtgaatagtgccgcaataaacatgtgcgtgcatgtgtctttatagcagcatgatttataat

SEQ ID NO: 6762390 - DNA, 63 bp, Homo sapiens
ttgattttcatgagattgctggagccagtgaattgtaagtatccagtgattcaatgaaaacag

SEQ ID NO: 6762391 - DNA, 64 bp, Homo sapiens
ctctatttcctcatgatcataatgcagcaggaaaactttgcatcataattttgagagaggagag

SEQ ID NO: 6762392 - DNA, 86 bp, Homo sapiens
gggatttggggcaatgcatttcacttcactgggcttcagttttcttttctgtgcagtgaggcagttgggttggcttcccaggtgct

SEQ ID NO: 6762393 - DNA, 65 bp, Homo sapiens
gcacagcccaggctctggcctcattgaaggcccagccaaatgtctttgccagggtcgggctgtgc

SEQ ID NO: 6762394 - DNA, 61 bp, Homo sapiens
agagctggttcaagtcctggctctgtcacttgctgtaacagaccagatactgaacttttct

SEQ ID NO: 6762395 - DNA, 82 bp, Homo sapiens
agtttttgatgatcttctgctatcatttttgctatgttatctgaatagccatccagatctgtagtaaaagatctcgttagct

SEQ ID NO: 6762396 - DNA, 72 bp, Homo sapiens
gggcctgcagcccttggtattttccgatcccagctgctctgtgagggtggaaagtatttggggaccaggctt

SEQ ID NO: 6762397 - DNA, 93 bp, Homo sapiens
gttgttgtttaatgggtagggagttttagttttgcaaagatgaaaaacacttttgcaagatgaaaaagttctagagatctgttgcacaacgat

SEQ ID NO: 6762398 - DNA, 124 bp, Homo sapiens
gggcgcgggcggcggcggggggcgccggctgctgcggcggggccgggcggctgctccgcgcatgtgcacccgtccaggtggccctgccctactctgcggcgccggcacggccgcccccgggccc

SEQ ID NO: 6762399 - DNA, 72 bp, Homo sapiens
actcagatccatggctttgcttcagttcttctcacccttggtgcttctggcatccagccatgtgattttagt

SEQ ID NO: 6762400 - DNA, 85 bp, Homo sapiens
caattaatttatttttcaagtacagaaatactggggggttcttacaaaggggattgtcccatttctgtctaatttaagtttattg

SEQ ID NO: 6762401 - DNA, 58 bp, Homo sapiens
accagagggagacttcctcttctacttcagaaatgaatggggagtataattttctggt

SEQ ID NO: 6762402 - DNA, 60 bp, Homo sapiens
ctgtgcctggggggcagagctgggctgtagccaaggctgttctatctactcagagtatag

SEQ ID NO: 6762403 - DNA, 55 bp, Homo sapiens
tggttatcagccagcgaagctcattgtgaagatgagatcgcccagctggtaggca

SEQ ID NO: 6762404 - DNA, 68 bp, Homo sapiens
agaccctcacgctgtctctggtgtggagccctgttaaactccacacattagagccaatgtcagcctct

SEQ ID NO: 6762405 - DNA, 76 bp, Homo sapiens
ctgtatctcggcctgcaactggcacagcttgtcctcgttcacaggaccccggcagacgccatgcaggtagatgcag

SEQ ID NO: 6762406 - DNA, 60 bp, Homo sapiens
ttgcttccttccacaccttcagaatgaggaactcccagcctaggaatttggaggaaacga

SEQ ID NO: 6762407 - DNA, 73 bp, Homo sapiens
aggattgggtcttcgggaatcggtgcatttcttgttttagatgcgagaagtaattgtctgaaaacccaatcct

SEQ ID NO: 6762408 - DNA, 86 bp, Homo sapiens
ccattccacttagtctcaccagttcagttttccttcatctgtctattttactggaagacagaactgtgtgatgattaagaccctgg

SEQ ID NO: 6762409 - DNA, 71 bp, Homo sapiens
ggctcggtggtgttgggttggaaagcccccgcctcgtccggcggccatgcagtccccagcacctctgagtc

SEQ ID NO: 6762410 - DNA, 57 bp, Homo sapiens
gactctccccatgtcagtgtaccctgcaatatgcaggaacctgtgcgtagggatgtt

SEQ ID NO: 6762411 - DNA, 57 bp, Homo sapiens
ttcaagaatcgaggtggctgttccttacccaacagggcagagcctgaggttcttgag

SEQ ID NO: 6762412 - DNA, 67 bp, Homo sapiens
cagataagacacgcaaataggtacggcctctctttctcttttctgtctctctctgtgtgtctttctg

SEQ ID NO: 6762413 - DNA, 74 bp, Homo sapiens
tacctgcctcaggtcccactgctagtaagtgacactggaggtggaactcatgggtgggcctgaaagaacaggtg

SEQ ID NO: 6762414 - DNA, 67 bp, Homo sapiens
tgttgtgttggaaatgaggctggccatataaaatttagccctgaattccaagccttcaacacattca

SEQ ID NO: 6762415 - DNA, 70 bp, Homo sapiens
agtatgttacagaaagcaaagatgagtattgtttctcaaagcctttgctttatgtatttatacacatact

SEQ ID NO: 6762416 - DNA, 68 bp, Homo sapiens
tctcctttctccttccgacttcatgcccagcaggagcttttcagaatacaaggagggggaagagggga

SEQ ID NO: 6762417 - DNA, 95 bp, Homo sapiens
agtaagaaatgtggttgcagaggcagtaatttgaggtatctgtgtgacatccaaacagagatgtcagattggcagctgtgtgggtgcatcttgct

SEQ ID NO: 6762418 - DNA, 74 bp, Homo sapiens
ctggttaattttagggagacaatacaaaacctgagtgtcattgtgtgctcccttttgctgtgtccttgagccgg

SEQ ID NO: 6762419 - DNA, 78 bp, Homo sapiens
ctcgcacctgtagccccagctactcggaagctgaggtgggatgatcgcttgagcctgggaggttgaggctgcagtgag

SEQ ID NO: 6762420 - DNA, 63 bp, Homo sapiens
gagtacagacctgtctcttcctggaattaaggtgcccaggatggagggagggctgttaaactc

SEQ ID NO: 6762421 - DNA, 117 bp, Homo sapiens
ttctgcaaaacaagaattatttttctgactgtaaagttacttttgaaaggaccctgtttccctctagaattcctatcatatggctttcattttgagaagatggctctttatgtagaa

SEQ ID NO: 6762422 - DNA, 58 bp, Homo sapiens
ggggaggagggcaggatgttagggattgagcagaggctggcatcctcttctcctttcc

SEQ ID NO: 6762423 - DNA, 58 bp, Homo sapiens
ctggcaggcagacttctgcaaggaatcacattgttctagcaaaagttgtgcctgccag

SEQ ID NO: 6762424 - DNA, 91 bp, Homo sapiens
ccatagagatccatgtcttagaaaaatggtatgtttttatcagatctcagtaaagataatgctattttctgacttttgttgtttttaatgg

SEQ ID NO: 6762425 - DNA, 63 bp, Homo sapiens
ggagccttgagctgatgctgacactagctgagagaagatccatggcagctctagtcgaggccc

SEQ ID NO: 6762426 - DNA, 68 bp, Homo sapiens
caaaaccttcaaatggattcagtgagagttgctcccatgggggccttgctgcttccagaaggtgcttg

SEQ ID NO: 6762427 - DNA, 72 bp, Homo sapiens
caatattcctgtggcttccacatcatgatctcaagtcatgggatgagggtgagccacatgagccatatgttg

SEQ ID NO: 6762428 - DNA, 124 bp, Homo sapiens
gttcttcctgggggtgcagacaagcgcatgcagttctggaggtgcttcgctggccacccggccttgggtggcctggctggcaccacctcactctgcttcatgtaccccctggatttcccagaac

SEQ ID NO: 6762429 - DNA, 61 bp, Homo sapiens
ctgctggagtgaagcttatttttcagttaaaattgaagaacaactttacatcccactgcag

SEQ ID NO: 6762430 - DNA, 64 bp, Homo sapiens
atccatggcttagaagttccagccctccatgaaccgttgggttgaggttctctgggtcctgggt

SEQ ID NO: 6762431 - DNA, 61 bp, Homo sapiens
tttgctcaatgaggctactaagacagcttctcagtcctgggaacctggcctcttgagcaag

SEQ ID NO: 6762432 - DNA, 69 bp, Homo sapiens
tgacttagcttgttttcacctaagactctgagattctattctgtttatgtgagatttgggctgagttca

SEQ ID NO: 6762433 - DNA, 80 bp, Homo sapiens
agggctttgcatttttactttgttctgggactcactaattacatagctgttcctgctgacaaggaaagcatgctatccct

SEQ ID NO: 6762434 - DNA, 70 bp, Homo sapiens
gctatgatttctcactgtggatttcctcagagtgccattagtgtaccaaggagaacacaggggagattgc

SEQ ID NO: 6762435 - DNA, 78 bp, Homo sapiens
tcaagagcttaatgccctggagtcagaggtctgaattccatcagggcttttgaattccaaggcattaggactatgtga

SEQ ID NO: 6762436 - DNA, 61 bp, Homo sapiens
gttgcggatcttcatggcctcaggagacttgtttctccatgggctcttctggactgcacac

SEQ ID NO: 6762437 - DNA, 55 bp, Homo sapiens
gttctgagtggcccaagccctgatgtgtcgcacacaagggctaggcacatagggc

SEQ ID NO: 6762438 - DNA, 58 bp, Homo sapiens
gacctgtgtgccagtcctgactcctgaccactaagttatgatgtagttggcacaagtc

SEQ ID NO: 6762439 - DNA, 61 bp, Homo sapiens
ttttcacctgtctctggtatacagtggtaatgtatgcacattgtaaactgcagagtgagaa

SEQ ID NO: 6762440 - DNA, 71 bp, Homo sapiens
gcatcatttttctttctatcacctttccttgaaaatacatcttcagctctgggtaggaggaatcttggtgt

SEQ ID NO: 6762441 - DNA, 69 bp, Homo sapiens
ggtggctgcaggagttattcaaacctagcctgggcagatctggctgaaattcagagtaaattccccacc

SEQ ID NO: 6762442 - DNA, 70 bp, Homo sapiens
gacactcagtaaatgagaagctagtaatagtcatcactgttctttaacctagtctcatttgccacttgtc

SEQ ID NO: 6762443 - DNA, 58 bp, Homo sapiens
cattttttaaacatctcactgcctgggccctgaaccaggcattgagtatagacagatg

SEQ ID NO: 6762444 - DNA, 67 bp, Homo sapiens
taaactactgggcaaggacaggctcagatctttaaccctcagatcacttgcccttgccagtatttta

SEQ ID NO: 6762445 - DNA, 57 bp, Homo sapiens
ctgtggtcatgagtccttccatggtgccaaagttgtcatggatgaccttggccaggg

SEQ ID NO: 6762446 - DNA, 76 bp, Homo sapiens
ggagagggatggagaagtcaaagtgaacaggagctttaatttgtgctcctattcctagcctactccaaccctcttc

SEQ ID NO: 6762447 - DNA, 55 bp, Homo sapiens
tagcatagcacctgacacagagtgagtactcaatatatgttaaatgctactgcta

SEQ ID NO: 6762448 - DNA, 70 bp, Homo sapiens
ctttccaccgacatcttctgtgtccttaattagtctgactaatgccacggagcccgtgtcaggtgggaag

SEQ ID NO: 6762449 - DNA, 60 bp, Homo sapiens
ggctgcaggctgcaggtctgggtcatgtctattctacgtgtctcattctggggtccagcc

SEQ ID NO: 6762450 - DNA, 60 bp, Homo sapiens
agcagcagaaagttgatggcagtagaaccattttagaaatgtcacattgtccctgctgct

SEQ ID NO: 6762451 - DNA, 61 bp, Homo sapiens
agcagtggctgacagacttacctctttgccttcttaatggctggtgtgtcaaattactgtt

SEQ ID NO: 6762452 - DNA, 116 bp, Homo sapiens
ttagagagttaggaagaagtgacatgggctttctaggccagcccaagatattagtgttttagtctaagggttattggaaagcctggagggcctaatcaaaaactaatatcatctaa

SEQ ID NO: 6762453 - DNA, 77 bp, Homo sapiens
tgcacacaccacacccgcatgcacacactttctcactatttgatatggcaacaaggagttgcagctgagtgtgagca

SEQ ID NO: 6762454 - DNA, 102 bp, Homo sapiens
ggtactattataatctcaatttttaatggaacagcatgcatagaaaggttaaaatcttgtttaactctaggtgcttatgttggaggttgggatttgagtgcc

SEQ ID NO: 6762455 - DNA, 57 bp, Homo sapiens
gccctcagagttccccacagtgacatatagctgtggggaaaattatctatgaggagc

SEQ ID NO: 6762456 - DNA, 92 bp, Homo sapiens
gcttcttataatccatgccatgttacacttaaagagatcagtaatattttaattgaaaattttgttgaggtaattgtcaatttagatgaagt

SEQ ID NO: 6762457 - DNA, 56 bp, Homo sapiens
acacagccgtgaatctgcttctcttgctactaacagaacagtggaaatggctgtgt

SEQ ID NO: 6762458 - DNA, 64 bp, Homo sapiens
gaaaccctgggaaacttaatgtcagtggagtgttgaaggctgaaacttatatatcccaggtttc

SEQ ID NO: 6762459 - DNA, 59 bp, Homo sapiens
tgggctctcacacatgttctgacggctacatggagacaccagaacagtctgagaggcca

SEQ ID NO: 6762460 - DNA, 73 bp, Homo sapiens
ctactgtctgccagctggagaccaaggaaagctgatggtgtagtttgaagcctgaaagctggacaggcagtgg

SEQ ID NO: 6762461 - DNA, 57 bp, Homo sapiens
ttgtgtgtgtgtgtgtgctggttttttccttaaagtagcttaatatgaaacacataa

SEQ ID NO: 6762462 - DNA, 66 bp, Homo sapiens
tacacaacactcacatactaaatattatctacaaaacaggtagcgttatcaatttgagtgtgtgtg

SEQ ID NO: 6762463 - DNA, 129 bp, Homo sapiens
tcactgataagaagctatctttaagatctcaggttggtctgcttcagaaacatgtggctctgacagatagatagacagtcatgccctgccaagcaggctaaatcttagagtgcaggtatccacaagtga

SEQ ID NO: 6762464 - DNA, 68 bp, Homo sapiens
tagcaaggtcccaagcaatgcccttggcggcttagccaggacacagtgacttggaatacagcttgcta

SEQ ID NO: 6762465 - DNA, 57 bp, Homo sapiens
actatctcctgatgaaaattgactctggagttgggtgtcaatttcaggtagcatagt

SEQ ID NO: 6762466 - DNA, 130 bp, Homo sapiens
ggtttccatagcatttagtttagccaaaagtaaccttagctgaggcaaatagttttaagtgaaaatttatttatcaaatactactttggaattttaggaaaggttttttttaaattataatatggttact

SEQ ID NO: 6762467 - DNA, 68 bp, Homo sapiens
ctcgggcgagcagttcccagggaggtgagctgtgcagacccagggcctccaccgaacgctctcttgag

SEQ ID NO: 6762468 - DNA, 70 bp, Homo sapiens
aggaggccgtactgtccagtgtcgctcctcagcatcgtgctgagctggagggaaggccaggaggcctcct

SEQ ID NO: 6762469 - DNA, 71 bp, Homo sapiens
taccaggacatagcagtggtttggtgtcctgcccatttgtgtggcaggaaattcttttgtttgtgctggtg

SEQ ID NO: 6762470 - DNA, 64 bp, Homo sapiens
tgtatttcatcttcttaagctgtttgtgttgatgtacactgttaaaatggtttgatgaagtata

SEQ ID NO: 6762471 - DNA, 61 bp, Homo sapiens
tgtgtattaccattttacagctgaggaaactgaggcttagggaagttgaatgacatgcaca

SEQ ID NO: 6762472 - DNA, 68 bp, Homo sapiens
ctcaatagaaagcaataatcccaaagtgctgagaagtaatgactcagctaggagactgttgctctgag

SEQ ID NO: 6762473 - DNA, 68 bp, Homo sapiens
ggtgacctggaggtgcaggaggaggaagagaattcccaggactcggcactctccttggaggggtcact

SEQ ID NO: 6762474 - DNA, 83 bp, Homo sapiens
cccttctccactaaaatataatttagaaggggaaacaggttttgtctgttttgttcactgcattgtccttgtgctgagaaggg

SEQ ID NO: 6762475 - DNA, 129 bp, Homo sapiens
ggctctgtgctggcaggctctgcgttgctcagatcctgttcccacctacaacctggagggagggctcccagccccatctatagaggtggaaactgaggttcagagagagtgtatgacttgcctagggcc

SEQ ID NO: 6762476 - DNA, 76 bp, Homo sapiens
ttgcttgaactctggaggtggaggttgcagtgagccaagattgtgccactgcactccaacctgggtgacagagcaa

SEQ ID NO: 6762477 - DNA, 68 bp, Homo sapiens
acatttggcataggcagaggcccagacagggagaccacgctgggaccacgcctcctatccaacagtgt

SEQ ID NO: 6762478 - DNA, 66 bp, Homo sapiens
gtgcatgaagactcagaaagtcaggatcatttggagtcaatccagaaagtctcagcttcactgcac

SEQ ID NO: 6762479 - DNA, 78 bp, Homo sapiens
agcagatcccagaaatatttctcagaggaggtgatgaagtgttaaacgcagcagggctttcctgagaagtgatttgct

SEQ ID NO: 6762480 - DNA, 70 bp, Homo sapiens
ccagctttcctgcgagttgatttcacttccacataaatcatttcttctagcttgctggaaagttccttgg

SEQ ID NO: 6762481 - DNA, 55 bp, Homo sapiens
gccctggccatagctcttgtatccatggttgaacagttggacacatggcctgggt

SEQ ID NO: 6762482 - DNA, 71 bp, Homo sapiens
tctttggggagacttggatatagctatgaagttatgttcatttagctgtttctaagtgttgtttccatgga

SEQ ID NO: 6762483 - DNA, 59 bp, Homo sapiens
tccaggtctggcctgctaggcatgtatttgctcgaggccaagagagagccaggccagga

SEQ ID NO: 6762484 - DNA, 83 bp, Homo sapiens
tttccgttggttttctttgacaaaatctggcgacctgtgccaacaagacctgccaggcagtgtcagattgaggaccatggaaa

SEQ ID NO: 6762485 - DNA, 56 bp, Homo sapiens
aggattttacgggtatatattgtggacaccttccccactgtgcccggaaaatacct

SEQ ID NO: 6762486 - DNA, 79 bp, Homo sapiens
ggagatgctgtagagagcacaagcttcagagtcactcatcccaaggtgcaaaggagctgggtgtttatttgccaactcc

SEQ ID NO: 6762487 - DNA, 97 bp, Homo sapiens
tcactatagttttgccaggcagagctcatgcctgcacctctcatacactgagagcaggtgcctgtagctctctcaggctggaattgaacactggtga

SEQ ID NO: 6762488 - DNA, 55 bp, Homo sapiens
agggctaggaatggaactggagtgccgaacgacagctgtcatactcttagctcct

SEQ ID NO: 6762489 - DNA, 114 bp, Homo sapiens
gttttgctatgtcttaatgtattcaatgttttcaactgacaagtaaaatttgtatgtatttattgtgtactatatgttgcatggaaatatgtatacattatggaatggctagat

SEQ ID NO: 6762490 - DNA, 56 bp, Homo sapiens
tgctgcttgcagtgcttgattcgtggctcttttcaccatcttcaaagccagcagca

SEQ ID NO: 6762491 - DNA, 70 bp, Homo sapiens
gtctcctaaacattaaaccacaggaatatgcaagggcatggtttattgctttaatgaaatgtaggtaggc

SEQ ID NO: 6762492 - DNA, 118 bp, Homo sapiens
ggaaggatcgggagagatgggaacataggaatgaggcagagggctgtgccggctgaggagaaagagccgggtgagccctgctgcttcttgtattttacccacttgatgagatctgtcc

SEQ ID NO: 6762493 - DNA, 76 bp, Homo sapiens
ggactacaacaataagaacagctctatggaaatggtcagtatgtcaatcttttgttgttgtttttgccagcagtcc

SEQ ID NO: 6762494 - DNA, 78 bp, Homo sapiens
aactcccctttcctgagtcccttccctgagtcccttggaggtccaggcctgggcttcggggctgagggaaggggagtt

SEQ ID NO: 6762495 - DNA, 70 bp, Homo sapiens
cttctgttttaacctgaatttcttgatccagtcacttttggtccagaagctcaagttgaacttgaagaag

SEQ ID NO: 6762496 - DNA, 63 bp, Homo sapiens
cttatacagtaatgtgtccctgcaggtagaacaatgcctgtcacatatttgctgttcagtgag

SEQ ID NO: 6762497 - DNA, 75 bp, Homo sapiens
cctgtgcagcccttgccagtttccacgaggcaggatactccactagctgattcagacaggcagaggctgcagagg

SEQ ID NO: 6762498 - DNA, 111 bp, Homo sapiens
accaaccgcatggccttggtgtgcctagatttcctcttttgtaaagtgaggctgaagtgtctccctttggatggtaggcgaggaccaagaggcccagcgcctggcggtggt

SEQ ID NO: 6762499 - DNA, 93 bp, Homo sapiens
ggtagaggaacccagtaggggtgtttcgagagaggttgggggcctggtgcgtctatccttgttgaaagggctcctgagtggaggttctttatc

SEQ ID NO: 6762500 - DNA, 56 bp, Homo sapiens
tggctttgcctgaataagcccacatacgatactgtgacctttgatgggaggagcta

SEQ ID NO: 6762501 - DNA, 57 bp, Homo sapiens
ttgcagcttcgagtctatctgtggggactcagctttttcaataactctaggctgtaa

SEQ ID NO: 6762502 - DNA, 85 bp, Homo sapiens
gggtctcttgaggaaggggagctaaatctactgtaaatcagatgtgagcctggtccagtagttccctttgcctcactgaatgctc

SEQ ID NO: 6762503 - DNA, 70 bp, Homo sapiens
gcccgcggagttgtaagggatgtggcttgtgctgggaaacacagttatcatcccttacactttgtggagc

SEQ ID NO: 6762504 - DNA, 77 bp, Homo sapiens
aattctgtgcagcaacaagatagaatggcacaggtctactcaggtgacagccaacctttcttttgtagtaaggaatt

SEQ ID NO: 6762505 - DNA, 59 bp, Homo sapiens
gtatggttcagaggccatgattaattaggcaatatcctgaatggctctgggatcactgc

SEQ ID NO: 6762506 - DNA, 60 bp, Homo sapiens
aatattgagggtttttaagaatgtaaatggggacaacccacactggaaggcttcaatatt

SEQ ID NO: 6762507 - DNA, 106 bp, Homo sapiens
agcttggctggcagttcttccagtctctgctgggctcctcatgtgactgtggtcagctacagcccactgggtagctcagcttctgggagttggccagctattggct

SEQ ID NO: 6762508 - DNA, 60 bp, Homo sapiens
ccctcagctccaccctcagcagatgataatatcaagacacctgccgagcgtctgcggggg

SEQ ID NO: 6762509 - DNA, 103 bp, Homo sapiens
tcaaaggcaactcgaggaaaacgatttgcagctagagcaaaggtgacaagttgacctttactggctgcaaagacgtttgtcataataatcagctgctttctgg

SEQ ID NO: 6762510 - DNA, 55 bp, Homo sapiens
gggatcttgcatgaatcaaaagaacgacacatgtgttttcttttcatgtgatctc

SEQ ID NO: 6762511 - DNA, 80 bp, Homo sapiens
gagtctgcagtttatctcttttgaccaagattggtatgaagactaatctggacacttaaagaggaaatattctttgactt

SEQ ID NO: 6762512 - DNA, 71 bp, Homo sapiens
gcagacagtgagctgagactggaagctgagttttctgactcctggcccactcctagcttcttaatgtttgc

SEQ ID NO: 6762513 - DNA, 58 bp, Homo sapiens
aagaataaattaagatacttagcttctgttgtgaagctggggacttgttttgttactt

SEQ ID NO: 6762514 - DNA, 126 bp, Homo sapiens
ggggacagtgtcctccttttactagattatggacacagtgctttgtgctctcactgcatgaggttatctctgacagtgaatgacaaggttctttggcttaattcactagtggaggacagagtccct

SEQ ID NO: 6762515 - DNA, 128 bp, Homo sapiens
taatacctgcaattacttggaaggcaaataatatacctaatgtacctacagctctaggagaaacagttggaaattttagtgttaatggtgtatattaggcattgccgactgcatttggcaaggtatta

SEQ ID NO: 6762516 - DNA, 65 bp, Homo sapiens
gggtagcactggtgggaatgggatattagatattaacaataccaccattcttagtcaagtgtctc

SEQ ID NO: 6762517 - DNA, 63 bp, Homo sapiens
cccagatcggctttgcagacctcatgggggtcctcaccaaaggggtccgggaagtggaatggg

SEQ ID NO: 6762518 - DNA, 91 bp, Homo sapiens
tccaaaggtaagctgcaattggctcttgctctaatgctggactgactggctgtcggctgcatgcctcagtgtaagatgctaagcctctgga

SEQ ID NO: 6762519 - DNA, 112 bp, Homo sapiens
agattagattcacctgtgaagccttcgaaagtcctgctgcttaggccatatttcagaacaattaagttagaatctctgggggtaggactcaggccttagtgtttttatagct

SEQ ID NO: 6762520 - DNA, 72 bp, Homo sapiens
gggaggcccggggcttcctcatcaaagtgttggtgcaggaccggctgtgagtacaaggccctgggagccccc

SEQ ID NO: 6762521 - DNA, 62 bp, Homo sapiens
cttcccggttttctagatgatcaggaaattcagcaggccagaactttagaaagactgggaag

SEQ ID NO: 6762522 - DNA, 76 bp, Homo sapiens
agtgctgtaggctccattttcctgcagctgcgcatacactcaataagcctaaatgtagtcaaaggagcctcgcact

SEQ ID NO: 6762523 - DNA, 62 bp, Homo sapiens
gtagttgaatggggcactcccagcattcacttcagtgacattggaagtggttcatttgctgc

SEQ ID NO: 6762524 - DNA, 57 bp, Homo sapiens
tctatctagagcagtggttctcaaccaagggtgattgtgcagccactttctatgaga

SEQ ID NO: 6762525 - DNA, 61 bp, Homo sapiens
ttcctttcccttgcttctgtgcagttacatcatcttctgtccacttgccagggaaatggga

SEQ ID NO: 6762526 - DNA, 81 bp, Homo sapiens
tggtctctgtgacactcctgtgaggtaggtggcaatggctttgtggtgagttgacctttcatggtgagtgatcataaacca

SEQ ID NO: 6762527 - DNA, 130 bp, Homo sapiens
gacatgaccctgctcccaaacccctttgtggcacccataggcacttggcgtgttggagacatccgctggccaccggatgctttcccatgcacaaggtcccacagaggccaccagggagttgggtattgtc

SEQ ID NO: 6762528 - DNA, 66 bp, Homo sapiens
gataattttgagagtcatttaaggtgttgtgtacctctgtcgtagcacctgtcttttaaaaatatc

SEQ ID NO: 6762529 - DNA, 79 bp, Homo sapiens
tttaaggactttaaagtcaaggtactgtttcacagatgattatttgcagacagttaattcttgagttattgtcttggga

SEQ ID NO: 6762530 - DNA, 88 bp, Homo sapiens
ggagaatcacttgagcccaggaggtcgaagctgcagtgagctgtcatcgtgccactgtgctccagcctgggtgacagagtgaatctct

SEQ ID NO: 6762531 - DNA, 82 bp, Homo sapiens
tttgatgtggaaagagaggcttactaacttgctcatggtcattcatctgttaatcagtaaagcctactcaaccacacttaaa

SEQ ID NO: 6762532 - DNA, 82 bp, Homo sapiens
gggagtttagacactgatttctacatggaccacattttacagataaggaggatgaggctcagagatgttttcaaagattccc

SEQ ID NO: 6762533 - DNA, 70 bp, Homo sapiens
gaaggagggcttcagttccttatcatagggttgcttgagtgtccttgcgacatgggagctggcttccttt

SEQ ID NO: 6762534 - DNA, 78 bp, Homo sapiens
tccagactgttccatgcagaggagctggtggcaggtccacatccctagctccccgctaatttgcagtgtgaccctgga

SEQ ID NO: 6762535 - DNA, 77 bp, Homo sapiens
cttgtaaagtggctgctatcaactccttccagctttatctccaatggaaaagagtcttaggcagtcatagtcacaag

SEQ ID NO: 6762536 - DNA, 56 bp, Homo sapiens
tgtttgagaatttgctgatgttatcctgacagaagtttcagcagattttgcaaaca

SEQ ID NO: 6762537 - DNA, 76 bp, Homo sapiens
gggatcaccactaaggctggggagcacggtagggaaatggtgaccagatcacagtacagcttcccataggggaccc

SEQ ID NO: 6762538 - DNA, 61 bp, Homo sapiens
cagcacagtacaaggcacggatgcggaaccggctcccaaaccccgtgcctcactgtccctg

SEQ ID NO: 6762539 - DNA, 73 bp, Homo sapiens
aagcagtcttggctgggttcagtgagtttagacagatatagctctctgagtcctttacagcctggactggctt

SEQ ID NO: 6762540 - DNA, 77 bp, Homo sapiens
tcctcttctattttattatgcttgcactaaatgaggcagaaacaccttagcagagtgattggccatgagggagggga

SEQ ID NO: 6762541 - DNA, 81 bp, Homo sapiens
tctcataatcaaactgccaatggtttttataactggttgtttctagtctatataaaagatattgagcagtgtttctggaga

SEQ ID NO: 6762542 - DNA, 80 bp, Homo sapiens
gcccggactgctgtcacagtccagcctagtatgtataccatatggtttgatactgggtgtggacaaagtagtcagtgggc

SEQ ID NO: 6762543 - DNA, 55 bp, Homo sapiens
ccatgtattgaattgtttaagggggaataccctagaatgtcattcaatgatatgg

SEQ ID NO: 6762544 - DNA, 101 bp, Homo sapiens
gactcctccatgtacaccgcgactcacttagaggctggaggctctcttctctcaggcctttgcacgtgcagttgccctgcctagagcaccttttctaagtc

SEQ ID NO: 6762545 - DNA, 64 bp, Homo sapiens
tgataagaaagccctcacattttaggaagaatcctacagtgtcgtgtggtttctgctcttgtta

SEQ ID NO: 6762546 - DNA, 91 bp, Homo sapiens
tggggagatggtagggtaagatgaggagtgagctctggggaaataggccaggccagagtggtacttctttttcttctcctctttttcccca

SEQ ID NO: 6762547 - DNA, 59 bp, Homo sapiens
agagcagagaaggcagctctgataatgagatgacaaaacagagggcttttctctgttct

SEQ ID NO: 6762548 - DNA, 76 bp, Homo sapiens
tggatagtaaactgtgtgcctttgactaaatcgactaggagtctagggaagggaggaggtgagcagtttacattta

SEQ ID NO: 6762549 - DNA, 70 bp, Homo sapiens
cctctcagtaagcaggctgtaagtcagcatggaagcacctgctgcagcttcttgtcctgtgatttagagg

SEQ ID NO: 6762550 - DNA, 67 bp, Homo sapiens
ctgatcctagtttgctccaccgtatcaatcttcagtgtcattgattacagtgggtaaacagaattag

SEQ ID NO: 6762551 - DNA, 71 bp, Homo sapiens
ccctccagagccagtgcttttccacctctgctgtcctctgctggtcatggttggtcactggtgctggaggg

SEQ ID NO: 6762552 - DNA, 69 bp, Homo sapiens
ttaacttctgtgtgagtttagtgttttccgtgtttcactgatgaggaaaccaaggctcagggaggttaa

SEQ ID NO: 6762553 - DNA, 84 bp, Homo sapiens
tcggacagcagagcttgagtttaggcagcagtgctatgattcttctttgaagatcatcaatctactttgcctctcagtttccga

SEQ ID NO: 6762554 - DNA, 63 bp, Homo sapiens
ttttgtgttttcactagcagtgtagattcatttaatctgaacactaaatgtgaaggagcaaag

SEQ ID NO: 6762555 - DNA, 59 bp, Homo sapiens
ggatttagagcaggaatgcatggtgaaaatactcccacatcagcgttcttctctaaact

SEQ ID NO: 6762556 - DNA, 63 bp, Homo sapiens
gcctgctgagctgctgtgcacagcctcttccatggctgggacacacaaggtcagctctagggc

SEQ ID NO: 6762557 - DNA, 81 bp, Homo sapiens
ggccacagaaacatgtataaagttgtaaaaattctttgatgcatttccaaattgcactttgagaagtgtttctgtttagtc

SEQ ID NO: 6762558 - DNA, 86 bp, Homo sapiens
tcaggatctcctggagggtttattaaaacagacttctgggttccacctcagagtttctgatttagtaggtctgcagatgggactga

SEQ ID NO: 6762559 - DNA, 74 bp, Homo sapiens
caaatattcttgaagattgatccagtttgaagcatgttgtgcatgggtttactgttcaacttgcaagtaatttg

SEQ ID NO: 6762560 - DNA, 67 bp, Homo sapiens
aggacttggaaaggaatcttttaccatcgttgaaattggctagatttgtggattccttcccgaccct

SEQ ID NO: 6762561 - DNA, 67 bp, Homo sapiens
tacataggcagggattagggttgattacgtaacaggcgtaatcatctgttgttcccttggaaatgta

SEQ ID NO: 6762562 - DNA, 88 bp, Homo sapiens
cccattataccacacagcaagagctaaatgaccatctttctagaatgcagttggggagttctttgcacagtgtgtgcatgtgagaggg

SEQ ID NO: 6762563 - DNA, 89 bp, Homo sapiens
tcctggaggcctttgtgtctgggactttgagggagctgcaaggaagagggaacttgtcagcccaaagccccaggctagagagaccagga

SEQ ID NO: 6762564 - DNA, 58 bp, Homo sapiens
agccagagcagggaattggacacacgaacgtgtgattccaatgttcctgctttcagct

SEQ ID NO: 6762565 - DNA, 129 bp, Homo sapiens
ttctctcatcttgctctgctttttctgttttctttgtttgtttgttttccaggaagattgcaagatgcctggtctttttctggaagagtaaaataagccctgagaagaggggcaggtataggagatcaa

SEQ ID NO: 6762566 - DNA, 92 bp, Homo sapiens
gtggcacaaataaatgtgtgtaacaccaaactgaacagaatctggggtttttgaagaaaaaatctttcagttacagttacacacagggccac

SEQ ID NO: 6762567 - DNA, 62 bp, Homo sapiens
agtgacaagagctaggctttttcaagttagacagatttggctccaattctggctctgtcact

SEQ ID NO: 6762568 - DNA, 63 bp, Homo sapiens
tgagaacaagcaacaaccttcagctgtgggcggacgctgactcacagactgtgttgctactca

SEQ ID NO: 6762569 - DNA, 62 bp, Homo sapiens
ctgaggtggcgcctctctttaataccacagagaaggtattaaaggagtcagagccaccaaag

SEQ ID NO: 6762570 - DNA, 68 bp, Homo sapiens
gtctcaggtgttctccactcagtttcatgttagatctaccagcaaagcttgtggaaaataccaaggac

SEQ ID NO: 6762571 - DNA, 67 bp, Homo sapiens
tccctccacacctgctggtacctgtaaaatgccaaatggatctgccttgtcaggtgatgggacagga

SEQ ID NO: 6762572 - DNA, 62 bp, Homo sapiens
gttgtgccagcctctggctgtgtctttgtgcctggagtacttctggccaggctggccactgc

SEQ ID NO: 6762573 - DNA, 124 bp, Homo sapiens
agagctattatttggggtttcaattgtctctggaaagtgaggagagttccagttccggaaggttctctgtctcttcatatttctgagcatggggcagtttagaaatcaacagtaggagggttct

SEQ ID NO: 6762574 - DNA, 61 bp, Homo sapiens
ctcctggctcctggctctggccaagggagttggcttccctgtgtccatgccaggaggggag

SEQ ID NO: 6762575 - DNA, 55 bp, Homo sapiens
gcagtggcatatcatagctctcttcatgtcagcagggagagggaggtgccactgc

SEQ ID NO: 6762576 - DNA, 101 bp, Homo sapiens
gatgtttaaccttttgagaaattggcagactgttttcaaaagtggcttcactatttcacattttcacaagtaacttatgaaggttccaatttttccacatc

SEQ ID NO: 6762577 - DNA, 56 bp, Homo sapiens
caagtccgagtttcgggatttggggaggggtcctgcacaccttgagcttggaaatg

SEQ ID NO: 6762578 - DNA, 69 bp, Homo sapiens
cacttcccactgcaccagctgctagaacatcacaggaagaaatgccttggagcagctggaggtggagtg

SEQ ID NO: 6762579 - DNA, 57 bp, Homo sapiens
gctgctggctggacttgtgcatgtcaggaatccttgagtgtcattgccaggcacagc

SEQ ID NO: 6762580 - DNA, 58 bp, Homo sapiens
ccaggactcagtggggaaagggcaacatggccagctcttctccccagcgaatcctcgg

SEQ ID NO: 6762581 - DNA, 59 bp, Homo sapiens
ctgagggcctgaggacctagatgatcatcttaatttagattgctccttggcccacacag

SEQ ID NO: 6762582 - DNA, 88 bp, Homo sapiens
ggagaatcgcttgaactcggtaggcggaggttgcagtgcgccaagttcatgccactgtactccagcctgggggacagagtgagactcc

SEQ ID NO: 6762583 - DNA, 83 bp, Homo sapiens
ggtcaggggtcaggtctaagtctggggagggctgttgtttactgggagctacagtgtgacaggcttggtgctgagtgttgacc

SEQ ID NO: 6762584 - DNA, 56 bp, Homo sapiens
ggagcagctgggacttgaacctaggcagcggggttccagagtccacatctgccacc

SEQ ID NO: 6762585 - DNA, 61 bp, Homo sapiens
tggaaataaatgtgccaagatcaaggttagggaatgatctcaggcatggtttgttcatcta

SEQ ID NO: 6762586 - DNA, 66 bp, Homo sapiens
tgtccagattctagtatagggagacatcaatacacaggtgaaaaaactaattacagattttggaca

SEQ ID NO: 6762587 - DNA, 58 bp, Homo sapiens
agaggtcttaagttccttgatggtaattttgccaaccacagggattttcaagaccttt

SEQ ID NO: 6762588 - DNA, 86 bp, Homo sapiens
ggaccctatcctggtgcctgcatcttggaggccccaccctagcagaagtagagtgtcagagagcaggcagtagaatgatgggcttt

SEQ ID NO: 6762589 - DNA, 65 bp, Homo sapiens
aagtgttctgaccccagaagaaagaaacatctaaaatatatttcattgatcttgtcagagcattt

SEQ ID NO: 6762590 - DNA, 58 bp, Homo sapiens
ccaaagtgctaggattacaggcatgaaccaccatgcctggcctccactgtattcttgg

SEQ ID NO: 6762591 - DNA, 83 bp, Homo sapiens
gtatcaaaatcaaccaggaggtgctggaagaaagcgggcaagttgtggcctggttgtacaaatgctcctgagtgatgtgatgc

SEQ ID NO: 6762592 - DNA, 70 bp, Homo sapiens
ataggaggaggaaaggagttgaaatgggcaagccaatttatgctttttcttattctttttgtctttttat

SEQ ID NO: 6762593 - DNA, 68 bp, Homo sapiens
gttgtgatagggcaatttttctcttggaaatagctctaaggagaaaacccctttgtccaaatcatcac

SEQ ID NO: 6762594 - DNA, 55 bp, Homo sapiens
gagaggtgaaatagttgtccgggttcttgctgtgaccaagaatgttttatctctt

SEQ ID NO: 6762595 - DNA, 55 bp, Homo sapiens
cttctaggggctctgggaggaaatctgtgcaaggctctcttccagcttctggagg

SEQ ID NO: 6762596 - DNA, 73 bp, Homo sapiens
cttttataaatgtgcacaggttagaagggacttccaggatgtctgttttaaccctgacatgttgcaaggaagg

SEQ ID NO: 6762597 - DNA, 56 bp, Homo sapiens
actgattgcattcatagggtttttccccagtatgaattctttgatgtgcaataagt

SEQ ID NO: 6762598 - DNA, 56 bp, Homo sapiens
ggaaagacattagcttagatgtcagcaagctaagtctcttagagctatgtttatcc

SEQ ID NO: 6762599 - DNA, 97 bp, Homo sapiens
caccctttgtggacactgcttcccagccttccaggggcttcacggagactgcgttcatgcaagggcttagggggctgtgcagtgccacaaaaatgtg

SEQ ID NO: 6762600 - DNA, 62 bp, Homo sapiens
gagccatgtacctacaacagcaaaggctcagacaagccttctcctgccttgggttcatggtc

SEQ ID NO: 6762601 - DNA, 78 bp, Homo sapiens
gaggtcagaaaaggagagcattgttcttttcagcccagtagagatagtggagttcaatcacctctcctttctgagctc

SEQ ID NO: 6762602 - DNA, 56 bp, Homo sapiens
agtggctcattcctctaatgccagcagtttagggaggttgagatgggtgggtcact

SEQ ID NO: 6762603 - DNA, 68 bp, Homo sapiens
agcttctgatgttttctgctttagctactgtgttcaccttctggactaaagaggaaagatgtaaagct

SEQ ID NO: 6762604 - DNA, 66 bp, Homo sapiens
ttaaagttcattaaatgagccatccagtgtaatttaactgaataaaaatggctcagatggctttaa

SEQ ID NO: 6762605 - DNA, 130 bp, Homo sapiens
tcataatatggcttaataaaagcctaaatcaagaaactggtgctccctccttcctcaaggatgcaatccttagacaaagagtgggcttagatttggttgtagtttacatttcagtcgtggttatttatga

SEQ ID NO: 6762606 - DNA, 58 bp, Homo sapiens
ccctaggtaagggtcacagttcatattccaaatatgactgggatgatattgcacaggg

SEQ ID NO: 6762607 - DNA, 66 bp, Homo sapiens
agggtttgggagtccttggagagtaagacatccttagcacgctctgcaaggggttctttaggccct

SEQ ID NO: 6762608 - DNA, 61 bp, Homo sapiens
ggtggagaggccatcctaccaccacggacctctccagtggccggtgggtgacctccccacc

SEQ ID NO: 6762609 - DNA, 63 bp, Homo sapiens
ctgtgccctgtggctggcacctggattccacttcctcagtaatgcttgtcatgaatgggccag

SEQ ID NO: 6762610 - DNA, 69 bp, Homo sapiens
ggcaaaggaggggaaggaaagttattagcagagatctcccagaagtcctctgtaactgtcccttttgcc

SEQ ID NO: 6762611 - DNA, 69 bp, Homo sapiens
agctgctggcactggagtgagcccatgtaggacccttctgcccaggccaccttccagttgcctgcagtt

SEQ ID NO: 6762612 - DNA, 55 bp, Homo sapiens
ccacagtcccattcgagagtaatggcagtaactattatgcttccagggacctggg

SEQ ID NO: 6762613 - DNA, 66 bp, Homo sapiens
actcaaaagcagggctagaccaagaagagcctctagagctctttttttgcccttgtttccttgggt

SEQ ID NO: 6762614 - DNA, 83 bp, Homo sapiens
cttcctgggtgatctgggtcaggccactttccttctgatcactcatctgtcagacaagtgggttggacaaatgacccataagg

SEQ ID NO: 6762615 - DNA, 120 bp, Homo sapiens
gccaccaaatatgcgttacgtgatgtgtattactctactccaaaaggctacaatcatgttttagtttacatgagtgacgccctctggagtagggcactacactcagctgaaggtggtggc

SEQ ID NO: 6762616 - DNA, 71 bp, Homo sapiens
ccagggtctgagggacagagtcctggccctgctccagatagccaggtaagcactttggcttcaggttttgg

SEQ ID NO: 6762617 - DNA, 61 bp, Homo sapiens
tggttacagagggatcagaagtgtaaattatactaattttatagcaagctctttgtaacca

SEQ ID NO: 6762618 - DNA, 74 bp, Homo sapiens
caacctgctcagcttcagcacactgggcatcacaaatagtgtcactcagtgcagctaggcatgagaagaggttg

SEQ ID NO: 6762619 - DNA, 76 bp, Homo sapiens
ttcaacttcccacagaattcaatcagtgtcagagcatggctgaacacagacgcttattgaatggctgttggatgaa

SEQ ID NO: 6762620 - DNA, 99 bp, Homo sapiens
aggcgctccttggtcaaatgaggaggcaggtgctcagggctcttcaggatttaaaggtgagccagacatggctcctgctcctgcactcaaggagcccct

SEQ ID NO: 6762621 - DNA, 106 bp, Homo sapiens
caccagcctggtttgcttttgtctctacttcttgatctgtcgacctcagatattacctctcagccttgatgatcaaaggtgaggatctggctcactcgtgctggtg

SEQ ID NO: 6762622 - DNA, 74 bp, Homo sapiens
gtggacaaaaagacttccaactcaggagggactagaaggcatttctctgctgtgttagcaggtttagtgttcac

SEQ ID NO: 6762623 - DNA, 88 bp, Homo sapiens
agcctgaacatcatggtgttaaccagctaaactttgcttgaaccctcagtccattgcagaggagcaagctggacaccactgtggggct

SEQ ID NO: 6762624 - DNA, 62 bp, Homo sapiens
ggacaggcgccagctcctgttggtcttgaggaggcgagggtctctggggctggcatttgtcc

SEQ ID NO: 6762625 - DNA, 66 bp, Homo sapiens
tctctgatgtttgctgactttttagccaaaaagaaagagaacatttggttaacacaggctcagaga

SEQ ID NO: 6762626 - DNA, 86 bp, Homo sapiens
gaggtttaagaagtacagtaaagctgctatgaattcccagctatgggaattttcctcaaagcttcattgtctaaactctgaacctc

SEQ ID NO: 6762627 - DNA, 64 bp, Homo sapiens
aacggaggctaacattacggacatctgtcagactggcatctggccctgcctaatgtacttggtt

SEQ ID NO: 6762628 - DNA, 75 bp, Homo sapiens
caagaatggttttattattgcctttctaaacaagtggaatatttggatgaacaggtaatcagtaaaatgtccttg

SEQ ID NO: 6762629 - DNA, 78 bp, Homo sapiens
cagcataactaaatagaagctctggaaagacggattcgaaaagttctggggtctggattaactgctgtttattggctg

SEQ ID NO: 6762630 - DNA, 72 bp, Homo sapiens
aaaaaatcacagctggaataggtcttggttcatgaaaacatgtaaacaaagatcttcctgcactgaattttt

SEQ ID NO: 6762631 - DNA, 86 bp, Homo sapiens
agagtctcgctgtgtctcccaggctggagtgtagtggcgcgatctcggctcactgcaagctcagcctcccgggttcatgacattct

SEQ ID NO: 6762632 - DNA, 56 bp, Homo sapiens
ccacatggtgtagctgtggatggctgggaagagccaagcaggctgtaatcatgtgg

SEQ ID NO: 6762633 - DNA, 82 bp, Homo sapiens
cctcagggaaagagaactttctgtgtttttatctccacccccagtggaaggatatgttgagtagagtttttgctttttgagg

SEQ ID NO: 6762634 - DNA, 70 bp, Homo sapiens
gaggggtgtgggtggctggaggagctgatggaattaatacattcctggcagttcagccccctaacccttc

SEQ ID NO: 6762635 - DNA, 65 bp, Homo sapiens
gttgtttatattttaaaaaatcttacatagacacacaccagtaagacaaatggagtatgagcaac

SEQ ID NO: 6762636 - DNA, 82 bp, Homo sapiens
gctctcctgaggacttctattgggttctgcctagtggtaaccgccgaggcttcgcttactctgtagatctcccgggagcagc

SEQ ID NO: 6762637 - DNA, 55 bp, Homo sapiens
gggtctccaaacccctttggctctcactggggcttctgggcaggactggggaccc

SEQ ID NO: 6762638 - DNA, 82 bp, Homo sapiens
ttgcaccttggaaaggtcagccaatagtccttgtggggacagacacctactctgaatatgagtttgcctttcctgcctgcag

SEQ ID NO: 6762639 - DNA, 109 bp, Homo sapiens
agctccagagtccctgttcttaactagcctaggctacttctaatatcatgttatgctaagaagttccctggatgagctaaaaattgagacgatgttagtgctttgggct

SEQ ID NO: 6762640 - DNA, 59 bp, Homo sapiens
acaagtccttcaagtaacctgggacccattttggccccagtgaatttgggtggaactgt

SEQ ID NO: 6762641 - DNA, 100 bp, Homo sapiens
ggtgtgctgtgacacactgggattctgaaaatggattacaaatacgccaaggtattggttcttcagccctcaggtcctaggccagtcacccctggcagcc

SEQ ID NO: 6762642 - DNA, 75 bp, Homo sapiens
gggctctagtcaagaatgaattcgagtgaaggaaagctgtgtgacacttggccttcctctatgttcatggagctt

SEQ ID NO: 6762643 - DNA, 63 bp, Homo sapiens
gttctttctctgggcaggtaggaattcatttgccctgcctgccagcccccatagagacagaac

SEQ ID NO: 6762644 - DNA, 118 bp, Homo sapiens
tcagcacctgcaaggggatgctgggtgagatcctgtctgcattcgagttcatggatgctgtgtgcatgcagctggtcgggcgccatctccacctggccagcccggtgcaaggtactga

SEQ ID NO: 6762645 - DNA, 113 bp, Homo sapiens
gggtaactcatcttgaggtgcaggtggtcgtggggcttcccaggatgcgagggacctccctcttatcctcccaccccaccgccatgttgctatcctcttcaccaccaccaccc

SEQ ID NO: 6762646 - DNA, 69 bp, Homo sapiens
tgtaagaggacattctggacaaggcaagctcctggcatttgacagatgctaatgctgcttctttttgca

SEQ ID NO: 6762647 - DNA, 58 bp, Homo sapiens
ctggggagacgatcgatgttcttggccagcttttaatgacaatcgattctctccctgg

SEQ ID NO: 6762648 - DNA, 61 bp, Homo sapiens
ccttcaaatttagaacaagtgacactgatggtaaattttgctatgcttctaagtttgaagg

SEQ ID NO: 6762649 - DNA, 68 bp, Homo sapiens
ccctgtgcacacacttcactctgctgccaaaagcaaccaatcgcctgtcagagtggatgtgcatgggg

SEQ ID NO: 6762650 - DNA, 81 bp, Homo sapiens
ctgtcttcctctaccaaaaagtgagccccagagatttgggtctgtttattcattctgcatccctttttgggccaaggacag

SEQ ID NO: 6762651 - DNA, 97 bp, Homo sapiens
ttttttccgtcttctatagtgtttcttcctgcctctagaaatatgaagccccttgggtgtggttagtggagcaggaaacatctagaggcagaaaagg

SEQ ID NO: 6762652 - DNA, 59 bp, Homo sapiens
gagctttgtctcctggagaccctgagcctacagccatggggtcaacaggacacaaactc

SEQ ID NO: 6762653 - DNA, 70 bp, Homo sapiens
cctgacaccgcgcctgcgatttcagactgtttaattaattctgataataccacatcgcaggtgctgcagg

SEQ ID NO: 6762654 - DNA, 61 bp, Homo sapiens
gaggaggcggcaagctggtgtctggggcagtgaggatttcagatgcagctcctgcctcctt

SEQ ID NO: 6762655 - DNA, 67 bp, Homo sapiens
gactaagtggaagaactgcttgtcctccagcccgaggaagctagaaggtcttcttttgtgcttggtc

SEQ ID NO: 6762656 - DNA, 68 bp, Homo sapiens
ctgtgcattgcctctattcattatatatttcttctagcttgtaatcatggtagaggcaaagtggacag

SEQ ID NO: 6762657 - DNA, 71 bp, Homo sapiens
ccaaagcctatgctgtttgagcaaaatgccgagaaaagggagcgtcacagactcaagggcataggatctgg

SEQ ID NO: 6762658 - DNA, 57 bp, Homo sapiens
tactgacacaaagccaatcccttggcacttcccatgggatacactgatgtgatagtg

SEQ ID NO: 6762659 - DNA, 56 bp, Homo sapiens
ggagatccctggggcagtggctcggaggcacgacctctcctcctcacagggactcc

SEQ ID NO: 6762660 - DNA, 89 bp, Homo sapiens
agggtgaaatgacactggtgaaaaggtgtggcgatgtgaatgtcctttgtcctgccatttgctttttctccaatgtgattgtgagcttt

SEQ ID NO: 6762661 - DNA, 57 bp, Homo sapiens
agagaattcctgccttatgaagtttttatgatgattaaataaggcagtgactttttt

SEQ ID NO: 6762662 - DNA, 125 bp, Homo sapiens
gacgcggtatgtttgccaaggatggcctggccactgcgggcctctgcccaaacctccccaggctcactgcctggacaggcaggggtagcatgtggcgtgctgggccttgaaaactccactgggtc

SEQ ID NO: 6762663 - DNA, 60 bp, Homo sapiens
aaagggttgcagcatagaagtttccaggcaaattggtgattgaatgcttgctaacacttt

SEQ ID NO: 6762664 - DNA, 80 bp, Homo sapiens
agtgtctaggccactaggagacaaggcaaaccattatctgtgaaagcctgggttttctgagaggaagcatgctggacact

SEQ ID NO: 6762665 - DNA, 86 bp, Homo sapiens
gaaaagcatggtcagataagcaaagtctcagaaaatatgctttttgaaaacaaatatgctttttgaaggctgctcatatgcttttt

SEQ ID NO: 6762666 - DNA, 127 bp, Homo sapiens
cacggctggaaacggggaagctggatttggagtttgcctgactgcagagaggcacctctgttcccgtggtgtctctgctttccttgcagggcagtgcacatttcttggttttccttttaaagccgtg

SEQ ID NO: 6762667 - DNA, 63 bp, Homo sapiens
tcctcatggtgattttcatctctgcattcccaagcgtgtagatgaaggggttcagcatggggg

SEQ ID NO: 6762668 - DNA, 64 bp, Homo sapiens
acattatacaggtagggtctatgttagataaaactgtttctaaaatctaactctacctgtttgt

SEQ ID NO: 6762669 - DNA, 76 bp, Homo sapiens
ctcggtacctcaagcctagttagatccataggatttggaaaaaccacagatggatctgtgggctttgagggcagag

SEQ ID NO: 6762670 - DNA, 81 bp, Homo sapiens
agtcttgctttgtcacccaggctggagtgcagtggtgctgtattggctcattgcaacctcctcctgggttcaagcgattct

SEQ ID NO: 6762671 - DNA, 61 bp, Homo sapiens
ttctggagctctcgaccccactgaccttctgtactcagttatggaagtcagaattccagga

SEQ ID NO: 6762672 - DNA, 77 bp, Homo sapiens
gtcataaagtcatctgtcctaggctctacaatgtagcattttcaaattggaagagccttcagagattattttattac

SEQ ID NO: 6762673 - DNA, 67 bp, Homo sapiens
gctctgagtgatcagctgggaaacatggcctgggcacagccctctgcctagctgtattacttaaggt

SEQ ID NO: 6762674 - DNA, 60 bp, Homo sapiens
cctggtgagctgggtgcacggcagatgccatagtcacagcagtgccccagctacaaaagg

SEQ ID NO: 6762675 - DNA, 130 bp, Homo sapiens
aatgcacaggaacgaaaaatttcatttgatattgcccttctgtttactgcagaatgtacgaaacattctgtggaatatgaactagcaaaataagggaaataagggactaaatttctttattcatgtgtgt

SEQ ID NO: 6762676 - DNA, 116 bp, Homo sapiens
tttctctcaatgggggatgagccatggtcatttttattgtgttgattggtttgaaactttaatgaaccttttcagctggatgtggaagtgctaggaggtatcccctctcagagaaa

SEQ ID NO: 6762677 - DNA, 58 bp, Homo sapiens
tgtttgggcagaagctgaatgtctgtgtctccaagcagccagccatcatgcccggtca

SEQ ID NO: 6762678 - DNA, 71 bp, Homo sapiens
tgaaaaaggccatggttggagtgtttacatcataaaaatgagcaagatgctacaaatcaggtcttccttta

SEQ ID NO: 6762679 - DNA, 104 bp, Homo sapiens
ggaccaggtgatgaggaatagtttatgtagctgaatgcctagacaagttaaaaaagaggcaatgtatgtgattattcctctaccaactgcattactacctggcc

SEQ ID NO: 6762680 - DNA, 60 bp, Homo sapiens
aattctttatggattttatcccattccagtttcactggcctggtgttatcctgaagaatt

SEQ ID NO: 6762681 - DNA, 56 bp, Homo sapiens
tcagaggttccggccataaccacagaggaattggaggttggtaaatgacgctctga

SEQ ID NO: 6762682 - DNA, 55 bp, Homo sapiens
ggagaacctctccatccagaacagaaatgagatgttgggtgagagtgtttgctct

SEQ ID NO: 6762683 - DNA, 57 bp, Homo sapiens
ggcgcgccgtggacagccctggcgccgcaggggcctggggctcaagatggcgccgct

SEQ ID NO: 6762684 - DNA, 82 bp, Homo sapiens
tcctgctctggatgagggtggaaagggtgtacctggtatttccctaggtccttgctttccaccttctaaacatccagcagga

SEQ ID NO: 6762685 - DNA, 58 bp, Homo sapiens
ggttctttggcagtctgattgataactgctttatcaaataggccggaccacaagaccc

SEQ ID NO: 6762686 - DNA, 55 bp, Homo sapiens
gtatactcaacctgcctagaattgtgacatcctataattttaggctgagttgtat

SEQ ID NO: 6762687 - DNA, 69 bp, Homo sapiens
gaagttgtctttgccttctcctgtacccttaacctttcttctagaggtagaagagcaaggaataacctc

SEQ ID NO: 6762688 - DNA, 63 bp, Homo sapiens
agacttcgcgagagagggattcactgtaaataggttgcttagagttctgttccttgggagttt

SEQ ID NO: 6762689 - DNA, 77 bp, Homo sapiens
cttacaggacactacaacgtgggactttgtttcttccatatttggaagataaatttatgtgtagacatttttgtaag

SEQ ID NO: 6762690 - DNA, 69 bp, Homo sapiens
tgaatgatgaggggagaataatagatgtctttcatgcctttctccaatctcttctttcctcattaatca

SEQ ID NO: 6762691 - DNA, 63 bp, Homo sapiens
aagacatatactatggatggttctcatagatgaaaaaaatgagagaagattcttatatgtctt

SEQ ID NO: 6762692 - DNA, 57 bp, Homo sapiens
tccgcttgggggcggttgtgcggtcctggctactgcagcgtccgcaccccggccggg

SEQ ID NO: 6762693 - DNA, 68 bp, Homo sapiens
ggatccaagtgttttataagggacagtgagcttgcctgctctttgcttcagagggagacactttatcc

SEQ ID NO: 6762694 - DNA, 71 bp, Homo sapiens
gacactcctgcaagcccttgatggtgagagctgcagagctgtttcttcagctgccatcaaggcaggacctc

SEQ ID NO: 6762695 - DNA, 79 bp, Homo sapiens
tctgttgatctatgtccacttggattgttttcacgttttgggtattgtgaatagtgctgctgtggacatggtgtacaga

SEQ ID NO: 6762696 - DNA, 79 bp, Homo sapiens
tagggggaggtataggaggtagacatggagcaattccaggatcctgggaagaggctgtgactccttctacctgtctttg

SEQ ID NO: 6762697 - DNA, 55 bp, Homo sapiens
gacatttctttgctactgcctgagccccagcagccagagaacagcaggaaatgtc

SEQ ID NO: 6762698 - DNA, 72 bp, Homo sapiens
gagtcacgggattttgcagagagatatggcaagaggattgtttatcttggactctttgcagtgccatggctc

SEQ ID NO: 6762699 - DNA, 110 bp, Homo sapiens
ggggcatgatggtgggatcaaatgcaataaatagggaatagaagaggaagtgcaggcatttgtatttatttcttgagtttttgtttgttttgttttctcttatttgcttc

SEQ ID NO: 6762700 - DNA, 68 bp, Homo sapiens
ttagttcatattgaaagcaggtgacaccagcattctgctaggcagttaactacttttagtagaagtga

SEQ ID NO: 6762701 - DNA, 70 bp, Homo sapiens
tgagtctaatatgctttggaacttaaatccttggtttgttgaccacagattatttctaaacaggagctca

SEQ ID NO: 6762702 - DNA, 75 bp, Homo sapiens
gggaggtctaagcaggcttggctgcacgcctcgctccagtagaggagtcagatgaagccaaacctaagatttccc

SEQ ID NO: 6762703 - DNA, 82 bp, Homo sapiens
gtaagccttccagaaaccctttatgtttttcttgtaattatatattgcattcattgacatatgagtgttaaataaggcttgc

SEQ ID NO: 6762704 - DNA, 102 bp, Homo sapiens
ggtcagggtccctgctgacatctggcttgtgccctgccacaaaggtgctgtgagtcctaagagcggggcacagtgatggagcacggatcctagagtctgacc

SEQ ID NO: 6762705 - DNA, 67 bp, Homo sapiens
tttgggctatgttatataatgttctgcttgttagtagaataaatgtatctacatggtaaaaaccaaa

SEQ ID NO: 6762706 - DNA, 83 bp, Homo sapiens
gttaggttttaatgtcctgctgattcacattataaaaaatactatagtgttattatcgcagacagttttagttgtcccctaac

SEQ ID NO: 6762707 - DNA, 55 bp, Homo sapiens
tcccagggacccagcctgataccctcatatctggcacatagcagggtctctgggg

SEQ ID NO: 6762708 - DNA, 78 bp, Homo sapiens
tggatactgttgtgaggacagtgaacagagaggtttgcactaccattaaattccttgttctcaaattctcagtgttta

SEQ ID NO: 6762709 - DNA, 58 bp, Homo sapiens
gtcccctgctggtgttgctgcttggttggctttacagcagtagtgcgtcgcagaggac

SEQ ID NO: 6762710 - DNA, 89 bp, Homo sapiens
ttgtaaaatgacagggtaggattatggtgatgtcttaggggctgtcttccagctctatcattctgtgattctaaatccctttataacaa

SEQ ID NO: 6762711 - DNA, 98 bp, Homo sapiens
gcatgccctggtacaaaggagggtctggctaggcacgccgtgttcctgccaggaccatgtgtgtgtcagcgcatgcgcttgtgggtgcacagacatgt

SEQ ID NO: 6762712 - DNA, 70 bp, Homo sapiens
agttattagtttaggatcttttttgtgccaggtattgtgctaggcactggaaatacctagatgaatagct

SEQ ID NO: 6762713 - DNA, 102 bp, Homo sapiens
gtggaatgaaatgcaacatttgcatgctttattagaaagatcaaaagtcttaaaagaaagatcgacagtcttaataaaaatgtcaagcttgcagtgggccac

SEQ ID NO: 6762714 - DNA, 82 bp, Homo sapiens
agttttagggtacatatgcacaacatgcaggtttgttacatatgtatacatgtgccatgttggtgtgctgcacccattaact

SEQ ID NO: 6762715 - DNA, 60 bp, Homo sapiens
gggactcagtttctgtgtcaaactctgttagaactgataggagacacaggagagagtccc

SEQ ID NO: 6762716 - DNA, 57 bp, Homo sapiens
ctgtgctgcaattcataatccgaggaggtatttttcttctcctgttttgcaccacag

SEQ ID NO: 6762717 - DNA, 67 bp, Homo sapiens
gctctttgtatgtcatgacaactgtgccaattatttttggcacagttcactttttatatcaaagagc

SEQ ID NO: 6762718 - DNA, 69 bp, Homo sapiens
ggaaattttagactcctgggtctaagttcttggcttcagaagcattgggccataggagctcagatatcc

SEQ ID NO: 6762719 - DNA, 109 bp, Homo sapiens
gtgacctctatcacatcatcgtccctattctcatcatcactggagctgaaccccacttcagcaacctcatgagagtgaaatagaggcacctggaatggaaggaggccac

SEQ ID NO: 6762720 - DNA, 55 bp, Homo sapiens
cctctggaggctctaagagagagtctattgcctttccatctccagcttctagagg

SEQ ID NO: 6762721 - DNA, 90 bp, Homo sapiens
gagttcaatctgcatgtggattagttggctttattttggaaacaagctgaccaaacttcagccagctttcacaaatgaagattttggctc

SEQ ID NO: 6762722 - DNA, 97 bp, Homo sapiens
cctttttcttcctcttactaactatacttatccttggttttctgttaagtcatttaaggaatttaaggaatttatagttgtacttggagggaagggg

SEQ ID NO: 6762723 - DNA, 80 bp, Homo sapiens
gtactgcctgtgcctcaattttctactctgctaaaagagtacaatgcgagtgtgaaaagtagaggcacagcacttagtac

SEQ ID NO: 6762724 - DNA, 57 bp, Homo sapiens
aagcctgaatttatccatatgcttaggatgcagtgattggaagaagaactcaggctt

SEQ ID NO: 6762725 - DNA, 111 bp, Homo sapiens
cagttacctgggggagcttatcaaaaaacagattctggtttctcacttgcaaaagatggggcggggcgcgagacacaggattctgcatttctgataagtcccaagctgctg

SEQ ID NO: 6762726 - DNA, 67 bp, Homo sapiens
tggagtcaaagtttgtggcaatttattgatcctgtatcatgaataagctgctaggaacttagttcca

SEQ ID NO: 6762727 - DNA, 78 bp, Homo sapiens
ggttactctaaagactaggatcttggtttctcagtcagtattattaggaattctttgatcttaatcttgcgtgtaacc

SEQ ID NO: 6762728 - DNA, 56 bp, Homo sapiens
aggattagagacttctctacctcagttttaactgagagttttatggctttaattct

SEQ ID NO: 6762729 - DNA, 67 bp, Homo sapiens
aatcttgagtgttactctcattggacaagtttagatcatgtggttgatggaaagtgatacaaagatt

SEQ ID NO: 6762730 - DNA, 79 bp, Homo sapiens
tctgctcaaaggtgtgggtgacatacagcctgcaagtgaccttgagaagtaggctgtttctctcccaccccttcccagg

SEQ ID NO: 6762731 - DNA, 78 bp, Homo sapiens
gcgtgattttggggactgctcagcaggccagggggatgtggctggttcttcgctgggcggctgcggggagagtggcgt

SEQ ID NO: 6762732 - DNA, 80 bp, Homo sapiens
gtagcttgctcctatttttttctgattggagtctctttattaaaagaattgtttaatttgaaatgagtaacccaagttac

SEQ ID NO: 6762733 - DNA, 60 bp, Homo sapiens
gccacacaaggctgggacaagtgctgtggttctacagtcatgttacaagctttgcagggc

SEQ ID NO: 6762734 - DNA, 57 bp, Homo sapiens
gagctgcacatctgaggctaatgttacccgctacttggactttccttgatgcagctc

SEQ ID NO: 6762735 - DNA, 97 bp, Homo sapiens
ctagaaagataattatgcaagctgcagtgttctggaatgcattatctctattctagttggaaaagtgttgttctaaacactttgtagttctttgtag

SEQ ID NO: 6762736 - DNA, 55 bp, Homo sapiens
ttctttaggtagatccagtttttcatctgatatcatttgccttctgcctgaagaa

SEQ ID NO: 6762737 - DNA, 89 bp, Homo sapiens
gatgtgcaataactctagtcccaggcatgaaaagtaacttcagtgaaaatatccattcaatgcttatatggactaatattgtgcctatc

SEQ ID NO: 6762738 - DNA, 71 bp, Homo sapiens
gagggatgtggagcccccagcccagggcctggtacccagcaggctctcagggaaaggcctccccttccctc

SEQ ID NO: 6762739 - DNA, 79 bp, Homo sapiens
ggaggtcatctagagaatgtggacgtgtgccagacctaaattaggagtgcaatagtgcctattctcttgagcactgtcc

SEQ ID NO: 6762740 - DNA, 73 bp, Homo sapiens
gaagggttgaggccagacatatcgctcccaaacttaaacagtttccacgtgagagtttggctcctaaatcttc

SEQ ID NO: 6762741 - DNA, 56 bp, Homo sapiens
ttgaggagtagaagctttgaatgggtttcccatccataagtctttttgttcctcaa

SEQ ID NO: 6762742 - DNA, 83 bp, Homo sapiens
tagattggattggtttaaggtctacttcatcttgcaagcatctttgttcccatggatagtgaccttgttcttgattcagcctg

SEQ ID NO: 6762743 - DNA, 75 bp, Homo sapiens
aactgctgtgaacaatagcagcatctttggtattctctcaagctctaggaaatgtgtttgttttaaacagcagtt

SEQ ID NO: 6762744 - DNA, 84 bp, Homo sapiens
tcttgatcctgtctgattgataccaatgtgctttgtggccccttccttttccacgccagaggtatcaaagatagtagacataga

SEQ ID NO: 6762745 - DNA, 118 bp, Homo sapiens
ggagtgtatatgtatttactgtgggaatttgtttttaataaaactgttgtaaggcatttttattcctttgctttgttacattaaaaacattcactgcataagtaatgtattttattcc

SEQ ID NO: 6762746 - DNA, 90 bp, Homo sapiens
ctcatgccattaacattctggcacacaagtatttcctttccgtatgtgttccttaggaaaggcaatagtagttccgagtgtaggcttgag

SEQ ID NO: 6762747 - DNA, 81 bp, Homo sapiens
ctggctgtcagaacatttaaaataattgaacaaggtcattcacctcttcagcctatttgagtgcagatctgacgcagtcag

SEQ ID NO: 6762748 - DNA, 55 bp, Homo sapiens
aggagggtaagggggaatataggtacttgtgcatctgtgacctttctttcctcct

SEQ ID NO: 6762749 - DNA, 97 bp, Homo sapiens
taagagtcttatttggaagtcgggaaagcaaaattgatttcacaaaatagggacaaactgacatggattaaggctcccatttccaattaatttctta

SEQ ID NO: 6762750 - DNA, 63 bp, Homo sapiens
tgtgtttttcatttgtttcagttgcataagtaggtgtcctattttgcaataaatgaaagacca

SEQ ID NO: 6762751 - DNA, 77 bp, Homo sapiens
tggctgttcctggggcttagcaatggagttggctactcgcttattacatttcagttggtgggtccccaggctagcca

SEQ ID NO: 6762752 - DNA, 56 bp, Homo sapiens
tgacagtttgctttcgactggagaaaaataagaaatctcccaggaagcaaatgtca

SEQ ID NO: 6762753 - DNA, 64 bp, Homo sapiens
ttgtgactctgggaccagtgaagcaactcagcagtgagttccaaaactgcatcccaggatataa

SEQ ID NO: 6762754 - DNA, 90 bp, Homo sapiens
ggtggcattagccacatgtggctattttaatgttaattgtatttaattataattaatttaaacttaaatagccacatgtggttagctatt

SEQ ID NO: 6762755 - DNA, 65 bp, Homo sapiens
aagagtttaccagtgctgcttcccactttgtgtaccttgggaagtctgaggcacttgagcatctt

SEQ ID NO: 6762756 - DNA, 103 bp, Homo sapiens
gtgtggtggtggtacctgtaatcccagctactcgggaggctgaggcacgagaatcgcttgaacccacccgggaggtggaggttgcagtaagccaagatcgcac

SEQ ID NO: 6762757 - DNA, 58 bp, Homo sapiens
ggcccagaatactttgtaaaatttagctctaactaatgttgacaaaatattttaggcc

SEQ ID NO: 6762758 - DNA, 82 bp, Homo sapiens
attccatctgtactgagctcctactgtgtgccaggcaccatgccaggctcaggacacagtggtttagagaaacagatggggt

SEQ ID NO: 6762759 - DNA, 64 bp, Homo sapiens
agtacatgcagaactaacagatgttttatacagatacaaaaatatttgttataagcaatgtgct

SEQ ID NO: 6762760 - DNA, 76 bp, Homo sapiens
cagtggaacacaggactatcagctgtcctctggcatatttcatgtaggcctttagttaatattctgtgtatctctg

SEQ ID NO: 6762761 - DNA, 63 bp, Homo sapiens
cccactggctaggcctgcctctgatgtccacgacaacattcacagctaagcttggtcactggg

SEQ ID NO: 6762762 - DNA, 55 bp, Homo sapiens
tgctgaactatttggaatgaagattgcagaaacttccccatggaatagttcagca

SEQ ID NO: 6762763 - DNA, 128 bp, Homo sapiens
atctctatgcctcagtttgggtatagccaaagaggatattttgagaaatcctatgaatactcataattatgtttggtgagatttttcaaaataccttaattctgactctttaggaggctcagagagat

SEQ ID NO: 6762764 - DNA, 65 bp, Homo sapiens
cctctattttgctgcaacagccaaaggccattcatctgcccctcactgtagagcacaagtggagg

SEQ ID NO: 6762765 - DNA, 78 bp, Homo sapiens
gaaggatgaggagcatttaggtaagtagagggcctagggccgcattactgtagcttgacatatgtcttttcttctctc

SEQ ID NO: 6762766 - DNA, 68 bp, Homo sapiens
gtgttgatgacattttagaaacaaaagccaggtgcccatgaatagcctgaattaaggtggatcagcac

SEQ ID NO: 6762767 - DNA, 55 bp, Homo sapiens
tggaactaagtttctggtaccataaatacaggaatggtgctgagatgtggtacta

SEQ ID NO: 6762768 - DNA, 86 bp, Homo sapiens
ttgtcattttaagtatgctctgactgatacagtttacagagctaatctgtacttgtgtgtcaaagtcaggtgtcactaaggtacaa

SEQ ID NO: 6762769 - DNA, 56 bp, Homo sapiens
gccttccttacacctgctcagcctctcacagcagagctgcgcagacctaagagggc

SEQ ID NO: 6762770 - DNA, 80 bp, Homo sapiens
cttaaatcctgagctacacctgctccttggcatctcaatggaatgatggaagagtagtgaaagtgtggctagtgttaaag

SEQ ID NO: 6762771 - DNA, 63 bp, Homo sapiens
tggcaggctcgggcgggggcgcggcgcggggactgaccgccctcctctgccccggggctgcta

SEQ ID NO: 6762772 - DNA, 60 bp, Homo sapiens
ctgagcttccatggacgccatctgccattcagtgtcggtggtggtggacatgaggcccgg

SEQ ID NO: 6762773 - DNA, 60 bp, Homo sapiens
ctattcaagcagagactagatagctgtcagtaaaggatgctagagagatttctgctttag

SEQ ID NO: 6762774 - DNA, 79 bp, Homo sapiens
gtttagctcaattgtacataaaccatttggcccccagtatcaactggatgctttgtttatgtgtagttttatgctgggc

SEQ ID NO: 6762775 - DNA, 76 bp, Homo sapiens
gtgtcccctttgaaattggctcattggtttgatgtggatcagggatgagatcagaaagccaatatcatagggccac

SEQ ID NO: 6762776 - DNA, 65 bp, Homo sapiens
actctgtcaccaggccagagtgcagtggcaccatcttggcccactgcaacctctgcctccagggt

SEQ ID NO: 6762777 - DNA, 75 bp, Homo sapiens
tcttagagcatcaggtaggccaatgttttccaaaaggcgcttttcaggacattagtctgctgagatgtgctgaga

SEQ ID NO: 6762778 - DNA, 87 bp, Homo sapiens
ggagtctcgctctgtcacccaggctggagtgcagtggtgcgatctcggccactgcaacctccacctcccgggttcaagcgattctcc

SEQ ID NO: 6762779 - DNA, 92 bp, Homo sapiens
ttggctacaggccattactgttgctaatatgcaactctgttgaatataaattggaattgcactttagcaatggtgatggattgttaagccaa

SEQ ID NO: 6762780 - DNA, 59 bp, Homo sapiens
ccagattttggtatgccagcttagatttcttttagaaaataagggctaccagtgtttgg

SEQ ID NO: 6762781 - DNA, 62 bp, Homo sapiens
cgtccttacagagggtcacagccaatccgtagtccgtgtcctgtgtctcctctgagagggcg

SEQ ID NO: 6762782 - DNA, 59 bp, Homo sapiens
tctgggagcctgaaagtgaatggaagaaaggcagcttctcctcaccttcattttccagg

SEQ ID NO: 6762783 - DNA, 80 bp, Homo sapiens
cgtttgttgtgtgagtgaagctttagctgaggaaaactactaatgttatgtccagccccttttactcattcatataaatg

SEQ ID NO: 6762784 - DNA, 59 bp, Homo sapiens
ggaagttctagaggttgatttggtctttccttcaagggctgtctaatatggtagcttcc

SEQ ID NO: 6762785 - DNA, 62 bp, Homo sapiens
tgtgttttgtgtcacattacactgattgtggatcagttagtgtccttatgtcacaagcaaca

SEQ ID NO: 6762786 - DNA, 130 bp, Homo sapiens
tagctttagttctctctcctggtagctgggccaacagggtgcgggagatgtgcaccagctcagcttctgaggtgttatttgtacacttggatggtccagtgcatcaacattgaaggagacaggattcctg

SEQ ID NO: 6762787 - DNA, 82 bp, Homo sapiens
gccagggctgtagtctctggagactctaggggaatctgtgcctacctcctccagcttccagtggctcctgacattccttggc

SEQ ID NO: 6762788 - DNA, 69 bp, Homo sapiens
gggcttaagatttggcgcggtttggggccttataatgtattctcctggccgagccaattttcatgatcc

SEQ ID NO: 6762789 - DNA, 73 bp, Homo sapiens
ctaacctgcttctgccctcacggtaacgtgcacaatcttcatcgcatgtcctgggtggtggtaggagcagtag

SEQ ID NO: 6762790 - DNA, 103 bp, Homo sapiens
cagaattgagtttagtgccggcccccactggggaccgggtggccgcgattgtctgtcgcagcgaactgtccctcggtctagcgggtgactgagctcgctgctg

SEQ ID NO: 6762791 - DNA, 95 bp, Homo sapiens
ggccaggtcaagaaaagagacacagaggcatgacagtggcttcttccatcaaaagagcttttgtactgcttttgcttttccccttgcttctggcc

SEQ ID NO: 6762792 - DNA, 58 bp, Homo sapiens
cgttgcagaagcctgttgttcctgctcttcagataggatttcacagtctatctgcccg

SEQ ID NO: 6762793 - DNA, 59 bp, Homo sapiens
gctctgctgtaatgagtcagcatctagaaagtcagagcactgctgatttacagtccagc

SEQ ID NO: 6762794 - DNA, 59 bp, Homo sapiens
ccagtgtgtttttctctgactcatgcacattattggctcaaggagaagaacagatgtgg

SEQ ID NO: 6762795 - DNA, 80 bp, Homo sapiens
cgtgatctctgccctcagggtgtatagtgtagaagtttgtaaagaagctttgtttcacatacaccttaacagagtacatg

SEQ ID NO: 6762796 - DNA, 118 bp, Homo sapiens
tgcaaatatccctcagaccaaagagatgcttccgtgcttgcactacgcatagtttatgtcatttaacattcatttgtaactctgttagggtggctgcatctcctgagtataaattgta

SEQ ID NO: 6762797 - DNA, 67 bp, Homo sapiens
ggcaggtggattttctactctaaaaatctagtcgttttatcagaaaggagtgcaggatttacgtgtt

SEQ ID NO: 6762798 - DNA, 72 bp, Homo sapiens
agacattatgctaagtgaaagaaaccagacacaaaaggctatgtttgtatgatcccatttagtgaaatgtct

SEQ ID NO: 6762799 - DNA, 60 bp, Homo sapiens
aaatctcttgtggtccacactgttggctggctaagccagcatctgttcccaacgagattt

SEQ ID NO: 6762800 - DNA, 60 bp, Homo sapiens
gctgggagtctaagctagcaccgtttgaactaattgtgtacaatttagcattccccaagc

SEQ ID NO: 6762801 - DNA, 87 bp, Homo sapiens
gatttcagctgggagattattgctaaggtactaggtggctctgggaggtcacttcgttcttttcagcaagtcttccagacataaatc

SEQ ID NO: 6762802 - DNA, 126 bp, Homo sapiens
tctaggtttagccgtaatcctatgagtaatggatagctaataaaaaatttttatgaggggaaaactcttatcaaacttgttttttggtgtcaaagtgaagcatagagaggaactggagaccctgga

SEQ ID NO: 6762803 - DNA, 86 bp, Homo sapiens
tcatacagagtacagaggtggtcacattagatttggcactctaggactgtctatctgaggaggtgacattttagttctctaagtga

SEQ ID NO: 6762804 - DNA, 124 bp, Homo sapiens
agttggacatatttcaaagtagtacaaacattaggaactagggagtatgctttctgtggaggcagagagcaacttcaatagtactatttttttgtcccactaagtaactgaaattatgttcact

SEQ ID NO: 6762805 - DNA, 65 bp, Homo sapiens
tgaactgaattgctgggggctcagtgtggaaaactgagagttaaaaactccagggaactcagtca

SEQ ID NO: 6762806 - DNA, 80 bp, Homo sapiens
ggccaactgagcaaggacagaaagtagaggttgttggtgaccttgaccagccctctgctgttctagtctcttgatctgcc

SEQ ID NO: 6762807 - DNA, 81 bp, Homo sapiens
taatcatgaggctctgtgtcctttttgtaaaatattcatcccaagggaggatgtcccttcaagaaaggcactaggtgatta

SEQ ID NO: 6762808 - DNA, 83 bp, Homo sapiens
ggtgggaaaccactgtaatgttttaaagcagaggaggaacatgatctgatttaggctttaaaatgattattctggcttctatc

SEQ ID NO: 6762809 - DNA, 73 bp, Homo sapiens
gtccctaaaagtagctccaaggcaggaattaaaaatggttctggaagcttttgagcaactgagctagcaggac

SEQ ID NO: 6762810 - DNA, 86 bp, Homo sapiens
gctctgctcttcacactacacccgtgacctctgtttccgtgtctgtccacggggaacggcgatgggtgggtgtgaggtggccgagc

SEQ ID NO: 6762811 - DNA, 57 bp, Homo sapiens
aaagtgctgggattacaggcctgagccactgcacccggcctgaatcatccagatttt

SEQ ID NO: 6762812 - DNA, 55 bp, Homo sapiens
ttagattgtgatacccagggactaaatggaaacattcagggtttcacaatactaa

SEQ ID NO: 6762813 - DNA, 128 bp, Homo sapiens
gcctagaagaatgcctggcacacagtaagtacaaagatagggacctgagtgaatgagtgcatcttttattcttctctagaacacataatcaccaagtcctttcacagctgaccaccacattcaggggc

SEQ ID NO: 6762814 - DNA, 107 bp, Homo sapiens
gctgctggaaaactgagtggaggccatcttccttgctccttgtcacttgtgggaaaatctccaaaagctgccatagaacgagaggtggaaccatttaggatggcagc

SEQ ID NO: 6762815 - DNA, 92 bp, Homo sapiens
ttgagggtggggtagggggaggcctttctgcaacagcagctgctctgtctttaggctctgggcaaagatgcctcatcccatcctttcagcaa

SEQ ID NO: 6762816 - DNA, 62 bp, Homo sapiens
gggctccatacttccaacaaactttagactgaatcatatctagcagcttgagtctggagctc

SEQ ID NO: 6762817 - DNA, 62 bp, Homo sapiens
cctgagcctggctcatgcactctggccttccaggtcaagcgtggggtatgaccagagccagg

SEQ ID NO: 6762818 - DNA, 75 bp, Homo sapiens
atgggtgtaagattattttgtgcaataatcggaaaccaccaaatattaacaaagtaatttctactttgcagacat

SEQ ID NO: 6762819 - DNA, 68 bp, Homo sapiens
tgcaggcctctggagggtagacagtgggccctcatcatccctgaacccaccccacagagtccattgca

SEQ ID NO: 6762820 - DNA, 81 bp, Homo sapiens
ggctccctccgcagttatcccaagacggacacctgcggcttctgcaggaacataggttccttgggaactgccgggcgggcc

SEQ ID NO: 6762821 - DNA, 91 bp, Homo sapiens
caggttgttgttgcatctggagaaggaagagtctttgaacatgatgtggcccgaaccctccctttcgacaggtcaattccataacagtctg

SEQ ID NO: 6762822 - DNA, 65 bp, Homo sapiens
aaggagactgggctgggtctggcttgaatcccagctttgacactcgcccagccctgggtggcctt

SEQ ID NO: 6762823 - DNA, 56 bp, Homo sapiens
ggataacggagagaaaaaggaaagcattcttgctttacatcctgtttcccgtttcc

SEQ ID NO: 6762824 - DNA, 66 bp, Homo sapiens
tgaaaatgccaacaaacacattgtgcaagttttgtgactgtacaatgtgtttgttggcttttttca

SEQ ID NO: 6762825 - DNA, 57 bp, Homo sapiens
gctctccagttctacaactgtcacaagaatgtggcagccagggctaagctggggagc

SEQ ID NO: 6762826 - DNA, 97 bp, Homo sapiens
tcctggcaagggaggacgagccaaggaccagttttgcagaattgtcatcatgaggccctggttgtgtgctgggctggggcattgcccctttccagga

SEQ ID NO: 6762827 - DNA, 59 bp, Homo sapiens
gccctctgacctcctgccacagttccccactgatggaactggaccagaaggcagagggc

SEQ ID NO: 6762828 - DNA, 61 bp, Homo sapiens
gcttgtttccattcaccattcagggaacagttggcagacttcccccagaatgtgggcaagc

SEQ ID NO: 6762829 - DNA, 60 bp, Homo sapiens
ggggaccttcccagagcagttgaaaataatatacagaatctcagaaatggaaaggtcccc

SEQ ID NO: 6762830 - DNA, 78 bp, Homo sapiens
gagaatctgcatttctttaaaaactttaaaaattcaagagttagttattttaagaagtttttgtagagacagggtctc

SEQ ID NO: 6762831 - DNA, 81 bp, Homo sapiens
catctctgagtccagccctctgcctccaggtggagtagctgtcacaccctgcagggcagaggctggtgctctccagggatg

SEQ ID NO: 6762832 - DNA, 58 bp, Homo sapiens
ggcctgggcccactgtcaagagcagaccctgagaacctctgttctgggtcccagggcc

SEQ ID NO: 6762833 - DNA, 56 bp, Homo sapiens
gctgactcatgcctggccagagctgagtgtgaccagcgcgcccaggctgggtgagc

SEQ ID NO: 6762834 - DNA, 78 bp, Homo sapiens
tcctttggtaacattccaaccttcctgcaggtttcagcgcttcctgtcatcttaaggtttgggtgttggctatgtggg

SEQ ID NO: 6762835 - DNA, 66 bp, Homo sapiens
agtctaacaggaggtacatagattcagatgcatgcttgcagagggaatttactgctctccaggact

SEQ ID NO: 6762836 - DNA, 68 bp, Homo sapiens
ccagcaagtccttccggcagatttcactcatcccggggaagtgattgatcttctggaagggaagccgg

SEQ ID NO: 6762837 - DNA, 56 bp, Homo sapiens
gttcagcttcctctctccctgcagtgcttctcctggaatgagctgggaagctgagc

SEQ ID NO: 6762838 - DNA, 84 bp, Homo sapiens
tcttgtctcacatccttcatactcagctctgcccagtgcagctcagtcacaaagaagctgtggtatgaaatgtgaagatctgga

SEQ ID NO: 6762839 - DNA, 63 bp, Homo sapiens
tacaaaggaggtagtcttataaatgttttagtcaaaagatgtctactgagtacctcctgtgtg

SEQ ID NO: 6762840 - DNA, 63 bp, Homo sapiens
ggttcagcagcagccacaattcagcagaggggtctatcctgggtgttctggcagctggtgacc

SEQ ID NO: 6762841 - DNA, 115 bp, Homo sapiens
ccatttgcataaaatttaaattccttataaaagctcacagtaatacaaggcctgtggagtcaggccttgtatttgtcaggctgtggtaagaaatagacccaaaaatgcagactgg

SEQ ID NO: 6762842 - DNA, 56 bp, Homo sapiens
tctgggtgtcactcctgcctgccctgcctgctgggtgacgtagagcacatcccaga

SEQ ID NO: 6762843 - DNA, 87 bp, Homo sapiens
aggatgggtgatgggctggggagaaagcatgcctgtgacctgcagcttcacaagttctcactttagccttgaccaccgagacatcct

SEQ ID NO: 6762844 - DNA, 66 bp, Homo sapiens
ggcttagcagtgtttgcacagctacagaagtagggcctgtgggctggcacgaagccctgctgggcc

SEQ ID NO: 6762845 - DNA, 94 bp, Homo sapiens
gggtctggccagctgcggccctgatgaggctcagtgagccctgcagagtgcagcctgttgggggtcctgggccttgggccagctccccagacct

SEQ ID NO: 6762846 - DNA, 58 bp, Homo sapiens
gaagcaggtgttgcctaaattgacaaggccagtgaagcctggcagacacaccttcttc

SEQ ID NO: 6762847 - DNA, 116 bp, Homo sapiens
cagtaaattacactaatgatacttattaatatgatgaattatgttaagagagtttctaatattgagaattttttcatttctgacatggtcatgatgtattattccttaatgtgctg

SEQ ID NO: 6762848 - DNA, 59 bp, Homo sapiens
cagcgttcgaatcattggcctgtaaccctgtgggctgcttcacaagaattcaggacctg

SEQ ID NO: 6762849 - DNA, 90 bp, Homo sapiens
gggaatcagccaggctggtgtgtcctgaagcctcccagaccccagtgggagcctaggattcctcagggtctgccagatcccggctaaccc

SEQ ID NO: 6762850 - DNA, 64 bp, Homo sapiens
gccctgtcatcaagttctgtcacatttgtctgggtggagagcccaggggcaggaagaacagggc

SEQ ID NO: 6762851 - DNA, 73 bp, Homo sapiens
ccactgaagggccctgcgggctcctggaactcttgcctttgggatgggggcctgcgaggttcaacttcggtgg

SEQ ID NO: 6762852 - DNA, 74 bp, Homo sapiens
tagggcactgtagttaggaaaacatcttggcctctgagttcaagacgattgccaggttcctgagtcatgcctta

SEQ ID NO: 6762853 - DNA, 59 bp, Homo sapiens
ctgcaggtgtctccagggcaggtctgctcccacagattccgtgaccatgacacctgcag

SEQ ID NO: 6762854 - DNA, 93 bp, Homo sapiens
gtgctgcatttctcatgagttgatatgtgtaaagtgttcagaacagaattgagcacattgtaggtctcagctcttggagtgatgaaatcgcat

SEQ ID NO: 6762855 - DNA, 129 bp, Homo sapiens
gaagatctattcagttagttttaaagcttatttgtttttggtcctatgagttgatgcttgtccaacacaagtcataggtagtattcatgattaaattgattgatgagttactgatagggatgggtattc

SEQ ID NO: 6762856 - DNA, 58 bp, Homo sapiens
ggaccctgctactgtctgaaacactcgtgtatgtcctcagtgctgccatggcagggcc

SEQ ID NO: 6762857 - DNA, 56 bp, Homo sapiens
cttgagtgggtgagcctcactctcagattttttaggtggctcatcccacaatcagg

SEQ ID NO: 6762858 - DNA, 82 bp, Homo sapiens
ttgataatttgatttgaatagtcagttttttagatctttaattgggatgtagccagattgataatttgattcaagagatcag

SEQ ID NO: 6762859 - DNA, 69 bp, Homo sapiens
gacattgaacagtacaaatgatccagacttttgctctaccaaacctcggggcaatgtcttttcaatgtc

SEQ ID NO: 6762860 - DNA, 101 bp, Homo sapiens
atgttggtcaggctggtctcaaactcctgacctcgtgatccgcccgctttggcctcccaaagtgctgggaacaggcatgagtgaccacgcccggctgatat

SEQ ID NO: 6762861 - DNA, 90 bp, Homo sapiens
agaataacatgctccaccacagtctactaaacatcatcagcgatcacgtccctgagaggtaagcagcgcagtggtgaagaggttaactct

SEQ ID NO: 6762862 - DNA, 70 bp, Homo sapiens
ggtggacagtggaaatcagagtgagagtatatggctgtagattctataattctttttccattgtaccacc

SEQ ID NO: 6762863 - DNA, 56 bp, Homo sapiens
tgtttcttatggtggagagatatttatttggacccaagtctctaccagaagtgacg

SEQ ID NO: 6762864 - DNA, 65 bp, Homo sapiens
gggctgggagggtgagctctggctgtgggtccagccaagcctgcagcaaggcagcctctcagcct

SEQ ID NO: 6762865 - DNA, 96 bp, Homo sapiens
gtctgctggataattacgttttctaagtaagattaacttcttaattacttgtgaaggagaagctgtaatattgaactgtgattgcttttggcaggc

SEQ ID NO: 6762866 - DNA, 130 bp, Homo sapiens
ggctctggtgaaaagagaactaagacttattaatggaaagtgtaaacttcaggtgatcaaggcatgactgggtttttgtaacttaagttttgcatattctagagtaaagtaaggattttcacgaagtcac

SEQ ID NO: 6762867 - DNA, 85 bp, Homo sapiens
cccagcgggggtcagggctctggtgccttcacagaacagccttgcttggggtgtggccctcaggttcctgaccttccctgctcgg

SEQ ID NO: 6762868 - DNA, 128 bp, Homo sapiens
gacaactttttttttcccccaggatagtgatccccaaaggacaaaatgaaaagctagccgctcccctcccaaaagctagctgcccatctttcctttaggagctaggaccctgggatcctgacgatgtc

SEQ ID NO: 6762869 - DNA, 128 bp, Homo sapiens
gaacaggtctcaacagagagaaaggcatgtcatatcgatttgtattacatctacatgttatgatagcataagtagaaatatactaagtctagtaagagtgtcttgatgactttttgaaccatctgttc

SEQ ID NO: 6762870 - DNA, 77 bp, Homo sapiens
gcaggattttattgttttaaaaatccatgactactggaaatagtaatgaatggaatgttaaacctcaatgatcctgt

SEQ ID NO: 6762871 - DNA, 62 bp, Homo sapiens
aggcaggcgtgggtagggagtgccgagccagaccagccagcaagcccagatcctgcgtgtct

SEQ ID NO: 6762872 - DNA, 69 bp, Homo sapiens
ggcaatatgtcatctgctaaaattcatctctgcttctgcaagatacattgcacgatgcagatttttgcc

SEQ ID NO: 6762873 - DNA, 56 bp, Homo sapiens
tcttgctctttgatgaattttccttaaatatggggtgtgggaaaagaagagtagga

SEQ ID NO: 6762874 - DNA, 85 bp, Homo sapiens
agataaaattcatgggcaggcctctcatttctgtaaataaagttttactggaacatggccatgcccattcctttatgttttgtct

SEQ ID NO: 6762875 - DNA, 102 bp, Homo sapiens
ttgagacagagtctcgctgtgtcaccaggctggagtgcagtggtgtgatctcagctcactgcaacctccgcctcccgggttcaagcgattctcctgcttcag

SEQ ID NO: 6762876 - DNA, 56 bp, Homo sapiens
ggatgtgcttggaacaccgtcatccaggataggaatatgaggtggctgggccatct

SEQ ID NO: 6762877 - DNA, 94 bp, Homo sapiens
tttttataaatgaagttttattggaacatagccatgcctggtcatttacatacgtctatggcttcgtttgcaatatagcaacagaatatattaa

SEQ ID NO: 6762878 - DNA, 110 bp, Homo sapiens
gatatgttatagtttgtcagtggcagaactacctttttatgaggcaactgtctaacctactaagcttcatgagggtttttttctgccttacttagagatttagacatttc

SEQ ID NO: 6762879 - DNA, 114 bp, Homo sapiens
cactcacccaggagtgcgtttttataaagcaggtccccagacactcaccagagcattctgtagatttagtgtgcctgggaatctgcgttttaataggcacctctgattgaagtg

SEQ ID NO: 6762880 - DNA, 64 bp, Homo sapiens
tctgatggcccagtcttgggacagtatttcctcagtggggccctcctgagactggccaggaaga

SEQ ID NO: 6762881 - DNA, 74 bp, Homo sapiens
gcatgaatacactttagaaaaacgctgcagttctcgatagctgcttgccttgtgtctagaatgtaacagtatgc

SEQ ID NO: 6762882 - DNA, 74 bp, Homo sapiens
tgaatggtttgtgtcttcaggcaatctcattattctccccaaagcagaagtgctgaatgaagacacaaacttca

SEQ ID NO: 6762883 - DNA, 120 bp, Homo sapiens
gacagtgttggcaatcactgtgctccataatgtagcggaggcttgtttgtttgtttgttttgggagacaatatcagctcaagccctgtctgcttatagtcacagtattttagcacatgtt

SEQ ID NO: 6762884 - DNA, 71 bp, Homo sapiens
atgtgcagatatattttacatttttagcacattacctaatatgcagtagtgctggaaatatatttgtttat

SEQ ID NO: 6762885 - DNA, 57 bp, Homo sapiens
tttcctcacacagaagatcttgaaactttctcttcatgtcttcatcctgtgagggaa

SEQ ID NO: 6762886 - DNA, 69 bp, Homo sapiens
ccatgatggcaccagcacctagatggggcctcaataggtagctgttgaaggtggtggtgcaaagtgtgg

SEQ ID NO: 6762887 - DNA, 90 bp, Homo sapiens
ctaaaccaactaggtaagaaatctaggttcattcttgattctggcaataactgtgagaacttaattcagtgacttaacctttgagtttag

SEQ ID NO: 6762888 - DNA, 56 bp, Homo sapiens
agccacagagagggagctgcaaattttgtgtataaattctgtcctaatctgtggct

SEQ ID NO: 6762889 - DNA, 98 bp, Homo sapiens
gattggtccttaatgcatttttaaaaagcaacgtatatgggtaaggatatcaatatcttagtatgctgtattctgtatgttagctcattttggctttc

SEQ ID NO: 6762890 - DNA, 80 bp, Homo sapiens
tctgtcttcataacactggtgattaagaaaatgtataccctaatttgtttactattcatctatcaggttagaagacatga

SEQ ID NO: 6762891 - DNA, 63 bp, Homo sapiens
ggccacagagggcgggatgctggatttctcagcatctctatgtctccttctgcaaaatgagcc

SEQ ID NO: 6762892 - DNA, 87 bp, Homo sapiens
acttttatgctggccatgttgcctctgagactattataagctttcatatagtaaggaaaatggcagaatggttattgaatagacagt

SEQ ID NO: 6762893 - DNA, 67 bp, Homo sapiens
ggtgatgagtttgtatttttggtgtctatatttgccaatagcctttcatgcaaactcacaaaatacc

SEQ ID NO: 6762894 - DNA, 76 bp, Homo sapiens
ttgagcacaccgcgtctaaacgaattggcttgaatatgtttccaaagtaccaagtttgtttgacgcttcagcttaa

SEQ ID NO: 6762895 - DNA, 65 bp, Homo sapiens
taaagaaaagtttagcatttgaagttattctatttgggaatgctttggagtgaagctaatcttta

SEQ ID NO: 6762896 - DNA, 100 bp, Homo sapiens
gaaggatagaaagactttggaaggagggtgtggtccagcagatttcggcttcctcccagcccatcagtgactccttcttcctgctcctccctttcctctc

SEQ ID NO: 6762897 - DNA, 81 bp, Homo sapiens
gttgaatggtagtaaagatcagtctgaagcaacatttaacaaaagttgctttctagggctagatttcttgtactataaaac

SEQ ID NO: 6762898 - DNA, 89 bp, Homo sapiens
gggacgggtgggtgtgcgggcaggcaggcaggtggatagcttcatcaccaaccactcacattgccaccctctctgctacccgcctgccc

SEQ ID NO: 6762899 - DNA, 71 bp, Homo sapiens
gtatgctttgaatcaattatccaggctgttggaacttgtggtcctgcaatctccatgcttgattttcatgc

SEQ ID NO: 6762900 - DNA, 130 bp, Homo sapiens
attataagaatccgataggaggtgtgtgttaaaaattcagattccctgtctactctggatctgatccagagatctagggtggagctgggaatccgtatttttaacaagcacccctagcgatttatataat

SEQ ID NO: 6762901 - DNA, 71 bp, Homo sapiens
tctgttaatggagcagagcatttcacagcctggttccctacccctaggtgttcctgctctgcttctgcagg

SEQ ID NO: 6762902 - DNA, 88 bp, Homo sapiens
ggcagattacttctctctggacctcaactattttatctgtgaagtgaaaggtttgaagtagtagagctccaagatctaaagttttgtc

SEQ ID NO: 6762903 - DNA, 62 bp, Homo sapiens
gctgttcacattttgggccaaataattctctgttgtagggggctgtcctgtgcattaacagc

SEQ ID NO: 6762904 - DNA, 56 bp, Homo sapiens
ggaaaagctttgtttggccatagggctctactctccctagcttagcatacttttcc

SEQ ID NO: 6762905 - DNA, 83 bp, Homo sapiens
gagaaaatcttgttgagccaattctttaagactccctcttgtctctttgagtcttacaagaaataagccaatgagaggttttc

SEQ ID NO: 6762906 - DNA, 64 bp, Homo sapiens
ggcagaagtgaaggcacaattgtgtagactttgtcatgcagccaattcattcattcttcttgcc

SEQ ID NO: 6762907 - DNA, 63 bp, Homo sapiens
tcaggcttaggagtcagcctgctgggtactagctgtgtggcctcggcaggttccttagtttga

SEQ ID NO: 6762908 - DNA, 88 bp, Homo sapiens
ggaatcttactctgtcacccaggctggagtgtagtggcacgatttcggctcactgcaacctcagcctcctgggttcaagtgattgtcc

SEQ ID NO: 6762909 - DNA, 88 bp, Homo sapiens
gctgcgttggcacaccctgctctgctgtgcggcccggcacaactcagccaggaaaggcggcaggctgagtccggggaagtgccccagc

SEQ ID NO: 6762910 - DNA, 57 bp, Homo sapiens
ccagctgtcagtgtgaaaataaagccaaatagcttaacatttctaaagactagctgg

SEQ ID NO: 6762911 - DNA, 82 bp, Homo sapiens
ggatctggaaagactccatatttacctgggcaaaagactttctgtgctgaggtttctgactatggagtctctaacagtctcc

SEQ ID NO: 6762912 - DNA, 76 bp, Homo sapiens
ggatggtggaggtggaggctgaacatctggcattgctcccaaccctggagtcctgatccttagctctccatcatct

SEQ ID NO: 6762913 - DNA, 62 bp, Homo sapiens
aggaaggactccatggtccgtcagcttccagcgtcgtggctgatgcatctggtatctttcct

SEQ ID NO: 6762914 - DNA, 62 bp, Homo sapiens
ggtagttcttatgcacacatcgcagcaggaacagtggtgttccacgtgtgtgtgcagccgcc

SEQ ID NO: 6762915 - DNA, 96 bp, Homo sapiens
cgtgacaaacccttggctgagcatgagatgagcaataagtgagtggtagctcctttccagcctcacctcagctgcagaaacaagaggctcttcacg

SEQ ID NO: 6762916 - DNA, 55 bp, Homo sapiens
tctgcagggttttaacaatggacaaggagttttttctgcagtctggccctataga

SEQ ID NO: 6762917 - DNA, 100 bp, Homo sapiens
tcaccttttcctggggaagatgaattcttgttatgttggtttcttatcgcatcctggattagggaggaaatgtgcagcgaattcagactagggatggtga

SEQ ID NO: 6762918 - DNA, 59 bp, Homo sapiens
gcggcggcggtagcaaaaatgaccccgggactttgccctggccgctaccgttgggctgc

SEQ ID NO: 6762919 - DNA, 59 bp, Homo sapiens
ttgttcatcaggtgacacatactaagtgccacttagcacatgtggtcatcctgggacga

SEQ ID NO: 6762920 - DNA, 77 bp, Homo sapiens
gagcttatttcagccctactacttggccatctgcagacctaagagagagcaagtgcaaatgggttgagagaaaggtc

SEQ ID NO: 6762921 - DNA, 78 bp, Homo sapiens
atgcatatgcacacaatagatatgcatacatatgatatacattggtagatatgtgtatatctgtatgtgcatgtgtat

SEQ ID NO: 6762922 - DNA, 65 bp, Homo sapiens
agaagagccactgttgacggcacggcagagcaagatggcagggttgagtgtgcagcggcttttct

SEQ ID NO: 6762923 - DNA, 59 bp, Homo sapiens
gtcttcttcctgtgttctggtgaaggcacaatgtattaatgaggaagcaggaggaaggc

SEQ ID NO: 6762924 - DNA, 122 bp, Homo sapiens
tatttttcaaagatgtttattttctgtatttctggcagtgttttgcttagaaaagctgctgacacgctctctcagtggtggcattccagacccctgcagaaaccccttacatgagaaaaata

SEQ ID NO: 6762925 - DNA, 60 bp, Homo sapiens
agtgacattttttaagcccttgtgtgtgtccgactcataaaagttcagaaggttgttact

SEQ ID NO: 6762926 - DNA, 57 bp, Homo sapiens
cccactgagcctatacaaacagcagctggcacagcaggttttgggaaactcagaggg

SEQ ID NO: 6762927 - DNA, 72 bp, Homo sapiens
gagtacagagatagtgaataaatttatgctcccatagaaatgtgtgtaaatttatttacataaatttgactt

SEQ ID NO: 6762928 - DNA, 98 bp, Homo sapiens
ggaagaccaaactacaactttccagacctccttgtagctgggatggccccgtgatgccagctgctgaaaggggttctgggaaagtgtttgctttctcc

SEQ ID NO: 6762929 - DNA, 102 bp, Homo sapiens
tttaatgagataatccaggtaaagagttttatcagggcttggcacagagtaagccctctaaaaatgataactatttttcttgctttggatagggaagttaaa

SEQ ID NO: 6762930 - DNA, 65 bp, Homo sapiens
tgttattggcagcatttcagagtgcttgtgagaaattcaaaattgaggaaattctgcaaatagca

SEQ ID NO: 6762931 - DNA, 91 bp, Homo sapiens
gcgctggcttttgcgtcatctcctcccgcgccgagctcgctccatcctggcgcagtggcgccggctcggcccgggaggagggagaaggcgc

SEQ ID NO: 6762932 - DNA, 64 bp, Homo sapiens
gtcacacaacctctctgggcctgcttcctgatgattagattagaatgcctagagagagtgcgat

SEQ ID NO: 6762933 - DNA, 97 bp, Homo sapiens
tttcagctaggaccaagatgggccttgacacatggagtgtaaaaaaaacctcaatgtccatacttccaagggtgttaggtcctagttctaaatgaga

SEQ ID NO: 6762934 - DNA, 60 bp, Homo sapiens
gttacctgtggggtctgagcgctgatggtttgtttatccaattctggaaacccaggtaat

SEQ ID NO: 6762935 - DNA, 65 bp, Homo sapiens
agaactaaattcagagacatgaagtgacattcccaatgtcactcagcaagtatttggaagattct

SEQ ID NO: 6762936 - DNA, 80 bp, Homo sapiens
ggagaggtggcctgcagctgggtctgtgtgggctgggacccaggctctgctgctacagctgtgtgaggcccaacctctct

SEQ ID NO: 6762937 - DNA, 77 bp, Homo sapiens
gtattttcttgacatatctgtaagagtaggagagcgtactttctctttctttgtatgtctattgaccaaggaaaaac

SEQ ID NO: 6762938 - DNA, 65 bp, Homo sapiens
atgaagcaggcaaggacaggcagcaaatacaaggtgttgagctgctgtgttggccactgcttcat

SEQ ID NO: 6762939 - DNA, 72 bp, Homo sapiens
tgttaaggcaatgttagcaacataataatagcaatataggggctcattctgtgcctggcattgtcctaaaca

SEQ ID NO: 6762940 - DNA, 55 bp, Homo sapiens
agtggctcatgcctgtaatcccagcactttggaaggctgaggcaggtggatcact

SEQ ID NO: 6762941 - DNA, 58 bp, Homo sapiens
gtgtccttagaagaagtgaaagagagtcaagttcactctcttggctgtgtgaggacac

SEQ ID NO: 6762942 - DNA, 66 bp, Homo sapiens
gctcgagaaacgccgtgtcccgggggccactctctgcagggaagagcccctgggtatggagtgagt

SEQ ID NO: 6762943 - DNA, 61 bp, Homo sapiens
tccatcaggctcgtgggctctccaatcactcagccagccaggagcaccctgggccagtgga

SEQ ID NO: 6762944 - DNA, 95 bp, Homo sapiens
tccaagactggctgacttcatttgaaatggttgaatctgctgtgtaataaagtggttcaaccatgattaggaactgaaatttagtagaagaggga

SEQ ID NO: 6762945 - DNA, 84 bp, Homo sapiens
agggggagctgcccaagttgcctggcttgtagatgggggcctcagtccaccagccaggcccaggctgccctacagctgccccct

SEQ ID NO: 6762946 - DNA, 58 bp, Homo sapiens
tatcttgtctctcggtctggactaaatgttatctttcagagacatgagacacaggatg

SEQ ID NO: 6762947 - DNA, 58 bp, Homo sapiens
gcaggatggcagtaagagggagaggctgggatatttcttcctcttgcttccgccttgc

SEQ ID NO: 6762948 - DNA, 59 bp, Homo sapiens
aagtgttaaagacttgaacactgggagaaacttttcactgttttatgtttttactactt

SEQ ID NO: 6762949 - DNA, 62 bp, Homo sapiens
ggtgccgctgcagagcatactgctcatgaagatgagtggcatggccttgctgtagtggtact

SEQ ID NO: 6762950 - DNA, 68 bp, Homo sapiens
cccttgttggagtaggtttcgtgccgcttttggcttcttgggggcacacagcggaatttgctctaggg

SEQ ID NO: 6762951 - DNA, 102 bp, Homo sapiens
gttaggaggccaagatgggaggattgtttgagcccaggagttgatcaaaacccaaatccaaatacctacttagcatattttctcttctgggaagtaactaac

SEQ ID NO: 6762952 - DNA, 67 bp, Homo sapiens
ctttccacttggaggccccctgtgccctgcagcctcagggtaggccgtgggtcaccaggctggagag

SEQ ID NO: 6762953 - DNA, 61 bp, Homo sapiens
agccattgaaggattttaagccagcatgggattgcgtttgaagtggatcccttcagtggct

SEQ ID NO: 6762954 - DNA, 100 bp, Homo sapiens
tcatctgtgactagtgatctaacagaagaccagagagctaacttgtgaccagtgttagtgaatctgtggcctaacttgtgaccagtggtctaacgtgtga

SEQ ID NO: 6762955 - DNA, 83 bp, Homo sapiens
ttggtgatcccagggagcaggctctgtccatcccctgcataaagccagagagggcaccgcctgcacctgtggcattttgccag

SEQ ID NO: 6762956 - DNA, 56 bp, Homo sapiens
ctgtgtttctgagaagtggggaaaactgctcttgctttgagtcctcagtaacacag

SEQ ID NO: 6762957 - DNA, 58 bp, Homo sapiens
gctgatcacatttccaaaacccattcgttgacataggggttttggaaatgtgaacagc

SEQ ID NO: 6762958 - DNA, 80 bp, Homo sapiens
cctttccccactgcccaggaaccagaggggcagataagtatgactcagctgccccgtggtgcttgtagactggcaagagg

SEQ ID NO: 6762959 - DNA, 56 bp, Homo sapiens
gcctgcaacatccttgctcctgagcccgctgcttccttgagcactggtgttgaggt

SEQ ID NO: 6762960 - DNA, 76 bp, Homo sapiens
cgtctggtgggtagaggccagggatgctgttaaacatcctacaacatataggatagccccctgcccccaaccaacg

SEQ ID NO: 6762961 - DNA, 57 bp, Homo sapiens
gctctacctcatcagatgacaaaagaatgttctgcagctttttggtggggtggcggc

SEQ ID NO: 6762962 - DNA, 57 bp, Homo sapiens
acccactgtcatctctgaccacagtaccacatgcaaggtgaccagaagacagtgggt

SEQ ID NO: 6762963 - DNA, 75 bp, Homo sapiens
gaccttgcttcctgcagcctgttcagtgggggctgctttatccctcagaccctccctctgctgggtgtagaggtc

SEQ ID NO: 6762964 - DNA, 75 bp, Homo sapiens
tggtcaatgcagctacaaatacttttgtatgcttcaggaggttctcatgctgtgtgttttagctccatcagatca

SEQ ID NO: 6762965 - DNA, 58 bp, Homo sapiens
tttatttatgcagtgttgcatgaattttcttgtttgtgcatctttctgcatatgtaaa

SEQ ID NO: 6762966 - DNA, 63 bp, Homo sapiens
gccactgataattttggagtaggggtgaatgctagaattccttttaactagagtatcagctgc

SEQ ID NO: 6762967 - DNA, 67 bp, Homo sapiens
gttgccttggcctgctttgagaatctacctctttataatgagaggcaaggacagcgtcaggtgcaac

SEQ ID NO: 6762968 - DNA, 66 bp, Homo sapiens
atgattattggtatataaaatgtgtactatgcatcgcccagaatatattttaatgccaaggatcat

SEQ ID NO: 6762969 - DNA, 57 bp, Homo sapiens
gaagctgtggggaggaggctagcagatgctctttgcatccttcttgtcatcagtctc

SEQ ID NO: 6762970 - DNA, 77 bp, Homo sapiens
tgactgtggccgggtgctcgaggtcagcatcacaacagggaaacatcatgttggcagcggggaccctggctgtggca

SEQ ID NO: 6762971 - DNA, 61 bp, Homo sapiens
aatacagtcttactagaaaatccaagagaattctatcttctgcaattgatgagactgtatt

SEQ ID NO: 6762972 - DNA, 63 bp, Homo sapiens
actgccccgcatcaggcttccttcagctgtccccagtcaagtagtacccaatgcgtgggtagt

SEQ ID NO: 6762973 - DNA, 69 bp, Homo sapiens
gctgtctgcaagccaggaaatgaggcctcaccgaccttaccggcatcttaatcttggacttgcagtcgc

SEQ ID NO: 6762974 - DNA, 82 bp, Homo sapiens
actttggaattgatgcctggggcctgtcaccagaaattaattggtgccagtgggtctcaggatatttaaaagttccccaagt

SEQ ID NO: 6762975 - DNA, 69 bp, Homo sapiens
ggaaaactggcaggaagttagatggtaactacagattacttaccagcttctttcttgtcccagtcatcc

SEQ ID NO: 6762976 - DNA, 102 bp, Homo sapiens
ataaatggaacaggtggatttcatcacatacattgtgcatctcatggttctaaggtgctaaaatgattgcctgtgtgtgagaaatgccttgctaagatttat

SEQ ID NO: 6762977 - DNA, 111 bp, Homo sapiens
cactgcctggatgtttggtagacttgaatagcatgtttagtgcatatgagtttatctttcagattttcatgtatatgcatgcattcaaaggctataaaaattcctccagtg

SEQ ID NO: 6762978 - DNA, 81 bp, Homo sapiens
ccttatgcttgtgttcccagtaaatcctagagccctcatcgctcagcctgtgcgaggagtaggattagcacaggcagccgg

SEQ ID NO: 6762979 - DNA, 65 bp, Homo sapiens
caggttgaggtttatggagggctgcccttgagggtcctcagtgtccttcattggaatctctcctg

SEQ ID NO: 6762980 - DNA, 129 bp, Homo sapiens
gctctgtgacacagttcaagccgatgaggtatgagcagaagagttctctgactgtctggaaagtctgatttcctgatacagacaccactcttttccccatgcctgaattctagatgtgttgatagatac

SEQ ID NO: 6762981 - DNA, 70 bp, Homo sapiens
tccctaactgtcatcttttctatcatataattgtatacttttattgacagaaaagatgttggattaggga

SEQ ID NO: 6762982 - DNA, 121 bp, Homo sapiens
cagtttggtttcactttcctcagttctaaaatgaaaataacaagttctacctcacaaggtttttctgggaatctatgagggaagggatgtgatgttatattttgtaaactgaaaagccctg

SEQ ID NO: 6762983 - DNA, 58 bp, Homo sapiens
ggtttccatatttttagtgccaatgcgaacattaatgttttggtctactatggaatcc

SEQ ID NO: 6762984 - DNA, 67 bp, Homo sapiens
aaccaaaggaacctgattttctttagtgggagagagaaatcttgtttgagagaaggatcctatggtt

SEQ ID NO: 6762985 - DNA, 75 bp, Homo sapiens
gttctgagaatgagtggcagagtgaccaacttagacagtcagttcagttcagtccagccatcatttattcaagac

SEQ ID NO: 6762986 - DNA, 61 bp, Homo sapiens
ttgggacctccaggacctctcttagtgtcatactgagcagaagagatctgtgaggctccaa

SEQ ID NO: 6762987 - DNA, 57 bp, Homo sapiens
gcaatagtggcaatggtagtaaggtcaccatcccttttctattggcgtcactgttgt

SEQ ID NO: 6762988 - DNA, 90 bp, Homo sapiens
ccatgtccaaccttgatgctgcgggtgacctgcaggagaaactggcactatctcctgcagtgtgtctcctgcacacacacttggcccagg

SEQ ID NO: 6762989 - DNA, 97 bp, Homo sapiens
tttgagaataattcctttcaaaacacgaatttccatgccttagcttaaggttacatctaggttatgtactgaagtgaaaaggagtctatcattcaga

SEQ ID NO: 6762990 - DNA, 56 bp, Homo sapiens
tagacctagcagcgtctcccaccagcctctactgtgttggcttgcctgttaggcta

SEQ ID NO: 6762991 - DNA, 83 bp, Homo sapiens
ccttctctcatagttactttgacttagtctatagtcatgggtgcttcatgaaaaatttactgttaacaaattgtgaataaagg

SEQ ID NO: 6762992 - DNA, 72 bp, Homo sapiens
taaggcattagagtgaaagcaagcaattttttaatgaaacatttatttgccttcttttactgcagtgctttg

SEQ ID NO: 6762993 - DNA, 71 bp, Homo sapiens
tgaagaaatggacagaaatgccatatttgtaaataagaagatatatctggtaaatatgtccattctcttca

SEQ ID NO: 6762994 - DNA, 66 bp, Homo sapiens
tgtaatcccagctactcgggaggctgagacaagagaatcgcttgaacccgggaggcggaggttgca

SEQ ID NO: 6762995 - DNA, 80 bp, Homo sapiens
gcatgatttgtgtcttaacccagagctggaggagagtatccttctcgggtagctgttcccagctctgtgtaggagtctgc

SEQ ID NO: 6762996 - DNA, 74 bp, Homo sapiens
gtgggcatagctgtgcccgccacccaacgttctgaaccatgggcttgacataaactgggcatagctgtgcctgt

SEQ ID NO: 6762997 - DNA, 128 bp, Homo sapiens
ccccagggagtgtggcctccctccaccccatgactctcgctaccagggcccggtggtcactatgccacaaactcccaagcagggtgcagaggcatggagggggcaaccctaatcatcctcacatgggg

SEQ ID NO: 6762998 - DNA, 70 bp, Homo sapiens
gtttagtaagtgttctagggattgtaaccatctgatgaagagccagttacaactgtggagaaatattaac

SEQ ID NO: 6762999 - DNA, 62 bp, Homo sapiens
aggctgcctaggttcaacacctggttccattacttaccaggtgtgtgagcttgggcagacct

SEQ ID NO: 6763000 - DNA, 104 bp, Homo sapiens
tagagtgaaagtagggaaatgtaatagctagtaatgaagacctagatggggacatacagaattcactacagtttccagatttcatattcctgttgcaaactctg

SEQ ID NO: 6763001 - DNA, 65 bp, Homo sapiens
ggttagtagtttgctctattagtttggttaattctatgtttgtcttacatgagcaaacattaatc

SEQ ID NO: 6763002 - DNA, 65 bp, Homo sapiens
gactgtttcaggagcatcctgattggcctcagtctcacgaggttgaccagagacctgaatcagtt

SEQ ID NO: 6763003 - DNA, 56 bp, Homo sapiens
atgtgtttataattactcaatcactattttgtggttgcagtgattttgaaatatgt

SEQ ID NO: 6763004 - DNA, 90 bp, Homo sapiens
ccagatgagataatgacgcagaagggcctggcgtgccgagggcagaaggcctggtcactgccctcccttttgcacttacttgttgtgtgg

SEQ ID NO: 6763005 - DNA, 66 bp, Homo sapiens
tccattttcatagctctcagtttgggattcacgagcctattgtgttactgagctgcatggagagga

SEQ ID NO: 6763006 - DNA, 62 bp, Homo sapiens
gtcctgcctgagtgatgtggcagccacaagtagaaaatgtggtctgttcaatctaggcagac

SEQ ID NO: 6763007 - DNA, 62 bp, Homo sapiens
agggagagcctggcctccaaaggacttcgttattatctgttttataggctggggtttgcttt

SEQ ID NO: 6763008 - DNA, 75 bp, Homo sapiens
aaggggggtggccaaggcagagaaagagcccgacaggccaggagccggcttttctccctgctttcttcctccctt

SEQ ID NO: 6763009 - DNA, 76 bp, Homo sapiens
cattccactggacacttgtggcctttctagtaagtttatggaagatttactggaagaccacattgtttatggtttg

SEQ ID NO: 6763010 - DNA, 95 bp, Homo sapiens
ccagcaccattaggaagggatggatatttgcttgctttggattcagtatttggctgttcttcaaaatattccatccatttccaaatgagtactgg

SEQ ID NO: 6763011 - DNA, 58 bp, Homo sapiens
ctctagaactgattgggaagaaaggatgtgcaagtctacttcccggaagatcttggag

SEQ ID NO: 6763012 - DNA, 69 bp, Homo sapiens
tgtgcatctttgtgatgaggcctaagacattgtctagcggtatttcttaacttctcatgcacatgcaca

SEQ ID NO: 6763013 - DNA, 56 bp, Homo sapiens
tagagaaaaccactggtgagctacatgtagcttctcaaagctactggttacctcta

SEQ ID NO: 6763014 - DNA, 111 bp, Homo sapiens
ttagaaatagccataataaagaactttgaaaacacacctagaaaacatccagggggcctgactgactttctaagatgtggtttcaaggttctttattgtggttatttctaa

SEQ ID NO: 6763015 - DNA, 94 bp, Homo sapiens
tgaggtgagacagagtttcactccacatgcccatgatccacaacccggggtcatgctgtgaatcagtgctctgctctgctctcactcagcctca

SEQ ID NO: 6763016 - DNA, 85 bp, Homo sapiens
aagttgcaatgcatgggtgtcatgctctcgtctcatattgcctgaagagtgtgttcagtatgacattcacaggcctctgcaattt

SEQ ID NO: 6763017 - DNA, 65 bp, Homo sapiens
ctttcttgctttcctggctctcactctacagacttccatcatgagaggccagcactgcagggaag

SEQ ID NO: 6763018 - DNA, 62 bp, Homo sapiens
ttccttctttctcaagggaggtcagtctttgttctattcagatcttcaactgattggaggag

SEQ ID NO: 6763019 - DNA, 59 bp, Homo sapiens
ggtgttgaatggtgtctgttggattgaattgagttcctaatcagaagtccttcaaggcc

SEQ ID NO: 6763020 - DNA, 60 bp, Homo sapiens
gccctggagccagggctggctctgatgggctccagggctggctctgatgggctccagggc

SEQ ID NO: 6763021 - DNA, 61 bp, Homo sapiens
gtcctggatctggttccctgagcctttattaagaatgaatgttttcttgccaatccatgac

SEQ ID NO: 6763022 - DNA, 63 bp, Homo sapiens
gctcctacttcctctgtggcttcacccttgggtgccacccctgtagagggacagactgggagc

SEQ ID NO: 6763023 - DNA, 57 bp, Homo sapiens
gtgagattttctccaggttcagaagcaaagaatggacactacagggagaagactcac

SEQ ID NO: 6763024 - DNA, 64 bp, Homo sapiens
ggggagcagaagcagcaacaactgcaaccaccaattttcagcagctgtgttgtgccttctcccc

SEQ ID NO: 6763025 - DNA, 79 bp, Homo sapiens
gagagatactgtgggaagcaggattcagatgtttaaaatcaaaattttcaacactgacctctaccctcagttaagactc

SEQ ID NO: 6763026 - DNA, 94 bp, Homo sapiens
gctggggtctctggggagcagcaagcagtgcacgggttctcagtgcccaggacagcccctgcagatgccttgtgccccttagggagacgctggc

SEQ ID NO: 6763027 - DNA, 78 bp, Homo sapiens
tgacacattaaattagcaatcacgcagtcatttagctatctgaaggcaaacatgcttgcattgctaaacatttggtca

SEQ ID NO: 6763028 - DNA, 60 bp, Homo sapiens
ggttgtgcatgactgtgaatagctgtgaatatgcatggttgcacatggctgtgcatggct

SEQ ID NO: 6763029 - DNA, 63 bp, Homo sapiens
tggctgcacattcatgacccactggtgttggtaggcatttctggattttggatgctgcataca

SEQ ID NO: 6763030 - DNA, 61 bp, Homo sapiens
gggctgaaggctgacgtttgtgtttattttccagaaagttgcacatttctagcctcaacct

SEQ ID NO: 6763031 - DNA, 84 bp, Homo sapiens
ttagaggtgctaattcttgggctccaccccagacttactgaatcagaaattctgaggacagagtctagcaatctgtatttctag

SEQ ID NO: 6763032 - DNA, 62 bp, Homo sapiens
ctgctttcaggtgtagtgctggtattaataatagctaccatttatcaagcacctgtgagtag

SEQ ID NO: 6763033 - DNA, 82 bp, Homo sapiens
gaaaatgagttgggtttgagtgttaacttattgactgggtaaatttagataagtcagttaacctcacagcatctctcttttc

SEQ ID NO: 6763034 - DNA, 66 bp, Homo sapiens
tactgataaacagtgctttgaccaggggcctccaggcctgagactgaaggcacagtttaaccagta

SEQ ID NO: 6763035 - DNA, 90 bp, Homo sapiens
cacttcattcattcagtcagtcaatcaaggtagtctagagcctttattttgttccagacacagtgttgaaggctagtgaaataaacagtg

SEQ ID NO: 6763036 - DNA, 105 bp, Homo sapiens
gaggggcagctaggatcatggccgcagctcccagaggggagcccccatcctccaggccgtcttaccgagcctgctccccagcctgcgcctttcctgacttccctc

SEQ ID NO: 6763037 - DNA, 67 bp, Homo sapiens
cccaaacagtggcaagaacagtaataatgattattttagttcatctttacactgcacttgctatggg

SEQ ID NO: 6763038 - DNA, 59 bp, Homo sapiens
agtgcttaaggcagtctgtcaaacagagaatgtgtcggatcctcaatgcttttagcact

SEQ ID NO: 6763039 - DNA, 57 bp, Homo sapiens
gtagtgtgtaaaatgtgctcttctctttaaggagatgatgtacatcaagcactttgc

SEQ ID NO: 6763040 - DNA, 78 bp, Homo sapiens
actactatatgtcaagaaatgtgcttggatatatttcagtgtggtgtatttcagtgtatgtcttgaaggacgggtagt

SEQ ID NO: 6763041 - DNA, 78 bp, Homo sapiens
taggaaggataagggagaagatgcaatgagaggatatattttttcttctctgtagcagcttccttcctgacctctcta

SEQ ID NO: 6763042 - DNA, 88 bp, Homo sapiens
atgcagggaggatggagcacacgccatcacatactgttgtggttacagtagtgggtaacaagcctgtgccatagatcttctcctgtat

SEQ ID NO: 6763043 - DNA, 66 bp, Homo sapiens
atgcacgccccacactggtgtgcctcacctgcctttatacagccaggcttcagtgtgtgtgtgtgt

SEQ ID NO: 6763044 - DNA, 81 bp, Homo sapiens
ctgcagttcccacagccacgccccctgcccattttgattcagaaaatggtgggcagtggggaatgctggggagatgagcag

SEQ ID NO: 6763045 - DNA, 97 bp, Homo sapiens
gcactttttgttcatagttctgttttgaaggattggtcaacgagccatatcataaacactgttaaaatgggactcttgtgcatgaataaatctgtgt

SEQ ID NO: 6763046 - DNA, 84 bp, Homo sapiens
ccttcctctcatttccctttttcaggtgttggttcccctctctcaaatcagtgcaaaggagagggtagtgagagatcacgaagg

SEQ ID NO: 6763047 - DNA, 57 bp, Homo sapiens
cttttctactaatgagtagctagaggcaatgactttgcagctcatattagagagaag

SEQ ID NO: 6763048 - DNA, 84 bp, Homo sapiens
agagaagttttatttgacctctgatggtaattatcatgaccacagaactagataagccaaagaggcctcaatcatgccctctct

SEQ ID NO: 6763049 - DNA, 71 bp, Homo sapiens
caggcaggagtcagcctgcggctgcacgaggcttcggagaccaagctgcctgctgcactcggtgctgcctg

SEQ ID NO: 6763050 - DNA, 71 bp, Homo sapiens
gttgagagctctgggtgtgttgtcagttggaaagaaatctgactgtttcggctcagaagcaaatgctcaac

SEQ ID NO: 6763051 - DNA, 129 bp, Homo sapiens
aactgcccaatgtcctcccttccagttcatgagcggcccagttctgtaccaggagaagctgctgaagccggcagctttgctgctggagaagggtgccgaccaggaggaagacgaggccctgcgggtgct

SEQ ID NO: 6763052 - DNA, 58 bp, Homo sapiens
accttccaggaatctgccagatgtcaggtaactcactgccctggggaaactggtgggt

SEQ ID NO: 6763053 - DNA, 89 bp, Homo sapiens
tttatttcattagagaagaattgtaagtaccagcatgctatttatactctcaaaaagctttgcctgctgacattctgtgctggaataaa

SEQ ID NO: 6763054 - DNA, 55 bp, Homo sapiens
ctcaggcaaggcccgcattctccactccgtgcccatgtggacgccctgcctggag

SEQ ID NO: 6763055 - DNA, 64 bp, Homo sapiens
cagctccagctctgggcgcctctgcaggaagcgggaggctggcggcccatgaggactgcagctg

SEQ ID NO: 6763056 - DNA, 76 bp, Homo sapiens
cttttcctctgtcatgacatctgtttatctcaaaattctgggctggtattgagctaaaaggttcatgttggaaaag

SEQ ID NO: 6763057 - DNA, 74 bp, Homo sapiens
caaataatcactgctcgataacatgattatgagacaaataatcataaggcagaaatatgagcagggattatatg

SEQ ID NO: 6763058 - DNA, 69 bp, Homo sapiens
ctgctatcacaaacacatcattcatgtcgtcagtcagcatgttgcaggcataaccgatgttgatggcag

SEQ ID NO: 6763059 - DNA, 63 bp, Homo sapiens
gctgagggtagtttaattaggaagaaattaggtttcttctaagatttcaaactacagctcagt

SEQ ID NO: 6763060 - DNA, 110 bp, Homo sapiens
cacaaagaaatatagctcctgtcaagaaaatgcctgctggtgtcttcaaggttttggttgcagaagaattgggcaaatttcaaggacgctggaaactttgtgactttgtg

SEQ ID NO: 6763061 - DNA, 63 bp, Homo sapiens
gggtcttggggagttggtcaatccatgtcttatcttagacatgagattagctcacccactccc

SEQ ID NO: 6763062 - DNA, 69 bp, Homo sapiens
gaggcaaaacagtcgatgcctcccagtttcaagctggtttggtcatcatgggagagcgttgctgtcctc

SEQ ID NO: 6763063 - DNA, 69 bp, Homo sapiens
ttctgcccttgggatttaggtaaggctggcaatgggggagacatttgacctgggtctctagggaatgga

SEQ ID NO: 6763064 - DNA, 60 bp, Homo sapiens
tttcagcaggacaggccaccaagtatgctataggtatacatgggtctcctgtcttagaaa

SEQ ID NO: 6763065 - DNA, 91 bp, Homo sapiens
aacatgctattggagtgattaaagctaggataaaatggatttgaatcaatttttataatagtttggttttcagattacccagtttcatgtt

SEQ ID NO: 6763066 - DNA, 69 bp, Homo sapiens
aggtcactggtccttctctgcctgcagtgtggtggtgcctacgtagagcagaagcaggaagggaagcct

SEQ ID NO: 6763067 - DNA, 64 bp, Homo sapiens
cattttttatagcaatgaacccacattgatctaatagggagtgagtgcaatgctattaaaggtg

SEQ ID NO: 6763068 - DNA, 60 bp, Homo sapiens
ggggcctacaggcgggtgggcaggaggcggcccaggcccgccccagtctgtaggtgcccc

SEQ ID NO: 6763069 - DNA, 75 bp, Homo sapiens
aggccgttagtcacttggattgtttttgcttggtctcctgaaggcaccttgcggtccagtgaatattgattgctt

SEQ ID NO: 6763070 - DNA, 55 bp, Homo sapiens
cagcataggggagaacttggggcactaaccagggtgttcaggattgaccctactg

SEQ ID NO: 6763071 - DNA, 74 bp, Homo sapiens
gggaagttcagtttctgcctctgtatgcaggggatatcaaaacctccctgctaataaggtagaaatatgatccc

SEQ ID NO: 6763072 - DNA, 75 bp, Homo sapiens
gctacagcccagagggaagggaatgaggtaagggcgttttattttgctcctgtttttttggagacatttgtaagc

SEQ ID NO: 6763073 - DNA, 68 bp, Homo sapiens
cccacgggacgccagcatccttcggtggggctctgcgtgcacccagggagcggggctgggtctctggg

SEQ ID NO: 6763074 - DNA, 90 bp, Homo sapiens
gagttgagcctgtggagtctagagtctgtcaggttgggattccttaatttcttccaaaccatgaatgggttctggtgtaaggcttaagtc

SEQ ID NO: 6763075 - DNA, 86 bp, Homo sapiens
gagacaggttcctgagtccccagactccctcccagacaggcagccaggtggaagggaaagtttggggtccagcgcctgcacttctc

SEQ ID NO: 6763076 - DNA, 56 bp, Homo sapiens
ccggagagaccccatctgctgggacagaaggtccgaagtcattgggtgtccttcgg

SEQ ID NO: 6763077 - DNA, 59 bp, Homo sapiens
caggctaaccaatgttaaacactgaacgcccgctgcagtgtaactggttaaaaagcttg

SEQ ID NO: 6763078 - DNA, 59 bp, Homo sapiens
ggtcttgtgatttggggcaagggcagaatccactgccctgatgatcctcctcgcacacc

SEQ ID NO: 6763079 - DNA, 76 bp, Homo sapiens
atgaagaccggtggttctctaactttgactggaggctagtggctaacagtggattagaggccaaagtctccctcat

SEQ ID NO: 6763080 - DNA, 78 bp, Homo sapiens
gctgtcttgccatttgtttagcaaagtctgagttgatcaattttaaatagcacttcctgaacacattaagactacagc

SEQ ID NO: 6763081 - DNA, 74 bp, Homo sapiens
ggagaaagaaatacatggtttttgagtgcataatatgtgccagatgctcagctatcagtgttcctgaagtttcc

SEQ ID NO: 6763082 - DNA, 58 bp, Homo sapiens
catgtgcaacttcagcagaaaggaaagatcagctattctaatgctgtatttgtacctg

SEQ ID NO: 6763083 - DNA, 79 bp, Homo sapiens
gatgcagactgcttttagaaatctatagattaaactgctaaaaataataggtttatagagttctgttagtataaggctc

SEQ ID NO: 6763084 - DNA, 56 bp, Homo sapiens
ctggatccaacagagttgggttcaaatctcagctgaatgtaacactattgggccag

SEQ ID NO: 6763085 - DNA, 69 bp, Homo sapiens
gcttcctgagaaacaatctgatgtggaactcaggccaccaaatcacacgattgttttttaggttgttgc

SEQ ID NO: 6763086 - DNA, 79 bp, Homo sapiens
aaatgcacttaaataacataacttatgtaggctaaatattgcaaaaatggatatggagttatgctgttaatatgcattt

SEQ ID NO: 6763087 - DNA, 76 bp, Homo sapiens
ccaacaaagatatgacatggaaaatggcattaagaaggtattttgtccataatctgctcacatattctttgtatgg

SEQ ID NO: 6763088 - DNA, 77 bp, Homo sapiens
gtctgttactgttttttagactcatggtttgattattaaacccctgataggagtcatagtcaaggcaggaaacagat

SEQ ID NO: 6763089 - DNA, 58 bp, Homo sapiens
ccagaggcctaattgctaccctttggagctccagagttagtttttcaaggttgtttgg

SEQ ID NO: 6763090 - DNA, 100 bp, Homo sapiens
tctgttgtccgaggcctgggcccgcagctgctgctccagcttcgtgcggctctcatggatctcggcaatgcgggacttgagccgctcggagttcagcagg

SEQ ID NO: 6763091 - DNA, 69 bp, Homo sapiens
cacacacctttcaggtccagacagtcgaggcggtgcccgaggtctgtgaattcctgagaaagtagagtg

SEQ ID NO: 6763092 - DNA, 68 bp, Homo sapiens
actgaactttttctaaattgctgaaaaagttgttaaattgcagctggttcagaaattagatggtcagt

SEQ ID NO: 6763093 - DNA, 64 bp, Homo sapiens
ctgcttaggcagcaggaatttaaatttatacaaacactgtgtaaatccattcccgctgtaacag

SEQ ID NO: 6763094 - DNA, 82 bp, Homo sapiens
atgtatgtaaagcaatagggtaatctactcattaaacaaattaataaagtgacgttgattcttttattgcaaatatgtatat

SEQ ID NO: 6763095 - DNA, 56 bp, Homo sapiens
tactatctagctctttgcagagagtttgccaatctctgcgacggagttagattgtg

SEQ ID NO: 6763096 - DNA, 69 bp, Homo sapiens
ctggagatctggttaaaatgcagattcagtaggtggggcctgggagtctgcatttctaacaaatcccag

SEQ ID NO: 6763097 - DNA, 63 bp, Homo sapiens
gtaattggagcagaactactcacatatcggaaaatttgaggtgggtggcttctgttatattat

SEQ ID NO: 6763098 - DNA, 59 bp, Homo sapiens
gagttagaagacagaatgtaaaagtgcctaattattttttataagttgtaagctgactc

SEQ ID NO: 6763099 - DNA, 81 bp, Homo sapiens
tagaaggagagaaacaaggtgtaggttgaccaaacatttgcctgggtgtgttatcttccttgttctcaaatgatcctcata

SEQ ID NO: 6763100 - DNA, 68 bp, Homo sapiens
gctgtctctttccactccctcctcctcatcacaaatcttcaggtgcaggtaggcctgaaagtgacagc

SEQ ID NO: 6763101 - DNA, 93 bp, Homo sapiens
ttgaactcagcattcaaggcctcacacaacagatgcatcttttatgggtttagaaaatgcttgttgagccttgactatgtgctatgtattcaa

SEQ ID NO: 6763102 - DNA, 63 bp, Homo sapiens
gttttctgtttcttaacggcattgtggtatattaggagtctttggttataagagacagaaaac

SEQ ID NO: 6763103 - DNA, 59 bp, Homo sapiens
gaggggcagcagaggtgcgggcttggcttgagccaggccacaaccaccctgtgcccagc

SEQ ID NO: 6763104 - DNA, 57 bp, Homo sapiens
ggctacagctgattggatcaaggacagacacctgaccaaggacagtcacgctgtgct

SEQ ID NO: 6763105 - DNA, 62 bp, Homo sapiens
gtttgggaaggaattccaagactaaagtgaatgacacttaagcaaaatattctttcacaaat

SEQ ID NO: 6763106 - DNA, 58 bp, Homo sapiens
tagaaatgcagtgactaggctgaaacgacacagaatgtttctctacactacatttcta

SEQ ID NO: 6763107 - DNA, 56 bp, Homo sapiens
gtaggattcctattagctttctccctcacatggctggagaattgtaagaatcctac

SEQ ID NO: 6763108 - DNA, 71 bp, Homo sapiens
ctttctattcccttaaaggcagaacctcagagcctcaagtggggccatgaggctgccttgggaagagggag

SEQ ID NO: 6763109 - DNA, 66 bp, Homo sapiens
ggctgtgaagttctttgctccccagtaccaccacctggctacctgagcaagagcttcaaaactgcc

SEQ ID NO: 6763110 - DNA, 75 bp, Homo sapiens
gtgcgtccattggaggtttcccaactgtggggaccccaagctcacagggtttggaagcctcctgaggacagctgc

SEQ ID NO: 6763111 - DNA, 67 bp, Homo sapiens
cctttctatctggaagattgaaggggagtattccttggtgaggtgggctctgtctgtgatagagagg

SEQ ID NO: 6763112 - DNA, 67 bp, Homo sapiens
ggcttctctgctgtgtgatcatttgtctcctaagagcaggtgagtcctgggcacaggtaaggaatcc

SEQ ID NO: 6763113 - DNA, 124 bp, Homo sapiens
agagcctttattatacttgtttgtatcgtacaaaaggatgttttcatgaaacatcctttcggattagtgtttcatgaaacatgtttagggatatgctgaattaacataaataaaacaaggttct

SEQ ID NO: 6763114 - DNA, 57 bp, Homo sapiens
agcagtcagtcctgaatgaaggtgcatttgtgttttctaattctaactggcagagct

SEQ ID NO: 6763115 - DNA, 81 bp, Homo sapiens
tgtgactcagacagctggcaggtccaagatagagcatatggatgatgctctaatgacatctgtccagttgttgtaatcaca

SEQ ID NO: 6763116 - DNA, 68 bp, Homo sapiens
tcagggctgtttttcagtgtgtgatttactctctcccctttaattaccctggagatagcaagccgtga

SEQ ID NO: 6763117 - DNA, 67 bp, Homo sapiens
gcctttgtaccttaaatcctgtggggcctgtgtcctctttctacaggatctctagggtgctggaggt

SEQ ID NO: 6763118 - DNA, 63 bp, Homo sapiens
ctgggatactgtgtcattctcacatgctgctcgtgtgctaatatgattcagtgattcccccag

SEQ ID NO: 6763119 - DNA, 76 bp, Homo sapiens
ggcaggcgaaggaactgggatcagagcgtgaggaggagccccggccccgcctgctgatcttgttctcttcgcttcc

SEQ ID NO: 6763120 - DNA, 66 bp, Homo sapiens
caacatacctgagagttaggtttttatgttcccctaatatgacaatattgagtcttaggttaattg

SEQ ID NO: 6763121 - DNA, 70 bp, Homo sapiens
gtgtcaggctgctgtccacaaagcatccacaagggcatcacccaggagcttgttggaagcgccggatcgc

SEQ ID NO: 6763122 - DNA, 129 bp, Homo sapiens
cagaatcacctatagagcttttacaaaattcaaatgactggtctcctacctgggagttctggtttacaaatcagggaaaggggagagtcatttagattgattttttttaatgttccccaaatgattctg

SEQ ID NO: 6763123 - DNA, 84 bp, Homo sapiens
gtggcataagaccataaatgttcatttctcactcacatcaatgttcatcacagattggtgagaaagtggtgatctatgggccat

SEQ ID NO: 6763124 - DNA, 59 bp, Homo sapiens
ccttttatagatcagtgtgttaccactgatgacagtggaagaaatgctgctattagagg

SEQ ID NO: 6763125 - DNA, 57 bp, Homo sapiens
tagtactagaacctggttgtttcagcatttttctagaagtcagtcagttctatacta

SEQ ID NO: 6763126 - DNA, 88 bp, Homo sapiens
ttctgatgttggtgagtgttgaatatcgtgttcttgttttttaaaagtatgaatccaggagttatttagcaaaagcatgacatgagga

SEQ ID NO: 6763127 - DNA, 59 bp, Homo sapiens
tcagagcatgtgggctgcagttcccctcgaccaccaaagctagcctggccttgctctgg

SEQ ID NO: 6763128 - DNA, 62 bp, Homo sapiens
gcctggtgtgattgagcccaggtggtggcaattaatccctaagaagcaaagtgataccaggc

SEQ ID NO: 6763129 - DNA, 61 bp, Homo sapiens
attctccatatttgcaatgtagaaataactgtagctaccttgtgcaaatgctgttgagaat

SEQ ID NO: 6763130 - DNA, 57 bp, Homo sapiens
gtgattgtctctcattcctgcaactcctaatggtgcacatcagtgagggcagagcac

SEQ ID NO: 6763131 - DNA, 81 bp, Homo sapiens
ctgtgcacgactgttaccggacccatgcagctgatgtctccatcatgaaccaggtgtgccgggagcagtttgcttgcacag

SEQ ID NO: 6763132 - DNA, 59 bp, Homo sapiens
acaccagagccacttggaggtcaggttcccccgagatcctgattcaaatggtctggtgt

SEQ ID NO: 6763133 - DNA, 129 bp, Homo sapiens
gctgccaggcagcctcaaagcgggagagcacctgactgccgttgaatgtttaccgcgagacagacacatggtaacagatggaactctcaccatacactgaggtcactgccattggcatccccatgttgt

SEQ ID NO: 6763134 - DNA, 79 bp, Homo sapiens
catcctttattactctatggcatacttgaaaatttcttaatttattgtggtgtcctgtcagctagagtgaaggaggatg

SEQ ID NO: 6763135 - DNA, 57 bp, Homo sapiens
ctgttacacggaccttcaaatctgggaagattccctctgaagcaaatgtgataatag

SEQ ID NO: 6763136 - DNA, 65 bp, Homo sapiens
gaggagggcctggtgtcccttcgtccttggctctctttggccccgggccacaccaggtcatcttc

SEQ ID NO: 6763137 - DNA, 63 bp, Homo sapiens
ttagaaagatggaaaatggaacttgtcttgatgacagtgtctgctaggttcatcaacttctga

SEQ ID NO: 6763138 - DNA, 60 bp, Homo sapiens
tcccagagtattagcaattgctaatgcagcatcatctgcagttgttttagtgctgtggga

SEQ ID NO: 6763139 - DNA, 76 bp, Homo sapiens
atggaggactctcttgggggagagcagagggataagcccctcatctctcaaggatcccagagcaaaatccttccat

SEQ ID NO: 6763140 - DNA, 78 bp, Homo sapiens
tccgcagtgctccgctggagatctgcacctgtgtcccggggctgggcgcagagtgaagatctccgtgcacgctgctga

SEQ ID NO: 6763141 - DNA, 72 bp, Homo sapiens
gtaggccatttcattttctagaaagaactttgagggaataactggagctgctgaagggaaaatgaagcctat

SEQ ID NO: 6763142 - DNA, 55 bp, Homo sapiens
tcaccttgtgatccacccgccttggcctcccaaagtgctgggattacaagcgtga

SEQ ID NO: 6763143 - DNA, 56 bp, Homo sapiens
gaggtctcactatgttgcccaggctggtctcgaactcctgggctcaagtgatcctc

SEQ ID NO: 6763144 - DNA, 91 bp, Homo sapiens
ggaaatattgactcaactaggttaggaagatacagaatgtcgttacctttacatgatacgttttatttattccttcttaggaatcatttcc

SEQ ID NO: 6763145 - DNA, 77 bp, Homo sapiens
gtggataacagtgtggacttgagatctgccaccgaagccactgggcaagttattcaacctcactgtcactgttctac

SEQ ID NO: 6763146 - DNA, 71 bp, Homo sapiens
caaggatgtggaaaaagaggaactcttatatactgttggcagggatgtaaattcttcttcttaacttcttg

SEQ ID NO: 6763147 - DNA, 70 bp, Homo sapiens
taccagtatggccatgccagtttacagccaatacctgttctaaatggttggtgcccaggccatactggtg

SEQ ID NO: 6763148 - DNA, 69 bp, Homo sapiens
tggtaccacagtcagcctctagtagcatttggatgcaaaggtttaactggtgctgatctggacaagcca

SEQ ID NO: 6763149 - DNA, 123 bp, Homo sapiens
ttgctgtaggaactctgacctggcagataggagaccagattccaaattatgaatgcactgctctaggtgttcttcagcaactgagtgtcttttatcttccaagcatagtttcttctttcgcaa

SEQ ID NO: 6763150 - DNA, 78 bp, Homo sapiens
gcactgaagttattttacctgttaaaggaatctaattctttcaggtcactttagccagatgtgaaggacaacagttgc

SEQ ID NO: 6763151 - DNA, 74 bp, Homo sapiens
ctactggtggccccctaaacgagctggcagtctttaactttagttcataaaaccagggtggcatttgccagagg

SEQ ID NO: 6763152 - DNA, 61 bp, Homo sapiens
agctctgcctaggttccacgatgggttctaattccacccccttggaacctgtgccagggct

SEQ ID NO: 6763153 - DNA, 57 bp, Homo sapiens
tccctcagcttgtctccatgcacgcagtgaagcccgtggggatgtatgggtgaggga

SEQ ID NO: 6763154 - DNA, 55 bp, Homo sapiens
ctgtctgtttcaaaagtggttatccttcattgagcaccaaatgtgcaacaggcag

SEQ ID NO: 6763155 - DNA, 80 bp, Homo sapiens
atcctgggtttgtgagtttatgaagaagctgaagagctccatcacttcccagctaaacatagctcttcagatctcagggt

SEQ ID NO: 6763156 - DNA, 63 bp, Homo sapiens
ccccagccctccggatgttctgggcttccaacatgggagccctgagagttgtgaggccaaggg

SEQ ID NO: 6763157 - DNA, 57 bp, Homo sapiens
ctatatcatcattacctgcaccaaccaaggccaggcactaggttttgagtgatgtag

SEQ ID NO: 6763158 - DNA, 74 bp, Homo sapiens
agacatcatcttgaatgactgtgattttcttgaactgatcaccaggctattatagtctctcaagaatgatatct

SEQ ID NO: 6763159 - DNA, 81 bp, Homo sapiens
tctgctggcacctgtctcagtgcccaatgccataaggagcctggtgcatcagagggcctgaaagaccaggtgtgaggcaga

SEQ ID NO: 6763160 - DNA, 129 bp, Homo sapiens
agtatggttatttctgaatgacagtcttatccacagagtcatggtagtcaaaggttataaaggcaaagccccttttcttgccactgactcggtcagtcatgatttcaatcacttcaatttttccatact

SEQ ID NO: 6763161 - DNA, 80 bp, Homo sapiens
ggggaagagataaatgcagcagctaattgaaaaggatctgtttgccattttcccattttgcttttgtaatatttctcccc

SEQ ID NO: 6763162 - DNA, 64 bp, Homo sapiens
ttgtgctcaggattctcgacactcacagagagcttgaggagtccgaggatcccgagaaacacga

SEQ ID NO: 6763163 - DNA, 73 bp, Homo sapiens
ggtgtgggtaggagtgcagagaataaatctgggcctgttttgttcatttgttcatctgctcttctctcctccc

SEQ ID NO: 6763164 - DNA, 61 bp, Homo sapiens
tctcatggtcttgattttccataggttcttgtgacttcagagttagttatagaccatgaga

SEQ ID NO: 6763165 - DNA, 68 bp, Homo sapiens
gtgtcatttcacaatatcactcacacattggtttttgtcaattgagggattcagatgtgaagtggaat

SEQ ID NO: 6763166 - DNA, 90 bp, Homo sapiens
tgaagagttctgaaataggtgctgtctgcccataagtcatccttcaaacctttgtatttacaggacagcttggcatttttcttctcttca

SEQ ID NO: 6763167 - DNA, 72 bp, Homo sapiens
ggggtggggctggggcgccattgagtccaagcaccatcaggcacgccatggccctggcccagaccccacctc

SEQ ID NO: 6763168 - DNA, 86 bp, Homo sapiens
gttaaaaatttgaagagaaatgcacacatttggtactgaaaatgaacttatttttaaagaccagtttgcactttttagacaagagc

SEQ ID NO: 6763169 - DNA, 86 bp, Homo sapiens
gaagctaatgggttttgcttttgtaacacagtgtgcactaaggagtttgtgcattctttgtggctgaagcaggttacttagtcttc

SEQ ID NO: 6763170 - DNA, 68 bp, Homo sapiens
ctgccaccccaaggggggccctcaggacaaatattttttcattagaggggtcctgccttggctggaag

SEQ ID NO: 6763171 - DNA, 57 bp, Homo sapiens
ttagatagcaatgcaattctgggaaatacaactccattatttgcttggctcatctaa

SEQ ID NO: 6763172 - DNA, 70 bp, Homo sapiens
cctccaagtgagagatggtacagtaaagagatattataatccaacatgactggtgctatttcctgggagg

SEQ ID NO: 6763173 - DNA, 94 bp, Homo sapiens
gctagtttgatggattcacgatggctctactcaaatatctggcactttggcacagaaggccagaagactggagtcagctggatccctctctcgc

SEQ ID NO: 6763174 - DNA, 60 bp, Homo sapiens
caagaatagacattttatgtttgtttacaagttacacagttagtgagatgtctgtttatg

SEQ ID NO: 6763175 - DNA, 89 bp, Homo sapiens
ggagttttgctcttgttgcccaggctggagtgcaatggtgctatctcagctcactgcaatctctgcctcccgggttcaagagattctcc

SEQ ID NO: 6763176 - DNA, 103 bp, Homo sapiens
tgtagcaagtcaggtatgagatctttcaggaaggtgaggcacatgaggttagtaccacatttgccaggattttccagaaaggcatcttcctgaccttggtaca

SEQ ID NO: 6763177 - DNA, 120 bp, Homo sapiens
ggttctttggaaggatgtatagtgtctgtatctttgtcttcatgttggatgggtgtggaggtaagatatacaatagatgtggatacagatgtacaaatatatacacaagaaaagagatcc

SEQ ID NO: 6763178 - DNA, 87 bp, Homo sapiens
ttatataaagggaagttaagggtcccagtctgtttggggcaacagtgggagcaggctaagggacctgtttaaaactaatttatatag

SEQ ID NO: 6763179 - DNA, 74 bp, Homo sapiens
tagtccctgctctgcatgccacatgagtgacctagaagtaggtagcggttatgtctgcagggagttctggacta

SEQ ID NO: 6763180 - DNA, 57 bp, Homo sapiens
aagtgcaaatctgtggctgaaaggatcatatcccctcgtccaaacatttgccagctt

SEQ ID NO: 6763181 - DNA, 67 bp, Homo sapiens
gggaggcctggctgtcgctggcagtgttgtgcacacagacaaggcaaggcggccagatctgctgccc

SEQ ID NO: 6763182 - DNA, 72 bp, Homo sapiens
aaactcttaggtgtcaggcagtcagcatggagagcttcttttcatcccctgagtgtctggagatgtgagttt

SEQ ID NO: 6763183 - DNA, 64 bp, Homo sapiens
gaggagagccctcactccttccctgaaccagaggacccaggctgaggcagtagggtttggcctc

SEQ ID NO: 6763184 - DNA, 58 bp, Homo sapiens
tcagatttgaggcatgtgttagatatctcataggagatattgcataccatgaatctga

SEQ ID NO: 6763185 - DNA, 95 bp, Homo sapiens
ttggaaggatatagcaattacttggtctagtgagtgagcatagttgtgttagctatagctcaaagaagattatgtgattaatgtttatttgccaa

SEQ ID NO: 6763186 - DNA, 77 bp, Homo sapiens
ggcagcacttaacaatgagtcctctgaggttagaggatttccaggctctgttagaggattattgttctatttatgct

SEQ ID NO: 6763187 - DNA, 129 bp, Homo sapiens
taaaataaatgtattatggtgactaaaacagaaccaaattaatgtcagttttaggaatatgtattttaaagttgagtcctctctgacttattccagctgcaagttttggagttatgcatatacttttta

SEQ ID NO: 6763188 - DNA, 61 bp, Homo sapiens
tccttcctcggggacccagatctgtggcctccgtggggagatctgggcccccgagtaagga

SEQ ID NO: 6763189 - DNA, 86 bp, Homo sapiens
ggatctaaacaaaaatagtaacagtaacatcttcctagagcatattaacttctctttggggagaaatagtgttattgcatagaacc

SEQ ID NO: 6763190 - DNA, 75 bp, Homo sapiens
tggactaacctcacagcttgggcaaacggccttcctctttgaatgagcttcccaagctgtgaaatggaggtcaca

SEQ ID NO: 6763191 - DNA, 75 bp, Homo sapiens
cttgactctgaaattcttttgtgcggtgaagtcaagaacctgaactggccagccaacaacaatagcagcgtcagg

SEQ ID NO: 6763192 - DNA, 71 bp, Homo sapiens
agggaggtgtggcaggagtgcaaaaggctctgtttttatcttgtgctgacccctcctggccacactacctt

SEQ ID NO: 6763193 - DNA, 62 bp, Homo sapiens
tgggacacccaggagggagtggctgggctgccttggggggcctcctccctcctagggtctca

SEQ ID NO: 6763194 - DNA, 59 bp, Homo sapiens
tgagacagagtttcactcttgttgcccaggctggagtgcaatggcgtgatctctgctca

SEQ ID NO: 6763195 - DNA, 62 bp, Homo sapiens
ggtttaaagcaaccatcaatttggaagttgcttttgaagctccttatagttgtctttgaacc

SEQ ID NO: 6763196 - DNA, 57 bp, Homo sapiens
gcaggaggtgagcagcaggcgggcaaagagcattactgcctgagctccgcctcctgt

SEQ ID NO: 6763197 - DNA, 57 bp, Homo sapiens
tttctggcttagttgttgtatataactaggagttaatgtatcaattaagccaaggaa

SEQ ID NO: 6763198 - DNA, 77 bp, Homo sapiens
taatagcctgctgaaggagagacgtgtgtgtagcaggatgtgttgctacaaagaatttctctagctctttgttgtta

SEQ ID NO: 6763199 - DNA, 111 bp, Homo sapiens
ggtgccacatatgcacttgagtatttgggcatgtggagggtgcttaagttgtgtttctccccaaagaggttaggccaattgctccccactccccaaccaggtgtatgcatc

SEQ ID NO: 6763200 - DNA, 73 bp, Homo sapiens
tgtgttaaggtgcatctagtgcagttagtgaagcagcttagaatctactgccctaaatgccccttctggcaca

SEQ ID NO: 6763201 - DNA, 55 bp, Homo sapiens
gagaaataggaggagagaaatatgtttgaatcaaacatttctcttttcctgcctc

SEQ ID NO: 6763202 - DNA, 91 bp, Homo sapiens
tccagatgttttgtctgcttgatgccaagcatcctgatttttcaactatccagatgtttggcatcaggcagaccaatatccaaaatctgga

SEQ ID NO: 6763203 - DNA, 90 bp, Homo sapiens
gcagcatgggtggtcctctgagcacgccaggcacgagtgtgcagggagctggtgcaaatgcctctgtgtgcgggtgagcatctgtgttgt

SEQ ID NO: 6763204 - DNA, 83 bp, Homo sapiens
ggtcactctaggcctttgaaagttgcatccttttctgagcacaccattttgatacaggatgaaatgtgaaagttctgggtgcc

SEQ ID NO: 6763205 - DNA, 60 bp, Homo sapiens
agttatagccatattctaagattgtcatttcttgctaagactttggaaaaggctatgatt

SEQ ID NO: 6763206 - DNA, 57 bp, Homo sapiens
gcagcatactgcatcaaatgagggttttgtttctagctttctcagaacagtggctgc

SEQ ID NO: 6763207 - DNA, 76 bp, Homo sapiens
tctaattttgcatgtcgctagctgtcaccaattgaatccctttcagttgcacctgcatggtacttgtaagagaaga

SEQ ID NO: 6763208 - DNA, 73 bp, Homo sapiens
cgtgattttatcttacttgcagatgtagaagttaatttctaaattgatcaaatgcatagaaagatgaaacatg

SEQ ID NO: 6763209 - DNA, 70 bp, Homo sapiens
aatggtaggtatgtgttttggatttagaatgagacagtcttaggtttgaggtccagctgtgtctaccatt

SEQ ID NO: 6763210 - DNA, 129 bp, Homo sapiens
aatggatattttgctatgaaattgatattccctgataagaattgcaagtgctagctaaaatatttgttctaaatgttctttaaacttcagttcctttgctgagtgtcttataaaccaaatatcatcatt

SEQ ID NO: 6763211 - DNA, 81 bp, Homo sapiens
gtgatactcttcagaactataaaaagtactgtaaaatactttttcatacatagtactttttgtgggctgaaactgtattac

SEQ ID NO: 6763212 - DNA, 66 bp, Homo sapiens
caatgagctaatgtatgttgaaagcactttgtgaattgtaaagtgctacacaaatgttagttgttg

SEQ ID NO: 6763213 - DNA, 60 bp, Homo sapiens
gctgccttgcggtgtatttctgggcagagcagctcaccacaggaacctccgcgaaacacc

SEQ ID NO: 6763214 - DNA, 61 bp, Homo sapiens
tttaagaacataaattcatacgggcaggaaatgagaaactgctctttgaaatgctcttggg

SEQ ID NO: 6763215 - DNA, 79 bp, Homo sapiens
gtttcacagaataccaggttcttccaggtgagatcactctccaagaggcagtttcatcaggagaaaagattcgtcaaac

SEQ ID NO: 6763216 - DNA, 70 bp, Homo sapiens
atctgggcatggaggaaagagaaatgagtctgctttattttgctaattatatctttctttccgcctagat

SEQ ID NO: 6763217 - DNA, 55 bp, Homo sapiens
tccagtgtctacaggctctggagagccagactcttcaaacactgttggcactggg

SEQ ID NO: 6763218 - DNA, 104 bp, Homo sapiens
gagttgctgtgacctaattgtggaaactgataaaataagtacatttttaaaatgtagtcttgatttttgttattgtactatacaataagctattacaacaattc

SEQ ID NO: 6763219 - DNA, 61 bp, Homo sapiens
tggaaatagggtcggatctctcgttgtggatttgcgcaatttatcctaaatccagtttcta

SEQ ID NO: 6763220 - DNA, 57 bp, Homo sapiens
ggattcagtgtctgttaatagtccattcctcatggactgtgccttcttattgggtcc

SEQ ID NO: 6763221 - DNA, 126 bp, Homo sapiens
gaggaatcttctgttctcaagatgcttgactttaccacatcttcaaagtctctacctgtgtaaagcaacatagtcacaggttccagggattaggatgtggtcatctttgaaggactgctgttcctc

SEQ ID NO: 6763222 - DNA, 57 bp, Homo sapiens
tctgtatattctctggttgtgtataatatgagcttgcgcagctgagaaatatacaga

SEQ ID NO: 6763223 - DNA, 92 bp, Homo sapiens
ggggaactggagagctggggacccggactcctgggtcctggggaaagcaggtccaaggatggggtctcccagatattttctcccgtgaatcc

SEQ ID NO: 6763224 - DNA, 63 bp, Homo sapiens
cctgcattaagttgcctgtaagacttctgactctgaattcttccctgggagctcaatagcagg

SEQ ID NO: 6763225 - DNA, 62 bp, Homo sapiens
aggagagttggctgataaggcatttgtaggatataccaggccaaattcagtcagcagctcct

SEQ ID NO: 6763226 - DNA, 130 bp, Homo sapiens
aataaactgccttatcttttgttcattcactttatgaacatacaattattaagaaccaactatttttggcattccataaatgtttgtggataaatgtgtggatgaatggatattatatgcaagtcagagt

SEQ ID NO: 6763227 - DNA, 62 bp, Homo sapiens
gcaaaatgcaggagttcgaggctgtatgagctatgatcatgcctctgcactccagcatgggt

SEQ ID NO: 6763228 - DNA, 69 bp, Homo sapiens
ctgtggcagtcaggtatgttgctcaaatcttcaggctaacctactgtgaggagcatagctgactgacag

SEQ ID NO: 6763229 - DNA, 99 bp, Homo sapiens
tcctgttgtgtattctaggttgctttgagtcactgtcttggagattttttaatcctccagagatttgagttatttaggccacttcatatatgcgtggga

SEQ ID NO: 6763230 - DNA, 75 bp, Homo sapiens
ggtcagtcttctagcaaatccaggcctttggaactagaaccagaaccttgagagaagctgtgaagacttctgact

SEQ ID NO: 6763231 - DNA, 61 bp, Homo sapiens
gtccctcataactggcaggtgtcacctggttggccgcagaagggcctgccagccgagggac

SEQ ID NO: 6763232 - DNA, 77 bp, Homo sapiens
gctcagcacagtccaggctcagtcaagcacttcgagtacaaaacaacttgagtgcgtggagatctcactgtgtgagc

SEQ ID NO: 6763233 - DNA, 72 bp, Homo sapiens
cctttgggctcctcaacacccggctgtccccagacttgtgtccagggaagatagtgttgagggccctcaagg

SEQ ID NO: 6763234 - DNA, 63 bp, Homo sapiens
ctgtgaagctagtattaactcagattattcagatgagatcaagttattaagtagctttcacag

SEQ ID NO: 6763235 - DNA, 67 bp, Homo sapiens
ggcctggttaggtccattggctgtggtttgctgacccctagcatgtgcctagtggatttgaagggcc

SEQ ID NO: 6763236 - DNA, 70 bp, Homo sapiens
aatcagagcattgtttcagttaaaacatccttccttctaatgttatggctgagagcaattgactctgatt

SEQ ID NO: 6763237 - DNA, 63 bp, Homo sapiens
taggaggatgtaaaatagacaaaatggaacagccactttggaaaacagtttggcatccactta

SEQ ID NO: 6763238 - DNA, 68 bp, Homo sapiens
gttcagttttacccaagcttattttaggtaatcaaaacctagagcaattagcttaggtaaaacttaat

SEQ ID NO: 6763239 - DNA, 58 bp, Homo sapiens
tccagatgattgttaggtagctgttgtcttctgagagggatctgaggcctcatctggg

SEQ ID NO: 6763240 - DNA, 66 bp, Homo sapiens
gtttcttcctcagtgacagcttgggtacagtatgtgtaaactgattgtcagctgagctgaagggac

SEQ ID NO: 6763241 - DNA, 72 bp, Homo sapiens
ctttcatgactttgtggcaaaataatagattttggttttggttttgttttgttttgctaaagggtcatcaag

SEQ ID NO: 6763242 - DNA, 78 bp, Homo sapiens
cctttctcccactctgtctttgtcaggaccagaggatgtttggcatttcccctggtcaccaagacaagggagataagg

SEQ ID NO: 6763243 - DNA, 130 bp, Homo sapiens
ggaactgggccagtcttaggcttacctagaaatatacacctgatcccatgagaccacgttggctgtgatatgatagcacttctcatgggatcaggtgtatatttctagatagcagcaggcttccatgctc

SEQ ID NO: 6763244 - DNA, 71 bp, Homo sapiens
atttttcctctttgattgactacacgccttttttatgaaaaagatttgtggatttaaggatatggaaagat

SEQ ID NO: 6763245 - DNA, 69 bp, Homo sapiens
gaccgtcttcccatggggtctcctggagtttctaggaggctctggagaggttcccatgggaggctggtt

SEQ ID NO: 6763246 - DNA, 101 bp, Homo sapiens
tcctttgttttatttggtccactctgtggagtagtgttgagagcaccaaagtcatagaggagctctcctaggtaacagggtggtttgagtgaaagaagcaa

SEQ ID NO: 6763247 - DNA, 68 bp, Homo sapiens
gtgacgtgcagagtcttggcattcatgcgttcctggagacagggacatcaccgtggctttggatgcgc

SEQ ID NO: 6763248 - DNA, 77 bp, Homo sapiens
ggcacgtctgctgagaacagagctctgagcttttgataaatggaagaagctcctggctttcctctcaccacagatcc

SEQ ID NO: 6763249 - DNA, 92 bp, Homo sapiens
agattcatctgcattttacaaaatgcttttcatgggattttttaatttatttactttaagtcttaggaaatagcaaagatgaagatgaattt

SEQ ID NO: 6763250 - DNA, 70 bp, Homo sapiens
gcacggtgtcttctagtggggacatgtgacagtaatttcttttccacattatctgccattgacaccatgt

SEQ ID NO: 6763251 - DNA, 57 bp, Homo sapiens
gtgagggatctgggttgcgctgtccttatgagagtctaatacctattgatctgtcac

SEQ ID NO: 6763252 - DNA, 57 bp, Homo sapiens
ggttcttgacaatcttggtctttgctttcagaggagactgtattgttttcaaggatc

SEQ ID NO: 6763253 - DNA, 63 bp, Homo sapiens
aggaaactctgagcggaccagcaaggccagataatggccaatggtgaagtctcagtgtctcct

SEQ ID NO: 6763254 - DNA, 61 bp, Homo sapiens
tatttcttttcgtgacttattgcagtggctaagacctgcagtacaatgtggaaaaggagtg

SEQ ID NO: 6763255 - DNA, 63 bp, Homo sapiens
ccatgcaggaagtcggggagcgggggcccaggggtgccttgtggcccatggcttcctgcctgg

SEQ ID NO: 6763256 - DNA, 73 bp, Homo sapiens
tacacctctgagtctttgcagggttcattccttctctgtggagtaaacacaccttaccagagcctccaatgta

SEQ ID NO: 6763257 - DNA, 65 bp, Homo sapiens
gcttggtgtcccagtcactgtccatgcagcacacagctgctgtatggtccacgtgggtgcccagc

SEQ ID NO: 6763258 - DNA, 105 bp, Homo sapiens
ggtcctcagcctctcccctgccttggggtccacaccgcaggacagggcagcttcttaccttcccgggtgggctgcgaggccagggacaaggagtactgagtggcc

SEQ ID NO: 6763259 - DNA, 58 bp, Homo sapiens
ttcccaactctggttcagtgatttcaggttgatagcttgaaatcagccatgatgggag

SEQ ID NO: 6763260 - DNA, 129 bp, Homo sapiens
ttttaataagtccaagggtagaaaagtccccactaaaatgtcattgtgagttaggcttgtgactgtttctaaggctgtctttcacagggaatgttttgcttgggtgatctttattcttgtttattaata

SEQ ID NO: 6763261 - DNA, 83 bp, Homo sapiens
tgggtatagagtttcagttttgcaagatcaaaataattctggagaaggattgcagtgatggttgcataatatgaatgtactta

SEQ ID NO: 6763262 - DNA, 71 bp, Homo sapiens
ctcaactggagggcaaatggcttgtacactgtttacatttcacagacattgccacagtgccctccaaagag

SEQ ID NO: 6763263 - DNA, 58 bp, Homo sapiens
tcaggcagaccaccgtgggcagctctgatatggatacgtgcacactggattgctctga

SEQ ID NO: 6763264 - DNA, 75 bp, Homo sapiens
tcacctagagggcttgttaacatagagattagtgtgctcatacctacagagtcttctttagtaggccttgggtgg

SEQ ID NO: 6763265 - DNA, 57 bp, Homo sapiens
tcaatgaggtaatcagtcacccacaaagcatggagtcaatgaaaaggcctcatttga

SEQ ID NO: 6763266 - DNA, 101 bp, Homo sapiens
gggaaacttgtcaagcatgcaaatttctgggctccatccccagaagctctgatacagcaagtctggagaagcccagggagctgcgtgtttaacaagctccc

SEQ ID NO: 6763267 - DNA, 114 bp, Homo sapiens
gtttcttgagtcataggaagctgctctccatgtgttactttcagggtagttaaggtaatttaatgcaaatgaccttaaaactgacacatggagagcagctatgactcaagaaac

SEQ ID NO: 6763268 - DNA, 55 bp, Homo sapiens
gcccaggctggagtgcagtagcgcgatcacagctcattgcattttggcgctgggt

SEQ ID NO: 6763269 - DNA, 71 bp, Homo sapiens
ggaggtaaagtaactcgcccagtatcacaatttgtgtttgtaccattgctgaggtgagcacctgggccttc

SEQ ID NO: 6763270 - DNA, 83 bp, Homo sapiens
caacctttgcacacaaagtttgctaacccttgctctagactctagagaaagaggttggaaaacaatgtgagcagtgtatgttg

SEQ ID NO: 6763271 - DNA, 97 bp, Homo sapiens
ggttaagttagtttcaagttgtgttttccgggctcagggattggtgtttgagctacccatagaactcagctgaaacctatgtgaacttaaagtaacc

SEQ ID NO: 6763272 - DNA, 69 bp, Homo sapiens
tgccacaggcagggcacgggctccaggtgcatacattcccttgggcctacggactccttgccctgtgca

SEQ ID NO: 6763273 - DNA, 65 bp, Homo sapiens
tgtccgctgtcttccttgctccaagggaactcttgcgtgaaccctgcaaaggagcccagcccaca

SEQ ID NO: 6763274 - DNA, 72 bp, Homo sapiens
gcccccgcagtaccacaggctgaggccggggccgctcactctggcggcttggctgcctttggatgttggggt

SEQ ID NO: 6763275 - DNA, 64 bp, Homo sapiens
ttgtcaccatgcaaaatgtgaaaactgtaattaacataaagcatttcacaaaagtatgtgacaa

SEQ ID NO: 6763276 - DNA, 74 bp, Homo sapiens
cttttttcttgtcatgcccttggtaactgctgggaatagctgcagtgtatcatggttggcagacactaagtaag

SEQ ID NO: 6763277 - DNA, 97 bp, Homo sapiens
agtattgtaacattttatagagagtgatgagtggtatctatttaatgtggactttagtacttatattttatcctcgtggcctttataaaacaaaact

SEQ ID NO: 6763278 - DNA, 64 bp, Homo sapiens
ggcccgaatccccgcctttccgagcggggacgctgataggtgcagaggcggggttttggaggcc

SEQ ID NO: 6763279 - DNA, 111 bp, Homo sapiens
tggccttgccatgagggcacagctgctgcggaaagatgccaccgagatcagcttcatgacccgtctgtgttttccacagcagctggagcgcaccccatggacgctgggcca

SEQ ID NO: 6763280 - DNA, 58 bp, Homo sapiens
ggtgggcggcccccgctaggcttcctgggaaagcggaagccaggcaagcacccccact

SEQ ID NO: 6763281 - DNA, 58 bp, Homo sapiens
ggccccctctttggagccagccacccacagggctttggtgcctcagaagcagtgggct

SEQ ID NO: 6763282 - DNA, 58 bp, Homo sapiens
cagggctcccaaatatctcttctttatacaattcaaggaccagatgacaggggttctg

SEQ ID NO: 6763283 - DNA, 69 bp, Homo sapiens
gtcctgaaagaagacagacatttctttcttagggattgccgatagagatcccctgttttcccctgggac

SEQ ID NO: 6763284 - DNA, 57 bp, Homo sapiens
tgcttcggggtcatgggccatcattcctagggctttgggaggccctggcctcgaaca

SEQ ID NO: 6763285 - DNA, 63 bp, Homo sapiens
ggagctgggggaagggctgggttctggtccttaagcccaagcctggcttaatcctccttttcc

SEQ ID NO: 6763286 - DNA, 63 bp, Homo sapiens
ggtcaaatcatcctttgtagaaacttctctggggacttgtcccttttacagggaatggagacc

SEQ ID NO: 6763287 - DNA, 83 bp, Homo sapiens
ccaatgatttctttattgagaaggagattggcatctagagaagttaagtgacttaatctcctctcagggtaagtcagcattgg

SEQ ID NO: 6763288 - DNA, 130 bp, Homo sapiens
ttggtaatggaattcttttggttgctattgcattttgaataatgtttgggagaaatttagccagatgcattgacaagcactgcagtgtttccagatattgtctgtatagtttttatcactgccataacaa

SEQ ID NO: 6763289 - DNA, 61 bp, Homo sapiens
agagacaggagttctgtttccatttagaatatataactttgggcaagtcacttctgtcttt

SEQ ID NO: 6763290 - DNA, 72 bp, Homo sapiens
cagctattgttctgtataatgaagccctggctgttgaccctcagaactgcatcttatacagcaatagatctg

SEQ ID NO: 6763291 - DNA, 68 bp, Homo sapiens
tcacctcagattacagttaatttaccttctttacatatttagagaaaatcactgactgtgcttggtga

SEQ ID NO: 6763292 - DNA, 66 bp, Homo sapiens
cccctctttttgttgtataagccctttctactcccagacaggctgatagaccataaataagggggg

SEQ ID NO: 6763293 - DNA, 63 bp, Homo sapiens
agatagatggtgacaggtatacaaagaggtgccctgagcatcccagcttgtcttcatttttct

SEQ ID NO: 6763294 - DNA, 58 bp, Homo sapiens
gcctgctggctggaaattctcctgagatcggttggagtctatttgcaggcatgcaggc

SEQ ID NO: 6763295 - DNA, 73 bp, Homo sapiens
tgaagtcctaagtctagctcagagacagatgcttgactctttcctgctgcctagtctgctgagcagagcttca

SEQ ID NO: 6763296 - DNA, 59 bp, Homo sapiens
aggtacagggtgaaagtttatggctgaaataaagtgatgtaaacttcagctctctgcct

SEQ ID NO: 6763297 - DNA, 55 bp, Homo sapiens
ctctaggaaataatgactcatccctctcacttttgggaatctttgtttcctgggg

SEQ ID NO: 6763298 - DNA, 61 bp, Homo sapiens
ggtgtaagggaccccctgcccccagtggccacaggtcgggcagcagaggatcccttaatcc

SEQ ID NO: 6763299 - DNA, 62 bp, Homo sapiens
caagcaggtggagtagtaactctctgaaacagccagagactggtttttaacttcacctcttg

SEQ ID NO: 6763300 - DNA, 67 bp, Homo sapiens
agccacattctgctgttgaatgtagctttatgctcagcagctacattcaacagcagagttttaagct

SEQ ID NO: 6763301 - DNA, 68 bp, Homo sapiens
gtaagacacattgagaaacacaagaaacccattgttctctggatgtttgtgcatttcagtggttttgc

SEQ ID NO: 6763302 - DNA, 58 bp, Homo sapiens
acagtatgttgcaatgacctgtgtgtttttaaacatcatcatcattgctaacatctgt

SEQ ID NO: 6763303 - DNA, 114 bp, Homo sapiens
tgtggggttttatagcctcagaacacaatggcgtgtgccacagattgctctttccatttgtattttgtgtgtagtacacagccaatgtcctgcttgctgtaacctttcctctca

SEQ ID NO: 6763304 - DNA, 65 bp, Homo sapiens
gagggaggctcagagggactttcaagatactttatttcagttcctcttttgggctctgacccctc

SEQ ID NO: 6763305 - DNA, 58 bp, Homo sapiens
agccagtcagaggctcccccaagcccctttttcttctttggggcctgtttctgtggtt

SEQ ID NO: 6763306 - DNA, 79 bp, Homo sapiens
gggaaagagccctcagtgcttgaaattttcatctaagaatggagaaccataggtgctatttcagcagggtctcttttcc

SEQ ID NO: 6763307 - DNA, 56 bp, Homo sapiens
gaactatacatttcaaatgctccatgtggcccttggggcacttgatcccctggttc

SEQ ID NO: 6763308 - DNA, 72 bp, Homo sapiens
ggtcacagagcatgatggaagatcgagtttgcttttcggttttagtctcttctattcagctctcatttcacc

SEQ ID NO: 6763309 - DNA, 74 bp, Homo sapiens
aagataccgatgcttgagtccctccactagattcggatttattggtctggggtgtgacctgagcatggaatttt

SEQ ID NO: 6763310 - DNA, 130 bp, Homo sapiens
ggcgatctcagcctccagcttgaccttgatgtttggcagggcctggtactcctgggcctggccctgtccctctgcccaggtctgtgccagctctgactccaggtgcagcaggatcccattgagttgttcc

SEQ ID NO: 6763311 - DNA, 74 bp, Homo sapiens
taggctatagaagtaagcattgtgatgggggaagagccactcgttttgtaacaaatgccttgttccattgtcta

SEQ ID NO: 6763312 - DNA, 72 bp, Homo sapiens
gcaggagttgctgagtctgaattcatactttaattcaacacgaggtgtacaaacaagtttcagcagccctgc

SEQ ID NO: 6763313 - DNA, 68 bp, Homo sapiens
cccatatctattctgatgagccgtgtcctctccactgtcccacactggttctcaagactaggtctggg

SEQ ID NO: 6763314 - DNA, 76 bp, Homo sapiens
atacactcagctcatccactaaatcccttttcaggtagacagggttatatgggaagatgagctagaatgagtctat

SEQ ID NO: 6763315 - DNA, 58 bp, Homo sapiens
cttggcaagagggatgcaaggtttgggctggggctggggcccagtaccctctgccaag

SEQ ID NO: 6763316 - DNA, 73 bp, Homo sapiens
cattgtctgaattactgaagctcaactcatctgataaaataggtgagctttgtggtaatgaagtcagataatg

SEQ ID NO: 6763317 - DNA, 62 bp, Homo sapiens
gagtgccaagagaagaggctggtgaattaggaaagagtgagatcttttcagtcttggtagtt

SEQ ID NO: 6763318 - DNA, 67 bp, Homo sapiens
tggtgatatgatatttagtctattagagctgtaatgaaagtggtaatgactaagcatcattaaacca

SEQ ID NO: 6763319 - DNA, 57 bp, Homo sapiens
acggagcttctagattgcacagctagttaataacacaactgcaactgaaagctttgt

SEQ ID NO: 6763320 - DNA, 71 bp, Homo sapiens
tttgatgggtgtctattaaaagttaaatacttgtttgtttagctttcgttccttagacacatataatcaag

SEQ ID NO: 6763321 - DNA, 67 bp, Homo sapiens
tctggggctttatctgagatgcactggatgattgcaggcatatatttctgctcagctgaaccccaga

SEQ ID NO: 6763322 - DNA, 58 bp, Homo sapiens
gcaaacataatatgaagacactgtaaagattgtgtctcagtttcatactgtgtattgc

SEQ ID NO: 6763323 - DNA, 65 bp, Homo sapiens
gtggtgcatgcatgcatatgtatatatctgcgtctatgtttgtatatatgcatatatgtatacac

SEQ ID NO: 6763324 - DNA, 71 bp, Homo sapiens
tgtcaggaggccctgaagacagctggggtgagagctagccatcttgcctcggtctatcagggtgccaggca

SEQ ID NO: 6763325 - DNA, 60 bp, Homo sapiens
tttcaaaggtggaagagtgaataagtatagtaattcagtcactaagcacgcctattggaa

SEQ ID NO: 6763326 - DNA, 76 bp, Homo sapiens
ggacctggtaacgctgcatctttcccttccctgtttgattcttagggtggcaaagccttccagctgttaccagtcc

SEQ ID NO: 6763327 - DNA, 78 bp, Homo sapiens
ggtagctttcttctctggacagtgaagagaggagcattgggacctttctctctttctgttcagaggctgagagtttcc

SEQ ID NO: 6763328 - DNA, 83 bp, Homo sapiens
gcaaatttttttctgttaagggccagatagtaaatattttaggctttgtgactatactgtctcttatagataataagttttgc

SEQ ID NO: 6763329 - DNA, 82 bp, Homo sapiens
gctctagagaaaaaactcaagtgagagactcagggcttctttaaatgtaattgctctcactcagagattttctttctagagc

SEQ ID NO: 6763330 - DNA, 62 bp, Homo sapiens
tcttagcaataagagggaatatagtaatactttcactcctatagcccccttttattctaaga

SEQ ID NO: 6763331 - DNA, 58 bp, Homo sapiens
catctgcaaaggatgaatcctgttaactttttggaaaactggttctcttttgcttgtg

SEQ ID NO: 6763332 - DNA, 59 bp, Homo sapiens
tccagaccatggatggctgcaatcgggcagcaagcagcattgcagcctcaatgggagga

SEQ ID NO: 6763333 - DNA, 73 bp, Homo sapiens
gacctggcccagcaacttcactgatttaagcctgcaaagctgaatgctgagaatggagttgttctgctaggtc

SEQ ID NO: 6763334 - DNA, 103 bp, Homo sapiens
ttgagacggagtctggctctgtcacccaggctggaatgcagtggcgcgatctcggctcactgcaagctccgcctcccgggtccacgccattctcctgcctcag

SEQ ID NO: 6763335 - DNA, 63 bp, Homo sapiens
ttccagttcccatgaggattaaaaggaagaagtggactttaactccagcgatgggactgtgga

SEQ ID NO: 6763336 - DNA, 56 bp, Homo sapiens
agtgcctctttttccgtctgtttgtttcccatgtgcccacggaatgatgaggcact

SEQ ID NO: 6763337 - DNA, 114 bp, Homo sapiens
gaaattatcttacttgttgaagtggcctcttttggaaaaagcctgaacatagtttgtctattgtgatctgttctttttcctgaagaaaatattttctttttagtttttaatttt

SEQ ID NO: 6763338 - DNA, 97 bp, Homo sapiens
gagtaggtcgaggaaggggaggcctgcgctttcgggagggaagccgctggggctagtctggctgaagctgggcacttccttttttccctcgatactt

SEQ ID NO: 6763339 - DNA, 62 bp, Homo sapiens
atcttcaaagcacatcgtttgtacaagagatagactaagaacaaaaatgtgtttatggagat

SEQ ID NO: 6763340 - DNA, 58 bp, Homo sapiens
gtattactcttgtttgacaattaatcctaaggattaagtgtattgctgagggtaatat

SEQ ID NO: 6763341 - DNA, 87 bp, Homo sapiens
agctcctggagggcaagtcttgcatccactgctttgctggcaacccgactggtaagcttctggaaggcaaggcttgcatccagtgct

SEQ ID NO: 6763342 - DNA, 77 bp, Homo sapiens
aagctgagcacagaacagcttagaaatgttgctaaagctcctggtcttggtggctctaaagcctgtacctcaagctt

SEQ ID NO: 6763343 - DNA, 62 bp, Homo sapiens
gcaagaagttagagaaggcagccaggggcctctcttttgctctgcttccagtcaacttctgc

SEQ ID NO: 6763344 - DNA, 57 bp, Homo sapiens
ccctgacttagttgcaaatggaaaccgggcattgtttccaggagtggctgggcaggg

SEQ ID NO: 6763345 - DNA, 58 bp, Homo sapiens
ccacctcggcttccacttggttttgtttctgaaccaacataggaatgcagagaagtgg

SEQ ID NO: 6763346 - DNA, 57 bp, Homo sapiens
tctttgctgtactgggtttatatgctgaaagatgtatcctgatccaggcaggaaaga

SEQ ID NO: 6763347 - DNA, 70 bp, Homo sapiens
ctctcctggtccactggcctcccatggggggaaggacagtccctaggaagcagcccatggatatagggag

SEQ ID NO: 6763348 - DNA, 86 bp, Homo sapiens
cccagctgggaagtggtagttagaatgcacacacatggagtcatgactgactctggaatgggtgtttctaacaccacctggcttgg

SEQ ID NO: 6763349 - DNA, 70 bp, Homo sapiens
gggagcttgagcacaggtgaacagcatctcgccaccctgccagggcccttcaaatgtgcctcaggtcccc

SEQ ID NO: 6763350 - DNA, 129 bp, Homo sapiens
tgagactggggggcattttatggttataagagctaaatgatatttatgcaagtgtgtaaacattaataactcagcgtttataagcatgttagaatatttgattatggctagggaaatgcatattagcta

SEQ ID NO: 6763351 - DNA, 82 bp, Homo sapiens
ctcctttaaatagaggttaagattctgtaatgcttgtctggcacatagcaagtatatactaaatgttaatcatttgagggag

SEQ ID NO: 6763352 - DNA, 73 bp, Homo sapiens
cgagaggcaaaaagactacacgggaaagagctggaactccggtagtaccagctctgtggtcatttacctcccg

SEQ ID NO: 6763353 - DNA, 75 bp, Homo sapiens
tggtccagacacaatggcccagtcagcaggagagggtgattttgacatcttcccttaggtgggcctctgaggcca

SEQ ID NO: 6763354 - DNA, 97 bp, Homo sapiens
gtgtaaacagagagtccattggagggaaaagcatctgcaattgctttaaattccaacgcaatgagatggaattcccgcctagggtctttgccagcac

SEQ ID NO: 6763355 - DNA, 90 bp, Homo sapiens
ggtgagctctttgatttttgtttctgatccgagttaatcatttattcatgagcatttgaaaattagacacaggctaattgaaagctcatc

SEQ ID NO: 6763356 - DNA, 79 bp, Homo sapiens
gtcagttccacttaattgcattatctatgtattgagaaacatcaatctctagacatggggaatgtcatcgtgaactgac

SEQ ID NO: 6763357 - DNA, 85 bp, Homo sapiens
gtgcgtgtctgggagggacctggagcctgccccgcacctgtcccgcagggcttctggttcttcaggccatcctcccagcaaaagc

SEQ ID NO: 6763358 - DNA, 58 bp, Homo sapiens
gccagaggccttcaatactcatttcacactagagagggtgtcctagttgccatctggc

SEQ ID NO: 6763359 - DNA, 74 bp, Homo sapiens
tcctcttagatcttaattgagccttgagtatatttatctcatgatgtagcgaatgagaatctgaatacagagga

SEQ ID NO: 6763360 - DNA, 55 bp, Homo sapiens
tcaaggtgccagcaagttagagcctggtctctgtgcttccaagatggcaccttga

SEQ ID NO: 6763361 - DNA, 75 bp, Homo sapiens
aggttactcaaggtgaggaacactattacacagccactgagtgatactagcagtattttttaccatgactaggct

SEQ ID NO: 6763362 - DNA, 102 bp, Homo sapiens
tttgatgtaattcagtttaatctatttgcttgtctagcatctaactaaaagtgcaagtggttggtgcagaaaagaaaaggaggaaattttggagtgcacaaa

SEQ ID NO: 6763363 - DNA, 55 bp, Homo sapiens
gggagcagagacctggttttgttgagttgtttctcagtctgtcagtctctgcccc

SEQ ID NO: 6763364 - DNA, 82 bp, Homo sapiens
gcagattagcagcagctgacagtgggtgccggctcacccacaggagtaaggcaattcataatcggttaaccttgaattctgc

SEQ ID NO: 6763365 - DNA, 63 bp, Homo sapiens
tgctagcactgtgcagtctacggattagattataaactgaaaagaccctgcatatgttcagta

SEQ ID NO: 6763366 - DNA, 55 bp, Homo sapiens
tggtacatgggtaggtatctcttcttgactagaagacaatcctacaaatgtggca

SEQ ID NO: 6763367 - DNA, 65 bp, Homo sapiens
tgggttagaagcaaggcaaaagagttatccccataaaagagatgacactgcaagtatttaaccca

SEQ ID NO: 6763368 - DNA, 123 bp, Homo sapiens
tcatgggtcaaatgttgtcaagtttttcattcattatacagtagagaagaggctaggatcatgtccaccctgggtcactatagtagcttgggtgaaaagtaacttggccattgaatcccgagg

SEQ ID NO: 6763369 - DNA, 76 bp, Homo sapiens
cactgtcactgaggatgcacggtcctctccttgccctggaagcagagaacgggaatgtgcagccacagtgagtgtg

SEQ ID NO: 6763370 - DNA, 67 bp, Homo sapiens
agcactaaaaagacatggcaagagatggggctctcaagagccagaaaatgatcttgcatgctgtgct

SEQ ID NO: 6763371 - DNA, 65 bp, Homo sapiens
tcaaaatgtgcttcttactctcaatgcaaattatttccagagctgggggcacatcattcttttga

SEQ ID NO: 6763372 - DNA, 69 bp, Homo sapiens
gtggtgcccgtgggtggggtacgggctggcctctgtggccaggccctgctcctcacaccacaggactgc

SEQ ID NO: 6763373 - DNA, 60 bp, Homo sapiens
gccatggagtctacaaagtgttggaacctccagaggttctaggaagaaaggccccatggc

SEQ ID NO: 6763374 - DNA, 67 bp, Homo sapiens
tagacaagcaactcctaggaggaaaggaatgcagcgctatcttccctctctaggtagacgtagtcta

SEQ ID NO: 6763375 - DNA, 55 bp, Homo sapiens
ctgtgtaacttcttttctttcatctgttgcccagaagaactattgaggtacacag

SEQ ID NO: 6763376 - DNA, 59 bp, Homo sapiens
ctgcccagcagggagctacctggagttggtctggcccagcagaagctcccgctgggtgg

SEQ ID NO: 6763377 - DNA, 116 bp, Homo sapiens
gggtttcaccttttaaaagttggctgactgaagcacttctcctttatttcctgcaatagaaatgtcaaagacgtgtttttgttatgtgccctgtctgcttttgttttttttaaccc

SEQ ID NO: 6763378 - DNA, 56 bp, Homo sapiens
ctgtaggttgggggggcgataccagagtgtcactgggaagcccccagaaatctcag

SEQ ID NO: 6763379 - DNA, 87 bp, Homo sapiens
gataataggattcatgttccatacatcaccagtctaagttgccaaaatatgcaagtttcagactgctgtgtgaaactgaaactcatc

SEQ ID NO: 6763380 - DNA, 69 bp, Homo sapiens
gcagttatgtatgtgtttgagaagtgtttctaatgtattcgcaacactcagacacagacatacacatgt

SEQ ID NO: 6763381 - DNA, 56 bp, Homo sapiens
ccattagtacctctggaaaattgacgctccgttctctatattcagagggctaatgg

SEQ ID NO: 6763382 - DNA, 67 bp, Homo sapiens
ctggggcatctgacagataaataaacaagatagtttctcaacaatttgtacagaattttgccttcag

SEQ ID NO: 6763383 - DNA, 85 bp, Homo sapiens
tgatacagtatctaggagtatctaaaatataaatactttgataaagtatttatattttgggagctcctgacttgataaagtttca

SEQ ID NO: 6763384 - DNA, 76 bp, Homo sapiens
gttactaagttgtgttttgtgttcaaaatagtatatataaatacatgttttgtgtacagaatatttaaacagtgat

SEQ ID NO: 6763385 - DNA, 90 bp, Homo sapiens
gtattttgtctacagtttatagttgttatgtgtgagagtgtccttcttattacattatgcgtaacatttatttaaccagatctctattac

SEQ ID NO: 6763386 - DNA, 57 bp, Homo sapiens
gtgaaggaaggaattgatcatgcgctcccctggagcggggatccggttctccttcat

SEQ ID NO: 6763387 - DNA, 66 bp, Homo sapiens
gatctcctccttctgggcctggcagtggctgaggagctgctgagccgcacccaggagctgggcgtt

SEQ ID NO: 6763388 - DNA, 56 bp, Homo sapiens
gatgaaggctgagtgggtacggaggcttgacaatagtcttcccacctgtcttcctc

SEQ ID NO: 6763389 - DNA, 96 bp, Homo sapiens
ctaactccaccgtgtgtttccaagacgagaggctctctgtttgtccctttcctaagaataaacatctgtttctcttctgggtttggtggacattag

SEQ ID NO: 6763390 - DNA, 55 bp, Homo sapiens
tggaaagacttcattttggaatctgatgcaaaaagctcttgatgaggtttctcca

SEQ ID NO: 6763391 - DNA, 57 bp, Homo sapiens
agtgttgggcattgtagcagaccacccaggcctagttgctaaaaagtgcctaacatt

SEQ ID NO: 6763392 - DNA, 59 bp, Homo sapiens
ccagactcttgagctgattgtatccgatgtcgagaaacttgaggctgcggcagtcctgg

SEQ ID NO: 6763393 - DNA, 56 bp, Homo sapiens
tttcaagctccagggtctatgtttggatctttatcatcagccttgaatgcttgaaa

SEQ ID NO: 6763394 - DNA, 62 bp, Homo sapiens
gcccaggcccttgcagagcgggcttggagggaacagcctctgcctgcgctcacggggccggc

SEQ ID NO: 6763395 - DNA, 71 bp, Homo sapiens
aggtattagaagagtcatgggacccttgcagtttttgtaggactaacgctctctgtgacatttctgagcct

SEQ ID NO: 6763396 - DNA, 60 bp, Homo sapiens
tgggcaatggctctgatgttgttgtgacttctgatgtcaccaccagaagagctattctca

SEQ ID NO: 6763397 - DNA, 76 bp, Homo sapiens
ctgattgcagaaacagattgtaacctgatagcccggcccacctggcccgtcgtgtgccagtttctttgcagatcag

SEQ ID NO: 6763398 - DNA, 95 bp, Homo sapiens
ctgctaacagtatattgaacagtgcattcctgtccatattctagacactcctaaagcattggcagggatgcattacgtggcaataattatagcag

SEQ ID NO: 6763399 - DNA, 55 bp, Homo sapiens
gctccaggagagggaagcagattggcacagtcagttttggtcctggcttaggagc

SEQ ID NO: 6763400 - DNA, 95 bp, Homo sapiens
gacctatagaacaagcctgtgttgttttcagctattacatttgtggtcattagttatagtagcaacaagaaacaaatacactggcttttcaggtc

SEQ ID NO: 6763401 - DNA, 85 bp, Homo sapiens
aattacttcttgcattcctttataggaaaatgggaatccaaagcttttccccatttgccttagtggtaggaattcaagaataatt

SEQ ID NO: 6763402 - DNA, 78 bp, Homo sapiens
agaattaggtggtttggttttggtggccagctcaggcacagacttgctgccttgcttcaatcaaaccgtttggcctct

SEQ ID NO: 6763403 - DNA, 58 bp, Homo sapiens
ggttatcattgttgacatgattgttatcatgatgatgataatgatgacaatgacaacc

SEQ ID NO: 6763404 - DNA, 88 bp, Homo sapiens
gaaattagttctcagacagtatgatatatgaatacatttttttctctgtggattcataaaaatatcaactgtaaagggagatgctttc

SEQ ID NO: 6763405 - DNA, 97 bp, Homo sapiens
agcaaaggttggcgggcacctgtgtcagcccctgcctccactccacccctaacaagtatcaggtgcccacacgggcctgctgctcgcctcctgggct

SEQ ID NO: 6763406 - DNA, 56 bp, Homo sapiens
ggtcgactaatgtttcatttcatgtgcatgctaagtgaagctggttagtgatgacc

SEQ ID NO: 6763407 - DNA, 93 bp, Homo sapiens
gctttagctactattgtagtggccaaagaactcttgggaaaaagaccaagctatttcattttggtcactgctgggagctaatatatgcaaagc

SEQ ID NO: 6763408 - DNA, 70 bp, Homo sapiens
ttggaagggatggagggaaagaagtgaaaggcgggtcttagccttttacttctgcatttcccctagccaa

SEQ ID NO: 6763409 - DNA, 110 bp, Homo sapiens
gggacaggggacactgagaaaagattttgttgaactgagggacacctgacagccacttaagtggctcagtgcattcacagtaaaaactattttgccttctccccataccc

SEQ ID NO: 6763410 - DNA, 65 bp, Homo sapiens
ggcaatttgtctgcttgctgccttccctcgtgtctgggggtagctgcagcaggctggcaaatgct

SEQ ID NO: 6763411 - DNA, 68 bp, Homo sapiens
aactttctcttacacgatatttttacagatacactgcaggtgtataatatctgttaggagtgatggtt

SEQ ID NO: 6763412 - DNA, 86 bp, Homo sapiens
aagtggatggtcactgatccagtaaaagtctccattttacccatcttcaagactaaaactcagggctaggttagtggctaacattt

SEQ ID NO: 6763413 - DNA, 81 bp, Homo sapiens
tgggaatcttgttaaaatgcatattctggttctgtaggtaaaggatggaacctgagattttgcatatttaagaagctccca

SEQ ID NO: 6763414 - DNA, 85 bp, Homo sapiens
tggtagtgtcctcattctgggtttttgtcttctgtgtttactgtgacatgaagtcatttttagatgaaggttaaacattttgcca

SEQ ID NO: 6763415 - DNA, 63 bp, Homo sapiens
ttatgtattggctgtatgtacatctgttaccttttagtggcagagagagtgcagtcgacataa

SEQ ID NO: 6763416 - DNA, 69 bp, Homo sapiens
aaaatagatgaaaggaagtctgtttaaaaggatgagaatccaaggtatggatttccttttcagcatttt

SEQ ID NO: 6763417 - DNA, 71 bp, Homo sapiens
gtcctgctgctgtccagcctgaagagtgggggccacaggctcccagaaccaaggctggggaggcaggaggc

SEQ ID NO: 6763418 - DNA, 55 bp, Homo sapiens
ctcactgaaccttggcacctcatctgtcaaatgggcttggtgccggttacatgag

SEQ ID NO: 6763419 - DNA, 76 bp, Homo sapiens
atggaccatagcatagtcagcttcgctgattcagctcttttcactagtcaccgtggctgaactattttgtcaccat

SEQ ID NO: 6763420 - DNA, 59 bp, Homo sapiens
ccataggtggatttgtgtgatgagctaaggagtttcccaagcagatatcatcctaatgg

SEQ ID NO: 6763421 - DNA, 114 bp, Homo sapiens
cttttctttttaaaaatcccccttactatagatttgtatagatgtggttgaagtcacagatgccatattcttcatctttataatgcaagttttctttccaggtagaaggacaag

SEQ ID NO: 6763422 - DNA, 95 bp, Homo sapiens
gcgtgtcccccggacagaggggcagagtgtgccaggaaatgggaagaaacaggaactgacacagcactttgcccctcctttggcaggggagacgt

SEQ ID NO: 6763423 - DNA, 77 bp, Homo sapiens
gcagaatttattaggtttacataaaggttatggggaataaatcactggcttttatctttgcctggtatcacctttgc

SEQ ID NO: 6763424 - DNA, 98 bp, Homo sapiens
taatgtttttgttgtgtttgtgttctgacatgttttcaagatttataatttagttgtgtttctgtgatatgtaaacaggaagtagaggagggatatta

SEQ ID NO: 6763425 - DNA, 130 bp, Homo sapiens
ttattttgcctgttttagattcttccggaggacccctgggcttggttccaacctgtatccatcagctcctgaggttggccaaccagaacggaggtctagctgttcagtgatgaaaccggcctttgaatgg

SEQ ID NO: 6763426 - DNA, 55 bp, Homo sapiens
agtggaagaactgggatggctttctaaagtctcttagaaatgaagttctttctct

SEQ ID NO: 6763427 - DNA, 70 bp, Homo sapiens
gaggacgggggcacccacaaatgaggaaatggcagggtcaagttgggcgttatggagtgcccctcccttc

SEQ ID NO: 6763428 - DNA, 80 bp, Homo sapiens
gtcaccattaattactttatgctaaactttactctttaggtatatcttggagtatggggcagggtggggtggtggtggac

SEQ ID NO: 6763429 - DNA, 87 bp, Homo sapiens
tgatcagtttatttaaggtacagctagcagcatattcatgattttggtatgttttatacacatgtatcacttggtttaaactgagca

SEQ ID NO: 6763430 - DNA, 103 bp, Homo sapiens
atactgagaatacatttcctagagatgctgaaatctgagtgtagatttaaatgaatttcagtttgttttagatctctaataaggagaaatatagtctttgtat

SEQ ID NO: 6763431 - DNA, 71 bp, Homo sapiens
gactcatagggcgaggagacggaggcacagttgtcgtagacgatggccgagtcactctcgtcactgtagtc

SEQ ID NO: 6763432 - DNA, 127 bp, Homo sapiens
attgtcctaagccatccatacacaaaacgtttaatgtgttatggaaggctaacagtttttcagcttttctcaatactttcagccatccatacataaaatgtttaatgtgttatggaaggctaacagt

SEQ ID NO: 6763433 - DNA, 80 bp, Homo sapiens
ggagagtttcaagaagtatctatatgtatactcatggttggggttctagaggcattacatctaaatatttatgacttttc

SEQ ID NO: 6763434 - DNA, 74 bp, Homo sapiens
cctgttatgtgccacacttgagggtgatatggtttgaaagcaagtttctttccttaggtgctgggcagacatgg

SEQ ID NO: 6763435 - DNA, 129 bp, Homo sapiens
gatttttggaattgtcacaactgagaaacattgctggtggtgtatggtctgcaagtgtaaagatgttccttgtgaattgcttgcatccaacattaagggctggtttttaccttttattttccaatcctc

SEQ ID NO: 6763436 - DNA, 55 bp, Homo sapiens
gaggagttcctgcatattcttgcaccatcccgggtgctgttgctggggctctctt

SEQ ID NO: 6763437 - DNA, 64 bp, Homo sapiens
gatctgctctaatatcagatagactgcctttaaatggagtgagtttctgtaattagacgcattc

SEQ ID NO: 6763438 - DNA, 81 bp, Homo sapiens
gagtggaaagagcgggaggaacggctcgggcaggcaggtcctgtgctgtggtctaagtcacttcccacgtccgtcccactc

SEQ ID NO: 6763439 - DNA, 61 bp, Homo sapiens
cacgtatgtcttaggcttccagtgggtgtctttcccactgtggagaaagaaagactgcctg

SEQ ID NO: 6763440 - DNA, 78 bp, Homo sapiens
ggagaacagctgcctgtctggaggcaatgatagcagagacataatgaccttagcctccgaaaggcagctgcagaatcc

SEQ ID NO: 6763441 - DNA, 61 bp, Homo sapiens
gagtgcctatttttcaaacttgggattccaggaagttccaaggattgaaatgtagtcattc

SEQ ID NO: 6763442 - DNA, 59 bp, Homo sapiens
gtgtatgtgcatgtttgtgtgcatgtgcatgtgtgcatgcatgtaggatgcatctacat

SEQ ID NO: 6763443 - DNA, 74 bp, Homo sapiens
agctagggtggatatttgtaaaattctgtgtcttggctcaaaatgttaagactgctacaaaaatctactaagct

SEQ ID NO: 6763444 - DNA, 74 bp, Homo sapiens
ggttgatgcaaaagtaactgtgatttttggcattgaaagtaagggaaaagatcacaattacacttgcaccaacc

SEQ ID NO: 6763445 - DNA, 76 bp, Homo sapiens
attatttctcacatttggttcggtataaaaagggatatttactcaaatatatagaaaagcagatgttggaggtaat

SEQ ID NO: 6763446 - DNA, 120 bp, Homo sapiens
aggtgtttagaggcataaacagattgagacccagctaacccaatacctgtgcagggctttttctcagtaaaatgcttagcacagtgtttgactgcttcttgtcattgcctcatcccacct

SEQ ID NO: 6763447 - DNA, 112 bp, Homo sapiens
agggagatgggtagagattgatggcaccaggctctgagaggaatgtgagatctggtttcgtgtttaactccagagacctgctgacccagcattgtcctgaggaattctccct

SEQ ID NO: 6763448 - DNA, 84 bp, Homo sapiens
tcttctggaagcttcttagaaatgcagaatcttaggcctcagatttactgaataagaatctgcattttaacaagatccatagga

SEQ ID NO: 6763449 - DNA, 66 bp, Homo sapiens
gaggacaggggtggagtggggatatgtgcccgagccaccggggcagctgccactccgcttgccctc

SEQ ID NO: 6763450 - DNA, 65 bp, Homo sapiens
gaccgagactggactctgaagatgggtggcctggccagtcccgaacagtgtccaggcatttggtc

SEQ ID NO: 6763451 - DNA, 92 bp, Homo sapiens
attactgttatcattataaataactgtagaacaaaatgggctatttgtttagagatagcaaggcatggttgttttagagagtgggaggtaat

SEQ ID NO: 6763452 - DNA, 78 bp, Homo sapiens
tcaagctttcacgtaagtcatttaaggtaagctctctgagcagctttgaagtctgtgtcttttgaatgcaaagcttga

SEQ ID NO: 6763453 - DNA, 108 bp, Homo sapiens
ctcttcaaggctataagaagacttgggagaagagaaatgtctgagacttctgaactttggcagataaagttggtgttagagtttttcagctcccgaagccatcaggag

SEQ ID NO: 6763454 - DNA, 62 bp, Homo sapiens
tcatatagcattttgcaaaatggcagttagcaaaaaatggctgctcagtaaatgctgagtga

SEQ ID NO: 6763455 - DNA, 61 bp, Homo sapiens
tgctttgctttggagagccagcagtcataagctcaccctggaagagctctaaagcagccca

SEQ ID NO: 6763456 - DNA, 62 bp, Homo sapiens
cagcgttttataaggattgattagtgggacaagcagttcaggtaatcacttataagacaatg

SEQ ID NO: 6763457 - DNA, 72 bp, Homo sapiens
ttaagcttaacttgtcagaaaatacagtgtccagtgacaaactgtagaaatgtttttgacaaattaatttga

SEQ ID NO: 6763458 - DNA, 67 bp, Homo sapiens
gaagcatggagagctatttggacctccaggttaaaactgatgcagcctggagccctggcctcccttc

SEQ ID NO: 6763459 - DNA, 70 bp, Homo sapiens
ggtgggggtgggtagaagtgacaaaaattaaaaaaccaagaagtttagagtccctttctcaccaccctcc

SEQ ID NO: 6763460 - DNA, 103 bp, Homo sapiens
gaacaaacaccatcataagttgttatagtgtacatgtttctcttagactgtatggcacttaaagggctaatgtgtgactgggaacaacttaaaagaaaagttc

SEQ ID NO: 6763461 - DNA, 73 bp, Homo sapiens
gggtgccactggcatctagttggtaggagccatggagacttctaaaaactctacgatgcacaggattggcccc

SEQ ID NO: 6763462 - DNA, 63 bp, Homo sapiens
tttagtgttatattgggaaatgttttctaaaagaatagggtagctgccctttatgatgctgaa

SEQ ID NO: 6763463 - DNA, 85 bp, Homo sapiens
atgttcctgggctgaagtcaagtgtgggatattctgcttcttataaatatgtgcccacatccacgaatttcagtttaatatgcat

SEQ ID NO: 6763464 - DNA, 62 bp, Homo sapiens
tcctagaaggatcattctagtggctatcctacagccacttgagaggattgtcctagttggga

SEQ ID NO: 6763465 - DNA, 76 bp, Homo sapiens
gttctgtgtctgtctcttttggtattctcagacttatgtagtcatccatatagaaagatgattaggaaaataggac

SEQ ID NO: 6763466 - DNA, 76 bp, Homo sapiens
gagtgcaaagtgctttaggatatttggaaatggtttgttcctttaagtatttcaagtattccctttccttgtactc

SEQ ID NO: 6763467 - DNA, 96 bp, Homo sapiens
agaccagaggctccaatagggccagcttcatgagtgtacaacctgtgtagacacacagcacactattcttagaaggggcccatgtttgcttggttt

SEQ ID NO: 6763468 - DNA, 93 bp, Homo sapiens
tgctgggtcaaatggtagctctgtttaaagttctttgagaaatctccaaactgctttccacagtggctagaccaatttacattctcaccagca

SEQ ID NO: 6763469 - DNA, 71 bp, Homo sapiens
ataaaatggtaggttttcttaagaaaaaggatgttattcctggttctcagatggaaaacctttcagattgt

SEQ ID NO: 6763470 - DNA, 63 bp, Homo sapiens
ccgtggggtggcctagggcccagcctgtgtcaaggctgcgggcagggcactggtcccctgtgg

SEQ ID NO: 6763471 - DNA, 98 bp, Homo sapiens
ggcagagggcaggtgcagctggaagtgacactctgtgtttccctgcatccccctgaggtcacaggtcctcaagtcagctgggaagccgttctctggcc

SEQ ID NO: 6763472 - DNA, 61 bp, Homo sapiens
gcatattagtaatctttcaacaagcattagctgttattgctgttgatgatgatgatgatgc

SEQ ID NO: 6763473 - DNA, 85 bp, Homo sapiens
gagtacgcaggcctcctcccacggtctcaggaagcccagacgccgcaggcttccccgccgtagaggagctgccggggcgtaattc

SEQ ID NO: 6763474 - DNA, 60 bp, Homo sapiens
ggactgtgtgggccgctcactgggaggcgagggccttgacaagagcattcccacacctcc

SEQ ID NO: 6763475 - DNA, 69 bp, Homo sapiens
gaatttgactggagataatgctggcatacccaaaagctgcatgtctgcaaatatctgccagttctattc

SEQ ID NO: 6763476 - DNA, 130 bp, Homo sapiens
agataaatattgatagaatagtccaactagaatgcctgaggcctgcttggaattgaattttgaatgcatagaacaaaaatgtttcaattaagtcttttagttcaagttgtttggtttggtgttttgattt

SEQ ID NO: 6763477 - DNA, 75 bp, Homo sapiens
gggaggcagatgccttggccgtgacccatggctaaagctcagggggaatcaggtcacaggcctgcctgtcctccc

SEQ ID NO: 6763478 - DNA, 70 bp, Homo sapiens
tcctgtgggggcaggatgacactttgatcctcaaactctgctgtctcttctgcctccagctgtttcagga

SEQ ID NO: 6763479 - DNA, 70 bp, Homo sapiens
tctttactgtggtttggccaatgactgctgtttttaacatgccagttcctatgggcaaaacacaaaaaga

SEQ ID NO: 6763480 - DNA, 56 bp, Homo sapiens
ggttttgaagacagcagaggcctatgatctgttggctctctagatggcttccagcc

SEQ ID NO: 6763481 - DNA, 58 bp, Homo sapiens
ctccagagatccattgaatgtagtttgaaaataataggtttatatgatttctctggag

SEQ ID NO: 6763482 - DNA, 67 bp, Homo sapiens
ttgcttctgcagcccactaatgggtggcgatcacattgtacacagggaagtggctgggcagaagcaa

SEQ ID NO: 6763483 - DNA, 68 bp, Homo sapiens
cttgccccacccacctgacctcagcttctctgagtgagaggaatccaggacggtcgtgggttggagag

SEQ ID NO: 6763484 - DNA, 75 bp, Homo sapiens
agggaggcacagggccgccctctgtgctgaggccgtggaggaagccaggaggagggtggcttgctttgcttcctt

SEQ ID NO: 6763485 - DNA, 60 bp, Homo sapiens
tcacacatgtaagggctttggagtaagatggaccttggttatccaacgcttactgtgtga

SEQ ID NO: 6763486 - DNA, 62 bp, Homo sapiens
ggaggggcggctccgcgatgctctccccaccgctcccggcggcccggctggagcagctcccc

SEQ ID NO: 6763487 - DNA, 56 bp, Homo sapiens
gtctttctgccatgtgaagagacaaagggaagttggctctttgcaatgcagaagac

SEQ ID NO: 6763488 - DNA, 114 bp, Homo sapiens
ttctctgaaaacaaagaatatagtcaaatggcagggatattttggaggccattgataccgttctgaaattctctctccatagggctgctgtttttgctacttcctccaggagaa

SEQ ID NO: 6763489 - DNA, 69 bp, Homo sapiens
tgtgctccacactcccagtcctccaagtctgaaaataaaggtctccactgggaagtttggagagacgca

SEQ ID NO: 6763490 - DNA, 130 bp, Homo sapiens
tggcttttgcttgtttcttgaatataatcctgaaggcagaatctaagttttgtaactgatgatttatgaacattatttttgtctagaagaggtgatattcctacctactttgaaatcagcttggagtgca

SEQ ID NO: 6763491 - DNA, 69 bp, Homo sapiens
ctgtaatgcttctctggggagcacatgcgattgcttacttctttgtgcccattacacagaggcattcgg

SEQ ID NO: 6763492 - DNA, 69 bp, Homo sapiens
agtgttgctatatttattgtcttttaaatgttgtatcatacccaggagagagacagagaaagtaacatt

SEQ ID NO: 6763493 - DNA, 90 bp, Homo sapiens
gtgaggttgtggttgatttttccccctttccttttagtttcctaaatatagaattaatgggttgtagggaaagtcaacaattgttcttac

SEQ ID NO: 6763494 - DNA, 60 bp, Homo sapiens
acagcaggtgctgcctgtcaccctggagcaccaggcagggttccaaagcacccttgctgt

SEQ ID NO: 6763495 - DNA, 67 bp, Homo sapiens
agtgggtgtctcattattgtattcttagtttgtagcaaacttcctagcacatagtgggatattaact

SEQ ID NO: 6763496 - DNA, 67 bp, Homo sapiens
tttgttctaacttctgcagacatcaattttttcaagaaatttgtcatttgagagaagggaggagaga

SEQ ID NO: 6763497 - DNA, 103 bp, Homo sapiens
tctgtgtgctgaccttgggcgggcgtcctgagctcctcgcaggtgctgttgtagcagctgtgcagtaggtcagggctggcccccagtgcagctttgcacatga

SEQ ID NO: 6763498 - DNA, 129 bp, Homo sapiens
tgttactgcttcctgttctgagactccccttctggcaaccttttcctctcactcctcactgtttcttcggggtagaaaattaggatgaggcttgttaacatgggtggttcaagtctgggaagcttaatg

SEQ ID NO: 6763499 - DNA, 57 bp, Homo sapiens
tgggatgggtagggaggaactctgaggagactccaggttcttctctagttatcttca

SEQ ID NO: 6763500 - DNA, 66 bp, Homo sapiens
gcataggatgcagaatgttatcaaagttagaaaaatcactgctgagctgcactgtgctccgtatgc

SEQ ID NO: 6763501 - DNA, 89 bp, Homo sapiens
tgatctttagccagtttgtaccagtttggccgtgagtctgagtggttcagtgcccacgccacactggtggttaaatattttgaaaatca

SEQ ID NO: 6763502 - DNA, 89 bp, Homo sapiens
gaacacaacttatttgactttctgtggtcctcttgaaggtgattaatcaccaattttagagcaccaagaattgcacaatattaatgttt

SEQ ID NO: 6763503 - DNA, 57 bp, Homo sapiens
acatgtcttgtggctttgatctaagcctctgtgtatggttcataagcctcagacagt

SEQ ID NO: 6763504 - DNA, 73 bp, Homo sapiens
ccaggctctccaggagctcaggctctcagcacagtatttgcacctgtctaggctgctgccttggagagtgtgg

SEQ ID NO: 6763505 - DNA, 71 bp, Homo sapiens
ttcacagttgggcaggttgtgtactgtaccagggctaacatggtgcagtgcacaacctgctcaactgtgag

SEQ ID NO: 6763506 - DNA, 72 bp, Homo sapiens
ggcttaagatggtagctttgagcaggtttgatataaaattttagagaaaagcataggcatcatcttaaggcc

SEQ ID NO: 6763507 - DNA, 66 bp, Homo sapiens
ctagcttcaagtcctggctgtgccactaattccattagtgaacataacagctatggattgagttgg

SEQ ID NO: 6763508 - DNA, 64 bp, Homo sapiens
taagtcatacctctgcttgttttttagtgttttttcacaagacaagctaggaggtaattacttg

SEQ ID NO: 6763509 - DNA, 55 bp, Homo sapiens
taggacaatttataatgaatgggtgatgttcattctgtcacttaagaattgccta

SEQ ID NO: 6763510 - DNA, 100 bp, Homo sapiens
taagatgaagggttagttattttcacattacttggattaaaccccttttatttccttataggcttagtgtttaagtaataaagtagcagctctcagctta

SEQ ID NO: 6763511 - DNA, 98 bp, Homo sapiens
ctgcctgtagggcctcgtttctgtgcatggccatcagtgcccttctaggcataagaagtggtagctattccaggctggtaaggaggccgctggggcag

SEQ ID NO: 6763512 - DNA, 74 bp, Homo sapiens
aaagaatgctacttgactcagctcattggtcaaattagaatgtaacccagctggatgagtttgtagcatttttt

SEQ ID NO: 6763513 - DNA, 58 bp, Homo sapiens
ggggagaatcgaaaggaaggtagaatcgataggttcagctttgaggttgattttcttt

SEQ ID NO: 6763514 - DNA, 57 bp, Homo sapiens
gtgctcaattactgtatggattccacgagttgatgagcgtgctgtgaccttgagcat

SEQ ID NO: 6763515 - DNA, 71 bp, Homo sapiens
tagctatttggaaaattccaataaaatattttgactggtaagatatcgcagtggcctttttgaaatagcta

SEQ ID NO: 6763516 - DNA, 89 bp, Homo sapiens
gcccgaggcactatctgtcactcttggtgaatttgcaaatgcctatcatagaggcagtttcccaagagacagaatggtatcctttgggc

SEQ ID NO: 6763517 - DNA, 59 bp, Homo sapiens
gtgacaaaggtcaagcttttgagcatggtcaccatgtaataaagtctggactatttcac

SEQ ID NO: 6763518 - DNA, 77 bp, Homo sapiens
gaaatgcaaattcttaggctccatcccagactcatagaatcagtaactctgtggttgggcccaagaatctgcatctt

SEQ ID NO: 6763519 - DNA, 84 bp, Homo sapiens
agttgctaccggtaagtagaggagttgaaatttgtatccaggacaactgacccaaaagtctgtcctttaacttccatgcacgct

SEQ ID NO: 6763520 - DNA, 60 bp, Homo sapiens
ttctaggcctggcttgggcccagtccttgctggaagcttgaacagggccaggctctggag

SEQ ID NO: 6763521 - DNA, 76 bp, Homo sapiens
agagctttaaaaataggaaaatatttaacaagataatacttatttttagtctgtgaaatcatttcctgtaagctct

SEQ ID NO: 6763522 - DNA, 69 bp, Homo sapiens
tggttgttgttgccactgaaccagtcttgcacaagcctgtgtacctttttctgtgcatgctctcaacca

SEQ ID NO: 6763523 - DNA, 55 bp, Homo sapiens
aaagcactttgagactgacaggtgtttatgacctgtgcacattttccagtgcttt

SEQ ID NO: 6763524 - DNA, 56 bp, Homo sapiens
gtaagacaagcggactgccgttcacacctacttgagggactggaagtttgtcttac

SEQ ID NO: 6763525 - DNA, 68 bp, Homo sapiens
caagggcaggagaggatggatgtctcagctcaagcagagaaaacaaactcaccctttctctgcctttg

SEQ ID NO: 6763526 - DNA, 90 bp, Homo sapiens
tggacttccgagctcatactcttcacctctagcttgtcccatgagatggtttcagtctcagaggtgggagtggggcttgggaaaattcca

SEQ ID NO: 6763527 - DNA, 76 bp, Homo sapiens
agctgtattcaccctgcctcctagttggggcaccacactagttccaaatgggggaaactagggcaagactggagct

SEQ ID NO: 6763528 - DNA, 59 bp, Homo sapiens
aggcctgaaggaagatgagctgatggcattcccagcttattaccactccttgggggcct

SEQ ID NO: 6763529 - DNA, 74 bp, Homo sapiens
gcagcagtgtgtgtgtgtgtgtgtgtgtgtgtgtgtgtgtgtattcacatgtacatatgctcatgaactgttgc

SEQ ID NO: 6763530 - DNA, 74 bp, Homo sapiens
cctcccagctaagaggtcacttggtttgggcttcattaggactgagactttgttgagttctttctgggacttgg

SEQ ID NO: 6763531 - DNA, 63 bp, Homo sapiens
gctttaagggccagatccagcatgataattttgctcagctggttcccactgggcctgtaaaac

SEQ ID NO: 6763532 - DNA, 104 bp, Homo sapiens
cgccctcagctgtcgctccttataaggcgggggccgggcggcgccggaggaggggccgcggcatcagcccggtcctgggctctggggcggcgctgggccgggcg

SEQ ID NO: 6763533 - DNA, 63 bp, Homo sapiens
tctagcagggaaagcagagaataaacaaacaaatatattttcagtgtgtgatacctgctgtga

SEQ ID NO: 6763534 - DNA, 130 bp, Homo sapiens
cttccatttgtcctcatttcttactgtggctccattcacatgcccaagcagcaccagggcaacacatagtagcaggagaggtgctctggtcatggtggagtgaagctgagtgaaagaggggatgcgggag

SEQ ID NO: 6763535 - DNA, 84 bp, Homo sapiens
gataaggcaaattggataacacattatgcctagatgttatactatttacagtcttagtctctattgtgtttctattgcctcttc

SEQ ID NO: 6763536 - DNA, 79 bp, Homo sapiens
gagctctgtgcggggccagagtccaaagtcttcatttgctcaatgtaaatatccacactgtgtccctgccactcagttc

SEQ ID NO: 6763537 - DNA, 79 bp, Homo sapiens
ggccttcaaagcaaaggtccagagttgagatacagaagcaatgaggcatttgtgaaagtctttgaccttagcgagggcc

SEQ ID NO: 6763538 - DNA, 62 bp, Homo sapiens
atttggcacagcttttcctaccgtggcaagcaacttgtcccattctgaaaagtgtgttaaat

SEQ ID NO: 6763539 - DNA, 79 bp, Homo sapiens
tcccttctctttaatcaggcaaagcataatagatatccatgtcttattatgaagacagtctgcatttagaaagtgggga

SEQ ID NO: 6763540 - DNA, 64 bp, Homo sapiens
ggatggtgtcatggctgaaagtgggggctctcaagcttccgtccacatcctggctgtgccattt

SEQ ID NO: 6763541 - DNA, 64 bp, Homo sapiens
acatttcttcctaattatccctattgtgggtgatgaaattgacagggatggtaggggagaaagt

SEQ ID NO: 6763542 - DNA, 63 bp, Homo sapiens
catctgagatttaatggctaatctgttcagacagctgcttcttagccattaaattacaaggtg

SEQ ID NO: 6763543 - DNA, 76 bp, Homo sapiens
tcctgtgttctgctcacaaaccagcctgacaaccagacttatctgccagagtttgcaagggcagaagcccgcaggg

SEQ ID NO: 6763544 - DNA, 57 bp, Homo sapiens
gtttcttaggtaaattctttgagctgagagacaagttagagaattccctttggagat

SEQ ID NO: 6763545 - DNA, 58 bp, Homo sapiens
tggagtgactcacagctgggacaaaggtccactcgctcttgcccctgcagtctaccca

SEQ ID NO: 6763546 - DNA, 68 bp, Homo sapiens
caatacttcaatctcgttcttatgtaatgagccttaattaaccaagtgctcctagaatgagggtgttg

SEQ ID NO: 6763547 - DNA, 119 bp, Homo sapiens
gcctttgaaggcagcagtccttgatatttcttaggctgacttgtttcataaagatttctaaaagagtttttagagagccagtgagccccgtgatttatgatgattgctcaagcagtggc

SEQ ID NO: 6763548 - DNA, 67 bp, Homo sapiens
agcacagtttgggtctccggggcattgagaaagaattagaaagtgtgtggggagctagactggagct

SEQ ID NO: 6763549 - DNA, 100 bp, Homo sapiens
gcttgttttaaatgttaagagtataattagtgtcttctaaagaaactaaatttactttttcttgtagaagcaagttttgctcttcacgcacacaaaaagc

SEQ ID NO: 6763550 - DNA, 56 bp, Homo sapiens
tgttcaacagagccttctggggcaatggaaatgttctagatctgcactgttggaca

SEQ ID NO: 6763551 - DNA, 67 bp, Homo sapiens
ctgcatcaatgacaatgattttttagagtagtttaaaatgaaacttttcattgaatcatgtcagcag

SEQ ID NO: 6763552 - DNA, 65 bp, Homo sapiens
aggcaggctaccctaggtcttggtggttgctgctgcctcgctgtgtgaccttgggtgagttgctt

SEQ ID NO: 6763553 - DNA, 57 bp, Homo sapiens
ggtggcattcagtaagtatataaatgtactcacagcttttatttactgtgtgttacc

SEQ ID NO: 6763554 - DNA, 84 bp, Homo sapiens
agtgcagagaacaggtagggctatgtgggcatgtgacttgtgcagtcacacagggttctggtctcatacttgctttcatgtgct

SEQ ID NO: 6763555 - DNA, 94 bp, Homo sapiens
aatgttgagtgtacaggttaaatcccattataacgaactccaggggactggccaaattattttgttgtactgggattagactttattaaatatt

SEQ ID NO: 6763556 - DNA, 66 bp, Homo sapiens
gtgggtgggtagaggtgatagaagcagtgtatttgagagagctcacaactgtcaccgccaccacac

SEQ ID NO: 6763557 - DNA, 68 bp, Homo sapiens
ggctagtttcatcgccttctctctagggactttgtgtctggatctgacaaggacgggaaaccacagcc

SEQ ID NO: 6763558 - DNA, 60 bp, Homo sapiens
gtactgaatggggcagtaagaaaggattaagcatcactttctagactgctttatttttac

SEQ ID NO: 6763559 - DNA, 68 bp, Homo sapiens
aatgagcggtcaggagaaataagcattgtttgttcaatgcatgattttttcttacttaggagtttgtt

SEQ ID NO: 6763560 - DNA, 83 bp, Homo sapiens
gaggcaggagaatcacttgaacccaagaagtggaggtcactccactgcattccagtctgggcaacagagtgagactccgcctc

SEQ ID NO: 6763561 - DNA, 69 bp, Homo sapiens
gcctggcagctacctggcagctctcctccagccaagacaatggaagaggtggttcaggtagagcccagc

SEQ ID NO: 6763562 - DNA, 64 bp, Homo sapiens
gagctgggctctgcggtgtcgctctctgggactggagcggtgaggacgcagaagccccaacctc

SEQ ID NO: 6763563 - DNA, 81 bp, Homo sapiens
cttccagcccaggagacagggatggcctggagaggtcatgggaccctgtggggccatctcagtcacctccagccagggaag

SEQ ID NO: 6763564 - DNA, 71 bp, Homo sapiens
agacaggctgtttgcatagcatgtttgcatcagtaaaatattgaaaatgacatttgtgcccaagtccatct

SEQ ID NO: 6763565 - DNA, 72 bp, Homo sapiens
tcagcacgggcataacgggcagccaggtgcaaagcagtctcgccagtacggtcagtccgtgccccaagctga

SEQ ID NO: 6763566 - DNA, 85 bp, Homo sapiens
gttgtttgttcaagctcaactgaaagcttttaaataacccaattagtaatcaaaagctgaatgcaggcttgattattcagacaat

SEQ ID NO: 6763567 - DNA, 69 bp, Homo sapiens
ctccaagcctcagtctctctatctgtaaaatagggattctaatattacacttagagggttgttttggag

SEQ ID NO: 6763568 - DNA, 64 bp, Homo sapiens
gtctcaggatgtgggttttcacattgtgtgtctcgcacagtagtacacatctatgtcctcagat

SEQ ID NO: 6763569 - DNA, 84 bp, Homo sapiens
gaccctgggtacccagaagaggtttggccccttcccagcaactatgatgggaccctcaacatctgcttctgggttggatgggtc

SEQ ID NO: 6763570 - DNA, 70 bp, Homo sapiens
ttcctaccagcttttgagcctgcctactttcaatgaagccagcagggcccaaatgctggctctctaggaa

SEQ ID NO: 6763571 - DNA, 103 bp, Homo sapiens
tatctgaatgattcatctgccagagttgctagaactacatcttttaatagaccaattattgtggttaggatttggctttagtcaggtgatgagaaattagata

SEQ ID NO: 6763572 - DNA, 111 bp, Homo sapiens
gtggctgggcatggtggctcatgcctgtaatccctgcaactctggaggctgaggcaggaggatcgcttgagccccggagtttcaggctgcagtgagctatgatcacgccac

SEQ ID NO: 6763573 - DNA, 82 bp, Homo sapiens
tgttaaaatgctgtgtccagggccttacctcttcagattctgactcaatctggggtggagccctggagtctgcattttaaca

SEQ ID NO: 6763574 - DNA, 61 bp, Homo sapiens
ctacatcttgacccaacacccaaggatgtctttggacatgtctaggatcagtcaggatgag

SEQ ID NO: 6763575 - DNA, 68 bp, Homo sapiens
gccgccagggccactgcatgaggttcacacacccgctgattgtgattctgccccttggctctggcggc

SEQ ID NO: 6763576 - DNA, 61 bp, Homo sapiens
ttccacatttttgatactctcactctgccacagcgagtgggcttactgagggagtgtggga

SEQ ID NO: 6763577 - DNA, 57 bp, Homo sapiens
gcagaaactgaggagttagactagggatccccaagggccctttaagctttagtatgc

SEQ ID NO: 6763578 - DNA, 71 bp, Homo sapiens
ttttgaaaatatgttcagaaaacattggaatacatgtagtatgtgtttctctgcttcagaacttctcaaga

SEQ ID NO: 6763579 - DNA, 78 bp, Homo sapiens
cttggagaatttaagcatgccatctgtttggatgaagatgcaaataatcgcaaacattgggggcttcaacactctagg

SEQ ID NO: 6763580 - DNA, 65 bp, Homo sapiens
tggtagtgcttaacagttattcactgtatgaatgaatgaatgaatgatttcttaggcaattgcca

SEQ ID NO: 6763581 - DNA, 89 bp, Homo sapiens
cagagaaggaaagggaatccatgatttgagagcagccggcttcactgaactggtactgttctgcggatcagaagctaagcctgtatctg

SEQ ID NO: 6763582 - DNA, 56 bp, Homo sapiens
ctcccaggtgtcccttctgccaccccagggcttggcgacatcagggatcctgagag

SEQ ID NO: 6763583 - DNA, 85 bp, Homo sapiens
cagctgtccaggggtcacctgcctgggtggtcacctgcctgggtggtcaggctgtctcacctcaggagggcccccggaccagctg

SEQ ID NO: 6763584 - DNA, 63 bp, Homo sapiens
tctggggtttaaagagtaacgacatttatctctgaaagttgatggcgtctttgagatttcaga

SEQ ID NO: 6763585 - DNA, 61 bp, Homo sapiens
tttcaagcacagagcaactcaaatcagcttccccggaactgggatccagatgctcttgaaa

SEQ ID NO: 6763586 - DNA, 84 bp, Homo sapiens
ccagggtttcatatatgcaataataatttggtgtctttaaattaaatttctggcactgtattttgggtgtattttcttttctgg

SEQ ID NO: 6763587 - DNA, 74 bp, Homo sapiens
ggaggtggaaagctagtttttcttagttttaaatcattaagggtttatatctggagttgctaggagctattttc

SEQ ID NO: 6763588 - DNA, 89 bp, Homo sapiens
gaaatgataatgtgtgtaccattttgaaacatttcatcatttgttaatgtgacatgaaagtccagatgtgtccatacagtggtaatttc

SEQ ID NO: 6763589 - DNA, 61 bp, Homo sapiens
gccgttttctgttacaaagtacagcgatagttttttcctgtgctctttagccgaggaccgc

SEQ ID NO: 6763590 - DNA, 108 bp, Homo sapiens
cctccagtggaagattctactttattcaggaaggctggtggcttgcaggggctaggcttacacaagccagccaagattgagaaggtaggggagtgctttcaatggagg

SEQ ID NO: 6763591 - DNA, 73 bp, Homo sapiens
gccattgatgcattcattcattcattaggtatgtagtatgtactgctgagctgggtagaaggaatacaatggt

SEQ ID NO: 6763592 - DNA, 59 bp, Homo sapiens
gtgtggcacctcctttccagctcctcagggaatgtgagacatgtgaggagctgccacac

SEQ ID NO: 6763593 - DNA, 77 bp, Homo sapiens
tctcctttttctccttctttctggttatgcagttcctgtccctgactttggataagaaaatgagaaaaatcaggagg

SEQ ID NO: 6763594 - DNA, 78 bp, Homo sapiens
agatgaaatcaaatgaggttaatacagtgcttctgtaactctatttgaggcatatgtatttgcattcgtttgttcact

SEQ ID NO: 6763595 - DNA, 91 bp, Homo sapiens
tgttttcaacttttcctctattgtctgaaagtttgacgataggaatttctgaagtaaacttgacagtagacagattaaatagaagaaaaca

SEQ ID NO: 6763596 - DNA, 60 bp, Homo sapiens
gtgagaagtggtttacaatttctgcattttattttaatatgtactgaaactgcttttcat

SEQ ID NO: 6763597 - DNA, 81 bp, Homo sapiens
agatgtttcctaactggcctttatggataagtttgctaacctgtactctagatcacgtgaagtccataatagtttatattt

SEQ ID NO: 6763598 - DNA, 92 bp, Homo sapiens
ggctcggggaggaagcggtggtttctctttgaagcctggctgcaacaagtccaggagcggccaaattgcagagagaagctgcctccccagcc

SEQ ID NO: 6763599 - DNA, 72 bp, Homo sapiens
ctgggatccaaaatttactgtagcatttcattgacttacagctagtgtgaccatagattttggattttctag

SEQ ID NO: 6763600 - DNA, 69 bp, Homo sapiens
gccttcaagtactgcatttatcaagtggcgaaattaatcaggtattgattaaatgcatgaatgtaaggc

SEQ ID NO: 6763601 - DNA, 60 bp, Homo sapiens
ttgccatttttctttgactgagtccattgatatcagttggctgcaaaggaaaagtggtga

SEQ ID NO: 6763602 - DNA, 71 bp, Homo sapiens
agaacgtgagaaggaaaggatcagtgtctatcttcagagaccaggcttaatcctttgctatccaaacgtct

SEQ ID NO: 6763603 - DNA, 78 bp, Homo sapiens
tagagtgcgtattggcttatttccttagatgatgttctcaggagtggaatgaataacatctgaaaaggcttcactcta

SEQ ID NO: 6763604 - DNA, 73 bp, Homo sapiens
tctccaagatgtgctctgcaatcagttcttttttactctataaaaaacacactgagaatagagacattgggga

SEQ ID NO: 6763605 - DNA, 110 bp, Homo sapiens
ctcccagtctttgtctatatctatacttactttgaatgtcacaagcaaatgagctgacaccatcattgcaaagtgtcatgcaaagtaagagagctacagtgaaaagggag

SEQ ID NO: 6763606 - DNA, 60 bp, Homo sapiens
cctgattagggtctttcaaatgctaaccagccacctctagaatgtggattcctgattagg

SEQ ID NO: 6763607 - DNA, 59 bp, Homo sapiens
gcaaggctgccataaaaggtgttaatcatgtcatttgctaccattaatgtaagctttgt

SEQ ID NO: 6763608 - DNA, 112 bp, Homo sapiens
ccaggagagcacagcagggcttctggtgggaaaacaccctgtgtcaaggtagtagatgcacagggctcagctggcagggttctcactgaaatctagactgcacctttccagg

SEQ ID NO: 6763609 - DNA, 62 bp, Homo sapiens
gattcacactttacttctttccaagtggtttattgatttgtggattcagtgaaatgtgcatc

SEQ ID NO: 6763610 - DNA, 74 bp, Homo sapiens
gtatagttgttcacagaatatctaatgtcagagcgattcattatgttgacgttttatagtctttccaattatac

SEQ ID NO: 6763611 - DNA, 78 bp, Homo sapiens
ggggcagggcttgatgtcaggctgaaaataggagaattaaggaaaagtctgtactcagctcagatctcaggatgcctc

SEQ ID NO: 6763612 - DNA, 73 bp, Homo sapiens
ttacaacttgcagaggatgttgctttagagacaaaataagtatgtggggagtaaatccctgccattgttgtaa

SEQ ID NO: 6763613 - DNA, 66 bp, Homo sapiens
ataaaacccatgggagccaattataatgctgttactcctccagcagaggttcagcctgtgttttat

SEQ ID NO: 6763614 - DNA, 110 bp, Homo sapiens
agtaagttggccaaagtcacacagctaggaggcagcagagccaggatttcaatctccaggctctaggctgctctccatggagctgttgaatcacacattttgtccttgct

SEQ ID NO: 6763615 - DNA, 113 bp, Homo sapiens
tgctctccctactgactctgaaaattggacgtagctactccattaccagaaaggatttggtttagtcccctcttggatctctagtttccaatttaaagtctggggcaagggca

SEQ ID NO: 6763616 - DNA, 79 bp, Homo sapiens
gcctagcagtgtcagtgtggaagcagatgggtgagcgaatggcgttgtcacacaaggcccacgggggaagtgctaaggc

SEQ ID NO: 6763617 - DNA, 76 bp, Homo sapiens
ggtaaattttatctgtattattacaaggaatgttgactttaaagtccatttagtctgatatggatgaagctatgcc

SEQ ID NO: 6763618 - DNA, 65 bp, Homo sapiens
ggtagcatatgcagttttacagatgaagaaactaggatgtaacttgcctgggactcaatgctact

SEQ ID NO: 6763619 - DNA, 64 bp, Homo sapiens
gctgcttcctagaaggcccagttcaggtgcataagaacctcacagtggagctttctgggacagt

SEQ ID NO: 6763620 - DNA, 128 bp, Homo sapiens
aagcagtcacttgacagaagtctggaagctaagctttgccctaggtgagcacattttcccacttctctaatagatgtgaaattcttcaggttaacttgtcttttgagagatgactgtaccatctgctt

SEQ ID NO: 6763621 - DNA, 126 bp, Homo sapiens
tgcacttctgttcaggcatctctagggctggctggaccacccctccctgctcctcaactggcaggatctgcaaggtgctggcgagggtggcggggccagccatctccagggacaggacgcagtgca

SEQ ID NO: 6763622 - DNA, 62 bp, Homo sapiens
tgtgaatttctggaccctttgagaagagtgagctataatttttctctatccaaagatttata

SEQ ID NO: 6763623 - DNA, 86 bp, Homo sapiens
aaggccagagcacagattgatttaaaatatttgctacttattgttttctaaaagcttttatgtttatattaatttgttgctgtctt

SEQ ID NO: 6763624 - DNA, 73 bp, Homo sapiens
gctggcaagggccctgtctatgtatcctctatatctatgtatgtattggtcatgtcacagagctccttggagc

SEQ ID NO: 6763625 - DNA, 79 bp, Homo sapiens
gtctgatatgtgcagtgactcacaggaaggaggccagtattagcctccttcagctgaatccctgctccaacatatttgc

SEQ ID NO: 6763626 - DNA, 85 bp, Homo sapiens
tgtgtcaatcccagatctacctctatgcatgaaggtattaagcatgcatgatgactaaggtggtgatggttcagcgattgacgca

SEQ ID NO: 6763627 - DNA, 95 bp, Homo sapiens
gaaagaaattagttctaagttatttcctcgtgactgaaattgcaaatgtcagattccattacaagaggctgagatggaaagagctcattcctttc

SEQ ID NO: 6763628 - DNA, 64 bp, Homo sapiens
tgccctaggaagcccttctgccatagtaaacagcctcacatggcttccaaagggctcttgggca

SEQ ID NO: 6763629 - DNA, 59 bp, Homo sapiens
ttggttttgtgtgaaagcgtggaaactttcacagtttccacactttcacacgaggtcaa

SEQ ID NO: 6763630 - DNA, 67 bp, Homo sapiens
ataaagtagccactggaaagctgcctaataatgtgacacagacaatgatttgcagtggttcctttgt

SEQ ID NO: 6763631 - DNA, 71 bp, Homo sapiens
ttgggaggtgaagttaatgcattagcacatccctcgtatgcattatacattaatttctccagatattccag

SEQ ID NO: 6763632 - DNA, 105 bp, Homo sapiens
cttttgagttattatatttcttcctcaatgtctgtaggtgtaatagagcttaaggctaggttcctatttgcctatggaatgtgctagaaaggaaatattcaggag

SEQ ID NO: 6763633 - DNA, 77 bp, Homo sapiens
tcttaatcattggctgcctgtggatcgcattgtttagcctgagagtgcccatgggtccagaggtgctaatttttaga

SEQ ID NO: 6763634 - DNA, 73 bp, Homo sapiens
ctcaagcctctggggcctcatctgtaggatgaaaatcatagcaggtctgccagcgcccatggagaggtttgag

SEQ ID NO: 6763635 - DNA, 66 bp, Homo sapiens
ggaatcctttcattttttctcatctgtgaagacaaatcttccagtgtttctggcaaatgaaagtcc

SEQ ID NO: 6763636 - DNA, 78 bp, Homo sapiens
aatgtttaaggaactggtttgctaactcatttcttaatgacaagaattaagccagcacagcctctggtttctgacatt

SEQ ID NO: 6763637 - DNA, 80 bp, Homo sapiens
gagtaggtctcagtagtcaagctacaggagccttccttatcttcaagaggcagctgagcatggctacctttgctctgctc

SEQ ID NO: 6763638 - DNA, 104 bp, Homo sapiens
ctttcttctgcaagtggtctcagagttccagtgtgagagaacatgaggccttcatcttccataatcatcactggagagttcatgacacatgagacagaagaaag

SEQ ID NO: 6763639 - DNA, 90 bp, Homo sapiens
aatttaacagatgcttactatggttgtatgtgtagatgtgtacatgtgagcatacccatttgtttcaggagcacaaatttctattaaatt

SEQ ID NO: 6763640 - DNA, 130 bp, Homo sapiens
aaagaaaacttctccttatctactatttagttatttaagatttgtagagaaaaagcaaaacaaatgttgggctctttctattttgcactggttttcaaaacaataagttggttaggagatgatgttcttt

SEQ ID NO: 6763641 - DNA, 67 bp, Homo sapiens
tgggctcagccaagccctgaaggcaacaagataccatccctcctgcccaagtgtttggctgagtcca

SEQ ID NO: 6763642 - DNA, 72 bp, Homo sapiens
gctaagcttcatacagtggctgcactccagccagtaaaaaggctggagtgcagtcactgtgtgtagcttagc

SEQ ID NO: 6763643 - DNA, 65 bp, Homo sapiens
tgggagcctggcaggccagagggacattcacatatcacacctgtctggctatatgctggcttcca

SEQ ID NO: 6763644 - DNA, 129 bp, Homo sapiens
gcattctgaaaaacttttaagttgacaaacacagtaacagtttgggttccaattgcactagaaaattcagtttaataacccatagcttttatagccagttgatattttaaaaaataaacagatccatgt

SEQ ID NO: 6763645 - DNA, 64 bp, Homo sapiens
gggaggagtgaagattcacctgcttattcacaccgtcacaatcagaagtcctttcactcttccc

SEQ ID NO: 6763646 - DNA, 130 bp, Homo sapiens
tggtgccctaggcagggctcatagcggcagaggcaggaatggattcgctgtgagctgggtcaggcttgctcctgcccttcacgatggtatcttaggtcctgccacctgtgttccaggcgtggggtcacca

SEQ ID NO: 6763647 - DNA, 56 bp, Homo sapiens
caattacccataggcagccgagcttcaaagctcatgttttaatcctgtggtaactg

SEQ ID NO: 6763648 - DNA, 77 bp, Homo sapiens
gggtagaaatggcaatgtggcttatttggaggattgtatattttgttttctagaatgttccaccttgtttcctactt

SEQ ID NO: 6763649 - DNA, 92 bp, Homo sapiens
agatgcttgggcagtaatcagatggcagtcaaccaggtgaggaggtaacagatcttcaatgaaattccatcagaaaaattgcttgatcattt

SEQ ID NO: 6763650 - DNA, 59 bp, Homo sapiens
cctggccacatcaacatgagtttggcaatctgctgtacaagtgaaagatgtgggctggg

SEQ ID NO: 6763651 - DNA, 98 bp, Homo sapiens
attgaggacttttgtagcagtacttggtcaaggaagcaggaaagttcactaaaatattattgttcttgccaagacatgaagcactgagagtttacagt

SEQ ID NO: 6763652 - DNA, 121 bp, Homo sapiens
caggaggccttcctgtccctcctcctctgaaggctgagacgtgcggccttgcctcggctttgcctgcttgtaagacacagtccgcactctctacctccaaggaaccccggggttcctcctg

SEQ ID NO: 6763653 - DNA, 60 bp, Homo sapiens
cagatttttcaagtcagccatggttcgaaacccagcttcaacacctggctgtgtgagctg

SEQ ID NO: 6763654 - DNA, 65 bp, Homo sapiens
agtccttacacctggaacctataatccaaccttatttggaaaaatgggtctttgcaggtgggatt

SEQ ID NO: 6763655 - DNA, 68 bp, Homo sapiens
gagatcaggactaaggggtggccagggtcagatctagaagacttgggccatcccatagtcaatacctc

SEQ ID NO: 6763656 - DNA, 72 bp, Homo sapiens
gatatggctgcccacgttggtgcttcccggactccccaagaggtgatggagcattacgtgagcatgtacatc

SEQ ID NO: 6763657 - DNA, 66 bp, Homo sapiens
gggaaggcaggcctctgttggattcagctctgacttcaagaggcaaaacagagcttgctgtttccc

SEQ ID NO: 6763658 - DNA, 67 bp, Homo sapiens
gggctggaggagagtctgaatgacagtccccatgctatactctcatttacttctctcttccaagctt

SEQ ID NO: 6763659 - DNA, 58 bp, Homo sapiens
cgggcactgccaggcttcccagaggccgaggtacccgggcaatgggagtctggccccg

SEQ ID NO: 6763660 - DNA, 61 bp, Homo sapiens
ggtacatattgtagcttgattaggtggctctgaaatctgagaagttacattgtattgtacc

SEQ ID NO: 6763661 - DNA, 64 bp, Homo sapiens
gagaccagaacattgttttctcatctgtgcttccactagatgtgatataatcttccacggtttt

SEQ ID NO: 6763662 - DNA, 61 bp, Homo sapiens
agtgataattgcagagaaaggagaaagcagaaggcttgttctacatactgtatttctcgct

SEQ ID NO: 6763663 - DNA, 83 bp, Homo sapiens
atcagctctcccgaatgatcatggaagcctatcttgagaggcagcctttcaagctcttcagtgttatttgtggaaagtatgat

SEQ ID NO: 6763664 - DNA, 77 bp, Homo sapiens
gcagggtgaggaccagcagccacagctcttccaggcaagtccctgagatgctaaagggctgctcaaggtttatctgc

SEQ ID NO: 6763665 - DNA, 91 bp, Homo sapiens
tggttgaatgaaaaatggcttttcacagagggttctgagcaaatgaatagaacagaatttcccagaattggccgtttaaaaaatacgatta

SEQ ID NO: 6763666 - DNA, 104 bp, Homo sapiens
gagaatgcagggatagcaaattctatatccaactccagttcattgatagttgctatctggaatagcatggggttgagaaggattatgaggctatgtctgagctc

SEQ ID NO: 6763667 - DNA, 63 bp, Homo sapiens
catgctctccattggacacagagcttacagcacacctgctaggtgccaggcacggagtgcatg

SEQ ID NO: 6763668 - DNA, 92 bp, Homo sapiens
ggattcgcagttgaatgatttatgtgtgacttaggaaaggagataattgcaaaactatttctaatctttagttacaaaatgaactgtattcc

SEQ ID NO: 6763669 - DNA, 73 bp, Homo sapiens
ggaagaggctctcattgagggctgaggtcctgggatacagaattgagtgagacctgggtgggacccctcttcc

SEQ ID NO: 6763670 - DNA, 61 bp, Homo sapiens
gcactagaagtacgccttgtaaaaagtaacagtgctgggaaaaagggtactttaagagtgc

SEQ ID NO: 6763671 - DNA, 77 bp, Homo sapiens
aagggttctgtttgatttttaaaaaggtactttcttttgtaattaggtgcaaaaaggaaagcacagaaaggactctt

SEQ ID NO: 6763672 - DNA, 90 bp, Homo sapiens
gctggagggaggctgttaggagggactctgagcttcacacctgtctgctgccatgggtgcagagccctagtcctgatggcccctggtggc

SEQ ID NO: 6763673 - DNA, 68 bp, Homo sapiens
ttcctacaaagtactgtttaaattgcagaacaatttccagttccactgtagcaaaaagtacttaggaa

SEQ ID NO: 6763674 - DNA, 55 bp, Homo sapiens
gcccggcaggagtgggcccggctcccgggtggcttgggcccagttcccgctgggc

SEQ ID NO: 6763675 - DNA, 80 bp, Homo sapiens
gctgtgaatgtgaccttatttggaaatagggtctttgcagatgtaatccgaggtaaaatgaggtcatgctggttcagggt

SEQ ID NO: 6763676 - DNA, 79 bp, Homo sapiens
gggagctcaggcctgaggaccttctggaggccaggcgctggaggtgccctcttcactgtggaggcctcagcaagttcct

SEQ ID NO: 6763677 - DNA, 75 bp, Homo sapiens
ctcctacaatgagcagttcttcgggccagggacacggctcaccgtgctaggtaagaagggggctccaggtgggag

SEQ ID NO: 6763678 - DNA, 130 bp, Homo sapiens
cctttgggggcatattgcagattgtatatatgggagaacgtgttatgcatgtgtatgcagctttcttgcatgtatatgtgcacatgtgcttctgtatggcttgatcctcaatagcctgcttctttaaagg

SEQ ID NO: 6763679 - DNA, 71 bp, Homo sapiens
ggctttcagggttgtggtggaattcagttattttcagttgtaggacagaggtccctatttctttgttggct

SEQ ID NO: 6763680 - DNA, 82 bp, Homo sapiens
gctttttaagtcgacatacattttctttagtagacaaggaatgatactcctgttagtaatgaagagaatggtcaaaaaaggc

SEQ ID NO: 6763681 - DNA, 59 bp, Homo sapiens
gcgcctgtttgtgttctagtctggggacttggtctcgtttggaacaagcagcagtttgc

SEQ ID NO: 6763682 - DNA, 103 bp, Homo sapiens
tggaggcagcacgcactggtctcccagctgtccatccacttcccagcggggctggctgtgcgtggggacagctgggtggagggtggagggcctcgctcctcca

SEQ ID NO: 6763683 - DNA, 63 bp, Homo sapiens
gctgcatctgtcagcctgggattaggggccagtggtccacgctcatcctctctgagaggcagc

SEQ ID NO: 6763684 - DNA, 100 bp, Homo sapiens
aagccatatggtttatcgggctttctggttctcaaagcacttttccatgtgaggaaaaggctaatatttatgaaaccaaggtgccgagctatatacgttt

SEQ ID NO: 6763685 - DNA, 87 bp, Homo sapiens
gcagcttcccttgcccatgtgtgtccatgtgactaagttctggccaatggaatgtgagtgataatgatacatacagagggaggctgc

SEQ ID NO: 6763686 - DNA, 63 bp, Homo sapiens
agagcgggagtgttgagcgccctgccaggtttgtgcactctggcccagccccactcctgttct

SEQ ID NO: 6763687 - DNA, 92 bp, Homo sapiens
cttatgcgcctcctgcccacaggaagacaccagcggtgactacaagaacgccctgctgagcctggtgggcagcgacccctgaggcacagaag

SEQ ID NO: 6763688 - DNA, 81 bp, Homo sapiens
gagctagatggtgatagagctgggattggcatatggatattgttccaaatcccatgttgtatatacagtaacataaggctc

SEQ ID NO: 6763689 - DNA, 58 bp, Homo sapiens
atatgactgaggttgaataatgaagcagggatgcacatgtttttctatctcagcgtgt

SEQ ID NO: 6763690 - DNA, 84 bp, Homo sapiens
ttttactgtgtatgcttctgtaatgtgggaatgtttttacaagcatgtatcactcctataattaaagatgcaaatctagtaaaa

SEQ ID NO: 6763691 - DNA, 78 bp, Homo sapiens
gctttggaatgttaaagatgaatctgggtgtgcatatgtattatgttcccacagtatatttttgcaaaaccacatagc

SEQ ID NO: 6763692 - DNA, 74 bp, Homo sapiens
gcttaatctttaaatgcatcttttaatggggcttttgacactcaaatagccaaagtgcatttatgaattaatgc

SEQ ID NO: 6763693 - DNA, 84 bp, Homo sapiens
ggctatgaagtccactgggctaccccaccattaccctcggttcccatgacgggggtgccagagtggcccaggggcagcagggct

SEQ ID NO: 6763694 - DNA, 69 bp, Homo sapiens
actccatgaggttcagctgctgcctggtacatgtggtcacctgcagcttcttcagccctacatgtgagt

SEQ ID NO: 6763695 - DNA, 68 bp, Homo sapiens
agaggacaaagagatgcaccatatttcttaaagtcctggataggaagtttgagcatctgtttccctct

SEQ ID NO: 6763696 - DNA, 88 bp, Homo sapiens
ggaaagcaagcatcaccttctgcaatcatgacaagaggcttttattctcagcaggcacttgatcattgttacagatgctttctttacc

SEQ ID NO: 6763697 - DNA, 67 bp, Homo sapiens
cgttgtctatctgttcacacggattatgggccatggaatactccttccctggaacagagagacaacg

SEQ ID NO: 6763698 - DNA, 106 bp, Homo sapiens
attttcatatgtttaagatttaaatttgcattgggtgatgtcatgtttcaattgttgattgtgttatctatctcgatgcttaggtttcttcttatgttttgaaagt

SEQ ID NO: 6763699 - DNA, 55 bp, Homo sapiens
ggaaggagcatttgccagtttattatctttaaaagtagtctaaaatgctcctttc

SEQ ID NO: 6763700 - DNA, 68 bp, Homo sapiens
cctttgtgtcatgccctggggtccaggtttgcagcttaaggtgctcactccccagggtaggctagggg

SEQ ID NO: 6763701 - DNA, 62 bp, Homo sapiens
tcgaatcttggttaactatgtgatttgcggcattagcaaatgcaaagcaagcagagatttga

SEQ ID NO: 6763702 - DNA, 55 bp, Homo sapiens
ctccagggttccagaagatattccagatgatgacactgggcactggggactggag

SEQ ID NO: 6763703 - DNA, 92 bp, Homo sapiens
gagcccttctgctgagtaaagttataaattacctgtcactgtcatcgtacaatgattctgtgctggctttgccatcatgcagacctgggttc

SEQ ID NO: 6763704 - DNA, 81 bp, Homo sapiens
gacctgatgacggggtgtaccactctactaagggttcccaacatgaaggtgagggggcccctgggaattctgtgattggtc

SEQ ID NO: 6763705 - DNA, 75 bp, Homo sapiens
agttaagagatctttctggagaagaacccctgaaatgattcagggtttcggctcaacagaattggattattggct

SEQ ID NO: 6763706 - DNA, 84 bp, Homo sapiens
tgtgtttctgggcctgtgttagttatgggtctcttgttataagaagcagagactcctgccagttaacataagcaaagaaggaca

SEQ ID NO: 6763707 - DNA, 79 bp, Homo sapiens
agccagctcaaattgtcttcagccaaaacagaattatattgattcatgtaggctgcaatgcacaaggggtagggtggct

SEQ ID NO: 6763708 - DNA, 80 bp, Homo sapiens
acttcagagaaagagggaattcttatatctgtctcttcctaattccattgacatggattgaacccttccttctctcaagt

SEQ ID NO: 6763709 - DNA, 55 bp, Homo sapiens
cttggagtaaacgagctggtacccaactttcagttcccagcaggttcatttcagg

SEQ ID NO: 6763710 - DNA, 66 bp, Homo sapiens
taaagttgctgtcctagctggcttgtacccagttactgtaacctagccagagaggacagtattttg

SEQ ID NO: 6763711 - DNA, 77 bp, Homo sapiens
gtctgacaacattatggcattaaataaagtccaagaggtattgggctggtctttgtttggtctctggtggtttagat

SEQ ID NO: 6763712 - DNA, 85 bp, Homo sapiens
tttctgggtataggctgtgtttaataactcgactgaggaagtttaataactttgctcctgacagttttaggctcagaccctgaaa

SEQ ID NO: 6763713 - DNA, 89 bp, Homo sapiens
ccatctcagttaggccttgtcacaggaatacattactaccttctgaggaagacagactgtgctcttgggcaatagctgccactgtgtgg

SEQ ID NO: 6763714 - DNA, 55 bp, Homo sapiens
gaggtgttctgggcaaggccagggatttccatcccttggcctactagaaaacctt

SEQ ID NO: 6763715 - DNA, 74 bp, Homo sapiens
gaatcttacactgtccaatcagggattttccttctcttaccctggagagtggctgatgtaggcagtggggattt

SEQ ID NO: 6763716 - DNA, 89 bp, Homo sapiens
tgcaaattgccagctcccattcttcacctgttcccatacccacctcccaatcatggtcaccagaggtaaaaggaggagagcccaagaca

SEQ ID NO: 6763717 - DNA, 88 bp, Homo sapiens
ctggagccgagcagtgagccacagctttccttgtgcacttgcctgagctcagcagtggtgtgaggagggctctgactgtgaagcccag

SEQ ID NO: 6763718 - DNA, 88 bp, Homo sapiens
tggaggtaagtggcaggagcctgcggggaggtgggctgtgcattgccgacctggtgtcctgagcgcagcctgggcccgcttgcctcca

SEQ ID NO: 6763719 - DNA, 71 bp, Homo sapiens
gcattaaaaactagtcactgcaggaagaccttatgcagggcatgtgtaggaattccagtgacttcagatgt

SEQ ID NO: 6763720 - DNA, 78 bp, Homo sapiens
ggagcacaaggccttctcttgtgtctgtgaagggaagaaatgtctcagaacatggacatatgagacctttccagctcc

SEQ ID NO: 6763721 - DNA, 91 bp, Homo sapiens
gcagcctcagacttgcagtgggtagaggactgaaaccccaagcagcctcctctgggctccctgcaacagtctgagccctgagagcagctgt

SEQ ID NO: 6763722 - DNA, 57 bp, Homo sapiens
gtgcacatatttgtgcatgcatgtacatgtgtgtgtgtgcatgagtaatgtgtgcac

SEQ ID NO: 6763723 - DNA, 84 bp, Homo sapiens
gaaggaaagaatcgtgtgtagtttgaaaacagcagaattttgtcctactgctttgatttgtttttagacatgatatttattttc

SEQ ID NO: 6763724 - DNA, 81 bp, Homo sapiens
gagtgaaataccagaaaataaagtgccacaggaaagctcaaaaaggtttccaaatgagctctgccttccagtgttcaactt

SEQ ID NO: 6763725 - DNA, 80 bp, Homo sapiens
gaggcgttcgggtgcagcactggggggattcggagctggacagcccagccacgttgccacccgggtgaccctgagccctc

SEQ ID NO: 6763726 - DNA, 64 bp, Homo sapiens
tcatatgtgtgtaatatattagtgttttgacttaaaatgagagatacaatacacatgcatatga

SEQ ID NO: 6763727 - DNA, 84 bp, Homo sapiens
tcattgtcacccaaaattcatagtttacattagtgttctttcttggtgttgtacattctatgggttttgacaaatgcataatga

SEQ ID NO: 6763728 - DNA, 87 bp, Homo sapiens
ttttacgtttcacaagtccataggtttcatgagggtataaactgtacctgtgaaacaatgtctatgtggtaaagtgcaggtgtaaaa

SEQ ID NO: 6763729 - DNA, 68 bp, Homo sapiens
gttatggcttctcagtcatgaaaagctcagttatttggggtctacattttctcactgagagccttgat

SEQ ID NO: 6763730 - DNA, 65 bp, Homo sapiens
ctccaggagctggccagatgtcccaaagagccctgagggctcatgcatatggggtcagcccagag

SEQ ID NO: 6763731 - DNA, 116 bp, Homo sapiens
gttagaacctcagactgctttgtcagacattttctgaaaggagagctgcaaggattctctttgaattcttacttgttctctttgcagtcaggcaatcagtaaggaggacatctaat

SEQ ID NO: 6763732 - DNA, 79 bp, Homo sapiens
cactgagctatgtttcagggaagtgttgaaaaggcccagcctgcgcatattcttgaaattttgaaataatggctcagtg

SEQ ID NO: 6763733 - DNA, 61 bp, Homo sapiens
ggcagccagcaatgagaagtttgttgaaaacctcttcatggagctcctccttctgtatgcc

SEQ ID NO: 6763734 - DNA, 60 bp, Homo sapiens
gcacagaaattccaaccctggacataattctgagtcagagttggcctttctgtattttgc

SEQ ID NO: 6763735 - DNA, 102 bp, Homo sapiens
gctccagagtcggggaagcgccatggttcctgcgcagaaaggatgcgggttggggccggcagatcctgccaggactaggggccttccctttccatcaggagc

SEQ ID NO: 6763736 - DNA, 55 bp, Homo sapiens
tgacatgacacttagcttattcctcctcatgggatagttatttctgtcactgtca

SEQ ID NO: 6763737 - DNA, 65 bp, Homo sapiens
aattcaatctgcatttagttagtgtagcttttttctgagttacacttagggtttgtcagagaatt

SEQ ID NO: 6763738 - DNA, 61 bp, Homo sapiens
ttgctaacgagtgcagattattcaataacagctcttgaacagttaatttgcacagttgcaa

SEQ ID NO: 6763739 - DNA, 111 bp, Homo sapiens
gcatgatatttatccttcctttggggaatcacagaatggaccagttttagaaacttggaaccccatcctagatttttccatgtgtttcttcatgggagggtggatgggtgt

SEQ ID NO: 6763740 - DNA, 106 bp, Homo sapiens
tttctcggtgatggcaggtttctcggtgatggaaggtttctcggtgatggaaggtttctcggtgatggaaggtttctcggtgatggcaggtttctcggtgatggaa

SEQ ID NO: 6763741 - DNA, 99 bp, Homo sapiens
gaggcaggagaatcgcttgaacccaggaggcggaggttgcagtgagctgagatcatgccactgcactccagcctaggtgactgagtgaaactccatctc

SEQ ID NO: 6763742 - DNA, 71 bp, Homo sapiens
aagcactttcttttggtctccaagccatgtgtcaagtcagtgaactgctggggaggccaaactcagtcctt

SEQ ID NO: 6763743 - DNA, 99 bp, Homo sapiens
ccccttttagaggtttagctggcagctggtacagtgggtctgctatcctctctcctggaacagatcctgtatcaggcacagcccagctttgtctagggg

SEQ ID NO: 6763744 - DNA, 59 bp, Homo sapiens
cagttcctgcaatgcaatgtgttgttaactgaatagccagcatatagcagggagaactg

SEQ ID NO: 6763745 - DNA, 80 bp, Homo sapiens
gtgacactgtcctctgagtttggttaatcataaagaaatattcttcatttaatgaataattcaaatctgagtcttgtcgc

SEQ ID NO: 6763746 - DNA, 86 bp, Homo sapiens
attagatttagctcatttgatgcatctctactttgttcctgcttctgggaagagagggacttattaaagtctagcataaatctggt

SEQ ID NO: 6763747 - DNA, 92 bp, Homo sapiens
aacaatttgtagagtaaaatactgaattagttgagacaagactgggtatcatttttattgtttcaaatatttcagaataccagcatgttgtt

SEQ ID NO: 6763748 - DNA, 101 bp, Homo sapiens
ttaagataggataattagaaaaagaatgttagtttctgatacagtaaatttgaggctgttaataaggattcacattttcttggcaaattatctacttttaa

SEQ ID NO: 6763749 - DNA, 73 bp, Homo sapiens
ggcacattagcaactcttatgtaagcagaagtgtgaaaaccgtttgcacattggggtttgcctggtacttgcc

SEQ ID NO: 6763750 - DNA, 55 bp, Homo sapiens
ggcagatggaatgagctgtctaccaggcgaatggtggttgccatgctctctgact

SEQ ID NO: 6763751 - DNA, 69 bp, Homo sapiens
tctgagtaacagctatggtactcagttgaggtcgttcttgctacatggtttcaaagctggaagctcaga

SEQ ID NO: 6763752 - DNA, 60 bp, Homo sapiens
gcaaacggggtcagccgtattgaagtgagccagcttttccaacctgagctgaacccgtgc

SEQ ID NO: 6763753 - DNA, 78 bp, Homo sapiens
ctgtgtccagcagcctgggagcagttatgagctgggccacagcctcagcagctctggaactcccggctgctgtcatag

SEQ ID NO: 6763754 - DNA, 67 bp, Homo sapiens
gcaaggcagtcctggggccctgggcccactcagcgggagccaggactccccggagagctcaccttgc

SEQ ID NO: 6763755 - DNA, 64 bp, Homo sapiens
gggtggccggctactccaaggtatcaatttaaatctccaactaccttgaaggcagaggacacct

SEQ ID NO: 6763756 - DNA, 117 bp, Homo sapiens
ctcttgagtagctaggactacaggcgcctgccaccatgccaggctaactttatttttcatagagacagggtcttgctatgttgcccaggctggtcttcagttcctggccttaagcag

SEQ ID NO: 6763757 - DNA, 75 bp, Homo sapiens
agcatgaaacaatgtgaagttgctgagatgggtaactagtcttttttatgttgtttattgtttcactcccctgct

SEQ ID NO: 6763758 - DNA, 60 bp, Homo sapiens
tcggtgtcccttagagatatggggtttatttcccctccccatgattctgggctacactgg

SEQ ID NO: 6763759 - DNA, 55 bp, Homo sapiens
cctctggatctgtcccctttttgttgtctctgagctaatgggacagattccatgg

SEQ ID NO: 6763760 - DNA, 72 bp, Homo sapiens
tacctcaaagacaggctggggctgcagccaagtcaggcaatgagctggctgggtgccagtctccctggggtg

SEQ ID NO: 6763761 - DNA, 56 bp, Homo sapiens
ggttaggaaggtgccagagttactcagaaagttctggagggtacctacttctaacc

SEQ ID NO: 6763762 - DNA, 89 bp, Homo sapiens
ataagttgagttgtcaagtttggaggtcactggtctttgaggctcaaggttcagatgacttttatgctgatgacatgaaccaaatttat

SEQ ID NO: 6763763 - DNA, 57 bp, Homo sapiens
gatctcttggtcacacaaatgtttgatataataattaaatgtggagactcaggagtc

SEQ ID NO: 6763764 - DNA, 68 bp, Homo sapiens
catttgtcttcaatagagcctcaatttgaaagaaagctttcaaattggccctgatgaagagtcaactg

SEQ ID NO: 6763765 - DNA, 69 bp, Homo sapiens
agtttcatcagaggcatctggcaaggctctcatggtttgactgtcaccagatctctctgtaatgggatt

SEQ ID NO: 6763766 - DNA, 68 bp, Homo sapiens
tcccatgttggcagttggaagggagtgcagcctgcattgcgcgctaacttcgtgcttgccatctggga

SEQ ID NO: 6763767 - DNA, 70 bp, Homo sapiens
gcccctggctgccttgtgttgatctctggcctaggtaatgaccagaaatctcactggcaggcaggcaggc

SEQ ID NO: 6763768 - DNA, 61 bp, Homo sapiens
gagcttcactttcagaagtcactggcaatgttttgctttcagtgtgctatctggaagtctc

SEQ ID NO: 6763769 - DNA, 96 bp, Homo sapiens
caaagtgctgggattacaggtgtgagccaccccaccgcgcctagcctaaaaattagttttgtgtggtggtacatacctgtggtcccagctactttg

SEQ ID NO: 6763770 - DNA, 77 bp, Homo sapiens
ctctgaccctctgggattctgagtttatttttagcaccaacttggtgcaaattgctaaggatctcatgtgggcaggg

SEQ ID NO: 6763771 - DNA, 95 bp, Homo sapiens
gtatctactagtttctggtattggggatgtggttgagtgaagcacactgtgtcccactgacttcacatccagacacacacaaatgggtgagatac

SEQ ID NO: 6763772 - DNA, 55 bp, Homo sapiens
ggggcagaaagcccacagagtgcccagcctgcctctgtgtgtgcccccctgcccc

SEQ ID NO: 6763773 - DNA, 123 bp, Homo sapiens
aatttaattctgctagaacacctggtctactgattaactgcagctaatatggggtctacttcacatacaagttaaatgcagtgcccttaatcagtgatatgatgaggtcaacagtaataaatt

SEQ ID NO: 6763774 - DNA, 57 bp, Homo sapiens
tttctctattatgcattttgctgatgctgacagaagcaggcaggctggatagagagg

SEQ ID NO: 6763775 - DNA, 55 bp, Homo sapiens
gatatggcttggagacatgcacttgacggcagtgacaacagctctcagccatgtc

SEQ ID NO: 6763776 - DNA, 59 bp, Homo sapiens
gtgtaagtgccccaagggaagggatggcatctgctgtgctggaacccagggcctaacac

SEQ ID NO: 6763777 - DNA, 57 bp, Homo sapiens
atggaattgaagacagcataggggccagaaccttgtgtcaggaagtttcagttctat

SEQ ID NO: 6763778 - DNA, 61 bp, Homo sapiens
agttttgtataagcaactgtcaccattggaaggggacagtttatggtgttttatatagact

SEQ ID NO: 6763779 - DNA, 55 bp, Homo sapiens
gctgagagtgtgagatcagattagagagactggaagtctggctccgcctcttagt

SEQ ID NO: 6763780 - DNA, 101 bp, Homo sapiens
aatagtaaatttaatttttaaaagtctgcaaattggtgaggaccacttgtataaaattatatatttggccactaattgcatctcaaattgatacagctatt

SEQ ID NO: 6763781 - DNA, 56 bp, Homo sapiens
aaagagcttgcttgctttatatcatagggttatatgaggcattaaacaggcttttt

SEQ ID NO: 6763782 - DNA, 55 bp, Homo sapiens
acactttagaaaaaagaatggtgcatgtaattaccaatccttcactctggagtgt

SEQ ID NO: 6763783 - DNA, 77 bp, Homo sapiens
tattgttaggttctatactaagatgagaaagctagaatctttattgctgtgtatataaggtcaggaatttgacaata

SEQ ID NO: 6763784 - DNA, 66 bp, Homo sapiens
gagggggagatgtgcacacactttcgtgcaaacacacacatgcagtgacttggccatctcccttgc

SEQ ID NO: 6763785 - DNA, 110 bp, Homo sapiens
tgcaatttctgaatttgcattctatgaaagcctatttgctctatcttcaccttatttgaatgaatgagtgctaggtttgtctagaaactgtaacgattttaagaaatgta

SEQ ID NO: 6763786 - DNA, 105 bp, Homo sapiens
aaaggggcttgtaggaactgttcactgaaccaggcagagaaaaatatttttcaaggtgtttttttaaatggtttcagtcttttagacacaattacaagtactttt

SEQ ID NO: 6763787 - DNA, 62 bp, Homo sapiens
aagggttggttctgaaacccagcttcctcccctagctgaaaacacttctgagccacttcctt

SEQ ID NO: 6763788 - DNA, 69 bp, Homo sapiens
acacatgcacattattcaaagcccattgaggtatgtttcaccttggagttgcttataatctgtgtgtgt

SEQ ID NO: 6763789 - DNA, 87 bp, Homo sapiens
cttctaattagtttatctactgccacttaagacatttgcaagcctatctgcaaagctctttgtatagtggaatgagtaacagggaag

SEQ ID NO: 6763790 - DNA, 63 bp, Homo sapiens
ggacccgtcaggttagacactgtggcataacttatgtctacatttctgaccatgaacttatcc

SEQ ID NO: 6763791 - DNA, 71 bp, Homo sapiens
ggctctgcaggggtggctgcagcagaggtggcttgttcagggaagctacctgctccatccgtgctgggacc

SEQ ID NO: 6763792 - DNA, 66 bp, Homo sapiens
tgtgctgaagagaggatctgggtggagatctccttagtgtgccccatccagccctcatgtcgctca

SEQ ID NO: 6763793 - DNA, 63 bp, Homo sapiens
tgtgtgcccctcccagcacacagcctgagccctagcacagagctggccgcagagagggcagca

SEQ ID NO: 6763794 - DNA, 84 bp, Homo sapiens
actgagctgcacagcgagcctgggagatggttgtgccgtgctcccacagcacagccagcatctgagggatgatggcggacgagt

SEQ ID NO: 6763795 - DNA, 93 bp, Homo sapiens
gcacctttttctatagcctgggaataaatcttgtcttgatgctgcaatttcaagattctgttctttatgtatggtatcgtagacaaaaggtgc

SEQ ID NO: 6763796 - DNA, 82 bp, Homo sapiens
aggaatatgagaaggcacttggagttctttgcccagactgtgttgtatgggcagagacctccaagtgccttctcatagtcct

SEQ ID NO: 6763797 - DNA, 74 bp, Homo sapiens
ggccccaggatgcgtagaaagaaggtggcctgaatgaagcttcaggaccacagtacttcctggctggtggggcc

SEQ ID NO: 6763798 - DNA, 56 bp, Homo sapiens
aggctaggctgatgcctcttcctttgctatgtgagacctgaaggcaaagtctgcct

SEQ ID NO: 6763799 - DNA, 63 bp, Homo sapiens
taaaggtatgtcttaatcaaacattgctcacttttgcgtttgggacttggggggatatctttg

SEQ ID NO: 6763800 - DNA, 70 bp, Homo sapiens
aacattcaagttctggtttatgggactcagtgagcttcttttggataaatatggactatagcttgttgtt

SEQ ID NO: 6763801 - DNA, 76 bp, Homo sapiens
tgctgtcgctttctcttcttcctcctagctcagcttccagagcatggggcacagctgagaaagcacaaagatagca

SEQ ID NO: 6763802 - DNA, 64 bp, Homo sapiens
gcatccactgtgagcatgaacaggactacaggctgttagttgtgtcatttgctgatgtgtctgc

SEQ ID NO: 6763803 - DNA, 64 bp, Homo sapiens
agagctgtctgcttggcttataacctcaggctgacataagcctgatgaagaagagcccagttct

SEQ ID NO: 6763804 - DNA, 68 bp, Homo sapiens
tcatagttacacaaaagcaagtgtgtgtgcgtgtgtatgcacgtctatgcttgtgtgagaaaatgtga

SEQ ID NO: 6763805 - DNA, 57 bp, Homo sapiens
acacaaaatcaaagtcctaggctgatgtgacagctctcaaatggctttgttctgtgt

SEQ ID NO: 6763806 - DNA, 77 bp, Homo sapiens
attcctgttttcttgaactttgggtataattgttagaaattctctaaagttgttgttcacaggttatagatagggat

SEQ ID NO: 6763807 - DNA, 113 bp, Homo sapiens
cctccccaggagcctgggctgaagacttcatctgctgtaattaacaagccaactgcagctgtcttgctccattaatagcagatcagcctgtcgggcgagggctgacagggagg

SEQ ID NO: 6763808 - DNA, 70 bp, Homo sapiens
ggaggctgtgagttgtctggggacctcatcaacatttgcacaaatgccccagactctgctcacctctttc

SEQ ID NO: 6763809 - DNA, 66 bp, Homo sapiens
cctctgggggtcctcagagtctgggcacatatctatatctcgccctggactgtgggctccaggagg

SEQ ID NO: 6763810 - DNA, 98 bp, Homo sapiens
agggatgtatggtatttatggctgggtaggaccagaaatgcactttgtattacagagtgttaaggctggttgctatagtatggaacagaaacacctct

SEQ ID NO: 6763811 - DNA, 64 bp, Homo sapiens
caggccaccagatacatgccccttggggagtcatttactagtagggtctgaatatctggtgctg

SEQ ID NO: 6763812 - DNA, 74 bp, Homo sapiens
cctgcccatgccaggactctggaggcttagctcctccctttgtaccaggcacgtccagagccctggctaccagg

SEQ ID NO: 6763813 - DNA, 59 bp, Homo sapiens
gtaaagataatgttctagctgtcagcagatgtctgacacttgatggagcgtatcattac

SEQ ID NO: 6763814 - DNA, 129 bp, Homo sapiens
agggttggataagtgaggcacctaaggaggtgcccactctcaggcactgaccctgcctacatgtccatgtccctgagagtaggtgtctctttagatttggtgctttaggctcttgacttcccttgccct

SEQ ID NO: 6763815 - DNA, 76 bp, Homo sapiens
cccttattgagctctctaccttcaaaacgtatccggagtgtctctgctcctcacatgaatgtaagctccatgaggg

SEQ ID NO: 6763816 - DNA, 81 bp, Homo sapiens
tatcatcagtctagattctagtaccaggaccaggttactcagaagtggtcacaaagggtggctggtgtcaggggggtgatg

SEQ ID NO: 6763817 - DNA, 61 bp, Homo sapiens
ctcagtaggctgacactattctacttccatctggaagacaaggaatgtagcttactcagag

SEQ ID NO: 6763818 - DNA, 65 bp, Homo sapiens
gtggcagcctcaggttccggtgtatcttccagcacttagaaggaacacaacttcctgagagccac

SEQ ID NO: 6763819 - DNA, 59 bp, Homo sapiens
tggccaaattggcctgatgtattttaagcttttatcatgcaacattgccagtatgggca

SEQ ID NO: 6763820 - DNA, 69 bp, Homo sapiens
gagcaggagtaaacctagcaataaaaaccaaacctctgccttcagaggtatatgctattacttctgctt

SEQ ID NO: 6763821 - DNA, 77 bp, Homo sapiens
tgtagataatagtgttacccttcttaaagtccaagccaactggagccctgcatagaagggaacactttctaactata

SEQ ID NO: 6763822 - DNA, 64 bp, Homo sapiens
cctgtcttgcttccagaaggttcttctcatgccttgtgaagtgtgtcttgggaagggagggagg

SEQ ID NO: 6763823 - DNA, 89 bp, Homo sapiens
gccgcacttgtagggccgctctccggtgtggatcttctggtgctctataagcgaggacacgtggctgaaggcggccccgcattgcaggc

SEQ ID NO: 6763824 - DNA, 80 bp, Homo sapiens
gggggccgagaactgggactttgtaggccagttgatccgacaccctcatctcgcccgcaaagacccagccctcagctccc

SEQ ID NO: 6763825 - DNA, 85 bp, Homo sapiens
gggtgttcattaagtttcaagaggttctttgaatttcaccagaggttcaatttcgtcgtctctctagatgaaattgttgaatccc

SEQ ID NO: 6763826 - DNA, 103 bp, Homo sapiens
acaggattgttgggaatattaagggaaatgttaggcatgcttgaccctagatggggactcaagacatcactgtgcattttgctttttcttccacagctcctgt

SEQ ID NO: 6763827 - DNA, 55 bp, Homo sapiens
tgccctcccacattatggctgtgaatagatcttcatagttgggtgaggagtggca

SEQ ID NO: 6763828 - DNA, 61 bp, Homo sapiens
ggcctgcacagaggtggctctaggagaaatgaccatcacaatagcctccctgtgccaggcc

SEQ ID NO: 6763829 - DNA, 58 bp, Homo sapiens
atggatgacttggaagcctgtcatttaactgttctgattcagtttcttcctcatctat

SEQ ID NO: 6763830 - DNA, 130 bp, Homo sapiens
ttcactacctccttgagtttgggcttggccatgtggtctgggcttgcctggttgtgcagcctctcttgtttctctcacattgccattagttcagtttcccatggaaagcgtttaactgaagaaggatgaa

SEQ ID NO: 6763831 - DNA, 57 bp, Homo sapiens
gcgcgctgagtgtccgttggggcccctgctcttgggggcgcctggggctctgcgcgc

SEQ ID NO: 6763832 - DNA, 104 bp, Homo sapiens
aattattgttgctgttgtgttgctgttggtagtagcagtgatgttgttatctcaaatataatacattcctactgactagctagataatagtgcatttgataatt

SEQ ID NO: 6763833 - DNA, 69 bp, Homo sapiens
tgtggtgcaaaatttggccaataacagttaaaaaaggaaaatttgattgttaaacagatattgcccaca

SEQ ID NO: 6763834 - DNA, 63 bp, Homo sapiens
ctttgcattccatggttttccttccagttttaaggctgtatgaagggaattcatgagacaaag

SEQ ID NO: 6763835 - DNA, 85 bp, Homo sapiens
tcaaggcccaggaagggaaagtgacttacccgaggtccagcttcctggcttcatcctgtctccttttcttcatcttgtgccttga

SEQ ID NO: 6763836 - DNA, 76 bp, Homo sapiens
acccattcccaaaaaacagtttcatagagtttagcaatatatttgcaggaaactagttttaattgtctgatagggt

SEQ ID NO: 6763837 - DNA, 64 bp, Homo sapiens
tattttctgttgctattgatagtcattgtattactagaaatgaactgttgatgaatagaatata

SEQ ID NO: 6763838 - DNA, 72 bp, Homo sapiens
aggtattggtcaggaaagagtaatgtatacaaattagaagctgtattatggattattcctgaatttgtacct

SEQ ID NO: 6763839 - DNA, 58 bp, Homo sapiens
gtagcagtggttcctacgtgttggtatctaagccaggttctggggctccactgtgaac

SEQ ID NO: 6763840 - DNA, 75 bp, Homo sapiens
tctatttctgtagtaggttgtagttcttgtcaaagtcctactgacaaagtcctactacctattgtgcagaagaga

SEQ ID NO: 6763841 - DNA, 68 bp, Homo sapiens
tggatagtcttagatcagataaagtagcaatgtctcaagaattgaactctctggaactgagctaacca

SEQ ID NO: 6763842 - DNA, 64 bp, Homo sapiens
gagtgagatgatggcacacagacatccccgccccagctaggggaggggcctgctgcgtttcctc

SEQ ID NO: 6763843 - DNA, 68 bp, Homo sapiens
gaattgtggcaggtgcacttgctttgtgtttctcctctgggaagcagagaggtcacttgtagcacttc

SEQ ID NO: 6763844 - DNA, 72 bp, Homo sapiens
gcctgagacccaggggtctgctgcccatgggaggccccagcagggtgacagcaaggccctggagtcttgggt

SEQ ID NO: 6763845 - DNA, 75 bp, Homo sapiens
ttcctgtgtgatgggaagaatgtttcagcaggaaataaaaccacagaagaaacactttttttatcctacagagaa

SEQ ID NO: 6763846 - DNA, 69 bp, Homo sapiens
agtgtcttagtccatttgggctactataaaaataccataaaatgagtggcttattggcaacaaagaact

SEQ ID NO: 6763847 - DNA, 74 bp, Homo sapiens
atatgggctgaggaagctcctgaggatagagaacactatcaagtagaaagactcaggaagccatcagcctatat

SEQ ID NO: 6763848 - DNA, 62 bp, Homo sapiens
cctcttctttgttgagacagatattttacagagagtggagtaaaatttctgctgaggagagg

SEQ ID NO: 6763849 - DNA, 75 bp, Homo sapiens
atttcatctggtctagtttttagtactctttctggattactggctgaggattaagaaacatggaccagatgaagt

SEQ ID NO: 6763850 - DNA, 58 bp, Homo sapiens
gcgggctggctgcagctgctggagccagagacggctctcaagccagaccaggcctcgc

SEQ ID NO: 6763851 - DNA, 130 bp, Homo sapiens
cttggtcaaagtcaaactctcaagaaatgtggaggaacagggcttcaaactcagctgtgtttggttctaaagcctgtaccctttccacatattactgcttctcagggttttccatcaaaatgaccccaag

SEQ ID NO: 6763852 - DNA, 129 bp, Homo sapiens
aactgctcaaggaacctggatcatcagcttcttctctgtatcagcacctgctgggctgctagaaaggtgatcaggagattcagcagggctgggagctgtgacccaattggatccctaaattgagcacct

SEQ ID NO: 6763853 - DNA, 69 bp, Homo sapiens
tctgccacctggacaaccttatgcaagttacttagcaacttggtagtatgaggtgttcagagtgaagga

SEQ ID NO: 6763854 - DNA, 84 bp, Homo sapiens
aagtcatttcttgagctgaatgcaatcaggagaaagtgggccaaggagccagctcaaggtgagtcatttggctcaagagaactt

SEQ ID NO: 6763855 - DNA, 57 bp, Homo sapiens
ttctataggactcccttgaatacagtatcatgggtcaaggagctcagacctgtagaa

SEQ ID NO: 6763856 - DNA, 74 bp, Homo sapiens
tgtgttagttactctcatgcctaagacaatcataaaaatcccaagtttgaaaagcaaatgagttaactaactca

SEQ ID NO: 6763857 - DNA, 108 bp, Homo sapiens
acgaaggtggatcttacttgtatcaaagcagctgatctcagagcctccagcccgtggtttcaggtcagttagctgtttttatgatgccctagtgggatatgcctctgt

SEQ ID NO: 6763858 - DNA, 59 bp, Homo sapiens
ctccaggccagggaagtggacaaggtaatgagctcctaggaatgtccatttgcctggag

SEQ ID NO: 6763859 - DNA, 91 bp, Homo sapiens
aagattaaaaaatgcgtggaggcagaaatcttctgttgactcactttggtcaatgtgtagatgttgcattcctctcaaatttttaggtttt

SEQ ID NO: 6763860 - DNA, 116 bp, Homo sapiens
gcaaatctcatgatatagtctttcttttatttctccttcctggttagcaccttatttttctgatctcataaagtgtttttggagggaagtggaggggattgggattagaggtttgc

SEQ ID NO: 6763861 - DNA, 100 bp, Homo sapiens
aggtgagagggtcgcttgagcccaggagtttaaggctgcagtgagccatgatctcaccattgcactccatcctgggcaacagagctagaccctgtctctt

SEQ ID NO: 6763862 - DNA, 70 bp, Homo sapiens
ctacctccagaggccctatcccactagataatttgtagattcaataggggaagggtgcttcctgacttag

SEQ ID NO: 6763863 - DNA, 78 bp, Homo sapiens
aataagatggcactgacctcccttgtaagtacagagacaatgtggagctttggggctggtcagaatctgtcacttatt

SEQ ID NO: 6763864 - DNA, 96 bp, Homo sapiens
tcttcttgaatggcaccagatactgacactcggtacacgcagctctctggagcatgctgttttctcggtggcactgatctgctgccttcacagaga

SEQ ID NO: 6763865 - DNA, 55 bp, Homo sapiens
ctagttctagatccctgaggaatctccacactgacttccacagtggttgaactag

SEQ ID NO: 6763866 - DNA, 76 bp, Homo sapiens
tcattcttgcagatgacaatggcttaatgataccttatcaaaatggtaatgtgttcattagtcattctcaagaaga

SEQ ID NO: 6763867 - DNA, 71 bp, Homo sapiens
ctgtggctgctaagtctccttccttctctggacctcaggaaataaagaggatggaaggaatggtcccgcag

SEQ ID NO: 6763868 - DNA, 107 bp, Homo sapiens
gttttagcatccatcaagctccctctgagccctcttttgcagccccaccagcctggggtttgttgagagagaggctccccttgccgcctgagtgggtcctctggaat

SEQ ID NO: 6763869 - DNA, 83 bp, Homo sapiens
aggttaaggaaattgttccctaaatgtagcattgctcggattgacagctgctgaagtgagagaattgcaggtttcttaaacct

SEQ ID NO: 6763870 - DNA, 60 bp, Homo sapiens
tatattcttaccagtgtatgtaagtgtatgtattgtgtgcatgtattgtgtaagtgtatg

SEQ ID NO: 6763871 - DNA, 55 bp, Homo sapiens
aagttcaagtgtaatctttattaaccttcactttataaaggaagcatttggactt

SEQ ID NO: 6763872 - DNA, 100 bp, Homo sapiens
gtttcataatacagcatggtctggtagtttgcaaaatggtgtgcttttggggagatacactagcaatttttttaaaaactggaacagtgtgataggaagc

SEQ ID NO: 6763873 - DNA, 55 bp, Homo sapiens
aatcacagccacaacctgggggagaagaatcaaatcctccacagggattgtgatt

SEQ ID NO: 6763874 - DNA, 81 bp, Homo sapiens
ggagccgccactaccacggcatgcctcccttagcctcggggaagggggtgggctaccgatggggtggcctacacgagctcc

SEQ ID NO: 6763875 - DNA, 110 bp, Homo sapiens
tgttctgaccaggactactgaataacataacttctggagacctagccctgttgttgcctaggtaaataacactccctggagttgtacaattcacagcatggttagttaca

SEQ ID NO: 6763876 - DNA, 75 bp, Homo sapiens
tttacagctacatttttttcaagatttgtaaacttacgagaagtacaggttgtgagagaattaaaaaactgtaga

SEQ ID NO: 6763877 - DNA, 57 bp, Homo sapiens
agctgagaatgttcctactggtaagtacaacacttccaggaccctcacatttttgct

SEQ ID NO: 6763878 - DNA, 62 bp, Homo sapiens
tttagacacgtaaaggaaaactgaggtaatgtgagacctcaggggcttttcgttgttgttga

SEQ ID NO: 6763879 - DNA, 83 bp, Homo sapiens
ccgaggctgggaggactgcagatgggtgcatccctgtgaagtctcagggctgggctcagacctagtgaactccacggcctggg

SEQ ID NO: 6763880 - DNA, 73 bp, Homo sapiens
ccctctgattctatctttcctgtggccttacatctgtggcttgtctgcccacacagggggatgagttattggg

SEQ ID NO: 6763881 - DNA, 63 bp, Homo sapiens
gcttggcttcttgcagcagggtgaattcactctgcgccagggtgttcattctgctgtccaggc

SEQ ID NO: 6763882 - DNA, 65 bp, Homo sapiens
agacagggtcttgatcagagctcactgcaatatcaaactcctgggttcaagtgatcctcctgtct

SEQ ID NO: 6763883 - DNA, 80 bp, Homo sapiens
agcttaggaaggacatggattgttttaaaagatggtggaaaaattgctctgttaaattgtccagccacttttcctaacct

SEQ ID NO: 6763884 - DNA, 110 bp, Homo sapiens
tgtgtgcaattgccagcatctgctttggtgttgctcttggtgctggagcttacttgctgcccatgtgacaggagcagctctaaaccagtggtcgtgagctctgtttcgca

SEQ ID NO: 6763885 - DNA, 61 bp, Homo sapiens
gaggctactgccaggttatgccttttcaaaaatagacttttcactcatttggcatggcctc

SEQ ID NO: 6763886 - DNA, 117 bp, Homo sapiens
tgagagggtgctggaaggatgtgcattgcaggtgcccagctggcttccagcacatcccaaggggatgaatgtgggggccactgtgcacctgccttttggaccagactttctctctca

SEQ ID NO: 6763887 - DNA, 84 bp, Homo sapiens
tctctacatgtctgttttctcatctgtgaaatggatctgatagaagtatttatgtcatgtggtggtgaagatgaataaatgaga

SEQ ID NO: 6763888 - DNA, 56 bp, Homo sapiens
tgggagctaattactccggttgaaaggtgcttcatctgttcagattacagcttcca

SEQ ID NO: 6763889 - DNA, 56 bp, Homo sapiens
tttgatgtgcaatagtctgatgttcaatctcaattcaggatcagtagcatatcaga

SEQ ID NO: 6763890 - DNA, 92 bp, Homo sapiens
cacagaaagagaaactcagggggcagtgccgtgggagcgctgtgtgggccaggagctcgtgctcccaggctctgtggtctgcgtccgctgtg

SEQ ID NO: 6763891 - DNA, 56 bp, Homo sapiens
acaaaggtagtatatatattgtttaattgccaagcaaagttatatgttatctttgt

SEQ ID NO: 6763892 - DNA, 68 bp, Homo sapiens
cacccaataggaggtgtgaccttgggagaggaaaacagccatttcccatccatagccctgcaagggtg

SEQ ID NO: 6763893 - DNA, 64 bp, Homo sapiens
ctttccttagttgcaatgtttgggatatgctttggcactaaatcacagcattcgcaatggacag

SEQ ID NO: 6763894 - DNA, 56 bp, Homo sapiens
agaagccattgaagcagacctctagctgccagtcaggtctgctctgaaggctgcct

SEQ ID NO: 6763895 - DNA, 56 bp, Homo sapiens
tcaatcaataagatctttggcactgtttattagcaaattggccacttattgattga

SEQ ID NO: 6763896 - DNA, 80 bp, Homo sapiens
cccttagctccaaggggtttgggatcactgcgttttacagcaacaatcttcaaccttttggtcactctttcagctaaggg

SEQ ID NO: 6763897 - DNA, 61 bp, Homo sapiens
cctatcaggtgatttgatttgtcccattgctggtggtgttaactttgatcacttgataagg

SEQ ID NO: 6763898 - DNA, 77 bp, Homo sapiens
tactgggtcagcctgtgccccaaggccagggctcctgggaggagctctgaagaagggtgccaggctggcactcggtg

SEQ ID NO: 6763899 - DNA, 128 bp, Homo sapiens
ggggctgagccaggcgggtctcactcctcctggctgggtcacctcctgtgtcaccctggctctattttctggagtcaggggttggacggggccacagtcaaggtgatgtgcagcctgccagcagcccc

SEQ ID NO: 6763900 - DNA, 68 bp, Homo sapiens
aactctgctcttatagtgttatagtgtgaaaccagctataggcactattttactaagtgagcatggct

SEQ ID NO: 6763901 - DNA, 66 bp, Homo sapiens
ctgagccctcttgtctatatggtagatcaaaacaagttttatctaaagacagtgagaggaaagcag

SEQ ID NO: 6763902 - DNA, 59 bp, Homo sapiens
gtttcaaaggtgtcaggcagtttttattcccactctgattaccacacaccatttgaaac

SEQ ID NO: 6763903 - DNA, 97 bp, Homo sapiens
ttgcctctgctttgccaggggcctctgcctgcacatcatcctgagaccaggaaagagctgccaggcaggctgtcccattgtggggggggggagggga

SEQ ID NO: 6763904 - DNA, 58 bp, Homo sapiens
tagaagaggatatcgaagtcatttaagtcaaaatttcaattgatgatgttctcttttg

SEQ ID NO: 6763905 - DNA, 57 bp, Homo sapiens
ggatctgtctctgcaattagtcctgatgccaggtctgcctgctggggagacagatct

SEQ ID NO: 6763906 - DNA, 57 bp, Homo sapiens
ggtttcaaacactctgagaatgggatcagatatttcactccagcagtgcttgaaatc

SEQ ID NO: 6763907 - DNA, 79 bp, Homo sapiens
gaatgtgttttgctcaccttggaaaattggctgcttgactttctcttctgctttttccgaggtggctctgggacatctc

SEQ ID NO: 6763908 - DNA, 109 bp, Homo sapiens
gtttgtcctgctgccagcacaggaggaagcatttgccctgataatgatgaacaaatttccttgatcgagtccatgggccagagctcctctgggtgctggtcaggctggc

SEQ ID NO: 6763909 - DNA, 70 bp, Homo sapiens
gataccgtcacatttaatgatcctactgtgaattcaagaattcacgatgaaagttggattgagcggtatt

SEQ ID NO: 6763910 - DNA, 59 bp, Homo sapiens
ggtgccctttgtagaattcagttggcttctgggcacagcaggcactatacagggcagcc

SEQ ID NO: 6763911 - DNA, 55 bp, Homo sapiens
tctgaaggcctggagggtcccagaagcttggcaccagcacccactaggctccaga

SEQ ID NO: 6763912 - DNA, 128 bp, Homo sapiens
ctcggggaggccattaccatggctgctctctgtctgccctgtgagggtccttggggtggctgcactctggggatggtgctggggctgactgactcacgcggtcgtgtaacacatcagaccttccaaag

SEQ ID NO: 6763913 - DNA, 110 bp, Homo sapiens
tgggggaaagggactagagatggttggaatcctgggtaaacactgaccttttagtattctagaggtgagatttaattcactgctaattagtgttggttttggctccccta

SEQ ID NO: 6763914 - DNA, 87 bp, Homo sapiens
actccaaaggccagtggccagctggatgtgggtgacgggaagactctcactcaggtttctagcttgggaaacttggcgagtggtggt

SEQ ID NO: 6763915 - DNA, 88 bp, Homo sapiens
acttatagaagttacattgctgaaaagctggcctttgtaaagctcgctcttggcaaattgctagctttctctgcgtgtgtctatacgt

SEQ ID NO: 6763916 - DNA, 56 bp, Homo sapiens
atatttcttatcttgattttctcctggataagatcctggagcttggtgagaagtgt

SEQ ID NO: 6763917 - DNA, 78 bp, Homo sapiens
ttagtctgattgtttaagagcatttgcaatttatgaaatatatcaggaaatgtaatgttcttgaaaaggaatggctaa

SEQ ID NO: 6763918 - DNA, 87 bp, Homo sapiens
ccttgcacattctccaggtaaccagagcaagagagcaacaggcttacccttacctaggctgcctcctgctgggctggagagcagagg

SEQ ID NO: 6763919 - DNA, 80 bp, Homo sapiens
gacatgtctgatatagtatgggaagaactttgtagtagaaacatttctattaatggccccattttatgtctctacatgtt

SEQ ID NO: 6763920 - DNA, 77 bp, Homo sapiens
ggaattcttggattcatacagtgatttcatggtgttatgtgttgtgaaacattgcactgtatgaatctggaatatct

SEQ ID NO: 6763921 - DNA, 124 bp, Homo sapiens
ggttgccgctggtcttccttattttagtgttttcgtgatactcaggctgttttttccttgtttatgacctgactgggaaagtgctgcctgcagctgatgattaactctgggaggcctggcatcc

SEQ ID NO: 6763922 - DNA, 55 bp, Homo sapiens
ccactctttactgttgggttttaggctacttgccgaggtctcagctaaggagagg

SEQ ID NO: 6763923 - DNA, 123 bp, Homo sapiens
tatccctgtaccatctgcccctcccaagagtgaatgggttccttgttctcagatttagaatgaactggaccgtgggtggcaaaggcccattgtctctggacttggcagagagaattatggatg

SEQ ID NO: 6763924 - DNA, 62 bp, Homo sapiens
attcacagttcattagctgtaagtagccatatgccccagatagctgaaaggagctggagagt

SEQ ID NO: 6763925 - DNA, 61 bp, Homo sapiens
caaatagcaggtggttctgagtatttattttatagtaaatacagcagactcctgttgtctg

SEQ ID NO: 6763926 - DNA, 68 bp, Homo sapiens
cctgggctcaggcttgggcagctgcacctatcacccctggagaaggcagaccaagcctggcacccagg

SEQ ID NO: 6763927 - DNA, 107 bp, Homo sapiens
cattgtcactgctgtttatagtgtgtgtgtgtgtgtgtgtatgtgtatatattttgttttgattagccactacctataccataagtattttaaaagtagtgatcatg

SEQ ID NO: 6763928 - DNA, 79 bp, Homo sapiens
ttggagtccttagcacagccaaaatagagcatggaggggaaaaaatcctgtaggttctggcattgctcagtaaacccaa

SEQ ID NO: 6763929 - DNA, 57 bp, Homo sapiens
gacacagtagccagtgcagtgatgtgtcatatcccattctttgcttgtttctgtgtc

SEQ ID NO: 6763930 - DNA, 65 bp, Homo sapiens
tgctaatggggctagacaaccagtgcccttgagtctgaagggagccagtttgttagccccctgta

SEQ ID NO: 6763931 - DNA, 84 bp, Homo sapiens
ctgtagaacaagtgtgggactcagtggcacccaggctcaatcctgctgctgagcagaggtgctggagtgagtcctgctctgcag

SEQ ID NO: 6763932 - DNA, 60 bp, Homo sapiens
acaatcacttgagtgaacttgagagtgaatcctctccatgttaagccttgaggtgattgt

SEQ ID NO: 6763933 - DNA, 104 bp, Homo sapiens
ggaaatgtagtctgactgtgtgctcaagaagaagaggtaaagatacatttttggtgagaagcattagtctttgccacacttctgtacaacagtgtctacattcc

SEQ ID NO: 6763934 - DNA, 64 bp, Homo sapiens
gatggaggcaggagacagggcaaaccttgggcctgggtctgcgattgtccaccgtggctttgtc

SEQ ID NO: 6763935 - DNA, 66 bp, Homo sapiens
agaaggcaactgtaaaacatgcacaatttcacaatgtacctggcattttttagtatagtgccttct

SEQ ID NO: 6763936 - DNA, 61 bp, Homo sapiens
aggtattattagcatctctattttgcaggtgaagaaacaagcccagagaggttaagtacct

SEQ ID NO: 6763937 - DNA, 61 bp, Homo sapiens
tttgaagctcgagtgtggactgattttgctcctgcttttgggctttgctcagcttaccaaa

SEQ ID NO: 6763938 - DNA, 67 bp, Homo sapiens
gtggcaattcagttgtgtctgacctcgatgccccagtgtttaggccaggatagcttaattaatccat

SEQ ID NO: 6763939 - DNA, 91 bp, Homo sapiens
tagtgcctatttcattgggctattgtaaggattaaatgtgtgagtacatgtaaagcacttcataacagcacccagcatgaattaagcactg

SEQ ID NO: 6763940 - DNA, 56 bp, Homo sapiens
ggcgccagcggtaagtaagacacacaacatatctgtccaacatgcctgatggtgcc

SEQ ID NO: 6763941 - DNA, 83 bp, Homo sapiens
aatcttatctgccttaatcctaatgtgggtccagtttttattacagaaaattctttgcatttaggaagtaggcagttaatgtt

SEQ ID NO: 6763942 - DNA, 78 bp, Homo sapiens
tcccaaggtctggcatgagtaacgtgagtgaggagagagctctgaattcacaattgcattatgacatagggattggga

SEQ ID NO: 6763943 - DNA, 55 bp, Homo sapiens
gcactgctatttagctccatcatttatatgtgaatataagttagtgtagcagtgc

SEQ ID NO: 6763944 - DNA, 77 bp, Homo sapiens
ggaacttaaagcacaggagagttcagtaacttgctcaaggtcatgttgttgtggactaactcctggtcccaagctcc

SEQ ID NO: 6763945 - DNA, 59 bp, Homo sapiens
attcctgacaatggcggagatagtcgtggggtgtccaccgctttgccactgataggagt

SEQ ID NO: 6763946 - DNA, 61 bp, Homo sapiens
gctgcctgacttaggagctcaatggcagcaccaggaagctgcactgggctggagtcagggc

SEQ ID NO: 6763947 - DNA, 80 bp, Homo sapiens
attaacggatgtgatagaagcagagccttgaaaactgtttgtgacagggcctgctctatcactctcatgcctttgttaat

SEQ ID NO: 6763948 - DNA, 118 bp, Homo sapiens
gtggaggtaatattggagcagtggattattctcagtgctataagtagagaagccacttaaaagtcattctgccttagcaattgtcaagggtgattctgttccattgttactgttccac

SEQ ID NO: 6763949 - DNA, 62 bp, Homo sapiens
catgcttattcatatattctcggtagctgatttcatgctacaatgacagaattgagtagctg

SEQ ID NO: 6763950 - DNA, 66 bp, Homo sapiens
ggcctttcagttccatcaaaggaagataagtccccactcattgtccctggaggaaactgtgaggtc

SEQ ID NO: 6763951 - DNA, 65 bp, Homo sapiens
cctagggcaccacacatgactgtgacttcctgacagatagaccaagtgcaggtgccactatcagg

SEQ ID NO: 6763952 - DNA, 56 bp, Homo sapiens
taggtgcctggacgcaaatggagcctatagctgtgtacacttggtcaaggtactta

SEQ ID NO: 6763953 - DNA, 69 bp, Homo sapiens
gctccatggtttggcctctgagtaccttctctttactttttctcaggacagatttttggccaccagggc

SEQ ID NO: 6763954 - DNA, 82 bp, Homo sapiens
taagacgagttagcaaatgtaaaatgcctacaacaatgcctggaacgctgtaagcattatataattgttgattatttccttg

SEQ ID NO: 6763955 - DNA, 78 bp, Homo sapiens
cttcacttgctgagcctctcttatttgccgggccctcttcttggagctgaaggtgtgtggagagaggtgggaaggagg

SEQ ID NO: 6763956 - DNA, 95 bp, Homo sapiens
atatggaattactgcatgattcagcaattttatatctgggtatatagcccaagaagtaaaagctgggacatgaatagatatttgtatacccatat

SEQ ID NO: 6763957 - DNA, 76 bp, Homo sapiens
aatggttccttgaaaaccagcatgtagcctgttcataaattttatgatgtgtgaagcacatgttcaaggaagtatt

SEQ ID NO: 6763958 - DNA, 89 bp, Homo sapiens
taattgaagaagagtcttaggcaaaaataatggagtagaaatatttggtagcataacttattttccttatctgggacttacttcaatta

SEQ ID NO: 6763959 - DNA, 63 bp, Homo sapiens
agataagtgtctaccactttaagagaggcacacattttagccttttctgtaaggcattaatct

SEQ ID NO: 6763960 - DNA, 68 bp, Homo sapiens
cttctgagactggagaagtctggctgatggtctgcagcctgtctgcattgaccctactagtccagaag

SEQ ID NO: 6763961 - DNA, 58 bp, Homo sapiens
ccaaagagctagaattataggcatgagccaccacacccagcctataacggttttttgg

SEQ ID NO: 6763962 - DNA, 61 bp, Homo sapiens
tgtttttagtaattagaaagtaattctctgaagcagagaatgctctggtttgccaagaaca

SEQ ID NO: 6763963 - DNA, 69 bp, Homo sapiens
gtgtgtatttttgaagaaggatgagggatgagaattctaacctcccatttacctttaattaaaacacac

SEQ ID NO: 6763964 - DNA, 67 bp, Homo sapiens
aatggccaaagtagaaaataatagggttcttaagattaatatctcactattgttaagactggccatt

SEQ ID NO: 6763965 - DNA, 58 bp, Homo sapiens
agactgcaccttccatgcctgtctctttcattagagatcagactctgcattgcagtct

SEQ ID NO: 6763966 - DNA, 80 bp, Homo sapiens
ggcaagaagaaggaaattttactaatctgagtgtgaggtatagtcatcctgaatcacgttcactttggaaaattcttccc

SEQ ID NO: 6763967 - DNA, 72 bp, Homo sapiens
gatgtgtggctgagggatgtggattttggtcccctctgggactcctcagtcaccctcagcttatcacatgtc

SEQ ID NO: 6763968 - DNA, 61 bp, Homo sapiens
acatcttcccacacttgcaaaatcttcatagaacatggtggaagtggatgggcaaagatgt

SEQ ID NO: 6763969 - DNA, 60 bp, Homo sapiens
gcatgtgactctggcttaccccctgtaattcagagacctgaagccagggtccagacatgt

SEQ ID NO: 6763970 - DNA, 55 bp, Homo sapiens
tttgtatgaactggtatgtaggtgttatcaaaacccctgctcaacagcatataag

SEQ ID NO: 6763971 - DNA, 126 bp, Homo sapiens
atagaatagagctcagaaataaatccatatatttatagtgaactgatctttgataaagatgccaagaaatgcataatcgaggaaaggacagttccttcaataaatggtattgggaaatctagatat

SEQ ID NO: 6763972 - DNA, 72 bp, Homo sapiens
agtccctcccacctctgatattctttgagctgctaagatttgaaatttcactcaatggtatcaggaggttct

SEQ ID NO: 6763973 - DNA, 56 bp, Homo sapiens
gctaattcagaatttatggtctctagttcactaggaagcctaaatgtggaattagt

SEQ ID NO: 6763974 - DNA, 87 bp, Homo sapiens
ataatgaagtctccgagtgtatgaaagtagccggcttcaaaataaaatctttgagtgcatactttattttaatacttattttgttat

SEQ ID NO: 6763975 - DNA, 65 bp, Homo sapiens
caattaacatgcagccagacacacacagtgactacacattttggtgtggttggcggcattagttg

SEQ ID NO: 6763976 - DNA, 57 bp, Homo sapiens
ctcaacatccccttcatgtcatgatccttgcatggattttttcaaggggctgctgag

SEQ ID NO: 6763977 - DNA, 59 bp, Homo sapiens
tagaaacaatgacatgcttgtagcaataagcacagctagcacccaggtctttgtttcta

SEQ ID NO: 6763978 - DNA, 58 bp, Homo sapiens
cctctgtgaatgggtcattacttttaggaggggaagtgaatagcctatttactagagg

SEQ ID NO: 6763979 - DNA, 62 bp, Homo sapiens
ttgagccaggtctcactcaccttcaaggcctttcttccaggaagatttatgggacttgccaa

SEQ ID NO: 6763980 - DNA, 56 bp, Homo sapiens
ggagttggtgccgccgggccagaggctgcgagtccagctggctctggacttgctcc

SEQ ID NO: 6763981 - DNA, 65 bp, Homo sapiens
tctctcagggtttcctgggggctgctgatgggaaagaggcagcattcgcaggggccctgcagaga

SEQ ID NO: 6763982 - DNA, 126 bp, Homo sapiens
tcacaagtacttagccgattcttagttgagatacgttaaagatgcagctttagagaagatttccaggcctctggccctattctagactgcttctttctcactgagtgttcaatgcattgactgtga

SEQ ID NO: 6763983 - DNA, 67 bp, Homo sapiens
ggcgggcagatgcggacacgcgtcttggaggggccccaccgagcctcagcagccgcagctgcccgcc

SEQ ID NO: 6763984 - DNA, 60 bp, Homo sapiens
cacctgcctggtccttagggcttccctcttcccatttgcccggaaaaccactatcaggtg

SEQ ID NO: 6763985 - DNA, 73 bp, Homo sapiens
cccaatgctcatattattctagtaacagtgatctgttagcaaaggattctgtgaaaagaataatgggggtggg

SEQ ID NO: 6763986 - DNA, 82 bp, Homo sapiens
atttttggttcaagggctgtagtttgttgatcaccatcctaggagggtggttctcaaagtatactcccagggaactagcagt

SEQ ID NO: 6763987 - DNA, 67 bp, Homo sapiens
tcatgtattttaggtaagagcagaagagactagattgaagtctgtttattacgtaattaatatatgg

SEQ ID NO: 6763988 - DNA, 64 bp, Homo sapiens
gaggaagcagtagaggaactgaggcagagtgaaattgaaaagtgaaggttattgctgcttcctt

SEQ ID NO: 6763989 - DNA, 55 bp, Homo sapiens
gggaggggaacgtggggcagatgcacaggaatgtgctctgcccagttgtctgccc

SEQ ID NO: 6763990 - DNA, 63 bp, Homo sapiens
gtgagtgaagcaggccttagtccaaagacttgctagtggtctgaagctgcctgcattcctcac

SEQ ID NO: 6763991 - DNA, 94 bp, Homo sapiens
gaccttagtctagacccatggttctcaaagagtggtcctgggactcttggggattcctgagatccttttagggatctgtgaggtctgtgaggtc

SEQ ID NO: 6763992 - DNA, 87 bp, Homo sapiens
ggggatcacttcagcccaggagttggaggctacggtaagctgtgatcacagtactgcactccagcctgggtgacagagtgagacccc

SEQ ID NO: 6763993 - DNA, 82 bp, Homo sapiens
taatagctggtaacttacagggcccctttaaaaggaatcattttatctttatagaccaccttgcaagttacagatgcttcta

SEQ ID NO: 6763994 - DNA, 58 bp, Homo sapiens
ctgcagctggagcatcttctcatcttgcatttgagcgtggtggggtcctccagtgcgg

SEQ ID NO: 6763995 - DNA, 71 bp, Homo sapiens
aattccggaggtgactttaacttcagattagattctagaatcagtttgtaaaatagagtcatttatgaatt

SEQ ID NO: 6763996 - DNA, 81 bp, Homo sapiens
tgtttctcccagaggcagtggtctgatgcaaggtcccagaatttattttctgtctttatctgacctgtctctgtcatttca

SEQ ID NO: 6763997 - DNA, 96 bp, Homo sapiens
tagtgggatatttttaaatacaaagttattctttcagaggagatcaggaacatgattcctggggacttgacattgtatttaataggaagttcacta

SEQ ID NO: 6763998 - DNA, 77 bp, Homo sapiens
ctcttctgtacctcggcctccaagctgcctagaatctggctgtggcagtgcccaaggggaggcgagcagcaggagag

SEQ ID NO: 6763999 - DNA, 115 bp, Homo sapiens
ggaggcaagtggaagctgcctgggtgtctggacattggggccctttcagtgttgctgagctgctgggcctcacctctccaccgcctgcctccaggcccttggctacccttcttcc

SEQ ID NO: 6764000 - DNA, 59 bp, Homo sapiens
gaaatagaagctgccaatttcttcaggtctgagcccaggaattgtcacagcatcatttc

SEQ ID NO: 6764001 - DNA, 58 bp, Homo sapiens
gctttggtatttgaaatgtgctagctacttactgctgagcaccagttttatgccaggc

SEQ ID NO: 6764002 - DNA, 99 bp, Homo sapiens
ttctgcacatgagtaattgggggcagaggctgaccctgctgttgtataaaagtaattgacggcagtaaattcagccctttgtgttgctcaggtatagaa

SEQ ID NO: 6764003 - DNA, 98 bp, Homo sapiens
gaatatgcccctgtcagtatttaacatttcttctgaaactgagtctagatactcaatctgctccagttttttgaacaagatgagtagcaaggttattc

SEQ ID NO: 6764004 - DNA, 81 bp, Homo sapiens
gctcagtgtttctgtggatggcaaggtggtgcttttggttttgtccacagagtcttccttctcttctgctgaattctgagt

SEQ ID NO: 6764005 - DNA, 75 bp, Homo sapiens
tgtacagggcatgtgcagacacatatgtgcacactatgtcgcacacattcaaatgtgcctgcacatgtctttgca

SEQ ID NO: 6764006 - DNA, 55 bp, Homo sapiens
gtcaaggtttgaaaacgccatggcatatcatgccgtggactattcagaccttagc

SEQ ID NO: 6764007 - DNA, 55 bp, Homo sapiens
tgcccaggattgtgaggtcagggcaggatgccaagatgaactacatttcctggca

SEQ ID NO: 6764008 - DNA, 121 bp, Homo sapiens
caggacttccagagaaagcatttttagacataggaagtggaagcttatggtctcttaaggcttggcaccagaagctagctccatattctattggtcaaagaattcgctaaggccagtcctg

SEQ ID NO: 6764009 - DNA, 61 bp, Homo sapiens
gaggtgtgggtaatgttacagataggttgatcctggatattttgttcatagctcactcttt

SEQ ID NO: 6764010 - DNA, 111 bp, Homo sapiens
aaatcagggtgcatcatatgtgaagctttctataaatgaatgtgtatattgagccaaaatgtaaaatatatactgtatattgtagtcagaaacattgaaagccactgattt

SEQ ID NO: 6764011 - DNA, 60 bp, Homo sapiens
tgattgcctactatgtgccatgctctgttccaggctttaagggtgcagtggtagcaatca

SEQ ID NO: 6764012 - DNA, 71 bp, Homo sapiens
ggtagggatgctttgctgacagattcgggcgtcctcccctgaacgaatgtcctggcggggcgtgcccagcc

SEQ ID NO: 6764013 - DNA, 67 bp, Homo sapiens
agggagggagtgcagggacagaccggggcactccaggccccatccactggccactgcacctcttcct

SEQ ID NO: 6764014 - DNA, 56 bp, Homo sapiens
gctgccaccgtggagatgagtggtgattaattgcaggttgcaagccacggtgcagt

SEQ ID NO: 6764015 - DNA, 59 bp, Homo sapiens
ggcgcaaggtgcagtcggagaaggccaacctgatgatcctctttgacaagtacctgccc

SEQ ID NO: 6764016 - DNA, 89 bp, Homo sapiens
gcccctcctcacagagtgcacatccctggcaggcgcttctgctcacaggtgaggggagggctccctgggagtggatgggaggagggagc

SEQ ID NO: 6764017 - DNA, 75 bp, Homo sapiens
gaatctgctttcaaattcacttagtacatttacagaatccatttccttgaggctgtgtgactgagagcctggctc

SEQ ID NO: 6764018 - DNA, 76 bp, Homo sapiens
gtggctcagatttggacacaggaactttaactcagcatgggggggtctctgagcttccaagatatcactgaggcac

SEQ ID NO: 6764019 - DNA, 59 bp, Homo sapiens
acagtgctggctacaaccctgggaaggcctaacagggttagtaacgtgacagcatctgt

SEQ ID NO: 6764020 - DNA, 55 bp, Homo sapiens
atgggccctgtgtgcacgtgtgtacgcctgcacgtgtgttggtcagggggcccgt

SEQ ID NO: 6764021 - DNA, 90 bp, Homo sapiens
gggttcccagggaacctggctccacaggccagggtgtgggaggaccgcctggccacacctcagccatgtggaggcggcacctgcacaccc

SEQ ID NO: 6764022 - DNA, 92 bp, Homo sapiens
agctgggaattcaggatatggcttttctgtagtagtttggcatttttccacaaagactagttatcaaggccacaggggctgtttccctagct

SEQ ID NO: 6764023 - DNA, 70 bp, Homo sapiens
ctactagaaagccattacaaaatttcatatgggaaatgatgtttgtctgaagtaaggttagtggcagtag

SEQ ID NO: 6764024 - DNA, 56 bp, Homo sapiens
gctagcaccatacagtgtgattccagagcagtggtaatcaagagtactggtgtggc

SEQ ID NO: 6764025 - DNA, 73 bp, Homo sapiens
cttgaacactgacattttcctgactgccatgcacgtgatatatttctttggcatctgaaaggttagtgttgag

SEQ ID NO: 6764026 - DNA, 74 bp, Homo sapiens
tggccaatatctgctaattttgtgcaagtctgataccatattgatatttctgctcaagtttggtagctggtcca

SEQ ID NO: 6764027 - DNA, 105 bp, Homo sapiens
ggccctaaaggagtttatctgacttggagtgggtggaggcgtcgagggcaggaagcccctagtcccacccgatgcctcgcctgtccagtgtgagcttggagggtc

SEQ ID NO: 6764028 - DNA, 64 bp, Homo sapiens
gagtccggagccgtggacggggccctaggcgacaccagggcgccctgactgcggcctcccactc

SEQ ID NO: 6764029 - DNA, 59 bp, Homo sapiens
gtctgtctccctgtgactgagaccaccgctagtgattctccaagtacagaggggcatac

SEQ ID NO: 6764030 - DNA, 123 bp, Homo sapiens
ctggataattttagggtggtaaagagagaatgcatgtaggcactctaaagcctcggtggctgttccctgctgccgctacaggagctgtcacatgcttttataactctgcctccttaagttcag

SEQ ID NO: 6764031 - DNA, 61 bp, Homo sapiens
ggcgctcgtgccgcatcaggcaggcgtaaagacaagtgcccagcctggctgggatgagccc

SEQ ID NO: 6764032 - DNA, 56 bp, Homo sapiens
caggccttgggagcagtgtttgtcctgtgttacacacctgacaatcccaggggctg

SEQ ID NO: 6764033 - DNA, 61 bp, Homo sapiens
gtcactggaattacaggcatgcaccagcatgcccggctaattttgtatttttagtagagac

SEQ ID NO: 6764034 - DNA, 62 bp, Homo sapiens
cacagtaagaaatgaagaggtaattgatagtgggcagactccatcctctgcattttgctgtg

SEQ ID NO: 6764035 - DNA, 66 bp, Homo sapiens
gatttcagtctaagatagaactctgaggctaccattcttgggtcttggattctatttgctgctttc

SEQ ID NO: 6764036 - DNA, 63 bp, Homo sapiens
gagaggagctcagtctcacagggtgaggaaaggctttctttcttacacagtctggcacttctt

SEQ ID NO: 6764037 - DNA, 74 bp, Homo sapiens
ttttgacccacatttctagacccggggtttacctcagcgatgacaacacctgtgggctgagaacaagggcaaaa

SEQ ID NO: 6764038 - DNA, 69 bp, Homo sapiens
ggggtgagttactgcacgccaggttctcagaacggtggtgtggagagactgcgtgtcagcgctggccct

SEQ ID NO: 6764039 - DNA, 55 bp, Homo sapiens
aagattttcccattggttctgctactaaataggtgaacacatttgggaaaatctt

SEQ ID NO: 6764040 - DNA, 66 bp, Homo sapiens
gaagtgtattgtctcacagttcttgaggctacaagcccaagatcaaggtgttggcagggtcacttc

SEQ ID NO: 6764041 - DNA, 101 bp, Homo sapiens
aagaatcaacagcatttagatagatgttttaggtccctgtagctcaaagtatggccctgagattatcagcacctgggaacttattagaaatgcagaatctt

SEQ ID NO: 6764042 - DNA, 83 bp, Homo sapiens
gaaataggttatattgtcagctgatcatattaaaatgtagaccttttatgttcatctggtgcatcagtcacgacaaccatttc

SEQ ID NO: 6764043 - DNA, 92 bp, Homo sapiens
gccctgaggctggggagactgggacatatacctgctcacttccagtgacagaatgtgactctcagatgtgacctttcccacacctgcagggt

SEQ ID NO: 6764044 - DNA, 83 bp, Homo sapiens
gttgagctgcatggtgagccgtgggcttccctggtgtcaggtttgagctctgccatggctcccacctcgcaaatgcagccaac

SEQ ID NO: 6764045 - DNA, 67 bp, Homo sapiens
cagcacaggaacaaagaagacaatttgtgattgatttcaagagttgtcaaaaggttctgtgatgctg

SEQ ID NO: 6764046 - DNA, 91 bp, Homo sapiens
ccatggggcttggcgtgctggagtggctctccctggagataggcatgtcctgggagtggcactcacagcaggatatgaacacagcccttgg

SEQ ID NO: 6764047 - DNA, 61 bp, Homo sapiens
ggatcaagtgcactctgaacaccccaatgccagggctgttcctgatgctcttgaagattcc

SEQ ID NO: 6764048 - DNA, 95 bp, Homo sapiens
tgcggatattgtgattaaacagacagtaaatgaaacaaatgggcagaggggtgtgtgtctgtaggtttctgtgtgtctgtttgtgtgtgtctgta

SEQ ID NO: 6764049 - DNA, 78 bp, Homo sapiens
tctccatatcccactgtaattatctgaacgtgcagataccactctgcatcttggaagattgcacaaatgggtgtggga

SEQ ID NO: 6764050 - DNA, 90 bp, Homo sapiens
ttgaagatcagagggagcacagtggaagaagcactgaacttggaataagaaaactcccagttccatccttccactgccctgtgatctcag

SEQ ID NO: 6764051 - DNA, 59 bp, Homo sapiens
tttcataatctgtcaagtggggataattatggtaaccaccactgagcattgttatgaag

SEQ ID NO: 6764052 - DNA, 84 bp, Homo sapiens
ctgccacacagaaccaggtgtgttccaggaatggtgaggggttaggtgttactagagaagggggccacgtggttagtgagggag

SEQ ID NO: 6764053 - DNA, 58 bp, Homo sapiens
gggatggatcttggctgaggctgggtttttcttgctagcttctttcattttccatccc

SEQ ID NO: 6764054 - DNA, 60 bp, Homo sapiens
acaaagctttgttcttcacagagtgctttttaagtatgtgaagatttgcgaaggatttgt

SEQ ID NO: 6764055 - DNA, 63 bp, Homo sapiens
gcagtgagcagtgagtgtggtgcagggttaggagcaggccctcagcatcctcatgctcagtgc

SEQ ID NO: 6764056 - DNA, 64 bp, Homo sapiens
caactatcctgtgagacttgtccattatcttcactttgcagatagtaacaatttataggacttg

SEQ ID NO: 6764057 - DNA, 66 bp, Homo sapiens
gaaagcagccactggccagttataggggaagttttgttatttgtaaaagaaacagtggttgtgttt

SEQ ID NO: 6764058 - DNA, 66 bp, Homo sapiens
tcaaaccatataatcggttacactacaattcaaaacaaattagggtgaaagacatatatggtttga

SEQ ID NO: 6764059 - DNA, 64 bp, Homo sapiens
tctgagtgacttaattctggctgtttgaaaagatatgatcaaacactagcaggaagcactgaga

SEQ ID NO: 6764060 - DNA, 56 bp, Homo sapiens
tgacatatcatcccattttcagagaatgaaaattcattttctctggatgatggtca

SEQ ID NO: 6764061 - DNA, 74 bp, Homo sapiens
cagggttctcaggtacaggagccatcctctccccagagtggcccaggacaggagcctgttagttgagtgctctg

SEQ ID NO: 6764062 - DNA, 81 bp, Homo sapiens
gctgtgtgacttccgaagccaggtcataagaagccttgcagcttcttgattctcagaatgcttgctctggaagaagccagc

SEQ ID NO: 6764063 - DNA, 84 bp, Homo sapiens
ggaggtggccatctacaagtcaaggagagaggtctcaggaaaaaccacacctgctgacacctcgatcttggacttccagcctcc

SEQ ID NO: 6764064 - DNA, 59 bp, Homo sapiens
agcaacagggtggtcttcagaatggtgagaacacatcacactggacacactctattgct

SEQ ID NO: 6764065 - DNA, 72 bp, Homo sapiens
gctttgtatctccatgtctgtaacacatgactagaatgacttcttgtcagtgtcttaacagagattagaagc

SEQ ID NO: 6764066 - DNA, 128 bp, Homo sapiens
ccaagtctgccctgagtttagttccttggttgtgaaacgtggctctgcagtgtcaatgatccaacttgaagcagctgctgccaagcccgtgctcctggccctcaggtcttggattcagcaggaactgg

SEQ ID NO: 6764067 - DNA, 61 bp, Homo sapiens
tggctggtcaaacggaaccaagtccgtcttcctgagaggtttggtccccttcaaccagcta

SEQ ID NO: 6764068 - DNA, 55 bp, Homo sapiens
ccctttctgaaggaagtgcagtttccttcgggcactgtcacctgctcagagaggg

SEQ ID NO: 6764069 - DNA, 77 bp, Homo sapiens
atgttgcttcactggctccacataggatacaggcacagcccccagtgtgtagaaccctaaaggagtgtggggcacat

SEQ ID NO: 6764070 - DNA, 87 bp, Homo sapiens
ggcttttatgatgcaatccactttgtgcccctctcttgcagcagctgcggccagggaaaaagcactaagtgggcttgctcactggtc

SEQ ID NO: 6764071 - DNA, 72 bp, Homo sapiens
gtaatgtggaagtaatagagtactggggttgaaaataacaaatctcccagtctcttttcagctccatcctat

SEQ ID NO: 6764072 - DNA, 56 bp, Homo sapiens
ccttaatcacccccttaaaggctctatctcgaaacagtcacattgggggtttaggg

SEQ ID NO: 6764073 - DNA, 55 bp, Homo sapiens
tttgcctggacccccagcatcatggtttcccatttcatggggtctctcaggtaag

SEQ ID NO: 6764074 - DNA, 65 bp, Homo sapiens
ggcctcagtttcttgtgaaatgaaatctggtttcttgatggaaagggcctcacaggtctcaggcc

SEQ ID NO: 6764075 - DNA, 65 bp, Homo sapiens
catcttgtgaatttctgattctaccacatcacatacctcagtggctcatcagaacttcagaggtg

SEQ ID NO: 6764076 - DNA, 81 bp, Homo sapiens
tgatattgcactggaagagcatctgagccagcgtgctccttgttgctccatttgactcatgctctctccagttatctatca

SEQ ID NO: 6764077 - DNA, 70 bp, Homo sapiens
agtaaagtatccagttattcttctagggctgcttagtcaagttaactggaagatatgacaatagtttgct

SEQ ID NO: 6764078 - DNA, 62 bp, Homo sapiens
tggcacatggtaagactcagtaagtgtcagataagatacctctactgttgttgctgttgcca

SEQ ID NO: 6764079 - DNA, 66 bp, Homo sapiens
tacacgtatctggacactgcagaggttgtagatgcatggacgtttacaacagtgtccatatttgta

SEQ ID NO: 6764080 - DNA, 81 bp, Homo sapiens
cagtgaatctctgtcaaggtccaggactacataagttgtctaaaaaaaatgaggtacttacattgagcttgagattcattg

SEQ ID NO: 6764081 - DNA, 121 bp, Homo sapiens
aggtaaaatatgtttcctataagtacctagagtaggtacttatatgaggtacttggaatgttgtatggaatgttgcatgcttcctgtaagtacctattgtaggtacttatatgaggtacct

SEQ ID NO: 6764082 - DNA, 58 bp, Homo sapiens
tcctggccacacattaatagtgcatagggagtgtttaatataaattcttggctcagga

SEQ ID NO: 6764083 - DNA, 70 bp, Homo sapiens
gctattgtgaatagtgccgcaataaacatacgtgtgcatgtgtctttatagtagcatgatttatagtcgt

SEQ ID NO: 6764084 - DNA, 70 bp, Homo sapiens
gaaaagtcatatcccttgactgcctatgccctccccataataacagaatgtagggagatatgctcttttc

SEQ ID NO: 6764085 - DNA, 87 bp, Homo sapiens
aaaaaagtaaattgccttctcacttcatctggatgagaatcctctgcagcagactgagtatgagaaataaaaagctttccctttttt

SEQ ID NO: 6764086 - DNA, 70 bp, Homo sapiens
gcctgctttaagtctgttgcctgaccccctgactaaatggagggaaaaaaatggaacagctcagggcagc

SEQ ID NO: 6764087 - DNA, 76 bp, Homo sapiens
gttctggctgagtgtccagtttcggatgtaacatttttttctgaatgtagacttcatcatgctggtagctcagaac

SEQ ID NO: 6764088 - DNA, 67 bp, Homo sapiens
gtgacagggacagagaaatgtcactatgagccctcagtgtcggtggcagttctgtgtctcttgttcc

SEQ ID NO: 6764089 - DNA, 77 bp, Homo sapiens
ggagtttcaatatttttgggaaagtgctgtagatgattgctgggttgggcagtgtttcccagagatggaaagaaccc

SEQ ID NO: 6764090 - DNA, 116 bp, Homo sapiens
agggtgtttctcagccccaagcaggcctgtgccttaaccctttaggcccctcaccaaggcctcagggggagaggccagctcaccctgctgccctcaggggcccccagaaggatcct

SEQ ID NO: 6764091 - DNA, 67 bp, Homo sapiens
aggtgaataccgacagtgtaaggtgctcttcctcaggccatgccgtttgctgtcgtgttttctgctt

SEQ ID NO: 6764092 - DNA, 56 bp, Homo sapiens
gtcatgttattccctgttgaaagccactcaatggcttcagctcggtctggcatgat

SEQ ID NO: 6764093 - DNA, 55 bp, Homo sapiens
tctccagtcccttctctgttagtaattaatctgcaactgtagaggttctggatga

SEQ ID NO: 6764094 - DNA, 75 bp, Homo sapiens
agcccggcagatggagagcccgagacatcctgtatctccggataaggctaggggccctctccccgcacccgggct

SEQ ID NO: 6764095 - DNA, 57 bp, Homo sapiens
tgtcaacattggctgacagttgtaacaaatgtaccacgctggtgggggatgttgata

SEQ ID NO: 6764096 - DNA, 56 bp, Homo sapiens
ggtaagagccctggctgacacatctgaaatgccttggtgtgcatgcatgctctgcc

SEQ ID NO: 6764097 - DNA, 112 bp, Homo sapiens
atagcagccagtgggaggctctgatggaagagggaggtagtgggaagaagggagaaaccaggatatttctccctctttgtctgctttgggtggagtctccagtagctgctat

SEQ ID NO: 6764098 - DNA, 105 bp, Homo sapiens
ttcagtagctctatttaggagggatattgtatcttctgtttagaagtgagaacttattcatttactaagcccagttatatgccatccactctgcaaagcactgaa

SEQ ID NO: 6764099 - DNA, 56 bp, Homo sapiens
ttggcccctcttgtggcacatacggtgggctgtgggggcccagaagagagggtgaa

SEQ ID NO: 6764100 - DNA, 86 bp, Homo sapiens
atttgtcaattttcacaaaggtattctcattttggaagcaagtgtcttgttctccaattggcatacttttaagaagtatgacaaat

SEQ ID NO: 6764101 - DNA, 129 bp, Homo sapiens
catgtccctttagaggcattaatgtgacaagcatattgcatttagagtgaaacattatgcatcaactaaaacactggtacatgaccaagcatgttaaatgtatgttcatatttttgttacaaaggagtg

SEQ ID NO: 6764102 - DNA, 60 bp, Homo sapiens
caggagacaagttagcagctgatggggcagatatgtttgtttagctagcgcttggtcctg

SEQ ID NO: 6764103 - DNA, 68 bp, Homo sapiens
gctgggagagacaattttggttttcaaagcaaggcctttggagtctgtcacctgtttctctatttggc

SEQ ID NO: 6764104 - DNA, 60 bp, Homo sapiens
gccagctgtctgtctcctgaggagacctgcttgtgcattcacccaggtccaggctctggc

SEQ ID NO: 6764105 - DNA, 86 bp, Homo sapiens
gggtataatgtacattattcgagtgatggttacactgaaaggccagacttcatcactacctaatatacccatgtgcacttgtaccc

SEQ ID NO: 6764106 - DNA, 65 bp, Homo sapiens
cttctgcatgccctctgtgtggctgacagttctgggggcccaggaggttgggctgtgcagcttag

SEQ ID NO: 6764107 - DNA, 73 bp, Homo sapiens
cagtttcgttgtacttccattcggaggcaacagcctcattggctgctgtcttttcctggcagtaaaatagctg

SEQ ID NO: 6764108 - DNA, 56 bp, Homo sapiens
cacattgccacacaagtaaagaaacaacttctgtttcaactaggtgtggtcatgtg

SEQ ID NO: 6764109 - DNA, 68 bp, Homo sapiens
gtaatgatgatgatgatgggccttgctgagacatagtgcagctctttaaaccatttcatgattattac

SEQ ID NO: 6764110 - DNA, 55 bp, Homo sapiens
ccttacagcagcatcgcagtgacctgtttaggttactccagtgcattctgtctgg

SEQ ID NO: 6764111 - DNA, 79 bp, Homo sapiens
cattctgttaggtaagatcttggcttcttcaatgttctatggatatttaaggattccagttttacttgccatccaaatg

SEQ ID NO: 6764112 - DNA, 66 bp, Homo sapiens
gatacaaagaagaggtcaaggctgagaaagaccccctgattcagccctgggcttcctcatggtgtt

SEQ ID NO: 6764113 - DNA, 55 bp, Homo sapiens
gagagtagggactgggctctgtgtcatatacgcaaagcagcagcacctgcatttc

SEQ ID NO: 6764114 - DNA, 92 bp, Homo sapiens
ctggagagctttttaaaaattgtcatttctgtgccctacccacctgaggtctggcatggggcccaggaatctgcattttatgagctccccag

SEQ ID NO: 6764115 - DNA, 81 bp, Homo sapiens
tgggactggaagatcgcgcgcgttggacctgtggcttgttgcgctcagagctggcccaggaagacgtgtcccggctacccg

SEQ ID NO: 6764116 - DNA, 73 bp, Homo sapiens
ggctggctcagggggattagcaattatctgaactcacacttagaaatccttgacctgttccccttggtccatc

SEQ ID NO: 6764117 - DNA, 99 bp, Homo sapiens
ggcctttggaccctgggactcacactggtgcaaccactccccgcaggttcttggccttggactgagagttccaccattggtttccctggttctgaggcc

SEQ ID NO: 6764118 - DNA, 90 bp, Homo sapiens
gatacaggagacagctatcaggctcagccacaggggaaggggatgctctctctaaggtgctgggtctcaaacttggttgtacattgtatt

SEQ ID NO: 6764119 - DNA, 90 bp, Homo sapiens
tggtcacactttatcaatattcaaaaatcagcacggagacaacaacaacaaatctgtgttggtttttgaatattgataaagtggggttca

SEQ ID NO: 6764120 - DNA, 79 bp, Homo sapiens
cccgtcccttcctggtcaggtaactgggctgaagggcactcacccttgggctggggactctgtccttctggagagcggg

SEQ ID NO: 6764121 - DNA, 90 bp, Homo sapiens
ttcaagtcaaattccattctctgtgtctgagttatggtcttttactaagataatgttaatatcataagcgatacaaaatggttacttgaa

SEQ ID NO: 6764122 - DNA, 85 bp, Homo sapiens
ctagaaaactgaacctgaagggttcactaagtaagtcttagtgattagactaggccttgaaagtagctctgctttagaattctag

SEQ ID NO: 6764123 - DNA, 71 bp, Homo sapiens
gagtagctgggttgaggtcatctacgtctgaaatctctcagaccactgtggtaggtgagaacccagctctc

SEQ ID NO: 6764124 - DNA, 89 bp, Homo sapiens
ggagtttcactcttgacacccaggctggagtgcattggcatgatctcagctcaatgcaacctccgcctcccaggttcaagcaattctcc

SEQ ID NO: 6764125 - DNA, 82 bp, Homo sapiens
gtctcccttctctccctcatcccatcgcctagggtgtccgggcccctaggagaggtaatgaagttcagaaaggccaagggac

SEQ ID NO: 6764126 - DNA, 56 bp, Homo sapiens
gctgtgggtacaaatacacaatgaggaggaattctttcctgtatttgtaccacagc

SEQ ID NO: 6764127 - DNA, 93 bp, Homo sapiens
cagagggcaggtgcagctggaagtgacactctgtgtttccctgcatccccctgaggtcacaggtcctcaagtcagctgggaagccgttctctg

SEQ ID NO: 6764128 - DNA, 76 bp, Homo sapiens
aggccctgggcagggagaccaggctctgaccccccagttacatccttggaatgagctctggcttccgccctctcct

SEQ ID NO: 6764129 - DNA, 127 bp, Homo sapiens
agttttacttgaaatatttgtaaattggtttgttacaagtcttgaggtactttcacagcttgagtggaagccttgcctatttgatgacatactaacgttaccaactgaacatgtcccaaatagaact

SEQ ID NO: 6764130 - DNA, 92 bp, Homo sapiens
gtaggactgtttgtcaaaactaggagtgagtttgagattcaggattaaggttcaagtagggaatctccatttaccctgcatctcagtcttac

SEQ ID NO: 6764131 - DNA, 73 bp, Homo sapiens
caggaaggctagggacacagctctgctccatcacacaggaaggctgggggcactgctttgctctgtcacactg

SEQ ID NO: 6764132 - DNA, 71 bp, Homo sapiens
cagacatttatttctggtaggtctggaggctgggaagtccaagatcaaggagctggcagatatggtgtctg

SEQ ID NO: 6764133 - DNA, 75 bp, Homo sapiens
tcagtcttctaagcattggtcttaatactgcatgttctttgcaaaatataaagtgttgtacaaatgtatgactga

SEQ ID NO: 6764134 - DNA, 61 bp, Homo sapiens
ctcccgccctgacacagctgctcctgggaacctagtgcagacccacgtccagggccaggag

SEQ ID NO: 6764135 - DNA, 66 bp, Homo sapiens
ggttgtagcttatgggaaactccagaggctggacaagatctctgaggttccctgggtcccacagcc

SEQ ID NO: 6764136 - DNA, 68 bp, Homo sapiens
ttggcttctgcatatttttagagacaaatgctttatcaagaagggtcctgaacaaatggcatagccaa

SEQ ID NO: 6764137 - DNA, 75 bp, Homo sapiens
ggctagacgggagacctggaggatgtggatgggcgggtttccagggccgggcacgtttccaggttgccatcagcc

SEQ ID NO: 6764138 - DNA, 59 bp, Homo sapiens
ttaaaatagccagtgcccctctgaaggtttaaaactcagaggggcactggctattttag

SEQ ID NO: 6764139 - DNA, 108 bp, Homo sapiens
ctgtcttctgtgccacttgttttaatatccataccttatttcctggtgacattgtgtagcagcaaatacccatctgtgagggggtgaggcagtggacagaggtgacag

SEQ ID NO: 6764140 - DNA, 74 bp, Homo sapiens
gagtttcacaggatggactgcattttattttctgaacttaaaagtaaaaaacattactctgtcctgagaaattt

SEQ ID NO: 6764141 - DNA, 71 bp, Homo sapiens
gaccaggcatgtggctggcactctgtccagtgtcccacaggggctgtggactatgccagcagggcctcgtc

SEQ ID NO: 6764142 - DNA, 56 bp, Homo sapiens
actggaaattgagaggtcactgctttgtgaggaaggtagtcacttcagttttcagt

SEQ ID NO: 6764143 - DNA, 60 bp, Homo sapiens
gtccttctcaaatcctgtgttttaagccacaaagataggtcaggaaatgagaaaggggac

SEQ ID NO: 6764144 - DNA, 59 bp, Homo sapiens
gtggaggctgtgtttcagtgaggccttggaagttcggggctggtactacagcctgctat

SEQ ID NO: 6764145 - DNA, 115 bp, Homo sapiens
actacctaagatctctgctagtaaatggctgaatgatctggactacaattctttggactcttccttctcaggagatcctgtagtctcacagccccatagctgtgatctaggtagt

SEQ ID NO: 6764146 - DNA, 56 bp, Homo sapiens
ggtgggcacccgagactggatcgaaggggagacctaccagtgcagggtgacccacc

SEQ ID NO: 6764147 - DNA, 71 bp, Homo sapiens
ctggggattcccatctctgagtggaaggcgcgaaggcccctgccttgaacatggatggcgtgggtccccag

SEQ ID NO: 6764148 - DNA, 105 bp, Homo sapiens
gcttgtgggctggaccctggagcccagctgcaccctggtgggtcccaggcggctgagcagagggctcggacagtgtgcgtctggcctcggggtcctcccatctgc

SEQ ID NO: 6764149 - DNA, 63 bp, Homo sapiens
aggggtgagctctctgggtcctcttttataggggcactactcccactcatgagggttccccct

SEQ ID NO: 6764150 - DNA, 61 bp, Homo sapiens
ggtacagatgctgcctgggaatgtctgccctgcccgcagccactccttcagcgtctgctcc

SEQ ID NO: 6764151 - DNA, 81 bp, Homo sapiens
gggctgcatgcctgtccccgcctgtctgagaaagcaggcggggcctccctctgctgtctcagatgggccaggccccagccc

SEQ ID NO: 6764152 - DNA, 74 bp, Homo sapiens
tcttgggaggagcacctgcctgtgactcccttcctccctgtctttttctggcaggtgactcgcctttctcaaga

SEQ ID NO: 6764153 - DNA, 63 bp, Homo sapiens
ctgaggagtttgggttgttcaaagctatgtagcttcctgtttgcaaagcctgaaactcttcag

SEQ ID NO: 6764154 - DNA, 75 bp, Homo sapiens
cttattgagggtaatgatgtttttaaagaacatagaacattctttatgttttaaaagaatcatgccttcattaag

SEQ ID NO: 6764155 - DNA, 118 bp, Homo sapiens
gtggcggtttccaaagtgcgggggacaaggtgtggcatgcagggagtgctcctattatcgtgattattgtggtttttcctgcatcttttcctgccctttcctcccatcctactcccac

SEQ ID NO: 6764156 - DNA, 64 bp, Homo sapiens
cagtgtggagcatcgagggcagaggagagctgagccgaccccaccctctgccccagccgcactg

SEQ ID NO: 6764157 - DNA, 70 bp, Homo sapiens
gaagaagatgctgcttgttcacgggcatttttattacattaggatctctgagctcgtgcagtacttcttc

SEQ ID NO: 6764158 - DNA, 90 bp, Homo sapiens
catatgtgataaattatttattattaatttgcagcagatgaaaccacataagcatctgttcagaaaacagataactaatttggacatgtg

SEQ ID NO: 6764159 - DNA, 56 bp, Homo sapiens
tcatctctcagggccaaaggaggtacagccctgcctgtggcaagtagatgagatga

SEQ ID NO: 6764160 - DNA, 63 bp, Homo sapiens
tcacagctccagactgcaactcctggtgtgatctagcctacagaggcactcgggagtctgtgg

SEQ ID NO: 6764161 - DNA, 122 bp, Homo sapiens
ccgatttttcttctggttcttagcaggaagcacgaaaacattttaattgtccagttctggagggaatggaacttgaaaatcaaggtggtaagtgcactgagctcaaccattgggaaaaaagg

SEQ ID NO: 6764162 - DNA, 60 bp, Homo sapiens
ttgtttcagcccagatctttactaaattttgtgagatcagcattgttgggcttgaattaa

SEQ ID NO: 6764163 - DNA, 58 bp, Homo sapiens
taagggaaaactggtataattggtgctggaatcactaactaggaatagtttaccctta

SEQ ID NO: 6764164 - DNA, 72 bp, Homo sapiens
atcaggaaggtcccactgtaaccagtaaattatctgccccatcagccagttcttacaggggacctttgaggt

SEQ ID NO: 6764165 - DNA, 94 bp, Homo sapiens
ggatttcctgatgtgtcaacaagaataccatcctcctgggatcaacattcataatttccagagaactggactcttatttgcatatagaatagcc

SEQ ID NO: 6764166 - DNA, 63 bp, Homo sapiens
aagaactgtttacaattttcaccctggaaaggtttttctcttgtgtgaactgtagatagtctt

SEQ ID NO: 6764167 - DNA, 81 bp, Homo sapiens
ccccctttccccagaggctgagttgggagcatgttaggaacactagctagttgctcctgaacacagccctatgaaataggg

SEQ ID NO: 6764168 - DNA, 69 bp, Homo sapiens
gggcttgcttttatttcttcacaaaagtagaagataactctatttcctggaggaatggaagcatctccc

SEQ ID NO: 6764169 - DNA, 64 bp, Homo sapiens
actgggcggctgggttcctctcaggccttgggcatgtgagagatgaagttagttgttcctcggt

SEQ ID NO: 6764170 - DNA, 130 bp, Homo sapiens
cctcagctgagatggccagaagtgggagcctacctttgctatccttggaatcctagttcaattgacctcatcaagaagtgggccaaatggaggcaagtggctcataccattgtttattttctgagctagg

SEQ ID NO: 6764171 - DNA, 84 bp, Homo sapiens
tcactagcatcctgggggcaggctggtgtgatgcagagcctgagggggcagccatactcagacctgggcccagattggtggtgg

SEQ ID NO: 6764172 - DNA, 82 bp, Homo sapiens
gtccctgtgctcacatgtgcaagtgggttgtgtgtttctgatgtgcaaagggacttgcacatggggaagtagaggtagtgac

SEQ ID NO: 6764173 - DNA, 62 bp, Homo sapiens
cttcccattctttccatggaaccaggctggacccagtattccaggaccaggaagaggggaag

SEQ ID NO: 6764174 - DNA, 80 bp, Homo sapiens
tcgatcgtttagaaatcttattagcttgctttgggctttcttttagagttggagaaattaaaatttagagaccaggttgg

SEQ ID NO: 6764175 - DNA, 58 bp, Homo sapiens
gaggctgagaactacagtggcctttccccaggaaggctgtgttctggttcttagcccc

SEQ ID NO: 6764176 - DNA, 56 bp, Homo sapiens
ggtaagtctgggagggcaatcagattcatttcaatcttgagctctccacaatttcc

SEQ ID NO: 6764177 - DNA, 58 bp, Homo sapiens
gcccaggatggtgtgtagtggtgtgatttcagctcactgcaacctgccgctcctgtgc

SEQ ID NO: 6764178 - DNA, 68 bp, Homo sapiens
gtcaagtggaattcaaaatgtaggcatgacaataaaacagccctggattctgaggtccaacaggtgac

SEQ ID NO: 6764179 - DNA, 94 bp, Homo sapiens
agggtatgcttggcttgtcacagcagcaaaggctctgacaaatgatgaagaagatggggccttttctgaatgtggaaatggccgggtgatccct

SEQ ID NO: 6764180 - DNA, 117 bp, Homo sapiens
cccttccatggccctctccacctgggcctccatccccagactctcctcttgaagggctctaggccctgcagggagctctggggtgcagggctggctgggagggtggggtggcaaggg

SEQ ID NO: 6764181 - DNA, 75 bp, Homo sapiens
ttggggatcattacagagacatccagaacacagataagcaaatatgtgcgtggattcctgtactcatttctctaa

SEQ ID NO: 6764182 - DNA, 101 bp, Homo sapiens
tggcttaatgccctgaagactctctgatggtcaattttcaggcagtttgtgtaggaaacatggcctggcaatggcctcaggaagcctggctgtgatttcca

SEQ ID NO: 6764183 - DNA, 78 bp, Homo sapiens
gccccaattcagcaggaagcagttagagctgtcattggccaacctccccaacagcacttgggttttcctgttgagggc

SEQ ID NO: 6764184 - DNA, 72 bp, Homo sapiens
aagcttcctgtacagtgaatgaatgtgacaagggttattgaagttgcctcactcattcatctgctgaaggtt

SEQ ID NO: 6764185 - DNA, 59 bp, Homo sapiens
gcttgctgttgctcttttcttggttggcttttgtgcagattactttgtagcagtcaggc

SEQ ID NO: 6764186 - DNA, 65 bp, Homo sapiens
agcacagagctcggggaatggaagaaaggaaggaatattccatgacatcgccaggctctgctgct

SEQ ID NO: 6764187 - DNA, 69 bp, Homo sapiens
ctaaaatcttcacaatctggcttagcattgtgcaatagaaacataaagcaggccacatatgtgatttgg

SEQ ID NO: 6764188 - DNA, 60 bp, Homo sapiens
ttttgtcctcagtaagagggcctctggccaaaatttggctagcggcccattgggataaga

SEQ ID NO: 6764189 - DNA, 76 bp, Homo sapiens
tagatctagtctctctgggtcctggcaagctcacagatagatgtgggcctatatatggctgagagagcctgattta

SEQ ID NO: 6764190 - DNA, 91 bp, Homo sapiens
gtccaaaatctctagtcccctagaaaagtgcctgtgcttcccagttactggttgcacttggcctttatctggggaaattaagagacctggc

SEQ ID NO: 6764191 - DNA, 56 bp, Homo sapiens
gagcacagcgcagtttgtaattttgattctgtttcatgctgaatcttgttgtgctc

SEQ ID NO: 6764192 - DNA, 73 bp, Homo sapiens
tgagctttgttgttagtatatttgcattggagcccatggaatgaaatatatattagcaatccacagagactta

SEQ ID NO: 6764193 - DNA, 81 bp, Homo sapiens
atgcctaaactatatagctaatgtagtgagtggagctcacgcttcgaaggctgtgccctttcgctgcactgtgtaatgcat

SEQ ID NO: 6764194 - DNA, 71 bp, Homo sapiens
ctcagaaatgccacacttttaacaggagaattcccttgggaagggaaatttcggttgtagggtgccctgag

SEQ ID NO: 6764195 - DNA, 80 bp, Homo sapiens
atatttgtgtaaagaggaggggttttttaatttaattttattactttatggctaagaatctctctactttattactgtat

SEQ ID NO: 6764196 - DNA, 84 bp, Homo sapiens
gatagaagagaatgatgccctctagtacgataaaactgcttacaattcaacttatggtatatgactgtattatgcttttgtgtt

SEQ ID NO: 6764197 - DNA, 72 bp, Homo sapiens
gtcagcctgtcggctccttcattctggccacacatcacaacagtccatgaatgcagcagtgacagggctggc

SEQ ID NO: 6764198 - DNA, 85 bp, Homo sapiens
aggagcctcgttgtggggagaaatagagcctccccgaaggtagacaggtgacaggctctgtttctccatgctgtggctggcacct

SEQ ID NO: 6764199 - DNA, 68 bp, Homo sapiens
gtgtagggtggtcaggaaagtgttctcagaggacatgacatgtccacttaatttcctgacttccccac

SEQ ID NO: 6764200 - DNA, 71 bp, Homo sapiens
ctgatgagggaactggttcataccccagcacaacctggaaatacacgtgtgagcaggtttgacctaagcag

SEQ ID NO: 6764201 - DNA, 66 bp, Homo sapiens
cattaaataatttatttgaaattttgtaaatggcatatgccattccagacaggtaaattaggtttg

SEQ ID NO: 6764202 - DNA, 83 bp, Homo sapiens
gtgaatgcagtatcttccaaatggagaagatgagttcaatcctttgaaagtacatgtttggccatttgcccaggactggtcac

SEQ ID NO: 6764203 - DNA, 70 bp, Homo sapiens
catcaccatcagcagatgctcaatgaacacctcctatttgggtgtgacatcctgttgtgtgcttgtgatg

SEQ ID NO: 6764204 - DNA, 85 bp, Homo sapiens
cgagtcccgggacaaaggggagcctgccccggagaggctccggctccccgggcggggcaggcccgcccctttcccccgcgacttg

SEQ ID NO: 6764205 - DNA, 65 bp, Homo sapiens
ggcatctaccttattaagttgttatgataattaaacataatcattcacataaggtgcttggtgcc

SEQ ID NO: 6764206 - DNA, 57 bp, Homo sapiens
ttccccaggcggctttttcagcatctggccacatgttggcaaggtgagcctagggaa

SEQ ID NO: 6764207 - DNA, 57 bp, Homo sapiens
tctgtgactcatatctgtagatagcaattttcttacaggtgtttgttgagtgatagg

SEQ ID NO: 6764208 - DNA, 78 bp, Homo sapiens
tccaagtggcttcccaatgtgctagtttctgggctgacagtcaattccaggccctaggactttggggggaaattagga

SEQ ID NO: 6764209 - DNA, 74 bp, Homo sapiens
attcatttctcataatattagcacttgtgttttaagagcacatagcaaggagctattgttagagaagccaggat

SEQ ID NO: 6764210 - DNA, 66 bp, Homo sapiens
gccaacaacagtgcagggatgcttcttggacactctaactggagcccctctgccactgtgtcaggc

SEQ ID NO: 6764211 - DNA, 59 bp, Homo sapiens
gatctaccctttgtcctgtgttctgttgctgcttgcacagggctgtccagggctaggtc

SEQ ID NO: 6764212 - DNA, 66 bp, Homo sapiens
taactaagacatttgaaatgtgatcccatcttgggagcactgatgtcatgatgtctcccacagtta

SEQ ID NO: 6764213 - DNA, 79 bp, Homo sapiens
caagatggttcacattcaaccaggaagaacaggcaaggcatggcatcccatctgctgtcttttctgggtgagtcttttg

SEQ ID NO: 6764214 - DNA, 60 bp, Homo sapiens
gtttaagatttgtaccctgttgacttcttaaaggacttgcgacagtgtatagattagagc

SEQ ID NO: 6764215 - DNA, 70 bp, Homo sapiens
gtgctacagttccaggatcatagggtcttctggggtttcccgcgtggcccaagatctggagctgcagggc

SEQ ID NO: 6764216 - DNA, 129 bp, Homo sapiens
ggatctaggctaagcaaagagttcttatgctatatgcactgtgatcaaggctaagcaaagagttcttatgctacatgcactgtgatctaggctaagcaaagagttcttatgctacatgcactgtgatct

SEQ ID NO: 6764217 - DNA, 130 bp, Homo sapiens
gccccacctccaacaccggggattacagttgactatgagatttgagtggtgatatggtttggctctgtgtccccacccaaatctcatcgtgaattgtactcccataattcccacatgttgtaggaaggac

SEQ ID NO: 6764218 - DNA, 65 bp, Homo sapiens
gctggtaaatgctcaacaattgcctttccaggaattaaaattgctagtttgtagcatttgccagc

SEQ ID NO: 6764219 - DNA, 90 bp, Homo sapiens
gattcccaggagaatataatgttcttgtaagagttttgtatcttgtttactaatgaaaagagagaatatggtgtatattcttggggcttc

SEQ ID NO: 6764220 - DNA, 66 bp, Homo sapiens
agcaaagagtaccacttccctacactttccatgttaatggaaactctgtgtgtgtgtgtatttgtt

SEQ ID NO: 6764221 - DNA, 61 bp, Homo sapiens
gccagtgaccccttcctggcctccccacccagggtccccggagggcagagggattacaggc

SEQ ID NO: 6764222 - DNA, 73 bp, Homo sapiens
ggaacatatttttgatatttctgatattgttaatggagtggttcagtccataaaccagaaaatcaagacttcc

SEQ ID NO: 6764223 - DNA, 65 bp, Homo sapiens
tgaggaggcagtctgtcccttagcacagctagagcactgtgctgagagatctgctgctctcttca

SEQ ID NO: 6764224 - DNA, 55 bp, Homo sapiens
gttcaatttcatgcatctctgcacttgaacttccagccaggagcaggagttgaac

SEQ ID NO: 6764225 - DNA, 60 bp, Homo sapiens
aaggtaagaaccagagtcttgtatatgcccttagtctttgaagtttctggtttatatctt

SEQ ID NO: 6764226 - DNA, 63 bp, Homo sapiens
gatgtcccccatccacacctacaccctgcaatcattctgtcagagtgcaggtctgatgccatc

SEQ ID NO: 6764227 - DNA, 74 bp, Homo sapiens
agttctttatatattagggatatcagctctttgtgttctgttgcaaatattttctcccagtttgtcagagaact

SEQ ID NO: 6764228 - DNA, 85 bp, Homo sapiens
gacttgtctcagtttctcacctcttcagagtcctaacatgttacgtgttatactatttagaggtacagattataaagactgagtc

SEQ ID NO: 6764229 - DNA, 90 bp, Homo sapiens
ggctagctatgaaggtgggcaggaaaaactaagggtgataactttacctgaattgatttgacctgtagggccattaactttatgcctccc

SEQ ID NO: 6764230 - DNA, 98 bp, Homo sapiens
tatgttggatgtggaagtgggatagagataacattgtggcttttggaaagttcaaactctatttctgttggcttaatttcattatcatttctttcatg

SEQ ID NO: 6764231 - DNA, 56 bp, Homo sapiens
gtgctcctggccacatgaagctggaagaaggccagctttaaccctttcaggagcat

SEQ ID NO: 6764232 - DNA, 69 bp, Homo sapiens
gacgcagggaggatgggctgttttgccctgaaccctaaggtgcagggtaggggctccttctccctgttc

SEQ ID NO: 6764233 - DNA, 80 bp, Homo sapiens
ctggtttagcttccaaggagttctgtcatgtgagtgcagtgactcaggaaaaatgtagtgataggattttttgatgccag

SEQ ID NO: 6764234 - DNA, 118 bp, Homo sapiens
ggggggaaagatttgcaaagtgtgaggggtaaatttaaattttctgatggagagctctttcagttgctaatagaagatttgggaaaatgttatccctcaaagaaaaaaaattcccttt

SEQ ID NO: 6764235 - DNA, 56 bp, Homo sapiens
agggctgttgtgagggttatagagctaatgcttgtaaaatgcttaggacagtgcct

SEQ ID NO: 6764236 - DNA, 101 bp, Homo sapiens
ttccgagatacctctgcaacttcgttaggcatgcaagattaagctcgaattcatctcggcttagtcatacgcgctctgaaactgaattgtgaaggatggaa

SEQ ID NO: 6764237 - DNA, 88 bp, Homo sapiens
ttgtgggacaattgctattttgaattcttaggtgtccaactttacaaccaaggtttacaaatattttaaatggtgatttagtcagcag

SEQ ID NO: 6764238 - DNA, 58 bp, Homo sapiens
aagacaagcacagataaaacaggattctgttgttaagcagagtaacctgtgctgtctt

SEQ ID NO: 6764239 - DNA, 56 bp, Homo sapiens
tatcacatacttctcatccaggctgttctttgggtcgtgggggctcagttgtgata

SEQ ID NO: 6764240 - DNA, 65 bp, Homo sapiens
gtatcctatggctattttattgacacatcccttcagcatgtgtatatttggtgtcaataggatgc

SEQ ID NO: 6764241 - DNA, 75 bp, Homo sapiens
ttaagatcacaaggtcctggtggatagaaaatatatattatttctgtactcatcacagtgacttggcagtcttga

SEQ ID NO: 6764242 - DNA, 81 bp, Homo sapiens
gcatagagtaggcttcaggaaatatacatttaatgaataaataagtcaatagataagtgacctttgattcctactatgtgc

SEQ ID NO: 6764243 - DNA, 67 bp, Homo sapiens
gggaggagggggtcctggccgagcggaggcggtcgccttagcaaagcccttcaggccctgtcctctt

SEQ ID NO: 6764244 - DNA, 55 bp, Homo sapiens
gtgactgagaaagaccacatggagactcaagtcttctcatgtctgtctcattcat

SEQ ID NO: 6764245 - DNA, 78 bp, Homo sapiens
ttcttgtttgaatattagagctaacaggggtcagggaagtttacccaactgtgtcctcacctctagtgcagacaggga

SEQ ID NO: 6764246 - DNA, 129 bp, Homo sapiens
ttggcttttagaatttgattatatttaggattagggtacattttgttgtcaaatgtttctaaggccacaacagggacaatggcttgcaaatgggtccatattcttacatattctctcttcccgaaccaa

SEQ ID NO: 6764247 - DNA, 66 bp, Homo sapiens
ggaaaaagagagacagggattgtgaaaagtggggtaccttttcaaacttctattctctgttttttc

SEQ ID NO: 6764248 - DNA, 57 bp, Homo sapiens
ctgaagtggcctctctctctgctcctctgtacaggggacatgcagtggtcatttcag

SEQ ID NO: 6764249 - DNA, 57 bp, Homo sapiens
gatacacattactttctgtctgagtagcgttctcacccagacttgtgaatgtgtgtt

SEQ ID NO: 6764250 - DNA, 89 bp, Homo sapiens
ctggcctagacttcaggtggggcagctgtgggcaggggatggcttgtcttgtccatctaagtatccagcctgacacatgactagttcag

SEQ ID NO: 6764251 - DNA, 62 bp, Homo sapiens
gtaactagttgactttttcattttgttagaggtattttcgctgaacaaggtcaattggttac

SEQ ID NO: 6764252 - DNA, 77 bp, Homo sapiens
ggcatttcctagggtcgttcagttggcgtttcccacagtctgtagctaaagaatgtgctggctgttctagggaggcc

SEQ ID NO: 6764253 - DNA, 127 bp, Homo sapiens
aggggtgaaagctactcagagtcagcccaggatcctaggaggctggctcttgcgactcagcttggctgccattaaggccaaggagaaaggccagactcactaaggacctgctggcagtaccatcctt

SEQ ID NO: 6764254 - DNA, 63 bp, Homo sapiens
ccagaaagcaagcaaggtgttacatatgaggccaacagagggagcaatacattgcttgtctgg

SEQ ID NO: 6764255 - DNA, 87 bp, Homo sapiens
gcattattttatagaagatttccctatgattttaatctccaactctggactcttgagatacattgggaaatgccatgtgaaaagtgt

SEQ ID NO: 6764256 - DNA, 56 bp, Homo sapiens
ttctgggttcttcgattcttccctttcctgcaggggcagtaggaagagctccagaa

SEQ ID NO: 6764257 - DNA, 87 bp, Homo sapiens
tccctggagatgtacgagagcattaagccatcatcattcacccatgatacatttacctatggtcttgatcggctctcccatcttgga

SEQ ID NO: 6764258 - DNA, 68 bp, Homo sapiens
gggtattgcaattactcttcttcttcagatgaggaaactgagtctcagaaagattaagcaacttgccc

SEQ ID NO: 6764259 - DNA, 129 bp, Homo sapiens
ttcttgacctgccaaccctgtgactgagagtgtgagttggggctgggtggagaaagagagtccctgacttctcaactgcacttgccaggaatttagcctttgcaacttggtgttggaggtgataagaaa

SEQ ID NO: 6764260 - DNA, 56 bp, Homo sapiens
atttagcaaaaaatgatgaagcatccattagatgctataattgcaaattgctaagt

SEQ ID NO: 6764261 - DNA, 72 bp, Homo sapiens
tcgcttgaacccgggtggaggttgtggtgagccaagatcgcatcattgcactccagcctgggcagcaagaga

SEQ ID NO: 6764262 - DNA, 55 bp, Homo sapiens
gcatcaggtagaccaagactcagatctctactctgctgttttctgtacctgaagc

SEQ ID NO: 6764263 - DNA, 82 bp, Homo sapiens
tctcagaagtattatgctaaaggaaagagacagaattaaagcactacatactgcatgagtccatttacatgatattttgaga

SEQ ID NO: 6764264 - DNA, 75 bp, Homo sapiens
ctgacaactgaagtgttctggggacagcgtcccatgaaacagatgaacacctctccctagggccaggacagtcag

SEQ ID NO: 6764265 - DNA, 79 bp, Homo sapiens
cccttttttcatttgggtcagttttccataggcttcccaaatcatctaagtctgtgttgataattccagagacaaaggg

SEQ ID NO: 6764266 - DNA, 55 bp, Homo sapiens
ggggaggtgggattaggacctaaacagtttagctctagagtccacgctcttaccc

SEQ ID NO: 6764267 - DNA, 62 bp, Homo sapiens
ccctctgctgctgactcatcccagctctgcctgcagaaggggagtcaaagggcagtggaggg

SEQ ID NO: 6764268 - DNA, 59 bp, Homo sapiens
tttccatattctgcgtctgccaataattaagagttggctctataccaataatatgggag

SEQ ID NO: 6764269 - DNA, 58 bp, Homo sapiens
gtcactcatctcatggaggggtggtacctatgtcccctacccatgaatctgggatgac

SEQ ID NO: 6764270 - DNA, 62 bp, Homo sapiens
tgaatatgtgcaggtgttagtacttctgctagttggagttgtaacaagtctgcatacattca

SEQ ID NO: 6764271 - DNA, 96 bp, Homo sapiens
tttattgtagtgaatatgttagagtgtagcaggaagaggcaatatattcaatactggtcttttcctttattatttcacttatatttaagcaatgga

SEQ ID NO: 6764272 - DNA, 80 bp, Homo sapiens
tttatcagactgactttctgtggctatacaccatacacagtatagtaaagtaaccctcaggaaggacattagtctttaaa

SEQ ID NO: 6764273 - DNA, 61 bp, Homo sapiens
ctctccccagagaacacttgagtgattttcctatcagtcagcagtgggtcctgagggtggg

SEQ ID NO: 6764274 - DNA, 74 bp, Homo sapiens
atgctatctagaacaattattgtcacagataagatttgtttgtgccctgtctgttctcagtaaattaggagcat

SEQ ID NO: 6764275 - DNA, 80 bp, Homo sapiens
ggggagcttggttattcatgcacccatcttatgacaagaagaccatgcatggtagtaacctacatttgagagcttacccc

SEQ ID NO: 6764276 - DNA, 88 bp, Homo sapiens
gctgttttcctgggctgtttcctaccgtttttcattcaagggaatcagaggagtgggaaaccatgtggaagcaggatctggaagatgc

SEQ ID NO: 6764277 - DNA, 64 bp, Homo sapiens
aggcatgcatcactattcttaggcattaaatgaagaaactaaggcacacagttgctgcatgcct

SEQ ID NO: 6764278 - DNA, 83 bp, Homo sapiens
gtttgtaactggcccaggaaaagcagtgccagcaactcaaatgactgctctcactgtcttcttgagaaaacagcagtgcaagc

SEQ ID NO: 6764279 - DNA, 70 bp, Homo sapiens
gataggagaagtcaccttgtggtttatagtttaatatgctcagtgaactctaatggtgcttttctctttc

SEQ ID NO: 6764280 - DNA, 85 bp, Homo sapiens
cctggaggtctttttaagatgcagatttcgatacagtacatctgggctgggatccaagaatttgcactcctaacaaacccgcagg

SEQ ID NO: 6764281 - DNA, 92 bp, Homo sapiens
ggaggtcttgatctgattgtaggtgtttcatgatttggtatgcacacacatactctctcacacacgcctatatagaattgtcatgaatatcc

SEQ ID NO: 6764282 - DNA, 63 bp, Homo sapiens
tggggctcacctaggctggaagcatcaagaagtacacgtggttgagatctgggtgatgcccca

SEQ ID NO: 6764283 - DNA, 103 bp, Homo sapiens
gcatcacctggaatactgtcctcttctgcagggtcaatatggcattatcatacccatgtcccagatcacaggaggggagaaacacaggaattccaggtcaagc

SEQ ID NO: 6764284 - DNA, 84 bp, Homo sapiens
gcagggaggagaccacaggcagggagctggaaaggatgccaggcccagcaaaggggatctcagttaccttccatcccgccctgc

SEQ ID NO: 6764285 - DNA, 56 bp, Homo sapiens
gcctgcctcaaaatcccagttctgccacttgctagctttgtgatgatgggcgtggc

SEQ ID NO: 6764286 - DNA, 68 bp, Homo sapiens
gtaccaggcatggggccgctcctggtcccttttccggaccataaaagggcagcctcggtgcctgctgc

SEQ ID NO: 6764287 - DNA, 55 bp, Homo sapiens
ttctccaacacaagcatgatgtcttggtgacatccggctttcaatgttggtagaa

SEQ ID NO: 6764288 - DNA, 57 bp, Homo sapiens
agactgcagttgaggcagctggggaatttactcaatttttctcaatcgctgcagtct

SEQ ID NO: 6764289 - DNA, 76 bp, Homo sapiens
ttgcaagcccaggatcctacgtttgaatggcaggtgaattacatataccgacaatcactgggatattggtgtgtaa

SEQ ID NO: 6764290 - DNA, 81 bp, Homo sapiens
agaagaacattgaaacctgtttctctctgagttacttgtaagcattaagaaaaaagagagctgacagaaacattttctttt

SEQ ID NO: 6764291 - DNA, 57 bp, Homo sapiens
gggtagggaaggctctgcggggatgcactggccgcttcccccttgtctgaccctccc

SEQ ID NO: 6764292 - DNA, 105 bp, Homo sapiens
gtcttgaataataaaatgccttttgttcagctctcattgattagtcatcttcttacccacattgatcaaattcaggagtctggacaaagtgtctattacagagat

SEQ ID NO: 6764293 - DNA, 70 bp, Homo sapiens
gactcccgcggcttcccagaatgagggctttgcagagccctctctgtaggcaagtacttggcagggggtc

SEQ ID NO: 6764294 - DNA, 70 bp, Homo sapiens
ggtagaatctggatctgggcgcatttcttttgatgaaggtcccatgtgcttatggtctctggttgttacc

SEQ ID NO: 6764295 - DNA, 83 bp, Homo sapiens
agatggcccagaaatgccactgacaagcatgaaatacattaaaccaatgcatcttttcatagcagtccctttctgggtcgttt

SEQ ID NO: 6764296 - DNA, 79 bp, Homo sapiens
cctctccgtcttacaggccatgccaggcccaggaagtgggtgtgtcctcttctgtcctcgcaggccaagaagaggaagg

SEQ ID NO: 6764297 - DNA, 130 bp, Homo sapiens
accaaggcagggatcttagttttgttccctgatcatgagcatccagaacagtgcctgggacatactaggggctcaatatatagttctgggttgactacatcagagtaaaatggatgggatctgcctttgt

SEQ ID NO: 6764298 - DNA, 64 bp, Homo sapiens
gcttctaggccccaaggagagatgtatctatttctcttaccaatagattccttggggatagtgc

SEQ ID NO: 6764299 - DNA, 130 bp, Homo sapiens
ggggtcgggacggcagccccgcggcgtcctgctttctggcacagccgcgggatcccggcactgaacaactggctgtcccgcggcggtccgggcagggcgcggtgcgtggcaacggctcccgtccctcccc

SEQ ID NO: 6764300 - DNA, 100 bp, Homo sapiens
tcacaattatttgctctaactttagcttagattatcaatatgtttaacattaatctgcatgttagatgtcttcctaaagttagggatgaaataaatatga

SEQ ID NO: 6764301 - DNA, 60 bp, Homo sapiens
cctgtgggcttgagtgtagggtgtcttctctcctccaccgtaaatgcagttccccatagg

SEQ ID NO: 6764302 - DNA, 94 bp, Homo sapiens
gaagcagtgcattaatatttcttctaaagccctttgtacacacagtagtcctactgaaggaatgaatgacatattagctctatttatatgcttc

SEQ ID NO: 6764303 - DNA, 64 bp, Homo sapiens
tgtgggcactcagagttttcaagaagaccatgaaggaaagttttcaactgctgagggctccaga

SEQ ID NO: 6764304 - DNA, 78 bp, Homo sapiens
agcacaatgatcaatgcatgtgacaaagagtatgaatcactaggaattgcccttgtcagtgcattagcttgatgtgct

SEQ ID NO: 6764305 - DNA, 86 bp, Homo sapiens
cctttctcctttattcttccaagttgtaactcttcccaggagactgcagagtatagcgagttggggaaaaggaaagatgagaaggg

SEQ ID NO: 6764306 - DNA, 57 bp, Homo sapiens
caaggaggtgggaaagcagagcctgctttatgttgcagctctcttttcccctcattg

SEQ ID NO: 6764307 - DNA, 73 bp, Homo sapiens
tgctggcattaatatatgtaatactcacagcaacaactctgtgagataagtactgttattattgccattcgca

SEQ ID NO: 6764308 - DNA, 58 bp, Homo sapiens
atattgtgatggtttagtatcattgttaattgcatcttggtatcaaactatacaatat

SEQ ID NO: 6764309 - DNA, 55 bp, Homo sapiens
cctctcatgctggctggggagccatcatattgccatcacagctggctatgacagg

SEQ ID NO: 6764310 - DNA, 74 bp, Homo sapiens
gttttgaaacttttcctgctcttgtccttgaggacaaaaactgggaggaaagaggtggagaggtgatataaaac

SEQ ID NO: 6764311 - DNA, 70 bp, Homo sapiens
ctctagagcctcagtctatttccagcaggtgtgtggcccacacctggagtggggatactgaggccaggag

SEQ ID NO: 6764312 - DNA, 62 bp, Homo sapiens
gatgttcaagtacctttgtgtcttgatttgccttagcatgtagaaaagggacttgtaacatt

SEQ ID NO: 6764313 - DNA, 103 bp, Homo sapiens
ggccctgggcatcccgcagcagctccattgtgtcctcattgaccttcaccagccggatggggtacacgtggggcaggatgcggctgttgaaaccacaggagcc

SEQ ID NO: 6764314 - DNA, 67 bp, Homo sapiens
gccagtgtgcctaatgtttccattttcccctccttccaggaaaatggtaaattttgcactttgtggc

SEQ ID NO: 6764315 - DNA, 72 bp, Homo sapiens
acctactacacagtgatcagttactgtctgtattcatattttacagatatgtaaactgacacttggggaggt

SEQ ID NO: 6764316 - DNA, 72 bp, Homo sapiens
ggctgaaagaaggatatttgacacatttacatagcaaacttagtcaatgtttggaaatcctttgtagtggcc

SEQ ID NO: 6764317 - DNA, 57 bp, Homo sapiens
gctctggttttagcctttcagggccccgttctctcccttggaaagtaaccccagagt

SEQ ID NO: 6764318 - DNA, 65 bp, Homo sapiens
ctcacctgcaggcacaggtgtgcgcacttcgcatctcgaaggccggccagcaagcttcaggtgag

SEQ ID NO: 6764319 - DNA, 55 bp, Homo sapiens
gtccaagagggagctacagagcaaaaattgtcctgtgctgggtcccatcttgggc

SEQ ID NO: 6764320 - DNA, 75 bp, Homo sapiens
ctcatctaattttggaacagagacaagccatctctcttataagctgcccaaatttctgatccacaaattaatgag

SEQ ID NO: 6764321 - DNA, 67 bp, Homo sapiens
caactcctttggcctgtcatcctggctgtcagattgggctaggagctgtcagagtgccagagggttg

SEQ ID NO: 6764322 - DNA, 77 bp, Homo sapiens
tctccaatctatctggccactgctgatcagtaagaaactcccttatctgagaaagaagcaccagagaagttggtagg

SEQ ID NO: 6764323 - DNA, 56 bp, Homo sapiens
cttttcatcccactgggtttctattcaagcatagtgtgacccagtttgaaggaaag

SEQ ID NO: 6764324 - DNA, 102 bp, Homo sapiens
ggcctgtgaggaaagggagttgggtggtccaggctcagcagatgcccaccatccatgctctgctctgagagggccatcagacacccacctatccagcaggct

SEQ ID NO: 6764325 - DNA, 76 bp, Homo sapiens
tgaagttatctgagaaatagattcatggtagattctaagatagtattgttctagaattttttttcctgtggcttta

SEQ ID NO: 6764326 - DNA, 83 bp, Homo sapiens
gctttgcttgctagaattaagtggtcaatagtttcctaaagttgacgttgctcagggagcgatttaccatggcagggaaaagc

SEQ ID NO: 6764327 - DNA, 56 bp, Homo sapiens
cataagttgggtaatataatgaaatcttagaatggttcacttattctcaacttgtg

SEQ ID NO: 6764328 - DNA, 60 bp, Homo sapiens
gtgaaattctactgactttattgagcatcttacttctttaatggaggaagtatatttcat

SEQ ID NO: 6764329 - DNA, 56 bp, Homo sapiens
acatttgcctgtataaccttgtgtgttaccactgccaagcaatatagtgcaaatgt

SEQ ID NO: 6764330 - DNA, 126 bp, Homo sapiens
aatacagcccaagtttaagtagcttttttggcagccacatgcacttgagtcatatcgaatcatctaaaactctaaagtgtttttcacatgtgctgacattaagccacacctcccccatcctgtatt

SEQ ID NO: 6764331 - DNA, 60 bp, Homo sapiens
acccagaggccaatgaagtgagtttaaggctgatttgagcttactttgtgttgacctggt

SEQ ID NO: 6764332 - DNA, 76 bp, Homo sapiens
atggttgcgtcccagtatcatgtaaatgaccccatccttaaggctttatattaaaatgatactgaagcacaactat

SEQ ID NO: 6764333 - DNA, 59 bp, Homo sapiens
aggagcctccttctcatgtgcagctacaaatagcatgtctagcagattgggggctgcct

SEQ ID NO: 6764334 - DNA, 57 bp, Homo sapiens
cggggctggcacaggtgaccactgccctggcatcacccagctgtgtccggcagcctg

SEQ ID NO: 6764335 - DNA, 70 bp, Homo sapiens
ccaggaatcatagaggtgtcagggacatcttacctagttgtgacatgcctacttacctttaagccagtgg

SEQ ID NO: 6764336 - DNA, 83 bp, Homo sapiens
ggagctgggctctagtctctgctctgccacctattttctgggttaacctgggcaggtgacttatgtactgagcctcagtctcc

SEQ ID NO: 6764337 - DNA, 94 bp, Homo sapiens
ggcagttcttgtatgaagttactgagcctcttaatggccaaactgacttcagtgcacagccaggggctcagttactttggcagttgatctgacc

SEQ ID NO: 6764338 - DNA, 55 bp, Homo sapiens
gattatcttaaagtgactgcccttgttcttccaaagagcagatcattagataatt

SEQ ID NO: 6764339 - DNA, 56 bp, Homo sapiens
cccaggctgggggcaggatggctgccttttctgttttccctccctccagctctggg

SEQ ID NO: 6764340 - DNA, 73 bp, Homo sapiens
gcgtgtattccttgggtgcctacttagagcagaaggaaagcaaagatgctcaccgggtagccaggagcgccgc

SEQ ID NO: 6764341 - DNA, 91 bp, Homo sapiens
gatgtttgcagtgtgaagccagtctagtaacagtttaaatgtaataataaatcacagtgggtactagattgagtttattccactagaggtc

SEQ ID NO: 6764342 - DNA, 84 bp, Homo sapiens
ctacaggcaattacattttagctgttcactctcttaatgttatgtgggcagcttggatttctgtagttttatttattcttgtag

SEQ ID NO: 6764343 - DNA, 61 bp, Homo sapiens
ttgacagggcaagtttgagattattttccaatgagaagttctagaactgtgcccttctcag

SEQ ID NO: 6764344 - DNA, 57 bp, Homo sapiens
tcctttgcagaagaaaacatgaacaagtgtggccttgttcagcaaaattttgtagga

SEQ ID NO: 6764345 - DNA, 57 bp, Homo sapiens
gcctcggccccggccccggggtttcttggcgccatcggtgggcgtggaggccgaggc

SEQ ID NO: 6764346 - DNA, 96 bp, Homo sapiens
gatggaggagtctgaactgttgaagtgtgagcttgcaatggtatgatttattttccccaattgctgctttcatttatacagtgtaggccctctgtc

SEQ ID NO: 6764347 - DNA, 59 bp, Homo sapiens
ggggcctctgcagtcacgctgggtcacgtgctccagtcagccaagctgcagcggccacc

SEQ ID NO: 6764348 - DNA, 84 bp, Homo sapiens
gggtccttctctcaagggtagcaaggccaagctgatggctgcttgtttaggaggccatcagttccttcctgtggagaagggtct

SEQ ID NO: 6764349 - DNA, 57 bp, Homo sapiens
tgctattatcagacctttaaatttttgctttaaattttttaggggtatgaagtggta

SEQ ID NO: 6764350 - DNA, 55 bp, Homo sapiens
aggaggagcagttttgggaatggcacaacaagctcagaagttgaaggctcttttt

SEQ ID NO: 6764351 - DNA, 67 bp, Homo sapiens
gaagggcatggtatctattcaggaatgctccagtgagcttcctgaatataaagacactagctccttc

SEQ ID NO: 6764352 - DNA, 62 bp, Homo sapiens
agagaagtgttgctgtgttgttatttttaaaattaaggagcagctgaaaggcaaacttctct

SEQ ID NO: 6764353 - DNA, 92 bp, Homo sapiens
gtccactgtctcggtggtggtgttttttgaatcattaatcagaatgaatagtctatggtacagataatacatgctgctgagtttcagaggac

SEQ ID NO: 6764354 - DNA, 72 bp, Homo sapiens
cagtgtattagttgtccagcagttggatttgatcaccgaaaatgctaaaattgtgagattactatcacactg

SEQ ID NO: 6764355 - DNA, 62 bp, Homo sapiens
tgtaaggcacttggtctaatacttggtacataggaaagtaatcatgattactgtgctttgca

SEQ ID NO: 6764356 - DNA, 69 bp, Homo sapiens
ctgttctccctgcgtgggctccagggtccgtttgataagctgctttccccggggtcctgtgggagacag

SEQ ID NO: 6764357 - DNA, 84 bp, Homo sapiens
ggaaagtttttgtttgtgctatttaatgtagttgaagggtaaacaacatagaaagcactaagcttatataaagaaatactttcc

SEQ ID NO: 6764358 - DNA, 65 bp, Homo sapiens
ttggattagagatcactctgatgacctcatcttaacttgatcatctgcacagatcctatttccga

SEQ ID NO: 6764359 - DNA, 64 bp, Homo sapiens
gtgcagatacagcctgccaggttcttctaccctggtgttgaagaaccggtctggctttgtgcgc

SEQ ID NO: 6764360 - DNA, 59 bp, Homo sapiens
ccaaaataacagcccaattcaccaagccgagtaacttgggggttttgtgtttgttttgg

SEQ ID NO: 6764361 - DNA, 81 bp, Homo sapiens
gaaatgaaaagcaaaaggtggcagaaatgggactttgagtttaaaatactgagtttatttttctccatatagttttatttc

SEQ ID NO: 6764362 - DNA, 66 bp, Homo sapiens
taggaggaatatgaaagggaggaatgaatgttattagtgcatttacaccttcttcgattctccctg

SEQ ID NO: 6764363 - DNA, 70 bp, Homo sapiens
cactatgttggccaggctggtctcaaactcctgacctcaggtgatccaccagcctcggcctctcaaagtg

SEQ ID NO: 6764364 - DNA, 74 bp, Homo sapiens
aaagtacatagcatattccaactcttgaaccctggatccttctccccccactgggttgggtgtctctgtacttt

SEQ ID NO: 6764365 - DNA, 108 bp, Homo sapiens
ccagggatgacggtggtcaacagaactctttatcaaaatgcgttgatatgcataatataaaacgtgtaaatgtggagctgttctgttgaagcagggtgaggtccctgg

SEQ ID NO: 6764366 - DNA, 63 bp, Homo sapiens
gggagtctgaaagtatgttgtaatgcatagtcttgtatagctatgctttgagatgtaattccc

SEQ ID NO: 6764367 - DNA, 68 bp, Homo sapiens
tgataaagcagaaagtaaatgtgtatccaggatgcactggatgtaacacccacttttatagctcatca

SEQ ID NO: 6764368 - DNA, 87 bp, Homo sapiens
ggagggctcttctctctatgccttggggaatatccattcttcagcccccaagtctgagtccccagagtatgtgggaaaagtctctcc

SEQ ID NO: 6764369 - DNA, 70 bp, Homo sapiens
gcctcatgtggtagagggcagatgggcaaaaagggatgaactccctttgtctaagttctttcatagaggc

SEQ ID NO: 6764370 - DNA, 61 bp, Homo sapiens
ggcttttcctcaggaggagacgcgtccgcgccggcgtcgcctcgccgctctgggggcggcc

SEQ ID NO: 6764371 - DNA, 68 bp, Homo sapiens
gaatttggccaaataatcttgcagatggataatttcagactgggatgagtgttttgaaggcgaagttc

SEQ ID NO: 6764372 - DNA, 94 bp, Homo sapiens
ggagagggtctcctgctcgtggctcagctccccatggttcctgaagcgcacacgcgcccagcgccggcggcggcacgagtggtaggtcttctcc

SEQ ID NO: 6764373 - DNA, 82 bp, Homo sapiens
ttccccatctgcctttggtgacaggcatgtgtgggcattccttacctcccccaccagcctgatcatcaaagcaacaagggaa

SEQ ID NO: 6764374 - DNA, 72 bp, Homo sapiens
gcctagtacagtgctctgtaagtttttgttaaatgaaatatttttttaaattcctagggtattgtgcttggc

SEQ ID NO: 6764375 - DNA, 58 bp, Homo sapiens
gcgggggggtcttcagacctcagagcactgccattcttggtctaggggcccttcccgc

SEQ ID NO: 6764376 - DNA, 75 bp, Homo sapiens
ggagctggagctgcctgggcgtctgtcttccgttcctgttactacagggcctctgacgcccccagccccagctct

SEQ ID NO: 6764377 - DNA, 68 bp, Homo sapiens
aaccacatccagtttccaatcactgcacggcttttcaggttaatggttttttggagactgctggggtt

SEQ ID NO: 6764378 - DNA, 79 bp, Homo sapiens
atggcatctcgtccacacttaagttttcaataccctaaaaaatttatcgaagggagattttagtttggggaggtgctgt

SEQ ID NO: 6764379 - DNA, 58 bp, Homo sapiens
ccctcaccaggctccaggcatgtctgcagaagatcagctccctaaaagccagggaggg

SEQ ID NO: 6764380 - DNA, 60 bp, Homo sapiens
gagtctctggaggggtcagacctgggcattagtaggtgtctcaagctccccaggtgattc

SEQ ID NO: 6764381 - DNA, 74 bp, Homo sapiens
cccagtgtggccagtcaagtccctctgacctctgggctccttagaagtccctggtgctggctgcgctgcacggg

SEQ ID NO: 6764382 - DNA, 79 bp, Homo sapiens
tgtgctagctgcaggtatagtcaagtatgcttgcacagatgtgcaggtacaaagctactgcctgacaacagcgagtaca

SEQ ID NO: 6764383 - DNA, 68 bp, Homo sapiens
ctctgtgaacccctcctttctttgtgctggtgtctgggaccaaaaagggggaatatgggagggcagag

SEQ ID NO: 6764384 - DNA, 121 bp, Homo sapiens
cagaattgtttggagagcttgttaaaacacaggatgacaggcttcatcctcagagttcttaattcagtagctctgcagtagggcctgagtttgtattgctaccaagttccaaatgatactg

SEQ ID NO: 6764385 - DNA, 55 bp, Homo sapiens
gggtgaagcctttctgggtagaattcgatttccccaggaagacacatgctcatcc

SEQ ID NO: 6764386 - DNA, 85 bp, Homo sapiens
tcaattagcaagttagacatgagtgtgcttacatctgcccatgcagctgaaagcaataatctctgtactgtggtgttattgttga

SEQ ID NO: 6764387 - DNA, 83 bp, Homo sapiens
aggtcacagctcaggtggctgagctgacctttgaacccaaatcagcctggctcacagctcatcactacctgatgctgcctcct

SEQ ID NO: 6764388 - DNA, 78 bp, Homo sapiens
gcccgggccttgtaggctgggcattctggccaggccaggggcactggttccccaggtgcctagtggaaggcctgtggt

SEQ ID NO: 6764389 - DNA, 69 bp, Homo sapiens
gaatagaactggcagatatttgcagacatgcagcttttgggtatgccagcattatctccagtcaaattc

SEQ ID NO: 6764390 - DNA, 57 bp, Homo sapiens
ttttctctttccgtaagttagtggattcttctgtgtctattccaagggtagagaaaa

SEQ ID NO: 6764391 - DNA, 72 bp, Homo sapiens
cttaaattccactgccgaatgatacatttaacccatcagggagattgtgtgtgtgtggcagggggtggtggg

SEQ ID NO: 6764392 - DNA, 72 bp, Homo sapiens
ataggattaggctgtgggacagttaggagactgctttttcggcatttctcccaacttccctggccttcctgt

SEQ ID NO: 6764393 - DNA, 80 bp, Homo sapiens
tctttgggcttaaggccagtgtgcttttaaggaacaatgcattccaacagagagcctgcatctagcctcagagccctaga

SEQ ID NO: 6764394 - DNA, 83 bp, Homo sapiens
taaaaagcctgatgcccaggttataccccagaccaataacagcagactttctggggatgaaacccaggcatctgaccttttta

SEQ ID NO: 6764395 - DNA, 81 bp, Homo sapiens
tcttattagttctgttacctttgtgagtttcaccagcagctaatgaactccacagtgaggtaacttgagaacagatgaaga

SEQ ID NO: 6764396 - DNA, 70 bp, Homo sapiens
tgtggtatgacagaaaattcagagctaagaataaaaacctgaatctatgcactgagtctgtcatgctgca

SEQ ID NO: 6764397 - DNA, 88 bp, Homo sapiens
gagcctgtgctttgagcagggctctgaaggagacagctgctcctgggcatactggagccatttccttcagggtcaccagctcaggttc

SEQ ID NO: 6764398 - DNA, 63 bp, Homo sapiens
atttgcttcctaatactcatatgggttcatgctattcatctgtatgcttattagggactaaat

SEQ ID NO: 6764399 - DNA, 130 bp, Homo sapiens
gggtttcaccgtgttcgccaggatggcctcgatctcctgaccttgtgatccgcccaccttggcctcccaaagtgctgggattacaggcctcagccaccacgtcaggcccttctagaggatatttaaaccc

SEQ ID NO: 6764400 - DNA, 95 bp, Homo sapiens
gcatttcatgcccacaacttagacaacacaggttctgcaaaggaaatggtttttcttgcgtatttgtgtgtgtatgttgtaggagaaattgatgt

SEQ ID NO: 6764401 - DNA, 77 bp, Homo sapiens
ttggaggataggttgttgtattattaagagagcaggcaggtcctttgaattccagtacaataactcttctcctctaa

SEQ ID NO: 6764402 - DNA, 63 bp, Homo sapiens
ggtttgaccaagaaaagttctaaaattttatccttgaatgtcttcagaacacttggttagatc

SEQ ID NO: 6764403 - DNA, 60 bp, Homo sapiens
ggctttctcacagcatggcagctggcttccaagtgcgggaatgtcctgattgagagagcc

SEQ ID NO: 6764404 - DNA, 68 bp, Homo sapiens
ggagcttctgcgccaccttgtgcttgtgcccgctgggcgccagcaggttggtgcgcagcgcgtgctcc

SEQ ID NO: 6764405 - DNA, 57 bp, Homo sapiens
gtaagttcctcctgctaaatgaatttgttttgcttcatgcagagaaggactgcttac

SEQ ID NO: 6764406 - DNA, 65 bp, Homo sapiens
aggcacctcagctgagcctgggtataacaggcaaacccagccattcagtgactgaggaactgtct

SEQ ID NO: 6764407 - DNA, 80 bp, Homo sapiens
gagatgagcattgttgttaaacatagtaatgctggcttcccttactcaacacttactatatttgacaagagtttgatctt

SEQ ID NO: 6764408 - DNA, 56 bp, Homo sapiens
cttgctaaatcttcttcaaatgccaggcacgtgaggaacctatgatttagagcaag

SEQ ID NO: 6764409 - DNA, 59 bp, Homo sapiens
tgtctaacccagtggcaggaggggtgcttcctagaggagtatctgccagtggggaggca

SEQ ID NO: 6764410 - DNA, 66 bp, Homo sapiens
gttgtttttgtttaaaatcctggatggcaggataaatttctgtcattttcacacataaatagcaac

SEQ ID NO: 6764411 - DNA, 57 bp, Homo sapiens
ggaggctgggtcctgagttataaagaaaatcatcttttaatcagtctccctgtctcc

SEQ ID NO: 6764412 - DNA, 65 bp, Homo sapiens
gcagggaagtgatggagttcgatctgtgttttagacagatcgctcacatttggcttctagcctgt

SEQ ID NO: 6764413 - DNA, 60 bp, Homo sapiens
ggtgggagggggcctgtgagctctgtgtcgtgtgcagtctcgctgagcccccattctacc

SEQ ID NO: 6764414 - DNA, 58 bp, Homo sapiens
gagacagcagagcagactaatggaggaaatagagcttgtccatgtggctctgtttctc

SEQ ID NO: 6764415 - DNA, 83 bp, Homo sapiens
ggttgctagagggctggccctgggcagaggcaacatgaaaaggggccttttcatgcccccatagtcaccccattgaggcagct

SEQ ID NO: 6764416 - DNA, 67 bp, Homo sapiens
catgagcataattagaatccaagtgacctgtgagttcattccagtcctggttctgattctgacagtg

SEQ ID NO: 6764417 - DNA, 72 bp, Homo sapiens
caatgacttgttttgtaactgaaggcaagagaccttccctgtccatgtctcagtatacgaaacacttctttg

SEQ ID NO: 6764418 - DNA, 96 bp, Homo sapiens
ccccccctgggctcatatggggacctgggccttggattgacactgtatgcagcaaagacagcgtcaaagggtcctggataaaggctctgggagggg

SEQ ID NO: 6764419 - DNA, 95 bp, Homo sapiens
gtaaccgactgctccactttgcccagaactgtcccagttttagcagtgaaagtcccctgtccctcagttctgggcaaaccaggatggttggtcac

SEQ ID NO: 6764420 - DNA, 97 bp, Homo sapiens
ggtgctgggaggtccagggcacgggcagtgagcacagcctgcaccaggtgaacgggcacaggtggtgcctcctcccttcctggctgccccatgcgct

SEQ ID NO: 6764421 - DNA, 62 bp, Homo sapiens
gtagctgtgttcctcgctgggtgtccacagctactattgggcagcccatctcccacagctac

SEQ ID NO: 6764422 - DNA, 80 bp, Homo sapiens
aagtctttaaatacatattagtggctttgtttattgtgaggattttaaggtagccctaatgtgggtttaaatgtggattt

SEQ ID NO: 6764423 - DNA, 122 bp, Homo sapiens
acagaaagcagaagtggggcaatgggatgtgcggcccctgtggcaggaggaggagcacacgaaccctgaccctgcttcttggtgcaggccactccaggccttgcttctgtaagagactctgt

SEQ ID NO: 6764424 - DNA, 55 bp, Homo sapiens
ccttctcgatgtcttccatgttgatgggctagcaagcgtggatgcattgggaggg

SEQ ID NO: 6764425 - DNA, 76 bp, Homo sapiens
gattatctgagtggggagaggtatcattgagatcccacctaatcacaaaggatcacaatccctctctctgatattt

SEQ ID NO: 6764426 - DNA, 66 bp, Homo sapiens
ggtcaggcactgtggttgagtggggacagttgttctgatatgtgaagctattagttctaggtgacc

SEQ ID NO: 6764427 - DNA, 75 bp, Homo sapiens
aggtatgctaattgccagggtcaccactggaacttctcaccaggcaccagggtgaccagctggcctagtttgcct

SEQ ID NO: 6764428 - DNA, 55 bp, Homo sapiens
actgaaagttgatgagtcactgtgcctctcggggtagtgagttatcagctacagt

SEQ ID NO: 6764429 - DNA, 58 bp, Homo sapiens
ttgagactgccttgtcgtctgctgtagcagtgccctttatttctggggcagatctcaa

SEQ ID NO: 6764430 - DNA, 97 bp, Homo sapiens
gaaataaagttgtggcaatactttagtaaaatggccctagatttatagcaaggttacctgggttcttttcctggatagttgactgtgattttgtttc

SEQ ID NO: 6764431 - DNA, 72 bp, Homo sapiens
ttgcttttccttctcctttctactaaggggatcctccgtttgcttctccactgtagaggagaagggaagtgg

SEQ ID NO: 6764432 - DNA, 92 bp, Homo sapiens
tagttagccggagtgttggtgattgggatgccggctgataagagtcgactctaattttggcattttaacctacattctgagctgtcacacta

SEQ ID NO: 6764433 - DNA, 60 bp, Homo sapiens
ctgtaccacagtagactttaagttccatgcaagcaaggaatgtgtctatgtggttcacag

SEQ ID NO: 6764434 - DNA, 66 bp, Homo sapiens
atgccacagttagctgtgtgcacccccctgcccagtacttggcacagggctagctgacagtggtat

SEQ ID NO: 6764435 - DNA, 75 bp, Homo sapiens
gctatgttgcagttgcatatgcccctacagattgatatttcccaatagtattaacatagcaagctgacaatctgc

SEQ ID NO: 6764436 - DNA, 61 bp, Homo sapiens
tggaaagaattgtgacatttaaggtgcttagtattaggtacctgaagtaagcattcatcca

SEQ ID NO: 6764437 - DNA, 57 bp, Homo sapiens
tcgtggctcacgtctgtcatctcagcactttgggaggctgaggcaggcggatcacga

SEQ ID NO: 6764438 - DNA, 66 bp, Homo sapiens
tgaaagtagtgcttaccaagtgtttcatgagaggcgatgattattaaatacatgagcacactttca

SEQ ID NO: 6764439 - DNA, 97 bp, Homo sapiens
agatccaccaccacttattgaaaagcccgtcctttctccactgttctgcaatatcaactttgtcataataaaccaggatgggtctgtttctggattt

SEQ ID NO: 6764440 - DNA, 68 bp, Homo sapiens
cccagagcctttgtgtccacatttcagaatgaaccatgagaagcaggacagagaggactctaaatggg

SEQ ID NO: 6764441 - DNA, 75 bp, Homo sapiens
ctctactaagctgtctagattttatccattttaccttgatgatccagattttgggcagttcaaaaatgagtagag

SEQ ID NO: 6764442 - DNA, 69 bp, Homo sapiens
ggctccaggagatgctgggcagccgcagaagccccttccagggcccagggtgctcagctcctgtgagtc

SEQ ID NO: 6764443 - DNA, 74 bp, Homo sapiens
attgccaagaaaatttagaataggaagggatattattatctgcttgaaacttcttatactacatttgaggtaat

SEQ ID NO: 6764444 - DNA, 63 bp, Homo sapiens
ttctgtagactgctgaatgagacttgagtggtttatatcattgaaaactcagcatctacagga

SEQ ID NO: 6764445 - DNA, 55 bp, Homo sapiens
tcatgaggatgcacaaaacaacttttcctttgcttgtgcaatagttttctcatga

SEQ ID NO: 6764446 - DNA, 111 bp, Homo sapiens
acctactcattttagtattgattttatattccaggatgacataaacaattggaatcttccctgtgacccagatgcattctggaaagtagcaatttgtgtaaaatgagaggt

SEQ ID NO: 6764447 - DNA, 75 bp, Homo sapiens
agcatatcacatttggagatttatgaatgttataccatccttgcattcctgagataaatctcatgtgaccatgct

SEQ ID NO: 6764448 - DNA, 74 bp, Homo sapiens
tgtcttcttccattgtactatatatgtgtaaataaagtaatttgcatgtgtttcccagcaagcttaagaagata

SEQ ID NO: 6764449 - DNA, 70 bp, Homo sapiens
tttgaaaggtgtcgagatgtgtggtaggggggattatttttaatgaaactaagcttgcatatttttcagg

SEQ ID NO: 6764450 - DNA, 125 bp, Homo sapiens
cggagcatctcagaatctacggtttgacctcctgccaattctcatggtgtctttatacattttaacacaaaaataagatgttttcacttgagagcgagagggaaatgaactgttaaggtgctctg

SEQ ID NO: 6764451 - DNA, 63 bp, Homo sapiens
taagctcctcctcctgagggccgtaacgattcactaaatgcccatcatggatcaggtagttta

SEQ ID NO: 6764452 - DNA, 76 bp, Homo sapiens
atcacctagaggaaatgctaaaacacagatttttggattctactccaagagttcctgattcagtagatccagggat

SEQ ID NO: 6764453 - DNA, 70 bp, Homo sapiens
tgtggtcatcaactgagaatggtccgtctcatctttgagtatgcaattacctttatagctgattatgaca

SEQ ID NO: 6764454 - DNA, 67 bp, Homo sapiens
ggcactgggcatgggggtctggacaacaggcatcacgccccaatgagcctgcagaccccaccaggct

SEQ ID NO: 6764455 - DNA, 104 bp, Homo sapiens
caagagttggtgacttttcatgttggcagattgtctagggttgcgcggtaaatggcagagccagatccgaacccaggcctgcctaacccaaaagcccaagcttg

SEQ ID NO: 6764456 - DNA, 56 bp, Homo sapiens
cttcttgagcagcagaagaggattgggttactgcccatttctgcagctcagagaag

SEQ ID NO: 6764457 - DNA, 64 bp, Homo sapiens
caggcctgggttcaaatcccttaagatacatggcctagagtaggggttgtcaaactaaggcctg

SEQ ID NO: 6764458 - DNA, 61 bp, Homo sapiens
tctatggcatcagcatccgagacctgagcttctagggcacagaacgtggctgagccataga

SEQ ID NO: 6764459 - DNA, 55 bp, Homo sapiens
tctgtgcagaatcaaggagctttacataacgtagccctgtgagtcatgcggcaga

SEQ ID NO: 6764460 - DNA, 81 bp, Homo sapiens
gaagctcctgtggctgaaagaggactaaagtggcattttctgccaggctttgtcacgctcccttttgcccacaggtgcttt

SEQ ID NO: 6764461 - DNA, 55 bp, Homo sapiens
ggcaaagccttactctaactgatcaaatgaccaatcagctggattcaggcttttc

SEQ ID NO: 6764462 - DNA, 98 bp, Homo sapiens
cctacggcgtggccgaggcgggcggctccttcgacctgcggcccttcctgacgcagccgcaggtggtggcgcgcgccctgtgcttggtgagcccgggg

SEQ ID NO: 6764463 - DNA, 70 bp, Homo sapiens
actgtaggcctagctacttgggaagctgaggtggaagcatctcttgaatccaagagttcaaggctacagt

SEQ ID NO: 6764464 - DNA, 110 bp, Homo sapiens
gctgctatgctggaggagaagggctggggaggtagaatacacctttaaggcccagcctctgtgctttccctgccttcttagtaatccctttctcctatccagtctacagt

SEQ ID NO: 6764465 - DNA, 62 bp, Homo sapiens
tacagtaagatgaaatagcaatgctgtgcctaaaacagctcaagtttaatcacttgtctgtg

SEQ ID NO: 6764466 - DNA, 55 bp, Homo sapiens
ggctctggggaagctctcttcaggtatccccttgaggagtgccagccgtggagtc

SEQ ID NO: 6764467 - DNA, 57 bp, Homo sapiens
ggaggaaatgcaagagaagagggcttgcacattctcttcgggctcactatttcctcc

SEQ ID NO: 6764468 - DNA, 108 bp, Homo sapiens
gggttttaatttagagtttttattccctgaggtgtaagaaattaaaattttattttctggggagagtgaaccatactagctctgaatttcaaacacaactattaaccc

SEQ ID NO: 6764469 - DNA, 97 bp, Homo sapiens
gccaatggctttggccacggggacccagacagtcaagaggcctgctgcaaccctgaagagtcctcccacagtctggctccaggaccacaacattggc

SEQ ID NO: 6764470 - DNA, 60 bp, Homo sapiens
attttatgtatgtggtgtttacctaatattttaaagggtaagatgtcatccacatagagt

SEQ ID NO: 6764471 - DNA, 70 bp, Homo sapiens
cagttgccttatgaactttaagctctgtgtcagtatcatggaatgaaaattgatattgcttgagtaactg

SEQ ID NO: 6764472 - DNA, 70 bp, Homo sapiens
ggttcccccaagggccggcattcaccaccagacacgtgagtgagaggccccagctcttggccttggagcc

SEQ ID NO: 6764473 - DNA, 64 bp, Homo sapiens
ggagttctggagtcttcaattttagacaaccctctctggtgcttctgagaagactcctaacacc

SEQ ID NO: 6764474 - DNA, 75 bp, Homo sapiens
atttgcaggctctaattaatatttattaggtagggagtagagtctctggctgggaattttaattagcaagcagat

SEQ ID NO: 6764475 - DNA, 130 bp, Homo sapiens
tagatttctagtcccttagtctctttgtgggtcaatgtaactgtgcttatgcctgatgttaatcacattcctttcttgagcacagttacacattttgttgatagcaaggagaagaggaatgagggaatga

SEQ ID NO: 6764476 - DNA, 129 bp, Homo sapiens
aatacgcccataaagttcactgctgttccgtgagtgtgctgtataattacgcatttaccttctagtaagcaagtgagaagcacagctcactcacggcaaaaacccattgcagtcgcgttgatctgactt

SEQ ID NO: 6764477 - DNA, 63 bp, Homo sapiens
atccttaggctctggacctctaaaatcttcagcgaatggcaggtccctgagtcttcaaaggat

SEQ ID NO: 6764478 - DNA, 82 bp, Homo sapiens
gcagtagaaggctctgtgtgtccacacatacatacatatttatatgtctttgctgtgtgctgggcccaacccagagaactgt

SEQ ID NO: 6764479 - DNA, 63 bp, Homo sapiens
atactgttttgtgacttatctttgaccccacaacatgtcttggatatctttccacagcagtat

SEQ ID NO: 6764480 - DNA, 105 bp, Homo sapiens
tggccccacagccacagactcagcacatttgcaggtgtcgattagtctaaccagcacttcacaggggactgggtcatttgtagtgctgatgttttctgtctgcca

SEQ ID NO: 6764481 - DNA, 60 bp, Homo sapiens
gtgggttttttttggatcatgaattcaatattgaataattcattgtcttggaaaacccat

SEQ ID NO: 6764482 - DNA, 63 bp, Homo sapiens
ccttcagaatgaaattctaatgatctggtaagcagttagttagaatttggttctgccctaagg

SEQ ID NO: 6764483 - DNA, 80 bp, Homo sapiens
tttggtgtatatactgatcctttgactttgttgagaaatgtagggaagtagtagtaagaggaccaaatatatacatggaa

SEQ ID NO: 6764484 - DNA, 95 bp, Homo sapiens
taataacacacttaacataaaaaggacagatgtggtcttctattaataaaatgagagacttgcctgctcttgttttgggattaaatgttttatta

SEQ ID NO: 6764485 - DNA, 91 bp, Homo sapiens
ggagcacagtgtcatgaaggctggcctgtaacattgctgtagtcactttttaagtttgttcacaggggagccatttatttattctgagccc

SEQ ID NO: 6764486 - DNA, 89 bp, Homo sapiens
tgtgtccaataacaataatgctgttaagaatctcttcctttgcattttggcttttaggggtggttttagcagcatgtgttctggaggca

SEQ ID NO: 6764487 - DNA, 56 bp, Homo sapiens
tcctagcctggtgagaaactgtcactctgtgcctcagtttcctcatctgcatagga

SEQ ID NO: 6764488 - DNA, 79 bp, Homo sapiens
aggtgtgtgtgagtgtgtgtgcgtgtgtgcatgtgtgtgtgtgtgtatgcaagtgccatgtgcacagtgccaaccatct

SEQ ID NO: 6764489 - DNA, 58 bp, Homo sapiens
tgacagcataacactggtcttgttggatacccaacaagaagagtgaatatgcatgtca

SEQ ID NO: 6764490 - DNA, 75 bp, Homo sapiens
gtggtctgaattactggaccctgtttccctaggtcccagcccctgggaggtcagggaaggtccggctgcagccat

SEQ ID NO: 6764491 - DNA, 102 bp, Homo sapiens
gaggaaaaacaatctgaaacatgagtatatccagaaaatcagttcatttatgtaacccaagatgattggcagatattttctggctttcatgagtcaatcctc

SEQ ID NO: 6764492 - DNA, 75 bp, Homo sapiens
acatcagtctcatgaggaaaatgtcttatagatttggaaatcagatctcagagaggtttttcatctgcccaatgt

SEQ ID NO: 6764493 - DNA, 61 bp, Homo sapiens
ttcctggctgaactgaactcctagtttgacatgatggatccttttgagtctagccatggaa

SEQ ID NO: 6764494 - DNA, 93 bp, Homo sapiens
ggtttgcaacctaggctgggccagttatgtctcatctcagtgtccaaagtggcagattcaagagaagggacatatcttcaagccaggcaaatc

SEQ ID NO: 6764495 - DNA, 84 bp, Homo sapiens
tatggttctgtgcctggagtccccaagtccatccccagatttggtgatgtgctaggcagactcacagaactcacagttatgata

SEQ ID NO: 6764496 - DNA, 94 bp, Homo sapiens
tggaaggtggcagtgaatgagagactgttctgctcctggttgtggccaattgtgctttgtctgtagctgtggagcagaggtctcccgctctcca

SEQ ID NO: 6764497 - DNA, 128 bp, Homo sapiens
gtgaaccatatggtctctgtcacatctctgtcacaactattcaattttgctattgtagtgcgagagcagccgcagacatactgaagtgaatgagtgtggctggatttgatctgtgggctgtggatcgc

SEQ ID NO: 6764498 - DNA, 90 bp, Homo sapiens
aggggtggggcttcaccagcagctttcacctccccgcctggaagcttctctctactgcgtggggagctgtgactacaggctcccacctct

SEQ ID NO: 6764499 - DNA, 60 bp, Homo sapiens
gtatcatagttgaaggactatcatgtcatatcatgacagtgtggaaagtcaacttgatgc

SEQ ID NO: 6764500 - DNA, 63 bp, Homo sapiens
ctctgtccttgcacagttcctagattcttcatgtactcctggatgctgctgtcagggatggag

SEQ ID NO: 6764501 - DNA, 64 bp, Homo sapiens
tgtccttgttcctaatgtgaaagtgcttaactgcttcttccttgtattaggtagcactgggata

SEQ ID NO: 6764502 - DNA, 55 bp, Homo sapiens
agctacctataatgagacctggaccctaattccaggtgttttacatatggtagtt

SEQ ID NO: 6764503 - DNA, 94 bp, Homo sapiens
gtcctcttgaggtacctgaattaccaaaagctttatgtattctgaagttattgaaaataagagcttttgggaattcaggtagttcaggagtgac

SEQ ID NO: 6764504 - DNA, 77 bp, Homo sapiens
gcctctacagcagatcagaacatttgcaggatgttaatgaccatttcctgttcattttttgactctgcagtgaaggc

SEQ ID NO: 6764505 - DNA, 96 bp, Homo sapiens
agccctgctgccctgggtgagctgaagcagtcagttcagcttggagctgccggttccagctgagttcagtgacttcagtgactcaggcgttgggtt

SEQ ID NO: 6764506 - DNA, 85 bp, Homo sapiens
ggaatgaataaatcttttgtattagtataatgcagcaactgattgctgcaaaagaggtactgaattacaatctaggttttattcc

SEQ ID NO: 6764507 - DNA, 61 bp, Homo sapiens
cctgggttgttttcccatttcacctagtgaaaatttgaagtctttagaacgacctctcagg

SEQ ID NO: 6764508 - DNA, 58 bp, Homo sapiens
tagagctagcttcaaaatgcgattcaactgggtactctgtcactttaagctagctcta

SEQ ID NO: 6764509 - DNA, 84 bp, Homo sapiens
ttttcccctccaagtgctatattctctctttctaatggaaaattccattgtctgagggtttgagagaatagcagggtaggaaaa

SEQ ID NO: 6764510 - DNA, 84 bp, Homo sapiens
cacaactcattattgccctcctgaggggcagggaagctgggatatttatccaccaattccttccctcagtggctgaagtttgtg

SEQ ID NO: 6764511 - DNA, 75 bp, Homo sapiens
agtatcagtatacaggggacattcagttgttgactgcctgatgaatgtttgccagtgtaagttttttctgatatt

SEQ ID NO: 6764512 - DNA, 70 bp, Homo sapiens
cagtgcaggttcgaccgggttcagcaagagagcctctgcttcccatagtggaattcggggacctggactg

SEQ ID NO: 6764513 - DNA, 80 bp, Homo sapiens
ggactattaataatgaaatattacagtggaggggatgtttcacttaggaagtatcacttaataatattagttaatagtcc

SEQ ID NO: 6764514 - DNA, 125 bp, Homo sapiens
ggattatacaattttgatgacagaaacttgttcttaaccacctctctgtcttcagcattcagcctaatgttggaagaatagaagatggttgataaatgtttgctgaatcagaaatggaatgatct

SEQ ID NO: 6764515 - DNA, 77 bp, Homo sapiens
taatattgttggaaagactaaatgtgttctaaagtatgaggtactttataaagtatagtggtcatgaaataatatta

SEQ ID NO: 6764516 - DNA, 58 bp, Homo sapiens
tgattgatggaggtgatttacccttgatcaagttcatactgagtcactcttacagtca

SEQ ID NO: 6764517 - DNA, 57 bp, Homo sapiens
gacttgggtcacatgacctacctcaccatagggagaggtattctcactgacctggtc

SEQ ID NO: 6764518 - DNA, 59 bp, Homo sapiens
gctgtttagtggcagagtcagaacctgaattgaaatctcttgacttccactatagtagc

SEQ ID NO: 6764519 - DNA, 63 bp, Homo sapiens
gtttggtttgcctgagtaccctcactcctcctgcgtttaattggtctggggtgtagactaagc

SEQ ID NO: 6764520 - DNA, 59 bp, Homo sapiens
gagcgcttccctccaaacgccctcagccctcatctcggcctggagaggaaatgctgctc

SEQ ID NO: 6764521 - DNA, 81 bp, Homo sapiens
tggtaaacatttattttcagctgggaaatctgctattaattcatatagtgactttcccagctgaaataatgagtcaagcca

SEQ ID NO: 6764522 - DNA, 81 bp, Homo sapiens
agctggagcatggctgtgagcaccctgcctcgatgagccgggccatctttcacatggtaggggcagggccaagctgtggct

SEQ ID NO: 6764523 - DNA, 88 bp, Homo sapiens
gacatcttggagctctgtgggggaaatcctgggttgcaaaaacaaataagggtgcagtcctagcccccaggaagctcacttgggagtc

SEQ ID NO: 6764524 - DNA, 63 bp, Homo sapiens
gccctccctgaagaagttactcttgtgcagagatatgaaggaaagagactcttctggaagagc

SEQ ID NO: 6764525 - DNA, 64 bp, Homo sapiens
aggctgtgaaatgtggcaaggagattcaaggacctcattcaaaggctcacgtttgcatatgctt

SEQ ID NO: 6764526 - DNA, 57 bp, Homo sapiens
tctatgtttcttggctaattgttcagtgatgccaaaggaaagttgagaaacaatgga

SEQ ID NO: 6764527 - DNA, 56 bp, Homo sapiens
cttccagagctgggctgacctttccaatcgacattggcaggttcagggctctgcag

SEQ ID NO: 6764528 - DNA, 57 bp, Homo sapiens
gaagcatataggtactgaactagcaaataaaggatcctcagtcagtaccggtgcttc

SEQ ID NO: 6764529 - DNA, 59 bp, Homo sapiens
gtgctggaagagaatactggtggatataatcttttcatggggaataattttctaagcat

SEQ ID NO: 6764530 - DNA, 56 bp, Homo sapiens
accacagtgagttagattgaccatgtttttcaattgtggttggttatgcctgtggt

SEQ ID NO: 6764531 - DNA, 72 bp, Homo sapiens
attaaaatgttcaagcatgctggtttattttaccgttcagatgaaatggcatttatttgaatattacttagt

SEQ ID NO: 6764532 - DNA, 71 bp, Homo sapiens
taaattctgattattaaactgaggctttaattgatgttaatgccttatgtcaaatgtaaagttagaatttg

SEQ ID NO: 6764533 - DNA, 65 bp, Homo sapiens
tgtgtgcgtatgcatgtgaatacgtgtgtgaatgtatgtatgtttgttgtatgcatatgcaaata

SEQ ID NO: 6764534 - DNA, 61 bp, Homo sapiens
gaacagtttgggtaggtatgtagttggaaaaataatcccaacctattttgctcagactctc

SEQ ID NO: 6764535 - DNA, 89 bp, Homo sapiens
caggaagtccctgtgtctctttgtcctagagctctcatagaactccagacggatctggctgctgggtcatgatgcagaatgctaacctg

SEQ ID NO: 6764536 - DNA, 111 bp, Homo sapiens
acagaatttgtacttttttattagcacgttagtggagtttgaagctgttagttgatcttttcaggatattttcatgagctttactagtttaggaaacagtgctttttctgt

SEQ ID NO: 6764537 - DNA, 78 bp, Homo sapiens
agcttccacatagaccctggaaatggcagagcctctgctgggggttctgcgtggatcctgggatctggactctaagct

SEQ ID NO: 6764538 - DNA, 102 bp, Homo sapiens
cacatactcatgtgtgagtatgtatattcacacatactcatgtgtgagtatgtatattcacacatactcatgtgtgagtatgtatattcacacatacatgtg

SEQ ID NO: 6764539 - DNA, 83 bp, Homo sapiens
agctgaaaactctctggtcctttatggtttccaaaaggtactccttaaatgggcataactgatgggggattggctagtgagct

SEQ ID NO: 6764540 - DNA, 80 bp, Homo sapiens
tggagtaggggcttggggaggacgcagtgtcctgggctgggacccaagagaccctgtggcttcgccgctaacccctccca

SEQ ID NO: 6764541 - DNA, 64 bp, Homo sapiens
agcgatccctttggcaccccctgctgttagtaaccagcaaattcactgctcaaaagggattgct

SEQ ID NO: 6764542 - DNA, 87 bp, Homo sapiens
ggggaaatattacaaattataatgggagagcattttatttcaaagcaatgcttctctcgctttcgatttgcctttaacatacacccc

SEQ ID NO: 6764543 - DNA, 57 bp, Homo sapiens
gactgccataggctttgcagtataatgaagtattatttctcagtagtaatggcagtc

SEQ ID NO: 6764544 - DNA, 61 bp, Homo sapiens
ggatatgagagggtatgcatctctgctgcatgaagagaagacagcagcacctctcgttttc

SEQ ID NO: 6764545 - DNA, 61 bp, Homo sapiens
gccctgtggccaagccttgacagatggtgaacagaatctggaaagacagagggcatggggc

SEQ ID NO: 6764546 - DNA, 84 bp, Homo sapiens
ccagacaaaagacaaggacaagagagcacggtcttgggcatggtatgagcttgctgccccctgctttgtccttgagttgcttgg

SEQ ID NO: 6764547 - DNA, 61 bp, Homo sapiens
ctgtggcaggtggagcctcctgcaggcactctgtgtttccaggagggttttctgccttcag

SEQ ID NO: 6764548 - DNA, 63 bp, Homo sapiens
tgggaaggacagaacataattgcttccaaacaaaatttcaagcctgtgtacatttccttccca

SEQ ID NO: 6764549 - DNA, 63 bp, Homo sapiens
tcggtgttgtacagtatatttcaaagccaggaaattggcactgggatgctactgttaactaga

SEQ ID NO: 6764550 - DNA, 76 bp, Homo sapiens
ggtcgtagaccatgtgaaaatagaggagaaaaaaggaaagaaagtttcttttactgtgaacgcaaggaatgtgacc

SEQ ID NO: 6764551 - DNA, 87 bp, Homo sapiens
ttttagagcaaggctaattatgccttggggctttggcgaatgtgcttgtctttatgaaagagtccttggcatcatcagtacctagaa

SEQ ID NO: 6764552 - DNA, 84 bp, Homo sapiens
tcattacttttcttaggtgagataaggatattgtaattatacaagagatgtccttcatctaggagatggctgctgaagtattga

SEQ ID NO: 6764553 - DNA, 57 bp, Homo sapiens
gctatggagtcagatggctcacagctctctagccagagcctgcctgaactctgtggc

SEQ ID NO: 6764554 - DNA, 55 bp, Homo sapiens
tcagtggttcccttgttggaataaattcatggcattccagaagggcagctatgga

SEQ ID NO: 6764555 - DNA, 61 bp, Homo sapiens
gagtagcttgcctctggctgcacggtctgtatagggctgagccaggagtcggcaagcactt

SEQ ID NO: 6764556 - DNA, 78 bp, Homo sapiens
ccccagccagtctgctggctgtccctacctggctggatttcggccaggcaaagcgggggtcaggggaagcaggcgggg

SEQ ID NO: 6764557 - DNA, 66 bp, Homo sapiens
aactttctctacggcatttgttgatctaaccccagggtaggaagtctaaactctgaggagagggtt

SEQ ID NO: 6764558 - DNA, 98 bp, Homo sapiens
agtgactccttatctcttagaggcatgccaaattctactttcagcagttttattctcatctttgaaaacttaatttggtcgtagctactggtgttact

SEQ ID NO: 6764559 - DNA, 67 bp, Homo sapiens
gtgggaatggagtggttcttgccctctgagcttacagactaagaaggcagaaaagctttacaactac

SEQ ID NO: 6764560 - DNA, 70 bp, Homo sapiens
ggtctggcaaatgccctagggctgccttctcttctttagaggactgggtaggagcccagggcctcagacc

SEQ ID NO: 6764561 - DNA, 62 bp, Homo sapiens
tgatctctctgggagctgacagtgaggattagatgccttaaggcagccgctcagagaggtta

SEQ ID NO: 6764562 - DNA, 56 bp, Homo sapiens
caggaatgccttcttcagccatgtaagaggaagctggggttaggaaggagtttgtg

SEQ ID NO: 6764563 - DNA, 76 bp, Homo sapiens
ctgtgttgtttcaatgtctttaaagtgcaatagatctttacaatatatctattttaaggtaaaggcggcaaagcag

SEQ ID NO: 6764564 - DNA, 95 bp, Homo sapiens
ctgcatgttcagccactgctgcttccgctaaaaattaatcccatttttcccctgaatggaggtatttctcagcaggaagcagtatgtccatgcag

SEQ ID NO: 6764565 - DNA, 79 bp, Homo sapiens
gttcctggtgctgtggcagatacagaagatcaaaaggaaactgttgctgagttgacattctttctgtcataacctcaac

SEQ ID NO: 6764566 - DNA, 89 bp, Homo sapiens
ctgtgttcaggatgtggcagggaccttgtagggaagtggtttgatcatcaaggacttccagctaggttctgctaaaccatacaacacgg

SEQ ID NO: 6764567 - DNA, 67 bp, Homo sapiens
aggattatagtaaacatttgttgagctctgtgtgttgggcactgttccaagtgctttacttaatcct

SEQ ID NO: 6764568 - DNA, 62 bp, Homo sapiens
cctttcagaaaggttaatctggatttactaggaaagaaaatgcagctgactttcctgaatgg

SEQ ID NO: 6764569 - DNA, 83 bp, Homo sapiens
ggctcttggaagagctggggcagcttaggagtgactttggttaggcatggccagcccccagttcctctgcaattccaagtgtc

SEQ ID NO: 6764570 - DNA, 60 bp, Homo sapiens
tttttctaatggcttaggatgttgcttatcttggcaaatgttctatgtgccattgaaaag

SEQ ID NO: 6764571 - DNA, 72 bp, Homo sapiens
gttcctctgggttttgtttgtacagtgtaatttgagggtgattaaagttaaaaagatgaatctaagagggac

SEQ ID NO: 6764572 - DNA, 76 bp, Homo sapiens
tgatcagtgcctacctccaaattagaaccacagactttcctaaaatttgatgatgggggtgcaggacacgcgatta

SEQ ID NO: 6764573 - DNA, 76 bp, Homo sapiens
gtagctaaagagaaccttgagatttacttggcttagcacactctccatggcatgccatttcttctctttatgctac

SEQ ID NO: 6764574 - DNA, 75 bp, Homo sapiens
aggggacaaagtgtgcggagcccagggagggccgttcgcatgaggcccagtcttggatgcggcacttggtcgtct

SEQ ID NO: 6764575 - DNA, 76 bp, Homo sapiens
tagcgattggttgcggggccctcccgtgcactgcagaatgtttgcaacatccctggtctctgcccactagatgctg

SEQ ID NO: 6764576 - DNA, 77 bp, Homo sapiens
ttagaagtttacaactgggcttgtcagctttaaaagcaccctggaaggcttgacaattttacatgtattaattctaa

SEQ ID NO: 6764577 - DNA, 61 bp, Homo sapiens
gcagctgcagaggcttggtcacgcctggaagtcctccccagcagccaggaatctgcagagc

SEQ ID NO: 6764578 - DNA, 58 bp, Homo sapiens
ggggcgtcaccggggcacctgggaccgggctttctgctgtaggaccctggtggccccc

SEQ ID NO: 6764579 - DNA, 79 bp, Homo sapiens
tcctgttggagtgagcaggtcggttttctttgagctgtgcagcagcagtctccttggctaaactcaatccagcacagga

SEQ ID NO: 6764580 - DNA, 70 bp, Homo sapiens
ggggacagacagtgatggacaggcagactctgaaagtggagctgagtcttgagcactgagcatgtcatcc

SEQ ID NO: 6764581 - DNA, 100 bp, Homo sapiens
gttatcaaactaaaagcatgtaatccattctatgcttacatttatattaaaagcctcacaatatgaagactaatgtgaatgggatatgtaatttgatgat

SEQ ID NO: 6764582 - DNA, 82 bp, Homo sapiens
tgacctttaaatcctcgtgcagttctaaaattccactgctgaattcacaatagcagcttgcatggtggagggagagaggtca

SEQ ID NO: 6764583 - DNA, 72 bp, Homo sapiens
ttgtttattagcaattatcctggttttcttgagactgatttccaggggagtacagaattgctacatgagcaa

SEQ ID NO: 6764584 - DNA, 117 bp, Homo sapiens
cgtttatggaatgagagctgaaccaagaaggcagggcatcaccctgttcgacctcagttgggattgtacacatctggtgccttcccttttttaccattctgcatatgtccacaaatg

SEQ ID NO: 6764585 - DNA, 67 bp, Homo sapiens
gttcctgacttccagcaacttggtgctatggtatttgtatgataaatcaagaggcttggaaaggaat

SEQ ID NO: 6764586 - DNA, 69 bp, Homo sapiens
ggagaggaggtgagaggaagtatcctgactgagtgacaaagcagctcctcctcctttcaccccttctct

SEQ ID NO: 6764587 - DNA, 97 bp, Homo sapiens
gataactcttttgaaattgtcatgcttatgttacatactcctaaattttaaatgctggagttataaaaggagcactgattctgaaagtgtatttatc

SEQ ID NO: 6764588 - DNA, 62 bp, Homo sapiens
ctttggagggaaggaagattatttgtgtgaacatatttaatctgtattcctactttgcagag

SEQ ID NO: 6764589 - DNA, 97 bp, Homo sapiens
gattaattcagcatggttttactcatcactgaatatccctatcttttgcagtagaattttctaggtcctgtggtttgggtaaaatgttggaatgatt

SEQ ID NO: 6764590 - DNA, 64 bp, Homo sapiens
ggccttctgttttcctgggtgaagaaggaggggtgctgagtgcaccaggatgggcaggtaggtc

SEQ ID NO: 6764591 - DNA, 78 bp, Homo sapiens
tctccctcttaggaaactgtgaggatcttaactttccaggtgggaaggccaaagacacctacacagcactgtgggaga

SEQ ID NO: 6764592 - DNA, 59 bp, Homo sapiens
caggctggattgggcttgctcacctcagcagtgatggcactgagctcactagtcccctg

SEQ ID NO: 6764593 - DNA, 71 bp, Homo sapiens
ggagataggcagtgagcagggtgtcatgagcttgtaatatgtcagcttggctaggctgaactgccttttcc

SEQ ID NO: 6764594 - DNA, 86 bp, Homo sapiens
tagccagccagcagtggtagctttgcacttccctgggatggagctccccaggaaagggatgggctgccacctttgctgtttggctg

SEQ ID NO: 6764595 - DNA, 72 bp, Homo sapiens
catttaacactgagcagcaactgtccatggcaggctactgcttgttattctcagctgccagacgaaggaatg

SEQ ID NO: 6764596 - DNA, 59 bp, Homo sapiens
ggcaggcctgcagtggcccttcatttcacctatttgactctgcctgcctagagcttgcc

SEQ ID NO: 6764597 - DNA, 56 bp, Homo sapiens
gatactgtaggtgaaagtgtttttaaaaactgtgaagggccataacttgcagtgtt

SEQ ID NO: 6764598 - DNA, 78 bp, Homo sapiens
gaatattcctgaggtgtgggtggttggtttccttacaaggtagggtttgcaagctccttacatccacaggggctgttt

SEQ ID NO: 6764599 - DNA, 60 bp, Homo sapiens
ggtggggaagaactaaatggaagcaggcattaactcttctggatttattcattccttgtc

SEQ ID NO: 6764600 - DNA, 82 bp, Homo sapiens
tggtacttggagagtggttatccctgtcctgttcgttttgctcatgtcgaatcgtacagggtcatccactttttcagtatca

SEQ ID NO: 6764601 - DNA, 74 bp, Homo sapiens
gtctgtttggccctttttgccccttctgctttcctcatgaggatgcagcaagaggtgccatcttgaaagcagac

SEQ ID NO: 6764602 - DNA, 62 bp, Homo sapiens
tctccacaagtgttgagagtacacagcttcaaatatgcatacatttcaagacttgtgagaga

SEQ ID NO: 6764603 - DNA, 84 bp, Homo sapiens
ttatttttgttatacaaagtcacattgaaatgaaatggatacatgcaccattgactttaataggattttgcattgtaagaataa

SEQ ID NO: 6764604 - DNA, 55 bp, Homo sapiens
tgcagcaggttccaaagggttacttttagaaatgaactaccctcaatctcctgca

SEQ ID NO: 6764605 - DNA, 108 bp, Homo sapiens
ctcttgtaatttttcagcagaaaggcactagatgatcttgcccacattctgtaataatgagtttcatttacatgtctttctctgagaagatgaaatgattacattgag

SEQ ID NO: 6764606 - DNA, 104 bp, Homo sapiens
gctggctccattttctgctgatatatagttgtgacccaggacaatttatttaacctctttggaacttggttttctaatgtattaagggaggtggttatgccagt

SEQ ID NO: 6764607 - DNA, 92 bp, Homo sapiens
gaaaacaccccttggtttttgcaaagttccctacacatgtattgaatttccaataacatttaggatgttttgagagatgaagaatccttttc

SEQ ID NO: 6764608 - DNA, 67 bp, Homo sapiens
gttgcatggctgtgaaaatttggcctttaaaataactaggcatgggccagaaatcacagccggcggc

SEQ ID NO: 6764609 - DNA, 127 bp, Homo sapiens
gtttgccctcctctccaaaaaaattcacatgttaaagttctaatctccagtaactcagaatattactctacttggagttagggtctttaaagaggtaattaaatttaatgaggtaattagggtgagc

SEQ ID NO: 6764610 - DNA, 90 bp, Homo sapiens
caggtgttcatagcagctttattcatagtaaacaaaagtggaaacagttcaaatgtccaccagctgatgaatggctaaatgtaatacctg

SEQ ID NO: 6764611 - DNA, 74 bp, Homo sapiens
gtaagtgcctgtgattaggtcccattatacgtaatgaacctattacgacacatctgatctcaaaatggatttac

SEQ ID NO: 6764612 - DNA, 91 bp, Homo sapiens
cccaaaccatgcttcactttcaccatctgagtagagagaagtacaagcctctgtgtccctctgctcagagggtggggcacctttgtttggg

SEQ ID NO: 6764613 - DNA, 68 bp, Homo sapiens
caggtttcaaagagaggcagaaggaacaggtcagtgggctgtttgttaggcaatctttgagaaacttg

SEQ ID NO: 6764614 - DNA, 61 bp, Homo sapiens
tctccaataaccacaatcagatagacaacctgcttctgtttgaaacttttggttattggga

SEQ ID NO: 6764615 - DNA, 72 bp, Homo sapiens
cctctcaatggacacagggtcacctgggggctgtgggggaagccagccagagtggctgtgtgtgaggagagg

SEQ ID NO: 6764616 - DNA, 61 bp, Homo sapiens
tgttcctgcaaggaactggtgctcaactaaacatactgtcacatggttccttgaaggggca

SEQ ID NO: 6764617 - DNA, 60 bp, Homo sapiens
tgctgccctggttttgcacaccctcctaaccatatctatgtgtgcacctgctagggagca

SEQ ID NO: 6764618 - DNA, 55 bp, Homo sapiens
ctgtctcttccttcccttcccagcctgccaatcagcagggaaaaggatgatacag

SEQ ID NO: 6764619 - DNA, 80 bp, Homo sapiens
gtggaaaggaccctgcgtttagagtaggaggcatcagatgagtcatttcctgtctctgagcctcagcttcctcattccac

SEQ ID NO: 6764620 - DNA, 62 bp, Homo sapiens
acacatatacatgtgttaatatatgtaagtatatacatatgtttaaatgtatgtgtatgtgt

SEQ ID NO: 6764621 - DNA, 60 bp, Homo sapiens
ttcatatgaattgggttttttttactttgttttgaaggaaagttacccaatctctatgaa

SEQ ID NO: 6764622 - DNA, 59 bp, Homo sapiens
atttgccagtgtaaaacaaattatttggtatttattgtatttggatattgctggcaaat

SEQ ID NO: 6764623 - DNA, 101 bp, Homo sapiens
tattaggttggtgcaaaagtaattgcagttttggccattgaaggcaacggtcaattgaaagcaatggccaaaactgcaattacttttgcagcaacctaata

SEQ ID NO: 6764624 - DNA, 101 bp, Homo sapiens
tgaggcaggagaatcgcttgaacccaggaggcagaggttgcagtgagccgacatcatgccactgcactccatcctgggcaacagagtgagactccatctca

SEQ ID NO: 6764625 - DNA, 128 bp, Homo sapiens
gcaaacatcggaaggcaagaggccaggttgaacagtggttagcagcttagactgcctgggatttgtccagctctggcttggctagctgtgacactgtgggcagcttgcttgttcttcgtgtgtcttgt

SEQ ID NO: 6764626 - DNA, 64 bp, Homo sapiens
gaggagtgtctatgtttagtctttctccttgccacagggaaaggttgtaacaagactcttcgtc

SEQ ID NO: 6764627 - DNA, 62 bp, Homo sapiens
aagcagcctggcatgatgctttctctgtggcccactcaccttctgtgtatttgctgctgctt

SEQ ID NO: 6764628 - DNA, 116 bp, Homo sapiens
tccaattttttcttaaagaagttacacttaagtttggggagaatttcatttcatattagccgctgtaggagttgaaaaaaatggctactggaacttagtgggaagaaaaggaagga

SEQ ID NO: 6764629 - DNA, 61 bp, Homo sapiens
gcaggctatgagtttctcaccaacgtgagaaatcaggagtggaggggaagctctagcctgc

SEQ ID NO: 6764630 - DNA, 111 bp, Homo sapiens
agtatgtacaaagttcagaagattgcattttgagatagtaggtttctagttgctcgtgtaatctggagatttcttttcaatagaagtgcaaaatttgtgcacagacatact

SEQ ID NO: 6764631 - DNA, 58 bp, Homo sapiens
cagaaggagcgctaaggtcccaggtgtgataggatgagggcacccttagcctcctctg

SEQ ID NO: 6764632 - DNA, 94 bp, Homo sapiens
catcaggtagaaatgggcttagtctccacaggtccagcaggatggcctggggcctgcccctgggcctgggaggccaggtcttcaccaacctatg

SEQ ID NO: 6764633 - DNA, 63 bp, Homo sapiens
ctaggatcaggaggtctggattttagttcctggggtctgtcttgtctggcttcgtgattctgg

SEQ ID NO: 6764634 - DNA, 89 bp, Homo sapiens
tcttacttgaaaaatttaaacatttttctggaacctgtcatggtaacattgaaaggattaaataaatgtgctgtgttttttaagtatga

SEQ ID NO: 6764635 - DNA, 81 bp, Homo sapiens
agtgctcataaaaatgtgaaaccctgcaataacattaaatccccatatgcagaggaaaacaattcacatttttgtggcact

SEQ ID NO: 6764636 - DNA, 56 bp, Homo sapiens
gctggcctgggcagcctgtcggattctaccctcagcgggttgctgcccagccctgc

SEQ ID NO: 6764637 - DNA, 79 bp, Homo sapiens
tagcacacgaatgcactcacccatcactcagttcagtgcatgattatgtgtgaatgtgtgattgctagattggtggttg

SEQ ID NO: 6764638 - DNA, 87 bp, Homo sapiens
ggaggatgcaatcttattgtgtctttgaataagtacccaggctagtatggggacttgtgtaacacagaaagaacatctgcaaccttc

SEQ ID NO: 6764639 - DNA, 93 bp, Homo sapiens
tagcccatccttggagtgacttttggacctcactgtccacttgagggaaggccagtccacaggaaggaggccccagagcacccagtgtggcta

SEQ ID NO: 6764640 - DNA, 78 bp, Homo sapiens
ttgctctcagttctgtcctcctaccaggcatttatttaagagagctaagtttctggaggcagaataatgagaaggcaa

SEQ ID NO: 6764641 - DNA, 71 bp, Homo sapiens
gggttacatgattagagctgagactggaacgccaaagcccatatctgtgtcccttctaatttcagtgacct

SEQ ID NO: 6764642 - DNA, 63 bp, Homo sapiens
gagtggattgcatgagctcaggagtcgaaaactagcctgagcaacatggcaaaaccccatctc

SEQ ID NO: 6764643 - DNA, 61 bp, Homo sapiens
gagccagctgagctgcactgtctgtctgtcatgcttagagagtgacgacctcggtgggctt

SEQ ID NO: 6764644 - DNA, 55 bp, Homo sapiens
tggctcctgtggctatttcagttgctattaaacaggaaatgggactacaaagcca

SEQ ID NO: 6764645 - DNA, 61 bp, Homo sapiens
gagcccagcaaggaccaagggccgggatgcccaggctcttccatcctgctgaggaaccctc

SEQ ID NO: 6764646 - DNA, 58 bp, Homo sapiens
gatccacagtttgatgatcatatgtatttcccagtgccaatgaatatggacttggatc

SEQ ID NO: 6764647 - DNA, 77 bp, Homo sapiens
cctatgtgtgtttaatgggccttgctggagggaggactgtttttagcagaaactcattaaattgcagacatttcggg

SEQ ID NO: 6764648 - DNA, 64 bp, Homo sapiens
tacagaatgttatgaagcatagcatgtaaaaattattgtctttccccttcatggatattctgta

SEQ ID NO: 6764649 - DNA, 69 bp, Homo sapiens
ccagtgggcagccaggtttgggaaccacttctatggggatggtccatctgggaattggctgtccacagg

SEQ ID NO: 6764650 - DNA, 80 bp, Homo sapiens
ctggagtgggattgtcttcagagtgagcagtgtcatcgtacatcataacaatgatgtgctcgtctggaatcccattccag

SEQ ID NO: 6764651 - DNA, 92 bp, Homo sapiens
ggggctctatgggtgcaaggcagggtacttaatatttacggggtgtggggaagcctgaacctttcagtgccctttctgtcccccagtgccct

SEQ ID NO: 6764652 - DNA, 59 bp, Homo sapiens
gggtgcagcctagaaccgaatgtatgttataaaagaggtgcaggaaagtgctgcgaccc

SEQ ID NO: 6764653 - DNA, 111 bp, Homo sapiens
tcctaaaatcccatagataataccaacttgcagccaaatttgagaatcagtgcactaccctaaatttttcagttcaaatgaatttggtattggtcaatgagaggtcaagga

SEQ ID NO: 6764654 - DNA, 60 bp, Homo sapiens
aatatttctccttcgttatagcttcacaagttggctaaagactgaggaaggggaagtatt

SEQ ID NO: 6764655 - DNA, 59 bp, Homo sapiens
ggactcaggtcggtctcactcttgcccctagggcttcctcgaggaactggcttggttcc

SEQ ID NO: 6764656 - DNA, 60 bp, Homo sapiens
tgtgggcactaatgacatgcaggcactctgtcccaagcgttaaatcattcagtccccgca

SEQ ID NO: 6764657 - DNA, 60 bp, Homo sapiens
aattctcctctcacccctacgatatgaagaatatcttataggctcagtgagtagggagtt

SEQ ID NO: 6764658 - DNA, 56 bp, Homo sapiens
agctttccccaacccccaatgcctaggccttgccttctctgcagttggggagagct

SEQ ID NO: 6764659 - DNA, 60 bp, Homo sapiens
gttataagatgcacattttttcatgcttaacatctctgaaattagggtgcctcttataat

SEQ ID NO: 6764660 - DNA, 59 bp, Homo sapiens
ccaaagtccatagtttacattacagctcactcttagggttgtacattctatgggtttgg

SEQ ID NO: 6764661 - DNA, 102 bp, Homo sapiens
cccgtgtctccctgcagaaagcgggcagcggcctgcgccagtggaagcgggtgtacgccgcgctgctggcgcgctcgctctcgctgagcaaggagcagcggg

SEQ ID NO: 6764662 - DNA, 99 bp, Homo sapiens
gtgagtttgactatttcagacacttcatgtaagtggaatcattcagtatttgtcctatggctggcttatttcacttagtgtaatgtcttccagattcac

SEQ ID NO: 6764663 - DNA, 129 bp, Homo sapiens
gagatccagttgataagggaattgaaagaaatagaggacagctggatcacactaatgaaagccatttatgactcctagttgctgaagtctctgtagctttttaggttaacttcttctacgtcaggcctc

SEQ ID NO: 6764664 - DNA, 86 bp, Homo sapiens
tatatctgtgttgctagtgaatttctgccactgaaacttcaacagctctactagtttcaggcctaatttctagccccagggatata

SEQ ID NO: 6764665 - DNA, 69 bp, Homo sapiens
gcagttacatatttagtaggttaaaatgactccagcgttcggacttgtggatggcttctgaacaactgc

SEQ ID NO: 6764666 - DNA, 111 bp, Homo sapiens
gccctttcatgaccaaccacattggggctaggccatttctcctggcggggcccatgtgcctccccaggttcaggaggtgggtgctggctctctgtgtctgttcctgattgc

SEQ ID NO: 6764667 - DNA, 59 bp, Homo sapiens
tgtggactctggagtcagacagacctagtgatgagaatcttgattcctcagagtttaca

SEQ ID NO: 6764668 - DNA, 99 bp, Homo sapiens
tggataacttcttttggtttcattctctcatctgtatatagtgaatgatcctgagtcttcctagctcatagagatgtcataatggtccaatgagatcca

SEQ ID NO: 6764669 - DNA, 73 bp, Homo sapiens
gggaagggctctaggccaagagtcccggcatcattcgagtctgctctggcccgctcctgccctaagccctcct

SEQ ID NO: 6764670 - DNA, 57 bp, Homo sapiens
gctgtctttgctaggaaagaggagaaatattctgctttcagctggtaaagaaacagt

SEQ ID NO: 6764671 - DNA, 92 bp, Homo sapiens
ttagaactaatatatgagcacggaataaacgtctatggtggtggagccattatagattttgggtctctgccatggcagttagctttttctaa

SEQ ID NO: 6764672 - DNA, 75 bp, Homo sapiens
ggagagagggtggcatgcttattcattctgctaactcattttacctggaagagttaataatgaacactttctccc

SEQ ID NO: 6764673 - DNA, 61 bp, Homo sapiens
tgaccagttttctgctttggaagccctgggagaccatgccttcgggaggaggatgctggca

SEQ ID NO: 6764674 - DNA, 77 bp, Homo sapiens
tacatgcagagttgcgtccatgcagagttgcatgcagttacatgcagagctgcacctatgcagacctctctgctgta

SEQ ID NO: 6764675 - DNA, 64 bp, Homo sapiens
ccctctttgacaccattcctcattgtcctaggcacaggcaactgaggtctccagtgcagaaggg

SEQ ID NO: 6764676 - DNA, 101 bp, Homo sapiens
attacatgtagagatgtttttagtctgactattacctccaagaattcttatggagtgtgaaaagtggtattcattaaagacagaatttatgggcatgcaat

SEQ ID NO: 6764677 - DNA, 55 bp, Homo sapiens
tgcagcctgtccaggcccagaatgtccttaactcggcatctccaggacgagctca

SEQ ID NO: 6764678 - DNA, 82 bp, Homo sapiens
gcagtgggtggaatgggaggtagtatgggaggtggcatgttctaactcctagaatagtgctttacctttattcatgaactgt

SEQ ID NO: 6764679 - DNA, 60 bp, Homo sapiens
agatatgatctatgattttgacagcattcagttttgttctcaagatcagtgacataatct

SEQ ID NO: 6764680 - DNA, 60 bp, Homo sapiens
ccttcctcacactcccccattcgacagaattctgctttgtaaagggagctgtgaggacgg

SEQ ID NO: 6764681 - DNA, 61 bp, Homo sapiens
ccaccttcatctccgccatcgcgaacgcctgcccgatgcagttccttggggagggaggtgg

SEQ ID NO: 6764682 - DNA, 71 bp, Homo sapiens
catttgatgagtgcctcccatgcattgcctcctttaatactcaaaaagcaatgtcatttatttatcaaatg

SEQ ID NO: 6764683 - DNA, 59 bp, Homo sapiens
cagagcacagagcttgggacaaggccaacagttcatacttgtctcttacctgagttctg

SEQ ID NO: 6764684 - DNA, 77 bp, Homo sapiens
ctaaagaaaagcaaggggaatagtaggacctgggacagcagtcctaggcccattaattccccttgcccctctgacag

SEQ ID NO: 6764685 - DNA, 79 bp, Homo sapiens
ttgctattgatttacatattgtcaagaagtttatagtgtatagtacctatgttggcaatgtgtagctaatgagaagcaa

SEQ ID NO: 6764686 - DNA, 65 bp, Homo sapiens
gtaggactggatattgagtactgcaatgttcaatgacgttgcaactctgaggtccatacttctac

SEQ ID NO: 6764687 - DNA, 65 bp, Homo sapiens
ctgtgctggattctgaggctacaaagagaaataagataccatctcaggcctctaaaatctcacag

SEQ ID NO: 6764688 - DNA, 61 bp, Homo sapiens
tcctggcaggcagtgtgggagctggggcacattccccacgcatccctatgccctgcgggga

SEQ ID NO: 6764689 - DNA, 60 bp, Homo sapiens
tgcccctctaggccctgttctaaagctgagtgcttcagatgtggagctgggtctggggca

SEQ ID NO: 6764690 - DNA, 68 bp, Homo sapiens
ccggtgcctggtttggggaatgttcgtgggatatgttccaaaggactgacggaccaatcaggtactgg

SEQ ID NO: 6764691 - DNA, 61 bp, Homo sapiens
tttccatgttggtgaaatgaggaaaaatcccaccctccccaggtttcattaagataggaaa

SEQ ID NO: 6764692 - DNA, 62 bp, Homo sapiens
tcctgccactcagatgaatgcgtcagtcctcctttgggttgagttagcaaagggtggcaggg

SEQ ID NO: 6764693 - DNA, 56 bp, Homo sapiens
tcccactgtcaggcccaagaagctcagagtggtggctgaaggagcctggggtggga

SEQ ID NO: 6764694 - DNA, 83 bp, Homo sapiens
aggcatttagaatgattctgaattagaggatacgtcttgctttatccacccagcagcctcctctattcttctgggaattgtct

SEQ ID NO: 6764695 - DNA, 60 bp, Homo sapiens
tggcctggaagagaggtcgaggatacaatcacccccttatgcctctggagccaaggacca

SEQ ID NO: 6764696 - DNA, 67 bp, Homo sapiens
aaccattaagatgcaaacctaactatggagacctattagtgggcaactctttgcattgtaaacggtt

SEQ ID NO: 6764697 - DNA, 56 bp, Homo sapiens
tctcctggtacccttcctagcatcaattctgtatttgtaggagtccaatcaggaga

SEQ ID NO: 6764698 - DNA, 56 bp, Homo sapiens
ctcttagtaatgccatgaagcagccactttgggcagctttttgtgttgtctgagag

SEQ ID NO: 6764699 - DNA, 65 bp, Homo sapiens
cagccaaggctcagtaccatatgtaccaagacccagcctcatgcatgttgtactggcccatgctg

SEQ ID NO: 6764700 - DNA, 92 bp, Homo sapiens
tgtcagatgccacatagttgttgaactcaatgtctgcacaatgcacagtgtacaatgtctggcagatattaggagctcaataatgtttgata

SEQ ID NO: 6764701 - DNA, 56 bp, Homo sapiens
gagtaggggtagggaatttgacagacctaggtttaaattctgtctgccgcttactt

SEQ ID NO: 6764702 - DNA, 65 bp, Homo sapiens
cagtgggaggaggcatttgataggcttataatggcttaagagcctgggttagggttcttcccctg

SEQ ID NO: 6764703 - DNA, 121 bp, Homo sapiens
ggtttgcaactgcaccagacttgctgtacctggctctattccctaaggatgagtttagtcctacaaggattttcagtctattttcaggaaataggcttctagtgggtttgccctgcaaacc

SEQ ID NO: 6764704 - DNA, 109 bp, Homo sapiens
ctggaaaatccctgagatatcagcttcaggcgaggcttaatccaaggctgagagtctgcatttctctatttcttgggtttgccttgctgctgcaggcctttttttccag

SEQ ID NO: 6764705 - DNA, 79 bp, Homo sapiens
gccactcccatccctcagcaaaccgtggtggtcactcggatgtgagttctgtccactgctggggcctcgggagtgaagc

SEQ ID NO: 6764706 - DNA, 106 bp, Homo sapiens
tctgccttaatttccttccaggccagggtaagaggagagcgagtgtatgatgttatggttatctgttttcccttgcctctgtccctggttccaagtgtactgcaga

SEQ ID NO: 6764707 - DNA, 64 bp, Homo sapiens
tatgctaaatgaccttagaccacttataaaatgcatatgagtgctttaaatgttattttgtgtg

SEQ ID NO: 6764708 - DNA, 83 bp, Homo sapiens
aggataagagatgattagaagtacagcctgtttgtaatgataatactcaccagctgtgtgacttttaatgagcctcttgacct

SEQ ID NO: 6764709 - DNA, 61 bp, Homo sapiens
ggccatggcgggagccggcgtcatctcaggcttcgacatgacatcggaggccgccctggcc

SEQ ID NO: 6764710 - DNA, 65 bp, Homo sapiens
ggtgagttttctgctaaaccagctaaagggagatttgcacctcttcttgccagcagaaacacgcc

SEQ ID NO: 6764711 - DNA, 63 bp, Homo sapiens
cttgctttgtccagaaattcagctataactccacacatctgatggccctttctggcaagcagg

SEQ ID NO: 6764712 - DNA, 56 bp, Homo sapiens
tctgcagggtcccagcctcagcatccaaatcagagtttagaagctgggcttgcaga

SEQ ID NO: 6764713 - DNA, 64 bp, Homo sapiens
tctctgcttatcaaactggagcaggctttgcattgaataaagcttgcaataaatgatacagaga

SEQ ID NO: 6764714 - DNA, 126 bp, Homo sapiens
gtatttggaaagagggctgggctggagatgaggaaacttggggtccagaagctgctctgccacactccagctcactgaccctggtcaagttgcctcacccacttgggcctctctttcctcatttgc

SEQ ID NO: 6764715 - DNA, 130 bp, Homo sapiens
tgtgtgtgtatatatatgtgtgtgtgtatatatatatgtcatttgtatatatgtgcatatatgtgtgtgtgtgtatatatgtttaagtcatttgtatacatgtgtatatatgtgtgtgtatatatacaca

SEQ ID NO: 6764716 - DNA, 96 bp, Homo sapiens
gaggcaggagaatcacttgaacctgggaggcggaggttgcagtgagccaagatcgggccactgcattccagcctggtgacagcgagactctgtctt

SEQ ID NO: 6764717 - DNA, 70 bp, Homo sapiens
gggtcagagaacgcaaatccaaacctagaaatatgaaactgccttctaaagagaatgcgtttctgctccc

SEQ ID NO: 6764718 - DNA, 65 bp, Homo sapiens
ttttgctgcgtcctcacacagtgggagggcaaaaaagatgaacactgtgtcctcatgtggcagaa

SEQ ID NO: 6764719 - DNA, 72 bp, Homo sapiens
ttagacaggatgtatgaaagctgggtaaaaatagttccctaaatgatgttatttcatacaacttctgtctaa

SEQ ID NO: 6764720 - DNA, 90 bp, Homo sapiens
tgcagttgggcagaaacattggtcagagtaaatttatttcagggctgctagtagccaaatgtctttctttttcagtctctgcacactgca

SEQ ID NO: 6764721 - DNA, 99 bp, Homo sapiens
aagagttttagagttttcattcttaaatttaggtctgtgattcattttgagttaatttctgtgtatggtttgaagaatgagcccagctttaattctttt

SEQ ID NO: 6764722 - DNA, 56 bp, Homo sapiens
tctgtgtgtgtgcatatgcatgcatgtgtgtgtgtgtgtgtgtcctcatttgcaga

SEQ ID NO: 6764723 - DNA, 87 bp, Homo sapiens
gggagctggtgagcctggtttcactgacaaggtcaggcccactctggggcatgtgtgtgagggaaacatgtttggagccgtgctctc

SEQ ID NO: 6764724 - DNA, 74 bp, Homo sapiens
tgcttgagcccaggagttcgaggctgcagtgagctaaaattgtgtcactgcactccagcccgggcaaaagagca

SEQ ID NO: 6764725 - DNA, 59 bp, Homo sapiens
gtccaggactttcttaaggcactccagattaggttggaattgcaagccagtcctgtgac

SEQ ID NO: 6764726 - DNA, 57 bp, Homo sapiens
cctgcccagggcttggtggacccgagggacactgtgggcatggcacctctgggcagg

SEQ ID NO: 6764727 - DNA, 64 bp, Homo sapiens
gtgtacccagtatcaagtgtgtggggagttcacataagatatattatatacatactgtgtgcat

SEQ ID NO: 6764728 - DNA, 93 bp, Homo sapiens
gagctatggctggagtatctggggaaggaggctaactgacatacacggcacatgtcttcttctctacctgaactttaagaaccatttcagctc

SEQ ID NO: 6764729 - DNA, 57 bp, Homo sapiens
ctgagaagcactgtctgcaagaaacctaatctgggcatgggacagctgccttctcag

SEQ ID NO: 6764730 - DNA, 83 bp, Homo sapiens
atggtgagtgatgtttatatctaacttaagtgacaccagtctaagttatacttgattagagttttatgaataagaaccatcat

SEQ ID NO: 6764731 - DNA, 57 bp, Homo sapiens
tagcacagatttgtcaacatagacctgttacattgtctatccctaaatctgctgctg

SEQ ID NO: 6764732 - DNA, 65 bp, Homo sapiens
aatgcttctgagaggtcaaggcaaaaactaaagaagctgttggatttgacagctcagagggcatt

SEQ ID NO: 6764733 - DNA, 112 bp, Homo sapiens
gagccctatttcaggatcgtaaaaacatgtcttatgcggaactttcatgtcagatgcctggagtgtgaagtgttcattggacattccattttactgttcgaagtatggactt

SEQ ID NO: 6764734 - DNA, 94 bp, Homo sapiens
ggttagcaagtggtagagctggagctggaatttgagctggaagtttgactccagaatccatgctcttgtctagcctccttgcctcattgcatcc

SEQ ID NO: 6764735 - DNA, 68 bp, Homo sapiens
tggtttccccattcacagtatggacgaaatgagttcctagagtactcagagttggaatggggaaggca

SEQ ID NO: 6764736 - DNA, 66 bp, Homo sapiens
ttgttaatgagctgaatagtatagcaattggatttctttttgaatctataatttcagtattggcaa

SEQ ID NO: 6764737 - DNA, 58 bp, Homo sapiens
gggctttaaagctttacatgcagtgagcaaggaagcttctggaaagcatttgaggccc

SEQ ID NO: 6764738 - DNA, 58 bp, Homo sapiens
gctacttattcatgggggaaacacattttaaaactttccccctacataatagggtagc

SEQ ID NO: 6764739 - DNA, 82 bp, Homo sapiens
tcttagtgaaaggagtatataattaattggtctggtggtctccactcaaccagtgatatgtgtaattggtttctcactgaga

SEQ ID NO: 6764740 - DNA, 56 bp, Homo sapiens
gctggaggcagttcagacaccatgtggaggtgcacaaggtctgaatgcctctgagc

SEQ ID NO: 6764741 - DNA, 59 bp, Homo sapiens
ggagcttctagatagagtgcaaattattgccaatactttgtactcttctggaataatcc

SEQ ID NO: 6764742 - DNA, 70 bp, Homo sapiens
cagtcttagccttccctcacccaggacgcactacctggagtgaagcatggggaggggcagatgagggctg

SEQ ID NO: 6764743 - DNA, 129 bp, Homo sapiens
gtccgcaaactctttagtttctggctgaaaattgatgtgtaagttgttcatggggtgtgattggccttttggtcaataacatttggcatcttgtaacactcatctggcaaaggactgaagacaaaagac

SEQ ID NO: 6764744 - DNA, 123 bp, Homo sapiens
gggaaggctttcaggtctggcttgctcaagggactcagctcctaccccggccccagctgttgctgagcctgagggcaggtggtgctgccaggtgccttgtgttggcctccctgcatgcgtcct

SEQ ID NO: 6764745 - DNA, 95 bp, Homo sapiens
cccacccctggcatctggggccccggaagttcctgcatgtcccagttggggggacacaaagtactgggagattctggtgtccagaatgctgtggg

SEQ ID NO: 6764746 - DNA, 71 bp, Homo sapiens
tgacaagtatttctttatctggtcagaaaatggaaattctgttttctgagccagccaagataccaggtaca

SEQ ID NO: 6764747 - DNA, 57 bp, Homo sapiens
gggatgacaaagtgtctgtcccccacactggtcaaagggacaggtcattgttatgct

SEQ ID NO: 6764748 - DNA, 98 bp, Homo sapiens
gctcgaaaagaaatatgaaaagatgaaaatttactgtgatggctagttttctgtaagacattaattgtatttttcaaagttttgtttcttagttgagc

SEQ ID NO: 6764749 - DNA, 63 bp, Homo sapiens
gaagtgatgacgctgtgtttttcatcccaggccaaaacgaaagaagaaatggtgtcattcttc

SEQ ID NO: 6764750 - DNA, 79 bp, Homo sapiens
gtctttgtatgctcatatactggatgtttgctttttgcaagacaccatttgacagtggcagtgggcatggtacaaagac

SEQ ID NO: 6764751 - DNA, 97 bp, Homo sapiens
gcaatgaagcctggagagtctcaaggcaggaaactgatcagtcatatggctcacctcttttgtttcctgtctctcaggggccacttttcttcattgc

SEQ ID NO: 6764752 - DNA, 101 bp, Homo sapiens
ggagtctcacccacaggaacgcgcaccagctgctgggttctagagagttccagaagcactgacgatcttcccggcatgcggtgtgagcccggtgatgcccc

SEQ ID NO: 6764753 - DNA, 94 bp, Homo sapiens
gtaggtctcaggcacttcggcagcgtggtagaggtgacaattccaaaggaggcagccacagtggtgctagctgcccgaaggtctcagagaaagc

SEQ ID NO: 6764754 - DNA, 116 bp, Homo sapiens
ggagccaggctgccaagaggcaggaaagggaagagtctgcagccacaggagtgtattgtttcctgccagctggggctgcttcctccccccagcagtctcccggcagccgagcctcc

SEQ ID NO: 6764755 - DNA, 63 bp, Homo sapiens
gtgctgggattacaggtgtgagccaccaagcccggcgaaccctgcccttttactccacagcat

SEQ ID NO: 6764756 - DNA, 92 bp, Homo sapiens
gtgagtgggcagggcccctggatcccagcactgacctcagttacatgaagagtctgagtccatggcaggatctgggcccacagtcttctcac

SEQ ID NO: 6764757 - DNA, 127 bp, Homo sapiens
gctctggccacagcaaccaaggaatgggaggagggaagtacagaggatggaggcagttagggcctgtgtggaatgggcactgaggaggcctgtcttccctgccctcttctccctgcagctccagagc

SEQ ID NO: 6764758 - DNA, 63 bp, Homo sapiens
gctgctggactacaggaagagtttgatcatccatttgcaaacaatttccgcatagtctagtgc

SEQ ID NO: 6764759 - DNA, 70 bp, Homo sapiens
ctgttttatcagccactggttctatgatctggaagccctcatgtcatctgcacagtggcgtggaaaatgg

SEQ ID NO: 6764760 - DNA, 81 bp, Homo sapiens
agtggtaaaagcctgaaattctgcctctgcacaaaccatgctaagtggaaatttgtgacagaagaggctccttttattgct

SEQ ID NO: 6764761 - DNA, 75 bp, Homo sapiens
tcctgttaacacaatgtttcttgtaaccagtgagttgtgccaaaactcactgtaaagtaatactgtcaggtgggg

SEQ ID NO: 6764762 - DNA, 84 bp, Homo sapiens
gtctctagggtgctaataacagctctgtgtattgtcatctggagcagtggttctcaaccagagcttgtgttacccccaggggac

SEQ ID NO: 6764763 - DNA, 55 bp, Homo sapiens
ggctagggaaatcctgatccaaggaagacctttgatctcattgttctcctcagcc

SEQ ID NO: 6764764 - DNA, 128 bp, Homo sapiens
acatgaatctttgaggataagaaaaagcgtttaaaacacaggtctcaaactggcaccctgtgggccccatctggccagcagatgtgttttgtttggaccatgctttgtttttctaactctgaattagt

SEQ ID NO: 6764765 - DNA, 70 bp, Homo sapiens
gtggaagacagtggctttttagtggcagatgttcactcatctcacttctgaaaggccctccattgaccac

SEQ ID NO: 6764766 - DNA, 81 bp, Homo sapiens
gtgaggaaactgaggcccagagcgagtggctcagctacggtcagaatgctggtatcctgcttctgggcctggtgttcccat

SEQ ID NO: 6764767 - DNA, 97 bp, Homo sapiens
ccacgccttcctctttgggaccccagagggagccaccagggtgttaccacagtaccctggggacttccttttatggagccctcgagaggggcggagg

SEQ ID NO: 6764768 - DNA, 55 bp, Homo sapiens
acatttctaagaaggctgcacatcacagtctatgtgatggtggccctggagatgt

SEQ ID NO: 6764769 - DNA, 63 bp, Homo sapiens
gaaggtcagaggcaatttgaatagtagtagttggcagaatacagattcagtgtctctgacttc

SEQ ID NO: 6764770 - DNA, 75 bp, Homo sapiens
gatagatgacatggttcaagtttccaagaaaatgttattccatcattgaatggggaagctctgaaccaatctttc

SEQ ID NO: 6764771 - DNA, 100 bp, Homo sapiens
caggagttgcagctttttatgctcatgaggtagcctgttctggtaacgggcactgcttcctgagcctgagttccatttttgcttgcacaacttagtcttg

SEQ ID NO: 6764772 - DNA, 61 bp, Homo sapiens
gctgaggtacataataaaaataacagctcagcagtaattgagtatttattatgtgccaggc

SEQ ID NO: 6764773 - DNA, 71 bp, Homo sapiens
atgtaactattagagtttaggggtaagcatagtggggtatctaatcccagtttgggtcttagctgttgcat

SEQ ID NO: 6764774 - DNA, 78 bp, Homo sapiens
atatctctataaaaggctttatgactccagtggataataatatccttgtcacattaggatctggggacctagagatat

SEQ ID NO: 6764775 - DNA, 69 bp, Homo sapiens
ggttggcctcaggaggtttcctgtctaggctgggtcttgtccttgcgctggcttcctcctggggccact

SEQ ID NO: 6764776 - DNA, 57 bp, Homo sapiens
gagtccttgtcataattcagtgagatacttatgtatagcattgaatatagacagctc

SEQ ID NO: 6764777 - DNA, 87 bp, Homo sapiens
tcggttcgcatatgattaaatgtttaagtgtaggagcaacagaaacatgtcaatgtttaggcattataaacatcaggaggtggaaga

SEQ ID NO: 6764778 - DNA, 70 bp, Homo sapiens
tgttcagatcttttgacaatttttttaattgggttgtctttttattattgagttgtaagagctctttaca

SEQ ID NO: 6764779 - DNA, 77 bp, Homo sapiens
ttgcttgaacccaggagccggaggttgtggtgagctgagatcgcaccattgcactccagcctgggcaacaagagcga

SEQ ID NO: 6764780 - DNA, 104 bp, Homo sapiens
gacctcatcctccagtggccatttctgtaggacctgttccttgccactgtttgctgattgatacaggcttctcacagaaaagggatctccagaggatggtggtc

SEQ ID NO: 6764781 - DNA, 85 bp, Homo sapiens
ttaaatagagtgttcatttggggaagatggttggtcttcattatttctatctttctaattctcccatagtctacattctttgtaa

SEQ ID NO: 6764782 - DNA, 103 bp, Homo sapiens
tattttattgtggtaagaacacaacatgagatctaccctcaggaaacttttaagtgtacaagaccttattgttgcctgtatgttctatattgtaatgcagata

SEQ ID NO: 6764783 - DNA, 63 bp, Homo sapiens
tcctgtgccctttgtcctcgtctcactgacaggttgccttggagatggggcagaggggtggga

SEQ ID NO: 6764784 - DNA, 85 bp, Homo sapiens
cactgacaaaaagcctggggctggaacgttctgtgctgcctgcatggcatgtacaggaccgcggccccctggagctggtggagtg

SEQ ID NO: 6764785 - DNA, 60 bp, Homo sapiens
gtatggcttctgcagaagagctgggactgcaaaaccagtgccttctgatggaaagccaac

SEQ ID NO: 6764786 - DNA, 95 bp, Homo sapiens
tccgagaccccaagttctgggccctgggttgctttattcccaagaactgctgtgagctgagagtgtcgggggccccaggatgatggggtacaggg

SEQ ID NO: 6764787 - DNA, 78 bp, Homo sapiens
gaaggagattaatgtcaagggctgatctgtgcttagtctataccttacttgaagtccttgaattaatttgactccttt

SEQ ID NO: 6764788 - DNA, 70 bp, Homo sapiens
gtgaatttctgactaaaagtgccaggcaagccttttcatgctgcagaacatttacagtgagagtttttac

SEQ ID NO: 6764789 - DNA, 68 bp, Homo sapiens
caggagtctgccatcctcaccagagcagcttccttgtagtctgttttatgtgtttggtttcctcattg

SEQ ID NO: 6764790 - DNA, 67 bp, Homo sapiens
tctctggccaatgtcctcttccagaactcttccttccagccctcctggcctccgacactggccaaga

SEQ ID NO: 6764791 - DNA, 61 bp, Homo sapiens
ttgttagtatcattttggcattagtatttggtgacagatgtagctttagtgatacctgtgg

SEQ ID NO: 6764792 - DNA, 59 bp, Homo sapiens
gttagcagttcattgattatcgtcctgttataatgcagcaggatggtgcgggctgctgc

SEQ ID NO: 6764793 - DNA, 86 bp, Homo sapiens
ggcaaaaatttaccttctgctgtaaccttcagaggtattttattcaatactttgatgaagcttatggtgaactgacatgatttgcc

SEQ ID NO: 6764794 - DNA, 61 bp, Homo sapiens
agtttataaaacattgcgtggcgtagccaaggtcctaggtcatagaatgagttaatgaact

SEQ ID NO: 6764795 - DNA, 74 bp, Homo sapiens
tgaggcttaaagcaatgcccgttcattatcttacaattctgtaagaatgcctggtttatctgctcgaggtctca

SEQ ID NO: 6764796 - DNA, 90 bp, Homo sapiens
gccacctttggcaccctccagccacggctctttgttttctatagcatccctggggatgtgaaggtaaggaggggcaagagggtgggtggc

SEQ ID NO: 6764797 - DNA, 130 bp, Homo sapiens
tagtgcattggaatcacctggagagcttgttaaatgagcctgctgggctccaccctcaactgtttatgattcaaaaggctgaggtagggcctaaaacattacaagttcccaggtgaatctgatgctgctg

SEQ ID NO: 6764798 - DNA, 55 bp, Homo sapiens
tgtagcacaaacacagtccaggcaatatataaatgaaggggcgtggctgtgttca

SEQ ID NO: 6764799 - DNA, 72 bp, Homo sapiens
tgctttgaaattctagagtgttgtgtgctgtaggaaaagaaaacatgattggtcatttggaatttaaaggca

SEQ ID NO: 6764800 - DNA, 55 bp, Homo sapiens
aatttgacccatcttggaattttggccccttggtcctgtttccctgggacagatt

SEQ ID NO: 6764801 - DNA, 117 bp, Homo sapiens
ggtgtgattgaaagagataatgtgtctgaaagtgcaatgtaaattgtaatactctatatacatgtcatagttattattgttactatcagcaccatcatcatcatcctctagcacatc

SEQ ID NO: 6764802 - DNA, 59 bp, Homo sapiens
tgtggacctgatggaaattaatagtgttgagcattattctagaagtccaccagtctata

SEQ ID NO: 6764803 - DNA, 86 bp, Homo sapiens
tttgttgtgatattggagcttttttattaggttgaaagcttacttaaatttctcacttgaaaggaagctctaaaacttgcaaaaga

SEQ ID NO: 6764804 - DNA, 90 bp, Homo sapiens
ccctgcagggctgccctgcccagggtggtccactggcatctctgtgagcctgacctcttctgccctgggctcggctggccctgtctaggg

SEQ ID NO: 6764805 - DNA, 70 bp, Homo sapiens
aaggccaggaggacagttagaggactgggaaatagattcccacttaactgtgacttctctcccaatcctt

SEQ ID NO: 6764806 - DNA, 67 bp, Homo sapiens
tctcccctttttcattcatccatttcttccttatgttgaaattctgatgagtcagagaaaggaaaga

SEQ ID NO: 6764807 - DNA, 67 bp, Homo sapiens
aagtggcctgtggttatcacaactgaaaagagcacattgaagctttagtatataattactgctactt

SEQ ID NO: 6764808 - DNA, 79 bp, Homo sapiens
atccttcctgccagtcattgcaactgtggcttttaaggttggcacatggggcgctgcattggcctgttcataggaggat

SEQ ID NO: 6764809 - DNA, 58 bp, Homo sapiens
ggcagtagtccattaaattagattcaattaaagttgatttgattgatgaactaaggtc

SEQ ID NO: 6764810 - DNA, 71 bp, Homo sapiens
gtaaatgccaaggagagactgttactaccaggcttatttactagcaatctagcatttttctaggcatctgc

SEQ ID NO: 6764811 - DNA, 70 bp, Homo sapiens
ttaagtggaattggatgtggggttttttgtactatttaatacaactaaaacctgattgaattctatttaa

SEQ ID NO: 6764812 - DNA, 81 bp, Homo sapiens
atgtagagtggctttaaagtgtggtcgttcattttgtattaatagacgttttagagagttgtaccacactcataactgcat

SEQ ID NO: 6764813 - DNA, 68 bp, Homo sapiens
gattttgtcatgatccttctgttaggtgcatctcttattccagccctaacagattgggtgacaatatc

SEQ ID NO: 6764814 - DNA, 61 bp, Homo sapiens
ctgaccctgtcttcccccattctgatttaataaagaatttggagagggtgagtagtgtcag

SEQ ID NO: 6764815 - DNA, 103 bp, Homo sapiens
gaggtcagattgaggggagatttcaggagtgcagcagtttggagatcaaacgcacatgtgatcttctgatctggattcctaactctcccctctagtagacctc

SEQ ID NO: 6764816 - DNA, 74 bp, Homo sapiens
ttaaacttctgagctcaagcgatcctcccacttggacctagccaggtgctgggattatgggtattagagtttaa

SEQ ID NO: 6764817 - DNA, 62 bp, Homo sapiens
gggagaagggtgagaggcagtgctgtggaaggggcctggcccctgctgcctgcgattctccc

SEQ ID NO: 6764818 - DNA, 70 bp, Homo sapiens
ctgagtgttttcagccacggccttgatacctgtacaaaggagataatacccgtatctggaaactacttag

SEQ ID NO: 6764819 - DNA, 89 bp, Homo sapiens
ttttcaggttatattttgagttgtgtcagccaaagtgcaatgtgcattaaggaacaattctacacaccctcagttttatgttttgaaaa

SEQ ID NO: 6764820 - DNA, 56 bp, Homo sapiens
tcaaaccttgttccagtcaactctgtgcgtgagtagggagggggaattaggtttgg

SEQ ID NO: 6764821 - DNA, 93 bp, Homo sapiens
agtactcattgcttgctgcaagctcatctggggctttcagcttagctaggttacagttcccccagtgggcttcttcacagtgcaatcaggact

SEQ ID NO: 6764822 - DNA, 76 bp, Homo sapiens
tagcataaggtctcaaatttgctggaccagtagaaattctttagtctttgcattccaaaatttgagattgatgtta

SEQ ID NO: 6764823 - DNA, 57 bp, Homo sapiens
atattttgcaattaattcatcctgacaagttcatcaggaaggcaaattgcatgatat

SEQ ID NO: 6764824 - DNA, 63 bp, Homo sapiens
caggctacaaataagcatgtaatactgaaaatacattctaattacatggctgtttgtcccctg

SEQ ID NO: 6764825 - DNA, 87 bp, Homo sapiens
cattcactccagagttcaagccttcattcagctatagcatcccaggtgggagtgagggagcatgagtgaggagcctggaggagaatg

SEQ ID NO: 6764826 - DNA, 74 bp, Homo sapiens
acctaggacaaaggaccagatctggaaagttcctgtccttgaagagctttcacaaacaactgtttgttctgggt

SEQ ID NO: 6764827 - DNA, 106 bp, Homo sapiens
gtgaggagtttgaaaaaaataccaatacctgtgtcctgcgtcaagccaattaaaaatcatgatctattggggtggtgtcagggccagggtattttaatcttttcat

SEQ ID NO: 6764828 - DNA, 55 bp, Homo sapiens
gctggggcagggtgggtggtgggctttggagaccccagcccagctgtgtcccagc

SEQ ID NO: 6764829 - DNA, 56 bp, Homo sapiens
caaacatttgttggaacccctgaagcatatcctagggttccttggaacactgtttg

SEQ ID NO: 6764830 - DNA, 67 bp, Homo sapiens
gtaatcttgccagtctccaaatcaatctgaatggtgtcattcaccttgatgaggggatcagggtagc

SEQ ID NO: 6764831 - DNA, 78 bp, Homo sapiens
atcttcagtctggagagaatgtggaatgatttgtctcttttaataagatttccagaccaatttctcaagctgatagat

SEQ ID NO: 6764832 - DNA, 87 bp, Homo sapiens
ggtgccagcacaaaacaaggtacacagtaatggttagaaatgattattattgttattatctactgtctattattatctgttggtacc

SEQ ID NO: 6764833 - DNA, 87 bp, Homo sapiens
ctgaatctgattcttaaaaatggatgaagggacagagaggtaactttcaagatgcttccacattatttaggaatccaagatcatcag

SEQ ID NO: 6764834 - DNA, 127 bp, Homo sapiens
agcctctccacacccccaaaccgtttgctcgaaacttgatctccttggccctcagagtcacctcagtggagaagcctgcacagggctttgatggctgagtttccccagatgtggccttagagaagct

SEQ ID NO: 6764835 - DNA, 62 bp, Homo sapiens
gcatctactacagtgttcaacatgtacttgaaaagcatgtgtcaaatgatgtagctgggtgc

SEQ ID NO: 6764836 - DNA, 67 bp, Homo sapiens
agttgtttaccttctgagctgcagacagaagttcacatctgttatacagacacgatggtatccaact

SEQ ID NO: 6764837 - DNA, 61 bp, Homo sapiens
gcacaaacatcaagattgataatgtgtagctacttctactgttggagtcttgagtttctgt

SEQ ID NO: 6764838 - DNA, 129 bp, Homo sapiens
aggctgaagtgggaggatcgcttgaccccaggaggttgaggctgcagtgggctgagatcacaccactgcacttcagcctgggtgacagcaagaccctgtctcaaaaaaaaaaaaaaaaaactttagttt

SEQ ID NO: 6764839 - DNA, 97 bp, Homo sapiens
gaagcactgctgtgtatagtgaaaatagagcaaactttaggggcaaacagcacttttgagtttgagccctggctctttcacttactgtgtgatcttt

SEQ ID NO: 6764840 - DNA, 56 bp, Homo sapiens
caggcttgtgtctcagctgcaggcagttatcacaaatgcacgctagcacaggtttg

SEQ ID NO: 6764841 - DNA, 58 bp, Homo sapiens
gtgtgtgtgtgtgtgtgtgtgcgcacatacaggtacgcatgcacatacgcatgcacat

SEQ ID NO: 6764842 - DNA, 75 bp, Homo sapiens
gtgcttttcacatgcctggttcacaggagaagctcaataaacctgtggaaaattgaatgaggcaatggagggcat

SEQ ID NO: 6764843 - DNA, 64 bp, Homo sapiens
catattgacaattctatgcagagcaaagcttccaaaaaggcatgctatgaattctgtcaatgtg

SEQ ID NO: 6764844 - DNA, 75 bp, Homo sapiens
ggatcctgttgatctcctggtccacccgggcggcggccttctcatcctccgtcaggcaccaggggcagcagcgcc

SEQ ID NO: 6764845 - DNA, 66 bp, Homo sapiens
ggagtctctgctgggggttccttcactgtatgtgctgaccatggagagcccattggcaggggtacc

SEQ ID NO: 6764846 - DNA, 78 bp, Homo sapiens
ccctctacctgccccgccgcggcggcctgcggccaggagaagtaggctggcgacatctggcgggccgcgggccgaggg

SEQ ID NO: 6764847 - DNA, 108 bp, Homo sapiens
gagtgaagagggaaagagagaaacaagcacattatagctatctaggtcaaaattttaaacaaccttttggtttaaatgtgtgtgtgtgctctttgcaaagcttcactc

SEQ ID NO: 6764848 - DNA, 68 bp, Homo sapiens
gtaggtggagtggtgcctgcagatcccttctttggcaatgtgtctgagagagcacctatccactctac

SEQ ID NO: 6764849 - DNA, 76 bp, Homo sapiens
caggcccagcagggagaccatctcttccttaggacttgccttaggtcccatgtcctccctgaccactgatggcctg

SEQ ID NO: 6764850 - DNA, 55 bp, Homo sapiens
tgcaggcagtaggccagctccaggggccacactgctttctgccggctgtcctgca

SEQ ID NO: 6764851 - DNA, 106 bp, Homo sapiens
gatgttggtggagaagctctaagtacacttgtcttgaacagcctaaagattgattttcaggttgtggcagtcaaggctccagggttttgtgacaaagaaccagctc

SEQ ID NO: 6764852 - DNA, 68 bp, Homo sapiens
tgggaaattgtaacaagtctgttacctgtatattgtgtcttccacaaagcagactgaatacattctta

SEQ ID NO: 6764853 - DNA, 78 bp, Homo sapiens
caccagccccaggcctggcaggggggcagtggtggctctgcaagctgtcactcaccaggcctgcatcgggcacaggtg

SEQ ID NO: 6764854 - DNA, 63 bp, Homo sapiens
tattatggggggaacatcactcagctcactacaacttctgagacaaagttcccacctctgatg

SEQ ID NO: 6764855 - DNA, 130 bp, Homo sapiens
atgagtgtgtgtgtgtgtgtgtatttgtgtgggtgtgtgtgttttccagaatggtgttttgggtcatccaaacagtttctttttggagaacagatcaccaaatactagtcttcttcatagaaacatgtat

SEQ ID NO: 6764856 - DNA, 55 bp, Homo sapiens
tggccatatgaccacctttgatcaatgaaatgtgagcagaggtgatatatgccca

SEQ ID NO: 6764857 - DNA, 62 bp, Homo sapiens
actctttccaatgcatttccaatgtgcagtgcacatgtatctgatctgcaattggaaaatgt

SEQ ID NO: 6764858 - DNA, 76 bp, Homo sapiens
cctcctacacatctcacctcacaggcatgaactcagaaggtggttcttctaggagctgagagtgtgtacgtggggg

SEQ ID NO: 6764859 - DNA, 61 bp, Homo sapiens
cttctctttgtgttcactgcagtgcttggtacatatggcattcaatgaaaacaaagtgagg

SEQ ID NO: 6764860 - DNA, 75 bp, Homo sapiens
cttttaaatactctgggtgatggttaaaagcaagatgactgctggtttattcgtcacaccggaagcaagaaaaag

SEQ ID NO: 6764861 - DNA, 58 bp, Homo sapiens
tgggaagggtcaacagctggaaattctttatgcagagttgcagcacgggccctttcca

SEQ ID NO: 6764862 - DNA, 68 bp, Homo sapiens
cctgagccttccttgtcatatcatttttccccttccgtggggtttgtggtgaacaaggagggaccagg

SEQ ID NO: 6764863 - DNA, 77 bp, Homo sapiens
tcaaacttttgaggagttcaggaatagctatttcttttagcaagctctccatgaaacacttagatattaaagtttga

SEQ ID NO: 6764864 - DNA, 68 bp, Homo sapiens
ttggcagggcagcttccatagtctggccatagaaccacaggcctgagccactggaaggccctttacaa

SEQ ID NO: 6764865 - DNA, 63 bp, Homo sapiens
ctctggagttcttcaagctactacaggcaacagagtttagtagtctgagtgtgaaccccagag

SEQ ID NO: 6764866 - DNA, 71 bp, Homo sapiens
tgggttctgcctcgagtctttgggcaggcatctctgatccctgggctctgccaacagtttgggcaaaccca

SEQ ID NO: 6764867 - DNA, 100 bp, Homo sapiens
ggaacaaggtggttccaaggcctttgggggcctggtcctgcatgggtggggtgctggggcttggccccagaagagctacttgggagaactgttttgttct

SEQ ID NO: 6764868 - DNA, 78 bp, Homo sapiens
ggccagagtttcatcccactagcttagagcagcaccaggtcaggtggcactgggagaggtgagacggaaactaaggcc

SEQ ID NO: 6764869 - DNA, 63 bp, Homo sapiens
gagggtggcatagattgcggggtggatgcctggtctgggcttcacctgtgcactctacccctc

SEQ ID NO: 6764870 - DNA, 67 bp, Homo sapiens
agacctggcctgcacagcccttactgcagacactcacaaactggtcaggactcctgtaggccaggct

SEQ ID NO: 6764871 - DNA, 58 bp, Homo sapiens
ggctttcattttatgccagtccttcccccaggatggaacatggcataaaatcagagtc

SEQ ID NO: 6764872 - DNA, 57 bp, Homo sapiens
atcatctccttttgtttagttgtattaggaagcagcaaattaggtcaaggagatgat

SEQ ID NO: 6764873 - DNA, 129 bp, Homo sapiens
atgcttccttccctgttctggaggttgggtcctcttccataaggtgttgtcctttggtacagctttgttgtaccatatagatggtaccttctgggcctggacaatcacttgaccaaagggatgggagct

SEQ ID NO: 6764874 - DNA, 63 bp, Homo sapiens
ggtttcaccctccactgccctggggggtccacgcttccccttgagctgtggctgggtgatgct

SEQ ID NO: 6764875 - DNA, 84 bp, Homo sapiens
cagaatacccaactcagactggattaaataaaaggggattttcttgcttatttaactctagattcagtggtaaatgggtttctg

SEQ ID NO: 6764876 - DNA, 69 bp, Homo sapiens
ttctatgtagagcaggacttgagatgttatgataaatgtataatttctcaaaagtggtctacttgagaa

SEQ ID NO: 6764877 - DNA, 71 bp, Homo sapiens
tttctaatactgtgtccactagccacatgtggccattgaacattggaaatgtggctagtgagaccaagaaa

SEQ ID NO: 6764878 - DNA, 66 bp, Homo sapiens
gaagtccatgttctcttcaagtcttacactgatgtacgcgtaggcactgtggaagacatggttgtc

SEQ ID NO: 6764879 - DNA, 74 bp, Homo sapiens
gttcattaacatagagacaggaagtgctttgtagttcagtacatcaaagcacacttggctctgtgtactgtaac

SEQ ID NO: 6764880 - DNA, 75 bp, Homo sapiens
cttccagaagcacaggcttttttgctctcgaatatcaggatgatacctggagttctgagtctgatgacctggaag

SEQ ID NO: 6764881 - DNA, 92 bp, Homo sapiens
acccagacatcttttctagaaaccaagatattgtttgcttccttgaattgtctttagaagtgcagaatttaggaattaggaaagtgatgggt

SEQ ID NO: 6764882 - DNA, 62 bp, Homo sapiens
gagaaaattgtgttcaccagatccttttcaggaacacactggctttggaaacaatttatctt

SEQ ID NO: 6764883 - DNA, 105 bp, Homo sapiens
ggctggagtgcggtggtgcgatcacggttcaccgaagcctccacctcccaggctcagcaatcctcccacaggtgggcccacaggtgtgcaccaccacagccagct

SEQ ID NO: 6764884 - DNA, 61 bp, Homo sapiens
ctcctccacccgctggggcccatcgtcttcatccgagtcctggcgccctgggctggagggg

SEQ ID NO: 6764885 - DNA, 88 bp, Homo sapiens
tctcttacgtgttgcttcatctttatggtggataggaaagtcttatgaaactgcttagcccttatgaagcttggaagtaataaagaga

SEQ ID NO: 6764886 - DNA, 72 bp, Homo sapiens
attatctttgatgattttggtggggggttggggggtgctcgttgaatttgtttcagagtcatcaaagatggt

SEQ ID NO: 6764887 - DNA, 57 bp, Homo sapiens
tgccagtttctgattctgaatgaacagcctaacaggaggcttcagggcagaatggca

SEQ ID NO: 6764888 - DNA, 69 bp, Homo sapiens
gagacaggttgaccttttctgtgccttagtccccgctcctgcaaggtggcatgaaaacagcctgtgctc

SEQ ID NO: 6764889 - DNA, 90 bp, Homo sapiens
gactatccagttggctagtaggtgagtagtgctgaagatactattctgggaggcaatcatttatctctggttattggtttaagaatggtc

SEQ ID NO: 6764890 - DNA, 69 bp, Homo sapiens
actaaatgcaatatgtgtttctgtttaggatcctgcacctgaaagagaggcattgttgggacatttggt

SEQ ID NO: 6764891 - DNA, 63 bp, Homo sapiens
attactgtctttgaggagattttgataagcatacagtcttttagacaatcctcaaaaggtaat

SEQ ID NO: 6764892 - DNA, 71 bp, Homo sapiens
ggctatgaaagcaatgggtctaaggtaaagtggcaacatctttgataaaagacaccatgtttgccttagct

SEQ ID NO: 6764893 - DNA, 68 bp, Homo sapiens
aaggtctgtacctaataaaggtaaattctgtttcatttatggggcagtgtttacatattagaaacctt

SEQ ID NO: 6764894 - DNA, 76 bp, Homo sapiens
ggtttgccagggcaggaggtggaagggagccccatttacagtggtaacttcctttccctttccatcctggcaggct

SEQ ID NO: 6764895 - DNA, 56 bp, Homo sapiens
cttggtgatttacttgtaaatttcctaaatggggaagccacacaaaggtcgccaag

SEQ ID NO: 6764896 - DNA, 55 bp, Homo sapiens
gcgccatgatgtcagcaacacaattttatgtgtcgatgtacctgggtcatggtgc

SEQ ID NO: 6764897 - DNA, 85 bp, Homo sapiens
gctctaggggaggcagaatagagtgtgggttctgccatgggtcacatccgggttttaattctgcctctgccacatgaccttgagc

SEQ ID NO: 6764898 - DNA, 130 bp, Homo sapiens
ggctttcagtacttcccaggtttaggtactgagctgagtggcaggtctcagctaccgacgggtttgtgggttcccgtcactctctctgggtctttgctcagttcgcctatctttgcttttgtctgttgtc

SEQ ID NO: 6764899 - DNA, 86 bp, Homo sapiens
gtttcttaacacaggcaggactaattgttattgtttcattattaagcaatgaccagtgatcttgtatactgtatgaattaagatat

SEQ ID NO: 6764900 - DNA, 62 bp, Homo sapiens
tccagggcactgagtggatgatgcaggctgtgcacagccgctgcacaccctggtgccacgga

SEQ ID NO: 6764901 - DNA, 60 bp, Homo sapiens
tcaatcattaacccttgatgctgggaagagcttggtctcagtctcttgggctgtgaagga

SEQ ID NO: 6764902 - DNA, 114 bp, Homo sapiens
tccttcttcactgtgatctcaagcaagtggcttaatttctctgtgcctcagttttcacaactgtggatacatgaataattctagtcttgcctgcagcataaggtgtggggagga

SEQ ID NO: 6764903 - DNA, 63 bp, Homo sapiens
agcctttttaatgtgacatcttttagaggaattctgctggaataatttcatgttaacgaggct

SEQ ID NO: 6764904 - DNA, 96 bp, Homo sapiens
atctttacagcaattggcatggtggagtgacgggcacaagccttaaggtcaaatgatgcttctgtcactttctatgtctttctatgaaataaagat

SEQ ID NO: 6764905 - DNA, 61 bp, Homo sapiens
ctttaccagattccattgcaagggtgaaaaagctcagtgaaccataatggggctggtcaag

SEQ ID NO: 6764906 - DNA, 104 bp, Homo sapiens
ctaagtgtcattttcacatcatgattcctacagtggagaaggcatgaggctaacagactgggctagagtttctgtcttcccattaacttgataagtgaccttgg

SEQ ID NO: 6764907 - DNA, 65 bp, Homo sapiens
gagcagggggagacatgtgtgtgttttaatttttaagacatttcatactatttttccaactgctc

SEQ ID NO: 6764908 - DNA, 61 bp, Homo sapiens
cttcaagtgtccccttcatccagatatcaggaaacatcatgggcctgtggggatcttgaag

SEQ ID NO: 6764909 - DNA, 70 bp, Homo sapiens
gaaggacttccctggacagagagctggctggaatgtgccacatactctgctgtctccagggcagtccgtc

SEQ ID NO: 6764910 - DNA, 72 bp, Homo sapiens
ccatgttttttcgtatctgtcatcaatatgactgtcagagtcatggacgatgccgtgtacgtgagaatttgg

SEQ ID NO: 6764911 - DNA, 73 bp, Homo sapiens
ctagaggagtgggttagtgcttattttcacagattgtataaataacaggcctgctattgcttctttcttctag

SEQ ID NO: 6764912 - DNA, 61 bp, Homo sapiens
gcagtagtccataagtactctgcagggatatctcatgtcagaagcacctgttgactgctgc

SEQ ID NO: 6764913 - DNA, 79 bp, Homo sapiens
tcttagtaaccttatttagtatgcttgatacaacagcaaggctgaactcaagcaactgaattctaaaaggaagctgaga

SEQ ID NO: 6764914 - DNA, 103 bp, Homo sapiens
gcatcgtcacagcaagatccctgaattataaactagtgacttcagagttaattttccttctttcggtctaatttgtaaccagggagcattgtatggcacatgc

SEQ ID NO: 6764915 - DNA, 75 bp, Homo sapiens
tcaccaccacctcccctgctccctgcttctgaggtgatagccttggggaaaggatcagtgggaggctggctgtga

SEQ ID NO: 6764916 - DNA, 79 bp, Homo sapiens
ctttggtcaagcacttgtagactagaattttaaaaacagaaaactggtagagttaggtcacaaggtgtatgaagaagag

SEQ ID NO: 6764917 - DNA, 91 bp, Homo sapiens
tctggattcctagctgagagactacatcagcactttgttcccgaagccacagggaaccgtggatttgtagtcatttctaatggagtccaga

SEQ ID NO: 6764918 - DNA, 62 bp, Homo sapiens
aggggtttgtgcttcaagacttgatcactgggttttgtggttgttttaaggcacaggccttt

SEQ ID NO: 6764919 - DNA, 60 bp, Homo sapiens
gagcaaatatctttgggaagagtaaataatgtcaattaacactttaatggatatttgttt

SEQ ID NO: 6764920 - DNA, 56 bp, Homo sapiens
gtcccatgggatcagttctatcaggcatcagtgtgggagatactggtctgtggtac

SEQ ID NO: 6764921 - DNA, 72 bp, Homo sapiens
accttagaatgtgaccttacttggtgatagggtgtttacggaggtaatcaagctcaagtaaggttataaggt

SEQ ID NO: 6764922 - DNA, 62 bp, Homo sapiens
tcttgtgctcagctggccatgcaggcaacatttaataatgcaaggatgtcagtggcacagga

SEQ ID NO: 6764923 - DNA, 78 bp, Homo sapiens
tcttttgcagaagaatacacactgcattcatgacagtcagtacaaggaagggaggccgtgtgtatactctgtaataga

SEQ ID NO: 6764924 - DNA, 81 bp, Homo sapiens
gaaagctggcaggtgaggtggctggaacaaactggtctcatcagggaggcctgtgacaaacccgcctattcctccgctttc

SEQ ID NO: 6764925 - DNA, 107 bp, Homo sapiens
accctctgggcattccagagtatcctgttggtccattacattgatgacatgtttataggacatgattagcagaaagtggtgaccatcctggttgtgcttcatagggt

SEQ ID NO: 6764926 - DNA, 66 bp, Homo sapiens
ttgtaatgttcattgattaaatgaatgagtggacatctcattcatttaattaatgaactcgtgcag

SEQ ID NO: 6764927 - DNA, 76 bp, Homo sapiens
ttaggctagcccttaaattcttaatgccctcatttataaagtgagcataacaacagagtttagctcgttgggctga

SEQ ID NO: 6764928 - DNA, 80 bp, Homo sapiens
gtcattaacaagaccagaggatataaccagactttagtcattgctcctgtgtggttgagttccttgagggctttgaagac

SEQ ID NO: 6764929 - DNA, 74 bp, Homo sapiens
gcctccccacccacggctggtggaacctgagggcccccggcgccaccagagcttcgtggcttaatgggggaggc

SEQ ID NO: 6764930 - DNA, 80 bp, Homo sapiens
tccacccgaggcaggtccagtcaccagagagagaagcagccacctcctttctcacggcagctggcaaagcaccgggtgga

SEQ ID NO: 6764931 - DNA, 55 bp, Homo sapiens
ctccttcatgtcatgtgtccggggatggtaaaaaatcatcatacacatgagggag

SEQ ID NO: 6764932 - DNA, 98 bp, Homo sapiens
gggttactggtagcacctctctggtttcagcgaaggggcttcggtttatgaatttccttggagttaagaccctgggaatgagtgcaatcttaaagtcc

SEQ ID NO: 6764933 - DNA, 61 bp, Homo sapiens
aagagttattagtcaaatagggaatgatttacattgttataacccaatactaatgactttt

SEQ ID NO: 6764934 - DNA, 59 bp, Homo sapiens
gtgtcacaagagcccaggaaacactttggcccccaaagaatcttttctctcttggattc

SEQ ID NO: 6764935 - DNA, 73 bp, Homo sapiens
gagctccaaatatgtgtaaagtactgtgttgagccttgaggatacagtaaacaatgcagcaaatttctggctt

SEQ ID NO: 6764936 - DNA, 104 bp, Homo sapiens
cttcacataggagctggatgtgtagaaagatctccaagatttgtggccatcacgataattttggaggtgtctttttaaaaggtctcattggctcctttacaaag

SEQ ID NO: 6764937 - DNA, 70 bp, Homo sapiens
gggctgggatttggaagtaaatgagtgttttaatcataatagagaaagtccacattttaaaccacagcct

SEQ ID NO: 6764938 - DNA, 70 bp, Homo sapiens
taggtcagttgatatcatatctgtttttgcatacatattatgcttaaagatatgttgttgcctataccta

SEQ ID NO: 6764939 - DNA, 62 bp, Homo sapiens
gacaagtcactctatcattttcaacttaacaagagagaagtggaaaggctgggagatttgtc

SEQ ID NO: 6764940 - DNA, 62 bp, Homo sapiens
gtgttttagtgctgctgagctgagtgtgaaccgctccttgtttcagcaagcactctggacac

SEQ ID NO: 6764941 - DNA, 89 bp, Homo sapiens
ggcatagggagattaagtaacttgtccaaatgagcaggtcatagaacaagctgtgcaactctgggcaagtcacttaagctctcttggtc

SEQ ID NO: 6764942 - DNA, 64 bp, Homo sapiens
tgctgaattggtagtactgttgtcagggctaagtcagatagcaggtaaacatgcccattcagca

SEQ ID NO: 6764943 - DNA, 69 bp, Homo sapiens
tctgcatgaagcctgcacatattttggggggaaaaccaagtaatcctctttgtgcctgcaggctgcaga

SEQ ID NO: 6764944 - DNA, 58 bp, Homo sapiens
gtgatggcagtgggcctcgagtccttggaccatgagagaccagggccagctgtgtcat

SEQ ID NO: 6764945 - DNA, 95 bp, Homo sapiens
acataaatgtgatagcatagctaggtttttaaataattggttcaaaatatttgtagcacaaaaaggatcttgggttgtgacttttaccaagatgt

SEQ ID NO: 6764946 - DNA, 79 bp, Homo sapiens
cctagcgtaagtatagctttgtctatattgtgtgaataagaaaactgagctacaagatgataaagcagcttgcctaagg

SEQ ID NO: 6764947 - DNA, 84 bp, Homo sapiens
aggaggaaggctagttcttgggtccccatggtgcctgggggtccccaaatgccaccccggcccagagagcatctgtttccacct

SEQ ID NO: 6764948 - DNA, 76 bp, Homo sapiens
tcgcttgaatctgggatgtggaggttgcaatgagccgagatcatgccattgcactccaggctgggtgacagagtga

SEQ ID NO: 6764949 - DNA, 71 bp, Homo sapiens
ctttatttacaaaacaggcagtgggccagatttgtaccacaggacatagtttgccaactgctaatataaag

SEQ ID NO: 6764950 - DNA, 57 bp, Homo sapiens
gctaagtgcttctttctcctcaagccttccctcaaggagaggtggaaaaagcacagc

SEQ ID NO: 6764951 - DNA, 64 bp, Homo sapiens
gatttgggtggaaggtggcattttggctggctaaaataaatgcagacagcttcacacaccattc

SEQ ID NO: 6764952 - DNA, 70 bp, Homo sapiens
tctacaaggagttagcaccagtgctcataacactattataatggtggtggtggtgctaactcctgtttga

SEQ ID NO: 6764953 - DNA, 101 bp, Homo sapiens
atgattggcaaaataattagtctagtcatgcttcaaagaatgttagtttagctatggggttttctaatactttgaatgagagctaaaaatgtcaaattcat

SEQ ID NO: 6764954 - DNA, 70 bp, Homo sapiens
tttcatcaggataaagtcctaaaagtgtttactaattcaaaagtttggcaaacttttaggacttttgaaa

SEQ ID NO: 6764955 - DNA, 93 bp, Homo sapiens
cgccggtgtgtgaactacagggggtggcaggcggctgctccgctgtggaacctgctgccctgtgccaccctgctgcctagtcacaggccggcg

SEQ ID NO: 6764956 - DNA, 77 bp, Homo sapiens
ctctgggagcttaagacagttccaatcttaccccacacttccggggatcctgatttaactggtctaggggcccaggg

SEQ ID NO: 6764957 - DNA, 130 bp, Homo sapiens
tttccccaccatccctggtatctaccaaccttattttcccctttctttgtcataccctatgctcttggggggtagtgaggtgaaagagaggtgatgtttaaggtgagaagatctagagatggttctctaa

SEQ ID NO: 6764958 - DNA, 63 bp, Homo sapiens
tttatttgggatttctcatctgactaggcttgctttttagagactgatggatcaccaaataga

SEQ ID NO: 6764959 - DNA, 76 bp, Homo sapiens
tcttaatgcgttctcctgcactggagggagaagctgctaatgcaagctcagccctcctgtgcagctcgtaatgagg

SEQ ID NO: 6764960 - DNA, 120 bp, Homo sapiens
taagccaaggaatccaccttgacttataatggttaaatgggttaacccatttaagattgtgaacctataaatgtggttaacccatttaagatttggaagggtggtagattctttggctta

SEQ ID NO: 6764961 - DNA, 96 bp, Homo sapiens
gagggatgtgaacagagtcagtggtcaggggcttctgagctgtagttctctacagcttccagtattcttgaaaggccatttctgtaaacccccttc

SEQ ID NO: 6764962 - DNA, 69 bp, Homo sapiens
ttaattttcatgacaactctgtgagattggtaacaatcactattcccattttacagatgtggaaattga

SEQ ID NO: 6764963 - DNA, 64 bp, Homo sapiens
tcctgtgcctcagtttacccctcttgtataatagagagagcttggagagactgaggacacagga

SEQ ID NO: 6764964 - DNA, 56 bp, Homo sapiens
ctggatgcttcctctctgctagccactgttcttggctgcacatggcagccatctag

SEQ ID NO: 6764965 - DNA, 104 bp, Homo sapiens
gaaaggagaggagaaagtagagctacttcctctgtatgctttgctgcttggaaaggagacagaaaaacagcaggaaatgctcacttcttctcttgggatctttc

SEQ ID NO: 6764966 - DNA, 68 bp, Homo sapiens
ttgcctgagcctgggaggcggaggttgcagtgagctgagattgcaccactgcattccagcctgggcga

SEQ ID NO: 6764967 - DNA, 81 bp, Homo sapiens
cattgacatcccctccccatgaagctgggtgagtctgtgcctgcttggaccagtggattatggtggaaccgatgttatatg

SEQ ID NO: 6764968 - DNA, 90 bp, Homo sapiens
aagatcaaggttccagcagggttggtttcttctgaggcctctttccttggctttagatggctgtcttcttgcttaccctcatgtggtctt

SEQ ID NO: 6764969 - DNA, 72 bp, Homo sapiens
atatacgttttatgcataagattaagctggttaactttatgttgatatattttttatgcataggaaatatat

SEQ ID NO: 6764970 - DNA, 59 bp, Homo sapiens
gcagcatacagggagagtactcattacccaggcagtggttaccctttctatgctgctgc

SEQ ID NO: 6764971 - DNA, 85 bp, Homo sapiens
gtgcgcgcgcccctcaattgtctctggggacaggtagtccagggtgccacacatttgtcttcctcctcagtgagggggcgtgcac

SEQ ID NO: 6764972 - DNA, 60 bp, Homo sapiens
ctttcccttaataatcttcaaaatgtccacgtgaaggacaggaagatgtttaatgggaag

SEQ ID NO: 6764973 - DNA, 82 bp, Homo sapiens
cccgtgatccctgaggtttctgcattctgaccctatgatttaagtccccagggacttcagctgcagttatgtttagggaggg

SEQ ID NO: 6764974 - DNA, 81 bp, Homo sapiens
ctccccatatgcctccctgactgcatttgccatgtgcctgtcaagccggggaccaaatgcaggtcagcaggtgtcagtgag

SEQ ID NO: 6764975 - DNA, 56 bp, Homo sapiens
ccagctatcctgaccagcctcgtcgcttcccagaggcaccagggaaggaaggctgg

SEQ ID NO: 6764976 - DNA, 68 bp, Homo sapiens
tttcacaagacagtcttggattccaggagtcatgtcctgattcctgctattcacagggctatgtgaaa

SEQ ID NO: 6764977 - DNA, 68 bp, Homo sapiens
cttttacctccccagtgtatcagctgctaatctgagaagggtttacctgctgaggctgagggtagagg

SEQ ID NO: 6764978 - DNA, 64 bp, Homo sapiens
tgagtatgagttcaggaaaggctttctaagaaggtattatttaacttctgggcattcatattta

SEQ ID NO: 6764979 - DNA, 95 bp, Homo sapiens
gaaaatagaggatcttgcattcatgtgagtttctgcccacatcctcttcagggccctagaagtttccacatgttaatgaaaggttttttcttttc

SEQ ID NO: 6764980 - DNA, 65 bp, Homo sapiens
agtggccagaagtactttaataggaaagtaaattaggcttttaagatgctagtatttcagcgact

SEQ ID NO: 6764981 - DNA, 79 bp, Homo sapiens
ctttccactggcaatgaggccttttgaagactggcaatttcctgatcagttggttcactccttcatgcccagtcagaag

SEQ ID NO: 6764982 - DNA, 71 bp, Homo sapiens
tttttgcacctgtattcgaaagtgatcgtgggctgcctgtgccctggtcattgatagtgcagggaaagaaa

SEQ ID NO: 6764983 - DNA, 55 bp, Homo sapiens
gagtcattgttggtccctcccctctgttctgagatggcaggaccccagtggcatc

SEQ ID NO: 6764984 - DNA, 58 bp, Homo sapiens
cagctgttcctggaaggagacccagttgaaaggggttgttatggaccaggaacagctg

SEQ ID NO: 6764985 - DNA, 56 bp, Homo sapiens
ggacagctctgccaggagctcacattggggcctggcaactccttgcagatttgtcc

SEQ ID NO: 6764986 - DNA, 76 bp, Homo sapiens
tgtaagaatgggatgaaaagttcaggcctatgataaacatcagtttaagagggtttcattcccaaataagcttata

SEQ ID NO: 6764987 - DNA, 77 bp, Homo sapiens
gaataattgtgatgcttgaagttgctaatctgctttaagtggattttaaatgtcaggcaattctagacagttttttc

SEQ ID NO: 6764988 - DNA, 92 bp, Homo sapiens
gagctgctgctgggggcaggtgagggtgggggcacaggggcagaagaaaatgtctgaggggccagaccccacctagactgtggcggtagctt

SEQ ID NO: 6764989 - DNA, 56 bp, Homo sapiens
gccaagaatagagataggtgatccccgaaaaacttttggtatctctgcttcatggt

SEQ ID NO: 6764990 - DNA, 82 bp, Homo sapiens
agttccaaattaatggagttggaattaataaggttatcatggtatttttattggatgggtcagctctatattatttggttct

SEQ ID NO: 6764991 - DNA, 67 bp, Homo sapiens
attagtcacacgtggaaaatagaaacaggttttcagggagaagaaggttttgattccactgaataat

SEQ ID NO: 6764992 - DNA, 70 bp, Homo sapiens
caccctgtggaggaggagagcagtctccatataaaagttctaaagatgaggactctttttcccttgggtg

SEQ ID NO: 6764993 - DNA, 110 bp, Homo sapiens
gaggctgaatggctggctgactaatgagctggccggctgcagggcagtctgactcactcatgccctggttgacaagccagctcaggacagacagaatgcctaacagcctc

SEQ ID NO: 6764994 - DNA, 57 bp, Homo sapiens
cagccagggaggattacaccccagggcccagcctcctcctgggtctccctttggctg

SEQ ID NO: 6764995 - DNA, 61 bp, Homo sapiens
ttgttgtccattgtgacaagtgtggcctctgactggggccaattgttgcacttggatacaa

SEQ ID NO: 6764996 - DNA, 107 bp, Homo sapiens
gagccattccagagatagaatacggcactataacctgttagaatagatatcaaatgtcaaggataactgggctttcgggtttggatgcctcctctcaggaattgctt

SEQ ID NO: 6764997 - DNA, 66 bp, Homo sapiens
ctgggggttcatccagaagagtgctgccccaaaactgagggcatggcgtgtgctggattcccccag

SEQ ID NO: 6764998 - DNA, 67 bp, Homo sapiens
gttgctttgggactggcttaacaagcccacaatattctagaagcatgtgcccgtcccaggagccgac

SEQ ID NO: 6764999 - DNA, 99 bp, Homo sapiens
ccagtcaaaaaggcaaattctgtatgtttccacttatatggtacctagagtagtcaaattcatagagaccaaagtgaaatgatggttgccaggggctgg

SEQ ID NO: 6765000 - DNA, 67 bp, Homo sapiens
aagtttctgtatgctcttctgtaaaactttgaagtgcttgttcctagaagactatgcaggagtgctt

SEQ ID NO: 6765001 - DNA, 68 bp, Homo sapiens
ggggcctcatttctgttgtgcatcactgcatttctagtgcctagcaccatgcctgacagagaagctcc

SEQ ID NO: 6765002 - DNA, 57 bp, Homo sapiens
gagatgagaaatggacaggagtggagcctgagtccaagtactgtgatttcttatctc

SEQ ID NO: 6765003 - DNA, 61 bp, Homo sapiens
cagaccgtgaagctgcagcagggccatggcgggtaaagcatggctctgagcctcatggctg

SEQ ID NO: 6765004 - DNA, 58 bp, Homo sapiens
acccaggctggagtgcagtggggcgatctcggctcactgctagctccgcctcccgggt

SEQ ID NO: 6765005 - DNA, 78 bp, Homo sapiens
cactgagagcattgattgtttcctaaatccattaggctctattttgatctccaatggctggagacaatctgctctgtg

SEQ ID NO: 6765006 - DNA, 66 bp, Homo sapiens
agggacagcagtggtgcactgagccaagggtgggtacctgggcagtgcctaccatggctgatccct

SEQ ID NO: 6765007 - DNA, 71 bp, Homo sapiens
agccagagtgcccttcatgaagcaagaggtcaatagcttttggttgaatgaatgaagtggtacctatggct

SEQ ID NO: 6765008 - DNA, 67 bp, Homo sapiens
ttaaaggcaatagtattaaactggaaaatcatggtgtagtcctgaatccagtttatactgtctttga

SEQ ID NO: 6765009 - DNA, 68 bp, Homo sapiens
aaatcggtttcatttccagtgtcagctttgactgattggtcatggctgcctagaggtgagatggattt

SEQ ID NO: 6765010 - DNA, 87 bp, Homo sapiens
ctgccactgccttggccacctatcctcacctcatagctcgcagcgcgaggcgataggccaggtccgggtcatgaggcagcagtgcgg

SEQ ID NO: 6765011 - DNA, 96 bp, Homo sapiens
tcctcaagaatcgctggtccagccactcaccttccagcaggtaagttaacagacctgttgggccagaaggtggttggagggcagcatcgttgatga

SEQ ID NO: 6765012 - DNA, 77 bp, Homo sapiens
ggcagagatccaatctgcacagaagatattagtattaccacttcttctgttttagattgcatacttctgttattgcc

SEQ ID NO: 6765013 - DNA, 64 bp, Homo sapiens
tccagttctgtggcagcgaaggagaggaggtaaaagatccttacgtgactgcctcaggggtgga

SEQ ID NO: 6765014 - DNA, 67 bp, Homo sapiens
atactgtggagagtatcctgaaatcctacgtaagcagtagagtcccaggccttttttcctgcagtgt

SEQ ID NO: 6765015 - DNA, 95 bp, Homo sapiens
ggtatggaagcttctggactttgaacaggctagttttaaagcatattcaaagtatcctctgacactagttttgtacaaaatctgcaagccaaacc

SEQ ID NO: 6765016 - DNA, 76 bp, Homo sapiens
gtgagtatgagtgtatgtacataaaatacatattttaacggaatctgaatatttatgtgtattcatatatgcacac

SEQ ID NO: 6765017 - DNA, 81 bp, Homo sapiens
cctatgtatggcctgggctttcaaaaccagcctggcagactgccaggcctgggacgggagccgtgacaggctggttattgg

SEQ ID NO: 6765018 - DNA, 73 bp, Homo sapiens
agctctccaggaggatgaggggcatagaaagtttgagaaccactgctctatagtatgttatccatcctcagct

SEQ ID NO: 6765019 - DNA, 127 bp, Homo sapiens
cagagggttaaccaagcgtgatgccatgactttctcaaggtcagagtgagggttgggaggtagtacccatgtatcctgacctcttgctctgacctttaagcaggcggcgtccttggaacacatcggg

SEQ ID NO: 6765020 - DNA, 65 bp, Homo sapiens
ttcccactgctggctccaggctggagcgcaactgagagggggtgttactggagtcacagtgggga

SEQ ID NO: 6765021 - DNA, 72 bp, Homo sapiens
gtgaggtaggagttttcattccagttttatttcatttacagatgaggaaattgagaatcagaataatgtcac

SEQ ID NO: 6765022 - DNA, 56 bp, Homo sapiens
cacagcctttagggtacacacagatacatttgggctggacaccctaaagtgctctg

SEQ ID NO: 6765023 - DNA, 73 bp, Homo sapiens
gtaaggatgccaactctgtttctgtgtatgttccatttagattgaagccatagcagttgttgtgcattctagc

SEQ ID NO: 6765024 - DNA, 67 bp, Homo sapiens
gagcagatgccggccagggcaccatgctgatgtgtgtcagcagctgcgtgcccaggccggagagctc

SEQ ID NO: 6765025 - DNA, 88 bp, Homo sapiens
ctgtatttgctttttaagaatgggttatggctgggagggatgtgtgaagctgcccccagagcataacgtatcttgaaggttaaatcag

SEQ ID NO: 6765026 - DNA, 80 bp, Homo sapiens
tctagaggcatgaccaagaaacaaccctcttctgagcattttcacggctttaaaggaattgagtttcttgtggttttaga

SEQ ID NO: 6765027 - DNA, 57 bp, Homo sapiens
ttgctagtctctgtttcaggatagggtattaactatctgggcagcagcagctagtag

SEQ ID NO: 6765028 - DNA, 82 bp, Homo sapiens
tctcttgatgactgtattacaattggcagcaacgttggctattggagttctttgatttaaaacagtcaaatcattacagaga

SEQ ID NO: 6765029 - DNA, 98 bp, Homo sapiens
ctgggcaaaggctagttagagtggcgtcctaggaaaggagggggctaacagtgtttctggttcatcttctatcctcagcccctgcctagcttgtccag

SEQ ID NO: 6765030 - DNA, 56 bp, Homo sapiens
ggaagtctcacagacagatcagactcaacaggtctgaaatgaactcttgaacttct

SEQ ID NO: 6765031 - DNA, 85 bp, Homo sapiens
gctgaatagggaaattgggaagtattaagtctctcctcaaacatttcgaattaagaggcctgtagttcctctttccatttttagt

SEQ ID NO: 6765032 - DNA, 61 bp, Homo sapiens
ttccctctcagagtcgccaggctggggcatctatcccaggaaattggctatttgggatgaa

SEQ ID NO: 6765033 - DNA, 64 bp, Homo sapiens
tgttttgtccttttctatataccctcaaactgagaaggtgtttctggtggagatggaaagaaca

SEQ ID NO: 6765034 - DNA, 65 bp, Homo sapiens
ttgtaccttctcttgacaaatgtcaaaatgtcatttctcatcacaaatgtctagagagggtgtga

SEQ ID NO: 6765035 - DNA, 72 bp, Homo sapiens
ccaacaaacattccgcttctcccaggatctaggcaatggccagcacttggtgactgagcaacgaatggttgg

SEQ ID NO: 6765036 - DNA, 81 bp, Homo sapiens
ggactcatggtttctcactgtgtctatggcatgtaaacctggcattcaagtaaacactgaaggaaccattatgtagaatct

SEQ ID NO: 6765037 - DNA, 66 bp, Homo sapiens
gaggaacagatatttggggaaagacgttagttttagacgctgagtttcaggtttctgagacttctc

SEQ ID NO: 6765038 - DNA, 81 bp, Homo sapiens
gccttcattccaaagattatggagaaataattagaagcagaccttttaagatattttctgtaaatttagatgaataaaggc

SEQ ID NO: 6765039 - DNA, 69 bp, Homo sapiens
tggaagggcatgggaatgtttttgctttccagagaaagccacagttctatgtctgctttaagttttcca

SEQ ID NO: 6765040 - DNA, 130 bp, Homo sapiens
catgatgttcctctgccacatcctaggacattgttcccatctgcacagttgaagttggggtaccaccagctccagattcctgctggcagaaaaggggatatgaatatggaagaagcacaaccagcgtctg

SEQ ID NO: 6765041 - DNA, 57 bp, Homo sapiens
tgggaaatctttccgtatttatatccatgctgggtgtgaatatatgggaattttcca

SEQ ID NO: 6765042 - DNA, 55 bp, Homo sapiens
cttcctggcatgggtctcatgaggacagccccctgtggagacctgggcaggcaag

SEQ ID NO: 6765043 - DNA, 62 bp, Homo sapiens
gctgctggtagattcagcatctggtgaagtttgcttcctggatcatagcgtcttcttgcagc

SEQ ID NO: 6765044 - DNA, 65 bp, Homo sapiens
taaagtctgtagcagtataaataatcaagagctgttgttcttgacattgttgttagcaggctcta

SEQ ID NO: 6765045 - DNA, 65 bp, Homo sapiens
tgaccatcaagcacgtctccccatacctgaggatgtggggcggcagatgctccctgtgatggtta

SEQ ID NO: 6765046 - DNA, 92 bp, Homo sapiens
agtgggagtggtgctggtggctttgcagttagcctaggattgagcaattgctgcaattgttgctctctgcatcttcggtgttacttcttact

SEQ ID NO: 6765047 - DNA, 62 bp, Homo sapiens
agtgcgggtgctcatgcctgagtaaaaatgatagcagttttaggaacaaagagcctcacatt

SEQ ID NO: 6765048 - DNA, 68 bp, Homo sapiens
tggtgggcagagcaagggaactcaagacagccattgtccactgcaagatcttgtctctgccacatcca

SEQ ID NO: 6765049 - DNA, 57 bp, Homo sapiens
atgtgtggaagtgtgttgcccccgtgtgcaaatatctatcatagcacttcagcacat

SEQ ID NO: 6765050 - DNA, 81 bp, Homo sapiens
agggatgcttaatgtttcttctgtgaggtgtgtgcctgtaccacacacatgtacacatacagtggagtggaaagtattcct

SEQ ID NO: 6765051 - DNA, 81 bp, Homo sapiens
agagagagagagaaatatatttaaatccaggttgaaatttgtggaaaagttatgatctgtattaaattctttcactgctct

SEQ ID NO: 6765052 - DNA, 86 bp, Homo sapiens
gggacttatttcttggatgatcctgtaaattggaggactgcattgaaaagtggtcttgcaccaggaatcctatgaagtatagtttc

SEQ ID NO: 6765053 - DNA, 55 bp, Homo sapiens
atctttctccatatacatctttcatcatataaagggagaagtaaaggggaaaggt

SEQ ID NO: 6765054 - DNA, 64 bp, Homo sapiens
gcacatttattgagcacccgttgtgcgtgtgtggcacctgccccaacaggtgtttaatgattgc

SEQ ID NO: 6765055 - DNA, 102 bp, Homo sapiens
aatgctggacatttatctggagctgcagggggtaaagtgtcatccttgggaaattcaaagctggcctgtacctgctgagagcaccagggatatggtcacatt

SEQ ID NO: 6765056 - DNA, 62 bp, Homo sapiens
cgctcgcgccgcaccggtccaccaggtactccaccacgtccaggtggccgtagcgggcggcg

SEQ ID NO: 6765057 - DNA, 69 bp, Homo sapiens
tagtctggttttaagctgtcagagagcaaagcactcaggcgcagctctttggggctggaagcctagctg

SEQ ID NO: 6765058 - DNA, 60 bp, Homo sapiens
catcctgctattaaattgatgtggtgtccttcccagtatcacatcagagggcataggatg

SEQ ID NO: 6765059 - DNA, 88 bp, Homo sapiens
tagtaaaatgggctgggtaattccagcactctggaactccaaagtgctttggaattccaaagtgctggaattacatggctcacatctg

SEQ ID NO: 6765060 - DNA, 123 bp, Homo sapiens
ggcttgacagaggagggagaattgtatcctgagttaattcgaatattctagcccaaactaagttaaacaaaggcttaggtatgatagttagcctgatgccaaatttccttccagtgtaatgtt

SEQ ID NO: 6765061 - DNA, 63 bp, Homo sapiens
gcaagtagaagagatgacaaaggagcatggggatggttggtatgtattcctcatctcatttgt

SEQ ID NO: 6765062 - DNA, 66 bp, Homo sapiens
gtgccagatattgtctgttggtatagagaccattctgacctttctgtgctcttctcagtatcacac

SEQ ID NO: 6765063 - DNA, 64 bp, Homo sapiens
cccagcctcctccagctctgagtcacaaagacccagggctgacagtgaggagtcaagcaaaggg

SEQ ID NO: 6765064 - DNA, 76 bp, Homo sapiens
tttcatgaaggtagtatatatccaaaatgcattactttgtcttgacttcctttggatatgtttctgtcttctggaa

SEQ ID NO: 6765065 - DNA, 63 bp, Homo sapiens
cacgcagccagagggggtgtgatcagatgtgtgttctggttggatggctcttgtggctgtgtg

SEQ ID NO: 6765066 - DNA, 64 bp, Homo sapiens
gcctctgaaagtaggtatcactatctccatttcaacagatgatgacacttgggctttgagaggt

SEQ ID NO: 6765067 - DNA, 61 bp, Homo sapiens
atgtgtgtgtgcacaggcctgcaagtatgtatgtgtacatgcaggcatgtctactgcatgt

SEQ ID NO: 6765068 - DNA, 66 bp, Homo sapiens
gacgtggtccttggctttctggagcttctattcaagtagaaggagacagacagtcaagatcatttc

SEQ ID NO: 6765069 - DNA, 91 bp, Homo sapiens
atgttttagaggaagtagttaacctggagggagattcaaaggaggctggataagagaatgtctatttttctccttccctatcaccttacat

SEQ ID NO: 6765070 - DNA, 66 bp, Homo sapiens
agtaactggtcctcggatgttgtggagttggtaaatagctctaatacaaggcaggaagcagtaact

SEQ ID NO: 6765071 - DNA, 66 bp, Homo sapiens
agctaagctcttttcattcttttcttttaagtcaaattaatgtgaaacctgtgagtagagtaagct

SEQ ID NO: 6765072 - DNA, 128 bp, Homo sapiens
gctgtgacgtagaccctatgacacgcttattcaaaccccatagacaacttgcagctaggatgacccctcagagttgtctcaaatggggttaaaatggctgagtgtttatactctgccccttcatcagt

SEQ ID NO: 6765073 - DNA, 80 bp, Homo sapiens
agtcagataatgctacaaattcgtaatcaattatttcacggtgaaattaatcagtttaagggtttggggattgactgact

SEQ ID NO: 6765074 - DNA, 105 bp, Homo sapiens
acatgaatggttatagtgactttattcgttaactgttaaaaactggacacaacacaaatgtccgttaactagtgaatgaataaacaaagtacttccattcaatgt

SEQ ID NO: 6765075 - DNA, 88 bp, Homo sapiens
tttgtgcatgcatatgtcaactgtgctggttaataatcacattacaaattattaatcatactgcaagtcaatgaaatgtgagtacaaa

SEQ ID NO: 6765076 - DNA, 62 bp, Homo sapiens
agaacatgtagagctgtctttttttccaaatgcatcccttggattacagagctacatattct

SEQ ID NO: 6765077 - DNA, 98 bp, Homo sapiens
gcggcgcccagagtttcaaccggtgcgttcagcctgcatccctcgaattccttgacccagcccggggctggagcctggcggtggtttctaggcgctgt

SEQ ID NO: 6765078 - DNA, 55 bp, Homo sapiens
ggtctcagatctttattaaggcaaaagcattgcagccacatggaagtttgagacc

SEQ ID NO: 6765079 - DNA, 68 bp, Homo sapiens
tttgtgagcaatatgtgaattttcttttgtaacccactaaagagagtgatctattgcttctctacaga

SEQ ID NO: 6765080 - DNA, 83 bp, Homo sapiens
aagaaaaggaagatatgaaagtaagcatgtgtgtgaatgtgtttgtgcctccaccacatgtaactgctttcttttcgtttctt

SEQ ID NO: 6765081 - DNA, 88 bp, Homo sapiens
gcatccccgtgcctctcctccagtgggtccctcaggtagaatcggggcaggccccactggacgttcagggaggaggctcggaggatgc

SEQ ID NO: 6765082 - DNA, 105 bp, Homo sapiens
ggcaggtcccagtctcagtgacagctgtgaattgtcttatctacaccatcagtgaaattgtagaagagttgcattatagcaaatgagaatgaaatgaacttggcc

SEQ ID NO: 6765083 - DNA, 80 bp, Homo sapiens
tccattcttcactgacccaccagtttgcaaccctggtctaaggtatccagggtttgcagggaaatcagtgaggatgagga

SEQ ID NO: 6765084 - DNA, 58 bp, Homo sapiens
gggctccaggtgcatgccaggctgtggatctgccgagcttcctagtgacctggagtct

SEQ ID NO: 6765085 - DNA, 63 bp, Homo sapiens
ttgcaaagtttgctcaaatgagggaagccagctactttcacaatgccagcaaccacttggcag

SEQ ID NO: 6765086 - DNA, 57 bp, Homo sapiens
gtggggtattgggtacttgtactgtgaaggtacagaagagtacctttagtatgttac

SEQ ID NO: 6765087 - DNA, 75 bp, Homo sapiens
acacacagattttacatggtgggtcaaggattcaattaatgtcatttggcttcaaaatctagtggtctgtgttgt

SEQ ID NO: 6765088 - DNA, 73 bp, Homo sapiens
gcagctttgttctttctagtagattgctagagtctactaaagattttcatttgcactctagaaatggggctgc

SEQ ID NO: 6765089 - DNA, 76 bp, Homo sapiens
gtggctgtggcactggtagttttaagatctctgtgaatccccacagtgtcttaagttaaccacaaccagcagtgat

SEQ ID NO: 6765090 - DNA, 80 bp, Homo sapiens
tcctggaaagtgtttctgatgaagtttatatgaacttactggcccaaatatcaaactgaattaaacacttgttccaagga

SEQ ID NO: 6765091 - DNA, 103 bp, Homo sapiens
ccttccctgccgggccacctgtgttcctgcctggctctggtcctgggccctccccgctgcctcatgctgagccacaggcagtgcactggctcccaggagaagg

SEQ ID NO: 6765092 - DNA, 72 bp, Homo sapiens
caattgtttcattttgactgccttgatatacaaggacataactttgtaaatcatggtcagaataaatttttg

SEQ ID NO: 6765093 - DNA, 55 bp, Homo sapiens
ctgcatctctctgggctctggggtctgaaaagactaggagctgatggggaagtag

SEQ ID NO: 6765094 - DNA, 69 bp, Homo sapiens
tttctgtcattgcaataaaatttcatcagacacttaaaagtttgagaaattataatgaatagacgggaa

SEQ ID NO: 6765095 - DNA, 60 bp, Homo sapiens
tgatgcgaactttctgatggtgcaaaggaacatccttcaccatgcacagctgttctatta

SEQ ID NO: 6765096 - DNA, 59 bp, Homo sapiens
tctattgcatgcacctaacaaattattttattagaataatttgtgtgtgtatgtttaga

SEQ ID NO: 6765097 - DNA, 74 bp, Homo sapiens
ataagtgattgctggcatttttaagatgtgtttaagatgctttcatatctctataattccagcatgatatttat

SEQ ID NO: 6765098 - DNA, 81 bp, Homo sapiens
gacatatttgggcatgtctgtgttatctgtagaatgttttgaaaatgatattctgagtacaacaagatgtttccttatgtc

SEQ ID NO: 6765099 - DNA, 100 bp, Homo sapiens
gggcaacagcagtatctgacatctgagctgctaggtatgcattgtcaccgaggcgatcatccacagttgcagcccacatgccagatacccacacaggccc

SEQ ID NO: 6765100 - DNA, 60 bp, Homo sapiens
atctgtagtattatactaaggactaaatgagataaagtcactaaagtgtttagtgcagat

SEQ ID NO: 6765101 - DNA, 62 bp, Homo sapiens
gcttacttgaatgctgtgatctcatctaggcttggatacctgggatcacagattcactgggc

SEQ ID NO: 6765102 - DNA, 74 bp, Homo sapiens
ttacgggaagcttggataactgtatgggggactttaaaatttatctctctgtgatagtttttcagctattatga

SEQ ID NO: 6765103 - DNA, 74 bp, Homo sapiens
ctctttcaaagtttgagagtctttaaattctgagaggtggcagctgtcttagtcggctctctgctttggttgag

SEQ ID NO: 6765104 - DNA, 65 bp, Homo sapiens
gtgtggaatggagtttttgcccgggctggagccagcaggacagtacagagattttacttcctcac

SEQ ID NO: 6765105 - DNA, 67 bp, Homo sapiens
caggtcccacagggagttcacgcaatgcaggccagcttttctggcccagagtgagtcctgggccctg

SEQ ID NO: 6765106 - DNA, 66 bp, Homo sapiens
acttctggcttttctcttggatggtcttcatgaagatcttaatcgagtccatgaaaagccatatgt

SEQ ID NO: 6765107 - DNA, 70 bp, Homo sapiens
ctgataattttgctttttggttcttttttgttccttcagtgaaatggcagcccagaggtaaggtagtcag

SEQ ID NO: 6765108 - DNA, 99 bp, Homo sapiens
agtaacattcctcgattcccaaatagccaactattgtgactctgtgtcagatcctatgcacagtagttggttgttttgggatggtttaggggtagttct

SEQ ID NO: 6765109 - DNA, 59 bp, Homo sapiens
gggtgcaaacccgttctgcaccaagtgcactcggagtttgtgggtatgggtgtgtaccc

SEQ ID NO: 6765110 - DNA, 85 bp, Homo sapiens
tggcaattgcattttacttttttcaactcatctttggaaagattatttttctgacgtcttgaagagtagaaaatgcaaattggca

SEQ ID NO: 6765111 - DNA, 60 bp, Homo sapiens
gtccagtaacactaagaatctaaatttaaattttggtttagtttgggattggtgctggat

SEQ ID NO: 6765112 - DNA, 70 bp, Homo sapiens
atatgagagtaaatgccgatctaggcctataactagtcttccagtttcttggccagtatttcttttatat

SEQ ID NO: 6765113 - DNA, 77 bp, Homo sapiens
ttcacattcctctgacttaaatctctctattctctttctttttgcgagggtgtgggggcaagtttgagatgtgtggg

SEQ ID NO: 6765114 - DNA, 129 bp, Homo sapiens
ttaatattacaagaagactgaggaattagtgtctttaaagctggttcattcattcatggtcttcttaaagaggacctattgagtggatgaactgttaattgcaatttcaagtcgagtgttaataggtgg

SEQ ID NO: 6765115 - DNA, 75 bp, Homo sapiens
cataactgttgtcatggtatatttcactctttaggaagtccctgaggaatagtgattaaactattattactgatg

SEQ ID NO: 6765116 - DNA, 63 bp, Homo sapiens
tcctgagcttcaaaacactttgctataaatttcctttgctatagagagttcttgggctcagga

SEQ ID NO: 6765117 - DNA, 84 bp, Homo sapiens
agccgagggcacagtgctcacacctctattatagcacattgtgctgtctgttcgagcgtgtgttgtttttgtcttcactaggct

SEQ ID NO: 6765118 - DNA, 70 bp, Homo sapiens
gcatcatgaaaatgacagatagtcttcatttgctttctttggccaaatgtgcactctgcagtcatgatgt

SEQ ID NO: 6765119 - DNA, 76 bp, Homo sapiens
catcatgtagagattaatgcccaatgcagttagctgaatcaattttagagctgcagcgttcatttttccatgtgtg

SEQ ID NO: 6765120 - DNA, 61 bp, Homo sapiens
gtaggtaagtacttctggtgagaaggcaaaaacttttaaaatgcctataagtaatgcctac

SEQ ID NO: 6765121 - DNA, 72 bp, Homo sapiens
gcagaatcctgtgtgactctggggagaagcccagtgctcttggccctcatccaccctcactaggaaagctgc

SEQ ID NO: 6765122 - DNA, 57 bp, Homo sapiens
gcattgcaggtgtacccagttattcagtcaacaaggtatacggagcacctgcagtgt

SEQ ID NO: 6765123 - DNA, 82 bp, Homo sapiens
agcaactaaatgaatgttcctcagacttccccaaaatttttgattctgggatagaagcaggaataatcttttgttagaagct

SEQ ID NO: 6765124 - DNA, 74 bp, Homo sapiens
ggtttctgttccttgtattcagcatcttaactaaaatattagaatgaaatgttgaatgcagtttgattagaacc

SEQ ID NO: 6765125 - DNA, 63 bp, Homo sapiens
tactggcttcaaattcagatgtctccctatttgggggaggaggcaccctatttgaggcctgta

SEQ ID NO: 6765126 - DNA, 57 bp, Homo sapiens
gtgcagtaggatttatcagaggacaaatgtttgttcctctgtgacttctaccttcac

SEQ ID NO: 6765127 - DNA, 58 bp, Homo sapiens
taagtgctttctggaagagtcagaattgtggctcttcagacttccggaaacgtgctta

SEQ ID NO: 6765128 - DNA, 80 bp, Homo sapiens
gggcagctttaccggagggcaaaacagagaagatgtgaatccccttcaccctctcttccgtgtgttttgctagcatgctc

SEQ ID NO: 6765129 - DNA, 56 bp, Homo sapiens
agaggatctaagtgagtcctcaccttaactgtgtgaagtagatatcactgtcctct

SEQ ID NO: 6765130 - DNA, 89 bp, Homo sapiens
gcgggccaggagccggctgggccagctgaagtgccgccccggcgggggccgggccgggccgcgctcaggatggcacagctgcggcccgc

SEQ ID NO: 6765131 - DNA, 70 bp, Homo sapiens
tctgcatttaagtctgccaggttgttatgctactcaatcaagttaagcaccgctacctcagaaatgcaga

SEQ ID NO: 6765132 - DNA, 60 bp, Homo sapiens
gccagcctggccgggcccacaccctccagtcgtgaccctgcaggcctggcccagcctggc

SEQ ID NO: 6765133 - DNA, 57 bp, Homo sapiens
gtttggagtagaaaaaatactccaaaacacaggaggaatttgtttctactctctgac

SEQ ID NO: 6765134 - DNA, 76 bp, Homo sapiens
cagaggcagatactcataggtgatggatgaggaagctgagggagttcttgcctagtggccttatgagtattctctg

SEQ ID NO: 6765135 - DNA, 88 bp, Homo sapiens
tttcatccttccctccttgtgtaagaaaataatgtaaatagcctttattgctcttagtttttcttgtaaaagctgtgggaaggtgaaa

SEQ ID NO: 6765136 - DNA, 75 bp, Homo sapiens
gaagcgtttgagattctgaatttctaacaagctcctagaagatggcagtgttactggttcatgaatcttaccttt

SEQ ID NO: 6765137 - DNA, 59 bp, Homo sapiens
ggacaggagtgaggcgggttccccccacctttttccggagagatcccgcttaacttccc

SEQ ID NO: 6765138 - DNA, 59 bp, Homo sapiens
gagcacagaaggagaaatatggccccgaggggctagcatattcctctatctcattgttc

SEQ ID NO: 6765139 - DNA, 56 bp, Homo sapiens
ctagctcacactctgaaatttaagccatccatttaggaaatgctgagtgtggctag

SEQ ID NO: 6765140 - DNA, 74 bp, Homo sapiens
ctatttcaagtctcagagtcctacttattccctgtgacttttgcatggaagacttgctgaggctgtgaatttag

SEQ ID NO: 6765141 - DNA, 65 bp, Homo sapiens
ctttcttttccatgtattcaccaggtgtcacccacacatcatccggtgggcacaggagagcagag

SEQ ID NO: 6765142 - DNA, 60 bp, Homo sapiens
catgcatcgatgaatgcgtgggtggattcataggtggccacatgggtggatggatgcatg

SEQ ID NO: 6765143 - DNA, 57 bp, Homo sapiens
atactgaaagggtgttacctaattgtttaaggttagcaagacaacttttctcagtgt

SEQ ID NO: 6765144 - DNA, 58 bp, Homo sapiens
tactatactctccattttatagtagaggaaactaaagctaagatgcgagaataaagta

SEQ ID NO: 6765145 - DNA, 115 bp, Homo sapiens
ctgatttgcattttgcctgtttttctctggcctcagtcggtctctcctgaggatattctctaatggggagaccatctgaaggtgatccagagaccctgagcggggcccagatcag

SEQ ID NO: 6765146 - DNA, 67 bp, Homo sapiens
cacagccaaagaggtgctctgcagcctggacagctccttcagtttggcagcagagtgcgtctctgtg

SEQ ID NO: 6765147 - DNA, 129 bp, Homo sapiens
tgtgggtgtcagtcaggctgtaaatggtgtgggtgtcagtcaggctgtaaatggtgtgggtgtcagtcagtcaggctgtaaatggtgtgggtgtcagtcaggctataaatggtgtgggtgtcagtcagg

SEQ ID NO: 6765148 - DNA, 66 bp, Homo sapiens
tgtagttttcttccctcaaggcatgttttatctaacactgttttagggaagaaaataaaagctgca

SEQ ID NO: 6765149 - DNA, 129 bp, Homo sapiens
agatgccaggtaatttcagagaaacaacaaatgttttttagtataagtatgtcccatgcaatatttaggaggtgctcataccaaaaaaaatttgttgtatatctgaaatttgaatttaactgggcatct

SEQ ID NO: 6765150 - DNA, 68 bp, Homo sapiens
gtcttggccgtgcagatgaagaactgggaaccatttgtgttgagtccagcatttgccatggacaagat

SEQ ID NO: 6765151 - DNA, 57 bp, Homo sapiens
ggcatgctgcgtacagatgaacttgcaaaaacatgccatcctatgcatgagcatgcc

SEQ ID NO: 6765152 - DNA, 73 bp, Homo sapiens
acttcctgaatggggctaattactagaaagagtggcctctggtgagttgattgtgtccggtctctcaggaagt

SEQ ID NO: 6765153 - DNA, 61 bp, Homo sapiens
gagccagggctctccttcgcgtgctggtttctttcccagcacctggactgtggcctggctc

SEQ ID NO: 6765154 - DNA, 89 bp, Homo sapiens
cactacagtcccttacagccacacagggtcttagagatcacctgagtcactctacagttaaggaaactggggccctgctgggggaagtg

SEQ ID NO: 6765155 - DNA, 106 bp, Homo sapiens
acagcagtgcaggttgtccactgcaatactccaggggttgctatttacatcatagccgatgtgaatgactttctggagttttgtagtgcacagccttcctggctgt

SEQ ID NO: 6765156 - DNA, 69 bp, Homo sapiens
tatgagatgttgtaaagagttccatgtctaatagatggatgatatctaaattcgtttgcaacactgata

SEQ ID NO: 6765157 - DNA, 67 bp, Homo sapiens
agcaagtgggtgggactatcttttgagcctctgtaataggccaagtactgtatcacttactcctgct

SEQ ID NO: 6765158 - DNA, 64 bp, Homo sapiens
ctcaggttttggtctggaatcttcagggtcctggggctccgggggttccagatcatccactgag

SEQ ID NO: 6765159 - DNA, 91 bp, Homo sapiens
ttttaaagtttctgtttactcctttataaagtttgtttactcctttataaggaatgtaaatttactgttgtaatgaattgaaatggtagga

SEQ ID NO: 6765160 - DNA, 88 bp, Homo sapiens
gtgactctcccctttctttatttggacttggctatatctggatgtgataccggagctactactaccaaactaaagaggaaagtgtcac

SEQ ID NO: 6765161 - DNA, 70 bp, Homo sapiens
gcagaagctgttcgaaggccgccagcagttgccgttcagtaatgaggtcggccacggatttgccttctgc

SEQ ID NO: 6765162 - DNA, 76 bp, Homo sapiens
atgaaaatatgtcctccctctggcttcagttatatcactgctatgagactgaataggaaagagggaatgttttcat

SEQ ID NO: 6765163 - DNA, 58 bp, Homo sapiens
aaatagcattgtatttagctgagtgacaaatgccgcttggttgaagaatatgctgttt

SEQ ID NO: 6765164 - DNA, 82 bp, Homo sapiens
tcaaatgtgaatggcagagctgaatttgggtggtggatataagagtgttcactataaagtttcaacttttctgtatatttga

SEQ ID NO: 6765165 - DNA, 97 bp, Homo sapiens
gatatttttctcaggtttacagtatttctcagtgaaatgacaggcctattgtgtagctcagtttaacatgcagaaatacagaactagataaaaattc

SEQ ID NO: 6765166 - DNA, 78 bp, Homo sapiens
atagttctacaaagggttagactgtgacaggtgaaattccagtcaactgaaacggtgatcttttaactcaggaactgt

SEQ ID NO: 6765167 - DNA, 78 bp, Homo sapiens
gctgctttcggattgggatggcttgcatttgaggactataagtaatagtcatttatcttagccattatggaaagcagc

SEQ ID NO: 6765168 - DNA, 74 bp, Homo sapiens
tttccctgttctatcattaaaagctatttgcaacataagtgggaatcagaagcagagggcttgggggagggaga

SEQ ID NO: 6765169 - DNA, 65 bp, Homo sapiens
gcaggtcacatatatccaaagcaagaacatgtattaattgcttctggataggggtatggagctgt

SEQ ID NO: 6765170 - DNA, 97 bp, Homo sapiens
gcagaggtgctgagctgtgatagggacgggggtcaggtggggctttgcccactggcccccacacctgtcagggaaaaatcttcgtttcactctctgt

SEQ ID NO: 6765171 - DNA, 64 bp, Homo sapiens
ctaaatgggcatgtttgtgttccaataaaatttcatttatagaacagagggttgcccagattgg

SEQ ID NO: 6765172 - DNA, 123 bp, Homo sapiens
acctggaccttgtccctccagtgaaggctgcccggatgcctcagagagcacagccttcttagcttcattcttccggagtgcttttccttatttggtgctttctagggagtaggcaggtcaggt

SEQ ID NO: 6765173 - DNA, 92 bp, Homo sapiens
ttccttctatctccttaaaggctccttttcttccataatttcttggtagaaagctggaagagctgggatttttgccaaggaaggtttaggaa

SEQ ID NO: 6765174 - DNA, 55 bp, Homo sapiens
ctaggcagtagggacatcagttgcatgggctttgcaatgtctgctctctgcctag

SEQ ID NO: 6765175 - DNA, 55 bp, Homo sapiens
gagacacagagaggctgtgtgatcagccaaaaatcacacagcctctccgtgtctc

SEQ ID NO: 6765176 - DNA, 62 bp, Homo sapiens
ggtagtggcattcgattttggtgggaaatgtatctctttgcctgccgttaaatgttacttct

SEQ ID NO: 6765177 - DNA, 108 bp, Homo sapiens
tgaaggaaaagagcttctactcttggtgttaacttgaatgaaaccaactgatgactaaaaactagctcttagtgttgagttcaaacattgtaaagttttaaaacttca

SEQ ID NO: 6765178 - DNA, 67 bp, Homo sapiens
tataggctccttgattataaaaaatgcacccatctggtgtggcatgttgataatggagaaggctatg

SEQ ID NO: 6765179 - DNA, 83 bp, Homo sapiens
gccctaagcctgggtggcccatgcatcctgtgcagccgtcttggctctctcctcgcggctggtgttagtcactcctggcgggt

SEQ ID NO: 6765180 - DNA, 89 bp, Homo sapiens
tgaggctgggtagatgaagtatgctaattaactagcactggggacatgtgctgatttccatggcatgaatttcagctaccaacaattta

SEQ ID NO: 6765181 - DNA, 58 bp, Homo sapiens
caagaaactttattctgccataagctatgtgactttggacagaatattaggtctcttg

SEQ ID NO: 6765182 - DNA, 64 bp, Homo sapiens
gtatggggactcactgactatcttgagatccagtcatcatgtggtattgtgagatccactatat

SEQ ID NO: 6765183 - DNA, 57 bp, Homo sapiens
tatcattgtatgggtgagacaggattgttcattaattcaccattacatacaaagatg

SEQ ID NO: 6765184 - DNA, 69 bp, Homo sapiens
caatgcctcagtggcactagccacttccttggtcctcaatggacacatgtggccagtgactacttattg

SEQ ID NO: 6765185 - DNA, 61 bp, Homo sapiens
tctacttccttatcctcaaggcacacaccagagttccactgggtgaggacagggaagtagg

SEQ ID NO: 6765186 - DNA, 64 bp, Homo sapiens
tcatttctctgttttcccctcgatgtctggcaaagtgctagatacaggataagaagagaaaaga

SEQ ID NO: 6765187 - DNA, 68 bp, Homo sapiens
ctgccttatgtcaagacttattataaagctatagaaatgaagacagtatagtatttgcataaggatag

SEQ ID NO: 6765188 - DNA, 87 bp, Homo sapiens
gtggcctcttgctttgctggcactcctggctggctggctggctggctatgctgacagtgtaagtcaagggattattagattggccac

SEQ ID NO: 6765189 - DNA, 75 bp, Homo sapiens
actctgtgatccactcatgaatatctggtctggctctgcgttccagtcagacccttttctgagaggaccacaagt

SEQ ID NO: 6765190 - DNA, 62 bp, Homo sapiens
ggtagaggaggatttgtaaaggtctcgtggaggaattgagatctgaaggtcttgctctcatc

SEQ ID NO: 6765191 - DNA, 101 bp, Homo sapiens
ggaagaatgaaataagtggtatcttggtcgattagctccaaaatccataaaaggtgagggcaaattagaatcaaattttaaagaatttatttcatttttcc

SEQ ID NO: 6765192 - DNA, 92 bp, Homo sapiens
taatgacagcagaggtaattggcattttcctgtttatcttcatagcatggtaaacaggtagggactctaacttgccttacatgctgtaattg

SEQ ID NO: 6765193 - DNA, 64 bp, Homo sapiens
gaaattgttgttttatcgtgcaagggaggcattttttccacctttggcactttacaataaactc

SEQ ID NO: 6765194 - DNA, 56 bp, Homo sapiens
ggctggaggaaaattactggggtctgaaggagtgcaggcccagctttcctcttgct

SEQ ID NO: 6765195 - DNA, 65 bp, Homo sapiens
ctttctcatgctgcaaatggctgtttctctggttcactcaaagcagcatatgacagcatccaaag

SEQ ID NO: 6765196 - DNA, 114 bp, Homo sapiens
agacctgagaggtttgagtctgtacatggtgaggcttcctgtttgaagttgatctgagagcttgttaacatacagatggccaggcctcaccccagagtctgattcagcaggtct

SEQ ID NO: 6765197 - DNA, 59 bp, Homo sapiens
ggtgcagtgcagggtaattatacactgtggtataatttgttataacttgggctgaggcc

SEQ ID NO: 6765198 - DNA, 80 bp, Homo sapiens
ggaggaagggaggaaagatgtaatattatctaaatatcgtagcaacatttggagatagatacatttttctccatttttct

SEQ ID NO: 6765199 - DNA, 74 bp, Homo sapiens
gtggtaaggagctgacttgtaaagcattgtgcaattcactcctcttttgatgcagcagccagcttctgaaccac

SEQ ID NO: 6765200 - DNA, 85 bp, Homo sapiens
gggattctaatatttgctgacagcagcaaatggagataagcgattttactttattatctgttgtcttggtttttattgctctctc

SEQ ID NO: 6765201 - DNA, 67 bp, Homo sapiens
cggcattgttgcaagtccttaggaagcagtcgttggattcagcgggggctctggggctacaatgctg

SEQ ID NO: 6765202 - DNA, 78 bp, Homo sapiens
ttcctgtgggtcctcaactctagggccccataggccctggacaggcagggcctctggggtcctgagcccaagcaggaa

SEQ ID NO: 6765203 - DNA, 75 bp, Homo sapiens
ctcagctctcctctggctggttgtctcaatccagggaccttttctgggcctgtgactcccatccttaggactgag

SEQ ID NO: 6765204 - DNA, 61 bp, Homo sapiens
agagctcttatagttctagcagttggttccctagaagtggctgttataggtaaagtgtttt

SEQ ID NO: 6765205 - DNA, 129 bp, Homo sapiens
gtgagggaattgaccgatctacaggtgaagaaaacaaagggccacatttgggtccctggtttgacaaagccagaggctcagatggccctggcactttaactaaggtagctcaaggtgagtttctgtcac

SEQ ID NO: 6765206 - DNA, 75 bp, Homo sapiens
aggctgggggcggaggtcggtggttgtctggggtctttcctgggggttctgaccactgacctcagccctgggtct

SEQ ID NO: 6765207 - DNA, 61 bp, Homo sapiens
gcagacatgaccaccaaccaggccacacttgggcctgcgttgcaccttgatcgtaatttgc

SEQ ID NO: 6765208 - DNA, 64 bp, Homo sapiens
tttatttattgctttggaaaacactcattggccaggaaaatgggcgtgtccagtaatgattaag

SEQ ID NO: 6765209 - DNA, 57 bp, Homo sapiens
ctccagcttcttgacttggtggttgacaacaaagtgcgcaaaaatagaagctgtgag

SEQ ID NO: 6765210 - DNA, 63 bp, Homo sapiens
tataagacacgccccactcactctaatgcatgattctaaggagctagtagaggctgtcttata

SEQ ID NO: 6765211 - DNA, 130 bp, Homo sapiens
gtttggatggagtaacatgcaagtgtgagggaaggagtgactcaggcaaggcttttcatagagaaagagtctctgccagcttgtcctctctcccatctctgctccttacctcccctgctctctccacccc

SEQ ID NO: 6765212 - DNA, 57 bp, Homo sapiens
cttggagccatgcccagctctctgcacctggagattgcaggtggaaatagcaccaag

SEQ ID NO: 6765213 - DNA, 65 bp, Homo sapiens
tcccagatggagtgattgattgatatttaccacacggagtgatagagcagtagatcaccatggga

SEQ ID NO: 6765214 - DNA, 55 bp, Homo sapiens
tgagctttcatgtatgaaaagactgtcaaaaacagatcattcatgctggggctca

SEQ ID NO: 6765215 - DNA, 65 bp, Homo sapiens
gctatttctttaaattgatctccagcagaattccaaatgtaaaggtcagcaggcaaggaaatggc

SEQ ID NO: 6765216 - DNA, 63 bp, Homo sapiens
ggggagggttgtgtacctgttgtctcaaaaagatgagcacgacagcacaacagcatcctcctt

SEQ ID NO: 6765217 - DNA, 89 bp, Homo sapiens
tcacctgggaacttgctaaaatacagactcttgtagcgtaaatttgagatgaactctgagtctggtatttctaacaggcttccatgtga

SEQ ID NO: 6765218 - DNA, 62 bp, Homo sapiens
atggccaccctacctaagaagcactttgctagattataggctgctggaggacagggtttcat

SEQ ID NO: 6765219 - DNA, 80 bp, Homo sapiens
gccagacacagctgggcatatgtgcagcccggccacagggtggccacttggcatgtgtgccagcagttaagccctctggt

SEQ ID NO: 6765220 - DNA, 58 bp, Homo sapiens
ggccagtgttggtgataagctctttgtgtgcaagctcagacttgagaccagcctgtcc

SEQ ID NO: 6765221 - DNA, 57 bp, Homo sapiens
ccagctcctgggtcttagtcagaggttcacatccaccaactatcttcccagggttgg

SEQ ID NO: 6765222 - DNA, 55 bp, Homo sapiens
ctgaagctttacttcaaatacaagaaacagctggtgtttgtgatttaaggctcag

SEQ ID NO: 6765223 - DNA, 71 bp, Homo sapiens
gtggaagccttcctgagtgcaaggcctgacacttgttgcggagccatgactggggatgcatttgaccccac

SEQ ID NO: 6765224 - DNA, 67 bp, Homo sapiens
tgggttggtagttgcagatattgtcagaaaagtgtattgctaattcttaagactgcaaatcaaccca

SEQ ID NO: 6765225 - DNA, 65 bp, Homo sapiens
cttgggatgaatactgattagaaaaaaatatgtgattgttggaatcagtgcagttttatgccaag

SEQ ID NO: 6765226 - DNA, 58 bp, Homo sapiens
gtttccagagcaggtgtctacacagttggtcatggtgacctctgtttgttctgggagc

SEQ ID NO: 6765227 - DNA, 111 bp, Homo sapiens
gagaagcggctcatcccagatggctgtagggtccgatacatccccactcgcggcgccctgggcaagtatcggactctgagctcatgagagattccactgtgctgtcccctc

SEQ ID NO: 6765228 - DNA, 127 bp, Homo sapiens
gtttactgctgtttctgggctgagagcaagacagaagccagaggcagtgggtactcttgtcggcaagggctgccctgcatctgtgccttccagtaagcttgagacgagtttggagacggctgtagat

SEQ ID NO: 6765229 - DNA, 56 bp, Homo sapiens
gctgaggtaggaggttgcagtgagccgagatggtgccactgctctccagcctgggc

SEQ ID NO: 6765230 - DNA, 91 bp, Homo sapiens
gatgtatctgtgagattgttttactataatatagctcacctccttgagcaaaaggattaagtagaattacaatcttaatatttgatagatc

SEQ ID NO: 6765231 - DNA, 95 bp, Homo sapiens
cattaactttttcatatgtgtcgtgctactgcccataaagttaattaaccacatgggtacctcaagtaggaaatacatgctatgaaaaaaaaatg

SEQ ID NO: 6765232 - DNA, 94 bp, Homo sapiens
attttttttatttgttatcagtagaattattataaaacattggctttttgtagattttttaaagttgtggttctgcgttacatatgaaggaagt

SEQ ID NO: 6765233 - DNA, 81 bp, Homo sapiens
agccctttagataaccatggaactcagtaaattataggtagtcaaatgtatgattttaggtttagtgaaggctggagggct

SEQ ID NO: 6765234 - DNA, 69 bp, Homo sapiens
ggaggctgtcctgaagttttcatgagaggatgtcaattctaacctctatgaggctgtcaggacgaatct

SEQ ID NO: 6765235 - DNA, 83 bp, Homo sapiens
aatcttagcagtgtcactagtaatagtcttacaaagtaggcaggtttttttaggctaagtgattagtgacatagttaatgatt

SEQ ID NO: 6765236 - DNA, 71 bp, Homo sapiens
tgtcacagacggctattttcacactgtgggggatccaatcagcaaagtagctgctgtacttgttttggaca

SEQ ID NO: 6765237 - DNA, 91 bp, Homo sapiens
gacttcacatcaacagtatgaagctgaatgattttatctttgtagtattcagtaaaaccattcctgctttcatggagttgaagttaatgtc

SEQ ID NO: 6765238 - DNA, 65 bp, Homo sapiens
tgccaggagataaaagagatgctttggcactttggggagaaaaaaagctactctttttctcggta

SEQ ID NO: 6765239 - DNA, 71 bp, Homo sapiens
gccatttaggaggtggaaaggaaaggtggagactgaagacaaacgctggctctttcctcaactttctttgc

SEQ ID NO: 6765240 - DNA, 80 bp, Homo sapiens
gcgaggacaggaagaagcagggcatttgaatgcattttaaggtgccatttaaatacaggttctgttacttccaggcctgc

SEQ ID NO: 6765241 - DNA, 96 bp, Homo sapiens
tcagtgagatattcactaatagtttgaataaaaggttattatttgagtataacttttaaaatacacagacaatatgggagtaaatcaagagactga

SEQ ID NO: 6765242 - DNA, 57 bp, Homo sapiens
ttccaggtggctttcctgggggagtgcctggtaattttcccagaggaatgcctggaa

SEQ ID NO: 6765243 - DNA, 74 bp, Homo sapiens
atcttggactttccagcttctaaaactgtgagaaagaaatttctattttgtttataagctacagagtttatggt

SEQ ID NO: 6765244 - DNA, 129 bp, Homo sapiens
caaacagccagacagaatttcagggtattgaaggaacttgccacagaaaagaagttcatttgtgaattatgatctttcatgtagtagatcctttgtactccctcatcacgaacattcttggcatccaag

SEQ ID NO: 6765245 - DNA, 55 bp, Homo sapiens
gaacacgagtctcaccttgaatctgagctctagtaaaggtccaaactctgtgttc

SEQ ID NO: 6765246 - DNA, 56 bp, Homo sapiens
gaactgttttgtaaaggaactcatctagcctttgctggctccttggcaaccagttc

SEQ ID NO: 6765247 - DNA, 66 bp, Homo sapiens
cagggccccagggatgtctgctgaagtgagaacaaggacagagatgccccctggggtttcctcctg

SEQ ID NO: 6765248 - DNA, 58 bp, Homo sapiens
aaggaggaaatgaaaggagggtttgaaatacttgtgtagacaatcttcattccttctt

SEQ ID NO: 6765249 - DNA, 100 bp, Homo sapiens
gtgttttaagcttcacagagttttactaaaatggatttatttaatttggcccacacaaaaatcaggccgatagacattcattttctgatgcaagaggcac

SEQ ID NO: 6765250 - DNA, 63 bp, Homo sapiens
agcaaccgtggctcttgggaccagttgactcatgttcaagtacacctttggagtccacgtgct

SEQ ID NO: 6765251 - DNA, 85 bp, Homo sapiens
tcagttctcagaggtcaagagcagagctttccaagtcagctaaatggacttccacctatggcactgctcctggcgtctgacctga

SEQ ID NO: 6765252 - DNA, 66 bp, Homo sapiens
tgaagtcccattcttaggttgattatgtctaagcctcagtttccacctctacagaatggggcaaca

SEQ ID NO: 6765253 - DNA, 55 bp, Homo sapiens
tagaggagccaaccgaatactatcctgctaagagtttggcctagaggcttctctg

SEQ ID NO: 6765254 - DNA, 75 bp, Homo sapiens
ggccttcaataattaggagtgtaagggggccaggtggagtggctcacgcctgtattcccagcactttgggaggcc

SEQ ID NO: 6765255 - DNA, 77 bp, Homo sapiens
agtaaacagttattttcagctaggaaagccactctcaatcaggtagtggtttcttaagctgaaaaaggctttccact

SEQ ID NO: 6765256 - DNA, 105 bp, Homo sapiens
ttcataagtttacatgtaaattctcttggatacagatgaaaggaaggaccatagcacaaatgtattttttccaaactgttctaagaattttgaaaaacttatgaa

SEQ ID NO: 6765257 - DNA, 63 bp, Homo sapiens
tagttaggaatagcagcgactcttccgcaagggctcagcgttgttttctgttttgcctgtctg

SEQ ID NO: 6765258 - DNA, 59 bp, Homo sapiens
aagttggtgttagcagagagtgggggttataggtagtttcccagctgacatcaaaactt

SEQ ID NO: 6765259 - DNA, 58 bp, Homo sapiens
ctgcggagaggctccttggaaccttcacattcaatttccatccggctgacatccgcag

SEQ ID NO: 6765260 - DNA, 70 bp, Homo sapiens
aagcatcagaagtgggagaatctagcacagaattgacgactgtctggtccccaccccactgtctggtctt

SEQ ID NO: 6765261 - DNA, 72 bp, Homo sapiens
ttattagggtggtgctggtaaaactacagctatttgtgtagtttgcgaaattcctgcctccaccctgtgtga

SEQ ID NO: 6765262 - DNA, 69 bp, Homo sapiens
aaacattcataggaggagatgattaattactgtttgaagagtgctttgagatcctctaatgaagggttt

SEQ ID NO: 6765263 - DNA, 63 bp, Homo sapiens
tcctgcagagatcttcctgagattcatttgcttacagtggaatttcatgaagatccacggtga

SEQ ID NO: 6765264 - DNA, 55 bp, Homo sapiens
tgaaaccttggatgtgtagaaatgtatgttttctgtccatccgtgtaggtcttta

SEQ ID NO: 6765265 - DNA, 56 bp, Homo sapiens
gggcagggactcctaaggaggaggtttcagggtcttcctccttcaagtcctggcct

SEQ ID NO: 6765266 - DNA, 69 bp, Homo sapiens
agctgccacatgcccaagggcacccctaaacaccactccccggcgtccacccagcacactgtggtagct

SEQ ID NO: 6765267 - DNA, 76 bp, Homo sapiens
gtttctacaagataatttattctgagtttcaactaaacaatgaccttggaatatgtctgttttgtaaatttgaaac

SEQ ID NO: 6765268 - DNA, 86 bp, Homo sapiens
cctcattcgtctgccaggaaggcgcctcctacaggtgtcccaggctggacactggactcacgtattcctgagcaaagtcaatgagg

SEQ ID NO: 6765269 - DNA, 64 bp, Homo sapiens
ggcactctttttcctcccagctaggaaagtgttagtggagacctagtggggagtcaggagtgcc

SEQ ID NO: 6765270 - DNA, 75 bp, Homo sapiens
aaattacaataatacatgctcattgtaaaatattctgagtataggagtagaaaataagtgtgtattatgtggttt

SEQ ID NO: 6765271 - DNA, 97 bp, Homo sapiens
aaggttttggaaggagcctgttggtatgaatcctgtgtgagcaacactcagatttgttgcatactgaacagcatgctaaatctcacttcacaatctt

SEQ ID NO: 6765272 - DNA, 107 bp, Homo sapiens
ctgggctcagagaggtggagtgaccatcccccgagagttagctaggagtcacagcagggcccgggctgtgactaggcctgagctcttgtccacccttagaaccctag

SEQ ID NO: 6765273 - DNA, 55 bp, Homo sapiens
ctcatgtcagggaagagagtcagtgtgtgcctactgatgtccctttgatgatgag

SEQ ID NO: 6765274 - DNA, 84 bp, Homo sapiens
gggggctttctaagtatatgggtatgtgagtgctatgatagacaggctgaaaggaactggcaccaccacccagccctgaccccc

SEQ ID NO: 6765275 - DNA, 61 bp, Homo sapiens
taatttaattccatggattctaatggtggaaatattaaagagggatcttggggttgaattg

SEQ ID NO: 6765276 - DNA, 59 bp, Homo sapiens
gtggctctaggtgagcatggagcgctttaactcttccgcgcatgctcagccttagccat

SEQ ID NO: 6765277 - DNA, 65 bp, Homo sapiens
accactttgacaatttgataggaacatatctttgtgtattttcatgtttcaattgttaatgtggt

SEQ ID NO: 6765278 - DNA, 65 bp, Homo sapiens
agggaaatgaggctggctttttacttgtagtactctacaacagtaggaaaacatgtctagtcttt

SEQ ID NO: 6765279 - DNA, 67 bp, Homo sapiens
cagagtttaattcacagtgcttggcacctggtaggggttcaataaacagctggtgaattaaagactg

SEQ ID NO: 6765280 - DNA, 81 bp, Homo sapiens
gctcttctcaggctgtggcttcagttcttgactaattaccatcaagattaggcaaagatcaccaagtaacagtctgtgggc

SEQ ID NO: 6765281 - DNA, 57 bp, Homo sapiens
tttgtagagggtaattgacagactttaagggccctggttctgttgccctttcacaga

SEQ ID NO: 6765282 - DNA, 77 bp, Homo sapiens
catacatacacacatatgtgagttttggggttcttttcagttttaggcatcagaaattgtgtgtgtgtgtgtgtgtg

SEQ ID NO: 6765283 - DNA, 67 bp, Homo sapiens
ttagggtttttcaagtaatgctactcctatgactactgggtcctagggtaaatgtatttgaacctga

SEQ ID NO: 6765284 - DNA, 88 bp, Homo sapiens
ggaagaaaggcacttggctgtggccttgaggagattcatgcatgaaggtaaaggcaggagttgggagcagcagaccaagagctcttcc

SEQ ID NO: 6765285 - DNA, 77 bp, Homo sapiens
gtgcagatggcagagaataaatcttgactttgcaaggaagataaagcaaggtggaggtgttttcatcgcaatcgcac

SEQ ID NO: 6765286 - DNA, 59 bp, Homo sapiens
aggcctgaaggaagatgagctgatggcattccccgcttattaccactccttgggggcct

SEQ ID NO: 6765287 - DNA, 58 bp, Homo sapiens
gacacttttttaaagctcattaagattgttaaacattgatgggtttgttggagaggtc

SEQ ID NO: 6765288 - DNA, 65 bp, Homo sapiens
gcagacaatccagactagcactgtcaaatagaactttctgagtgatggaaatgatctgggtctgt

SEQ ID NO: 6765289 - DNA, 84 bp, Homo sapiens
attcacatcactgggctcccaggcttgtcatttgatcaggctctcatctgcatgtcaatgaggcttagagcccatggaaagaat

SEQ ID NO: 6765290 - DNA, 68 bp, Homo sapiens
tttaatgattgtcattccaaaaagttctctctggtgggaagatgtttcactggaatgacagtaataaa

SEQ ID NO: 6765291 - DNA, 63 bp, Homo sapiens
tcagccctgaggacagaggcagcctgcattccagtcccagctcttctctgtctcggtgtgtga

SEQ ID NO: 6765292 - DNA, 58 bp, Homo sapiens
tctgggctgctgtgcagtgaccattatcaagtatgatcatagcttactgcagccttga

SEQ ID NO: 6765293 - DNA, 84 bp, Homo sapiens
caagatcaggtaaaggcactagaagttaccttttttgtggacgcttaagaaaggtgactggagaggccccaaaaattcatcttg

SEQ ID NO: 6765294 - DNA, 65 bp, Homo sapiens
cagagtcccagatgcccctcctaaataatctaattcagtaggcctggtagagggcacctggtctg

SEQ ID NO: 6765295 - DNA, 60 bp, Homo sapiens
tcgggcagagcctaaagcatgtgataaatgaaatgctatcacaatacaggttgtgtctga

SEQ ID NO: 6765296 - DNA, 78 bp, Homo sapiens
aaccttatagaagatgtcagatgatatccctgctaaaataaccccatagaagatgtcatctgatattacttataggtt

SEQ ID NO: 6765297 - DNA, 56 bp, Homo sapiens
aagagaagaggctttgaagccagatatgcttggacttgaatcccaactcctctctt

SEQ ID NO: 6765298 - DNA, 82 bp, Homo sapiens
ccaggtcctgaccttgcactcacatctttaggcttacaggtgtgctttttgtgcatcctgatcgaagatggagaggacttgg

SEQ ID NO: 6765299 - DNA, 90 bp, Homo sapiens
taaaagttagcagtgatagatgggaactatggtcttgtttctgatctcaaagagaataaatctaaagtttcttcattgttttaatactta

SEQ ID NO: 6765300 - DNA, 81 bp, Homo sapiens
agcttgggtgtgcatgtattgatttgtaccatttgctaattttcttggtgtaaattttcctactgtcaatgatttcaagct

SEQ ID NO: 6765301 - DNA, 56 bp, Homo sapiens
gtcactgttgttccattgccctagcaagtaactgggcttgggagcaggcatgtgac

SEQ ID NO: 6765302 - DNA, 72 bp, Homo sapiens
ggcagtgagctgagatgcttttaggaaaggctgctagattgtggtttcttgattagtctcatgccaactgtt

SEQ ID NO: 6765303 - DNA, 87 bp, Homo sapiens
cggggtggtaactgacaccaccaatatgttcatattgggagaaaagccactgttggatggaatgatggtgttgccagaactactctg

SEQ ID NO: 6765304 - DNA, 55 bp, Homo sapiens
gtctgagacctcagttccgtctctaaacagtagagatgtgggcaaaaggcttagc

SEQ ID NO: 6765305 - DNA, 58 bp, Homo sapiens
ccctgtggaggcagcatcctgcatccatccagggaaagacaggtggcgctctacaggg

SEQ ID NO: 6765306 - DNA, 63 bp, Homo sapiens
gactgtactttagaaagtgtagtgaaacccactcgttcacttggttctaactagtgtatagtc

SEQ ID NO: 6765307 - DNA, 59 bp, Homo sapiens
ctggcttggtggtcacagccctgaggaatggagtttctggagaatcaccaccaggccag

SEQ ID NO: 6765308 - DNA, 74 bp, Homo sapiens
ccccattgtggattagtgttgtggcttcatggccctaataggggtgtgtctgccaggaactgcactgcatgggg

SEQ ID NO: 6765309 - DNA, 104 bp, Homo sapiens
tcgctaagcagatgcatgtaaatgagctattttctatgcatggcttccaaaagtgctaattaaatagttggtattcaaggctatgctcgctcattgtttagtga

SEQ ID NO: 6765310 - DNA, 58 bp, Homo sapiens
gttgtgattccatgatgttttctctaaaacactgaggaaagggcatgggcatgacaac

SEQ ID NO: 6765311 - DNA, 62 bp, Homo sapiens
gatgactctttgtggatgccgcagtgggcaacagctctttctgtgacttgccaaaggtcatt

SEQ ID NO: 6765312 - DNA, 82 bp, Homo sapiens
cctgctgctgtaagaatatgtttgacatttagttggttcctaattaaacaacccaatatcaaacatatcacacagaagcagg

SEQ ID NO: 6765313 - DNA, 130 bp, Homo sapiens
gaaatgctaattttaatgtggccaggttataattgtatctttaaatttaaggaatattcatgaagtttacaatcttcctacatttttgaaagcttatatcctgaagtttagtgacactggtcattttttc

SEQ ID NO: 6765314 - DNA, 75 bp, Homo sapiens
actttgcttccaaatgttcatttgacaagtagtgatgcattgaatatccttgtacatgtgagcatgcagtaaagt

SEQ ID NO: 6765315 - DNA, 65 bp, Homo sapiens
tggtgcctgataaatcataaattggacaggctgcctgtcttgcataggtcttttatcaggtatta

SEQ ID NO: 6765316 - DNA, 58 bp, Homo sapiens
gagtgcagaaattcccttcctgcaaatcactttttgctaaagggaggctttctcactc

SEQ ID NO: 6765317 - DNA, 87 bp, Homo sapiens
agccagagctggttaacaggcactgccttgcagggcccgcctggtgctgtgcagtctttggtgtgcctgcaggagccatgcatggct

SEQ ID NO: 6765318 - DNA, 78 bp, Homo sapiens
gatatcttgctttttattattgcttgatacagaaatcattttactgaaacattgcaataacaaagggcctctggtatc

SEQ ID NO: 6765319 - DNA, 66 bp, Homo sapiens
cctgcctagggtctggtaccacactgtgatgggcagcctagctgtgggcccagattctgaggctgg

SEQ ID NO: 6765320 - DNA, 60 bp, Homo sapiens
ggagcctgaggcaggtgacagaacaaaggacacagcctatgttggatgctaccaggtacc

SEQ ID NO: 6765321 - DNA, 77 bp, Homo sapiens
gccacccgtgcacactcttggggcactttctgttggatgtcaacttgatggtgacttgggagtcgtaggcagtgagc

SEQ ID NO: 6765322 - DNA, 57 bp, Homo sapiens
ttctcaggcccctgcctggacttgctgaatcagaaactctaggggtggggcccagaa

SEQ ID NO: 6765323 - DNA, 66 bp, Homo sapiens
tccctggtggcgaatggtggtaggtggagaaaccagctgtatctacctctgaattcctatcctgga

SEQ ID NO: 6765324 - DNA, 109 bp, Homo sapiens
taattcacctatctacatctgtgtatttcttggactttgtttttcatggccattattatagactaatgctgtccaataggaacataatgtgagtcacaaaggtgaatta

SEQ ID NO: 6765325 - DNA, 81 bp, Homo sapiens
tgtttactgtggagagaggtgaaaagagatggagcaggtagggttctgccatcaggacagcttcttttcactgtaggttca

SEQ ID NO: 6765326 - DNA, 123 bp, Homo sapiens
accatgcccagtgatgaggcctgaaggttagggatcaggaacaagagcttgaggatccctgcaagaggtgaagctatgcattttggttccatccctggctgaatgcttgatcagctgcaaagt

SEQ ID NO: 6765327 - DNA, 101 bp, Homo sapiens
gtgcagagatgttagaggaggtcctaagttataaatgttttcttcattggtaagtctttatcgacagttatagcttcgacttctttttgcagtatgatcac

SEQ ID NO: 6765328 - DNA, 117 bp, Homo sapiens
ttatattgaaaccaatgaaagcggttggcaacattgaagagacggtatgagtgaaatttctcagtttatatcttatgtcatttcaattttttagaaacttttcgttttgaaatatag

SEQ ID NO: 6765329 - DNA, 82 bp, Homo sapiens
cccatggtgccttcccaccctgcgaggctgcactctcaactgggaggcaccagccccctggcagggtttcagagctcatggg

SEQ ID NO: 6765330 - DNA, 129 bp, Homo sapiens
tgctgcttactgttagttcctgtttctgaagtgctgattcgatgtgtaaggcttctcctctcttttagatctgtctagagaggagtgttttgcttcagtgagctccaggaacaaataataagtacagca

SEQ ID NO: 6765331 - DNA, 97 bp, Homo sapiens
agttctggtaggtacggcagagttgggaggtgctgtgaaggtggggataagatcttgttttgtacatcctaattctgagtgcccttttattacaact

SEQ ID NO: 6765332 - DNA, 65 bp, Homo sapiens
ggctctaatatgacagagcacttgacttgccggacagctggggcaagtcaatgattataagagtc

SEQ ID NO: 6765333 - DNA, 60 bp, Homo sapiens
gagatgccagcagaaataaatacttgacttttagtacaagattcttttttgctggtcctc

SEQ ID NO: 6765334 - DNA, 59 bp, Homo sapiens
tgattcttctctccttatacccatccccagatggcctcttgtaagaagtaggagggtta

SEQ ID NO: 6765335 - DNA, 110 bp, Homo sapiens
gcagtggtaatgagatcttcaggcagtggccatgttgggagttgagcaatggatgctctcttcagggtgacgcaggctgcagctgccttgtagttcatgttacctacagc

SEQ ID NO: 6765336 - DNA, 109 bp, Homo sapiens
tccatttctagaaagactctgacagaccaagtttccagcaggtgtggcaaatgcatgtcatcttggattgactggctctgcctacccagagtgctgtttggataaagga

SEQ ID NO: 6765337 - DNA, 83 bp, Homo sapiens
gtgtacacccctctgtgatatggtttgtaatatccagggggttagagggtgatattgctccccatatcgcagtgggggtacac

SEQ ID NO: 6765338 - DNA, 72 bp, Homo sapiens
gcggccagcgcgggcggcccagtggccccgtcctctcagcgcccctggccctgcgccgtcccgctggtgcgc

SEQ ID NO: 6765339 - DNA, 92 bp, Homo sapiens
tgtcccttccttttttggcactgcgtctacatggcatcttacaactctttgattgctgtgatgacaggcagggccaaactagtcaggagaca

SEQ ID NO: 6765340 - DNA, 62 bp, Homo sapiens
atctgcagtttagtgtcaggtgattcctaaatcttgagaaccactgcattaagtctgtaggt

SEQ ID NO: 6765341 - DNA, 129 bp, Homo sapiens
agggaaaatttaggcaagaatctttattgaggtttccttggtcaaacgtgaggcagggcagggtgagcaggtttagaattggctagtgggaatactttcaatgggctttggggtgtaggggttgtccct

SEQ ID NO: 6765342 - DNA, 69 bp, Homo sapiens
gggatggtggctgttggaccacagggtatgttgtgcttgcactgtggaaataaacaatgctaacatctc

SEQ ID NO: 6765343 - DNA, 78 bp, Homo sapiens
ggctaaacttttataacattgagactcaaaataaggcccaaacaagagtttcatgttacagtgtaaaagtgagtggtc

SEQ ID NO: 6765344 - DNA, 62 bp, Homo sapiens
cactcctgttccactaaatgagaccagtttgtataaggtcatgggtgtgacctcaggcagtg

SEQ ID NO: 6765345 - DNA, 68 bp, Homo sapiens
gtgctggaggccctccagctgtcagctggggtccgtgcaccccccagactgcctggagggcttcgcac

SEQ ID NO: 6765346 - DNA, 117 bp, Homo sapiens
gagacatgctgtgggcatcaggacgggagttatctggcctgtgttggtggcccctgggccttgtgtggggagcagggcatagagctagctgtacgctcttggtgacacaactgtctt

SEQ ID NO: 6765347 - DNA, 89 bp, Homo sapiens
gctcgcggagcatttcgggctcgcccagatcagtgcgccactggccgatgaaggtggccgcactgtcgcgggccacgaagaagcgcagc

SEQ ID NO: 6765348 - DNA, 84 bp, Homo sapiens
gacctttagcatagcatccagttcagatgttgccttttcacgaatttaactgtttgtagcatctgttggctgctcctaaatttc

SEQ ID NO: 6765349 - DNA, 70 bp, Homo sapiens
tcttcttgcctgccctgtgtcgtaaaatgggggtcccttactgcattatcaaggggaaggcaagactgga

SEQ ID NO: 6765350 - DNA, 74 bp, Homo sapiens
ctcattggaattgatggacagagatgaagaaaatgtaaacagattttctaattttaacccatttattttggaag

SEQ ID NO: 6765351 - DNA, 82 bp, Homo sapiens
tcatgactatcatattttcatgactaccttaaataagcacaaagcttatttcagggggtacaagaagatagggtagttttga

SEQ ID NO: 6765352 - DNA, 78 bp, Homo sapiens
gtaatttgcatttaagagcctgtgctttgagttctgtactacgctatttgaattcaggtaagcaggcaggcaaatagc

SEQ ID NO: 6765353 - DNA, 62 bp, Homo sapiens
gaaatgttatgagatatgtactattgggtggaaaccaagtatggaaattccataaacatttc

SEQ ID NO: 6765354 - DNA, 71 bp, Homo sapiens
agaccacatccagggagcccctcgagctgtttttctaaacaagaatagtcctctccttggaatttgtttct

SEQ ID NO: 6765355 - DNA, 55 bp, Homo sapiens
gtctttaaaaataggctcatcactctgctggagggggtgtctgggctttagagac

SEQ ID NO: 6765356 - DNA, 104 bp, Homo sapiens
ctgtcctgctagcttaattttaagtttgcattgtttgataggtgaattatttggaataattcagttgacagctaatgcctaaactgatttgggttaaaatacag

SEQ ID NO: 6765357 - DNA, 75 bp, Homo sapiens
tctctctttgtcgcttttcattttggaaacatcaataaaaatgtccagtttgaggaagaagtagatagcccgaga

SEQ ID NO: 6765358 - DNA, 76 bp, Homo sapiens
tgctcctggctagatgtgtggccatgaagaggttacttactcctttgaagcccaagttcctcatcttgcttttgca

SEQ ID NO: 6765359 - DNA, 92 bp, Homo sapiens
aggcagggtctggaatatatctggagatctgaattttgtgctgaggacgagaaggccagattccaatttccagggctgctagattcctgttt

SEQ ID NO: 6765360 - DNA, 56 bp, Homo sapiens
tccatgttttgtgtgtgtttcctccctctaggatggaagcactgtggtggcatgga

SEQ ID NO: 6765361 - DNA, 88 bp, Homo sapiens
tgagtgcatttgtgtgtgtgctgttcctgtgcatgtatcagtcagaattctgtcagctgcagtgggcacagcctgactcgaatgacca

SEQ ID NO: 6765362 - DNA, 79 bp, Homo sapiens
caaaagaaaagatccagtgttttgagaagggcacgtccactgagctgctctttgaaggacactttcaagttttcttctg

SEQ ID NO: 6765363 - DNA, 113 bp, Homo sapiens
ggctcggccccgccctcctacgccctgcctgcgggtcccctcgggaggctgctcaggagaggaggaggctggggaggggactggacagggatcgggtagggtggggccaggct

SEQ ID NO: 6765364 - DNA, 69 bp, Homo sapiens
tcccacaagaaacctaagtaacttttgtctatcagtttctgggaaaggtctgcttgttttcttgaggga

SEQ ID NO: 6765365 - DNA, 82 bp, Homo sapiens
taccgaaatgcctggctaagttcataagcttattcttatgagtgttaataagttaatgtactatgaatttccacatgcggtg

SEQ ID NO: 6765366 - DNA, 63 bp, Homo sapiens
tattgcttgatatgtgctaaccttccctttgcagggcctgcaattgaaagccatgcagcagtg

SEQ ID NO: 6765367 - DNA, 82 bp, Homo sapiens
cttcaggccggctctgtttactttcagaggctcctttatatcccaggcaggctgcctccaagaagagcagagtccccagggg

SEQ ID NO: 6765368 - DNA, 97 bp, Homo sapiens
gggatgatctagtaccaaccaggagatgtttagaagaccgagatgtttcctgaagtattctgagctgtctcaggttgattacgtgctttcttatctt

SEQ ID NO: 6765369 - DNA, 77 bp, Homo sapiens
gctatatgtaaatttcccgggccatttaaattatcttcatgtcctggtgtttaaatggagggggaaatacgttaagt

SEQ ID NO: 6765370 - DNA, 67 bp, Homo sapiens
cagcctgtacaacccatgagtctacatttcagtagttttctacatcaaatactacatgggttggctg

SEQ ID NO: 6765371 - DNA, 55 bp, Homo sapiens
ggtgccagaagatttggtgtctggtgaggactcactcaccacttctttttgcatc

SEQ ID NO: 6765372 - DNA, 77 bp, Homo sapiens
tcctcaggtaggtatagattctctgaggatagagaccatttctctttttttcatggttctttatttgccccagagga

SEQ ID NO: 6765373 - DNA, 71 bp, Homo sapiens
gatcatacccaggcttatgttggtcaggtagaaacaaatgtgccacctataagttgggtgacattatgatc

SEQ ID NO: 6765374 - DNA, 83 bp, Homo sapiens
ccctcatcatctagattcaacttagtttgcatgattatggagcatgtatttagactccagtatcagattagggatgatgacgg

SEQ ID NO: 6765375 - DNA, 65 bp, Homo sapiens
gagtctccttccacgccatcatcatttttaaaaacggcaattgatgtcgcctgaagcggaggctc

SEQ ID NO: 6765376 - DNA, 81 bp, Homo sapiens
cctttgtaatcttcgctgagatgatgaattcattttcatactttaagagggtcactcgtcaactgtagtgacttagaaagg

SEQ ID NO: 6765377 - DNA, 108 bp, Homo sapiens
tttcttttactttgccatagcttaaaagctcttgctctagtggcccctgaatgcaaaacaagcattgcctggccacaggcatgcttggccatggctggtaatgagaaa

SEQ ID NO: 6765378 - DNA, 88 bp, Homo sapiens
gcaggtcacgggggcgactgatcttctcccgggtgtttgcagggcacgcggcttgtccatgcgtatccagggagcgtctctaaactgc

SEQ ID NO: 6765379 - DNA, 60 bp, Homo sapiens
tgtagcacagctgctctctactttgagctctttctcagtagatggcaagactgtttttca

SEQ ID NO: 6765380 - DNA, 67 bp, Homo sapiens
ctgaatagatccttgcacttgacttggcatttaatggagtgcaattgtcagtgtaagatttatatag

SEQ ID NO: 6765381 - DNA, 79 bp, Homo sapiens
gatggatcagtaaggcagtgcaattctagtgtccctaaatccagatgggtttagaacggggattgcaaactgaaatatc

SEQ ID NO: 6765382 - DNA, 96 bp, Homo sapiens
aattccctcagctatgggtgtccatctctgtatgctgctcatattattagaggctgcatttcacaagatgtaatcatcgtgtagcatattggaatt

SEQ ID NO: 6765383 - DNA, 98 bp, Homo sapiens
ctcatagactgagtatagctgagtttaaattcttatcaaatctgacaatccttatgttttaattggtgaattgagaccatttgtacttaatctattag

SEQ ID NO: 6765384 - DNA, 56 bp, Homo sapiens
atttctagcaaaggctctgctaattaaagcagggatctgcagaaccttctggaaat

SEQ ID NO: 6765385 - DNA, 97 bp, Homo sapiens
aggactatagtttttacatctttgctttaatgagattttgccatgggttatttgatgctagattttagtttggaatgaagattctaattatggtcct

SEQ ID NO: 6765386 - DNA, 65 bp, Homo sapiens
tcccaggcagcttctttcatcaatgaggtcactgaagccagaaatgatcaggaagcggcttggga

SEQ ID NO: 6765387 - DNA, 89 bp, Homo sapiens
tttgggtagttgatttctgttgaaactaatttccttaagacatttatcttttggaaatttcatcaatagcctgtttgagactatctgga

SEQ ID NO: 6765388 - DNA, 94 bp, Homo sapiens
gactctggtatctctgagtcactcttcccagcttagcttactgtccccaccctgtctctaagctgttctccagtgactcaggagcccagatgtt

SEQ ID NO: 6765389 - DNA, 61 bp, Homo sapiens
tgtccagaacacagttagtaagggaaatattgccaatattccatctattgtgtttttgaca

SEQ ID NO: 6765390 - DNA, 56 bp, Homo sapiens
aggaggtgattttcaaaagaactttccagtgtgaagatttttaaaaatcccctcct

SEQ ID NO: 6765391 - DNA, 101 bp, Homo sapiens
aaaatcttatttttcaatgtacctaagaatgaaggaatattgctttgcttttagagattaactaaaacaaggtttggtcctatattttggtactagatttt

SEQ ID NO: 6765392 - DNA, 76 bp, Homo sapiens
gggttgttcgcgaacttgactgtgatgggctcagctgcgcccagcggcttctgcccattcagtcctttgatagcct

SEQ ID NO: 6765393 - DNA, 69 bp, Homo sapiens
cagtgttgttgattttttctggttgatttggaaacgagagatggcaatcaggaaactatcaacacattg

SEQ ID NO: 6765394 - DNA, 71 bp, Homo sapiens
aatacatgtaaagaatttcacacaagatctgacacacaaaatattaagatcttagtgtatgtgcatgtgtt

SEQ ID NO: 6765395 - DNA, 80 bp, Homo sapiens
ctgtggagtctgtccgacagaagcttggggagctcacggatctgcatgggcttcgcaggttcgtgttgcagggctcacag

SEQ ID NO: 6765396 - DNA, 56 bp, Homo sapiens
gtggcttcctggacagatgcggtgctaggagacttcacctggctctcaggagcaac

SEQ ID NO: 6765397 - DNA, 71 bp, Homo sapiens
agcttatgcaattctcttaatattcttgtggtttctttcttggcttatggattgtttagaagtgcattgct

SEQ ID NO: 6765398 - DNA, 80 bp, Homo sapiens
cctgcatttgtttcctcacagtcaccttttcttctttcctttggtctctgtgatgatggaaactttcttcaaatgtcagg

SEQ ID NO: 6765399 - DNA, 92 bp, Homo sapiens
tctgagcaggagggagacttggcttggatgcttctttctcttccatctaaggcgagtggaaagcattcatgtgtctttgactgtatctcaga

SEQ ID NO: 6765400 - DNA, 59 bp, Homo sapiens
ctgaagagcaaaccaactggactaattcttactccttagttcaggtggtagttttccag

SEQ ID NO: 6765401 - DNA, 59 bp, Homo sapiens
ttaaatgggttttggtggggctttaatcaaagacaactgtccttccagaactaaattaa

SEQ ID NO: 6765402 - DNA, 130 bp, Homo sapiens
ttattcataagttattagttctaattttcttgtattttattagagatgccgctaagtaggaaattaagtggtctccccagtagaataacaaaggtcgtaagtagagaatttagatcattgcttactatag

SEQ ID NO: 6765403 - DNA, 69 bp, Homo sapiens
cattggttctaatgatttcattcaaagcaggacaaattgctttgagcaaggaatcaattagtctcaatg

SEQ ID NO: 6765404 - DNA, 59 bp, Homo sapiens
agcagctgccactggaataggagccttcagacgttggttttaagcctagttcagctgtt

SEQ ID NO: 6765405 - DNA, 72 bp, Homo sapiens
gatacgtagctctttgagattggttcttgtcatcaactgacatgccctcaagatccattcaaattatgtatc

SEQ ID NO: 6765406 - DNA, 96 bp, Homo sapiens
caccctcatgggctcttggtgcaactctggatcttctggtaaaagagaagtttttcccttctgagccaagcttgcaacagggttaatttgggggtg

SEQ ID NO: 6765407 - DNA, 58 bp, Homo sapiens
gacactttctgaggagacgggctttgtgaggagaccgcgaagtttgggcagaggggtc

SEQ ID NO: 6765408 - DNA, 78 bp, Homo sapiens
ccttgaggccaggaaagcaaaatcacccacgatgttaaacagtttggatgagtcactgctcctttttgcgcctcaagg

SEQ ID NO: 6765409 - DNA, 80 bp, Homo sapiens
atggactttgctatcgtgtattctagccatgtcttcttcacaaacatgtagtagtttggagacactggtttagcattcat

SEQ ID NO: 6765410 - DNA, 60 bp, Homo sapiens
gaattccttaggctcttgactgtttctccactataatcagtctacggagagtaggaattc

SEQ ID NO: 6765411 - DNA, 87 bp, Homo sapiens
tcagacagtgatgcatctgcctgagtctaggttttcttaactctaagacagcactcccatctcagggaagttgtgaagctgtcatga

SEQ ID NO: 6765412 - DNA, 55 bp, Homo sapiens
ttcaaggtatggtagctggtcacacattctggaaaatagtttgctgtgctttgaa

SEQ ID NO: 6765413 - DNA, 96 bp, Homo sapiens
gcatggaaaggcagcagagtatggaaaatgaaatgagatgggcaaaaggttaagtacatgggagtttattattctgttctctctacttttttatgt

SEQ ID NO: 6765414 - DNA, 98 bp, Homo sapiens
ggaatgagtttgcagttagaaaaccagtgttgtgactatgaaattacaatatttcagttttataactttggcctcataatcactgcaagcatttttcc

SEQ ID NO: 6765415 - DNA, 70 bp, Homo sapiens
ctgatgttaacttgttctgcctcttttggtcagggtcaactttatgggatggcagaggaagtagcagaag

SEQ ID NO: 6765416 - DNA, 55 bp, Homo sapiens
ggcaatggggcagagggtcatgtgaggcctcatgggtcactgtttcaccattgct

SEQ ID NO: 6765417 - DNA, 65 bp, Homo sapiens
gttctgtaccttctgtttcaagcaatcatgaacattgatggttgagaaggtaaggtaccaaggac

SEQ ID NO: 6765418 - DNA, 72 bp, Homo sapiens
ggcagttttcttagagtcgagggcatgataagctagggactgagaatctcagtcctgccatgtcctactgtc

SEQ ID NO: 6765419 - DNA, 61 bp, Homo sapiens
aataaggtacctgccattcttcccagtcactgggagcccaaggacagcaggagcatttatt

SEQ ID NO: 6765420 - DNA, 58 bp, Homo sapiens
tatatccataggctgtgcctagcctagtccttcaggttgttgcagggcccaggatata

SEQ ID NO: 6765421 - DNA, 69 bp, Homo sapiens
accctctctccattcctttgaaggaagtcactgtgcacagactattccaaaggaatggggagctatggt

SEQ ID NO: 6765422 - DNA, 75 bp, Homo sapiens
cttaggatgtaagagaaggatctgttccaggcctccctccttggcttgtagacatctgtcttctctctccctgag

SEQ ID NO: 6765423 - DNA, 81 bp, Homo sapiens
ttagttgaatcctaccaagattttatgaattttggctgccaaagttagaacatcaggttgaatttggtttagatttactga

SEQ ID NO: 6765424 - DNA, 67 bp, Homo sapiens
ccgtgatatgtgcaagagtttattttcttccatttaggatgaaagaactacctgtatgatattcagg

SEQ ID NO: 6765425 - DNA, 63 bp, Homo sapiens
gccctactcagaaaggtgccatttatgtagattttatgtcactggctcctttctgggtagagc

SEQ ID NO: 6765426 - DNA, 61 bp, Homo sapiens
ctcagggatggtgaagcacccagcagctggcaaacggcagggagctgccaccacccctggg

SEQ ID NO: 6765427 - DNA, 89 bp, Homo sapiens
aattccagcttcagctcttggatagtgaggtcattgaatacagaagagaaattgagaaaattattctgagagttgaagtaatgtgaatt

SEQ ID NO: 6765428 - DNA, 63 bp, Homo sapiens
gtttgggatgtggccatggttctctccacacatctggagatgggagctgtggagctcttgggc

SEQ ID NO: 6765429 - DNA, 66 bp, Homo sapiens
tgagaacttgtgctattgcacaacattccacatgccatcaacattgtgcaattctcacaagtctta

SEQ ID NO: 6765430 - DNA, 62 bp, Homo sapiens
ttctcttttcaccagttgctaagtttcttggtgtcagaataatagcatgggtgagggtagag

SEQ ID NO: 6765431 - DNA, 69 bp, Homo sapiens
tatgtaaaaatgcacagtaatgagctggttgtttcaaaattccagctttaattgtgtgttacattcata

SEQ ID NO: 6765432 - DNA, 114 bp, Homo sapiens
tttcatctttatagttccagatccagctaagattacactctggttgcgtgactgaacaaatctgtttgcagggagagatgtggtgttggaattgtgaacctatggagaatgaaa

SEQ ID NO: 6765433 - DNA, 82 bp, Homo sapiens
gtcctggtttcagttctcttggaagttatgtgaggatctggtctcacaccttaccccgagagagccctgaagggcccaggat

SEQ ID NO: 6765434 - DNA, 58 bp, Homo sapiens
aggcaggcacagtaatacatgttcattcttttggcctgagctattacagtagcctcct

SEQ ID NO: 6765435 - DNA, 55 bp, Homo sapiens
tgttgcagaatctcaaaacagtgtttgcatccattgctgctttgaaactgcaata

SEQ ID NO: 6765436 - DNA, 60 bp, Homo sapiens
gctccctggatgtggccagccagccacctgcctacgtggactctggcagcactagggggc

SEQ ID NO: 6765437 - DNA, 74 bp, Homo sapiens
tccaggtgggttgtgtcaggctgcagagggagcggcctgggcctggccctctgaacctggtagcagaatctgga

SEQ ID NO: 6765438 - DNA, 65 bp, Homo sapiens
gctaaaggctcaggagactttgcaaatgtaaatgaatgagcagaaaagaatgctgagcctttagt

SEQ ID NO: 6765439 - DNA, 61 bp, Homo sapiens
acagtctgcaggcaagttctacactcctgcctcttatggccctgagcttcctgagacatgt

SEQ ID NO: 6765440 - DNA, 57 bp, Homo sapiens
gcggctgccgagacaagccggtgcgcatcaccatgcgcggcctggcttcggagccgc

SEQ ID NO: 6765441 - DNA, 109 bp, Homo sapiens
ccagtccctgacctgaagctgcccctggggctgaggagcctcactctgtccctgggccagggtcccgggctccccagcctgtggagtgagagccgcagggcagggatgg

SEQ ID NO: 6765442 - DNA, 67 bp, Homo sapiens
tatttgctggtggtttttaataggtgaatgttccaaatgcattgcctttataagccagcagcaagta

SEQ ID NO: 6765443 - DNA, 67 bp, Homo sapiens
gctttggattggtgttttgaaagaggatgaaagttattcctggcaaagtgagcatcactagcaaggc

SEQ ID NO: 6765444 - DNA, 59 bp, Homo sapiens
ctctcggccaccattgccgttctcagagctgctgaggaggggttctcgggtgctgaggg

SEQ ID NO: 6765445 - DNA, 58 bp, Homo sapiens
gcctacatttcccagttgaatgtaattaatttggcaaaaatcactgggtgtatgtggc

SEQ ID NO: 6765446 - DNA, 57 bp, Homo sapiens
attctgcagagatcttgaatctggaaggaagagtagaaagcaagttgactgcagaat

SEQ ID NO: 6765447 - DNA, 73 bp, Homo sapiens
gggccaggcggcggcggtcattgagcatggcttccactctggccatgtgtgtctccaccagctgctgtctctc

SEQ ID NO: 6765448 - DNA, 61 bp, Homo sapiens
cagcctggtgggcagtccgacacgttcggtaatgtaccaagctctgccgcctttcaggctg

SEQ ID NO: 6765449 - DNA, 110 bp, Homo sapiens
gaagtcctcagacctctcggtaccacattaggcccttgtcagctagtcagtcacaccctagtatcagctggctcagggactagagtttttattgagaggagggggtcttt

SEQ ID NO: 6765450 - DNA, 65 bp, Homo sapiens
gccacattctattctgcaggacaaggcacttcaaatctttttacctggaggataaatgtgtccgc

SEQ ID NO: 6765451 - DNA, 122 bp, Homo sapiens
ttctgttatggttatttgttggccagtctcttcttgctagactgagtgcccttggattgggaagatcgcattgcccggcactaggtctgccccagaaggatgctcaatatcattgtacagaa

SEQ ID NO: 6765452 - DNA, 67 bp, Homo sapiens
ctgtacaagggtctgctgaactggtggtttcagcagactacccagttcctaagcatccatgagacag

SEQ ID NO: 6765453 - DNA, 56 bp, Homo sapiens
ggctggactctgggcctctccagtcccaggtacggacctaggctcagagcccagct

SEQ ID NO: 6765454 - DNA, 65 bp, Homo sapiens
aggaaatttaggttggaattattgaaacccattctcttctttgattccaaagaatttaagttcct

SEQ ID NO: 6765455 - DNA, 78 bp, Homo sapiens
gagcagctgaatggctccctgctaaatattcaaatgtcccccacccttttgcagttagatggggtcatgtagctgttt

SEQ ID NO: 6765456 - DNA, 66 bp, Homo sapiens
gaacatgggccgggaatgacatgcctgagtcattgacaagggcccacatctcctgcctccatgttc

SEQ ID NO: 6765457 - DNA, 70 bp, Homo sapiens
ccctctaagcctgtttccatcaacacatgctcatttctgggagatatgcacggatagcaggtagggaggg

SEQ ID NO: 6765458 - DNA, 58 bp, Homo sapiens
ccctcaggatgcagtggaagtgcacccagatgtcaagcggcacattggattctggggg

SEQ ID NO: 6765459 - DNA, 84 bp, Homo sapiens
cagctgcttctgggtcacaagtgatcccaggccaggtgagaaacgaatgcaggtggcttctgggacttgtgagcaatgtggctg

SEQ ID NO: 6765460 - DNA, 92 bp, Homo sapiens
ccagctttaagggggcttagacagacagagaatttaaatacctctttaggttatagtggagatatttagctgtgtctataaggcccagctgg

SEQ ID NO: 6765461 - DNA, 67 bp, Homo sapiens
cagcgcgggcactggctctgggcagatcccagcgcggagctgactccctgggcccgtgccagcggtg

SEQ ID NO: 6765462 - DNA, 97 bp, Homo sapiens
tagtcacctgagaacttgttagaaatgtagaccctcagaccctaccccaaaactagtgaatcagaatctgcatttttacaagatccccaggtgattg

SEQ ID NO: 6765463 - DNA, 85 bp, Homo sapiens
ttcttatgccagccacagactagtagtgagtttctttggtcctctgtggaaaagtactttgggctatgtttgggcttcataagaa

SEQ ID NO: 6765464 - DNA, 58 bp, Homo sapiens
gttgatatattatggaaatgctttctgtcattatgcacttttccataatgtatgtaac

SEQ ID NO: 6765465 - DNA, 66 bp, Homo sapiens
ccacttttatgcctgtgacagcttcatgaagcacaaaacatggagcaatacatggcatgaaattgg

SEQ ID NO: 6765466 - DNA, 63 bp, Homo sapiens
gctaaagtttatggacatcttttggcctttcccttgtggtcacaagataaacatagctccagc

SEQ ID NO: 6765467 - DNA, 66 bp, Homo sapiens
acggcacagggtgatgttgcagttcccacacattgtcactgatctgctggctcgccctgttggtgt

SEQ ID NO: 6765468 - DNA, 62 bp, Homo sapiens
gccccaggtctgtgctccaagcaaatgggctctgtggtggtttcagagggcagatctggggc

SEQ ID NO: 6765469 - DNA, 60 bp, Homo sapiens
gattctggatgaccacctgtccagggtcctcaagacccctggctgccagtcaccagactc

SEQ ID NO: 6765470 - DNA, 66 bp, Homo sapiens
acatgctgggcaatgttgttttcctgaatgtctatcaaagtagatgagcaatgcccagttgcatgt

SEQ ID NO: 6765471 - DNA, 66 bp, Homo sapiens
cagggaattggttatacctgtgatgagagagctgagaagcctcacaaaggatgatgaattctgatg

SEQ ID NO: 6765472 - DNA, 80 bp, Homo sapiens
tggtaaagttaaaaagcagaaggggaataatattttgacctcactaatttgttttccccttttgctgacccagctttcta

SEQ ID NO: 6765473 - DNA, 84 bp, Homo sapiens
ctgttgaagtcaggtgatggggacagaaaggttcattgttctatttttgttccttttatatggctcatcacagagcttcaacag

SEQ ID NO: 6765474 - DNA, 63 bp, Homo sapiens
cccgtaagtatttggaggaggtagcgaccggtatttgatgcctacctgaaaatgtctaatggg

SEQ ID NO: 6765475 - DNA, 88 bp, Homo sapiens
ctttaggggcttccaagtgctgaggacagtagggaacatgacactatgctaactcctgacaggttggtagctttggaagcagcaagag

SEQ ID NO: 6765476 - DNA, 70 bp, Homo sapiens
tttaggcacagggagttggtttatatttatctaatccaggtaatagagtatttaatttcctgtcactaaa

SEQ ID NO: 6765477 - DNA, 64 bp, Homo sapiens
tcagaattcagagggagtggggtgaggcagtgggaggcaatgaaaattccctctggattctaga

SEQ ID NO: 6765478 - DNA, 59 bp, Homo sapiens
gggagttgcacactggctataacaagatgtttttgttcatccaatgtgtgtgtgtaccc

SEQ ID NO: 6765479 - DNA, 103 bp, Homo sapiens
tacaatggtaatgaatttacagggtgagcttcagaaaatggatgcattgttgaacactttttaccctgaaatccattaatattatcagtccatcaccatttta

SEQ ID NO: 6765480 - DNA, 61 bp, Homo sapiens
tgtagatgagtcagggtgcaccggggtaccagcattccacatgcaccctgactcatctaca

SEQ ID NO: 6765481 - DNA, 76 bp, Homo sapiens
agggggtccactcttcaacagagcagaaggctccagcacagcagctacctgcctttgaagagatcctagccccact

SEQ ID NO: 6765482 - DNA, 74 bp, Homo sapiens
ctaaaactttctgtgctattcagtgtgatagttattggacacaatgaccactgaaaacatggctagaatgatgg

SEQ ID NO: 6765483 - DNA, 94 bp, Homo sapiens
gagagtttagtttaacttggagtccttcaggcctgaagtgtggagtggggctttagagtgtcactccctggggctggactcctggctgtctttc

SEQ ID NO: 6765484 - DNA, 67 bp, Homo sapiens
agatacattctgaatagtttcttctgacctgtcttccaagtcacagtgtatctcttcagctgtatct

SEQ ID NO: 6765485 - DNA, 79 bp, Homo sapiens
gcaaactggtcatcactctaacagactgacagcactccaactttcaaaaaagtgtagctgtagggtattatcattttgc

SEQ ID NO: 6765486 - DNA, 65 bp, Homo sapiens
gctgtgtgcattttgttctcattgcctcgggagaggcagcaactcggagagaagagaatgtcagc

SEQ ID NO: 6765487 - DNA, 72 bp, Homo sapiens
ggctgatacaggagtatttaatcagaaaattgtcctagattttcacaggtacaaacactcctgatgttcgct

SEQ ID NO: 6765488 - DNA, 61 bp, Homo sapiens
acagacccttgagattttctgtgcaggacctcctgaactgcaggaatctcagtgggggtgt

SEQ ID NO: 6765489 - DNA, 74 bp, Homo sapiens
agagctagaagtacagccatatgacgttacaactaagttctctgtattttctgtggtgatttctaatatgcttt

SEQ ID NO: 6765490 - DNA, 63 bp, Homo sapiens
gcctagaggcttcctgcaggtcagggccatggaaggctggggccagtgaggaggctttctggc

SEQ ID NO: 6765491 - DNA, 80 bp, Homo sapiens
cagacacagctgcaggaggtgggtacctgtcttcgctgaaagctagacttggctcgtcctagttcttgtttagtgtgctg

SEQ ID NO: 6765492 - DNA, 130 bp, Homo sapiens
cattagaatcacctggggatattaagagacactcatacctaggcttcacttccagttattctgatttaattaatccggagcaagtcccaggcactagtatgttgtttacgcttcctaggtgattccaatg

SEQ ID NO: 6765493 - DNA, 57 bp, Homo sapiens
tgtgtcaagacatttagtcatttaataaataaatatgactactgtgtactaggcaca

SEQ ID NO: 6765494 - DNA, 83 bp, Homo sapiens
ggggcgtgggggctgccaagcctgcctgcctctcgagagacccagggggaggctctggagcccgagcctcagatcacagcccc

SEQ ID NO: 6765495 - DNA, 55 bp, Homo sapiens
tggtagtctccatgggcaaggctgtgacagtcagtgccacttaatgaggctgcca

SEQ ID NO: 6765496 - DNA, 78 bp, Homo sapiens
caggtgcagtattgccctgcctgcaggtgcggtgttgcccgcaggggtggtgttgcccgcaggtgcagtattgccctg

SEQ ID NO: 6765497 - DNA, 129 bp, Homo sapiens
tggagataaggccttaattaagaagtgtcgtactgataggggaagtctcagaatgcagtggctagcttctgcagagaattgtggggcttctccagtgaccccacagaagagttacctgccacgtctcca

SEQ ID NO: 6765498 - DNA, 103 bp, Homo sapiens
aatattgttcttggtgtattctgagagtattttggcattatcagtatgttattaaaatactgaagagtcatgaaaatatttattagaataaaagggatatgtt

SEQ ID NO: 6765499 - DNA, 88 bp, Homo sapiens
gaggaataccttagaaagtgacaaacgaaagacatgctacagtcttctaagcccattctgtcctttttgacgtatcttaacttccctc

SEQ ID NO: 6765500 - DNA, 82 bp, Homo sapiens
tagagagcaatcaacaggcttagggcaggctgaccccaagaccttgggtcactgtgtggctttgagcaaattgcgtaatcta

SEQ ID NO: 6765501 - DNA, 74 bp, Homo sapiens
cctaacatttagtaaaggcatttgtcataaataacctcaagtccaatttatggcaagggttttaatttgtaagg

SEQ ID NO: 6765502 - DNA, 73 bp, Homo sapiens
gaaaactgagttaaatattttctgaagtttcagtagctgctggaattggctatattatttagcctcagtgttc

SEQ ID NO: 6765503 - DNA, 129 bp, Homo sapiens
tgacaatctgagttacactaatttcacttacctctgatactgaaaatcctgcctgtcctcacttgactcccatgatgaatgatttgtcagtcacaggaatggtaataattaataaaatttatgatgtca

SEQ ID NO: 6765504 - DNA, 64 bp, Homo sapiens
tctagccttgcagaggagattatcgggcaaattgatgctggaaagaattttctgttagattggg

SEQ ID NO: 6765505 - DNA, 87 bp, Homo sapiens
ggtagtgaaaattttattactgctgtagcagctactaactctgaaaatggttatttgctcctagagagtaatacagttttgacttcc

SEQ ID NO: 6765506 - DNA, 81 bp, Homo sapiens
cagacacctgcagggatgggaactcctccagcagctccaggaacgtggggctgttggtgaacttccacttgctgtactctg

SEQ ID NO: 6765507 - DNA, 62 bp, Homo sapiens
acattgagcctcacctagatgccaggtaggtaacacgcattatcacaggtgagtctcactgt

SEQ ID NO: 6765508 - DNA, 59 bp, Homo sapiens
gggggccataatgctattgtagaaccacattattttacaatgcactttaaatggttccc

SEQ ID NO: 6765509 - DNA, 95 bp, Homo sapiens
acctctaggccagtttcccaggctgtggggccctataggcaatttcccatagggtctcagagcctgagaacctgtgcatcttactgcctggtggt

SEQ ID NO: 6765510 - DNA, 68 bp, Homo sapiens
cattatgtacctctttctgcttcattgctttgtttgttggccttggagtgaagtaaagaggacaagtg

SEQ ID NO: 6765511 - DNA, 70 bp, Homo sapiens
ctcccttcctcaatcatcttctggggctccctattggtcaaaaccaatgggaagccagaagacaagggag

SEQ ID NO: 6765512 - DNA, 82 bp, Homo sapiens
acacgtgtgctgggagggcccagaggcagtgacagcatgaacagtgcaagtacaagtctctgtgccttccctggggttgtgt

SEQ ID NO: 6765513 - DNA, 107 bp, Homo sapiens
cgtctgcagtcctgagcttggcaggcagggagagttcaggcatggccacattcacactctcactccctgacctgacaaagcctcagtgtctccagtgctgcaccacg

SEQ ID NO: 6765514 - DNA, 99 bp, Homo sapiens
atcttatctcacaataattctacactgggggctttgagcatgaagattcatcctggagataattgcagtgaacgagagttataccttggaagataagat

SEQ ID NO: 6765515 - DNA, 76 bp, Homo sapiens
actgtttgacaataaagaccaaacacagtgcagaaatatcggtctctgccctgcctttggtttttgaaacgacagt

SEQ ID NO: 6765516 - DNA, 69 bp, Homo sapiens
gtagtgcaggggcaggcggcggggacaggaccaagacaaacaaagtttcccctcttcctctgacactat

SEQ ID NO: 6765517 - DNA, 112 bp, Homo sapiens
gatgatgatgatgatgatgatgatgatgatggcagcagctaacttaggcagcacttactagatgtcctacacttttctgtacttttacatctatattatctcacttatcttc

SEQ ID NO: 6765518 - DNA, 82 bp, Homo sapiens
tgcagtcactccaggccgagtcaccttgggtcagcgataccatgtggtgtccaagaatgagtgatttgtccgagggactgca

SEQ ID NO: 6765519 - DNA, 58 bp, Homo sapiens
agcccctaaagtagctgttcttaacctggaatctgaagaacagcctgttggtggggct

SEQ ID NO: 6765520 - DNA, 60 bp, Homo sapiens
ggatttgaactagagccctgccatttaatgactgtggatcttgggctggggtataaatct

SEQ ID NO: 6765521 - DNA, 60 bp, Homo sapiens
cctactgtcttagtttgggtttcctctctcccaagagcagaacctgagtgaagacttggg

SEQ ID NO: 6765522 - DNA, 69 bp, Homo sapiens
ggatttttttctcttataaaatctctgttgtacactttatgacaggatggagataatagaaaaagttct

SEQ ID NO: 6765523 - DNA, 117 bp, Homo sapiens
ggaagtgtgtccctctagctgctgagcttgctacatagatcagatctgactggaggaagcggggtttctggatgtgaagatgagttaggtagctagagctgggattgtacaccttcc

SEQ ID NO: 6765524 - DNA, 71 bp, Homo sapiens
gggcccggtctgtgtacttgctggccgtcctgctcacaaggcgctgtagggctggcgacatggctgggctc

SEQ ID NO: 6765525 - DNA, 67 bp, Homo sapiens
tggagttctcaggtgagggctttgacctcagagagctgttggtctcattctcgcctgtgaaattcca

SEQ ID NO: 6765526 - DNA, 59 bp, Homo sapiens
acagagggccagccgacttccagcctcctcaacgatgttgcttaaggctggctttgtgt

SEQ ID NO: 6765527 - DNA, 70 bp, Homo sapiens
aggattgtcaagttgcttatgctggagtcagctgggctggttggcttcttataatgcaatagacaattct

SEQ ID NO: 6765528 - DNA, 107 bp, Homo sapiens
tggggaaatcaaatatttagaagttcatgcgaattatttaagttttacttcaacaaattaacagagtgcttctagcaagagcttcatatgagtttttttttttacca

SEQ ID NO: 6765529 - DNA, 84 bp, Homo sapiens
ttgccttattcttaggggagaattacatggcgtggagttgtcacacagtgctccatccattttctttgctgttttatgaggcaa

SEQ ID NO: 6765530 - DNA, 130 bp, Homo sapiens
tagcctgaagatttgagcaacatacctgactgccacagacttgtggacaacatgcaaaacactggcccatttaacatgtatttcacaaagtttggggacatctagtagtctagtgcctgattcttaccta

SEQ ID NO: 6765531 - DNA, 56 bp, Homo sapiens
tcaggcatacccgggtttgatccagctttgctgttttctaactgggtgggccttga

SEQ ID NO: 6765532 - DNA, 107 bp, Homo sapiens
cgatgatgatttatgcaaaacccggtcagctccacagctccatcagtttcaattaaaacaagccgcagaggaggtgtgctgcggcccggtgcctgtgatcaccattg

SEQ ID NO: 6765533 - DNA, 67 bp, Homo sapiens
gttacatggtgccttttccgtgtggcccaaggaaaaatatctgggaaggaagaggctgccactgagc

SEQ ID NO: 6765534 - DNA, 62 bp, Homo sapiens
tgtctgtattcctgtcggcagccgggcccacataaacattcggcacgcagcacttgcagaca

SEQ ID NO: 6765535 - DNA, 77 bp, Homo sapiens
ttttggcttttctagttttctcaaatgacttgattgaagacaatctgagtaattcaagactagagaggcaaacaaga

SEQ ID NO: 6765536 - DNA, 86 bp, Homo sapiens
tgacaaattgcattgttatagcattacacaccatagaccccattttgaatgggaggtgtgaaatgttcagtgttacaaatgagtca

SEQ ID NO: 6765537 - DNA, 68 bp, Homo sapiens
aggatcagaatcatctggagggatttttaaaacacagtttcctgagttcactccagatgttctgactt

SEQ ID NO: 6765538 - DNA, 72 bp, Homo sapiens
cctgctgaggggctgccctgctctctgctcactgagtgctaagtgcagagcatttcggttgcttccagcagg

SEQ ID NO: 6765539 - DNA, 100 bp, Homo sapiens
gaagagctagatttacttcaggtttattgactatttagtagaaggtctctgctcaggaaaacagtctagtaattgcttagcaataatctggtatgtcttc

SEQ ID NO: 6765540 - DNA, 85 bp, Homo sapiens
ggcaattcttcatcaagacatacctttttgttgcttctaattacctgctggcaggaactaaaagtgtgtctcttgtatgcatgcc

SEQ ID NO: 6765541 - DNA, 95 bp, Homo sapiens
tcagatctagaacagatctagtaggagctgggttattaggatgctagtcagccctaggaacccccaggcttctgagttctctggcctggaaatga

SEQ ID NO: 6765542 - DNA, 70 bp, Homo sapiens
agcgggaaggagaatggggctgcagccagaacagctgcatgcatgttccaactccatcactcccttagct

SEQ ID NO: 6765543 - DNA, 87 bp, Homo sapiens
tgaggtatttacaaaataaatctgttgtaatgttttttagtacagttaattgaggaatggcgcaaatagatgacagtatttacttca

SEQ ID NO: 6765544 - DNA, 56 bp, Homo sapiens
aagttggatttgatgactgatacggtttggctgtgtccccacccaaatctcatctt

SEQ ID NO: 6765545 - DNA, 130 bp, Homo sapiens
agaatgttgaggctcagcagaattaagcaaattttccaagatcacacaggtaacaagtggcagaatgtcacttcaatactagatgtgtgattccaaggttgattttgttcctgctgtgtaaagcaattct

SEQ ID NO: 6765546 - DNA, 69 bp, Homo sapiens
ttaactcagcagtatactctgaagattaggtaagaaatccaagattttctctttgtatatgctagttaa

SEQ ID NO: 6765547 - DNA, 122 bp, Homo sapiens
taatgtatgtctcaataaactggcatctgatccaatagatatatatgtcttgagaaaaagcattcaagaaaattttcatatatcttcattaggtcgagagaacagctttaaacacaatatta

SEQ ID NO: 6765548 - DNA, 59 bp, Homo sapiens
gttgcttttgtctgtcccagcttgtgcatcccatgggtcagggctggggtcagagtgac

SEQ ID NO: 6765549 - DNA, 85 bp, Homo sapiens
ccagatatcgtggttgcattgaaaatatattttaaagtacaaacgcttcttgagatatagttttagttttgttcactaaacctgg

SEQ ID NO: 6765550 - DNA, 58 bp, Homo sapiens
tgacaattgtgggcagtttgtgtgatgctgtgtggcagaaactctacctcaatcgtca

SEQ ID NO: 6765551 - DNA, 62 bp, Homo sapiens
ctggtggcctggaatcttaacaagacaccgcttttctttccataagaagtcaggctaaaaag

SEQ ID NO: 6765552 - DNA, 57 bp, Homo sapiens
tgagatggagtctcgctctgttgccatgctggagtgcagtggcgcgatctccattca

SEQ ID NO: 6765553 - DNA, 72 bp, Homo sapiens
ggcatcctgggaagctgacattgaagctgacattgacatatttccttacttcaatttcgagctttctgtgcc

SEQ ID NO: 6765554 - DNA, 72 bp, Homo sapiens
gagaacacagaacagggcccaaggggtcgggcttcaagccttgacttcttctagccctgcactctgtcactt

SEQ ID NO: 6765555 - DNA, 58 bp, Homo sapiens
gttcagtgtttacatgattgttatgctatttagagctaggtcatgtagttcactaggc

SEQ ID NO: 6765556 - DNA, 64 bp, Homo sapiens
tcacacgatcaaaggtcaattgtcagttctgattaaacaggatgttgtttctttgcattggtga

SEQ ID NO: 6765557 - DNA, 68 bp, Homo sapiens
ggcagtaccctggcactgagtggcttatgacctctgctggcatcctgtcctcgggggccgatgctgcc

SEQ ID NO: 6765558 - DNA, 94 bp, Homo sapiens
agctgttaaactcgggaatggattgtgtgtttgagtggtgcgaccactgatgtataaaatgcacaggagaaccaattcactgaggtaggcacct

SEQ ID NO: 6765559 - DNA, 80 bp, Homo sapiens
ggttccatctctgtggacagattccagtgggggagcctgtaggaggctagttcctggtctgtgccattcagagagaagcc

SEQ ID NO: 6765560 - DNA, 60 bp, Homo sapiens
tctttgaggccagtctcatcacaggctgagaggcctaggagtacagaatggttttggggg

SEQ ID NO: 6765561 - DNA, 87 bp, Homo sapiens
tgccagcactattattgatcatgccatttgcatatggccatattaaaggactatgtaatggatggcatgaagacaatgaattgggca

SEQ ID NO: 6765562 - DNA, 62 bp, Homo sapiens
ctcacccccaggaagctcgtttgattgaggtaccttttccaagctgcagtttggttggtggg

SEQ ID NO: 6765563 - DNA, 64 bp, Homo sapiens
cttctgcccggagctggcaaaggctgccacaaatgcaggactggttaaagttccgaggcagagg

SEQ ID NO: 6765564 - DNA, 65 bp, Homo sapiens
tgctgccttgctgtttgcctctccctacttagaacgcctcctaggagatggtggaagctggtgca

SEQ ID NO: 6765565 - DNA, 83 bp, Homo sapiens
aggcagatgggtggcttattttctgtgaaattaaacagttttaaacactggctagaaaatgttccactgccatttcaacgctt

SEQ ID NO: 6765566 - DNA, 76 bp, Homo sapiens
gcccctgatgtctttctcacagccagttcatatcctctgattgtggagttgctgagacagaacacactcacagggc

SEQ ID NO: 6765567 - DNA, 70 bp, Homo sapiens
tctacacaagtgagtggcacaaacaggaaggcataaattcaattttgcctttgccattcaccatgttaga

SEQ ID NO: 6765568 - DNA, 112 bp, Homo sapiens
aagtagaacgatttttctgtattgctcgaaataatttagaatatagagcctaaagtttactatcttctctgacattagattaattggaagcaagaacacagagatcctattt

SEQ ID NO: 6765569 - DNA, 76 bp, Homo sapiens
gcttcactgcctgactgtgggctctgtttgtcttggtccccgtggcattaccagagcttagcagataaggaggagc

SEQ ID NO: 6765570 - DNA, 71 bp, Homo sapiens
gagggagaaaacttcagactccccacttctcgcagtgcagagagagggaatatttggggtattctcacctc

SEQ ID NO: 6765571 - DNA, 56 bp, Homo sapiens
tcattcctccagcgggagtccagtcagggtcctgaagtttgctggttcaggaaaga

SEQ ID NO: 6765572 - DNA, 60 bp, Homo sapiens
agtccccttgtattcttgtacctttcaatgccttgaaaagatctggggtgaaggaggact

SEQ ID NO: 6765573 - DNA, 89 bp, Homo sapiens
agttctcatacccttggttccttctctgtggggaaggcaggaggaagatgcccctcctcgcccagagcagggatcagaatgtgggacct

SEQ ID NO: 6765574 - DNA, 70 bp, Homo sapiens
tcctgggcggttatgtgatctggtgtgggaattttgtggaccactttttcacatacagcaggcctaagga

SEQ ID NO: 6765575 - DNA, 73 bp, Homo sapiens
ggtagaacttaaagtttttcacagtacaaagtaggctgattgtttaccttctctgtaagaaatcagttttatc

SEQ ID NO: 6765576 - DNA, 59 bp, Homo sapiens
ccctttggcatttccaggatatgcacactttcactgtcctgagattattgcccaaaggg

SEQ ID NO: 6765577 - DNA, 81 bp, Homo sapiens
gtacggcatacacacttctgctgccgcctcggcacagaccctctgtgcagccccaggggcggtagatcctagtgtccgtgc

SEQ ID NO: 6765578 - DNA, 79 bp, Homo sapiens
gcaggatcaattctggagcttggcttgtatgtcctacatcactaatgggaaatgcaggagagagcctaggactgttagc

SEQ ID NO: 6765579 - DNA, 94 bp, Homo sapiens
ctttggttgattctgatgtacacagatgcttgagaatctttgcagtagggaaactgaatcagaggttaagtaacttgctcaaagtcatttagag

SEQ ID NO: 6765580 - DNA, 58 bp, Homo sapiens
gaggcatggtagatgggtagcactgtgctggcacaccctaccctcactcccattcctc

SEQ ID NO: 6765581 - DNA, 63 bp, Homo sapiens
tacaggaggctacaggagacgccaggagtaaaacgacctattctgagtcctgtagtctctgta

SEQ ID NO: 6765582 - DNA, 73 bp, Homo sapiens
gatggagaagcccagggcgtggccgggctcagaagagctctgtcgatttacggttacttcttaggctgccgtc

SEQ ID NO: 6765583 - DNA, 70 bp, Homo sapiens
ggcaaaatatagtgtgatgaaatcattcctgttgaatgactaacaggatgagaatatcatattttttgtt

SEQ ID NO: 6765584 - DNA, 62 bp, Homo sapiens
ggccttccatctgcctctgttttgttttgtttctcagactctttagatggatgagggtggcc

SEQ ID NO: 6765585 - DNA, 93 bp, Homo sapiens
gtcaggaggtctctcagctctctaaggtcttgcttttagctctaacagagaggaggtaggggccttaaagatgcatgggagcccccttttggc

SEQ ID NO: 6765586 - DNA, 127 bp, Homo sapiens
gatatttaggcttggtattcactattcatgtttcctaactattcacaaggtgggactatctagcagagtttgtggtgtgggaaacagagaatagaaaatattatttaacactgtagcctattgtatc

SEQ ID NO: 6765587 - DNA, 62 bp, Homo sapiens
tgtcagagctggaggcaagttctgaaaccaccagagccagccttctcagcttacaaatgaca

SEQ ID NO: 6765588 - DNA, 69 bp, Homo sapiens
ggaaccagcaggcagtcaggggaaggccactcctaggggcctcttctctgtggcctggtggtgatttcc

SEQ ID NO: 6765589 - DNA, 79 bp, Homo sapiens
gtaaagatcagtccttggccttcttgtaggcaaaagggttctgttctgtatgcctatgattaggggtgccaggcttcgc

SEQ ID NO: 6765590 - DNA, 83 bp, Homo sapiens
cccctgccaaccaatggtgctggtgctgggtgtgtttcatggccctgcccagcaggcctcatgcaccagctaccatgcagggg

SEQ ID NO: 6765591 - DNA, 86 bp, Homo sapiens
gtctgggtaaggggagtttgcctattgcttttggggtgcccaaagtggggtcataccagcagcccaagcacacaccccttccaggc

SEQ ID NO: 6765592 - DNA, 70 bp, Homo sapiens
gaggcatgaacagattcttcatttctgatagacagtacagtctagaggtctgatatttgttgtatgaatc

SEQ ID NO: 6765593 - DNA, 97 bp, Homo sapiens
acttgaacattgtacatgtgatgtgggcatagatagtatatatgtatttataatatacatacatgtatgcacatacatgcatgtacacacacagagt

SEQ ID NO: 6765594 - DNA, 70 bp, Homo sapiens
ggtggagagctggatgagaggtgcgacgaactcacaggtgatgttcacagccatcaccaagctcttcccc

SEQ ID NO: 6765595 - DNA, 94 bp, Homo sapiens
tgggaattaaatgaaagtcatggaaaatcttggaaccatcatgattatgaaagaaaattcttgagataattctatgtctgcagtttgctttcca

SEQ ID NO: 6765596 - DNA, 79 bp, Homo sapiens
ggccaatccatatatatagtttatatagaatgtctctttacaataactgtatgcaataataactatgtggctgttggct

SEQ ID NO: 6765597 - DNA, 129 bp, Homo sapiens
gttacataagtaaatacatgtacagaatgctaaaacactacctggcacatagcaaatctcaacaagtgtgagccactattatgtgccaggtactatgttgaaggttttatatgctttaactcatttaat

SEQ ID NO: 6765598 - DNA, 112 bp, Homo sapiens
acagtgtccaggtggagtacttgagtttaatggggccctttgagctaacttgcatttcaggcttattaggattgcatgaactcagttggcctgtactttacttgaccattgt

SEQ ID NO: 6765599 - DNA, 58 bp, Homo sapiens
gtcactggtcgggtgtggctgttaggccttggctgctgcagcgccctctgaccttgat

SEQ ID NO: 6765600 - DNA, 59 bp, Homo sapiens
tttgggaaatagtagaaaatgtgattaaaggcatacataatctgagctgtgttcccaga

SEQ ID NO: 6765601 - DNA, 123 bp, Homo sapiens
ggatatagcactagccaggacataactctactcagcagcatttaagtttcttctacttctaaggatgaggtacaagttgcagaaagttgttttgatttggtctgaattcctattgttgtattc

SEQ ID NO: 6765602 - DNA, 73 bp, Homo sapiens
gcctccaggagcaccaggcctgtgcccttccacgtcttaagaggaggcttcagtgactggtgccctcaaaggc

SEQ ID NO: 6765603 - DNA, 67 bp, Homo sapiens
ggcatgtgatgcagaagactgagaacaaccaagaatctctgggaagcacttatctctggcatgtgcc

SEQ ID NO: 6765604 - DNA, 64 bp, Homo sapiens
ctgtgtagaggagacagagctgcagcagcaggaacagcagcatgagacctgtagcttcacagag

SEQ ID NO: 6765605 - DNA, 58 bp, Homo sapiens
cagagtcttgtgtgttcagccccagactgagaagggctgaaaacacacaaggactctg

SEQ ID NO: 6765606 - DNA, 63 bp, Homo sapiens
tttcccccagtttttggatcttatagttccacaggacaagatacatctaagagatgggggaaa

SEQ ID NO: 6765607 - DNA, 71 bp, Homo sapiens
ctaagatgcaggaaggctcacccaggtgctgcccacctgggaggtacccaggcacgccttgctgatctggg

SEQ ID NO: 6765608 - DNA, 87 bp, Homo sapiens
cttgtaggagctgtctgtagggcacaggaggttcggggtagggattttatgtaggtcatctacagacagaaaactcacttttacgag

SEQ ID NO: 6765609 - DNA, 55 bp, Homo sapiens
cacttttgattttttcccagaagaaaatatttcatccaggaaagttttaagagtg

SEQ ID NO: 6765610 - DNA, 122 bp, Homo sapiens
ttagcagctggaaagagagagtggcctttgactgagatagtgtgtgaggatgtcttctgaaaccatcctaagaaggaattacagtttatccaggaagagcgagttcttgagagagctgttaa

SEQ ID NO: 6765611 - DNA, 130 bp, Homo sapiens
agactgcaccaaagtggggagagatcaaaagaccccgttttcagactgaagattccaaacctgtacttggaacaactcttcttgagagatgggtggctagtctgtgtgcctctctgcaactgctgcttat

SEQ ID NO: 6765612 - DNA, 91 bp, Homo sapiens
tttaaatttggttaaattagattaggtctctaattgtcaggatggagagttataaagtccatataagacggaggcaaatcggccatttaag

SEQ ID NO: 6765613 - DNA, 55 bp, Homo sapiens
gaatgtcagttgcgggcatttcaaacagaataggaaagagcccgctgagaggttc

SEQ ID NO: 6765614 - DNA, 66 bp, Homo sapiens
aagatttaccactttattcaagttttagttatccataaatttgtgaaagtaaagtggtggcatttt

SEQ ID NO: 6765615 - DNA, 103 bp, Homo sapiens
agtgtctaaaacaaacaaatactgattcaactaactctattatttgaaaaacctattcttgtttcagatgattagaatagtattttaggaatttgtggatact

SEQ ID NO: 6765616 - DNA, 78 bp, Homo sapiens
tagccaacagagttgaaaattaagtgaatttcaagtgaagtcaggtgaagtcattccatattcatgactcgatgtcta

SEQ ID NO: 6765617 - DNA, 77 bp, Homo sapiens
gactctcagagtagcacagtgcttctcagatgggggtgattttgcaccccagtagacattttgcaacatctggagtc

SEQ ID NO: 6765618 - DNA, 63 bp, Homo sapiens
agactggagttctcacacttgccagttgtgagataaagggcaagtggtagaacatctgagtct

SEQ ID NO: 6765619 - DNA, 77 bp, Homo sapiens
ggtctcgcctcactatggcagcggcatggcacagcacactcgacttcatgctcagcgccaaagctgatggcgagacc

SEQ ID NO: 6765620 - DNA, 67 bp, Homo sapiens
ctagtctgtgatgtcagacatctggtattgagtatggtcagtgtctaaaaactatatcataggctag

SEQ ID NO: 6765621 - DNA, 76 bp, Homo sapiens
ttttcattaggaggaagggtagcataatgtagcttgagtgagctccagccctgcccattctctcgttctgtggaga

SEQ ID NO: 6765622 - DNA, 63 bp, Homo sapiens
tagccagggtctaataaacggccacttaagaataaaagcaccaagaagccctttccttggctg

SEQ ID NO: 6765623 - DNA, 85 bp, Homo sapiens
tcaaggcttttagaatcttatttctaataatatatcccccaaaacccctaggataatgtttagaaaattaggaaaagagttttga

SEQ ID NO: 6765624 - DNA, 66 bp, Homo sapiens
gttgggttagttaactgtagctgccatagcagggaaaccctgataatgtcagtggtttaacacaac

SEQ ID NO: 6765625 - DNA, 62 bp, Homo sapiens
aacttcatctacttcagtctactgattttacagataaaaatcctgaggcaaagagatgagtt

SEQ ID NO: 6765626 - DNA, 60 bp, Homo sapiens
ttagaggtagtgtatgtgaaactttccaaagcactttttgcttgcatattttacctttaa

SEQ ID NO: 6765627 - DNA, 60 bp, Homo sapiens
gaggacaccatggtcccagcctccacctctcatctccctggccccagcccatgggttctc

SEQ ID NO: 6765628 - DNA, 57 bp, Homo sapiens
gtgaactgttctggtaactctacatcatacctatgtaacatatcagaatgtgtttac

SEQ ID NO: 6765629 - DNA, 95 bp, Homo sapiens
tacataaataaaggctttaattatctacaggagtagtaaaggctaatgatgtagctgtctttgagtaataattctgccttaaaattgtttgtgta

SEQ ID NO: 6765630 - DNA, 108 bp, Homo sapiens
gcctggacacaaaagccatgagtccctggccagcctgtcgatgccctccctcaggtcaggtgtgtaccgcaggctgcccttgtgtggcttggacttttggtcacaggt

SEQ ID NO: 6765631 - DNA, 80 bp, Homo sapiens
tgcatcttacagatgaagtttgcctagagcttttaattgactagttagctcaagttttcaaatattatttgtggattgta

SEQ ID NO: 6765632 - DNA, 69 bp, Homo sapiens
gttgctttgctctcttctctcctgcagaattttgtgtagctcccccaagaggaatggtttgcaaagcac

SEQ ID NO: 6765633 - DNA, 81 bp, Homo sapiens
ggttgaatctcttgaatctctgttttctcatcagttaaagaggcttaaaggggcataacagggattcaatgaggtcatgcc

SEQ ID NO: 6765634 - DNA, 72 bp, Homo sapiens
tgaaagcaaatgtgggtgcagaatttctgaggtgccacaggaaactttccacagccacatgctgtgctttca

SEQ ID NO: 6765635 - DNA, 110 bp, Homo sapiens
catcaactcacacgtgaggaatttaagaggatgaatctgtgtatccccttgtgcaggcactcacactcacagatactcggacctcttctctctcacctgtcccttgcatg

SEQ ID NO: 6765636 - DNA, 67 bp, Homo sapiens
ttcttgaagactaagcggttcttttcaatttttgggtattcagaaagggttgcctggttacagagaa

SEQ ID NO: 6765637 - DNA, 56 bp, Homo sapiens
cctgcacagaccaaagaggacagcatgcctttgtacttgaggtccaaatgtgtagg

SEQ ID NO: 6765638 - DNA, 89 bp, Homo sapiens
agcaccatttgatggtttgaggattcatgtcagaattcaaatacatctctgaattcaaatgaattcttaaatatatgccattatgtgtt

SEQ ID NO: 6765639 - DNA, 82 bp, Homo sapiens
ccctcagggaatagcaactttggctttgttcttgggattttggtgaaatcagagtagaattgagccagggtcctggttaggg

SEQ ID NO: 6765640 - DNA, 104 bp, Homo sapiens
ggagggagctagggcgatgggaattgccccttggccgttaaaacagttctgtaagagctgtgggggaaagggggcagtccatagcttgtaggcctcaaccttcc

SEQ ID NO: 6765641 - DNA, 78 bp, Homo sapiens
ggtgcccatctgctattatgtctccagtgcccagcacactccagtgcccagcacagaaccagacatgaggcaggcatt

SEQ ID NO: 6765642 - DNA, 75 bp, Homo sapiens
gtcagtgctgtggaggcagtcagtgtggttcataaagcaagcattgttaatgggcctgactctgacagcagtggc

SEQ ID NO: 6765643 - DNA, 89 bp, Homo sapiens
ccctgggcattttcttggagggacagatggctaggctgatggttcctgcaagcccagacatagagtccttcaaagccgcaatcccaggg

SEQ ID NO: 6765644 - DNA, 59 bp, Homo sapiens
cttggtcttgggagcagggacaggatagtcagagttcccctccatgcccaggcaccaag

SEQ ID NO: 6765645 - DNA, 58 bp, Homo sapiens
ctcctggcaggctgagtgaaataaaggacttgttatttcatctcgaggcctaccggag

SEQ ID NO: 6765646 - DNA, 70 bp, Homo sapiens
gggggccacatctaagccaattttgatttcgcctataatgagtgccgggcgaaggctggagaaggcctct

SEQ ID NO: 6765647 - DNA, 74 bp, Homo sapiens
aaatgctcagcaggatgggaagaactcaagaagatcttcagtttatttcttgttccacattctgttaactattt

SEQ ID NO: 6765648 - DNA, 78 bp, Homo sapiens
ctatgttccatgactatgcatgaaacaagctgtcactgtattataaaggctcagcaattcattcatggcataatatag

SEQ ID NO: 6765649 - DNA, 61 bp, Homo sapiens
ataaatcagcatagctgtgtttcaataaaactttattgacaaaaacaggtggttgaagtat

SEQ ID NO: 6765650 - DNA, 55 bp, Homo sapiens
ctccagtctagtagagcctgcttgattgaaattgattagctctagatgattggag

SEQ ID NO: 6765651 - DNA, 72 bp, Homo sapiens
tactgttttacagtgatagagagtagctatgagaaaatttcaaagtaatactaaatatcacctagaaaagta

SEQ ID NO: 6765652 - DNA, 80 bp, Homo sapiens
acacagtcgtgattagaatttaactgatggttttgtattataacttctaagacctgccagaatgctagtcctgagagtgt

SEQ ID NO: 6765653 - DNA, 55 bp, Homo sapiens
tgggaagcctagcagacagctgcctgcatacattcaggtctgctgggttctccta

SEQ ID NO: 6765654 - DNA, 88 bp, Homo sapiens
gcttccaaagtacataataagtgatgatgagtcactctaagccaggtagtcacctcacatcccttataaagtgaacttacatgtcagt

SEQ ID NO: 6765655 - DNA, 106 bp, Homo sapiens
ctgtcctctggtgagctagggccacctggattccatgtgtgctacaccctaggggaagaacgccaggatgtctacgtggccttcaaggagaaccctgagaagacag

SEQ ID NO: 6765656 - DNA, 94 bp, Homo sapiens
aggagcttcccagtcctttgagccagttctgagtattccccaagccccacctaccccgcccagggatcccagaatgggaaggactgcagttctt

SEQ ID NO: 6765657 - DNA, 80 bp, Homo sapiens
tggaaccttattaaaatgatgatgtagacatatattcaattatatggaagcaaaatacattaatttttaaaaggttgcta

SEQ ID NO: 6765658 - DNA, 86 bp, Homo sapiens
ggcttcccggaggtggcggccacacgatggccaagatttaggggtctggtggcgggcagggccgtcacccgcagtccgagggggcc

SEQ ID NO: 6765659 - DNA, 84 bp, Homo sapiens
gtttaaaaaaaattctaagctactaattaaagggaaaaaaattatactcttagtagttctagaggctgggaattattttcaaac

SEQ ID NO: 6765660 - DNA, 67 bp, Homo sapiens
aggaaaagcattttgccacttgaagttaaggtgtgattcaaattacaggatggcagagtcaattcct

SEQ ID NO: 6765661 - DNA, 88 bp, Homo sapiens
tgtggctgtggagaggcactgcttagatcttccttcaagagaagttgttgcaagggaagtagtgggcagacaatctccagtggccaca

SEQ ID NO: 6765662 - DNA, 125 bp, Homo sapiens
tattacctcatcctaggctcatgtctgtatctgggagcctgtggatgtctgactggtgtaggaacccaaagcagtgacccatatgcttgagcaaagagaacagagatggctgaggttaggctgta

SEQ ID NO: 6765663 - DNA, 105 bp, Homo sapiens
gcacataaatgcagggtacctttccttcccgttattgcccttgggtgtctggctgcttaggatgcccatttgccagatggggagagtgaggcctgtagaaggtgc

SEQ ID NO: 6765664 - DNA, 76 bp, Homo sapiens
tggggtggcctctggaagctgaaaaaaagcaaggaaacagattctcctttacagcctccagaaggaacaagcccta

SEQ ID NO: 6765665 - DNA, 66 bp, Homo sapiens
atctgagttatttgagggaagagatattcctttgtcagcttttcattcccagcacctagcacaggt

SEQ ID NO: 6765666 - DNA, 63 bp, Homo sapiens
gttaaagttcccagagctacctagtggtagatgacctgctaagtaaatcgtgggaggtttaac

SEQ ID NO: 6765667 - DNA, 62 bp, Homo sapiens
gggttgttttagtcttgatgtgttagagagtgataattttatgcaagttatgattaaaaccc

SEQ ID NO: 6765668 - DNA, 79 bp, Homo sapiens
accaagatagtctgaagtttagagtgttgtaatttactatggggagagggcacaagactctgagccccaagcaattggt

SEQ ID NO: 6765669 - DNA, 82 bp, Homo sapiens
ttgttcttagagtttcgggtgtttttctccagtcttgttactgtagactgtagaaagcacgggccccaggctctgagcttag

SEQ ID NO: 6765670 - DNA, 86 bp, Homo sapiens
ccctgggactcgtgactctctggcctgttggcctgggctctgcttttcagagctgaagttcagtccagagaagtgatggtccaggg

SEQ ID NO: 6765671 - DNA, 76 bp, Homo sapiens
gactggctcggctctgtcctcagcactgctgttctctccaactgagttcttcagcatgctggacagcctgtctttc

SEQ ID NO: 6765672 - DNA, 85 bp, Homo sapiens
cactctgatggctgcctgtggagtgtagatgctgggttaggatccttcagtgctcacaaagcactcctagaagccaggcacggtg

SEQ ID NO: 6765673 - DNA, 114 bp, Homo sapiens
aagtgtactgtatataaaattagaggttacatttcatgtttaaatacttccagggatataaatcagttatctgtaaataaatgtgtgtagccatctgtgtgtgtgtgtgcattt

SEQ ID NO: 6765674 - DNA, 69 bp, Homo sapiens
gttagattggttaagtattacatataatgatatatagttatacagtgtactatttagcagtcatctggc

SEQ ID NO: 6765675 - DNA, 61 bp, Homo sapiens
ggagctggctacagagaactcctccgttaaggagcctctctccaaagggccctttggctcc

SEQ ID NO: 6765676 - DNA, 127 bp, Homo sapiens
acggaacaccaccaggctcgtctttttgcgtcaattcacccaatagctgtttgaagtccaagatgggcttccaggggctgtgggctgaggaagaggctctggggcaaggcttggtgggatgaacagt

SEQ ID NO: 6765677 - DNA, 84 bp, Homo sapiens
gagaggaagaggtctcagaggaaaggagatatgtcgtatacaaatcatgtacagcacttaattaccttgagatttattcatttc

SEQ ID NO: 6765678 - DNA, 71 bp, Homo sapiens
gacaagtcctgccacctataagcctccgtttccatgtctatacactggggttcctagctcacgggactgtc

SEQ ID NO: 6765679 - DNA, 88 bp, Homo sapiens
ttcagcttccaaagatctcagatgcccttgcatcacctccctgaagagggtgggtgaagctttggtgtctgaagagaatttggctgga

SEQ ID NO: 6765680 - DNA, 130 bp, Homo sapiens
gataagatagatttaacatgcagcatttcccatacttagttctctccggggtctttccttcaagaagcatctccttgaaggacagcatctccgagcacacttttggaaatgctgaattaatctctctgtc

SEQ ID NO: 6765681 - DNA, 118 bp, Homo sapiens
tccagttcctccccacacaagctctggcacttagattcctggtacctccgctgcttcatctgtaaaatggagtaacaataggaatactttatagagttgtaaggattgagtggctgga

SEQ ID NO: 6765682 - DNA, 69 bp, Homo sapiens
atcctgttctgtataaacatattttcaagtttgtcaaaactggatgtgcactgtctgtactgaactgat

SEQ ID NO: 6765683 - DNA, 58 bp, Homo sapiens
gcacagatggtactagcttggttttcctatttatatgattaagtatgtactatcttgc

SEQ ID NO: 6765684 - DNA, 80 bp, Homo sapiens
ttggagagtttgtacttcattggttctactttgtctgagagcagatggagccctaaagtgaagctattattatttttcaa

SEQ ID NO: 6765685 - DNA, 56 bp, Homo sapiens
gcctagacttggagaggtggaaggaacatttcgtttttagggaccaggtcataggc

SEQ ID NO: 6765686 - DNA, 77 bp, Homo sapiens
gtgggagaaggaagccaggagggtgcagagggtgcaggcagaattccctgcatcagctgtgcttcttgactccccac

SEQ ID NO: 6765687 - DNA, 57 bp, Homo sapiens
agaaaggaggaagaatgacctcatgctgaaaaggaaccttcaatctttcttcttttt

SEQ ID NO: 6765688 - DNA, 61 bp, Homo sapiens
ggagaggcttccagagtcgtgcctctgctcagaggccaaaccttccccaccaagcctctcc

SEQ ID NO: 6765689 - DNA, 66 bp, Homo sapiens
gtgactagatccacaggaaccaaaacgcagtttccaaaagctcgagtgactgaaggatctatacac

SEQ ID NO: 6765690 - DNA, 70 bp, Homo sapiens
agaggttgggcagaggtgtgtctctggctctcctgggtgagtcagcacagagttgctcactgccgcctct

SEQ ID NO: 6765691 - DNA, 71 bp, Homo sapiens
gctccccaactcccagctcagggctttccctggtggacagtggaagcctaagagtagggagcctggcaggc

SEQ ID NO: 6765692 - DNA, 56 bp, Homo sapiens
aagcatggctgagtgcaatggtaccctcttattgaccattttgtattgtcatgctt

SEQ ID NO: 6765693 - DNA, 58 bp, Homo sapiens
aactgggagtgggccatgtgtatactcatgtacataaacacactacacattcctagtt

SEQ ID NO: 6765694 - DNA, 83 bp, Homo sapiens
accacagcaggtcgccgaagatagctcctggccagacactccactgctgggggcttggtggccatgaacatgactttgatggt

SEQ ID NO: 6765695 - DNA, 55 bp, Homo sapiens
caggaacctgctccaagaggcaagaatgaggcgatgttttgtgaggaggttcctg

SEQ ID NO: 6765696 - DNA, 65 bp, Homo sapiens
aggtaatgttgatgtagggattcctgtaaaataaagaattttcaggggtaatatttgcagtactt

SEQ ID NO: 6765697 - DNA, 76 bp, Homo sapiens
gataagggatcaaatcatgaaatctcttcagagaaagaaatctctggacagtagagcaatgattccatctttcttc

SEQ ID NO: 6765698 - DNA, 75 bp, Homo sapiens
tcacctggaagcttgttagaaacgcagagtattacattgtaacaagcagtccattgtaacaagttccctaggtga

SEQ ID NO: 6765699 - DNA, 55 bp, Homo sapiens
ccaatgtgaagtcaagggagcagccagcctgcctggactggaagcttcatgttgg

SEQ ID NO: 6765700 - DNA, 57 bp, Homo sapiens
aaacatttttcttcatcatcctgaaaccgagcagtgatgatccgctgaggaatgttt

SEQ ID NO: 6765701 - DNA, 69 bp, Homo sapiens
caattctttcagctgcatttgtggttcaaatagaagcaaggaatgctataaatgttctgacaaggattg

SEQ ID NO: 6765702 - DNA, 63 bp, Homo sapiens
tgggcctacgtgacagaaacatttgcaatcatgtcactgaaaatgtttgttttgctgggtcta

SEQ ID NO: 6765703 - DNA, 62 bp, Homo sapiens
tagtgtccagctatatgtgtatgtgtgtgtgtacacgtgcatgtacacacagctgtacagtg

SEQ ID NO: 6765704 - DNA, 80 bp, Homo sapiens
ctgagcaccctgtgtcagacctctgcagctgccaatgtcttcctcctgcagctgtggcaggtgtctggggcaggtgccag

SEQ ID NO: 6765705 - DNA, 80 bp, Homo sapiens
tgccccaggagtttcagaaattgttattattctcaaaacagttgtttaaagaatgtttttgatactgctgaagatgggta

SEQ ID NO: 6765706 - DNA, 91 bp, Homo sapiens
gcgtggccttcaatggccctaatgagttggtgttccattgatgtgcagcctcacggaacacccacccattgtgggcctatgagacgtctgc

SEQ ID NO: 6765707 - DNA, 64 bp, Homo sapiens
atttcactgcttgagctgcagctgggaaagcaattcttggcttctcaagttgcaagtgtgaaat

SEQ ID NO: 6765708 - DNA, 55 bp, Homo sapiens
gatttattgtccctgtcctgctgttggtgagcagtgtgacctttggcaatgcatc

SEQ ID NO: 6765709 - DNA, 86 bp, Homo sapiens
ttggccattcccccaaggaagaggcagtgccaaagtctcccatttggcagcatcaatccatgcttctcctagggagggatcgttgg

SEQ ID NO: 6765710 - DNA, 101 bp, Homo sapiens
ttattttaaaacagcaagtaaagaatttaaaatgatcagtaatctggtttaaaggactctgatgctaaaataattattttgagatttgttgtgtagaatga

SEQ ID NO: 6765711 - DNA, 85 bp, Homo sapiens
agaaggtttactctgagtccaggaagcatcatggtctatttatgataatagaaatttgtaggcatctggcttcaggtgaacctct

SEQ ID NO: 6765712 - DNA, 68 bp, Homo sapiens
gcttcaaagcagccggttccctggtctccctgggtgggctgggtccctgggggccggctgtgggaagt

SEQ ID NO: 6765713 - DNA, 81 bp, Homo sapiens
tgatttggtccctccctgcagctcaaattcaacatctgctctctttctctgttgtatgtggggggcaggaggggcttaaca

SEQ ID NO: 6765714 - DNA, 78 bp, Homo sapiens
gccagcctggagcctgtggccatgaggctagcctgccactgtgggcctgaagcctggtgctatgagggccagcctggc

SEQ ID NO: 6765715 - DNA, 59 bp, Homo sapiens
gctgctccgcagagtgtgtgtgccttctacacgcacgtgcagactgtgcggggtgtggc

SEQ ID NO: 6765716 - DNA, 63 bp, Homo sapiens
gcccaggtgttctttattatgtagtttttctccttgggcaaagcatggcatgaagaacatggc

SEQ ID NO: 6765717 - DNA, 58 bp, Homo sapiens
gctttggtcaggtgtccagccctggttcaatcaggtgttggggacaggaccccaaggc

SEQ ID NO: 6765718 - DNA, 67 bp, Homo sapiens
ggctatttgatctaagtcccagtgtaatcttatagataatcgcattgaaggacttccattataagct

SEQ ID NO: 6765719 - DNA, 61 bp, Homo sapiens
gggattggagagtggaacatgctggttctcctggagtggcagagtctctcctttccagccc

SEQ ID NO: 6765720 - DNA, 74 bp, Homo sapiens
atggtaagacttgggatgctcagagtcctgcagtttgaaggctagcaggaccctgagcatcccaagtcttccat

SEQ ID NO: 6765721 - DNA, 57 bp, Homo sapiens
tagaagtttggcgggagagataatttttacaaaatttgtaaatacctgccaattcta

SEQ ID NO: 6765722 - DNA, 74 bp, Homo sapiens
gacaaagtaactggtcctcggatgttgtggagttggtaaatagctctaatacaaggcaggaagcagtaactgtt

SEQ ID NO: 6765723 - DNA, 67 bp, Homo sapiens
ggtgggaaaacagaatgcaggggatgctgcccaagcctgggcgctcctgagggttctgcatctcacc

SEQ ID NO: 6765724 - DNA, 82 bp, Homo sapiens
ctgcaaattctctctctacagtgcctcctggaggcctttcaagtcttttgaattccagtggtagtaaagaggtcttttgtag

SEQ ID NO: 6765725 - DNA, 65 bp, Homo sapiens
gatgaccagctagaaatgggattggtatcctgaatgatatggagatattttttggttggtccttc

SEQ ID NO: 6765726 - DNA, 66 bp, Homo sapiens
gcatgtggtgggctggccactcggggctgcagttccaatttccaatgtctccagttcttcacaagc

SEQ ID NO: 6765727 - DNA, 82 bp, Homo sapiens
cagccatgcccatttgtttatatactgtctaaggctgcttttgccatggaacagtacagttgagtagttgtggcagagactg

SEQ ID NO: 6765728 - DNA, 80 bp, Homo sapiens
tggtcacctttggaatgagctcaaatggcaaggttgcattactgaatgaacctttgaggggagctctttcagaggtctca

SEQ ID NO: 6765729 - DNA, 69 bp, Homo sapiens
ctgagcaatttcagctctcactcagggataaatcaaaaattacctaaagtgagttgatggaaaactcag

SEQ ID NO: 6765730 - DNA, 98 bp, Homo sapiens
tcagcacctcctgctgtcagctacttagaatgtgaggccacactgtgcttggaacccaccctgggaagctaggcagcaggggtcagtccaattgctga

SEQ ID NO: 6765731 - DNA, 72 bp, Homo sapiens
atgtaccactaagctcagggaaatcagaattattttacatattcatttcccaatacgctaagtggagaacat

SEQ ID NO: 6765732 - DNA, 76 bp, Homo sapiens
tccctgcacagctggccagggagagcttgagcccataactccaattcaatcactctccctgccatctctgcagggg

SEQ ID NO: 6765733 - DNA, 76 bp, Homo sapiens
gtgagcatctattacatgaggggaaaagacatatcatcttgaactgtcattttctaatctgttgtcagtgactcac

SEQ ID NO: 6765734 - DNA, 59 bp, Homo sapiens
atgagataggggataccttagtatctattaccattatactaaagtatctcctatttcat

SEQ ID NO: 6765735 - DNA, 59 bp, Homo sapiens
tccagggctgttactttacatatttgttgagacccttcagtgttctgtaacagcctgga

SEQ ID NO: 6765736 - DNA, 79 bp, Homo sapiens
attgatgtcttattagcactgaagttggtattgaaatactgatgagagttagtgctagtaatcaagtcctgatattagt

SEQ ID NO: 6765737 - DNA, 75 bp, Homo sapiens
tattctacttattgttgaactgaatcaaggcttttatggaaataaatgtgatggtagtttatcaaaaagagggta

SEQ ID NO: 6765738 - DNA, 64 bp, Homo sapiens
gtttctattatggtacttatcatgatactgtttatcatgcttttatagttttatagtggagcac

SEQ ID NO: 6765739 - DNA, 73 bp, Homo sapiens
tcttatttgtttggttaaaatcaaattaatcagggcaagttccctgaaagatgactttgaaagagaaatgagg

SEQ ID NO: 6765740 - DNA, 55 bp, Homo sapiens
actgactcacaatactgcaatttgagaatgctatatgcagaatcctgtgatcagt

SEQ ID NO: 6765741 - DNA, 82 bp, Homo sapiens
tattttgaactgaaggcaactgagaaaaagcagatacaagaaaaattttctgccttcttcctatttgcctaaagacaaaata

SEQ ID NO: 6765742 - DNA, 62 bp, Homo sapiens
gaaactgtgatcgtgttctggggaatgtcccttttcccattcaagtgtatgatcatattttc

SEQ ID NO: 6765743 - DNA, 58 bp, Homo sapiens
ggaaatgtaattctcttgaagattcttcccaaaggatttgacagagcatagcatttct

SEQ ID NO: 6765744 - DNA, 56 bp, Homo sapiens
atgtatggggtgtatgggatcatcatatcttaagatgatctcatattgccaggcat

SEQ ID NO: 6765745 - DNA, 84 bp, Homo sapiens
aatctgttataagctccaggtgatttgaggtaccctgaaatttgagaaccactaccttaagacatccgttgcttataatgaatt

SEQ ID NO: 6765746 - DNA, 103 bp, Homo sapiens
ttccatgcttcactggctcaagaacagtttgccaaattggtggactactttgccaatccttgctagcttttttagagatcagaaaatgaaaaccctgctggaa

SEQ ID NO: 6765747 - DNA, 90 bp, Homo sapiens
gttggtcaggctggtctcaaactccttgtgatctggttgccttggcctcccaaagtgctgggattacaggcttgagccaccgtgcccagc

SEQ ID NO: 6765748 - DNA, 76 bp, Homo sapiens
aaatggctaactaagctgccctgggaaatcagagggaattgattacctttggcacttggcagttgagttggatttt

SEQ ID NO: 6765749 - DNA, 84 bp, Homo sapiens
agcattcctgcagttcatgtatcatgtatccaaacaaaaggctcgaactgcaggaatacatgatacatgaactgcaggaatgtt

SEQ ID NO: 6765750 - DNA, 77 bp, Homo sapiens
aattgggaataatagtacttatctctgtcattgtgatcatacagtgaatactgtatgtgctatttcctagcctaatt

SEQ ID NO: 6765751 - DNA, 90 bp, Homo sapiens
tcgtcttcctcctcgtggtcctctatgtcgtccgtccagaaccaggctcctgaaggtgacaaaggcaggccagaagagagaggtaagtga

SEQ ID NO: 6765752 - DNA, 117 bp, Homo sapiens
gggctgagctgctctggcccctgctgccctgatgtagaaggctctgagctgccgtcagggaagagtcacggagctcagaacctcctcatcccactaggaccccaagcagcttggccc

SEQ ID NO: 6765753 - DNA, 65 bp, Homo sapiens
ctgcagggccctctggcaggccaggcccggctcctttgtctgcctcagccgggggccgcccgcag

SEQ ID NO: 6765754 - DNA, 77 bp, Homo sapiens
gttaccaatgcggtttacatgtactcattatactagatgtaagaataacaagttgctatgggtatatgtaatgtaac

SEQ ID NO: 6765755 - DNA, 73 bp, Homo sapiens
ggtgatacaagtaactgactctagacagtcctaagcatcagacccagatggtaactgtttagtgttaatggcc

SEQ ID NO: 6765756 - DNA, 81 bp, Homo sapiens
ccaggcagggcccggcctggggccaagagtgcagggcctctgtttagaggctcctgcaggccttgtagggttccagcctgg

SEQ ID NO: 6765757 - DNA, 71 bp, Homo sapiens
gggagccaggaggtggtttccaggcacagggataaaggaaaatcctggctaatggcatttcctgggtgccc

SEQ ID NO: 6765758 - DNA, 59 bp, Homo sapiens
tccactacgtggtctgaatgtgtctgaagaaaaacagagcacagataacatggagtgga

SEQ ID NO: 6765759 - DNA, 84 bp, Homo sapiens
cctggattttgaagtgtatgggaaagcagaagacttatgattgaaatattctacattgctttctaatacatcttactgatatgg

SEQ ID NO: 6765760 - DNA, 60 bp, Homo sapiens
gtgatgggggcaggatttgaatttcaatatatccaacttcagaatccagtctcttattac

SEQ ID NO: 6765761 - DNA, 63 bp, Homo sapiens
ctgggtacattgacacatgtaaaataacagtgcatacatgctgtcctgtctttgtcagcccag

SEQ ID NO: 6765762 - DNA, 62 bp, Homo sapiens
tctcctttacctgtcaggatatttctgccaatcccaggaaagtgtctaccggatgagggaga

SEQ ID NO: 6765763 - DNA, 63 bp, Homo sapiens
gtgtgccaacaaaagacagtgcctcccaaccttatttcagggcttcactcgtagttggtatgc

SEQ ID NO: 6765764 - DNA, 130 bp, Homo sapiens
cgctccacagggcatggatgggcacctgggggagaggccacggagtagctgaggcctgggaagcccagaagcctgggatgtctggctcatctctccaggtaaacccccaggcccagcccaggagccccag

SEQ ID NO: 6765765 - DNA, 58 bp, Homo sapiens
gtctggtgatacctgcgtcccacaggcttagagcctattagggcagatgtcccaagat

SEQ ID NO: 6765766 - DNA, 83 bp, Homo sapiens
gcgtggctggctgcgttctgcctggcggcctagtgtcatcagcccagaggctgggccactgctgcggaaggcgccggcctcgc

SEQ ID NO: 6765767 - DNA, 78 bp, Homo sapiens
ggccacaaggagcagagctgggatcctgggtctggcaccgctgagggcccatgaccctagccaactgccctccatgcc

SEQ ID NO: 6765768 - DNA, 71 bp, Homo sapiens
gtatatgtacagctgccttttttacttcatcgagttaacattgacaggtagtttgcatgctgtatgtgtat

SEQ ID NO: 6765769 - DNA, 60 bp, Homo sapiens
tgttttccacacagtagtcatgcaaatacctttttaggatgtatacacgtgttgaaaaca

SEQ ID NO: 6765770 - DNA, 82 bp, Homo sapiens
ttcatttgtaaaaagggtcacaaagggtgtttctataatttatattcctagcatacaccctaaactgcttaaagcaaatgaa

SEQ ID NO: 6765771 - DNA, 68 bp, Homo sapiens
gagggggctctgtccacgtaggtgccggcacaagctgaggacatgagtgggacagaggaaccagcctt

SEQ ID NO: 6765772 - DNA, 63 bp, Homo sapiens
gctgatgtaagacttttggttttcaattgaatttaggaaacttggggctttcttacattttgt

SEQ ID NO: 6765773 - DNA, 77 bp, Homo sapiens
ttcatattggagtttgtttctgacctgtgacagtttgtaccaggaaaaaacctcagaagcagatatttcaaaatgga

SEQ ID NO: 6765774 - DNA, 57 bp, Homo sapiens
gtggcatgttcctttgcaatattttatttgcagaaaatatgtatgcctacatgctat

SEQ ID NO: 6765775 - DNA, 83 bp, Homo sapiens
cttgggaattatttgcatgtttcatagaaacagttattttgaaaactggacatttctagaaagcagctgtttttaatcttggg

SEQ ID NO: 6765776 - DNA, 79 bp, Homo sapiens
gcctgggatagaaatttagaacaaggttggatgttggtgatcatataaaaatagatttgttcttttttgtcattagagc

SEQ ID NO: 6765777 - DNA, 59 bp, Homo sapiens
aagacagccagcttgatgggatccgcgttgtgtgcaatcaccaccagctgagctttctt

SEQ ID NO: 6765778 - DNA, 76 bp, Homo sapiens
atgactgggggtaggttgcttaacttctgtttccttatctatgaaatatccataagcacatctatgtcctagtgat

SEQ ID NO: 6765779 - DNA, 57 bp, Homo sapiens
gagctgggcctgcgagtgctgccccgacggggcctgctccacatcgaggctcagctt

SEQ ID NO: 6765780 - DNA, 77 bp, Homo sapiens
gcatgcccattttgagagctgctgagactgtcctggtatttctcagggccttcaggataggtctcttcagggcctgc

SEQ ID NO: 6765781 - DNA, 81 bp, Homo sapiens
gtattcctttcctctctgagtgggtattaacaagattagcattaatgggaattaaattggtttagagaggaacacatatgc

SEQ ID NO: 6765782 - DNA, 65 bp, Homo sapiens
caggcccagggttattgggaaaataaccaaataaatggtcaactatctaaatagactctgacctg

SEQ ID NO: 6765783 - DNA, 58 bp, Homo sapiens
gtgaaacagtagtctgtgggtttcaaatcagaggccattaagcaaactgctgtttggc

SEQ ID NO: 6765784 - DNA, 99 bp, Homo sapiens
atcctttaggtgtgttggagtttagaaatgattgagctgtaatacttttccagagtattgctcctacagtcaatttcgagttccttaagccctattgat

SEQ ID NO: 6765785 - DNA, 73 bp, Homo sapiens
ggaggaagagttggtctgaggttgcaccacaagaagtttatatgcacctgacctacctgaagtctacacctcc

SEQ ID NO: 6765786 - DNA, 58 bp, Homo sapiens
atgatttctaggttaggggtgtagtgaaaggttagacttctataaatttgggaatcat

SEQ ID NO: 6765787 - DNA, 64 bp, Homo sapiens
ggacacctacctgggcctttctgccatgcggcaccataaaaataagagatgcctgtgggtgtcc

SEQ ID NO: 6765788 - DNA, 75 bp, Homo sapiens
cacatcttaatcttccagcgattattgaaatgtctgttccagcggcaattcaatggttgctgagactatacagtg

SEQ ID NO: 6765789 - DNA, 58 bp, Homo sapiens
gccctggagggccagcgactggagggtgagtgattcccaggtctggaaccaccagggc

SEQ ID NO: 6765790 - DNA, 58 bp, Homo sapiens
caagatactcagaaaggcattggggcactctccaataatttttaatagagtcattttg

SEQ ID NO: 6765791 - DNA, 75 bp, Homo sapiens
ggtacatggagaggccggggttaggagtggggcttgcctgcctccagacaagctcgcctgccccggaacagtgct

SEQ ID NO: 6765792 - DNA, 63 bp, Homo sapiens
ggcaagggttgaagataaataaggtagcaatgtctactttatatttttggccttaattatgcc

SEQ ID NO: 6765793 - DNA, 80 bp, Homo sapiens
gagagacatgaaacccagccgtggtcctgaggcaggcatgtgacagctgggaccagagctcgggcttctcatgccctctc

SEQ ID NO: 6765794 - DNA, 60 bp, Homo sapiens
accccaggcccagggaagaggctgggctaggagacggtctcgtctggggaggcctggggt

SEQ ID NO: 6765795 - DNA, 100 bp, Homo sapiens
caactttattttattttccctttatgagaatttgtcagcaggaattgtgaaaagtgattataatattccttgttgtaggtggaaaatggaaaaggagttg

SEQ ID NO: 6765796 - DNA, 81 bp, Homo sapiens
cttgtagtcaaggccagagaggcaaatcctagcatccctcctgggaatggtattggggacctttctggccacggctttggg

SEQ ID NO: 6765797 - DNA, 56 bp, Homo sapiens
ccagagtggctgtcatgttgtctacataaagcaactatattgaaagccacctctgg

SEQ ID NO: 6765798 - DNA, 80 bp, Homo sapiens
caggcggtcgcaggggctgagcaccagcgggtacaagcgggactcagatccagccccttgggcttcagccctaccgcctg

SEQ ID NO: 6765799 - DNA, 63 bp, Homo sapiens
gaaggcaggggaccctcactctatgctgaaggggctgggggctgagattggtgccctgtcttc

SEQ ID NO: 6765800 - DNA, 129 bp, Homo sapiens
gttgtatttctttgggccattttcttgtgtgataacagtttatgtaaatgtccagcagtccttaattgctgtttatttttataagtgttaagccatatttacaaaagtcagtgacacaaggttttctgc

SEQ ID NO: 6765801 - DNA, 71 bp, Homo sapiens
gctgcagcagaaatggattttgagatttaataaatgcatatttagactctgcttccacttttgctaacagc

SEQ ID NO: 6765802 - DNA, 68 bp, Homo sapiens
agctggatggtcttggcagcatacagttggattggcagaagtaatcccaagggctgctggcttcagtt

SEQ ID NO: 6765803 - DNA, 98 bp, Homo sapiens
cctgcacacagcatcagtgttctgtcaagctgtcacagtgcagttaaccacgctggctcacagtacagtgctggctccactgagtctatgtcttcagg

SEQ ID NO: 6765804 - DNA, 71 bp, Homo sapiens
tgcttctccttccatcatgtgctgaaagtagttgcttctttagaactattgcatagaaggaaggagtttca

SEQ ID NO: 6765805 - DNA, 121 bp, Homo sapiens
ctagggcactgtcaaagctgggggcccttggtctaacagaggggtgccttcaggactctcccctcctgcaagagctgcctgaagccatccctcagatggccacccacacccagagccccag

SEQ ID NO: 6765806 - DNA, 59 bp, Homo sapiens
cctgggcataaatcactccaagcgtaaatttcccatgttttggagatcacgtgtccagg

SEQ ID NO: 6765807 - DNA, 97 bp, Homo sapiens
cttattaggccttcagtctagtatccttcctgactttcagaagtggaagatactttcaaagtcaagaaggatactagacttaagtagtctagtctag

SEQ ID NO: 6765808 - DNA, 103 bp, Homo sapiens
agtggtagaatcgctgagtcacttggcaagtatctataaagtttgatttactgtgtgtttaagtttgaggaattgccaagttttccaaagtggttgtatcatt

SEQ ID NO: 6765809 - DNA, 60 bp, Homo sapiens
ggccacagattaggaaatgaggggagagaaatgctcctgtcttaatgatctcgtgcagcc

SEQ ID NO: 6765810 - DNA, 129 bp, Homo sapiens
agtgggagtgccaatactgggttagatgtggaccctctttttttatacgctcaatcctatcatcttggcaatccaagaggaaaagggtagaagacaggtttcatattccttaaggcagtttcctttact

SEQ ID NO: 6765811 - DNA, 74 bp, Homo sapiens
tttatcagaagcagaacactagatttaaaggctttccaaagcctaatgagtaagtccagtgttctctctgtgaa

SEQ ID NO: 6765812 - DNA, 60 bp, Homo sapiens
cttggaaggccctgcctagcaggccctgagcccacttgcagggtttgagggcctcccgag

SEQ ID NO: 6765813 - DNA, 83 bp, Homo sapiens
agtgaaataatacaagtgctaatttccctcaatatctgttactaaaatgatcattggaaataggccttgtacagaatattgct

SEQ ID NO: 6765814 - DNA, 73 bp, Homo sapiens
gccgagcgggagatttatggtggcgtttgctttcattatgtgtggaggctgcctcgtgagctcgctgcgtggc

SEQ ID NO: 6765815 - DNA, 74 bp, Homo sapiens
gagagtgagtggtggagtttgggttttgaacacaacgtgttgtcttcagggcctgagcttttaattaccacctt

SEQ ID NO: 6765816 - DNA, 102 bp, Homo sapiens
ggaatgattacgtagctctagggtgacttcaaagatatcctaatactgtctagcactttgaaaaatggtttcctagatacctatgatgatcgcaggcattcc

SEQ ID NO: 6765817 - DNA, 88 bp, Homo sapiens
gcgcagacggtctgtacttggctggttttgagtatgtgctggtgcggctcctgcacaccctctcaccagcactgcagctgcctggagc

SEQ ID NO: 6765818 - DNA, 72 bp, Homo sapiens
gctgtcattcctaatcctcacaacactgcaagatgggttgtattcttattttacagtggaggaaagtgaggc

SEQ ID NO: 6765819 - DNA, 80 bp, Homo sapiens
ttgggaattccttgggtatttttcacagttcactgctttgtagcatgacacagattagagacataccaaagaactctcag

SEQ ID NO: 6765820 - DNA, 64 bp, Homo sapiens
tttaagttggctgttgctatagtttgatgttcagccacttgcaatcttggctagctaacataaa

SEQ ID NO: 6765821 - DNA, 89 bp, Homo sapiens
tacctgagagcttgttagaaatgcagaatcctaggccctgcttcagaacttacagatgcggacctgcattttaacaagatctccaggtg

SEQ ID NO: 6765822 - DNA, 74 bp, Homo sapiens
tcttattttaatgttgaagatgctgaccatgtggtgattctttactattaaatactcttcaaattgaagttaga

SEQ ID NO: 6765823 - DNA, 60 bp, Homo sapiens
atatgcatgcatgtaccccacctttagagcctctgatgtgattggtctatgcatgggtat

SEQ ID NO: 6765824 - DNA, 81 bp, Homo sapiens
atcccaggggagatgtgtccccagaggattgaaggggagatggtccaatttacctgtgtaagggattacttactctgggat

SEQ ID NO: 6765825 - DNA, 84 bp, Homo sapiens
gggacagggtagttctagagctctgctactcaaagtatggtccttggcctcacagtttcacagtgtagatatgccctctgtccc

SEQ ID NO: 6765826 - DNA, 56 bp, Homo sapiens
cattgtaagctgttgaatcctcctgctaagactagattgattctcagtgtacagtg

SEQ ID NO: 6765827 - DNA, 105 bp, Homo sapiens
agcccgatatgtttcctccatataagtacagctgcactgtcacattggtaagtatgcagctaggtggtggtgggttgacatggaggttgttttgattttgtggtt

SEQ ID NO: 6765828 - DNA, 87 bp, Homo sapiens
gctaggacaagtgccaattagagacatccatctgggggcctggcagtggcagagagctgaggaggtgtctataatggtacttccagt

SEQ ID NO: 6765829 - DNA, 57 bp, Homo sapiens
cacaccatatgattccatttagaaatcctagacaaggcgaaactaatctatggtgtg

SEQ ID NO: 6765830 - DNA, 65 bp, Homo sapiens
actctggcactgggtacctcagggagcatgcaatattgttttctggaggtactcaggcacagagt

SEQ ID NO: 6765831 - DNA, 82 bp, Homo sapiens
ttacaaagtttaaggtggcactgctaaagatcatttattttagacattcctatcttaataagtgccctttacaacttcttga

SEQ ID NO: 6765832 - DNA, 76 bp, Homo sapiens
taggcaaggcctaatcatactgctaagtgacacatagtataggtgctattagatgtttgactgggccttatgtcta

SEQ ID NO: 6765833 - DNA, 58 bp, Homo sapiens
tcagctggaagatggtgcagaatcctaaggtagggtcctctgcagtgcttccaggtga

SEQ ID NO: 6765834 - DNA, 56 bp, Homo sapiens
ggcccctggaaatgagtgcctgggctttcttctgtccagcctcagatcagggagct

SEQ ID NO: 6765835 - DNA, 72 bp, Homo sapiens
gactgaggaggtggagtcatgcagaggggctgaaagttttacagcagctgctgatgaggccaccccacggtt

SEQ ID NO: 6765836 - DNA, 76 bp, Homo sapiens
gtgttgtaagacttcccagaagaatcccatttggtggagtttgtttattggaaggagtctttggggatgacaaggc

SEQ ID NO: 6765837 - DNA, 102 bp, Homo sapiens
ttgagacagagtctcgttctgtcaccaggctggagtgcagtggcacgatctcggctcactgcaacctctgcctcccgggttcaagcgattctcctgcctcag

SEQ ID NO: 6765838 - DNA, 73 bp, Homo sapiens
aactgagtcattcgcacaagggaatggctagctgtatcagtcacattcatggtgctaataaaagagctcagtt

SEQ ID NO: 6765839 - DNA, 127 bp, Homo sapiens
gaattgagggactgtagaatttactttctgcttctgtattttgggcttgaatctgggacaatgatcttttccctcagctggagatgagaaccgaacaacgaaagtagtgcctgctgtgccttcagtc

SEQ ID NO: 6765840 - DNA, 77 bp, Homo sapiens
gctttgtctaaaatgagtttaatgatatttatatgacagggttatgatatgcgttaaatttctaattttgagaaagc

SEQ ID NO: 6765841 - DNA, 67 bp, Homo sapiens
gccgggctctccagaatatgccgccgtgggcttcggcctggcagcagggcccctggaggagcctggc

SEQ ID NO: 6765842 - DNA, 58 bp, Homo sapiens
atgccattattaggactgaatcttcagatttcattaatttagtaaatattaatggcat

SEQ ID NO: 6765843 - DNA, 72 bp, Homo sapiens
gcgcggagctacaggggggagcatggggcagcccccaaggcgcgctccctgcatttcccaccctttccacgc

SEQ ID NO: 6765844 - DNA, 62 bp, Homo sapiens
caagccattagtcattttagaatataaatggaatttcatgttcctatgactgattggtcttg

SEQ ID NO: 6765845 - DNA, 70 bp, Homo sapiens
gccaatacactttatagaagaaaaagaggattattgcctcctggcgaatttcttttgaatagtgtgtggt

SEQ ID NO: 6765846 - DNA, 58 bp, Homo sapiens
tgtgatctgcacaattgtgtaggtaggtactattattattcacaatttacagatgaca

SEQ ID NO: 6765847 - DNA, 72 bp, Homo sapiens
cttagatctttaattttctcatctgtgaaatgggaagtcctaacagaaaatggagaaaattgtggatttagg

SEQ ID NO: 6765848 - DNA, 55 bp, Homo sapiens
gaggtgagtggctggagcccatagcttcctactctaaggcttccctactcacttc

SEQ ID NO: 6765849 - DNA, 62 bp, Homo sapiens
ggagaagcctgttgagagggccgtgaacatcatcatggtttattagctgcacaggcttttcc

SEQ ID NO: 6765850 - DNA, 77 bp, Homo sapiens
tggctgtctatgagccaggaagaaggccttactagcaaccaaatctgctagaaccttgatcttggacttctcggcca

SEQ ID NO: 6765851 - DNA, 56 bp, Homo sapiens
ttcaggaaattggagtccttctgccccacggtgtgaaggtactttaagttccagag

SEQ ID NO: 6765852 - DNA, 55 bp, Homo sapiens
ggtctacagtgtttggtttgaggattccatcctcaatcggccagcacagtagtcc

SEQ ID NO: 6765853 - DNA, 55 bp, Homo sapiens
caggccagaagccagaaatgctttaatgttgccaacaaagtatgcttttggcttg

SEQ ID NO: 6765854 - DNA, 109 bp, Homo sapiens
tacacataaaacactgcctacataacactgccaaactgtacacttagagatcttaaccatctctaagtgtacagtttggcagtgttatgtaggttcacattgttgtgta

SEQ ID NO: 6765855 - DNA, 99 bp, Homo sapiens
ttgaatgttgcatcaggcactagagttgcaaaagattctccgtcaatcagaaaggggcaggagaatgatatatagctcagtgagatgatgtaaactcaa

SEQ ID NO: 6765856 - DNA, 72 bp, Homo sapiens
gatttccttttctctttcaatctgcagtactttttatgaagactggtcttttgtgatggatgaagagaggtc

SEQ ID NO: 6765857 - DNA, 102 bp, Homo sapiens
aagcattctaatagtgtaggcatctacattcatgttgaaatttgtgatcaatattttaaaaattcacaatgtgtagtcatgcttttctaatagtaatagctt

SEQ ID NO: 6765858 - DNA, 88 bp, Homo sapiens
tcctccaggtcgcccacggtggccaacctggccctgaactcgcaccaggtgacgtgcaggatctggttggcgatgtagccctggatga

SEQ ID NO: 6765859 - DNA, 58 bp, Homo sapiens
actggccaggagctggaaatacattgagtaaaacagacatagctctagccctggaggt

SEQ ID NO: 6765860 - DNA, 69 bp, Homo sapiens
gtgattgtcatagcttcatgggtagcatgtctgtattgggaaggctatttccaaagctgctgttctcac

SEQ ID NO: 6765861 - DNA, 75 bp, Homo sapiens
tagactagcagtgactgtcattctagtgcccatggctaaatggctgtgggatacgtgtgacatacaagttagctg

SEQ ID NO: 6765862 - DNA, 60 bp, Homo sapiens
ctgggcactttggggagcctaccactgagcctagacagtgcccccagcctgggtgcccag

SEQ ID NO: 6765863 - DNA, 55 bp, Homo sapiens
tgccctgtatcccactgtttcactcatcttccccagtgaacgatgtctcagggca

SEQ ID NO: 6765864 - DNA, 60 bp, Homo sapiens
tgcagcaggtatggcaagctccctcctagcaccatcagagagagcgtagccctgctgacg

SEQ ID NO: 6765865 - DNA, 62 bp, Homo sapiens
ctggtgaggccagtggtctgagataagtaatgtaacttgcaaatagccctggccatcatgag

SEQ ID NO: 6765866 - DNA, 64 bp, Homo sapiens
ttatctgtctatcaagactagcaacttgtgcaacagcattaagaaagagtggatggataggtgg

SEQ ID NO: 6765867 - DNA, 58 bp, Homo sapiens
ggaaaaggaggaatgtagccagctccccactcaggacgcttcctcatttctcttcacc

SEQ ID NO: 6765868 - DNA, 81 bp, Homo sapiens
ctggggatcttgttaaatgcagattttgatttagtagcctgtggcatggcccaaaattctgcatttctaataaactcccag

SEQ ID NO: 6765869 - DNA, 106 bp, Homo sapiens
attttcctttgcaatttggccactggaggtgcctagatgagctctttctccccaaagctgctgagagtcgtgaggcagtttccccatcccactgcagctggaaaat

SEQ ID NO: 6765870 - DNA, 60 bp, Homo sapiens
agtgctcataactcacatgcagagatcttagaattagatgtcttccatggttttgacact

SEQ ID NO: 6765871 - DNA, 65 bp, Homo sapiens
agacctcaagaattgcccagggcaagagccaagcaccgcgctctgggttctgatttatgagcgct

SEQ ID NO: 6765872 - DNA, 95 bp, Homo sapiens
tgggagctgggggatgccaggtgggaggaaagcagagatggaacaagatgcaaaaccaataattctccccgttcctctccctgcccctgctgtta

SEQ ID NO: 6765873 - DNA, 56 bp, Homo sapiens
gctttcttttcaagaatgtatttccatacttcttttgggtttctagaaaagaaggt

SEQ ID NO: 6765874 - DNA, 56 bp, Homo sapiens
agagccaggcggctgggcaccttcccccaccttggtgtgtcgaagctcctgtctct

SEQ ID NO: 6765875 - DNA, 66 bp, Homo sapiens
agtttaggaaggatgaactgagtttgccttgcactgagtcactagacagtttatctttccggagct

SEQ ID NO: 6765876 - DNA, 89 bp, Homo sapiens
gtgcccttacaacagagtggacgtatgtgcttcattttctgatatattagtaaatctgagaaatattgtccaggttgtataggatgtac

SEQ ID NO: 6765877 - DNA, 74 bp, Homo sapiens
aagtaatatctgttggctttggaaataatattatatttagtattatatttaatggaagttagcagatttagctt

SEQ ID NO: 6765878 - DNA, 118 bp, Homo sapiens
caaatatttcacgatggttttaaatgtcataagtgtgagttatgtccctgctcacctccccttctgatttgagcagatgtctaacttttacatgagatcagaataatctgattgtttg

SEQ ID NO: 6765879 - DNA, 57 bp, Homo sapiens
tgcctggcccagggctccgcaggggtggatccagccctgggtcaccaggcccaggca

SEQ ID NO: 6765880 - DNA, 83 bp, Homo sapiens
cacattgcaggaattttttgcagaaagggaaaaaactaaaaaccttcatcctttggcctctgggagaatattccttttatgtg

SEQ ID NO: 6765881 - DNA, 61 bp, Homo sapiens
gatgttctgctagtggctttgggatacacacagttcagcagataaggcacaggagaacatt

SEQ ID NO: 6765882 - DNA, 88 bp, Homo sapiens
gccttctgtggccctaatgtgttggacagcttctactgtgaccttcctcggcttctcagactagcctgtaccgacacctacagattgc

SEQ ID NO: 6765883 - DNA, 60 bp, Homo sapiens
atttcattgttagctctgtcctctccacttgcatttcaggccagagcagtacaatgaggt

SEQ ID NO: 6765884 - DNA, 68 bp, Homo sapiens
aatgcaaggacctttgagcgtgccagcactctttatcctctctgcttggtgctgtgttgtcctgtatt

SEQ ID NO: 6765885 - DNA, 111 bp, Homo sapiens
ttctctggagagtcccagctctgctttcctggaagggttgctctttggaccctgctggatctctgagtgatggccagggcagcccccaggtgcactgggaagttcagagga

SEQ ID NO: 6765886 - DNA, 60 bp, Homo sapiens
catcattaccttgtaaccaatagttcaggatcctgaggtagctggctatagttagtgatg

SEQ ID NO: 6765887 - DNA, 84 bp, Homo sapiens
caaagggccctggctggcaccaggcatgctgggagaggggagagttatccttggagctattttcctggatgtcaccgtgttttg

SEQ ID NO: 6765888 - DNA, 120 bp, Homo sapiens
caagtattgccatttataaatgcctgagctggagtgagggaccatatttgtgaaactgcaagatgtgtcctcaaatcagttctccctttcttcagctgtgcatctacgatgcatttcttg

SEQ ID NO: 6765889 - DNA, 67 bp, Homo sapiens
gacccatgctattaaggctgcataacaaactgccccatggcctagtgccttaaacagcatcggagtc

SEQ ID NO: 6765890 - DNA, 65 bp, Homo sapiens
ctggaaatccagatgagggtaccagaatggtcaggttctggtgcgggttttcttctggattgtag

SEQ ID NO: 6765891 - DNA, 87 bp, Homo sapiens
aggccagtgactctgccctctgacctaggacaaggacctgcctccgtcctctgagaacacctggcgtccaagggaacacgtggacct

SEQ ID NO: 6765892 - DNA, 107 bp, Homo sapiens
agatgtgggtgcatgaactttggctgcattttgggttcgttaacagagcaaagaatttgccagtgaagccccgatgcgttttgccccaagtaccttgcccttcattt

SEQ ID NO: 6765893 - DNA, 85 bp, Homo sapiens
ggctgttgacagagtgttgaccataagcccattaaacagaaggtggaaccgcaattgtggtcaaaggctccctcccaagatggcc

SEQ ID NO: 6765894 - DNA, 72 bp, Homo sapiens
ccctggaggtcgggcccttttcagtcacatttaccatctcctaaattcactgcctggcctggcctcactggg

SEQ ID NO: 6765895 - DNA, 113 bp, Homo sapiens
agtagaaccaccagctatgattttcaaatgttacgggttatcttttattgatgcattttcaagtgtcagtctcatttctgtacatgagttgagaatcatgttagttatttact

SEQ ID NO: 6765896 - DNA, 64 bp, Homo sapiens
ctgggcttttggatttttgtaaagctcccacatgagcctgttgcatgtgattcatagagtccag

SEQ ID NO: 6765897 - DNA, 78 bp, Homo sapiens
aagattctgataatgttgccatgttgcagtaacacttttaggcttagcactgctatacagcagcttactagttatctt

SEQ ID NO: 6765898 - DNA, 55 bp, Homo sapiens
tatttttattatgttgcttaagttaatataaacttagtgcattttaatagagatg

SEQ ID NO: 6765899 - DNA, 81 bp, Homo sapiens
ggttttctgaagctctccagtttgtttctcctgatgtgtaggtttttagagtgaaatattgtactggagatgttgaaaacc

SEQ ID NO: 6765900 - DNA, 88 bp, Homo sapiens
tatgacttctaagatacagggaatgggacataaatcccagagcccaccaaggtagggagtccacatgcctgtatcccaaagaattata

SEQ ID NO: 6765901 - DNA, 62 bp, Homo sapiens
gctgtgattgctgcttgcctttctcactgagttgttaaaaggctgaaggagttgtcatatgt

SEQ ID NO: 6765902 - DNA, 88 bp, Homo sapiens
tcaaagagcctggacctgggctctgagccctgtacaaggatgagaagcagaggcagcacttcaggtttttgtccaggtttgatcatga

SEQ ID NO: 6765903 - DNA, 62 bp, Homo sapiens
gtgggagcggcccgggccacacggcttcaggatgaggccgtttgtttggcccttgttcccgc

SEQ ID NO: 6765904 - DNA, 65 bp, Homo sapiens
cagctggtgctctgggccctgaggagagtgaaagcccttggtggtgcagccctgggcaccagatg

SEQ ID NO: 6765905 - DNA, 72 bp, Homo sapiens
gtagagacggggtttcaccatcttggccaggctggtcttgaactcctgaccttgtgatccacccgcctcagc

SEQ ID NO: 6765906 - DNA, 81 bp, Homo sapiens
tgcgggctggggctgcggtggaggagccaagggttgatgcactgcctgacctgccctccggctcctcgcccccagcccgta

SEQ ID NO: 6765907 - DNA, 61 bp, Homo sapiens
ccgtgttatataattcctgtggtagtctatgtggaagtaccccaagagttgtgtagaatgg

SEQ ID NO: 6765908 - DNA, 72 bp, Homo sapiens
gggagccctttcactgggtggatgagcgtctcccacatttctactcccttgcctctgtgctaaagggctccc

SEQ ID NO: 6765909 - DNA, 80 bp, Homo sapiens
aggcttggaaaacagggtttcacccacacacaccatgttgtaaaaaggtgccatgttttgcttctctgtttcccaaccct

SEQ ID NO: 6765910 - DNA, 71 bp, Homo sapiens
cctctggacactgctttagccttgacagagacagtcagtgttgctgcagggaccacaagcaggttgtgggg

SEQ ID NO: 6765911 - DNA, 70 bp, Homo sapiens
cagggagcggtagccactgcctgcattccttactcaggaggcaggcatggggtctgccattgcttacctg

SEQ ID NO: 6765912 - DNA, 65 bp, Homo sapiens
agaaggtgcacacagccccacggtgagcaaagggaaacctcagagctcctaagggctgattttct

SEQ ID NO: 6765913 - DNA, 55 bp, Homo sapiens
ggaggctctgctccgtgtgttctttactcaaggacccacactgacaagagtttct

SEQ ID NO: 6765914 - DNA, 59 bp, Homo sapiens
aaaatgtgatctacaaatgcaagccacatagaggattgtaaattttgtagtcacatttt

SEQ ID NO: 6765915 - DNA, 79 bp, Homo sapiens
cttataccacaggtgagtttgctattgtacacctctgtgaataatgcagctttgtaggcagcacacctgtgcaaatgag

SEQ ID NO: 6765916 - DNA, 58 bp, Homo sapiens
tgtccacctaatccatcatagtataatacaaagagatacaaagggattggggtggata

SEQ ID NO: 6765917 - DNA, 118 bp, Homo sapiens
ggagtttagaaacatgttgcttaacacttgtgagaaaatgattgcacagtctctattagaatctcattagcatacgtgctccatttttttgagtgtagacttacaattgtaaatctcc

SEQ ID NO: 6765918 - DNA, 61 bp, Homo sapiens
ttagactcgtagtaactggatgtctgcccatttccccttggcatttattgctataagctga

SEQ ID NO: 6765919 - DNA, 114 bp, Homo sapiens
ctaaggtgacatcatgccaaggcctcctgatggagaggaacattttctggaggaaagttttgacctttagaaaggaatcttcatttcaagcaggcttttggcttccagccttag

SEQ ID NO: 6765920 - DNA, 74 bp, Homo sapiens
ctcagggaacaggggttcaatgatccagtggggcccaatctgtggagcctcttgacagcctctgtttccctggg

SEQ ID NO: 6765921 - DNA, 65 bp, Homo sapiens
atcccagtgggtgtgaagtgctatttcattgaggttttgatttgtacttaacaccgactaatgat

SEQ ID NO: 6765922 - DNA, 78 bp, Homo sapiens
ctggctattagcctaaagtggaatcaagaaactattctgtcttgtctttccctctaagctttagatttagtgagccag

SEQ ID NO: 6765923 - DNA, 69 bp, Homo sapiens
gtctttgctgttcttcagactccatttatagagaatgagggctgataacaggaatacagtggcaaagac

SEQ ID NO: 6765924 - DNA, 61 bp, Homo sapiens
ttactgtgtgaccctgggtaggttactctacctctctgatcctccctttctcatacggtaa

SEQ ID NO: 6765925 - DNA, 76 bp, Homo sapiens
ttcagggaaattaatgactggttggagttaatggactaaggagcaagcccttccaggcagtcattaatctctagaa

SEQ ID NO: 6765926 - DNA, 80 bp, Homo sapiens
cctaattctgccttcttggccacttccctgagagcacatctgacacactatcatggcttcaaggaagcaggcagaatggg

SEQ ID NO: 6765927 - DNA, 94 bp, Homo sapiens
agagtttcagttttacaagatgaaaagagctatgaatatggatggtggtgttggttgtgcaatattattaatgtatttaatagcactgaactct

SEQ ID NO: 6765928 - DNA, 94 bp, Homo sapiens
cgaggctgctggccagagacagtctacacaggcattgcagaaaagtagctcaattttgctgcctaacagaactctttccagtcatgcagtaacg

SEQ ID NO: 6765929 - DNA, 59 bp, Homo sapiens
gcgcgctgaggctggaggcgcacgagaagttctcgtctggcttctccacggtaaagcgc

SEQ ID NO: 6765930 - DNA, 75 bp, Homo sapiens
ggctgtttggagagttctgctgtgtctcagcaggttttcagtaaagctgtcatgggagagcttggaaagcagacc

SEQ ID NO: 6765931 - DNA, 92 bp, Homo sapiens
ttagtggcttataggttgcttgtttttgccttctctacagttatagctagtgaaagtcaaagacagctaccttcccctctcagagtcattga

SEQ ID NO: 6765932 - DNA, 87 bp, Homo sapiens
gatattcactcagcaagaaaaccacctcccatcaagcagcctcctggataatgtttaatgaagatggtttttcactgctgacatgtc

SEQ ID NO: 6765933 - DNA, 64 bp, Homo sapiens
ggagaactagaacgagaaagctgaactgggcaagtcagttgccttctatgattctcagtcctcc

SEQ ID NO: 6765934 - DNA, 69 bp, Homo sapiens
taatgagtgagtataatgtttcaactatgcaaaatgaatgagttctaaacattctactgtactgcattg

SEQ ID NO: 6765935 - DNA, 59 bp, Homo sapiens
ggcccaaggcccaggtcgagctcctcgtcctcgtcggagtctgggaggggtgttgggct

SEQ ID NO: 6765936 - DNA, 78 bp, Homo sapiens
cagccttaaggtgaaagctgagcagtgattcccagggctgagcatgttgggatgtgtgctgcttagtccactaggctg

SEQ ID NO: 6765937 - DNA, 65 bp, Homo sapiens
tgtctggagtggtggatttaaaggggacactgatgagtcatttctatcccccattcccaaaggca

SEQ ID NO: 6765938 - DNA, 56 bp, Homo sapiens
cgctggggcctgaacagtcagctgaatcagcctcctgcattttgtgccccacagtg

SEQ ID NO: 6765939 - DNA, 118 bp, Homo sapiens
ggtggaggtagaggttgaggttatgtatggcaggatacccagtccggcttccagttggatcaaggcatctgggtttcttgacccatcccacttgactctttcatttagcccttccatc

SEQ ID NO: 6765940 - DNA, 113 bp, Homo sapiens
gtggatgagaatgatgtataaatttgagtacttttgattaaaatatgaagttattgttggttcaacaaatgcaagttttatgtcaaaggaaatgaaaacaatgtttgctccac

SEQ ID NO: 6765941 - DNA, 95 bp, Homo sapiens
tcggcctcctgacgtcagtgaagcttttactggcctagacactttggccttgggcccagaaagcatcattgtggacagcccagacctgaggctga

SEQ ID NO: 6765942 - DNA, 86 bp, Homo sapiens
ggttggcggatcgcaggggttgagagaacgtatgctgttttgtagacccgcggccagcagcagggctctgcccgtgcatccgctcc

SEQ ID NO: 6765943 - DNA, 55 bp, Homo sapiens
tcatcaggatagaaatgagacacatcaatgtgttccttcaaactgtcattggtga

SEQ ID NO: 6765944 - DNA, 130 bp, Homo sapiens
gagccacccacattcctccaatctttttattgtaaatttctatccacttttcactaagatgaatttgtttacagtttatttttgataagtcttgcaatactttttggggagtgttaggggaaagaaactc

SEQ ID NO: 6765945 - DNA, 62 bp, Homo sapiens
atgtcacatgacacaaatatctatatgacaatgtagaatatgatgagtgtcatgaaagatat

SEQ ID NO: 6765946 - DNA, 61 bp, Homo sapiens
aggactaggggatgggccatatttgcaagatgagaaatgcagaggtctaagattctagctt

SEQ ID NO: 6765947 - DNA, 55 bp, Homo sapiens
atgcagggttatttcaaaaataacagctcttctgctatcaccagtgactctgcat

SEQ ID NO: 6765948 - DNA, 75 bp, Homo sapiens
ggtggaactggaggggaaaatggtagtataaccatattggtataaaatgcctacctttacttcaccacttccacc

SEQ ID NO: 6765949 - DNA, 94 bp, Homo sapiens
tctctaactgtttgtatactcatcccagagcatgaattaaatgtttgtgacttccgtttgactcttgctttggtggctgagtgtaattttgaga

SEQ ID NO: 6765950 - DNA, 99 bp, Homo sapiens
taaccattcctttttactttatttaaggaaagccaaaatgaatttgcctcagaaaagcaaatgttgacaatttcctgatgagaaaagaagggatagttg

SEQ ID NO: 6765951 - DNA, 72 bp, Homo sapiens
ctcagcttagtcaattataaataggcgataataatatctaccactgccagttttctgaggattaagtatggg

SEQ ID NO: 6765952 - DNA, 57 bp, Homo sapiens
tgttcagtgtaaacagtttggggtacagtacactcctcaggcaggtcccactgaaca

SEQ ID NO: 6765953 - DNA, 67 bp, Homo sapiens
tacacaatttctgagtaatgatgcacgagaatgctcaggtattcatagaattcagagagggggtgtg

SEQ ID NO: 6765954 - DNA, 92 bp, Homo sapiens
cttgtgaagttccttaaggaaggagggagtgtggccctgcagccctcccaaactgctccagcctatgctctccggcaccaggaagttccaag

SEQ ID NO: 6765955 - DNA, 61 bp, Homo sapiens
agctgttttcttgccgtcctagaatctattttgtaagagcttagttggggggaaaactgct

SEQ ID NO: 6765956 - DNA, 56 bp, Homo sapiens
tggggaagaataatgtatgtactctgagagtattcctgcaaaccattccctcccca

SEQ ID NO: 6765957 - DNA, 66 bp, Homo sapiens
ggtggctaaggtgtccctcttgctggagagggttttctccaagggctcatggacacttttctcacc

SEQ ID NO: 6765958 - DNA, 64 bp, Homo sapiens
aatgaatagtgtggaatggtaaatcctaacaattataggtaagacttggtccacattagtcatt

SEQ ID NO: 6765959 - DNA, 67 bp, Homo sapiens
ttctgagaccttggggagccctgttggcttctttctcggccaaacggagtcagcatcaagggaagaa

SEQ ID NO: 6765960 - DNA, 90 bp, Homo sapiens
gagatcaaggttcatgttttcgttattcaatactttatcaccaggactccccacagtgatgaattagtaacaaatgaggaatctggcctc

SEQ ID NO: 6765961 - DNA, 129 bp, Homo sapiens
gagaaatacttggcatgctgtgaatttggcctaggcagcagtactcaatatcctggcaggagagaaaactccctaatttgagtgtctgctgtacaccaagtttccattatatcaatattcctatttctt

SEQ ID NO: 6765962 - DNA, 100 bp, Homo sapiens
cttggcactccaggaggtcactttcaattggtcaggactggcatgtggaatgaagcccactttccatacctgtatcagatgagcctttctagagtctaag

SEQ ID NO: 6765963 - DNA, 83 bp, Homo sapiens
aatagattttgtacttgctgaatgcaagttggatagctcaggtcaatgagcatccactgaagtatttcagcatcgtgcctgtt

SEQ ID NO: 6765964 - DNA, 63 bp, Homo sapiens
ttttagaatgttagcgttaaagggacctcatagatcatcttgtcccatgccatcattttaaag

SEQ ID NO: 6765965 - DNA, 75 bp, Homo sapiens
cctgtgccaggcactgctctaagccctgatggtgcacagaggtgccagggggcctggatggtggctggctccggg

SEQ ID NO: 6765966 - DNA, 56 bp, Homo sapiens
gagccgggactctctctgcctggccagacttccagcaaagggagagaccgcgggtc

SEQ ID NO: 6765967 - DNA, 56 bp, Homo sapiens
ggtgatgtgaccgtggaggcagagattggagtgatgtgcccacaattcacaatgcc

SEQ ID NO: 6765968 - DNA, 83 bp, Homo sapiens
cccatgttctgcttttttcacttaacatcatatcatgagcaagtttccttgtcattacacagttcagtggaaagagtgaaggg

SEQ ID NO: 6765969 - DNA, 79 bp, Homo sapiens
ctatggcctctttcagggctgagactctgtgatgatgatttcttattttgtccacacagaacagtaaaagatgccatgg

SEQ ID NO: 6765970 - DNA, 74 bp, Homo sapiens
ggagagaacactggacttggagtcagaaaactttcatccaagtcattccctgctctaagtcccatttctgttcc

SEQ ID NO: 6765971 - DNA, 76 bp, Homo sapiens
cctggaaaataggaaataattcactctggcttgaaaagggtggagatttctttgtttctttttatatttattcagg

SEQ ID NO: 6765972 - DNA, 74 bp, Homo sapiens
gcaagaagacgacagcagaagaagcaagccaaatggtttctttggctattcttgttgctgtgtgtttgttttgc

SEQ ID NO: 6765973 - DNA, 82 bp, Homo sapiens
gcctgtgcggcggcaggaagcgtcttgaggctccccaagactacctgaggggccgcccaagcacttcagaagcccaaggagc

SEQ ID NO: 6765974 - DNA, 69 bp, Homo sapiens
aacctcaagtccaacactaaaaagcctcaaaaagttaacatagggctttgctgaaggcctcttggggtt

SEQ ID NO: 6765975 - DNA, 63 bp, Homo sapiens
gtgcaaactttcagggacttagtgtcagtttctattagaaactgaaaatggtgtcctgtgcgc

SEQ ID NO: 6765976 - DNA, 61 bp, Homo sapiens
tcaagcactgttaggttgcttgctttgttttaaggtaggtcaccaataatagtttgctaga

SEQ ID NO: 6765977 - DNA, 65 bp, Homo sapiens
tatccatgttggtgattctaatgtacatggtcagaagaccacacattcagaaatgccagtggata

SEQ ID NO: 6765978 - DNA, 68 bp, Homo sapiens
ctggaggtaaaaggctaccacttatggtccccattttgctctcatgtgtcacagccttttattgtcag

SEQ ID NO: 6765979 - DNA, 71 bp, Homo sapiens
tgtctgagccctggagccctctgttattaataaacaagtacaaaagatcacaacctgctcaggctgagata

SEQ ID NO: 6765980 - DNA, 56 bp, Homo sapiens
aggtgggacgtgggaggatgagacaagtaaggactctctgagcccagtgtccccct

SEQ ID NO: 6765981 - DNA, 60 bp, Homo sapiens
taggatgacaacagttgtgagaacattccaatatatgcagttctaacagctttcattcta

SEQ ID NO: 6765982 - DNA, 83 bp, Homo sapiens
atttatttcagctcagaggaaagggaacatagtcaaaagactattaaaacatgtaatcctttttttctgataaatgtataagt

SEQ ID NO: 6765983 - DNA, 56 bp, Homo sapiens
gcagagatggctgcctctgagtcaccctccctccttgactcatctgccacctctgt

SEQ ID NO: 6765984 - DNA, 66 bp, Homo sapiens
tcgcactcaggactctcatcagtaagatgggaatactaatgctaccacatgagagatctgaggtga

SEQ ID NO: 6765985 - DNA, 70 bp, Homo sapiens
gttttatcattgaatgctctgcaggttgtccttgaatagaaggtgtaagttgcattattcatgaaaagac

SEQ ID NO: 6765986 - DNA, 79 bp, Homo sapiens
acttgtctttctgcacttagtggggcttcattttatttagaaagcccgatgacattactatttgtactttgaagaaagt

SEQ ID NO: 6765987 - DNA, 60 bp, Homo sapiens
ctcccgaggctttagaagaatataattgccgttctaagaagaatctgaggcctctaggag

SEQ ID NO: 6765988 - DNA, 78 bp, Homo sapiens
ggaagccgtgaaaggaaagtacagtgatgctcggtgttaatcaattgcctgcatttctgcttttgcctttcactttcc

SEQ ID NO: 6765989 - DNA, 60 bp, Homo sapiens
tcttccttttcaccctgtaacgtgggtattgcatgatccatgtttctgagaaaagtagga

SEQ ID NO: 6765990 - DNA, 64 bp, Homo sapiens
tagctcttagacaccatgactttgatgtacaaatcagctctttcttggcctctagctagagctg

SEQ ID NO: 6765991 - DNA, 58 bp, Homo sapiens
acctttgggaaagtgtcttttgtatttggcaaggggcaagagacagtttctctgttgt

SEQ ID NO: 6765992 - DNA, 61 bp, Homo sapiens
tcagtgcaggaatctctagccaaatcttaagaaacaccatggctggcaaaactgcaactga

SEQ ID NO: 6765993 - DNA, 63 bp, Homo sapiens
ggcattgccattccagggtattagggtattggggcctgaggcccctgaggatagcatgaagcc

SEQ ID NO: 6765994 - DNA, 121 bp, Homo sapiens
tgagtgttcttacatcttggctgaggtagataccagtacaccaatttccttgtttgagtcaattaagcagtgagccataagtgctagaatttattggcctgataaaagcaaggaatactta

SEQ ID NO: 6765995 - DNA, 62 bp, Homo sapiens
gctgcaattttctcttggatcttcactgtgcaatgccatagttagccattgggacattcagc

SEQ ID NO: 6765996 - DNA, 79 bp, Homo sapiens
gctgactgcagcctcgacctccccaggctcaggtgatcctcccacctcagcctcccgagtagttgagactacaggcagc

SEQ ID NO: 6765997 - DNA, 66 bp, Homo sapiens
cagccactggtgccaggctgttgtctgagatccgggcagagacggtgctgtcgctcacgtggtctg

SEQ ID NO: 6765998 - DNA, 104 bp, Homo sapiens
ggttgctgtaggcctttgttttctagagtgacaacaaagttggttctgacagtttggcttgtttattcagtgtttcagtttggaaatgagagcttggagcttcc

SEQ ID NO: 6765999 - DNA, 65 bp, Homo sapiens
ttcccgtgctgttcttgtgatagtgaggaagtctcacgagatcttttggttattataagagggag

SEQ ID NO: 6766000 - DNA, 84 bp, Homo sapiens
ggtcattggtagtttttggctgagcagtttttatggaaaacgcagacagaaaggctgccaggtaaaatatttttttaagggacc

SEQ ID NO: 6766001 - DNA, 86 bp, Homo sapiens
gctctacttatagaacataattctcagccctttggggagcatttggggctagattagatgggaaaatatgttcttggcagtatagc

SEQ ID NO: 6766002 - DNA, 56 bp, Homo sapiens
aggggcagttccaagttttgtgaggcctaaaaggtaaacaatttggagactctctt

SEQ ID NO: 6766003 - DNA, 55 bp, Homo sapiens
caacagaggagtggcctgatccgagtggcatttaacaaggttcactttcctgttg

SEQ ID NO: 6766004 - DNA, 57 bp, Homo sapiens
gatttcttgagcaagttgcttaacttgttttgagtttcccaatttgtaaaagaagtc

SEQ ID NO: 6766005 - DNA, 72 bp, Homo sapiens
gagtcctgtaactttcttcctaattgtcaattctagccatgaaagaatgtgggaaaagaggtgaaaggattc

SEQ ID NO: 6766006 - DNA, 76 bp, Homo sapiens
ggggtcaggaattatctgatgtgatgttcaggaagtagctttggcactgtcaagcagaagataatttaaaaccacc

SEQ ID NO: 6766007 - DNA, 121 bp, Homo sapiens
ggatggtcagccaggcgcggtggcttacgcctgtaatcccagcactttgggaggccaaagtgggcggatcacaaggtcaagagttcaagaccagcctggtcagcatagtgaatccccatct

SEQ ID NO: 6766008 - DNA, 62 bp, Homo sapiens
gggagagaataatgaacgtgagacaatcattacatcaccttttcctgtacattattctcccc

SEQ ID NO: 6766009 - DNA, 57 bp, Homo sapiens
gtcatttaaagaccattgtgggctagagagtagggcctacagaggagagggaaaggc

SEQ ID NO: 6766010 - DNA, 56 bp, Homo sapiens
tggccatgggatagtgcaggggtgtgtggcaggctagtgtcattgtcctgaggccg

SEQ ID NO: 6766011 - DNA, 66 bp, Homo sapiens
atgctcaatgaatgtactgtgatgttgttatgaaaaatgaggatagggtcatagattcaagagtat

SEQ ID NO: 6766012 - DNA, 63 bp, Homo sapiens
cggcgccgcctgctgatgagcggatctccggaccccccgccagcagcgatagggtgagtgccg

SEQ ID NO: 6766013 - DNA, 61 bp, Homo sapiens
ggcctgctctgcagcctctacaggcccacatggaggcagagactcccaggctgcagcagcc

SEQ ID NO: 6766014 - DNA, 59 bp, Homo sapiens
caggaagcaccagcccggccccatcccaccatctgctctgggtgcccttctgggtcctg

SEQ ID NO: 6766015 - DNA, 76 bp, Homo sapiens
tcaactggttttccagctagtaagcacctgcatcctgagagaacaggctaagatgagactgtgctgtgagcgttga

SEQ ID NO: 6766016 - DNA, 77 bp, Homo sapiens
caagggaagtgaaggtttgagtctgaacaggttccaaaatggattgtgcaaaacctcaggcctccctccttcctctg

SEQ ID NO: 6766017 - DNA, 74 bp, Homo sapiens
aaggagtggggttgaggtttgcatttggccatttcaaatcacacatcatgtcaaccacagtcccatgtctcctt

SEQ ID NO: 6766018 - DNA, 73 bp, Homo sapiens
attctgccacacaattactgctgctatgtgctcttcagttgcactttattagctgtagtaattgtagttgagt

SEQ ID NO: 6766019 - DNA, 55 bp, Homo sapiens
ttttgtcagttgactttgggagctgaggtcttcccaggtcctgggactggcagag

SEQ ID NO: 6766020 - DNA, 66 bp, Homo sapiens
gtggcaatgtctgaaaatcagactgcagtaaaagtcttggtgcatctgattctcaggcagaaatac

SEQ ID NO: 6766021 - DNA, 58 bp, Homo sapiens
caaagtgctaggattacaggcgtgagccactgcgtctggccgcctggcctacattttg

SEQ ID NO: 6766022 - DNA, 129 bp, Homo sapiens
aaatgggcggtggagaatgctctgtgctggaggacagagcctcctggaggtataggctgcaaggtgcagggccaggaagcctgtgtctctggacatcagggaacagctctcccacaactggtcattcat

SEQ ID NO: 6766023 - DNA, 67 bp, Homo sapiens
gccttcccacattctttacattcataaggttttccaccagtatgaattttctgatgttgggtaaggt

SEQ ID NO: 6766024 - DNA, 87 bp, Homo sapiens
tactgtggttcagggactgtcctacatggagaggtccagtacctggactttggggtctgatagtcctaggtttgaatttcacgtgtg

SEQ ID NO: 6766025 - DNA, 122 bp, Homo sapiens
cttcacagagctggtgctgtcaaggatcaaatgagattatgtatgtgaaatcaccttgaaaaggatttcacagatataagatttcaccacagatataagacattattgcagctgctgtgaag

SEQ ID NO: 6766026 - DNA, 73 bp, Homo sapiens
gtgatggggctggctttgagggttggagatcacacacacacaatcagccagctctccaaagcaagccccacac

SEQ ID NO: 6766027 - DNA, 117 bp, Homo sapiens
ggcgctggggctggcgctggggctggggctggggctggggctggggctggggctggggctggcgcttgggtccagtgcagctgcgcgtcttcctccatccggcgccagcccgagtcc

SEQ ID NO: 6766028 - DNA, 63 bp, Homo sapiens
gagggcggcatcgcgtccttgtctgctgtctgggcacagcctagagaggccgcgggtcccctc

SEQ ID NO: 6766029 - DNA, 62 bp, Homo sapiens
aacattcacctctacctccttctgaaatctttttctgatagcttgaggcagaggtaaatgtt

SEQ ID NO: 6766030 - DNA, 122 bp, Homo sapiens
aatagcattagaattatttgtttgttaaaagttagctaggacaaagtgtaaaacaatctaatcctgatgacacttttaatagtagatttttaatcagctttgtgatttctttaatagttatt

SEQ ID NO: 6766031 - DNA, 63 bp, Homo sapiens
atctgtcctggagctaggcttcccaccaggcgaaaatgaaggccaggaggagctccagtaggt

SEQ ID NO: 6766032 - DNA, 85 bp, Homo sapiens
taaccaagacacaaaactctagttatgaagtttgtctgtgtaacaaaagatccataattggagttaatagagatgtgattggttg

SEQ ID NO: 6766033 - DNA, 76 bp, Homo sapiens
ccgctaaagtaagcagagcagatagtattatctcactttttagatgaggaaactaaggctcagtgaagcttagtgg

SEQ ID NO: 6766034 - DNA, 120 bp, Homo sapiens
gcctacttcttggtttttacagattctttgcttttaaaaaggaagttggtaagttctgcttgactaagttagtcctttttaaaagttgtgtattcatgtagaaagctctgaaaagtaggt

SEQ ID NO: 6766035 - DNA, 57 bp, Homo sapiens
gcctaggatcaaccacatgaaaagcacttagcatatgccaggtactgatcctagagc

SEQ ID NO: 6766036 - DNA, 130 bp, Homo sapiens
aggacaccgttaaatttgaactctgaagtcaacccaagtctaactcaatttgtgaagtcagttgtgtattgcctatacaaactgagcttgagcttgctattccctttcaatgaggagttcctggtgttct

SEQ ID NO: 6766037 - DNA, 64 bp, Homo sapiens
ttgcctgagttgtaattctcacagtagtcctgcaggacagctgctgttactgcttattacgcag

SEQ ID NO: 6766038 - DNA, 55 bp, Homo sapiens
gggctctgttctcctttgcatctcgggacaccccgaggtctcagagcaagagccc

SEQ ID NO: 6766039 - DNA, 90 bp, Homo sapiens
ttttatctgaaattaatgagtagtatcatttaggattgtgaaaggaatttcaacgatatctgtaatattttattaaagttttaggtaaaa

SEQ ID NO: 6766040 - DNA, 81 bp, Homo sapiens
caccccagctgctctgcagcgatgatctcctcagaatctgagatgacaagagcttgctgcagaagaaagctgtgacaggtg

SEQ ID NO: 6766041 - DNA, 117 bp, Homo sapiens
ccattgtttcaatttagtgttgttagcagaaattttgtttcttttctctgttgtatctttatataagcatgaaaacatgaaacagcattgacttgacaacatttttttaaaaggtgg

SEQ ID NO: 6766042 - DNA, 81 bp, Homo sapiens
gccttttttgtcttctcctgcttcttagagctgctctggatgctgcaggttcgttctcagttcaggaaggacatgtacggt

SEQ ID NO: 6766043 - DNA, 68 bp, Homo sapiens
cggagcataatgatgctctccatcacccgagacaggtggcctgcacagggatatggggagctgctctg

SEQ ID NO: 6766044 - DNA, 55 bp, Homo sapiens
catgatacctcagttgtttttacatcaaatcgacttggaaacagtgagtgttatg

SEQ ID NO: 6766045 - DNA, 70 bp, Homo sapiens
tcttatctactctttggaaaccaaccaaagttttaagcagaagaatgacaggaccagagagtagttagga

SEQ ID NO: 6766046 - DNA, 72 bp, Homo sapiens
tctttatccaattcaccattgatgggcacctaggttaattccatgtctttgttattgtgaatagggtggtga

SEQ ID NO: 6766047 - DNA, 108 bp, Homo sapiens
cgcttcgctcccggccacgcctatcccatgatgcccccaaatctggctcaaaagctgctagtactgagcgctggtaaggggtgcgggggtggcgttggtgggaaagtg

SEQ ID NO: 6766048 - DNA, 89 bp, Homo sapiens
ggccacagccctagaaacactagtccttggctttttctccatctgtgattacagctggacagaaacccgagtgatctgtctgtgttgcc

SEQ ID NO: 6766049 - DNA, 74 bp, Homo sapiens
aggtacacgtgtgtacctttgtacaaacatgcatacacacacatgcacacatacacaggtacacatatgtacct

SEQ ID NO: 6766050 - DNA, 79 bp, Homo sapiens
gtaatggtcaccagaacaagacaggagaatatcaagataagagaaatgttctatgtcttgaactttggattatggttac

SEQ ID NO: 6766051 - DNA, 58 bp, Homo sapiens
tatttggaaacaattcacatgctttttctgtctttgtaggcatgtgaatgttcaaata

SEQ ID NO: 6766052 - DNA, 57 bp, Homo sapiens
gatgcagaaagtagacaccatctagtcactttaaggagaaggtgtcccaactgcgtt

SEQ ID NO: 6766053 - DNA, 66 bp, Homo sapiens
ggcttcttcctgtgaacatgttctgttgaaagtgctaccgaaaaaggatactgttctaaaggagcc

SEQ ID NO: 6766054 - DNA, 81 bp, Homo sapiens
cagtgatggtgaaaggagagtagcatatcaaaatcacctgaaattgagggtgatttttaaaattctccttgcttcacattg

SEQ ID NO: 6766055 - DNA, 57 bp, Homo sapiens
aggacccaggctcgtgggacggctcaggcccctgcctcggtgtccagcctgggtttt

SEQ ID NO: 6766056 - DNA, 92 bp, Homo sapiens
cccgtcattccctcagcacttggctgaagactagatgtttactctcttattggggtaaaatgtcaggattctaggcacagctgagggtaggg

SEQ ID NO: 6766057 - DNA, 74 bp, Homo sapiens
cgcccctggaacctcaggtcggacttgggcgggacccggcaggtctggacagggcagagaccgagtcaggggcg

SEQ ID NO: 6766058 - DNA, 75 bp, Homo sapiens
ggtgaagtatagttttttcaacaaatggtgctagaacaactgcggtatcttttggtggaaaaataaatctttact

SEQ ID NO: 6766059 - DNA, 90 bp, Homo sapiens
gctatcatccaactgatgcctggcctagataccaagttgccacgatacaaactgtgagatgtgccagtgccaggtctctactgggtctgc

SEQ ID NO: 6766060 - DNA, 64 bp, Homo sapiens
atgaggttggttccaaccctcccagtcagagagaagatgtgtgggaatactgaaacaaccttat

SEQ ID NO: 6766061 - DNA, 66 bp, Homo sapiens
tctttagcttttccctttccacttcctggggtcacctttgactgcactgaagaaaggagctctaga

SEQ ID NO: 6766062 - DNA, 73 bp, Homo sapiens
aagtgcctcccaaggggctgttggagggacattcaatcccctcaacaattttcaagcttctttggaaacattt

SEQ ID NO: 6766063 - DNA, 69 bp, Homo sapiens
tggagacttggcttctgtccctgctacattgactttttgtcagcaggcaggtagcaagcagtgtctccg

SEQ ID NO: 6766064 - DNA, 92 bp, Homo sapiens
tattcttataagcccagtttttagattagttggtggaaaactggcaatatttcactgaattaaaatcaaagctgctgggttctataatgata

SEQ ID NO: 6766065 - DNA, 59 bp, Homo sapiens
cggcgatgggccaggtcctccgaatccccaaggcctccagggctacgggcaccgtcctg

SEQ ID NO: 6766066 - DNA, 67 bp, Homo sapiens
ctgtgcctccagtcatgtttactgtgcagcaaggcttttggccagagaacataattgacatgcacag

SEQ ID NO: 6766067 - DNA, 58 bp, Homo sapiens
gcccagtgttcatcaagaaaatgtggaactgcctacaggtttttgtggatatatgtgt

SEQ ID NO: 6766068 - DNA, 55 bp, Homo sapiens
ggggtgtggaatctggcagtgactggtggagctcagggtgctgcagacccacccc

SEQ ID NO: 6766069 - DNA, 130 bp, Homo sapiens
aatagagagctagtgctttggtaatacgtgtgtttaaatatttgtgtatttttaaggataatttatctttttttaaaaaaagagtatttggtatagaacactctttaagtattagtaaaggctatggttt

SEQ ID NO: 6766070 - DNA, 62 bp, Homo sapiens
ttggagggactgagcttcagtcaagcaccctactgtgggggtcactgactgagtcccttgaa

SEQ ID NO: 6766071 - DNA, 86 bp, Homo sapiens
tcagtgttcagaacactagtctagaccagaccagaccaatgtggtattcgttgtgggctggcaagtagactgtgtgagaataaaga

SEQ ID NO: 6766072 - DNA, 58 bp, Homo sapiens
gaattgttagctgatcttgagtgcatattttctatgtactgttgcacactaatagttt

SEQ ID NO: 6766073 - DNA, 59 bp, Homo sapiens
tctatccagcatgcaatcatttagcatttatgtgtgctcagtgctgtggctgaataaga

SEQ ID NO: 6766074 - DNA, 59 bp, Homo sapiens
atcttctaacgaaatacctcagactttcacttgaaagataaagaagttttgttgaggat

SEQ ID NO: 6766075 - DNA, 58 bp, Homo sapiens
catttgggaaataaacctagaggaagatttataattccaggttgtgtttccatgagtg

SEQ ID NO: 6766076 - DNA, 64 bp, Homo sapiens
cagagctgggatcccatgggcgcagcagcacacccagctcccatggcgtcactccctagctctg

SEQ ID NO: 6766077 - DNA, 61 bp, Homo sapiens
tacactcttaggaattggttatatcacaatttaaatgttggtaatctagcttcagagtgta

SEQ ID NO: 6766078 - DNA, 80 bp, Homo sapiens
gtgtgtgtgtgtagctttaataagctgctgaattattgctgaattatgcttattcagagtttgttttacaaggtcattac

SEQ ID NO: 6766079 - DNA, 74 bp, Homo sapiens
gtattagcaagagttgtgattttatcaccaatagaaatcatattttcctgtaacattacggctgtggctgatat

SEQ ID NO: 6766080 - DNA, 67 bp, Homo sapiens
ttgcagtgtttaacatccttagaccaggtcatcccagagttgagaggatggattagacaaaaggtaa

SEQ ID NO: 6766081 - DNA, 60 bp, Homo sapiens
gcctgtgcatttaaatgtctatatatgcaagtacatttatagagctctttatgcatgggc

SEQ ID NO: 6766082 - DNA, 92 bp, Homo sapiens
cagaaggtcagtaaattatggattaacatgtttatggtacttcttgttgagttgcagtgattaaagtgttaaattctttattgtcccttctg

SEQ ID NO: 6766083 - DNA, 78 bp, Homo sapiens
tgtatgtgtggtttaagaattgaattctggaaagataccggaattgcataaacacatttcttatgacctgcgtataca

SEQ ID NO: 6766084 - DNA, 109 bp, Homo sapiens
ttaaagaagcccattcactgtttacttggaggtgtttcctgttgaggtcctgctggctgtgatcacaatttagactttttaattataggtgaacgggatgggtctttgg

SEQ ID NO: 6766085 - DNA, 83 bp, Homo sapiens
gtggaggggcagagatgactcagaaaggtagcccagcagacccttgcttccatgaaatgtgttatgcttctagcctcttccac

SEQ ID NO: 6766086 - DNA, 77 bp, Homo sapiens
gagaaatggggacagaacttttgacattagccacagaaaatgaggatttttgtcataagtgtttgcacccagttctt

SEQ ID NO: 6766087 - DNA, 98 bp, Homo sapiens
ccggaaagctggctgaaatgcagatccctcactctgacatcctgcgtcagtacggctgagaattctgcatttaagcgaccccttgatgctcattctgg

SEQ ID NO: 6766088 - DNA, 84 bp, Homo sapiens
acagttttagaccacttaccccatgtgaaacgttattgtaagcactgacagtcagcatatatggagtaaggatctacaaggtgt

SEQ ID NO: 6766089 - DNA, 56 bp, Homo sapiens
aaaactgaaatacgatccaatggcagatccgcctgcaaggaaggtgattcagtttt

SEQ ID NO: 6766090 - DNA, 127 bp, Homo sapiens
ttgagaatttaaggtatggcctctcttttcaggaatccaaggaaaggcacaaattcagcattttgcatttatctgcagggagtcagagactgcctaacccttgccttgaaagcctgcctcagtccaa

SEQ ID NO: 6766091 - DNA, 93 bp, Homo sapiens
ctcaaatgcaagtcaccttcttcaaaacaacactggcctggattcctagtgctttgagcgtttgaaaaggggtggcttggcccattgattgag

SEQ ID NO: 6766092 - DNA, 61 bp, Homo sapiens
cttaaagtgcttagttccattggaagggataacacatctcatttggtttaggcacattaag

SEQ ID NO: 6766093 - DNA, 69 bp, Homo sapiens
agacttcccagcctttcttttctgctggcctctgttttggcaccagtacttgggaatgctggggatgct

SEQ ID NO: 6766094 - DNA, 76 bp, Homo sapiens
ctgattcaaacactgtacaatctgcagggagaacttattaaaagggctttgcagatttgtttagtgctctgttcag

SEQ ID NO: 6766095 - DNA, 66 bp, Homo sapiens
ggttccagtctctcccagaggagcagcgttttcctgtctttggcttctctgagacactctggagcc

SEQ ID NO: 6766096 - DNA, 101 bp, Homo sapiens
atgaagatatgaaattattgatcttttatgttatgggtaggatcaatgttaatgaactttgtatcctgatgcctggcatgtagcaaggattttatattcat

SEQ ID NO: 6766097 - DNA, 76 bp, Homo sapiens
ttaggccacatgtctgtcatcttccaggaagctcgtatgggcttcttcagagggcagtcataattctaaagcctaa

SEQ ID NO: 6766098 - DNA, 56 bp, Homo sapiens
cagggcctctcatcccacgggcttctccaggacaccgcgtggggcagaggcacctg

SEQ ID NO: 6766099 - DNA, 80 bp, Homo sapiens
aggtttggacacacctggagagctcgggccaggcagggccacacctgtgagcctgagctcatccaacaccgcccggagct

SEQ ID NO: 6766100 - DNA, 127 bp, Homo sapiens
gttagttggctctgctgctattataaaagggatttccttttctttccctggagattgggtgcccatctttttccctacatttctgatagtaaaggtctttttattctcacagcatgagtttctggac

SEQ ID NO: 6766101 - DNA, 130 bp, Homo sapiens
ccaccttacactttttcctctacctttctccagggaagaataggtgtggtttccagtggcacagttcaagcatggcagcacctttcttaccccagaaagcagcagtacccggggaaagaatatggggagg

SEQ ID NO: 6766102 - DNA, 63 bp, Homo sapiens
cctagctggctcccacaaactcactactttacccccagaagtcactgagatggtgaggctagg

SEQ ID NO: 6766103 - DNA, 83 bp, Homo sapiens
tcattacagtagaaatagcatgcagaagcctgtcctgctctttgctgtgaaggaaggtaagcagctgtttctaaggacagtga

SEQ ID NO: 6766104 - DNA, 83 bp, Homo sapiens
gaacatagctttaaaaatcatcaaagcatattagaagaaattgctaattttggtttagatgagattttagaacagctgtcttc

SEQ ID NO: 6766105 - DNA, 72 bp, Homo sapiens
tatcaaaactttttatgaacgttgtagactaaaaatagttatttactcttataatgttgaagggttgggata

SEQ ID NO: 6766106 - DNA, 88 bp, Homo sapiens
tcactctctgggcagatgtaattactcaagtcaatggcctactgacaaataagcattgaaattgtcaaaattaaattcccagagggga

SEQ ID NO: 6766107 - DNA, 67 bp, Homo sapiens
tggtgttgctgctggctggctgcatgacccagccagggttcaaagtcctgtcaggtagcctacacca

SEQ ID NO: 6766108 - DNA, 56 bp, Homo sapiens
gctctctgcaagtcagcagcctccagaacctggcaatgagttgaatgcatgagagc

SEQ ID NO: 6766109 - DNA, 100 bp, Homo sapiens
gagccgtgcactcgctggatagacatttatctccatgtggaggactgggatggtccctccacagggagataaatgtttatccagcaggtgcacgtgtctc

SEQ ID NO: 6766110 - DNA, 62 bp, Homo sapiens
tatgtgttgtatatgtgcagaggtgttatttgtcttcttctgttccatatttccagcacatg

SEQ ID NO: 6766111 - DNA, 85 bp, Homo sapiens
cagccctcagatggtctgtgagctgtgagacctgttgggaatcagagccagcaggggctctaaagatcatggaagctgagagctg

SEQ ID NO: 6766112 - DNA, 59 bp, Homo sapiens
cttgtgcaaatcctcgagcacatatgtcaagtatgtttctgggcacacatttgcacagg

SEQ ID NO: 6766113 - DNA, 74 bp, Homo sapiens
gaggaaatcattccagaaaaggaaaggccacaaactcacaaaggtgtctgctgttttctggagtatgtctcctc

SEQ ID NO: 6766114 - DNA, 56 bp, Homo sapiens
ttagaaaggagcttatttctttgttatgaatataaagaatggagttctcttcctag

SEQ ID NO: 6766115 - DNA, 97 bp, Homo sapiens
aattgcagagttccaggaatgaaatgtagataaatgtgtcttcaataatagtgacaatattttgtagtatatttaacatttgtgaacatctgcaatt

SEQ ID NO: 6766116 - DNA, 96 bp, Homo sapiens
gcagaccgaagtttccccaggcctgggaagactaagtgggaggcgcccaccgtgcgaagatcctcccggcttccagggaagggaggctgggcctgc

SEQ ID NO: 6766117 - DNA, 81 bp, Homo sapiens
acttccattttgtggtgactttaattttaaagcattcactattaagaacctttgaaagcaggagacacccagagtgcaggt

SEQ ID NO: 6766118 - DNA, 126 bp, Homo sapiens
aaattaatttcaatgctcttctcttcttgcctgagctggcaaaactaatgggaagcttagaaaagggtttcccaggttttgtctgttttatctaagtgcaaatcaatttcagactgaaaataattt

SEQ ID NO: 6766119 - DNA, 103 bp, Homo sapiens
ttgagatggagtctcactttgtcacccaggctggagtgcagtggctcaatctcggctcactacaacctccgcctcccgggttcaagcgattctcctgcctcag

SEQ ID NO: 6766120 - DNA, 57 bp, Homo sapiens
tggcattgctgtagtgtcagaagtacaattctggaattagtgctcagttaatgcaca

SEQ ID NO: 6766121 - DNA, 59 bp, Homo sapiens
agaaccctagcatgtcctttaggatgaagtgaatcacgttctgaggtatgatagggtct

SEQ ID NO: 6766122 - DNA, 119 bp, Homo sapiens
acatctggacgtgactgcatgaagttacccatgggataacaagaaggctgaggaaagaacatgaattccctgaccttcatcccaggagctcagtttgtctttgttttagctccagaagt

SEQ ID NO: 6766123 - DNA, 114 bp, Homo sapiens
gtcaggagcagtttgccccaggtgactgtcagaggttttaataaaacaattaaaaataatttgtgtctctgataatagtccggcctgttttgggctcagtaaaagctcaggggc

SEQ ID NO: 6766124 - DNA, 57 bp, Homo sapiens
gacacctttgacccttacctggacatcgccctggatatccaggcagctcagagtgtc

SEQ ID NO: 6766125 - DNA, 64 bp, Homo sapiens
gagtttaccttttataccatcccaagaagtgaggctaatttaatggtacatataaggtgagctt

SEQ ID NO: 6766126 - DNA, 103 bp, Homo sapiens
ggttgggatataacggctgggtcaaggaatgctggtgggcagaggagacttcttcaccaccactatgtatatctttatggccctgtggctatttgcctcaacc

SEQ ID NO: 6766127 - DNA, 57 bp, Homo sapiens
gggaggatctgaggcccaccagcagccacaggcacagggctgggagcagaccctccc

SEQ ID NO: 6766128 - DNA, 60 bp, Homo sapiens
gggattaaatgagtagatacttataaagcacttaaaataatgtctgctcataataaaccc

SEQ ID NO: 6766129 - DNA, 130 bp, Homo sapiens
ttccatttgtttgtatcctcttttatttcattgagcagtggtttgtagttctccttgaagaggtccttcacgtcccttttaagttggattgctaagtattttattctctttgaagcaattgtgaatggga

SEQ ID NO: 6766130 - DNA, 66 bp, Homo sapiens
aactatgccattattcatttcagtgggggcatgtaacctcaaagaatgttatgagggtagctcgtt

SEQ ID NO: 6766131 - DNA, 56 bp, Homo sapiens
gccaggctggagtgcagtgtcttgatctcggctcactgcagctccgcctcccaggt

SEQ ID NO: 6766132 - DNA, 68 bp, Homo sapiens
gagattcttttggggatctcattaacagtttcttctgtttgtgggatggctcttcccaaaggggtctt

SEQ ID NO: 6766133 - DNA, 73 bp, Homo sapiens
tacactacagataagcaatgaacaattttgtttcctgggggaaatgcagaattttctgttttctagagatgtg

SEQ ID NO: 6766134 - DNA, 67 bp, Homo sapiens
catgctgtactctgtgtcagaacctgctctaggtattgagtatacagtagtgaacaaggcaggcatg

SEQ ID NO: 6766135 - DNA, 74 bp, Homo sapiens
ggaaatctcaaggtttggggccggataattttttagaagcctccttaacatggttctttaccttgaatgttttc

SEQ ID NO: 6766136 - DNA, 79 bp, Homo sapiens
tggtggagatttgaataaattgagagcgaatgtccagtcttaaggagacatttattactcaggttgttgatttttgcca

SEQ ID NO: 6766137 - DNA, 103 bp, Homo sapiens
tagaggttgtatataagatagattagagttgacagtgagtgccaaaagatataaatggcttatagtggcagttcaggctgcaatcatgatgctacaatctcta

SEQ ID NO: 6766138 - DNA, 60 bp, Homo sapiens
gaccatagatgtatgggtttatttctgaactttcagttctaatccattggtctatatgtc

SEQ ID NO: 6766139 - DNA, 62 bp, Homo sapiens
agcagcaattttcactgtcaatttttgctagtctaatggctatgacatgatatattgttgtt

SEQ ID NO: 6766140 - DNA, 86 bp, Homo sapiens
gggggtctctcccggagtcggccagcccgaggcaggaagccctgcggtttctggcttctcccaggcggcctccggatctggccccc

SEQ ID NO: 6766141 - DNA, 105 bp, Homo sapiens
caggctcagagaagatacgtggacttccttcgagtcatatagttgtaacccaggttaggacatgtgcctccagggcagagtccacctgccttggtctctagtctg

SEQ ID NO: 6766142 - DNA, 82 bp, Homo sapiens
ggatcctcggtgcaggagaatagctgatgagcatgggcagagaccagtgcacacacaggagtctcctccacccagagtctcc

SEQ ID NO: 6766143 - DNA, 77 bp, Homo sapiens
gtcaaaattacaagccatctccttcgctctcccatggtgaattggggagctgtgggattggttgagtgtatgctgac

SEQ ID NO: 6766144 - DNA, 91 bp, Homo sapiens
ccttagggcagtgccacagtaatctgggaacttgttagaaatacacattctcaggccccatcccagacttattgaatcacagactctgggg

SEQ ID NO: 6766145 - DNA, 74 bp, Homo sapiens
gaagaaacaatggcagataattttccagatttgagaaaggcattgatttggaaacatgctgaccatggttaatc

SEQ ID NO: 6766146 - DNA, 59 bp, Homo sapiens
ctacataaatttatcacagactactggcattgagatgtactagtctgagtgaaatgtag

SEQ ID NO: 6766147 - DNA, 104 bp, Homo sapiens
gggagggtgcttcccactcggggtctttgggaggccagtacttctgggaatccatagaggaggacaagagcaggcctctcgaagcttcagtccagaacccaccc

SEQ ID NO: 6766148 - DNA, 72 bp, Homo sapiens
agaggccaggtggtcaggggctgaggtgccccacaaggtcgtgggggtaggtagttctgaccagcgccatct

SEQ ID NO: 6766149 - DNA, 59 bp, Homo sapiens
gccccgtggcgctggcctgtgggatcccgggcgcggcctgggccagggccagccggggc

SEQ ID NO: 6766150 - DNA, 67 bp, Homo sapiens
gttggagttaagagagatgacgctgactctgaattcagaggaggctctaaactttccttggctcaac

SEQ ID NO: 6766151 - DNA, 69 bp, Homo sapiens
agggatctcagggatggagctgggcctcaggttaaggaatcctgggctctcgtccctgcagaagtctct

SEQ ID NO: 6766152 - DNA, 75 bp, Homo sapiens
tcgctctatcgcccaggctggagtgcagtgatgagatctcagctcactgcaacctccgcctgctggttcaagtga

SEQ ID NO: 6766153 - DNA, 118 bp, Homo sapiens
agttgtaagagaaaatggtacagcagttacaagaggatgtggacatggaagatgcttcttaaaaaaaatctctgtaaccatttcttttatgtacatttgaaaatgccctctggagact

SEQ ID NO: 6766154 - DNA, 56 bp, Homo sapiens
tgatgagggagatttgagcccaggaatagggactgggtttcctatttacctcctca

SEQ ID NO: 6766155 - DNA, 63 bp, Homo sapiens
ccttccccactgtctgggacatgtggtctgacaaagtgcctgagttgtgggcagaggacaagg

SEQ ID NO: 6766156 - DNA, 75 bp, Homo sapiens
tctgataggtggtagaaggaggcccctagtgatctttaaaatccttttaagctcctctccttcactgccttcaga

SEQ ID NO: 6766157 - DNA, 67 bp, Homo sapiens
ggggtacccaacagagtaatttagtgaagtatttcaaagagctattcagttgtggtattgtaacctc

SEQ ID NO: 6766158 - DNA, 66 bp, Homo sapiens
gtattgggggtggtggctggggggtggtgtcttatgacattatctctaggctgccacttaaagtat

SEQ ID NO: 6766159 - DNA, 107 bp, Homo sapiens
tgcacacatatatgtgggtgtttttgtgtgtgtgcgtgtacatgggcctggcctgtgatgggggtgcatgctgcacacatgcgtaggcattcatgtgtgtgtgtgca

SEQ ID NO: 6766160 - DNA, 62 bp, Homo sapiens
tctgctcactagtattcgaaggcacatgctttgagaaaggctgatggaagctggtgagcaga

SEQ ID NO: 6766161 - DNA, 63 bp, Homo sapiens
aagtccttcaagtctggatgttgggtaatcacgttttcttccagaagccatttgttaggactt

SEQ ID NO: 6766162 - DNA, 63 bp, Homo sapiens
ggtttgtgaatgtgtttttgctttgtcttatttggtactgagacagcagcatgtttacaggcc

SEQ ID NO: 6766163 - DNA, 56 bp, Homo sapiens
gccttgcaggaaggagggacagcaggactgagcgactctgtcctttctgctaaggc

SEQ ID NO: 6766164 - DNA, 78 bp, Homo sapiens
caagtgtttatgaaatttcaggcattttgagaaatttgcatgtactcaaaagtcttgttacgttccattgttcacttg

SEQ ID NO: 6766165 - DNA, 111 bp, Homo sapiens
tatttactataaaaatgtttgaaatgcctttatcatctgctgaaaagtaatcatagaattgacattattgcagatggtgtgagagatttttaagattaatgatagtagata

SEQ ID NO: 6766166 - DNA, 55 bp, Homo sapiens
cccccagggctgcctcctgccgacaggctggtccccagtgaggaggtgctggggg

SEQ ID NO: 6766167 - DNA, 88 bp, Homo sapiens
aaaaagacacagctaagtttagagagaatggggacaggcactaggagtttccaagttttctttgagctcacacatagattgccttttt

SEQ ID NO: 6766168 - DNA, 67 bp, Homo sapiens
gacgttattatggggatgtgattcagagaagaaaacaatgatatgcacaggtgtctctagtagcgtt

SEQ ID NO: 6766169 - DNA, 56 bp, Homo sapiens
tcttgggcatgtgtttgatttcctgtttccatggggataaaataactgccacaaga

SEQ ID NO: 6766170 - DNA, 59 bp, Homo sapiens
aagtgtgtatttttcttcagtggttcactgttgccttctgggtgaataatacagcattt

SEQ ID NO: 6766171 - DNA, 58 bp, Homo sapiens
gctttctgctctgtaaaatggggattacgaatcccattagtcttacaaagaagagggt

SEQ ID NO: 6766172 - DNA, 84 bp, Homo sapiens
ggggaatgacttagatcactgtcttcctttggctcctcaccatgttgtgtggaggaaacgaaaagcagctcaagttcactcctc

SEQ ID NO: 6766173 - DNA, 61 bp, Homo sapiens
gtaatggaaatgttgggggaattatctctaagaaaaggtggtaagactaacatttctcagc

SEQ ID NO: 6766174 - DNA, 77 bp, Homo sapiens
atgttggtgaagtttgattgtatgggttttaatttaattgagttgaattttttatatcaagcattcctcatcaacat

SEQ ID NO: 6766175 - DNA, 58 bp, Homo sapiens
tttctccaatgtatcagcacacattccactttattttgtgagctgacccatttagaag

SEQ ID NO: 6766176 - DNA, 99 bp, Homo sapiens
gggcctgtctgcctgcgaacagctcccctggggagggtttcaggaggtctccatgacctcagggcccagagctcaggcaagtccaggctggcaaggccc

SEQ ID NO: 6766177 - DNA, 65 bp, Homo sapiens
gaaggccttggcctagccctccagggtcccatactgtggagtttggaggggcaggtctggccttt

SEQ ID NO: 6766178 - DNA, 78 bp, Homo sapiens
gtataattaacaaacagttaagtgtggatggtaaaacttccctaggtcctatctagaactgaaactctgtaattatat

SEQ ID NO: 6766179 - DNA, 59 bp, Homo sapiens
gtaatatcctgaacagttgactgtacaatgactgtacagtgacagatagggatagaaac

SEQ ID NO: 6766180 - DNA, 56 bp, Homo sapiens
tgctccgtttttgaccggcactgatgccacatcacatagctgagtaaaatggagta

SEQ ID NO: 6766181 - DNA, 56 bp, Homo sapiens
ggctgaaagcgcgacttgccccgaaacagaaagttacagggcaagcggctgtcacc

SEQ ID NO: 6766182 - DNA, 58 bp, Homo sapiens
gccctcaacctcctttcctgctggggttcccaactcacagtaagcggggttggagggc

SEQ ID NO: 6766183 - DNA, 60 bp, Homo sapiens
ctgcttgcaaagtgttggtgattttactgaaaacttttgagatcttcattttacaggcag

SEQ ID NO: 6766184 - DNA, 56 bp, Homo sapiens
gccaggggagggtcgtctagtccttaagcataaacactggctgtcttcctactggt

SEQ ID NO: 6766185 - DNA, 62 bp, Homo sapiens
tgcttgctttgtaagttgtgatgttcagtaatgactaagtacattcatttgcacagccagta

SEQ ID NO: 6766186 - DNA, 82 bp, Homo sapiens
gtgaatggtacaagtgtgtgtttgagcaggaggtgaatatgccagggaaacaaatctgttcacacacttgtactctcctcac

SEQ ID NO: 6766187 - DNA, 83 bp, Homo sapiens
gcgcccccagctaccccatggcctcgctctacgtgggggacctccaccccgacgtgaccgaggcgatgctctaagctcagcgt

SEQ ID NO: 6766188 - DNA, 76 bp, Homo sapiens
aagcagcagaggcaaaagaggtggaggtggcagtggcaacagcagcagctttgcagactcttttatcttgctgttt

SEQ ID NO: 6766189 - DNA, 85 bp, Homo sapiens
catggatgttgggctgtcacggggccttggcctcacctgggcacctccttacacagcaaggcctcctgggcccagagatctgatg

SEQ ID NO: 6766190 - DNA, 88 bp, Homo sapiens
taccactctataactctttactatacatttattttcaacagtttagccagaagggttggtgtaattaaagagtgttacagggtcggta

SEQ ID NO: 6766191 - DNA, 78 bp, Homo sapiens
tcattaagctttcacttgtagctcactgtgcagtcttggatattagcaccctgagttattgagaaataactgcaatga

SEQ ID NO: 6766192 - DNA, 73 bp, Homo sapiens
gcccatggcagaatatctgcatcgcatgagaaagagagaaaacttgcaaatctgcaatgagattgcgcagggc

SEQ ID NO: 6766193 - DNA, 79 bp, Homo sapiens
ggagagaaatgcttcagatttggggtattactgtgggaacactctctaaatctaatctccaaatgtggtatctctttcc

SEQ ID NO: 6766194 - DNA, 55 bp, Homo sapiens
gcactagctcttttataggaactctgggatcccggaagtgaaaaagtgttagagc

SEQ ID NO: 6766195 - DNA, 80 bp, Homo sapiens
tgagtaatttttgccagaaatactagtgctgatgtaaaataagggttaggattagggaaggatttggcctgaataattca

SEQ ID NO: 6766196 - DNA, 61 bp, Homo sapiens
aagtcccatctgcctccatgtaccagctgatcgcagagctggactggggcaggctgggctt

SEQ ID NO: 6766197 - DNA, 70 bp, Homo sapiens
gaggagacctggagcgggaggaagagtaaaaggacaggcaccgatcctccacctctgctccagtttcctt

SEQ ID NO: 6766198 - DNA, 126 bp, Homo sapiens
atctttatgggtccaatcttctgcttctagggtatgcagtgagcactatttatactataatcttgatgctgttaatgctggttactgacattatttagaatcaatccctgatcaaactatagagat

SEQ ID NO: 6766199 - DNA, 62 bp, Homo sapiens
ggagataatccagggagggactcagctgagaacagttccctgccttctctggaattgcctcc

SEQ ID NO: 6766200 - DNA, 104 bp, Homo sapiens
gtctgcacacctagccccagccttgggggtttctgccctcctctctcagtcttgtgaaagtagggagaccggaggccgcctgcaaggggctgggcagccagggc

SEQ ID NO: 6766201 - DNA, 59 bp, Homo sapiens
aaagcctattaggagctgggcaagagatactcatgaaaaagtagtttctaatggccttt

SEQ ID NO: 6766202 - DNA, 107 bp, Homo sapiens
aagtaagctactttgtggctatctttgtatgcaccattgtattaccttgttcaacaaggaagagcccgggtgacataacaaaataaatagacacgatgctgctgctt

SEQ ID NO: 6766203 - DNA, 60 bp, Homo sapiens
tgtgagctcagaggcgtctttgtccaaagaaactttgaaggcagattccttgagctctca

SEQ ID NO: 6766204 - DNA, 65 bp, Homo sapiens
tttttgtgaaatgggtgcaggacacatcagtttaattcattctgcatcctcatttttcacacgag

SEQ ID NO: 6766205 - DNA, 83 bp, Homo sapiens
ctgaagccagcctggctcagtaatcgagtctcctggagaaatctacactggggaggtcgaggctgggccgcaggctcattcag

SEQ ID NO: 6766206 - DNA, 56 bp, Homo sapiens
ggtccagctgatcttgacccagcctggagaacaagcggtcaaatcaccagcggacc

SEQ ID NO: 6766207 - DNA, 75 bp, Homo sapiens
caagaagcctgtgctttgttctcaagttattccatcaaataagaatgtctatttgctacaaagccaaactttttg

SEQ ID NO: 6766208 - DNA, 69 bp, Homo sapiens
tgaagtttttccagacaagtcccatctaacaatattctagacaggtcgggcttctctcagaaactatca

SEQ ID NO: 6766209 - DNA, 58 bp, Homo sapiens
ggtcaatccttaggcagaccgtgatgttgtcttggacatcattgtttagagtgagacc

SEQ ID NO: 6766210 - DNA, 55 bp, Homo sapiens
atctagatctttggctgtttggggcctcatagtccctagatttgatcatctggat

SEQ ID NO: 6766211 - DNA, 81 bp, Homo sapiens
aagggtttttgtagataaggattgatttttattatatctattttagttgttaataattgttaatcgttgtttcatttcttt

SEQ ID NO: 6766212 - DNA, 57 bp, Homo sapiens
tgcttaatattgtgatgtaatatttggctaatgtatgtgtatattgcaatgttagca

SEQ ID NO: 6766213 - DNA, 92 bp, Homo sapiens
ttaatgagcctatcctgtgttctaggtatggtcttagatgtttagctccaccttccctaagattccccagttttgcaagttaggctttttaa

SEQ ID NO: 6766214 - DNA, 75 bp, Homo sapiens
ggaagttaaggcagccaccaggtcactttgggctcccctgtgctgtgctgactggggtgactgcttatgaccacc

SEQ ID NO: 6766215 - DNA, 57 bp, Homo sapiens
ggagttagtgaagcctacgaggatgccgccaattgtctctggttattaactaactcc

SEQ ID NO: 6766216 - DNA, 59 bp, Homo sapiens
gggaagggctcatcaggtggccgctctgccttgaagagtggtaccctcaggcccttttc

SEQ ID NO: 6766217 - DNA, 62 bp, Homo sapiens
ttgctgcctgcttcaccagacgtgttttgagcatgtttgcataaagtggatgcaggctgcaa

SEQ ID NO: 6766218 - DNA, 77 bp, Homo sapiens
caacccactgaaccaacgggtgcacgtaggctcccaggtgcaaggaagcaatgtgtaccccttggttcagtgggttg

SEQ ID NO: 6766219 - DNA, 66 bp, Homo sapiens
attcagtgtcttgatctgggaatgataatattaactacctccatagattgctacaagtcattgaat

SEQ ID NO: 6766220 - DNA, 65 bp, Homo sapiens
cccctcggcttcagctcaggcccctcggggagcatcccttgccgtgagactgacagcctttgggg

SEQ ID NO: 6766221 - DNA, 65 bp, Homo sapiens
tctaatgtattttctgaggagcattaggaaaattattttgcattaatctcccaggaaatgaaaga

SEQ ID NO: 6766222 - DNA, 68 bp, Homo sapiens
tggggcctgcagtagaggttggtagggggagctgtagtttctatattaaagtgctttgcagtgtctca

SEQ ID NO: 6766223 - DNA, 82 bp, Homo sapiens
atggaaagggattaacctaaagaaggatgtgtgttttctggaaggataataaatctctgctcctcttgggtttttcctccat

SEQ ID NO: 6766224 - DNA, 62 bp, Homo sapiens
agtatttagtaacagcacagtgctgactcatgccagttggctgctggctttcctaaactgct

SEQ ID NO: 6766225 - DNA, 55 bp, Homo sapiens
ctcatggttagagcccagaaagcaagagagaaagccttctccagcctgacctgag

SEQ ID NO: 6766226 - DNA, 57 bp, Homo sapiens
ccaaaacaatgtaatgattcccagggaacgatggaagtcctcaatgcattgtcttgg

SEQ ID NO: 6766227 - DNA, 58 bp, Homo sapiens
gacatcttctgctcagaatcacaacagatagtgagtggttcaagtgagaagtaatgtt

SEQ ID NO: 6766228 - DNA, 69 bp, Homo sapiens
ttttaatctgagtgttggatttattgtaatctttagaatatgagcagaaaggaaagcactcagttaaaa

SEQ ID NO: 6766229 - DNA, 91 bp, Homo sapiens
gtgtgtgtgtgaggttctggtttaagaaagtgctggtgcactcaaaaggtgctggttcaggagacattcttaaagtagaatgaccatgcac

SEQ ID NO: 6766230 - DNA, 69 bp, Homo sapiens
ccaatgatgttgatttgattaaggcttgtgtttccctgcaaagaccttataaaatctacttgatcttgg

SEQ ID NO: 6766231 - DNA, 63 bp, Homo sapiens
ttgcctctagagaatcttttaagaagtggccttttgttctttgtgtctgttctctaaaggtaa

SEQ ID NO: 6766232 - DNA, 56 bp, Homo sapiens
tgactgtttgtaaagagattgctaagcaatgttaaagtgctctttataaagagtta

SEQ ID NO: 6766233 - DNA, 130 bp, Homo sapiens
tctgctgctcctgcctctaacctcaccccttctccctctccaacaagccttgctgctttctgtcattcataagtgccttggctgtgatggggaccagtggatggtgaggcatgtgagaaaaggggaatga

SEQ ID NO: 6766234 - DNA, 83 bp, Homo sapiens
gtgcgttcagtgccccacagaggcagatcccctagctatgcagtcatggctgctgggaatatgccagctgtcagggccaccac

SEQ ID NO: 6766235 - DNA, 75 bp, Homo sapiens
atttctttggctactccagtgctatccaatgtgaagggaagtgtgacagaggaaacattggagtggagaggaaat

SEQ ID NO: 6766236 - DNA, 85 bp, Homo sapiens
gaagataattccatagagatgcagcaatcaccttttttaaagatttcattaaatgaagatattcttgttttctgtggtagtcttt

SEQ ID NO: 6766237 - DNA, 56 bp, Homo sapiens
aggaatgctctgcagttcccagttgagggagctctctgggctggcaggcattacct

SEQ ID NO: 6766238 - DNA, 67 bp, Homo sapiens
catttgaacattcctgaatgaagcatgggcattctttgcaaaatacttaagggaatgttttccagtg

SEQ ID NO: 6766239 - DNA, 120 bp, Homo sapiens
ggcccttcctggactcacatcacagccacagcgcagcctgggcttctcctacttccagctccggacagcagggggaggctgtgctgcgtctggctgtagatatgggtgcagaagtgggtc

SEQ ID NO: 6766240 - DNA, 65 bp, Homo sapiens
actgacaatttttcaaagaagcttatctcagccaagtctgcaatagtcactgaaaaattgtgagt

SEQ ID NO: 6766241 - DNA, 103 bp, Homo sapiens
tggctctctgcaagggaatgcactgaaaattgtgctgtgggattatccttttcaacagtgatgataaataattttcaatgcaaatgtttcacaaaggaggcta

SEQ ID NO: 6766242 - DNA, 66 bp, Homo sapiens
cttgatccctttcactcatgagttgcctgcagtatctgtactaattcaattaggaaaggaagcaag

SEQ ID NO: 6766243 - DNA, 102 bp, Homo sapiens
gttggttggaattagttcttgcacaccaagactgcacagagccagctagcagagtgtgcagggcctctgagccagttctgggtgtgctccttgtccaccagc

SEQ ID NO: 6766244 - DNA, 67 bp, Homo sapiens
ggcagccgtgggaaacaaagacaccaaggcattaaggtgtcttcagtgtgttaccatgggccctgcc

SEQ ID NO: 6766245 - DNA, 64 bp, Homo sapiens
tgagtcactgacccccagctcagcaccggcctggtggcagtggcagctgagggggtatggctcg

SEQ ID NO: 6766246 - DNA, 65 bp, Homo sapiens
gcccttagaaatgtaccaaaggaagcatcttgaatgcattttcctttgacatttatgagatttgc

SEQ ID NO: 6766247 - DNA, 64 bp, Homo sapiens
tgcaaaacttctcagagcctttcatatgctaatgtgcattacaaagctctaagagaggtaggta

SEQ ID NO: 6766248 - DNA, 84 bp, Homo sapiens
gatacttggagttgatggaatcacttcagtttttggacaggctctgatcttcttattggagtggttgattgataccatggaatc

SEQ ID NO: 6766249 - DNA, 58 bp, Homo sapiens
ccaaaggccaggcactgaggttctggcctgtttctctgcttctggggcctggccttgg

SEQ ID NO: 6766250 - DNA, 70 bp, Homo sapiens
gctcagagctgctggttgctggtgcctcccatcagccccagggaggagctgcaaaaccggccgctggggc

SEQ ID NO: 6766251 - DNA, 111 bp, Homo sapiens
gtggaccttccaaacagatccaaaatttgtccctctgaggcttccctggtactacatgctgtttcagtcaagatcaagggggatagaatttggcagctgatataaagccac

SEQ ID NO: 6766252 - DNA, 64 bp, Homo sapiens
agctattgggattatcacatgtagacttgtgactaaagtaaatatgcatgtatccttatcagct

SEQ ID NO: 6766253 - DNA, 66 bp, Homo sapiens
gagtggccagtgctgctctggggctgcttcctgcaccccacaagctgcagaactgcaaagcctctc

SEQ ID NO: 6766254 - DNA, 61 bp, Homo sapiens
ggttacagctgagtttaggtacaggaaaaaggattcctcgcgctctcatcaagctgtaact

SEQ ID NO: 6766255 - DNA, 92 bp, Homo sapiens
cttctagaaatcatgatccatttagagtcttgcaattttaccaagcagagtgagtgaaatgccttgagattttgactcgtcttttcaagagg

SEQ ID NO: 6766256 - DNA, 82 bp, Homo sapiens
gcataatcataagcttcaaagattcacagtttcattgtgctcaatgctcttgtgaaatgacagtcttaagctctgattctgt

SEQ ID NO: 6766257 - DNA, 71 bp, Homo sapiens
agtatttttgtagcatttttccagtgttggctgagctgctttcattagaagaacagttatattaactatct

SEQ ID NO: 6766258 - DNA, 66 bp, Homo sapiens
cattgatttttccaccgtacttcctgagggaggactctccggggacttaaagtgaaggaaacaatg

SEQ ID NO: 6766259 - DNA, 60 bp, Homo sapiens
aaccattcacagtgtagccaaatttctcttatccatgttggctccactactgggtgtgtt

SEQ ID NO: 6766260 - DNA, 68 bp, Homo sapiens
gggtacatgtgcacaacatgcatgtttgttacatatgtatatatgtgtcatgttggtgtgctgcaccc

SEQ ID NO: 6766261 - DNA, 60 bp, Homo sapiens
aatccatgcatgcaaggaaagggcacaaggacaaatcctctgactttgtgtgtctggatt

SEQ ID NO: 6766262 - DNA, 69 bp, Homo sapiens
cttgtagttcattgataagaatgtatagaattccagaaattacatttatttatccttctggattgcaag

SEQ ID NO: 6766263 - DNA, 62 bp, Homo sapiens
ggaggccaccatggagtcacttctgggaaggcaatagaacgcagtggttcatggtggcctcc

SEQ ID NO: 6766264 - DNA, 57 bp, Homo sapiens
gcccccagaagggccacagattcttgagtagaaagagcctggtcctgactgaggggt

SEQ ID NO: 6766265 - DNA, 60 bp, Homo sapiens
gttaacctttaatgatagtctgggggttttttgccccctctactggcaaaaaaggttaat

SEQ ID NO: 6766266 - DNA, 88 bp, Homo sapiens
cccatgatttaacaattgcagtaggtggagtgaattttaacgttctagtgtttgttttagttactcattttgttcccagatcagtggg

SEQ ID NO: 6766267 - DNA, 88 bp, Homo sapiens
ggagtctcactctgtcacccaggctggagtgcagtggcacaatttcggctcactgcaacctccgcctcctgggttcaagcaattctcc

SEQ ID NO: 6766268 - DNA, 104 bp, Homo sapiens
agtgaggattttctttaactgcattaacactggaccatttaaacttgaggttttcatctttttcagtttaagtcatggttacagagttggcaggggtatctact

SEQ ID NO: 6766269 - DNA, 78 bp, Homo sapiens
catttttgaaggctctcttccttttctgggcttgtttcattatctcttccagaaaggtcttccggtcttccagaaatg

SEQ ID NO: 6766270 - DNA, 81 bp, Homo sapiens
attgagaattgtttaactagttttcacacttcttcaacaggtctaggagttgaaagcaaaagttgatattatgttctggat

SEQ ID NO: 6766271 - DNA, 94 bp, Homo sapiens
cttgtactgatcattggcacccagtttgtctcagggtttttgggttattctttctgcccctactaacatctgatcgaacagtgccagatgcaag

SEQ ID NO: 6766272 - DNA, 60 bp, Homo sapiens
ttagatgactgaaaagagcacagagactcagatgttaaactgtgattgacagtcaactga

SEQ ID NO: 6766273 - DNA, 70 bp, Homo sapiens
gtgaggcagtttccagacattattgatatactttcaagtatatcagtagaacaatggacattgagtgcac

SEQ ID NO: 6766274 - DNA, 84 bp, Homo sapiens
ttgttttgtttctgaaaatacttctaggttagagtttaagctaaaaatcaatcctagcactgcctggaaggagagacattacga

SEQ ID NO: 6766275 - DNA, 78 bp, Homo sapiens
aaggcctccaagatgtggattgagggcaggctcctgcatctgagagccctgtgcctgaaataccatcatgagtgcttt

SEQ ID NO: 6766276 - DNA, 67 bp, Homo sapiens
gagctattgattactgaatcaagccccagtactataaaaaggggccatagttcttagtctgtggctt

SEQ ID NO: 6766277 - DNA, 72 bp, Homo sapiens
gggataagccggcaccaggggatgtaatgtcctgtcccctgctatgccaggacgcacccctgctgccatcct

SEQ ID NO: 6766278 - DNA, 69 bp, Homo sapiens
agtggagaaaagtctaaattattcaataagggttttatctttcatttgttggatttggataactccact

SEQ ID NO: 6766279 - DNA, 90 bp, Homo sapiens
gaatcacctggggactttgtaaatatatagacctcgactcagtaaatctgagtaaaaattctacatttccaaccagctcccaggtgattc

SEQ ID NO: 6766280 - DNA, 80 bp, Homo sapiens
gtgccagttgctatttggtaccacactctacaaaagcttaattactttacttgatgctggttgctaagcagcgattgtac

SEQ ID NO: 6766281 - DNA, 74 bp, Homo sapiens
gaaaaagggagacagttgtgtgaggacattccctgagtggaaatttggtctttggcacaatttctttttggttc

SEQ ID NO: 6766282 - DNA, 57 bp, Homo sapiens
gtagattcttggaattcaagtcatatcactgaattagagtagagcctaagaatctgc

SEQ ID NO: 6766283 - DNA, 59 bp, Homo sapiens
ctagagacactagagaagaaggttaactcaagagtgaccaaagactttagatgttctag

SEQ ID NO: 6766284 - DNA, 74 bp, Homo sapiens
tgagtggctttaacaacagaaatttattttctcacagttctagaggatagaagtctgaagttaaagtgttagca

SEQ ID NO: 6766285 - DNA, 56 bp, Homo sapiens
gctgaggctgggagcagcctgtatttactagtaacattgtttcctaaagccccagc

SEQ ID NO: 6766286 - DNA, 75 bp, Homo sapiens
tcagtgaggaatgccagccatctaagccctagtgaagctgtgggtgaagccagggactgacacttcctggactga

SEQ ID NO: 6766287 - DNA, 68 bp, Homo sapiens
caaataagagctaataaacttcctgtacactagctatgtgctgggcatttttatggctcctttatttg

SEQ ID NO: 6766288 - DNA, 59 bp, Homo sapiens
ggctgagtaagtgttctttatggctcggtgcctatcatggggctcaacacttagtagct

SEQ ID NO: 6766289 - DNA, 60 bp, Homo sapiens
cccttttgctcagctgcctcctgtatgacaacatgggcagggcagcagcagcaacaaggg

SEQ ID NO: 6766290 - DNA, 89 bp, Homo sapiens
tgagggacctgatgtgggccagcttttctcctgggtgtgtgactgaatccttcttcccagagcatgtgctgcctttgttaggtctgtca

SEQ ID NO: 6766291 - DNA, 63 bp, Homo sapiens
cccgccagtgttgagggaaagtttgtgatttaggagaagcaagcgtcttttcaatgtggctgg

SEQ ID NO: 6766292 - DNA, 86 bp, Homo sapiens
tggccttgctgagtaaattaaatgtatgttcaagtgctatttctttatggcaccagggaacaagcatttcaaatagtattaggcca

SEQ ID NO: 6766293 - DNA, 73 bp, Homo sapiens
tgtgattaagggcatgggccttaagatggaaaagattattttgaattattcacatgggctcattctaatcaca

SEQ ID NO: 6766294 - DNA, 84 bp, Homo sapiens
ttttagcagctgtttttccagtctctggaaggctattgtcttctcatctgatgctggagctggaagagtaggcagttggtaaga

SEQ ID NO: 6766295 - DNA, 57 bp, Homo sapiens
aggggctctaagaggaagctccaagacagagcaaaggggctgctttatagggcccct

SEQ ID NO: 6766296 - DNA, 55 bp, Homo sapiens
gaaaaaccccaacagtgaataactcggaagagtttccaacatgtgggtgtttttc

SEQ ID NO: 6766297 - DNA, 55 bp, Homo sapiens
gcacagtaggtatttacccagtgtggtatgcaggggtagtgcaaccatactgtgc

SEQ ID NO: 6766298 - DNA, 125 bp, Homo sapiens
gattggcattagagctcatcgaggagaactgtgtcttgaccagcatccttgatcactgaggacactggtggtcctatgttggtgaggtgccagcttttcacactcagtctttttctaatgcagtc

SEQ ID NO: 6766299 - DNA, 66 bp, Homo sapiens
gccatcaattcttaggaaaatagctgcatcaacaagtcagctatgcagttccttaaggatttgggc

SEQ ID NO: 6766300 - DNA, 63 bp, Homo sapiens
ttatacatgtttataaggttgatatgattcatcttatttgctaacttttataaatgtgtgtga

SEQ ID NO: 6766301 - DNA, 104 bp, Homo sapiens
aatatgtcattttcattcatttggaaactaaagagctgtgctttgcaccacgtccttgatgtcagcaaagccagctctgtcggactaaaatgcagagacatgtt

SEQ ID NO: 6766302 - DNA, 83 bp, Homo sapiens
gagcacaccattttgagacaatatataattttagttggagtgaaacaacattcaacaagtatagctgttttgaagtggtcctc

SEQ ID NO: 6766303 - DNA, 88 bp, Homo sapiens
ggagaattgcttgaaccctggaggcggaggttgcagtgagctgagatcgcgccattgcactccagcctaggcaacagagcgagactcc

SEQ ID NO: 6766304 - DNA, 56 bp, Homo sapiens
gtaatgaatgaaagaaactgggtgaagggtgggtacgcaggatctttctgtattat

SEQ ID NO: 6766305 - DNA, 77 bp, Homo sapiens
aggcaatcacactcctggggattataggagcttggatacatgtctttccttataatgccctaaggatgtgattatct

SEQ ID NO: 6766306 - DNA, 71 bp, Homo sapiens
ggtttctgggatagggtctgagaatttaaatttccaacaaattctcaagtgatcctgttgattcagagacc

SEQ ID NO: 6766307 - DNA, 58 bp, Homo sapiens
aaaaactagttgttcccaagaatacaattcctttcccttttgggcacggctagatttt

SEQ ID NO: 6766308 - DNA, 79 bp, Homo sapiens
gtagacctgagttctaaggctttccttgtcatctttgactcttcaaagtttagggaagggaagccttatatcacactac

SEQ ID NO: 6766309 - DNA, 58 bp, Homo sapiens
ccgcagctggccactcaggaaggcagctcttccatctggctctgaggattagctgtgg

SEQ ID NO: 6766310 - DNA, 66 bp, Homo sapiens
gtcctgcctctcaaatgtcattcctctatgattctctatcacagagatgcccatttgggttcaggc

SEQ ID NO: 6766311 - DNA, 90 bp, Homo sapiens
agcctgttttagcatgtcctcttaatgaccttaattcaagatatcactttgagttttgaaccttataataggagatggctcctacaggct

SEQ ID NO: 6766312 - DNA, 77 bp, Homo sapiens
gatgctttggtccagaggttgtttgagtgaagtaagcatttaggtacttgtacactcagtacttctagacttccatc

SEQ ID NO: 6766313 - DNA, 113 bp, Homo sapiens
acattacaaggtatgaagcgttcgagataggtagaatagagcaggttatattagagaagtctcttctaaaattgtgttggctagcctgggatttgaacttataccgtgtatgt

SEQ ID NO: 6766314 - DNA, 59 bp, Homo sapiens
cccctgatctaattccttagggtcaggtagaagttagccaggcaggtgtggagaagggg

SEQ ID NO: 6766315 - DNA, 73 bp, Homo sapiens
gaggagctaggtgtggggctgtggtgttcttctgctgggagtgtgggggacgcagggccccgcgtagcggttc

SEQ ID NO: 6766316 - DNA, 60 bp, Homo sapiens
gggccaggtggaccccagcctcttagcctcccccagggctgcagccacattccctggccc

SEQ ID NO: 6766317 - DNA, 56 bp, Homo sapiens
tgcctgtgcccttcttggcattcagaaattcctctgtgccacaggaagtatgggca

SEQ ID NO: 6766318 - DNA, 91 bp, Homo sapiens
ggaaccgggaaggcacgaagtctctaaagcatccagaagacccctacaccagggtctggtccgctcctattcgccgcagcctttctgttcc

SEQ ID NO: 6766319 - DNA, 71 bp, Homo sapiens
gggcttggtgaatacctggtcccacatctcagatgaagttctgggaatggaacctggagttggcgaatccc

SEQ ID NO: 6766320 - DNA, 70 bp, Homo sapiens
ggttattttcattggctcagactgggcaaagttttgcctgcaggtttttggtgctcttggagaattaatc

SEQ ID NO: 6766321 - DNA, 80 bp, Homo sapiens
gtaaggcattctatggaagtacagtcaggcacgcaattcaaccaaagtgggcaaaggaaggcttccaggagggctgatat

SEQ ID NO: 6766322 - DNA, 110 bp, Homo sapiens
tccctgatgactccttagaggaagtggtaacccaggcttcccaatcagaaggcacagggaagactgacctggttgagggaggtgtggaccgtggggagtaacttcaggga

SEQ ID NO: 6766323 - DNA, 68 bp, Homo sapiens
agtcttgaagagtgggaaggatttggctggacctgcaagaccagacgagttacatccaccttcaattt

SEQ ID NO: 6766324 - DNA, 64 bp, Homo sapiens
gcaaatgtaaacagcaagagaagggaggttttccctggagcatctctgctgtctacgaactggc

SEQ ID NO: 6766325 - DNA, 105 bp, Homo sapiens
gcagggcgatgacatagccggagtcctgtgggcaagcaggcgagggcctggagcagcaagtctgcctgtgcctccctgtcctgcctgcccacctgctccccctgc

SEQ ID NO: 6766326 - DNA, 69 bp, Homo sapiens
ggccctgttctgtctcatgttgcacactcaggatagttgggtgtcatgtgtacagaataggaaggtgcc

SEQ ID NO: 6766327 - DNA, 61 bp, Homo sapiens
cctggcctggcactccctctgcacacattccatgggcaggcaagcaggggcccgggccagg

SEQ ID NO: 6766328 - DNA, 83 bp, Homo sapiens
ctgcatgttagtctaacgttctgatagaaatgacatgcatttatgctgccatttgttactatcaggactcgactcgtgtgcgg

SEQ ID NO: 6766329 - DNA, 83 bp, Homo sapiens
aaaggacagtcagcagggtttgccatacttatgcatcagctaaaagtataaaccttggtagcatcttgctggcactatctttt

SEQ ID NO: 6766330 - DNA, 82 bp, Homo sapiens
ttagctcatcatgcagttttgccacctaagagatttcttttactccctctcttaagtgtctgtctgactgcatttgttctaa

SEQ ID NO: 6766331 - DNA, 112 bp, Homo sapiens
cccccacttcagttcctggcacagagctgggtgccccctggagggtgccaaatagattcctctaaactcctttacccagaccttttggccaagagcaagacaggagtgtagg

SEQ ID NO: 6766332 - DNA, 75 bp, Homo sapiens
tcatactggatctcttttatggtctacctctttattttaaaatagacactttagaagtaagggttctccagatga

SEQ ID NO: 6766333 - DNA, 67 bp, Homo sapiens
gccataaccactggctctaacattttggtcatctctgggactgcagtaaaggacagtggtaaagggc

SEQ ID NO: 6766334 - DNA, 58 bp, Homo sapiens
ctaggatgacaccaccaagacctatttctgacatgaggtgtgttccctgtcatcctag

SEQ ID NO: 6766335 - DNA, 89 bp, Homo sapiens
gctaaaattaagtaccatgtagcatctatcctgataaaagtagtgacttataacagtttaggtggtgtcatttgtaagttaacttcagt

SEQ ID NO: 6766336 - DNA, 116 bp, Homo sapiens
ggggttttgtttttttggcccaggaatatgctgtttttcttgacgttgctgtgaaaatcctgaggggttttgaatagaacaaggtagacagctttggatgtaagcagcagaagctc

SEQ ID NO: 6766337 - DNA, 70 bp, Homo sapiens
cttcagtaaattaattgccatttctgatagaaactctttcaaatgtcaggtttcagttaatggtttgaag

SEQ ID NO: 6766338 - DNA, 72 bp, Homo sapiens
ttacttgtcagcagtttttagtggaggaaaaactgcagttaaagcacctttactgagaactttgagcagtaa

SEQ ID NO: 6766339 - DNA, 55 bp, Homo sapiens
gtttgttttaagataggatggagccttatagctctccccacatttctaaacagac

SEQ ID NO: 6766340 - DNA, 76 bp, Homo sapiens
attaggtggcctgggtacatgaagtatctttttggatgcctagaacacaaaaagggacgacaacaggccacctaat

SEQ ID NO: 6766341 - DNA, 82 bp, Homo sapiens
gtgctgaagggccatcgagggtgtgctgacccagctctgagatggcaactggtgttcatgcccttctataagtccctcacac

SEQ ID NO: 6766342 - DNA, 72 bp, Homo sapiens
ttccccgtggtaatatatcaaagacattcattacaggctactgtggctcaggtgatatattactcaggggaa

SEQ ID NO: 6766343 - DNA, 120 bp, Homo sapiens
tatgtgtatatccatgtatacacgcatacacttatacacatgtgtgtattcatatgtttgtgtatatgtgtacatatttgtgtatgtgtatgcatgtgtgtgtgcttgcatatatatata

SEQ ID NO: 6766344 - DNA, 102 bp, Homo sapiens
ggtggggcgccaggatggctcctgggggtgctcctgccgccttccttcacggcacttacaaccggcgggacccccagggaccacccctcagggcgccccccc

SEQ ID NO: 6766345 - DNA, 67 bp, Homo sapiens
aggcccctggcagtgaccggttctagagcttttccctggagcctctggagtgtctggccagggttct

SEQ ID NO: 6766346 - DNA, 82 bp, Homo sapiens
agattgaggtcagctagaggatgtgacattcgagttgggtcacaaaggatgtacaggagtttttcaaggctgaccacagtct

SEQ ID NO: 6766347 - DNA, 61 bp, Homo sapiens
ggcacatgtacagtggaaactaacaaattgcttcaatttgtagttcaactcgtgcattgtt

SEQ ID NO: 6766348 - DNA, 59 bp, Homo sapiens
ccacagtcctggcttctgtctgctggctgcctcccccagcagataagagttgactgtgg

SEQ ID NO: 6766349 - DNA, 56 bp, Homo sapiens
tgaaaacatccagagatagaccttaccttcaggtaaggctggatccaggtgtttca

SEQ ID NO: 6766350 - DNA, 62 bp, Homo sapiens
tcacagaagcatcatacccggaagatgcacatttgaaatgctatatggtggtgtttctgtga

SEQ ID NO: 6766351 - DNA, 64 bp, Homo sapiens
gggaggaccagcaaaaaagaatcttgtactaaaagtcaagtatttatttctgctggcatctctt

SEQ ID NO: 6766352 - DNA, 73 bp, Homo sapiens
tggatgcaaagtgaaatggggcagagacaccaaaaccaaataagcgggtttgccccagctcttttactttcca

SEQ ID NO: 6766353 - DNA, 90 bp, Homo sapiens
cctggttagccggaccttccttctttgctccgggttcctccagaaccacgtgacccaggccagagaggggaggtgtggaagataataagg

SEQ ID NO: 6766354 - DNA, 130 bp, Homo sapiens
ctcctgacgacacaccctttctttcctctggcctcctgtggacccttcttcatttaggtctggttcttctgagctgcaggctgagcggggtcccagagctcacatgtagggcagtggcagtgacaggcag

SEQ ID NO: 6766355 - DNA, 68 bp, Homo sapiens
tcttcagtaaaatggatgcctgataacgtcacctttcggtgcttgccggagctccatttcatcaggga

SEQ ID NO: 6766356 - DNA, 92 bp, Homo sapiens
ggggatttttgacatcgtaaagccctatggcttcatgtgacagatggtacaattgaggcctagggtcttggttatgtgtgaattgagtccct

SEQ ID NO: 6766357 - DNA, 62 bp, Homo sapiens
ggccagaggccacagctgtgtctccagcatcagaagagaagcagtgtgcatggcttttggcc

SEQ ID NO: 6766358 - DNA, 84 bp, Homo sapiens
tctccatgaatgaatggacaggagagcatagtcacccttaaacagtgagctctgcagtcctgtccttcaagaaacaataagaga

SEQ ID NO: 6766359 - DNA, 80 bp, Homo sapiens
ggcatctggaagccctcatccccatgggcgtctgcccttcggccacaatgtcccagctgagagacaacttcacaggtgcc

SEQ ID NO: 6766360 - DNA, 62 bp, Homo sapiens
acacttgaggaatgtggtgattctcagaacagaaagggagagaagtacatatctgtgagtgt

SEQ ID NO: 6766361 - DNA, 59 bp, Homo sapiens
cagaatatgactcgggcactacatttcaatttacaggtcttgctctgagttactttttg

SEQ ID NO: 6766362 - DNA, 56 bp, Homo sapiens
gaggcagagaccttcaggacctcactggaatgtgagttctgagggcgttctgtctt

SEQ ID NO: 6766363 - DNA, 99 bp, Homo sapiens
agctcccatctggcttttttgagaggctcactcttggaacccagctactctgctatgaggaagccaaacagctacacagaaaggccagatgtaggtgct

SEQ ID NO: 6766364 - DNA, 56 bp, Homo sapiens
tacaaggcttcagctcagctatttcagagatatctgggtttcaaagaagcctttta

SEQ ID NO: 6766365 - DNA, 66 bp, Homo sapiens
cacttggtagatggtgacactgaggcttacccagtgaaagcgcccaaggtcaacacctagtaagtg

SEQ ID NO: 6766366 - DNA, 72 bp, Homo sapiens
ctggtttggggcatcaccaagaaggaggaccgggggtcgacgggccttgttgggggtgaggcgaccagccag

SEQ ID NO: 6766367 - DNA, 83 bp, Homo sapiens
ctaggagaaattagaacctgttatttctgatccttcgatccttgagaggccaatagtaggtggcatgtttgtatttctcctgg

SEQ ID NO: 6766368 - DNA, 60 bp, Homo sapiens
ggagccagtatttagtggtcttccacatataaggagtgttactacagactggttaaagcc

SEQ ID NO: 6766369 - DNA, 86 bp, Homo sapiens
ctaggttaactagattatatgtcatcacagacaccctctacatcttagggggtgtctgtgatggcatataacctagtttcttctgg

SEQ ID NO: 6766370 - DNA, 79 bp, Homo sapiens
tggccatagacctcagagtcagctagtcttgggatttggatcttagatctcctgctcactgagctcatgaccttggcta

SEQ ID NO: 6766371 - DNA, 85 bp, Homo sapiens
acttgaatttggtagtagccaacttttcttagactttgaactgtaaatgtctttaaacttgagttgttaccttggaaatttaggt

SEQ ID NO: 6766372 - DNA, 77 bp, Homo sapiens
ttataagcagccagccagatcaaactcagatgtcatcccatgattacatagtttggatgtttggtttgttgaaataa

SEQ ID NO: 6766373 - DNA, 75 bp, Homo sapiens
actgggcctggaaacacatgatgatgaactgtcctcttgattatagtttcaaaatatgtctccagtttccccagt

SEQ ID NO: 6766374 - DNA, 96 bp, Homo sapiens
agaaatggagatctgggaccatggacaaatttctagagacctattttcctggattctgtgaatctcgccgaggttttcttccggatctcggtttct

SEQ ID NO: 6766375 - DNA, 57 bp, Homo sapiens
ttcgactgctgctcaaaccatctgctgagtataaggaggtggtctgcagcagctgaa

SEQ ID NO: 6766376 - DNA, 96 bp, Homo sapiens
ctgaaagtacaatggtgagctgatgttaagattttcttcagtattatttaacaataatgaatgcagagttatttttaaaacaacttagtcacccag

SEQ ID NO: 6766377 - DNA, 83 bp, Homo sapiens
ccagacttctatctggtgtcttctggtacttactttgagcccaggatgagctcaggagcatcagaagaaatgtgtagttatgg

SEQ ID NO: 6766378 - DNA, 78 bp, Homo sapiens
accccagccctgccagtcatcacgtcttgggcttccctggggccaggcaggggaagctgcgtggtctagggcttgggt

SEQ ID NO: 6766379 - DNA, 74 bp, Homo sapiens
ggcagagaagtaacgaggaagataagggttagcttaacaaggtttgtttgtacagattttcctcggtctcagct

SEQ ID NO: 6766380 - DNA, 80 bp, Homo sapiens
cctatcaaagactctaggtagcttataagcatgaatattgattgacttgattgttcctgctatttggggatcaggggagg

SEQ ID NO: 6766381 - DNA, 58 bp, Homo sapiens
tcaacattgagtccctgggtctccacatctgggaaaatcaggcaaaactcagtcttga

SEQ ID NO: 6766382 - DNA, 82 bp, Homo sapiens
ggtagccacccagctctttgatggtcttggcctgctggttcaggaagtcgttctccaggaagtcgcagagctgggggtcgcc

SEQ ID NO: 6766383 - DNA, 58 bp, Homo sapiens
atttcatgagctaatggatctctgaaaagccaatttaaatttccagggtttatgaaat

SEQ ID NO: 6766384 - DNA, 77 bp, Homo sapiens
aaacctccatcacacattctgtcctcatctgccccaagggtaccccctggaaggagatgggacatgtacaagggttt

SEQ ID NO: 6766385 - DNA, 100 bp, Homo sapiens
gtataggcttcaaggtggctttctgctgaggtggctgccagcctccctggagaaggtgtcagctgaagacctcaagtaagagccacagtgaagctcatat

SEQ ID NO: 6766386 - DNA, 66 bp, Homo sapiens
agataatacttattaagcacttactttatgccaggctgcatgctaagtgtttgttaagcattgtct

SEQ ID NO: 6766387 - DNA, 82 bp, Homo sapiens
catgtgtcacttctgggcagaagttttgagaaccagcctacagtttgctctgtctcgtttccttctgccacagatcaccatg

SEQ ID NO: 6766388 - DNA, 77 bp, Homo sapiens
atctcccgtgcccagcccacaagcccatctggggtcccgagtgccaggaacaggctgatgggcaggaagtggggggt

SEQ ID NO: 6766389 - DNA, 79 bp, Homo sapiens
cctggctaattccaagtagcatcccatcacagcaggcatgaacacctgaatggtacctgctactggcagatttcctagg

SEQ ID NO: 6766390 - DNA, 71 bp, Homo sapiens
aatattctaataaatgcccatcaatggatgaatggataaaccaattgtgacatgggcatataagggatatt

SEQ ID NO: 6766391 - DNA, 58 bp, Homo sapiens
ggaaggggtgtcgcccatggatggagagcatccattcttccctcctgacactgctttt

SEQ ID NO: 6766392 - DNA, 61 bp, Homo sapiens
cccagatgagaatatgatttactattgcttttctggtaatattatcatatgtttatgtggg

SEQ ID NO: 6766393 - DNA, 73 bp, Homo sapiens
gtgagagcgtgctgggtcagcctctccctggcgggaatcctctccgtccagtcttctaacctagcagcctcac

SEQ ID NO: 6766394 - DNA, 61 bp, Homo sapiens
gcttagggatgttctggaactccagatggcaccctgggattcctgcctacatgccttatgc

SEQ ID NO: 6766395 - DNA, 55 bp, Homo sapiens
agttttcctgtccctcctagaaattaaattattttgggcaggtgaagagagggct

SEQ ID NO: 6766396 - DNA, 61 bp, Homo sapiens
gcacacatgcatgtaagacctcttgggcagctgggaggcagttcttcctgcgtgttcatgc

SEQ ID NO: 6766397 - DNA, 58 bp, Homo sapiens
tgggcagtcatcagcacaccggctctcacgagcctgtgggaaaggatgagattgccca

SEQ ID NO: 6766398 - DNA, 62 bp, Homo sapiens
tgttaataaggagcctaatgggtggacgtttagtcagcatgcattttctctctttggttgca

SEQ ID NO: 6766399 - DNA, 78 bp, Homo sapiens
ttaacatttctgttaagtgggcgccttgaattacttgttatccaagtgcagcagctgctccttaacacttattgttaa

SEQ ID NO: 6766400 - DNA, 63 bp, Homo sapiens
tctgggtatgacctatttttccagactaaagctgcaactagatggaaaaatgcatgctcaaga

SEQ ID NO: 6766401 - DNA, 55 bp, Homo sapiens
ttctgagatgcgttagaaatttttggaaactagaacattctatgtgcattcagaa

SEQ ID NO: 6766402 - DNA, 129 bp, Homo sapiens
gcagagcatcccctagtttcctggcttgagggttcactggggaatggctgtctttgcaactttaaacagaagcctaaagcctgcaaagaagcctttgccttctgcctccctcggctatatgtgtgttgc

SEQ ID NO: 6766403 - DNA, 76 bp, Homo sapiens
tatatctaggctgaatgtaaaatcccttatgttgtatcaatgggggtaaaaactatttttatttgcctatgatata

SEQ ID NO: 6766404 - DNA, 55 bp, Homo sapiens
cctatcgctcatggagtagacaagaaaccttgtgatattcaggatgggtgatggg

SEQ ID NO: 6766405 - DNA, 90 bp, Homo sapiens
tgtatcactcttcaaagtgttatgaaattttttttggttagcccagaaacagtttataacatgatactacttgaccatggggatgataca

SEQ ID NO: 6766406 - DNA, 56 bp, Homo sapiens
ttcagaagcagcgaagtggaagggactcaaggactataccagcttgctgcttggaa

SEQ ID NO: 6766407 - DNA, 102 bp, Homo sapiens
tttctttttggacttgatggggggcgccatggtctcttggtcactttccccctcgtagtcctccaggctgctgttggtgtccgcctcgtagccaaacagagg

SEQ ID NO: 6766408 - DNA, 63 bp, Homo sapiens
ggaggcaggggaggctctccaggctttggggccgtgacagcagcttgggtctctcctgcttcc

SEQ ID NO: 6766409 - DNA, 72 bp, Homo sapiens
gtataactggattctgtctttggaaaaaagaatcattgactttaccacagacagatttcagtaaatttgtgc

SEQ ID NO: 6766410 - DNA, 88 bp, Homo sapiens
cagattattctggtaccataacgtaatgaacttgattctcatccggagtacattttttattagtctgtgggatcagaggcaaaatttg

SEQ ID NO: 6766411 - DNA, 88 bp, Homo sapiens
attattcattctaaaatattaattttgtgtgggatcaaaggaagtggatgtgctttttgtggaacaaggttgaccaagaatggatgat

SEQ ID NO: 6766412 - DNA, 83 bp, Homo sapiens
catcagagctgaaaatatactaggattttattttccatgagaaaatagttctttatgagaaaaagattgtaacagctttaatg

SEQ ID NO: 6766413 - DNA, 82 bp, Homo sapiens
tttctcaggcatataggggtatcatttcttaataaatcatgacttgataactggttaagggtgaaatccataaactgagaaa

SEQ ID NO: 6766414 - DNA, 73 bp, Homo sapiens
cctggcgcagtggctcacgcctgtgattccaacactttgggaggccgaggcaggcggatcactggaagtcagg

SEQ ID NO: 6766415 - DNA, 64 bp, Homo sapiens
attgtgaatggtgccacaataaacatacatgtccatgtgtctttatagcagcatgatttataat

SEQ ID NO: 6766416 - DNA, 89 bp, Homo sapiens
gctctatgacaatttggcaggactgttaagtatacagctgggagaatcagaccgcctgcatgcaactcccagttctgccatttattagc

SEQ ID NO: 6766417 - DNA, 66 bp, Homo sapiens
agcaccttcttggagtttacatgctggtaattatgccagacagtaataaaataggtaagaacggct

SEQ ID NO: 6766418 - DNA, 57 bp, Homo sapiens
ggaacaagtgaaagtccttttcgataatttctttgttgaattttgcttccttgtttt

SEQ ID NO: 6766419 - DNA, 67 bp, Homo sapiens
tcatcactagctcaacatttactagtatcgtattgttgtatttgtagtatttgctgagtgagtgaga

SEQ ID NO: 6766420 - DNA, 92 bp, Homo sapiens
gagtttgactattcgagatatataagtgaaatcatacagtatttgtctttttgcgactggcttatttcacttagcataatgtccgcaaactt

SEQ ID NO: 6766421 - DNA, 107 bp, Homo sapiens
cctgtgttttacctggtgatcagttctcaggctagtctaagtctgtgctgtcttggcatgccttgggtttcctatcctgagagtggtaatgccagtagaatgatggg

SEQ ID NO: 6766422 - DNA, 55 bp, Homo sapiens
ccagctacactttccccatctgtgaaatgaggtgtctggattcgactgtggttgg

SEQ ID NO: 6766423 - DNA, 62 bp, Homo sapiens
cctcctgaatccaggagagtagggtagcctaacccaaatctcatgaattcagaaaccagagg

SEQ ID NO: 6766424 - DNA, 120 bp, Homo sapiens
tcagatccaggagttctgtcaaagtctgaaatattggtaatactttggatccaaagatcaagagttcataaattattaatattgttcaatgaaactttacaaaactcgaggatgacctga

SEQ ID NO: 6766425 - DNA, 60 bp, Homo sapiens
tcaggctagattggggccagtagggtctagtggttttagggcccacatatctagatttgg

SEQ ID NO: 6766426 - DNA, 63 bp, Homo sapiens
gcaggctctgaggtcccaggattctgtggagattcacaggggacctaggaccctcggagctgc

SEQ ID NO: 6766427 - DNA, 84 bp, Homo sapiens
gattatgcaacattactgaggcaatagataacggctacagtaatggaatgtagttcaagtatctccttagtttcaggtatggtt

SEQ ID NO: 6766428 - DNA, 93 bp, Homo sapiens
gattttagggaagaagttagttaaactagcgacttaagaatacatgcttacaggtcagtttgactgaattttaccactttcatccccaaaatc

SEQ ID NO: 6766429 - DNA, 57 bp, Homo sapiens
agactgggactggtgggaatgtgccagcaatgtgtgcatgaagccggttccctgttt

SEQ ID NO: 6766430 - DNA, 79 bp, Homo sapiens
gtaaagctgtatgtgaaaatgtcaagtgctttttaagaatggattttacacttgccattttcaagtgcagtagatttac

SEQ ID NO: 6766431 - DNA, 66 bp, Homo sapiens
tctaggtggtttgcaaaattacaaacgtggtagtaaaaccaaagtaatgatgggaatttacttaga

SEQ ID NO: 6766432 - DNA, 85 bp, Homo sapiens
gggtgcagggctgagggagagaatggggcaaacaccaatgcatgctggtcttcctttcttcagtctcctttcccacctgctactc

SEQ ID NO: 6766433 - DNA, 101 bp, Homo sapiens
ctggcctgcaggtaccatgtggctgtggcattgccgaggctggcgagctccaagagcagctcagggcactgcgcagcaggcatgaggcccgcgagacccag

SEQ ID NO: 6766434 - DNA, 69 bp, Homo sapiens
atgatggggaggtacagttgtttgtttataagggatgcatttatctcaagaattggtttcctctgtcat

SEQ ID NO: 6766435 - DNA, 129 bp, Homo sapiens
tgattgcttcaaactctgcttaatatgggaagaagcagacaggatctgcctaaattacatccaggctgtctcctggtaggctcccagatcgtttgctgttatcctaaaaaggagaggcacaggtagtca

SEQ ID NO: 6766436 - DNA, 72 bp, Homo sapiens
actgttgaatgagtgaattctaaatgctaaagagttttccattcaaagtaagaatttattacaaaagacagt

SEQ ID NO: 6766437 - DNA, 58 bp, Homo sapiens
ttttgtgtcattaaattgccactctatttaaaatgagtggcaattcagtagtacaaaa

SEQ ID NO: 6766438 - DNA, 72 bp, Homo sapiens
tacacattcctgggcttaaccccagacttactgatgcagaatctctggggataagacccaggtatttgtgta

SEQ ID NO: 6766439 - DNA, 70 bp, Homo sapiens
tatggatgcctgggcctccttccaagaaattctcaccctgtttgactggaatggggcccggacattgata

SEQ ID NO: 6766440 - DNA, 129 bp, Homo sapiens
tagaggactaaaatgtattacttgaaagcaaatattgcagtgtgtttatgtgaatctagaaaataaatctctatcttaaagaaaatactgaatatttccataagtattatttatagtagtaggcctcta

SEQ ID NO: 6766441 - DNA, 128 bp, Homo sapiens
tagaaaaattagccggacatggtggcgcatgtctgtagtcccagctactcaggagactaaggtgaaaagatcatctgagcctgggaagttgtggctgcagtgagttgtgatcatgcctctgtactcta

SEQ ID NO: 6766442 - DNA, 58 bp, Homo sapiens
tggggctgtggattctcacgaaggggcagggcctgctcttgaggggctcacagtctca

SEQ ID NO: 6766443 - DNA, 76 bp, Homo sapiens
gggcagaataccctatagacagaatactctgtctatagaatatcctagagtattctgtctataggatattctactc

SEQ ID NO: 6766444 - DNA, 91 bp, Homo sapiens
agcagataaccacactttatggaaaactccagagagtagatgattctttatctattctcttcagggactttgctattagtgtcttactgct

SEQ ID NO: 6766445 - DNA, 84 bp, Homo sapiens
gatacatctgtggcctcatgtctataaagagcacactagattgtacccagcacttttggacatgacatgctaattatatgtatt

SEQ ID NO: 6766446 - DNA, 80 bp, Homo sapiens
ggaaccaggtgttttctgcagacagagaggcttcataagcaccctggggccagctcagatgcaggaaggacactggctcc

SEQ ID NO: 6766447 - DNA, 71 bp, Homo sapiens
atttaatgttcagtatctggtccacctgctgctgtgcatgagctgcggtgatctgacactgatcatgaaat

SEQ ID NO: 6766448 - DNA, 55 bp, Homo sapiens
ccaaactacaattcctaggcttctatttctagacatgccacaggatgaagtttgg

SEQ ID NO: 6766449 - DNA, 79 bp, Homo sapiens
gggaatgttgcagaggtaataaaattgtgtcaaacatcttctaaagtgtttataaattttcttgccatgctttattctt

SEQ ID NO: 6766450 - DNA, 96 bp, Homo sapiens
gggtggggctggggtgaggggtcagctcctagcaccccccaaacccacagggttgggcttggggtcaggggtcagctcccagcattccccccacct

SEQ ID NO: 6766451 - DNA, 86 bp, Homo sapiens
agtaataggaccaaatgatcacatttatagtggcacgcatagtagtttatgagtggcagtatatgtgtgagtgtttcctttgtgct

SEQ ID NO: 6766452 - DNA, 99 bp, Homo sapiens
cagtggtgctgggctgtccatccacaggcaagtctcttggcagattcatacagtcaccatctccttcagaacctgtgatggaaaagtccagtaccagtg

SEQ ID NO: 6766453 - DNA, 62 bp, Homo sapiens
atcagtttgataataaggcttggagagatgtgattttcaaagcttgaacctatcaaactgat

SEQ ID NO: 6766454 - DNA, 75 bp, Homo sapiens
gggtgttaaatggctccttctgtgcagttttggagggaaaagattcaagagagacaataggtagcattaataccc

SEQ ID NO: 6766455 - DNA, 59 bp, Homo sapiens
ggggacggggccgtgggcggggcatcacagtaggtgtggcctgtctcacgttccgcccc

SEQ ID NO: 6766456 - DNA, 65 bp, Homo sapiens
ttggtcactgagtccactgtcatgagccacactgtgtggtttgaatgacatgattcaggcattaa

SEQ ID NO: 6766457 - DNA, 115 bp, Homo sapiens
agtgggaaatgaggagtgaggtagggagaggaaggaatgtgcctcaacatgaaaacactgaggatcattttgatgcccttttagttccttacctactaacatctctagtcctatt

SEQ ID NO: 6766458 - DNA, 56 bp, Homo sapiens
catacagagtaatttgcatggggagtatggacttactatgtatgtatgtctgggtg

SEQ ID NO: 6766459 - DNA, 89 bp, Homo sapiens
gctgaagtttgtggccctgtagtaatgaccatgtactgcaactggtgtcagtgacatttaaaaccacagctctgccagtgactttcagc

SEQ ID NO: 6766460 - DNA, 58 bp, Homo sapiens
gaagatctctcagtggctcctgtgtccctttgacataggccaatactgtagagttttt

SEQ ID NO: 6766461 - DNA, 64 bp, Homo sapiens
aatttaggtctatgattcattttgagctaatttttgtgtgtagtgaaggataaggatctaaatt

SEQ ID NO: 6766462 - DNA, 72 bp, Homo sapiens
gcaagacaaggactgagttgaaaattggcacctggttcaggtcactgagctgtaattctgtctttgccttgc

SEQ ID NO: 6766463 - DNA, 56 bp, Homo sapiens
gagcttcagaatttaacagacttcttgagagggaagctggatgatgtttgaggttc

SEQ ID NO: 6766464 - DNA, 72 bp, Homo sapiens
ttggccttggccttctgcccaagtggagtctccgcattcctttgtatgggcccattgggcatgcctggctaa

SEQ ID NO: 6766465 - DNA, 77 bp, Homo sapiens
tttgaatagtccatctgtcacttatagtcgtgacaatgaaccatgacacctataagcgccagatgtgctaatttagg

SEQ ID NO: 6766466 - DNA, 130 bp, Homo sapiens
agggtagatacgtcagcaagtcagatgtttggaaggcttaatttaagtcactgatttcagttcaagagaagggacctctgccagctgccatggcctgaatttacctttatacatacagatactctgccct

SEQ ID NO: 6766467 - DNA, 57 bp, Homo sapiens
atctgggcagggcagcaaggcgagccacacttcacctaaactaattcctgctgagat

SEQ ID NO: 6766468 - DNA, 76 bp, Homo sapiens
caaggtgtatattctgcctaaaagcttttccgcactctttacacttaaaaggcttttctccagaatgtactctttg

SEQ ID NO: 6766469 - DNA, 83 bp, Homo sapiens
tggcaggctagagtctctcattaatctgtattttcattttaaaatgagtactttgcattagtaagtaattttaatttttgcca

SEQ ID NO: 6766470 - DNA, 60 bp, Homo sapiens
gaggagggggatgcacctggggtgctggaaacatgcgtgcaggggtcctcctggagcctc

SEQ ID NO: 6766471 - DNA, 69 bp, Homo sapiens
gaaaggagtgctttccaggtctctcagttttaaccatgggaatctttttcacaagaaagcacttgtttc

SEQ ID NO: 6766472 - DNA, 78 bp, Homo sapiens
tgtctgtccaaggactagattatacaataggttgtattatataaccagtattatataatactatccaagggctagacg

SEQ ID NO: 6766473 - DNA, 92 bp, Homo sapiens
gagctttgggcagtggtccttagggcagttggttgaactattgttatgaaactggtcagtcaattagttctagcaaccactttcactggctt

SEQ ID NO: 6766474 - DNA, 71 bp, Homo sapiens
tcacgacactggggattggtttttccttcctgctaagactgggctggcactgagggccacttccatcgtga

SEQ ID NO: 6766475 - DNA, 70 bp, Homo sapiens
ggggagcgagcggcttgcgtacacacacagcgtctgtcactctgggtgtggcagggcgtttgcagacccc

SEQ ID NO: 6766476 - DNA, 67 bp, Homo sapiens
ctggcacttcctggacacccagagcacaggctaagccagctctgaaggtgctagagaaagctgttgg

SEQ ID NO: 6766477 - DNA, 59 bp, Homo sapiens
agtcacttccagacacctgcctggtgcccaggtgtgcactgaggcaggctggagtgact

SEQ ID NO: 6766478 - DNA, 71 bp, Homo sapiens
gggggtttcctcagcagtgagaattaatgttgtttaaagacacatttccatggcacgactcggttattcct

SEQ ID NO: 6766479 - DNA, 60 bp, Homo sapiens
ctggccagttgccttcctgggtgaaattacagcttccaggctcagaggctgctggtccag

SEQ ID NO: 6766480 - DNA, 60 bp, Homo sapiens
actggcctggacttagcaacttgggcttcaggtttcatgtactgcttaggtcaggtcagt

SEQ ID NO: 6766481 - DNA, 55 bp, Homo sapiens
tgatgactgttcttcctgttgccttcagacctggcattaggattttaggtcatca

SEQ ID NO: 6766482 - DNA, 62 bp, Homo sapiens
taggtatattttttcagttttaagctgcatcatggcagtgagttaactgttgaaatagcttg

SEQ ID NO: 6766483 - DNA, 74 bp, Homo sapiens
tgccacccgcattccagttctatgaattcaagagatttttctttcaatttccaggctagaatttcatggtggta

SEQ ID NO: 6766484 - DNA, 70 bp, Homo sapiens
gctggccaggcctcactggagtaggaattttagatgaaactgagtccgtttctccttgaaggcaggcagt

SEQ ID NO: 6766485 - DNA, 59 bp, Homo sapiens
tgaacgtgcccagtccccatctgatgtaattggtctggagaggggtgtgggcatcttta

SEQ ID NO: 6766486 - DNA, 80 bp, Homo sapiens
gcaagtgggtcattaggaaatgtgttgcaagcagaagcttgaaaactgcttgcacattggcattttctgtctcctgctgc

SEQ ID NO: 6766487 - DNA, 70 bp, Homo sapiens
tcatccagcaagttttagcaagtggaaagggtagcaattggccctcactactagctatgattggtagtga

SEQ ID NO: 6766488 - DNA, 73 bp, Homo sapiens
tacctggagggccccacggctgggtctcagatcagacattcaggaccagatgctctggcgccttcctcaagta

SEQ ID NO: 6766489 - DNA, 76 bp, Homo sapiens
ggaccggatggctcaagagcttttgagaacactggtgtccaatatttcatttgaagttgttgagtagatctcctcc

SEQ ID NO: 6766490 - DNA, 87 bp, Homo sapiens
gtttagttactttcttttaggtcatgattcctactctgcgacccaactcagcagagtatgagcatggctttaggatggtagttgtac

SEQ ID NO: 6766491 - DNA, 60 bp, Homo sapiens
ccacagggcacaaccacattccacttttctacctgaaaggggtgaggtttatgttctggg

SEQ ID NO: 6766492 - DNA, 62 bp, Homo sapiens
ttgtgtgaagttttggagagggaaaatcctctaataggcttgaccttttttaacttcagcaa

SEQ ID NO: 6766493 - DNA, 124 bp, Homo sapiens
caggcaagcatcttagtattcctgagtcttgtatttcacatctatgaagtgaggatagtttaactctaccttatagtatgatgttgagaattaaattaaacaatatagttgagaagcttgtttg

SEQ ID NO: 6766494 - DNA, 62 bp, Homo sapiens
ggcagacccgtgctctttctgtctctgcacccagtgtgtgttgatacagtaaggtgtttgcc

SEQ ID NO: 6766495 - DNA, 70 bp, Homo sapiens
gctgggaaggaccctctggggtctcagtgccctcccctggcatttgaggcaggtccgggtccttcaaagc

SEQ ID NO: 6766496 - DNA, 82 bp, Homo sapiens
gataactaacttcaagtgacatcatgtcagcaaagtatctggcatagtacctgtcatgtcaatgttcagttgaacagatatc

SEQ ID NO: 6766497 - DNA, 78 bp, Homo sapiens
ccagctggtctagatgcgggcagggaccttgtctgttttcactcatctctgcgtccccagcatcgagcacatgtctgg

SEQ ID NO: 6766498 - DNA, 61 bp, Homo sapiens
gaagcattcacaccatgggctattacggcatgacccggaaggcagtgatgtgaagtgcatc

SEQ ID NO: 6766499 - DNA, 71 bp, Homo sapiens
gggaggggcagccatggaactccatgggccaaagccccagggcattaggagttaatggctggtcctaaccc

SEQ ID NO: 6766500 - DNA, 80 bp, Homo sapiens
tgaaatggctccagttgactttttagagaaatacatagctgcatttgtgaaaaacaggaagttaactgcagagcctctca

SEQ ID NO: 6766501 - DNA, 81 bp, Homo sapiens
gggtatgttgttttccagtgtttctaagtagatgtgaaagaaaacctcatttaaactctactcagaaatcaacaaaagcct

SEQ ID NO: 6766502 - DNA, 86 bp, Homo sapiens
agagtctctctttgtcatccaggctgaagtgcagtggtgtgatctcggctcactgcaacctcagcttcccgggttcaagtgacttt

SEQ ID NO: 6766503 - DNA, 60 bp, Homo sapiens
tttacaacctcatattctgatgtttgtatacatagacgggctttagggtgaaggtgtgag

SEQ ID NO: 6766504 - DNA, 92 bp, Homo sapiens
ccctagctgtcttcggcggagggcggggccgctaatcactttccagagtggggccgcggtcctgccctcgcttgtgagggcccaggctgggg

SEQ ID NO: 6766505 - DNA, 128 bp, Homo sapiens
ccatttcttgaccaccaggactccaactgtggcaggggtctttaggaacgtcgggagtgagtacaacacagcccttgtacccaggagcttacaatggagttggagacatgagtcacagatagaaatgg

SEQ ID NO: 6766506 - DNA, 57 bp, Homo sapiens
ttgtatgtgccagatgctctctctgttgagacaaggaagagtaactggcacataggg

SEQ ID NO: 6766507 - DNA, 55 bp, Homo sapiens
tacatcacaaacatgaagtgtcggccaatagtcaggcatggcatgtagtgaagtg

SEQ ID NO: 6766508 - DNA, 57 bp, Homo sapiens
tcacagacagtgtccctttgttgggggagacctcagtggcctctggctttgctgtga

SEQ ID NO: 6766509 - DNA, 77 bp, Homo sapiens
cactaagtccagagataaagtaggcttctgctccatttttctgcagtttctcaggctctgcttttctggatatattg

SEQ ID NO: 6766510 - DNA, 57 bp, Homo sapiens
caaccacctccttctcctgtatgccaaggataaaggtgctgaggagcagtgtggttg

SEQ ID NO: 6766511 - DNA, 61 bp, Homo sapiens
atctttagcagtttgtttctactgatgtgtttgatccagtgggtcccaaactcctagaggt

SEQ ID NO: 6766512 - DNA, 55 bp, Homo sapiens
gagaaatgagggatgggcagaacccaagactcgggaccccagcccaccatttctc

SEQ ID NO: 6766513 - DNA, 92 bp, Homo sapiens
catgggttgagggaagggactcctttcctctgggcctggctcagttctggcctgacccaggagcaaagtcgagggctttccttgggcctgtg

SEQ ID NO: 6766514 - DNA, 68 bp, Homo sapiens
gtctgtatagtttaatggtcaactaatgacggctcaagcttcgttcaaacaccttgaacctattagac

SEQ ID NO: 6766515 - DNA, 74 bp, Homo sapiens
gtgtttaatttgcttgtcctggtgactgtccgttgactctaagagcagacagagatcagaggcataagcagcat

SEQ ID NO: 6766516 - DNA, 70 bp, Homo sapiens
gcatattgagcattagaagttaattatatttccactgagatacccaggatgataatgttcacatatatgt

SEQ ID NO: 6766517 - DNA, 60 bp, Homo sapiens
ttttatttgatgtttcattttagtatggatattttgctaaacttgagcagtcagatgaag

SEQ ID NO: 6766518 - DNA, 55 bp, Homo sapiens
ttccaggaagattcaacaaaagccacggcttctctgagtttgttgtttcctggag

SEQ ID NO: 6766519 - DNA, 83 bp, Homo sapiens
catgtgtatgagtcgacagccagtgcctttaaccactccctaccctacatgtgtgccaggcatgtgctgtttgtctccacatg

SEQ ID NO: 6766520 - DNA, 64 bp, Homo sapiens
agctttgaggggagaatgtcttgtgattctccagaggattatgccaggacatttccctaaagct

SEQ ID NO: 6766521 - DNA, 64 bp, Homo sapiens
aaccactttaattagctcatgattctgtgtattatcaatttgtgttgggctcattcaggtggtt

SEQ ID NO: 6766522 - DNA, 61 bp, Homo sapiens
atggcaatttccaggttcaaaatgggccacctctattattgcatttgaccctcagtgccat

SEQ ID NO: 6766523 - DNA, 68 bp, Homo sapiens
tcctaggtcctatatgacctagctgtgaatgtggatatgttatgtaggttaagagtaggacctttgga

SEQ ID NO: 6766524 - DNA, 68 bp, Homo sapiens
ggttctggatcctctctggggggccagggttgtgttcttctccagacaacagagggtgatccagtacc

SEQ ID NO: 6766525 - DNA, 81 bp, Homo sapiens
agggtcatggagtaagtaaatgttggagctcaaatttgaaatcaggcagttcaaatgtatactttaccacctctagatctt

SEQ ID NO: 6766526 - DNA, 109 bp, Homo sapiens
cactgctgtatttccagtacctggcacagagtgtgtcctcagtacatatttgtagaacacatgactgatgcccactttgtctgggttaccttgttagcttacagctctg

SEQ ID NO: 6766527 - DNA, 69 bp, Homo sapiens
gaggagaggtcaggagagaaggctggctgaggagcgcctggacagcagcagttgctgacgttctatatc

SEQ ID NO: 6766528 - DNA, 60 bp, Homo sapiens
tttatgatttagaaagattcactgagagaaaaatacttagtgtttttttaaatctgtgga

SEQ ID NO: 6766529 - DNA, 81 bp, Homo sapiens
ccgccttgtgctgtagagcctgtgacatttccaacaatgcaacactatttggtaaatattaaaggctgctagagaaagggg

SEQ ID NO: 6766530 - DNA, 55 bp, Homo sapiens
ggctcacaaaatgttgcttaataatcatgcgttggttctgtaacattctgtagcc

SEQ ID NO: 6766531 - DNA, 55 bp, Homo sapiens
gtgtcaacagccgaagataaatacgattttatcagctcggaatctgttgaaacac

SEQ ID NO: 6766532 - DNA, 124 bp, Homo sapiens
catatgcatatctgggtatatatttggatatatgtgtgcatgtatgtgtgtgtgcatatttgtgtatatatgtgtacacacatatatgtatgtgtatatatatatgtatataggtatatatgtg

SEQ ID NO: 6766533 - DNA, 62 bp, Homo sapiens
gaagagctcatggtgctatctcagggcgagccaaggttgcttcatgggggccatgagacttc

SEQ ID NO: 6766534 - DNA, 79 bp, Homo sapiens
tagaaccattgtgtttggcttgaatatctgacaggacctatatagctttcctctggatataagcctcaccatgcctctg

SEQ ID NO: 6766535 - DNA, 59 bp, Homo sapiens
cataaaagtaggaccaacttacattaccaccaatagtgtatgtgagccttatttttatg

SEQ ID NO: 6766536 - DNA, 58 bp, Homo sapiens
gcctgctctgagtgtggggggtcctggaacctgtggaagacccctgactcctgcaggc

SEQ ID NO: 6766537 - DNA, 73 bp, Homo sapiens
tgtcctagatatgactagaagctcatttttaccctgaatttgtggaattgagatatgacagtcataaagggca

SEQ ID NO: 6766538 - DNA, 76 bp, Homo sapiens
caaacattcaagtacaagtctttgtgtggatatgttttcatttctcttgggtaagagatttgtgcttgaatgtttg

SEQ ID NO: 6766539 - DNA, 67 bp, Homo sapiens
cacaatgcagggagtggggtttagatagcaaaggagttgagagtgactcacagtccctgtaggagtg

SEQ ID NO: 6766540 - DNA, 129 bp, Homo sapiens
actgtaagcatttttcctttcataattgagattttgttggttgtgttgaggaccagtccacagatatctcaatttgtacacaattcttaacatacgtaccaagaatctaaaaagcttatgtgttgcagt

SEQ ID NO: 6766541 - DNA, 57 bp, Homo sapiens
atgggactatctctgaggtttgctattacaactcaaactaagagatctctgtctcat

SEQ ID NO: 6766542 - DNA, 64 bp, Homo sapiens
tttgctctgctgttgccaggtgccagtctgttttcagtgaggctttggacagcagtggggcaga

SEQ ID NO: 6766543 - DNA, 129 bp, Homo sapiens
tacatacaaaccatagtagcctggagggcaggagggagtaacgtactacagtgcagccttagaaactggtcgcttcagctgatattactcccactgctgccaccactgcctctatcattactgtctcta

SEQ ID NO: 6766544 - DNA, 74 bp, Homo sapiens
gacaaagcagtgggggtggcagtgggggcgcggttcttagcggacactggataccactgttattactacttgtc

SEQ ID NO: 6766545 - DNA, 69 bp, Homo sapiens
atgatcagcagttttcagtgttcactaacaacttcacaaatggtgtaaagcttaaaactgtagggtcat

SEQ ID NO: 6766546 - DNA, 87 bp, Homo sapiens
ggatctggcagaggcctaaccaagatgtcctcatgttgtcatcatggatcaggatatgatggttctgggcaaactgatcacatgtcc

SEQ ID NO: 6766547 - DNA, 62 bp, Homo sapiens
agagtccatgaagacagctgagagtctctcatatcagtgatcttcagcttccttttggctct

SEQ ID NO: 6766548 - DNA, 102 bp, Homo sapiens
tgtctaaagtatgttctggaaattgcaggcaccagcaggagcaggggggaaaaaaggaaagcctagctcaatgctcaatgctgcaaaagtagaaaatggaca

SEQ ID NO: 6766549 - DNA, 58 bp, Homo sapiens
caagcactactgactcttagtaaacatacaagtcaactgttggtgcagaagtgccttg

SEQ ID NO: 6766550 - DNA, 64 bp, Homo sapiens
ccgaggcaagcttgaaattggctcttccgagatgaaaaaggagaggcaggagtggcttgcccgg

SEQ ID NO: 6766551 - DNA, 57 bp, Homo sapiens
tctattgtgttttctctgtgcggagcctatagcaggtctttgtggaaggcacaaaga

SEQ ID NO: 6766552 - DNA, 83 bp, Homo sapiens
tggaaggttactgtcttgctaggagctatggaagacagaagagaaatctaagttttctctgcttctgagaaagttacagtcca

SEQ ID NO: 6766553 - DNA, 74 bp, Homo sapiens
tgggttggcctggaaggacagcgtgatggcagtcacagaagatatcacccccatctttctagattcccagccca

SEQ ID NO: 6766554 - DNA, 85 bp, Homo sapiens
gcacttcctgaaggccaggttcagtgtcgcactttctctaaacaagggtgcaaggccaccatctagtgttcaacagcggaagtgc

SEQ ID NO: 6766555 - DNA, 64 bp, Homo sapiens
cagcatctttataaaaagtaaagctgataaaattcagtacattgctttctgaagatctcagctg

SEQ ID NO: 6766556 - DNA, 92 bp, Homo sapiens
gcccaaatttcgggacagttacattaaacaaaaggatcagaaaatggaaatctattcctttgaaatggctgtaattggctgaatgttgaggc

SEQ ID NO: 6766557 - DNA, 82 bp, Homo sapiens
gtagcagcaggggacccatattttagcctttatggttatggcatgaatggccagattatatggtttttagaacttttgctac

SEQ ID NO: 6766558 - DNA, 99 bp, Homo sapiens
cagagtggtctgggagagtccagtagacaataattcaactccctgacatgtaaatagtggagtatcgatatttttgttggctcccatcgacacatcctg

SEQ ID NO: 6766559 - DNA, 106 bp, Homo sapiens
gattcaatcatattgaacaaaagactcatcctgttgttactgttctacatacagtgaatatttttactggtagtgcaaagtaatacaggctccagtaagaggaatt

SEQ ID NO: 6766560 - DNA, 77 bp, Homo sapiens
gcctgcccaaacctgggacagtggctgtgtcagtttccctggtcggagagaaaggtcctctgtcctggcttgtaggc

SEQ ID NO: 6766561 - DNA, 83 bp, Homo sapiens
gggaagctttggctctggaactatttctgaatgactgcaactttattggtccttggggcacaaggtccagagccaatctttct

SEQ ID NO: 6766562 - DNA, 60 bp, Homo sapiens
ggcagaagtgatgggatataacttccaagacaaggttataaaaagactgtggcttctgcc

SEQ ID NO: 6766563 - DNA, 80 bp, Homo sapiens
ggcttctggggacggctggggcaggcgaagcgcagctggccccagacgcaagccctgctcctccgtcccacgacatggct

SEQ ID NO: 6766564 - DNA, 102 bp, Homo sapiens
gggggagaggtgcctttaaaaatgcatattcctagacctcacccgagacctgccaagatctgtggaggacctgggagtttgtgtattttaaagctatccccc

SEQ ID NO: 6766565 - DNA, 61 bp, Homo sapiens
ttccggtctgagagcaggagaagggagatgaggtgtcccagctcaagcagttaggcaggaa

SEQ ID NO: 6766566 - DNA, 70 bp, Homo sapiens
caccctgttgctgcagccaaattcattgtcatagcaggaaatgagcttgacaaagtggtcgttcaaggtg

SEQ ID NO: 6766567 - DNA, 80 bp, Homo sapiens
gtatcagagagctttgtggctgggaagaaggtaactaaataattagtttcatttattcagtcattcattcgttctgtcac

SEQ ID NO: 6766568 - DNA, 59 bp, Homo sapiens
gccccactttagggaaacaaggaaactttgtgtatctttcagttccagaaaaggggagc

SEQ ID NO: 6766569 - DNA, 60 bp, Homo sapiens
gaacacattagtctgagttggctaataaatcctacagcccatctctagcaaatgtgtatc

SEQ ID NO: 6766570 - DNA, 55 bp, Homo sapiens
cagcatctctgggagaagcatctgtgcaaagacactgcttaaggccagagagctg

SEQ ID NO: 6766571 - DNA, 57 bp, Homo sapiens
acaacttgataggtgtggctgtgtccttccatcaagaggcacctaaagtcaagttgt

SEQ ID NO: 6766572 - DNA, 62 bp, Homo sapiens
tcacccttcaccctcacattccctccctcccttgagtgtccagagccgggctgaatgggtgg

SEQ ID NO: 6766573 - DNA, 78 bp, Homo sapiens
ctgtagtacatttaatcctcacaataaaatcagcctatgaagttataggtggaaaaactgaggattagagagattcag

SEQ ID NO: 6766574 - DNA, 74 bp, Homo sapiens
ggcggcaggggtgtgggggccgtgcaggtcttctgcccgcattggggctgcattcctccacctcctgcacagcc

SEQ ID NO: 6766575 - DNA, 68 bp, Homo sapiens
ctggccttggaatggggcagaaaatggggctgcaaaccagccctgctggcccccatttcagggtccag

SEQ ID NO: 6766576 - DNA, 77 bp, Homo sapiens
ggggtgacccgcgagtctcactgccgctcatcaataggaccaagcgttgtgcaagcggaggactccgggtcaccacc

SEQ ID NO: 6766577 - DNA, 57 bp, Homo sapiens
gccccgagtgtcaatagtaccaaggttcggaagccatggtctgaaagtatttgtggc

SEQ ID NO: 6766578 - DNA, 64 bp, Homo sapiens
tttccagtaagtggcaaggagcttaatgtactaatattttcatgttttgtccacctgcaggaag

SEQ ID NO: 6766579 - DNA, 104 bp, Homo sapiens
gtcaaaggagaggggcgcatggctgtgtgtgagaagcaggttgagggaactccttcatgcattgcagcacattcagcagcgttgccagccaatctctacttgat

SEQ ID NO: 6766580 - DNA, 72 bp, Homo sapiens
ctgattctgaaattttagttatagaaaatggaacagctttcccatttcaggtggaagttttagatgaatcag

SEQ ID NO: 6766581 - DNA, 64 bp, Homo sapiens
ctcaacagtgattctgcatgaggaaagggatcctcccagtcctccatgacatcactcaattgag

SEQ ID NO: 6766582 - DNA, 86 bp, Homo sapiens
ccctcatcaacagccacctctgggacatcccttggcctaaaggtgtgcctagtcaggtcctaagaagttggttttagttgattggg

SEQ ID NO: 6766583 - DNA, 55 bp, Homo sapiens
gttgtgttggcttgaagctcataggagacttaagacgggctctcgagcaaccaac

SEQ ID NO: 6766584 - DNA, 57 bp, Homo sapiens
acctttggtaagtttccaaaacataaactcatgtaagtaaatgggaactttagaggt

SEQ ID NO: 6766585 - DNA, 80 bp, Homo sapiens
ccatctcttaagtctttgctttaatcattgagagttgaatatatcctctcagatttcaatgtgagcattagtgagtatgg

SEQ ID NO: 6766586 - DNA, 88 bp, Homo sapiens
cgttttcttctgggtccctttgctgttgatgatgtgatacagacagttgctgtggacgtcattaaagcagtggacaagaagcctgcag

SEQ ID NO: 6766587 - DNA, 59 bp, Homo sapiens
tcccaggcctaggcatgagggagaagtgtacctgcatctccttcccccttggcctggga

SEQ ID NO: 6766588 - DNA, 64 bp, Homo sapiens
attaacaagtgtttgtgtgtgtcctgcagaccctgcaaggagggatagaaaaatacttgtgaat

SEQ ID NO: 6766589 - DNA, 60 bp, Homo sapiens
tgtatatatttatgtgtgtatatacacaggcatatgtgtgtgtacacacagatatataca

SEQ ID NO: 6766590 - DNA, 57 bp, Homo sapiens
gatggttttataaggcagagtttccctgcacaaggtctctgtttgcctgctgccatc

SEQ ID NO: 6766591 - DNA, 109 bp, Homo sapiens
ggggtgacttgatgctgagcactgtgtatcctaggagcttccttaggttaggagattaccatgagcctaggtagggctggggtactatggggagtaataagtaggcctc

SEQ ID NO: 6766592 - DNA, 60 bp, Homo sapiens
gagcagattttccctttagtgagttttagttaaactcattgaaacttaagatctaggctc

SEQ ID NO: 6766593 - DNA, 66 bp, Homo sapiens
tgagaaggtgaaagtgtggagaaaagatgtccttccctcagccatgacacatctatcacattttca

SEQ ID NO: 6766594 - DNA, 61 bp, Homo sapiens
gcacggagtgcccagttgaggctggtgactatgaaactgtagtgacaatgggcacctgtgt

SEQ ID NO: 6766595 - DNA, 85 bp, Homo sapiens
tcagtatcttccattagactgtcacactggccaggagcaggagcatttcatgtttacattcccagtgtgcagcatggtttactga

SEQ ID NO: 6766596 - DNA, 81 bp, Homo sapiens
ttatagacactggcctgtgctgtctcacctttctttttatatatgaaaatgaacagtacaaagcacagacccaggtcttaa

SEQ ID NO: 6766597 - DNA, 60 bp, Homo sapiens
gatcacatcgaggagcaatcagatggcagcctgtgatctctctgggatattgatgtgatt

SEQ ID NO: 6766598 - DNA, 59 bp, Homo sapiens
gatgtgtccttttctccatccatatctaactcctatgtggaggagagtcaaggtcactc

SEQ ID NO: 6766599 - DNA, 66 bp, Homo sapiens
gaagtaacaaggacttgtagttttatgcctaagcaaaactttaaatttgtacctctgtgttacttc

SEQ ID NO: 6766600 - DNA, 76 bp, Homo sapiens
ggggacagtgcccacctctcttcagctagggccgagggtgaggacctggctgcagatctgtgggacacgtggccct

SEQ ID NO: 6766601 - DNA, 62 bp, Homo sapiens
ggatctgagagcaagcaggaccaggaataacacatcctgagatgtctctggatttcaggtcc

SEQ ID NO: 6766602 - DNA, 90 bp, Homo sapiens
cattttagggttctttacattattgtcttgggatggtctatgctaatctagatcattttatagctatagcaactaaagagctataaagtg

SEQ ID NO: 6766603 - DNA, 59 bp, Homo sapiens
ctggagtcttcagcttgctgccaagttttgtgacctagaggcaggcaggaggtttccag

SEQ ID NO: 6766604 - DNA, 56 bp, Homo sapiens
ggatgttccaaagtctctgagctgagatgggctcacctcctttgctttggaacccc

SEQ ID NO: 6766605 - DNA, 64 bp, Homo sapiens
atggcgacaaagctctcccaccttcttcttacctgctggaagacagaggtgggggaggtcccat

SEQ ID NO: 6766606 - DNA, 126 bp, Homo sapiens
ctcagcctctgcaggaggcccggctgcagcccctggcagtccctctggtagcaccgagagctgagctcaggtacctgaggacactgtcactgggagctgggggaggggctggcctgggaggtttag

SEQ ID NO: 6766607 - DNA, 117 bp, Homo sapiens
gcacaagagcaatgactaagttcgttacatgtgatcagaaagtgaaacacatctaccatgttaatgtagctttcaatttatggtgacatttactgaaaatactctgcaatatttggc

SEQ ID NO: 6766608 - DNA, 55 bp, Homo sapiens
ggagctggaatatattgaaaccttcttgggaggtttcagaatatattctagcttc

SEQ ID NO: 6766609 - DNA, 72 bp, Homo sapiens
tgtacttgctctcaggcagttgtttgcatagttctatgaggaatgctgtaatatatgcctgcagcaggtaca

SEQ ID NO: 6766610 - DNA, 65 bp, Homo sapiens
gccaagaactatgagagcccagcgaaggatggattaattctgactgggactctcacagaagaggt

SEQ ID NO: 6766611 - DNA, 70 bp, Homo sapiens
gtgtcctttgtgagacagaagggttattctgcaaataaggaataatttctcaattgttacaggtggacat

SEQ ID NO: 6766612 - DNA, 77 bp, Homo sapiens
tttagacctagagagaaagcctggctggctgtggggtcagggctcttcagaaatgcctgcttctctctctgcctaga

SEQ ID NO: 6766613 - DNA, 64 bp, Homo sapiens
agtcaacattttcattagctattgttaatgttgttgttaacaatggagttttgagaaaggggct

SEQ ID NO: 6766614 - DNA, 88 bp, Homo sapiens
aggcaacatggtagaatccaaggcatgcaatgtcttcaggtaatcagaatgcctgtgctcccatagcttctgtgatttttttatgcct

SEQ ID NO: 6766615 - DNA, 63 bp, Homo sapiens
ggatggaagcatttcctgtgtgtgccactgctgtgctagcggctcacacggagtgcctccacc

SEQ ID NO: 6766616 - DNA, 67 bp, Homo sapiens
cagtttcctaggaatggtacctcttacaaggctcaggcctatctgaggttcattcttatagtaactg

SEQ ID NO: 6766617 - DNA, 98 bp, Homo sapiens
gattgaaatgtaggattgagtgatagaggtggttgctgtttctcagtaaagatggttgcctttactcattaaatcctggctattaaaacacttcactc

SEQ ID NO: 6766618 - DNA, 73 bp, Homo sapiens
atgtaagcaattaagtttagatgtacacttaatttttatatgtgtgatagctattcaattaatatgtttacat

SEQ ID NO: 6766619 - DNA, 62 bp, Homo sapiens
aggctcattcttgcctctgagctctcacactggctatttgctcaccaggcaggacttgactt

SEQ ID NO: 6766620 - DNA, 58 bp, Homo sapiens
acccaggaggtggaggttgcagtgagctgagatcgcgctactgcactccaccttgggt

SEQ ID NO: 6766621 - DNA, 82 bp, Homo sapiens
tgtgtttctttgtttaaagtcactgaaggccatgaacacatcaaaatgtttgtatggccgtcaatgaattacaagggtcaca

SEQ ID NO: 6766622 - DNA, 118 bp, Homo sapiens
ggaatttggatactttatggacatcagcaacatcgtcacatgtgataaggatttctgaagggtgattactcttcatccctttatcaggatgtccctgacaccataggatccaaaggtc

SEQ ID NO: 6766623 - DNA, 60 bp, Homo sapiens
gctctctggaaggtatcattatctccatgttacaagggagaaaatgagccccacagaggc

SEQ ID NO: 6766624 - DNA, 67 bp, Homo sapiens
aataatttgtgaggctgttttgaggattaaacaaggatgtctcagaaaagagcttcagaaatatatt

SEQ ID NO: 6766625 - DNA, 72 bp, Homo sapiens
catctggggacttagtaccagtgaatgagccattatctttacctattcacttattctcaaagtcctttgatg

SEQ ID NO: 6766626 - DNA, 63 bp, Homo sapiens
tgttgccagagaaacttgagcactatgtaattaagcttctgctttaaagtatttctcgcaaca

SEQ ID NO: 6766627 - DNA, 69 bp, Homo sapiens
gtcatgctttggccctccacctggctgtgctcctcttactggggcaaggagactgtagggccaagggac

SEQ ID NO: 6766628 - DNA, 101 bp, Homo sapiens
agagctgctagagaccatcctgcccatccgagttctgagattgggactgtgatgttgggacctgaggactggatggtagaatactggggtcccccagctct

SEQ ID NO: 6766629 - DNA, 82 bp, Homo sapiens
tttccgtttatgagtctgcctggatctcctgctgggtaatggcagaaaagctcaggagacccaggttaggaagtaactgaga

SEQ ID NO: 6766630 - DNA, 68 bp, Homo sapiens
agagtgtcactttcaacatttatcagtttatcagaggtgctatttttctggttttaaatggacacttt

SEQ ID NO: 6766631 - DNA, 72 bp, Homo sapiens
cagaggttcctggctccatctttgcttcctgatgctcatctgtacaggtatccacaggtgggccttcctctg

SEQ ID NO: 6766632 - DNA, 64 bp, Homo sapiens
ttggaagaaccatgcactgcagggagggggccgccccatgacagctgcaagcaggttattccag

SEQ ID NO: 6766633 - DNA, 77 bp, Homo sapiens
gcttctgagagatacaaggaggcaactgataagaagcgcatcagaagggcagttaattgcctccagtctctcggtgc

SEQ ID NO: 6766634 - DNA, 67 bp, Homo sapiens
gttcagttcagcttcaagctatgaggaacattgttagtgattgtcatagaagaggttgcagttgaat

SEQ ID NO: 6766635 - DNA, 88 bp, Homo sapiens
tctcttctttcagttctttcagtttttgctcgatgtattttgatcttttgttatgtgcatggactagaattggtttaggaggaagaga

SEQ ID NO: 6766636 - DNA, 80 bp, Homo sapiens
tgtgcatcatttggcagtggcattatcttaagacgattatccagtgtataaatgtttattgccttgctttaagatgcaca

SEQ ID NO: 6766637 - DNA, 103 bp, Homo sapiens
cttatcttttaagattgtttttggtgttcatgtgtcctggatatagttttattcctaactataattcatgaaatacttgcaatcaccccatttgatagatgag

SEQ ID NO: 6766638 - DNA, 55 bp, Homo sapiens
agcctgctgggaagggaggcttcctatctgggggggcctggaagtcaagtaggtt

SEQ ID NO: 6766639 - DNA, 60 bp, Homo sapiens
atttattctacagataagttagtttgcagaatgcccactgatacatctgtggaagtggat

SEQ ID NO: 6766640 - DNA, 59 bp, Homo sapiens
ctcttgggtgggcagtgggcctgggggagtctctctagaacttctggtgcccccaggag

SEQ ID NO: 6766641 - DNA, 83 bp, Homo sapiens
ggggtttggatcggaggccttggatgtgactccagctgcgccattccctagctgtgagtccctggggaggttactgaaaccct

SEQ ID NO: 6766642 - DNA, 109 bp, Homo sapiens
ggttgtgtgggagccatcaatgtaaggacattagaaatgatgctagccagctttcctggggcattactaggtgcttaccctgggccaatgctctgaagtgcacaggacc

SEQ ID NO: 6766643 - DNA, 86 bp, Homo sapiens
tggacgtggaaaagcagccctggggaaccagaagagttgaggtagagctcctctatcagctggcagttcagaggctgtttcctcca

SEQ ID NO: 6766644 - DNA, 73 bp, Homo sapiens
tggggccagcttctctgctgcctgtgattcagggaatagggacagggactgggagaggggctgcggtgcccca

SEQ ID NO: 6766645 - DNA, 55 bp, Homo sapiens
accctagccctctgcatgccctgccctgccagcagccatgctgacctgctgtggt

SEQ ID NO: 6766646 - DNA, 57 bp, Homo sapiens
gccctggggcctcaggccttttcctagcagtctgctaggctcctgaggactccatgc

SEQ ID NO: 6766647 - DNA, 79 bp, Homo sapiens
ttttgtgcttttatcagcatctgaccaatatctacaggactgacttctcctttaggcacagagttgagggaccacaaaa

SEQ ID NO: 6766648 - DNA, 91 bp, Homo sapiens
agcctgcgtcctaaacgtgcaaagcacttcactcccatgcaaaagcaggttctggggaagagcattgcacggtgttttaagaccacaggct

SEQ ID NO: 6766649 - DNA, 57 bp, Homo sapiens
tcgccttactcatcacagactaagtttggaaacaagatgtttccttgggtgtaggga

SEQ ID NO: 6766650 - DNA, 104 bp, Homo sapiens
ggagctcagaggcaaagggttcaatagtcaagttggtggggactttccctacttaaagttataatttgctaattcggatctattgcttttaaatatcgagttcc

SEQ ID NO: 6766651 - DNA, 56 bp, Homo sapiens
ccagggtagggaggttttcatacaattttgtagcccgcgtaacctctctactgtgg

SEQ ID NO: 6766652 - DNA, 129 bp, Homo sapiens
aagaggcatacattgtccagtgatgggcctatttgtatcatcagttcaggtattgatttgaaggcaaattaacaaggaaaaggctgtttgatacggctatcactagggaatgagcaatgaatgatagat

SEQ ID NO: 6766653 - DNA, 81 bp, Homo sapiens
gatacccatggaggtggaagaatgagttagaagacaaaaatatgcatatactctaactcagaaaattcatttctgggtatt

SEQ ID NO: 6766654 - DNA, 67 bp, Homo sapiens
ccagaccaaactgtaaatacagaactaggcacatctcaatgttctgtctctgtgtttacattactgg

SEQ ID NO: 6766655 - DNA, 60 bp, Homo sapiens
tggtggctttctttacatggctgtattatctgctttcacaccttagagagaaagccatca

SEQ ID NO: 6766656 - DNA, 77 bp, Homo sapiens
ctgctgcctctgcatgtttgcatctgaggaattttctctagtactgcaagtcctcctgtcagcacgcatgaggccag

SEQ ID NO: 6766657 - DNA, 77 bp, Homo sapiens
gttttcctgggctcttaatgaatgctgctgtatttctccttgaagaggttcagtaaatgttagttgattaggataat

SEQ ID NO: 6766658 - DNA, 58 bp, Homo sapiens
ccaggtgctgaccggtcagattacaaaaacaggagagtaatttgtacttgtcacctgg

SEQ ID NO: 6766659 - DNA, 64 bp, Homo sapiens
tctgcgatgaccctctcttgctgggaaatgtcacctctttcaaaacctgggttatccctgcaga

SEQ ID NO: 6766660 - DNA, 74 bp, Homo sapiens
gcagcttaaagtgttgtatctccatttgcatataacctgaatacaaatgcaattcaatgcatattttaagttgt

SEQ ID NO: 6766661 - DNA, 71 bp, Homo sapiens
tgttcctggttctcattagcttcccattagaatacagtaaggctagcaagatgagaataatctttggagca

SEQ ID NO: 6766662 - DNA, 83 bp, Homo sapiens
atctgatgcgattttttaagctgctggtttgttccaaactgatatctcaaaggagtacaaattatagcgcttggaatttagat

SEQ ID NO: 6766663 - DNA, 82 bp, Homo sapiens
taggaaataatcggttagagatgcacctacacatttattaacttaaagatgaatgtaagtggatttctttacctgttttgtg

SEQ ID NO: 6766664 - DNA, 83 bp, Homo sapiens
cagtcatgggttcttagtttctgtttctgattaagccagtaaagctccttcctcagagagacagaaactaaacaccatggctg

SEQ ID NO: 6766665 - DNA, 85 bp, Homo sapiens
gagggcaggtcgaggtgctgctgtacttcttgcggctggaggccatccctgccctggacagcaagagacagagcatcctgttctc

SEQ ID NO: 6766666 - DNA, 108 bp, Homo sapiens
gctgggggcttgaacgtggggctcccaggtgctggctgcagattttagaggtgtgggggacagaccctagcttagcagtttctcttttcccagttcttagcccccagc

SEQ ID NO: 6766667 - DNA, 70 bp, Homo sapiens
cctgcgccaggggtaggtgttgagtttgctcgttcattcattcagcaaatacttattgagcgccttaagg

SEQ ID NO: 6766668 - DNA, 67 bp, Homo sapiens
tttcaggcagaaaaatcactaatttccacatttaaaggaaaaataattggtgcattctgtcgggaaa

SEQ ID NO: 6766669 - DNA, 58 bp, Homo sapiens
tggaagcttctgaccatttttggaattttttggataactcttatggtctaggtttcca

SEQ ID NO: 6766670 - DNA, 80 bp, Homo sapiens
ggggctggaacccagacctctggcagctgtcactttcacaatgcccttgggctgactaggctgcagaggggtttcacccc

SEQ ID NO: 6766671 - DNA, 63 bp, Homo sapiens
gtcatagtagtggaacagcagctttggggcctgacttgacttctgctggtaccagtacatgac

SEQ ID NO: 6766672 - DNA, 62 bp, Homo sapiens
tggtatatgcatggaggtatcaaagctcgaggatagagcacacaccagttgatgcatagcca

SEQ ID NO: 6766673 - DNA, 81 bp, Homo sapiens
tgaatagctgaagtaagagtgataatgtaccgtttaagacactaaatgcacataaatatggtcttaataacaagctattta

SEQ ID NO: 6766674 - DNA, 89 bp, Homo sapiens
agcttggaggaccatacattaaatgactttcatcacaatttttctactccaacttgacctgaagatcagtgaatgtgtttccccatcct

SEQ ID NO: 6766675 - DNA, 77 bp, Homo sapiens
ggaggtggctatctgcttcatatttcatagtgatctggttacagattctatgggtaatggagtctcagcaaacctct

SEQ ID NO: 6766676 - DNA, 66 bp, Homo sapiens
gagagaggccccgccaccacccgccctgtgcttcggggttggacactaggtaggagcggcctcctc

SEQ ID NO: 6766677 - DNA, 62 bp, Homo sapiens
tcaaatgagaggcagggcagctctggcttcaggtggcagaaatggcttgccctctcgtttgg

SEQ ID NO: 6766678 - DNA, 74 bp, Homo sapiens
aagcaagtgaatctggctatttgtgtgagtacgtgtgtagcaatctgctcacaattatcagaagtattgagctt

SEQ ID NO: 6766679 - DNA, 64 bp, Homo sapiens
aggtctccccattaaaacttaaagatggttacatattttattctgagttaaaatggagagtctt

SEQ ID NO: 6766680 - DNA, 99 bp, Homo sapiens
ggcgtttcctcccgggctccctccatccccccaggcaagcatgacacatgtgtcttgagggggatggagtgtactggggaccagatgggaagctgagcc

SEQ ID NO: 6766681 - DNA, 62 bp, Homo sapiens
gtgctgtttgaagccacttcatctgtggtaatttcttacacagcagtggaaaacaaatacac

SEQ ID NO: 6766682 - DNA, 56 bp, Homo sapiens
ccagcagtcaggtggagggaatgagaactacagctctccctgccttttactgctgg

SEQ ID NO: 6766683 - DNA, 78 bp, Homo sapiens
taacagtaatgaacaaaaacaaggcctgttctcacagggattagagagaatggggcttgtttttgttcgttaccgtta

SEQ ID NO: 6766684 - DNA, 64 bp, Homo sapiens
gcagcaatcccaagtctgagtgaccagggtcagtgtttaggttataaacctttggattgctagc

SEQ ID NO: 6766685 - DNA, 76 bp, Homo sapiens
tgtgcaagagggagctttcgtgtcttgacatggaaaggagcaggttgggaatcaatgaagagttctgttttggaca

SEQ ID NO: 6766686 - DNA, 69 bp, Homo sapiens
aggttaatgaacaaccaggacctctttagaactgccagtggctggagtcagtctgggttgcaatgacct

SEQ ID NO: 6766687 - DNA, 55 bp, Homo sapiens
cttgctcagctctggaggcctcagtacagaaatggggcctcggatggagagcagg

SEQ ID NO: 6766688 - DNA, 55 bp, Homo sapiens
tcacatgttctcttcttccttttgatcttaaatgaggaaggggcaaagtgtgtga

SEQ ID NO: 6766689 - DNA, 80 bp, Homo sapiens
tcatgtttacattgaggtcatatatatttggcaggaacacctcaccctgccaaggatacatgacctaaatcttaacaaga

SEQ ID NO: 6766690 - DNA, 74 bp, Homo sapiens
ggactttccatgggctgcttggcttccacccagcatagtggttgggttccaaaaacaagcatcccaagaaaacc

SEQ ID NO: 6766691 - DNA, 69 bp, Homo sapiens
gtgcagcttttaattgttttcaatgttaatgatggtatttatggtaattaacatacaaaacagctgtac

SEQ ID NO: 6766692 - DNA, 74 bp, Homo sapiens
ttctgagcaattaatggaaagtaaggaaggttccatttaaccttgaccatttactgtctaatagagtcttggag

SEQ ID NO: 6766693 - DNA, 66 bp, Homo sapiens
tgacacaagagccctgtttgctgatttcctttgatcatcttttcagtatcaaagggcatgtggtta

SEQ ID NO: 6766694 - DNA, 57 bp, Homo sapiens
ggggcttgccaccttcctgaaaagttatgcagagctagaatttagaggataagcccc

SEQ ID NO: 6766695 - DNA, 130 bp, Homo sapiens
tctcttggagcagccaatcaagaattgacctcagtgttttgttacttgggcacagatgtgattcactgtgccctgagtcatgcaaatgtggcagttactgaattaacgagaagcttggcaggctccatga

SEQ ID NO: 6766696 - DNA, 60 bp, Homo sapiens
gttcttctgaaacataatcaataggttcatgaggaagttgtagaagttcttcaggagaat

SEQ ID NO: 6766697 - DNA, 72 bp, Homo sapiens
atacatgacagcatagcatcctttccccctcgctgccaggaaagaaatatcacaatgttagcaatcatgtgt

SEQ ID NO: 6766698 - DNA, 75 bp, Homo sapiens
gagccggaggaggacgagcccgcggcggcgcagcgctcatgctccaaggcgacgggctcggtccgcttcctcatc

SEQ ID NO: 6766699 - DNA, 65 bp, Homo sapiens
ctcttgagcttaggttcaggattggagtggaactcaacatacatacagtccacaagagccaagag

SEQ ID NO: 6766700 - DNA, 80 bp, Homo sapiens
ttcctcgctttcaggaaagagttagatgattagaaggaatcacatgcttttatgtttcattcttttctggtatttgggaa

SEQ ID NO: 6766701 - DNA, 130 bp, Homo sapiens
tgtgatgtgcataaggtgtttgaatgcatgccagcaagagtgctgtgggggaagaaagagagagaaaaggaacagcttttattctctccccaatcttgcttcacagtattgtgtttttcaccttcattca

SEQ ID NO: 6766702 - DNA, 60 bp, Homo sapiens
atgtcattttattaataatggagagagtctgcatggtctatctccagatgcagatgacat

SEQ ID NO: 6766703 - DNA, 60 bp, Homo sapiens
ctgttcatgagatgctccttgtacctggtcaagtatgtgtcagactgcactcaaggacag

SEQ ID NO: 6766704 - DNA, 63 bp, Homo sapiens
tcagggtatctcatgaagtacagtcaagatggtggcttaggctctattcatgggaagccttga

SEQ ID NO: 6766705 - DNA, 66 bp, Homo sapiens
ctgtttgaacagtgatctacatgtggcatttaaactgctaccttttatttcactgttgagagacag

SEQ ID NO: 6766706 - DNA, 68 bp, Homo sapiens
ggcctgaaccacaggagccagtaaacacaggatttccactctatgtgtagctttcttctgtgggggcc

SEQ ID NO: 6766707 - DNA, 66 bp, Homo sapiens
cactctgaccaataaattcagtgtttagagaaagataattcacatgatgtatgtagggccggagtg

SEQ ID NO: 6766708 - DNA, 119 bp, Homo sapiens
gtttaagccactcagtctgtggtatttttgttataggagcccgaactaagacaccactattctgatcgtagtctcttgatgttgccataataaaataccatagtctaggaggcttttac

SEQ ID NO: 6766709 - DNA, 85 bp, Homo sapiens
gggagcactgaggacagtgaggagggcttttaccttgttaatcctttccttatttagctagctttcctttttgtctagggcttcc

SEQ ID NO: 6766710 - DNA, 82 bp, Homo sapiens
ttccttgcagagaggcatgcggtcagaacgtcactggcagatctcgcctgagagttttgacgcttgtaactctgccctggaa

SEQ ID NO: 6766711 - DNA, 65 bp, Homo sapiens
gccaggacttggtcccaggcagagggctcgacccccaagccctgctgccctagacccagtcctgc

SEQ ID NO: 6766712 - DNA, 55 bp, Homo sapiens
cagaaatggtctgttcagcttagagtgaatgttctgagcttgagatccattgctg

SEQ ID NO: 6766713 - DNA, 82 bp, Homo sapiens
taagtctgttcattcagctgggtaggaggttcatgtcaatgaaagaccctctttctaggtttatgaatggagaatagacttg

SEQ ID NO: 6766714 - DNA, 64 bp, Homo sapiens
cagttccttaggggagagcctttcctgatgccttctagtaaaggtgttctcactgggggtcctg

SEQ ID NO: 6766715 - DNA, 75 bp, Homo sapiens
aggggcgtcctgagtgaggctgggcagtcccttgggccacgtcctcccagagcccgcccagcttcaccagcccct

SEQ ID NO: 6766716 - DNA, 59 bp, Homo sapiens
gagggattttagtgcagcaactgaatgtccttcaccgttctgcagcactaaaaactttc

SEQ ID NO: 6766717 - DNA, 65 bp, Homo sapiens
atctgtcagggatctatcaagtgactagagtatggtctaggcatgtgaggaattctaatataggt

SEQ ID NO: 6766718 - DNA, 96 bp, Homo sapiens
aggtgctagaatccaacttaatctctgctagccaagctttgtgtccacagagctggttctgtccagggaattctttgaattctcccagaggcacct

SEQ ID NO: 6766719 - DNA, 67 bp, Homo sapiens
tatacttgttcttagcaggagcatctattctattcttgaatggataaaatgaagaggaaagagtgta

SEQ ID NO: 6766720 - DNA, 58 bp, Homo sapiens
tggcaggtgcacttttggtttctgtgattacagtgatgagcaagagtgtacctggcca

SEQ ID NO: 6766721 - DNA, 88 bp, Homo sapiens
gagacagatgaggcccaaacattacaaatgctttggaaaaatacactcattttatttggtgtttgtgctttgactaaacatctgactc

SEQ ID NO: 6766722 - DNA, 78 bp, Homo sapiens
tgagcctgagttaattcccagctccagcgtggagagggctctgttcacaggcttggaggtgggggacacggaggctca

SEQ ID NO: 6766723 - DNA, 62 bp, Homo sapiens
agttttcaccatttaggatcttgggggcctttgcatgtctggcctaggatgtggagaaaatt

SEQ ID NO: 6766724 - DNA, 88 bp, Homo sapiens
tctctcaacctccttaagttatgtttaccattattaaaattaagtgacattcacttggaagaagtggtaatacaaacaggttgtgaga

SEQ ID NO: 6766725 - DNA, 56 bp, Homo sapiens
gaccttgttctagcttggaatccatctgaagtgcattctaaactaggggaagcgtc

SEQ ID NO: 6766726 - DNA, 70 bp, Homo sapiens
gagctcacctcattgctctacagcaacagttttaactactggagcctgcctggagcttgaggtgatcctc

SEQ ID NO: 6766727 - DNA, 77 bp, Homo sapiens
cgagctgtgaaaccctaagaagaagggagctgaaccagtgattgtgaaacagcatcattcatctggggtaatactcg

SEQ ID NO: 6766728 - DNA, 62 bp, Homo sapiens
tgtggaagcctgggccccagggctctgggttgagatgagagccctgggggccagctgccgca

SEQ ID NO: 6766729 - DNA, 72 bp, Homo sapiens
taggagcacctgggacacagcttgttctcgatttcccctctgaacactgacacctgccctcaggtcctccta

SEQ ID NO: 6766730 - DNA, 61 bp, Homo sapiens
ggagctcagaggtcccttccctagtgcaggagcctcactgaaccagggatctctaggctct

SEQ ID NO: 6766731 - DNA, 94 bp, Homo sapiens
ggggaaaggactttgtttcccggcctggtgcaatgcttggcaggcttccccagcacgaggatgctgcagtgcaggacaatagacagctttcccc

SEQ ID NO: 6766732 - DNA, 128 bp, Homo sapiens
aagggaactgtggatgtaaaaaatcctttgttctttaaacacacctttggaactgtgaccttgacatccatggatcatgtggtaaagaggagtgtttaccaaaaagtgatcaaaacagagcagccctt

SEQ ID NO: 6766733 - DNA, 102 bp, Homo sapiens
gccctgttggttcctgcttgggctcaggaccccagaggccctgcctgtccagggcctatggggccctagagttgaggacccacaggaaaatggggatggggc

SEQ ID NO: 6766734 - DNA, 70 bp, Homo sapiens
tgaggctgtgtgtgtccaggtcctattaattcatgttaaaaaattaaggagggctgggcatgatggctca

SEQ ID NO: 6766735 - DNA, 68 bp, Homo sapiens
agctagggagtggcagagctgggattcaaacccaggtagtctggtcccagagcctctgccactctgct

SEQ ID NO: 6766736 - DNA, 79 bp, Homo sapiens
tagggggagggctactggcatctacagtggatctacagtatataggccaagatcttatgatgcacagggcagcccccta

SEQ ID NO: 6766737 - DNA, 64 bp, Homo sapiens
tgccactcttctgcttgtccttagaaacctgggccatcatggatgaggatgcagacagagggca

SEQ ID NO: 6766738 - DNA, 55 bp, Homo sapiens
gtcatgcatgggctctgaagaaatgcatatttttctcaggttctccaatcatgat

SEQ ID NO: 6766739 - DNA, 65 bp, Homo sapiens
agctgattctgctttgatccttgtgcttgttgtcaaagcgcttgggattgaagagactgttggct

SEQ ID NO: 6766740 - DNA, 65 bp, Homo sapiens
ggaggcaacatgcttgtttctattttgacagctctcagagggaaaacgttgcggtgttggcctct

SEQ ID NO: 6766741 - DNA, 92 bp, Homo sapiens
gggtatgtaagtcccgcaaagctttggccaacctcgtgtggagctctggaacgagaactgctgaagttcgccagactcgggcactcctgcct

SEQ ID NO: 6766742 - DNA, 80 bp, Homo sapiens
catcttaaccaggtgggggagctacagcaagtagcgtaactgccctgtgccttggtttccccatctgtaaaatgaagatg

SEQ ID NO: 6766743 - DNA, 60 bp, Homo sapiens
gagctcttctggggtaagggacacctctgccttgttcattatagcccctcaagaatgctc

SEQ ID NO: 6766744 - DNA, 99 bp, Homo sapiens
gtttatgaatgatagtgtttgacctaccttgaagcaagggtatcctgttagatgttaacatgcaggttttagggttgccagagaaactatcaaataagc

SEQ ID NO: 6766745 - DNA, 55 bp, Homo sapiens
tcagctgatgaagatgagctcttttaagtgaattttgaaagatttcattagctga

SEQ ID NO: 6766746 - DNA, 72 bp, Homo sapiens
cctgcactgtggctgcagccttggtcctgcccccagacccacacccaggatggggtctgcagcctggtgagg

SEQ ID NO: 6766747 - DNA, 56 bp, Homo sapiens
attagggatagatgcagggctgactttattccttttcagcttccatattctctagt

SEQ ID NO: 6766748 - DNA, 64 bp, Homo sapiens
ccttatggagccttagacatctgatcctttcatttcaaaggttaggggctgaggcccagggagg

SEQ ID NO: 6766749 - DNA, 130 bp, Homo sapiens
ttagagcttccttgccactgtccaaagagagtctttctcttcctgttaggggtttccttttatgacacagaactagaagacagacagagaatgggcttgagatccatggatgaagggaagggtttaatga

SEQ ID NO: 6766750 - DNA, 55 bp, Homo sapiens
tgtttattttcaggatggattgaggcttttcctgcagtctctgatataataggca

SEQ ID NO: 6766751 - DNA, 91 bp, Homo sapiens
tcttagaatttgaagtgggtgagtggagggcattctactttgggaagaatggttggagttaagcctgaaccatttactcaccatttctaga

SEQ ID NO: 6766752 - DNA, 83 bp, Homo sapiens
tccagcatctccagttagcagtactgattttttttccccccaacaaaggaacactacatcaacactgttggcggggacctgga

SEQ ID NO: 6766753 - DNA, 108 bp, Homo sapiens
ggtgtggtgatggtgagtacatcctgtatcagaatgttaaaagcctcagttgacggactgagagttgtgcattcatgccaaggactgactctcctctgagactatgcc

SEQ ID NO: 6766754 - DNA, 66 bp, Homo sapiens
gcctcgcagtgctctcactcagacagcgcaggatcagactccctctgagtgattagcctctggggt

SEQ ID NO: 6766755 - DNA, 70 bp, Homo sapiens
ggctttccttaggtgttcttgctcacagcctggacagcagagatggagctgagcacctccagggcaggcc

SEQ ID NO: 6766756 - DNA, 75 bp, Homo sapiens
tgagaagcatagaatatgacttttagatccaagaacttacctacttgtctcttgttatcatttctgagttgctca

SEQ ID NO: 6766757 - DNA, 65 bp, Homo sapiens
cagctagtaaatggcaagactagcttactagtggcaagtctaaacacagccttttctgtatgctg

SEQ ID NO: 6766758 - DNA, 96 bp, Homo sapiens
ggtgtgtagttgttgaaaggattagaatcatacctctaggaacaacagggctctgtgttcaactgtgatggtttaatcttcacatactcatagact

SEQ ID NO: 6766759 - DNA, 78 bp, Homo sapiens
tcttgcaaagcacagaagcttgaaggagcagtgaccatccatagaaggacatggcaaacctcaggctaccttgcagga

SEQ ID NO: 6766760 - DNA, 59 bp, Homo sapiens
tgaggtggagttttgctgttgtcacccaggctggagtgcaatggcatgatttcagctca

SEQ ID NO: 6766761 - DNA, 62 bp, Homo sapiens
gcaggtcagagctctttctaggacatcactctggctatgcctgggaaaactgctgatcttgc

SEQ ID NO: 6766762 - DNA, 97 bp, Homo sapiens
tctggggcaaatggagtgcctgtggcagtgggcctggcacactcatttacagctaaacgcagtggcccattgcacaggctcaaagctcagctctaga

SEQ ID NO: 6766763 - DNA, 86 bp, Homo sapiens
cactaatataaatgaaggaggttggagactagagcatctctaagtggcttttccaactttaaaattcattctatggctctttagtg

SEQ ID NO: 6766764 - DNA, 125 bp, Homo sapiens
gctttctcaatgtctttggacagcaggaggagggtgatttggaaatgactctgcctgacttgagaagaaggaagaagcatgctgggtcatttttgccttgtttctagctgcatgaattgaaaagc

SEQ ID NO: 6766765 - DNA, 68 bp, Homo sapiens
tcactatttatggattcctttttgggtatagttattttctacatgctcagaacatcccagatagtaga

SEQ ID NO: 6766766 - DNA, 73 bp, Homo sapiens
ggcatggcttctggtttatccttatattcccttttgggaaatactgtcacagggataccatggggcccaaacc

SEQ ID NO: 6766767 - DNA, 60 bp, Homo sapiens
ctaccttttggtacccaaagatgccaacatctaaagggtctgagggtaaggttaaggtag

SEQ ID NO: 6766768 - DNA, 55 bp, Homo sapiens
gctactcagaagccttgattatctagagtgaagcattcagaaggtgtctgagagc

SEQ ID NO: 6766769 - DNA, 55 bp, Homo sapiens
gattctatgtggcatcaagctcagtggttctcaactctggttccacactagaatc

SEQ ID NO: 6766770 - DNA, 64 bp, Homo sapiens
gtactagtgtatctgttcttttatctttttggagaaagagaaaaggaaaatgcactgcatttac

SEQ ID NO: 6766771 - DNA, 58 bp, Homo sapiens
tcagcaaaatgtggctagtgctggtggtgcatgattacaccaagcacttttttgttga

SEQ ID NO: 6766772 - DNA, 108 bp, Homo sapiens
tctgcctgggttttgaggatgccagtggtactctttaatctggctttgcctctagccccatcctagtcccagctggtgttccttaggacccaagagactgttggcaga

SEQ ID NO: 6766773 - DNA, 64 bp, Homo sapiens
agtgtaggctcattttttaagtggttgctatttaaccagatatttaaaaggtgaactctgaact

SEQ ID NO: 6766774 - DNA, 75 bp, Homo sapiens
tggaggagcacagcttcaccgagcccatcctcatccctaagaaagacgggctgggcttggctgtcccggccccca

SEQ ID NO: 6766775 - DNA, 61 bp, Homo sapiens
ttatgcatagcatctgcaaatgttaggatagctgtatgcccaagatgctatggtagcatga

SEQ ID NO: 6766776 - DNA, 130 bp, Homo sapiens
cagctctgttttgtgaattaatgtttgaacccatgtccatgcttggggcaaccatgacagagagatcaaaagttgtctgcagaggttggttctaagatggccagaggtaaattgtagaagagtgcagttg

SEQ ID NO: 6766777 - DNA, 60 bp, Homo sapiens
gaagctgcaggaagtagaagcggagtgggtggcagctccctcccttgcttcctcagcttt

SEQ ID NO: 6766778 - DNA, 87 bp, Homo sapiens
ctgaagggctcagaaggatcaagtcatcctgatcccagccaacctgagctggcaaggacctgacattgtgttttctcagccttaaag

SEQ ID NO: 6766779 - DNA, 70 bp, Homo sapiens
ggagagcaggacagggaattctgaggcctctattttttatgtaaccttgaacaaatcccttcctgtctcc

SEQ ID NO: 6766780 - DNA, 60 bp, Homo sapiens
gctcatattcacccgactttgagtcaggggcctgatctcagagcaagatgatgtatgagc

SEQ ID NO: 6766781 - DNA, 56 bp, Homo sapiens
caggagcagttagaagcccactgcacggtccacaaaggtgctgctgactgcttctg

SEQ ID NO: 6766782 - DNA, 75 bp, Homo sapiens
cctatcatgagttgaaaagcaatttgtccaatatttcaactgctggggagaattctttattagcttttggatagg

SEQ ID NO: 6766783 - DNA, 76 bp, Homo sapiens
tttccttcttagcggtgttctttggctggagaagcagaaggctgggagcctacagcacatcaaagcagggaggaga

SEQ ID NO: 6766784 - DNA, 118 bp, Homo sapiens
tggtgagatagtaattatattcttcaatttatgtgtgggcaaactgtcagaaagagtctaagtgaaattctgtctcagtttacctatatgtaaatttgaaaatatatttatttcccca

SEQ ID NO: 6766785 - DNA, 76 bp, Homo sapiens
agagcagactagaaagagaaactatgagataattcagtgttgaatacttaaagtctatcctttctagagttactct

SEQ ID NO: 6766786 - DNA, 76 bp, Homo sapiens
gctcttactcagggagtcttttgtcactgggtagtgtggtagttgagtgattcccagacttcctgggaaacagagc

SEQ ID NO: 6766787 - DNA, 69 bp, Homo sapiens
tccaccttttttgttaatggccctaagcctgaaatatcagctgctgttcagaagcagaaaataggtggg

SEQ ID NO: 6766788 - DNA, 66 bp, Homo sapiens
gaatgaggtacactaaatttgtcttacaacagagcctgtatagcagatgctattagttgcctagtc

SEQ ID NO: 6766789 - DNA, 96 bp, Homo sapiens
gctgacttccttcaaaacattgtccatgatggttcttacaaaggtgctatttcctgcctagagcatttgtgtgggaacccatcagtgaaggtctgc

SEQ ID NO: 6766790 - DNA, 58 bp, Homo sapiens
gcatttcaagggagcagctgaaagaagaagacactgataggctctcccttgagagagc

SEQ ID NO: 6766791 - DNA, 55 bp, Homo sapiens
cagtttccagggtatttctgggaagtcagaccatgaagtttgccccaggaaattg

SEQ ID NO: 6766792 - DNA, 69 bp, Homo sapiens
tagggtttattgtctctcttgctagatgttactaagtaaacacagctggcatcgagcatttgaactcta

SEQ ID NO: 6766793 - DNA, 96 bp, Homo sapiens
tagacccctcgccttgaatatgagcagaagttataaataagatgagtcacttactctcttggttagagtactttatatggcaaaggtgatgggcta

SEQ ID NO: 6766794 - DNA, 94 bp, Homo sapiens
tttaaactttgcgtttagcatgttagcttttttgcagatgtccttttcccaaaagggtttggtagagttagttaaaatagttgcggagttcaga

SEQ ID NO: 6766795 - DNA, 67 bp, Homo sapiens
ctggcctccattgttctggagaaggttccagccacatggttgatgtcagctggttttccagagccag

SEQ ID NO: 6766796 - DNA, 64 bp, Homo sapiens
tgggcgggcaggaggcagagagaagctgaggacgtgagctgtgattgtgcctcctcgtctccta

SEQ ID NO: 6766797 - DNA, 56 bp, Homo sapiens
gcaggggctactctgagcttcctcacagcctggaggtctccggggagtagacctgc

SEQ ID NO: 6766798 - DNA, 76 bp, Homo sapiens
tctagaaaggcagtctaagttaatttccacaattttcattgtattggcaaagaacttgaggctttgttgttcaaga

SEQ ID NO: 6766799 - DNA, 58 bp, Homo sapiens
agggtgaagcttgatcacttttaccacttcagagtgatgccacacaatgctttgccct

SEQ ID NO: 6766800 - DNA, 75 bp, Homo sapiens
cggtgtggttggctcttttgtcttccaggatgggcctgtggggtctgtgtggggaaggaaggagctgggagcctg

SEQ ID NO: 6766801 - DNA, 63 bp, Homo sapiens
tttctacagctggtgcaactttctatgcacagtcatgcctgtaaagatgtttcatctgagaaa

SEQ ID NO: 6766802 - DNA, 74 bp, Homo sapiens
ttcattgcagaatttggcctcaccatgcgtgagtcagaacaagcgccttgaaggccagggatttgcagcctgag

SEQ ID NO: 6766803 - DNA, 61 bp, Homo sapiens
gtgcttttgtttcttctgggacctgcaaacccatccagtgccctcaggaaacagaatgcac

SEQ ID NO: 6766804 - DNA, 60 bp, Homo sapiens
cacatttgatgctctatttaaaaggacatccaacatgtctttagaagaacatcagaaatg

SEQ ID NO: 6766805 - DNA, 76 bp, Homo sapiens
tgttccaagtgatttctaagtttattagtcagagacattttaagtgacagagtaaaacagagaaatcactcagaca

SEQ ID NO: 6766806 - DNA, 63 bp, Homo sapiens
tgcttccttggaaattctgacttcagggtcttaaatagtattggggcactatttctggaagca

SEQ ID NO: 6766807 - DNA, 79 bp, Homo sapiens
tgtgccgcctgcgggaggggctgtgcgaggggtcacgggtgagcttgtccttcttgtcttgcccaaatcagcggggcca

SEQ ID NO: 6766808 - DNA, 85 bp, Homo sapiens
taatttctgtcagagaaagcactaaaagagaatcctggtcaaaggagaggattctttcaggggcttctttatttggcagatatta

SEQ ID NO: 6766809 - DNA, 57 bp, Homo sapiens
ctccagtcttctcatgtatcccttggaacaatacagctcttactgaggggtctggag

SEQ ID NO: 6766810 - DNA, 57 bp, Homo sapiens
tcctgcagagtccctttgttcagttggtgaccaacatcctgaaaaacattctcagga

SEQ ID NO: 6766811 - DNA, 69 bp, Homo sapiens
gggtaacattgaggagtgtattccacaccactgtccacagtgttcttctggggtatgctcctgtcaccc

SEQ ID NO: 6766812 - DNA, 108 bp, Homo sapiens
ggattggttcagtgtgggtctgtgctggagatcagcttattttgttttatacattgtttgaatagtctttactcctttacagaattaaaattcatttaaaaccatttc

SEQ ID NO: 6766813 - DNA, 61 bp, Homo sapiens
gcacccccacgaggcctctccaacctcagaggctctgaggaggttgccagtctgggggtgc

SEQ ID NO: 6766814 - DNA, 65 bp, Homo sapiens
agagccagactgcctgaagctcactgtaacaagtcctgccttgaggaagaaggaagtttgcctct

SEQ ID NO: 6766815 - DNA, 74 bp, Homo sapiens
ctccacgttgcctttcctgttctagttgttgccatcactgtgtggagagaaagttgaatggagggacggtggag

SEQ ID NO: 6766816 - DNA, 74 bp, Homo sapiens
ggacttttgacctccagaactataagaactgggaaaaatgtatgtagtttttacattccaggaggttacagtct

SEQ ID NO: 6766817 - DNA, 65 bp, Homo sapiens
ttcccctctcagatctggcctacttcaggtctaaaagctggggaatgggctgggctagaagggaa

SEQ ID NO: 6766818 - DNA, 55 bp, Homo sapiens
ccctaagaccctcaagatctcctaaaaagagagccttccatcctagggtttaggg

SEQ ID NO: 6766819 - DNA, 58 bp, Homo sapiens
gctctgagagctacacagggtagaccacagccccaggtaccctgtatggctcacaagc

SEQ ID NO: 6766820 - DNA, 61 bp, Homo sapiens
gagctttaatctgagggaacttgaactccgtgtagttggggttcatctctcggatttgttc

SEQ ID NO: 6766821 - DNA, 58 bp, Homo sapiens
gctgaaggttactcctgtgtctgcggaaaccctgtctgcaggctggtcaaacctcagt

SEQ ID NO: 6766822 - DNA, 56 bp, Homo sapiens
tcagagaatccgtaagtcacaacgttaccctgcaggttgtgaacttcattttctga

SEQ ID NO: 6766823 - DNA, 58 bp, Homo sapiens
accaggtggctatgaggatgcagtcatgataaatgtaattgctcatatggcacctggt

SEQ ID NO: 6766824 - DNA, 65 bp, Homo sapiens
atcatgccacagagttacaaaacagtcattgaattgtatacctgcaatggctgaactcttatgat

SEQ ID NO: 6766825 - DNA, 55 bp, Homo sapiens
tttgtagactatctctggggtgctgcagaaccccatgaaggagagtgtctgcaaa

SEQ ID NO: 6766826 - DNA, 77 bp, Homo sapiens
gcattaaactaggatttaggagctggctaacgttaaccaatagaaatgaagccactttccagaatcacatttaatgt

SEQ ID NO: 6766827 - DNA, 78 bp, Homo sapiens
gtgaggtcaagggcatgaagcagtggacagcacattctttgtgatcatactgctcctcctgccccacggtggcctgac

SEQ ID NO: 6766828 - DNA, 79 bp, Homo sapiens
ttatttagattcttgagtagctgtgctttcatatcctgttaattcgttgtaagtagttatttggggaatcaaaaaatga

SEQ ID NO: 6766829 - DNA, 61 bp, Homo sapiens
cgccagggctcccgcggtgtccgggaagtgactcttcctggcagagggcggcctcgaggcg

SEQ ID NO: 6766830 - DNA, 74 bp, Homo sapiens
cttatgtttcatcagtatattccttggtctttagcccaaggttggagtgtaggacttgtgtgaacacttgtaag

SEQ ID NO: 6766831 - DNA, 62 bp, Homo sapiens
ggggtgggtggggcacttttgaccgcagtttctggcgcaggtcctcacgcctcacccttccc

SEQ ID NO: 6766832 - DNA, 58 bp, Homo sapiens
ggctgaagcgatcctcccatctcaacctcccacgtggctgagactacaggcgcttgcc

SEQ ID NO: 6766833 - DNA, 83 bp, Homo sapiens
tgtgaattatgaggttggcatgttttttggtttggctgtcaggtttcatgaactcatactaaaaaatattttcatagctccca

SEQ ID NO: 6766834 - DNA, 59 bp, Homo sapiens
gcacttggtaaatactctttggagacagtaatgctcaaaggttgtgtttgctgttgtgc

SEQ ID NO: 6766835 - DNA, 70 bp, Homo sapiens
gcttctctgccagccctgtgagtcttgaacattcatgctttttaactcatttctggcagttttgagaggc

SEQ ID NO: 6766836 - DNA, 55 bp, Homo sapiens
gaggagcttgcatttaagtgccaaatattggtatttatgtatatgaaagctcttc

SEQ ID NO: 6766837 - DNA, 66 bp, Homo sapiens
aaatatattaaatttaggaggtttgagttagacttctgattctggctgtatgatatttaataattt

SEQ ID NO: 6766838 - DNA, 67 bp, Homo sapiens
gggacatctttctagtcagggtcaaaatactgagaagttatttcccagtggctagagcagatatcct

SEQ ID NO: 6766839 - DNA, 70 bp, Homo sapiens
aggtcatctttgcttgacactgtgattgtcagagccctgatggtgtttataggcaaagatcaatgacact

SEQ ID NO: 6766840 - DNA, 83 bp, Homo sapiens
gcttaccaatgatttcccattgctgcttggaatgaaaacccaatgacacatttcaaaattttgcagtggtaaatcatgtaggt

SEQ ID NO: 6766841 - DNA, 72 bp, Homo sapiens
ctcatccctggtgtcaggtctcccaggaatcctgtgagaagaatcccacctgaacaccccttggggagggag

SEQ ID NO: 6766842 - DNA, 61 bp, Homo sapiens
ctttatttttcttcccaaggagagatggttttcacacttacccttgggaaacaaagtagag

SEQ ID NO: 6766843 - DNA, 91 bp, Homo sapiens
ctgactctaagggggttggtgaattaccaaaggggcagatcagagccccagctctctggctctggagtccacctgccccatacaatgtcag

SEQ ID NO: 6766844 - DNA, 64 bp, Homo sapiens
ccactgggagagacacttctgattatctgtgacctatacaaattatcatgattctccccactgg

SEQ ID NO: 6766845 - DNA, 76 bp, Homo sapiens
ggagggtccccagcagcatgaaggtccagattcccccaatagtaactccttagcacatgctcgttgggtttcttcc

SEQ ID NO: 6766846 - DNA, 94 bp, Homo sapiens
caggctggatttgaagctgaggttggagatattgcagagctgagtttttgatcactaagtaatcccctccggctcatcttctctgcttagtctg

SEQ ID NO: 6766847 - DNA, 76 bp, Homo sapiens
tgggctctcaggctgagtttgtactcaaatgaagagtagatctttattggtaggactcagctgagaagtaagttca

SEQ ID NO: 6766848 - DNA, 65 bp, Homo sapiens
ttttgctatggtcttcatggacaaggttgttgttcactaccactccagcagactcatcagcaagg

SEQ ID NO: 6766849 - DNA, 66 bp, Homo sapiens
attggatgtattaatgatggagtgttcagccattaaaaagatgatataccatcatatgcatttaat

SEQ ID NO: 6766850 - DNA, 85 bp, Homo sapiens
tctggggaatttcttctttattgagacttcattgttagagtccttgacacagtgatcttttagttggaacagagattcactcaga

SEQ ID NO: 6766851 - DNA, 75 bp, Homo sapiens
tgagtaagcaattttattgcttagtaactaagacagggttctgaggattaaaacagtgggatttgtgctagctca

SEQ ID NO: 6766852 - DNA, 60 bp, Homo sapiens
ttccctactagccttaatgttttccccaaaactgtgaggtggaatgggttctgtagggag

SEQ ID NO: 6766853 - DNA, 102 bp, Homo sapiens
agcagtagaatctagggacaaatggtcactggtgagtgtcattgctggagttaaatgagactcattagtggctgttatgatttccactcttacttcattgct

SEQ ID NO: 6766854 - DNA, 104 bp, Homo sapiens
ctgaggcaggagaattgcttgaaatcaggaggcggaggttgcagtgagctgagatcatgccattgcactccagctctgggcgacagggcaagactcagtctcgg

SEQ ID NO: 6766855 - DNA, 72 bp, Homo sapiens
gcaaggctgagcacatttgcatgagcagaatgtaaatacaggaggcttcttgcagatgagcttctctcttgc

SEQ ID NO: 6766856 - DNA, 55 bp, Homo sapiens
agtggcttgtgaaaagctggtgactctcagagcgcctgccttttggaggcacatt

SEQ ID NO: 6766857 - DNA, 76 bp, Homo sapiens
gccagtcacaagcgtacctaatttcggagagtgacaagtactctgaaaaagaaagaaggtagggctggtgactggc

SEQ ID NO: 6766858 - DNA, 122 bp, Homo sapiens
ggggctaaagtagatgtggaagttgaatcaacctgagtctggaatgtgttcatactctgctcagttgcagagtatgaatctttcagaccgtaatacaattttatttccagtcttataatcct

SEQ ID NO: 6766859 - DNA, 129 bp, Homo sapiens
tgtggccttaattatagtgctataagatatgaagtctgaaacgcattgttatcgatataaaatggaaagacattgtgtattcataaaatcgaagattatatttagtgtgaaattgtttcgaaggtcata

SEQ ID NO: 6766860 - DNA, 99 bp, Homo sapiens
gttcttattgttgttgtcattagctgtttaagcgtatgcatatgacttatcacatctaagatgcttgaatagttttggatagcatatattcataagaac

SEQ ID NO: 6766861 - DNA, 62 bp, Homo sapiens
gcagaatacattttgttttccttcaacatgccaaggaagtgccatgaaaatgtgatttctgc

SEQ ID NO: 6766862 - DNA, 75 bp, Homo sapiens
ttgctagaaccaaccacaagagtttctgattcagtaggtctagggtggagcctatgaattagcactttctagcaa

SEQ ID NO: 6766863 - DNA, 66 bp, Homo sapiens
ctgagggtcaccacagtataaaagtgtaacagatgtccaaccactttctactgttatgacactggg

SEQ ID NO: 6766864 - DNA, 70 bp, Homo sapiens
ttcatactttaaaatagggcaccatttttatttagcagaataagtagtcctgatttaaccttggtatgga

SEQ ID NO: 6766865 - DNA, 57 bp, Homo sapiens
cagagcagggtgcaccttgggctcggccgacccagcctgtgcctatgcccagctctg

SEQ ID NO: 6766866 - DNA, 109 bp, Homo sapiens
caagctggctcctgagtgggcaacttgctggggctctgaccactccactggcaagcagctgaatgtggcttcttggttagacctctgctgaccatttaggaccaggatg

SEQ ID NO: 6766867 - DNA, 74 bp, Homo sapiens
cccggttttacagagcaggctactggggcttggatgggtcaagggacctacttaagttcacagagccagctggg

SEQ ID NO: 6766868 - DNA, 96 bp, Homo sapiens
tagatataagataaagatgaaaacaggacaattttgagccacctgactgaggattggcagtaggcaggttgtcttcttagttttgttgtgtgttta

SEQ ID NO: 6766869 - DNA, 69 bp, Homo sapiens
tctgcacacagccagctgagggctacaccttgtagggccaggtatctagatcctatggctgtgtgcaga

SEQ ID NO: 6766870 - DNA, 81 bp, Homo sapiens
gtgacctcgtctgtctcaggttcatgaacatgaaggtgagagcagctcttcctcacagcatgaccaggcagtgacaaacac

SEQ ID NO: 6766871 - DNA, 58 bp, Homo sapiens
actgggcagggaaggagaccgatgaaaaagttgagtcagtctctctctctctctcagt

SEQ ID NO: 6766872 - DNA, 71 bp, Homo sapiens
gctcgccgccggcggggccacttcataacgcgccgtgcgtgacgtgaggggctcctgttgcaatggcgagc

SEQ ID NO: 6766873 - DNA, 69 bp, Homo sapiens
gtgctgtattgagacaaggtcgtatttcaatctgtgagagaaaataatcccattgtctggaagcagcat

SEQ ID NO: 6766874 - DNA, 73 bp, Homo sapiens
tagctatccagggagtctctgctttatacaaggttctgtgcaatgtacaaagccagaactcccaactcagctg

SEQ ID NO: 6766875 - DNA, 68 bp, Homo sapiens
tcatagtcccttttatatcctgggcatgagagatttcttatacttagttttattaaggaggattttga

SEQ ID NO: 6766876 - DNA, 57 bp, Homo sapiens
cctggctctagaggccactcctagcttttaaagcaaagtggaacccttagggtcagg

SEQ ID NO: 6766877 - DNA, 65 bp, Homo sapiens
ctttaggcaaagctggaatccagggccttgtagttcccacccgttagtcctggttttgccttcag

SEQ ID NO: 6766878 - DNA, 107 bp, Homo sapiens
tccactgaagaagaagtcgtgatttatgcattatactgttgagggccgtttgggatgcctacaataaataacagtgctataacatccttgttcctgtttctggtgga

SEQ ID NO: 6766879 - DNA, 62 bp, Homo sapiens
gaggaaaactgtaagtggttggaagaaggctttgttttctacaagacttttagttattcctc

SEQ ID NO: 6766880 - DNA, 65 bp, Homo sapiens
gccccacacgattcctgtttaaacagacatagcagtcaacaaagcaggcatctgtggcacaaggc

SEQ ID NO: 6766881 - DNA, 60 bp, Homo sapiens
attacagggaaccaatccagtgtcatccgaacaggcagcattctgatggttctctgtgat

SEQ ID NO: 6766882 - DNA, 65 bp, Homo sapiens
ggggctggctaagacttttctgtgtgaggggctgacctctgtgttatagaatgtctagcagctcc

SEQ ID NO: 6766883 - DNA, 120 bp, Homo sapiens
cttctggaaatagattgtggtgacagttacacaccattgtgaacataattagtaccactgaactgtacacgttaaaatggttgtatgttatatatattttaccataataaaaactagggg

SEQ ID NO: 6766884 - DNA, 63 bp, Homo sapiens
ctcctgagctctgaggaagcttgccttcttttgagctacctgatccttcttctgagcaagggg

SEQ ID NO: 6766885 - DNA, 57 bp, Homo sapiens
ggggctgagaattcagtctcggcaggtagaaggctcagagggaagaatctcagctcc

SEQ ID NO: 6766886 - DNA, 79 bp, Homo sapiens
gtgtaaatagacacatgcgttcatatgtgtgcttgtctgtgcacatgattatgtgtgtgcgtgtgtgttttcccggcac

SEQ ID NO: 6766887 - DNA, 129 bp, Homo sapiens
gggccctacaggagaaaatggcacccctggaatatctggctgagcgaggcccacagaggcgcctaccctcccacctccatctgtgggcctcagcaggactccaaactcccatgtctcttctgtctgttc

SEQ ID NO: 6766888 - DNA, 65 bp, Homo sapiens
gctgttggaagaggcaatggtgtactgatacatttcagctgacatactacagtctctttatcagt

SEQ ID NO: 6766889 - DNA, 82 bp, Homo sapiens
ttgtacagctagaagcagcttggttttaggcatggaatgaacctctctgctcatgcttatgaagctgttacttggtcaacaa

SEQ ID NO: 6766890 - DNA, 64 bp, Homo sapiens
tctgatgtcagttgtaggttgcagccagaattgatttgattttgcaaaatgcaattgagttaga

SEQ ID NO: 6766891 - DNA, 65 bp, Homo sapiens
ttcttgaactttatgaaaaccagattggggcatgagcatgttctccattgaatcatgttcaagga

SEQ ID NO: 6766892 - DNA, 68 bp, Homo sapiens
atagtttggacaaaagactccttagatattcaaatatgtagaggcctgtcaagtcatgttcagattat

SEQ ID NO: 6766893 - DNA, 82 bp, Homo sapiens
tgggaaggataagcctggttgcatgctaatgagggagacaaagtagcctcactcttatttgcaactggctcagacctttcca

SEQ ID NO: 6766894 - DNA, 89 bp, Homo sapiens
ctaacctccatctcagtctgcttcctggagaactcaacagttggtaccatgagtagtccaagaaagcaggtgttaagatggaattttgg

SEQ ID NO: 6766895 - DNA, 80 bp, Homo sapiens
gcacacatttcacagtttaatggcaaggatttttaaaagataacatgtgaaaaggctttgtaaactgtggagttctatgc

SEQ ID NO: 6766896 - DNA, 56 bp, Homo sapiens
gaatctggtcgttggtgtctaaatgtgcctgttacttgtgcccaatgtccaggttc

SEQ ID NO: 6766897 - DNA, 92 bp, Homo sapiens
gtgtgctgggagttctacgtgtcatatctcttttaagcctcacatcatttacagaggaggcactgagaggctgtgttgcctcccctggccac

SEQ ID NO: 6766898 - DNA, 58 bp, Homo sapiens
gtgtgcccgggggaagcaggtgtgtttcagtgtgtgccgtgcctccccgtgggtacac

SEQ ID NO: 6766899 - DNA, 77 bp, Homo sapiens
gggatgtaaatgcagtctctacagctcctctgggcctctaagtgtacagactgtatttacaagtttataaaactccc

SEQ ID NO: 6766900 - DNA, 96 bp, Homo sapiens
ccgggagatgcctgtgagccaaggctgtggtgggctttgagccagacactttgactctgcctcccttgccaggccaggttcatttgtctcttctgg

SEQ ID NO: 6766901 - DNA, 77 bp, Homo sapiens
aactttgtaggaagggctactctttaggggaatagtcatgattatttcaaacttaaatacctttcctttgcattgtt

SEQ ID NO: 6766902 - DNA, 76 bp, Homo sapiens
gctggagtaggaggcgggagcatgaagtctcctgggccccgcccgccacctcgccctgccgcccctgctcagcagc

SEQ ID NO: 6766903 - DNA, 58 bp, Homo sapiens
tgacagcttggacaggtccctcttcccaggaatgcgaggctcctcctctcagctctca

SEQ ID NO: 6766904 - DNA, 60 bp, Homo sapiens
aagcacagggactcaggaccgggcgctttctaatctcttcagtctctgggtctcctgctt

SEQ ID NO: 6766905 - DNA, 92 bp, Homo sapiens
ggggatagtgatgatgggggatgctatgtttgtgtgagggcagatattatataggacatgtttgtatcttcctttcaattttgctataaacc

SEQ ID NO: 6766906 - DNA, 99 bp, Homo sapiens
gaggcaagaggattgcttgagcccaggaggtcgaagctgcagtgagccatgatctcgccactgcactccagcctgggtgacagagcaagaccctgtctc

SEQ ID NO: 6766907 - DNA, 69 bp, Homo sapiens
tcctttcaatcaaagtttctagtggaacaaaagcatttggttaaccatatagaacttggtggaaatgga

SEQ ID NO: 6766908 - DNA, 83 bp, Homo sapiens
tatgcagttcgatatcttttttgctttaaaggtaaaaatatacccacataaaacttttacttgaaggcagaaaagtttgcata

SEQ ID NO: 6766909 - DNA, 56 bp, Homo sapiens
gatttacagctatacccaatggtataactgttaactattgggtataactgtaaatc

SEQ ID NO: 6766910 - DNA, 65 bp, Homo sapiens
ccttgcaggggaacaggcagtgagtatataaattaataaaacattgttgtcacctctgtactagg

SEQ ID NO: 6766911 - DNA, 77 bp, Homo sapiens
ttcttcaggggaaagaaaaacatggataccttatctagcattgctcataaaagtactcatgttcatcctttttggaa

SEQ ID NO: 6766912 - DNA, 112 bp, Homo sapiens
ttcaagttgatctatcacctctttggctctattactgacttctgtatttaacttattcactactagtgttatcacagtgtaagtactagaagtaaagagagaaagactagag

SEQ ID NO: 6766913 - DNA, 56 bp, Homo sapiens
tgtgcttcttcattgcttatgtaaggatattaagccttactccaatcaggaacaca

SEQ ID NO: 6766914 - DNA, 88 bp, Homo sapiens
tttaggtcttctcttactttgttgtcttccattttaagctcatttcctctgtagagatgatggtggacagctggttagaactcttaaa

SEQ ID NO: 6766915 - DNA, 73 bp, Homo sapiens
aaagtatcttactgcagccgaggatacatgtagccaaatgggtgagcaactgggagttgagtgaggttgcttt

SEQ ID NO: 6766916 - DNA, 55 bp, Homo sapiens
gaagtttaggttcttatgtttaaattacatttaaattagtaaggatgtaaatttt

SEQ ID NO: 6766917 - DNA, 69 bp, Homo sapiens
tgtggcatcgttcacttcattaacgctgtttgatctttgacaagtgataaaggtgtgatatgaaacata

SEQ ID NO: 6766918 - DNA, 66 bp, Homo sapiens
gttcatggtttcagccacataaaaggctccagacccatttatgtgtctcagttgtgattgatgaat

SEQ ID NO: 6766919 - DNA, 62 bp, Homo sapiens
gactgaacagtaagaggctttatgaatatatccaggtgaaagccttatttgtctcatcagtc

SEQ ID NO: 6766920 - DNA, 71 bp, Homo sapiens
ggatgtggaggggaaggttagagtgatctccatggtggcctctgaggcacctttgccaaaccagtgcagcc

SEQ ID NO: 6766921 - DNA, 130 bp, Homo sapiens
tgtaatcccagcactttgggaggctgaggcgggcagatcacctgaggtcaggagttcgagaccagcctggccaacatggtgaaatgctgtctctactaaaaacacaaaaaattagctggacatggtggcg

SEQ ID NO: 6766922 - DNA, 93 bp, Homo sapiens
ctacaaaatccttttattatagtgtgttagtgacataggcttttccatgacagcctggagttgaaactattattcaatagaaacaatttgtgg

SEQ ID NO: 6766923 - DNA, 103 bp, Homo sapiens
aagtaactattgaatattctgtaatcttagacatgtatttttcaagctaaccctttgaagaaatgtgttcaaggtaggaaaatataaaattttttggttattt

SEQ ID NO: 6766924 - DNA, 57 bp, Homo sapiens
ctctttgctcacttcaccttatgggcagtgtcctgcaggtttctgtgagcagagcag

SEQ ID NO: 6766925 - DNA, 76 bp, Homo sapiens
agcaggaggtgagtgtggctccacttccccagtgtcctctgctggagggagcggatagacactagacacctctgct

SEQ ID NO: 6766926 - DNA, 63 bp, Homo sapiens
caggtgggtggatgattgactctgtagaccagactagctggactaatcagtgatccccagctg

SEQ ID NO: 6766927 - DNA, 105 bp, Homo sapiens
gagaagctggctctgtgacttggcgagctgaggtgtaggcctgagacgctcttttccagcacctccgcagttcacctgttttcacacgtgaggactgagtttctc

SEQ ID NO: 6766928 - DNA, 87 bp, Homo sapiens
ttcagtattcatttcagttcagaggcctttcacctgcggcatgtagattctaaagggacctgggattgagtttcaagaatcactgaa

SEQ ID NO: 6766929 - DNA, 61 bp, Homo sapiens
aggagaaagtcaagttggtcttcattctcagtcctgaggcagacaactgtgactattccct

SEQ ID NO: 6766930 - DNA, 74 bp, Homo sapiens
ctctcctgtgtcaggcactagtaagaaaaaggcacaacgctttttcctcgtagagcctaatgtctagaggggag

SEQ ID NO: 6766931 - DNA, 61 bp, Homo sapiens
ggaggctggaagtccaagatcaagatgtcagcaggtttggtttcttctggggctcctctcc

SEQ ID NO: 6766932 - DNA, 70 bp, Homo sapiens
gatttatccagagtattgtgaccatttgtcaatcactgatgctgactggttagatacttgcaattaaatc

SEQ ID NO: 6766933 - DNA, 70 bp, Homo sapiens
gtaggtagatgcagtttctttctcagaaggctctgtgcctttcaaaacagaacactagcattctgtttgc

SEQ ID NO: 6766934 - DNA, 86 bp, Homo sapiens
tttggtatttaaaaggtagattctccttctatgagtacattatttatgattaatcatagaggaaaatccacgttttcagtatcaaa

SEQ ID NO: 6766935 - DNA, 56 bp, Homo sapiens
aggcttcacctgcacctgagctatggacaaaatatgtttgagtgctacagaggctt

SEQ ID NO: 6766936 - DNA, 129 bp, Homo sapiens
acaaaactccagtgtcttaatgtcctggcgtgccatctcctggtcaactggtagagcagcaatcctttcctataagccagtggccctctggagaagggcacactgaacacaataagcatgacttttagt

SEQ ID NO: 6766937 - DNA, 65 bp, Homo sapiens
ctgggctggagagctcctatttgctgtctgagatttatactcagatgtagttgctccagccacag

SEQ ID NO: 6766938 - DNA, 64 bp, Homo sapiens
tagcagcatgattctgagcacacgtgggtaagacctttcttctctggttagatatcatatgctg

SEQ ID NO: 6766939 - DNA, 112 bp, Homo sapiens
atgaagcttgctgacaaatacacttcacacaattatgtgtgcacaatgggctaaacacctgtttattaatgtctaccagttgtgtgccagagtgggcttgtataagcttgat

SEQ ID NO: 6766940 - DNA, 62 bp, Homo sapiens
gtaaccagctggctatttacaaaaattgtaaaggcaacactgattatggctgagctgggtat

SEQ ID NO: 6766941 - DNA, 67 bp, Homo sapiens
gcaagtcacaagcatatatgcattaagattttaaaatctaagatgcttaagatgttggtggcattgc

SEQ ID NO: 6766942 - DNA, 56 bp, Homo sapiens
gcagcaaagctcttcatgtgatacgatactgtttgacatgccccagcttctgttgc

SEQ ID NO: 6766943 - DNA, 73 bp, Homo sapiens
tggtataatgtggcttgtcgatattagcaattgtttatatcatgttaatatctgataatgtcccttgtgacta

SEQ ID NO: 6766944 - DNA, 61 bp, Homo sapiens
tgcctctgccagcttctggtggttgccggaaacccttggcattccccagcttgtagacgca

SEQ ID NO: 6766945 - DNA, 64 bp, Homo sapiens
tattttataattattaattctttatgtggaacaccgcaaaagagtgactgataagtataatgtg

SEQ ID NO: 6766946 - DNA, 72 bp, Homo sapiens
gacatttgttcacactgcagggccctgaaaagacagactggggggctgctggagctttgcagaaggggtgtc

SEQ ID NO: 6766947 - DNA, 77 bp, Homo sapiens
gggggcttgggcttcaatgtgtgaattttgtggggacataattcagtccatagcacgtggaatgctcatgagcctcc

SEQ ID NO: 6766948 - DNA, 56 bp, Homo sapiens
ctctcctttgaagcaactgtattctaagttctaaatatagttgcttcaaaggagag

SEQ ID NO: 6766949 - DNA, 64 bp, Homo sapiens
tccaatgtcaccagtttccaaatttgactctgacatgggacagaggagactggtgacagatggg

SEQ ID NO: 6766950 - DNA, 75 bp, Homo sapiens
ccctgcctcttgcatgagctcatgccaccacaagtcaatcccttggttccatgagatctgcagggatgggcaggg

SEQ ID NO: 6766951 - DNA, 77 bp, Homo sapiens
tgtgattctgtagccatcattctcacattcttgttattagtcagaaaaggaatgtaatagtgtggctcagttaaaca

SEQ ID NO: 6766952 - DNA, 67 bp, Homo sapiens
tctagctgggtctctgttttctcatctctacaagggggttgagaatcgaatgagacactggattaga

SEQ ID NO: 6766953 - DNA, 73 bp, Homo sapiens
gtggacagttaggggctggatgccaggcacagaggagccagcctggaagaccacaagcccttaactgtgttgc

SEQ ID NO: 6766954 - DNA, 65 bp, Homo sapiens
agcgtgtgcgcaccttgcgccgggcgctgcagggagtctccagctcctggaggtgcgcactcgct

SEQ ID NO: 6766955 - DNA, 72 bp, Homo sapiens
tttgggggccgttcctgggagctgctggtaccagtatacataattacttccgatgttggagctgcttccaga

SEQ ID NO: 6766956 - DNA, 61 bp, Homo sapiens
agtgctgagccttttctggggggcactggtttagacattgtgccccttaggggttaagcct

SEQ ID NO: 6766957 - DNA, 55 bp, Homo sapiens
ggatgtctagggtttatgtgcctccagggaagaatcagaaagcccaagacaatcc

SEQ ID NO: 6766958 - DNA, 83 bp, Homo sapiens
tgatggggacaagtaggtgcacttcaatagaatcaggtcacgactttgctataagaattgtgcacctacaaaccaccccttca

SEQ ID NO: 6766959 - DNA, 80 bp, Homo sapiens
aagagaaatgagcaaggaaggagagatgatgggtgtcaggtccggaacccagcaaacgtttcctccagctcccttctttt

SEQ ID NO: 6766960 - DNA, 68 bp, Homo sapiens
agagtgaccaagtgctctgtgtattaggatgtccaccaggtatcctaaattggcagggcaggtactct

SEQ ID NO: 6766961 - DNA, 57 bp, Homo sapiens
ggtggcagaggatcaggctctggaaatctgtggtcttcctcctggtcttttggcatc

SEQ ID NO: 6766962 - DNA, 99 bp, Homo sapiens
caggaacaggccattttcacttcttttgtgattcttcagttacttcaggccatctagatgtatacgtgcaggtcacaggggatgtgatggcttagcttg

SEQ ID NO: 6766963 - DNA, 61 bp, Homo sapiens
aaggaagagtcaggatgagaggccaggtgtttctagtgcttaaaatccatgatttttactt

SEQ ID NO: 6766964 - DNA, 88 bp, Homo sapiens
ctccccacagatgccaaattctcagcctcttttggatgatgatgaaataatagaatggtttgctagagcattaggtatgggtggagag

SEQ ID NO: 6766965 - DNA, 69 bp, Homo sapiens
tcccagcaagaataaaggcatatatcctttcaataaaaataataaatgtatgcttattccttgttgtga

SEQ ID NO: 6766966 - DNA, 76 bp, Homo sapiens
ggagaaggcgtggaaagacattcagccgctgggcaaatgctgagaatgtctgagggtccttcaggagcccttctcc

SEQ ID NO: 6766967 - DNA, 73 bp, Homo sapiens
aactcagaatgcaagattcagcaggaagatgatttatttctgtcatctggataggttgttttgcatctgggtt

SEQ ID NO: 6766968 - DNA, 70 bp, Homo sapiens
gatgcttttgggatccaacatatagcacaataaaaatgacttttgagaaatgttggaatccaaaaacatt

SEQ ID NO: 6766969 - DNA, 61 bp, Homo sapiens
gcttgtgtatttttatgtgcggattttttttaagttccgtactgcaaagaatatagttagt

SEQ ID NO: 6766970 - DNA, 84 bp, Homo sapiens
ctacggtgtttcctgaagttatttcatccaagaggccatttttaggcatctcacaggataagtgggttaaggagcacactttag

SEQ ID NO: 6766971 - DNA, 79 bp, Homo sapiens
ctttgctgttgtgaatagtgctgcaataaacatacatgtgcatgtgtctttgtagcagcatgatttataatactttggg

SEQ ID NO: 6766972 - DNA, 77 bp, Homo sapiens
ggtcaagatgaagtgaagattagaacctaaatgccttatcctctgtcttggcgttcttccttctaatttatcttgtc

SEQ ID NO: 6766973 - DNA, 57 bp, Homo sapiens
gggcattcctaagcgagaagaggctcaatcctattttcttctcctaattggatgcct

SEQ ID NO: 6766974 - DNA, 69 bp, Homo sapiens
gcacccattgtgtgcagctctgccctcatctacccatctctggctatggagctacatgcagtgggtcgc

SEQ ID NO: 6766975 - DNA, 69 bp, Homo sapiens
ccctaaaccacccacctcacagcatagtgcagagatgtcctggcagtgcttctggtgtgtgggatgggg

SEQ ID NO: 6766976 - DNA, 124 bp, Homo sapiens
tttcaggaaatgtttatggtgatagtagcattaagataataagatatgctgtccatacatattactcaaaggatgacattctgttaagtctcataaagttatagtcatgaagagattattgaaa

SEQ ID NO: 6766977 - DNA, 56 bp, Homo sapiens
gctgtcagttttacccacagacagaagagatgactgtctgtgtggtttttgcatgt

SEQ ID NO: 6766978 - DNA, 70 bp, Homo sapiens
tagtatgtagatattcattttttgctttatatttaaatatattattaaagtgaaatggatgctgctactg

SEQ ID NO: 6766979 - DNA, 56 bp, Homo sapiens
tgcgcccagccaagtctggcacttctctattaagcacctggaatgtggctggtgca

SEQ ID NO: 6766980 - DNA, 106 bp, Homo sapiens
gccaaaggctcaagacatgaagattcttttgactgcccgagcctcccagttctcaggagccatcctgctgaggctctgggtgtcactgtttcatggaaatgcaggc

SEQ ID NO: 6766981 - DNA, 57 bp, Homo sapiens
tttggatgaggactatcgttgttttgaactgaaaaggctagaagtgcctcatctaga

SEQ ID NO: 6766982 - DNA, 65 bp, Homo sapiens
gagcacatgtggagagtctgggcccagtccttgctctgggatctgcctcattctcgcgtgtgttt

SEQ ID NO: 6766983 - DNA, 80 bp, Homo sapiens
gttaaatgaagcccatttgtacagcacattgcaattcacaaagcactttcccatatgtgcttgcagatgagcctcataac

SEQ ID NO: 6766984 - DNA, 56 bp, Homo sapiens
ccccctagtctcacctgtccacctgcctgggctgcacaggtgagactcaggaaggg

SEQ ID NO: 6766985 - DNA, 80 bp, Homo sapiens
ttttttcctgtggtttacatgacagttattaatggctctcctactaggagcctgacatcatggtgagcatcgagaaagga

SEQ ID NO: 6766986 - DNA, 69 bp, Homo sapiens
agatggtaagggatttgaacataggttaatccattgctgttaggatcaagaccagatcccttaccagct

SEQ ID NO: 6766987 - DNA, 121 bp, Homo sapiens
tagaagaagttatttccctttatgttgtattcctaagtcatgacaaatttttattagcaatttggagaattagagaatgcctggcattaacaaagttttggggaaatgggacttttttcta

SEQ ID NO: 6766988 - DNA, 57 bp, Homo sapiens
gaggtgagcattgggctcagccagaaatgctcctgccctcccagtgctcactgcctc

SEQ ID NO: 6766989 - DNA, 61 bp, Homo sapiens
acaggattttcagggaaggtgatacattttgctttgtacttcattcctgaggaattcatgt

SEQ ID NO: 6766990 - DNA, 60 bp, Homo sapiens
aatacagtctccagcggatgttggcacctccctgtcaggctagctaatgagtactgtgtt

SEQ ID NO: 6766991 - DNA, 72 bp, Homo sapiens
ggacacagccctgccctgccatgtggcagctgattggagtggtgttgctatgaaacagggagggctgcgttt

SEQ ID NO: 6766992 - DNA, 75 bp, Homo sapiens
ttccaattgtttatgagctgattagtgttgtagaaatacattctgcagcagaataatctgctcagtaatttggaa

SEQ ID NO: 6766993 - DNA, 67 bp, Homo sapiens
tttctgggtcaaaggatagtcacatttttatgtttttgatgtattttgccagactgtctcccagaaa

SEQ ID NO: 6766994 - DNA, 57 bp, Homo sapiens
cttgatccaatatactatagtaggtttgtgaatgttcttgcaagtgtcttggacaag

SEQ ID NO: 6766995 - DNA, 55 bp, Homo sapiens
accctggattgggaaccagaagagttgagtgctcatcctgatccttcccaggagt

SEQ ID NO: 6766996 - DNA, 71 bp, Homo sapiens
gaggaatgagaccttgccttaggaggcatttagttgtcttctgtgtagaaaggtagcccttcactttcctc

SEQ ID NO: 6766997 - DNA, 60 bp, Homo sapiens
ggtcaacgctgagaagaacatggccacaggtcaccatgtggctctgcacctcagtgtacc

SEQ ID NO: 6766998 - DNA, 77 bp, Homo sapiens
ataggttaataattttgggtagataacaaagatctttggccaacttgaagataattatttacttcaaagttacttat

SEQ ID NO: 6766999 - DNA, 56 bp, Homo sapiens
gccacccttgcgtcactgacattgggctcttcagtcattgtcatgttgtaattggc

SEQ ID NO: 6767000 - DNA, 67 bp, Homo sapiens
tttaggcaagggcaagattatcattgtgcttttcccactgtatcagatctactgctctctgcctaag

SEQ ID NO: 6767001 - DNA, 67 bp, Homo sapiens
cttctggttcttataagttaatatttccaattaggaactctcattggcaacttactggagttagagg

SEQ ID NO: 6767002 - DNA, 83 bp, Homo sapiens
gcagttgtttcacaaggcagttggacttcactttgagaagcactgctcttaaagcttacttcaattgtgccttatgggtctgc

SEQ ID NO: 6767003 - DNA, 55 bp, Homo sapiens
tgaggtgatgtggaaaatgatccctctctgagagagcatgcactacttcatctta

SEQ ID NO: 6767004 - DNA, 73 bp, Homo sapiens
gggccatgagagatcacagtggcaactcccttcctaacaaagaaaggtcagagtgagctgtggcccaaggccc

SEQ ID NO: 6767005 - DNA, 90 bp, Homo sapiens
aatacagtcatgtgtcacttaatgacaggataggctctgagaaatatatcattaggcaattttgtcattgtgtgaacctcagagtgtgtt

SEQ ID NO: 6767006 - DNA, 84 bp, Homo sapiens
aattatttcctttgaaagctgaggacaggagggtcaaataacttgtatcatttcccaaagtcttgcagctgataagtgatggtt

SEQ ID NO: 6767007 - DNA, 75 bp, Homo sapiens
ggctgtgaggaggcagagcgttcagttggtaaatgagggaggagccagctgacgatgcctggtctctccatttcc

SEQ ID NO: 6767008 - DNA, 55 bp, Homo sapiens
acagtgtcctaaattcccacagatggcatttacactgtgtgaacacggactctgt

SEQ ID NO: 6767009 - DNA, 61 bp, Homo sapiens
tctgggtctcaggagttctgaggggtttccctgacctctcttgagcaatccaggcgccaga

SEQ ID NO: 6767010 - DNA, 79 bp, Homo sapiens
cacaggtgctttggggaggttgccacattccactctcaggggccactcctgtgggtggcaaggccccacggcacatgtg

SEQ ID NO: 6767011 - DNA, 60 bp, Homo sapiens
tgagaaagacgattggacatctgacagcttcattgatagctgacacaaattgctttctca

SEQ ID NO: 6767012 - DNA, 85 bp, Homo sapiens
acttccccatatgacaatgtgggcctaagggttcaaaaggtgaaatgatttgccccaaggtcttacagtttgttcttggcaaagt

SEQ ID NO: 6767013 - DNA, 71 bp, Homo sapiens
ccagtaagaagagggcctactggacatgtcagctgtgacctggctgaaaccagggtgccctcctgggctgg

SEQ ID NO: 6767014 - DNA, 86 bp, Homo sapiens
ctgcatttaattggcattggtgggcaattcattggaggcattgcaatgtgacttcaggaaatgtctgcctaccatagtgctggcag

SEQ ID NO: 6767015 - DNA, 79 bp, Homo sapiens
aaaactgtagcatttaatgttgaagataactgacatgcatgaagtcattgtattaaaatattggtttatctatggtttt

SEQ ID NO: 6767016 - DNA, 57 bp, Homo sapiens
tgtatcctcactaattaggagggaaattattctcctcacactatagatgaggattca

SEQ ID NO: 6767017 - DNA, 80 bp, Homo sapiens
catctgatttctactgcagctgctcaactctgctgtcgtaatgggaaagcagccatagatagcatgcaaaagaatgggtg

SEQ ID NO: 6767018 - DNA, 83 bp, Homo sapiens
gctttttcttgctacacttgatggagtttccttttttaaatgaacatttttagggagaaaatgtcagtgtgcagggtaaatgc

SEQ ID NO: 6767019 - DNA, 67 bp, Homo sapiens
tgaattcatctgctcattgcttactgattagaaatttctgtcacattgtaggatagcagagagttca

SEQ ID NO: 6767020 - DNA, 57 bp, Homo sapiens
gccctctccccagagcttccctagttattctctgagcacagctctggggagatgggc

SEQ ID NO: 6767021 - DNA, 59 bp, Homo sapiens
ggcacagggagaggcggattttcccccaagggatgttcctctgcactcctgcatgtgcc

SEQ ID NO: 6767022 - DNA, 56 bp, Homo sapiens
gttgccctttccctcatgtgccaagaacaagtgcctgagcacatgtgtaaggcgac

SEQ ID NO: 6767023 - DNA, 69 bp, Homo sapiens
tccccgttcacagcctctgccccaggcacaaggaaaagtccccagtgtctgggcaggcctgagcaggga

SEQ ID NO: 6767024 - DNA, 88 bp, Homo sapiens
aagagacagcctgaggccggtcctcactcactgtctttgaggacctgaggggcagctgacagtgggatgaggctggccccctcctctt

SEQ ID NO: 6767025 - DNA, 68 bp, Homo sapiens
tgtggagtggtgatggataggtttattttgggaaactgagaacctagcaagtctaccatcatttaaca

SEQ ID NO: 6767026 - DNA, 57 bp, Homo sapiens
tggctctatgtggtggttttgatggtttttgaccaaacactatgattatagaggtca

SEQ ID NO: 6767027 - DNA, 111 bp, Homo sapiens
gtgatgagtatttgataacactacatcatccacaacttagaagaagcattttttggtatgttacttctgtgatttggttaggatatgtggtttggacacagtgatcataac

SEQ ID NO: 6767028 - DNA, 82 bp, Homo sapiens
tcctacccagctacactgccagcagcactttctccttcctcaggcaagtatggtaaagtgctgtgggctgtaagtgggagga

SEQ ID NO: 6767029 - DNA, 94 bp, Homo sapiens
atttccaatcattgaagtcactaattaacacgtcgtctctactagcctcagagagatgatatgccgagttcagttaacatcgatgatgagaaat

SEQ ID NO: 6767030 - DNA, 55 bp, Homo sapiens
ggtaactgaggccatattctgaaatcaaaaataccaggaggcctgggtatttgcc

SEQ ID NO: 6767031 - DNA, 64 bp, Homo sapiens
tagaggagctgtgttatccattcccaggcacagcatgggaatgtggcaaggcatagagtttcta

SEQ ID NO: 6767032 - DNA, 69 bp, Homo sapiens
gctctgctgatccgcagccatccgggttcagcccagcctggccagcagctgcgggtcaccagccagagc

SEQ ID NO: 6767033 - DNA, 116 bp, Homo sapiens
ccaacttctgccatatctatctcgtgtattactatatgcgtggcaggtgcttccaccataagacatccgaggccctcttgcaggtggtgcaccatgagaggtccctgcagggttgg

SEQ ID NO: 6767034 - DNA, 64 bp, Homo sapiens
tcttgggaccatttacacatacacattcactgtgatgtctgtgtttaaaagatatgtcctgaga

SEQ ID NO: 6767035 - DNA, 117 bp, Homo sapiens
gagctcagtacatttgagatgtttaccaagatggtcttgagatattataaagggcaaagagaaatgcaattatgtttttcaagtgcacactatgaactaggcattgtgctgatactc

SEQ ID NO: 6767036 - DNA, 66 bp, Homo sapiens
tcagttattagagtcaaaatggcatgttacctgaacctggtaggctgaaatagctctgacaattgg

SEQ ID NO: 6767037 - DNA, 65 bp, Homo sapiens
gtgaatgactggatgtgatggggagatgacggcaagttgcatccaaaccattcatcagccatcac

SEQ ID NO: 6767038 - DNA, 56 bp, Homo sapiens
gctgccctctgtgtttgtccttgccacagtcacggggtgcatgtgcagaggggagc

SEQ ID NO: 6767039 - DNA, 84 bp, Homo sapiens
tctgttttagcaccttgacttcaggattttggaaaccccatcagttcagtgaatcctatgtcataggctttgtaataagatgga

SEQ ID NO: 6767040 - DNA, 59 bp, Homo sapiens
ctgacttgttggcaggacaagggaattcttgaaggctctgggaccactcaacaagtcag

SEQ ID NO: 6767041 - DNA, 93 bp, Homo sapiens
ggtattaaatgatcttgtgagctgctatgtaggaataagattggaaaagatttctgtttttcccagtatggcggacaaggtcctctaaacacc

SEQ ID NO: 6767042 - DNA, 63 bp, Homo sapiens
tacatggatgttatccttactgctatgaatatcaaactattgcttgaggattgaggtccagta

SEQ ID NO: 6767043 - DNA, 107 bp, Homo sapiens
tctgcaatttcacttccatgagcttcctgaagatgaaaagagaggtttccccaccagttcagaaattctctgaagtctttcagggcactcatcaccagtgtggcaga

SEQ ID NO: 6767044 - DNA, 70 bp, Homo sapiens
ttggtcttatttaacctaaatttctagatcatagatagtgttaatggagaaataggtaagaggagggtag

SEQ ID NO: 6767045 - DNA, 94 bp, Homo sapiens
tcttttcagtcttgggtatgggcagcagctgccattcatttaaaaacaatgtaggaaggaggtagaggttagttgctggcctaagaatttagga

SEQ ID NO: 6767046 - DNA, 73 bp, Homo sapiens
gaaggacaagattttatgactctttttccaggacacctggcaaagccaaattttcatcaaggtcattgccctc

SEQ ID NO: 6767047 - DNA, 68 bp, Homo sapiens
ctctaggatggaaggtggtttggggacttacatctctctctttcctcctgtctccttcctatattgag

SEQ ID NO: 6767048 - DNA, 78 bp, Homo sapiens
caaagagcctcctcctggtgtgccgattattagttgccacaataattctttggaaaatatctgaggagaaaatctttg

SEQ ID NO: 6767049 - DNA, 60 bp, Homo sapiens
ctgcaggggtgtcctgtattggcatcgacctgtcgttaatccagcaaacacaccctgaag

SEQ ID NO: 6767050 - DNA, 77 bp, Homo sapiens
gcttttccttccccgagcgcctcaagcagtctctgggccgcaggaacagccctctgaagaggcgcttgggtagaggc

SEQ ID NO: 6767051 - DNA, 76 bp, Homo sapiens
gggcatgggggctcaggcctgtaatcctagcactttgagaggctgaggtgggaggattgcttgagtccaagagccc

SEQ ID NO: 6767052 - DNA, 92 bp, Homo sapiens
cactgacaagacatggtttatttcggtttttaatctattatggaaaaaacgaatttctctttggaaagagctatacaaccatgtccaacgtg

SEQ ID NO: 6767053 - DNA, 66 bp, Homo sapiens
ccccttgctactgattgaccttggagaggtgacttggcctctctgagcctcatctgtaacatgggg

SEQ ID NO: 6767054 - DNA, 89 bp, Homo sapiens
ccagtgtgtttatacatggcttgtatggcagctttcataagacatttaccccatgatttgcgatgagcttatgtgtgaataattaatgg

SEQ ID NO: 6767055 - DNA, 73 bp, Homo sapiens
tccgcgaactggggccacagcttttaacctcggggctcttctggccctggagtagcactgggtcgcagttgga

SEQ ID NO: 6767056 - DNA, 111 bp, Homo sapiens
gaagagaattaaagtgtctgacttgcatcttaaaggagtctgaaaagcagatatatacataagcttttaagttgacaagttttatttcaagactcttgttaaattctcttt

SEQ ID NO: 6767057 - DNA, 65 bp, Homo sapiens
aagaagagaactgccaaacacttaagcaaacagaaacagctgaagaagaggtagtgtcttttctt

SEQ ID NO: 6767058 - DNA, 81 bp, Homo sapiens
gttccaatggggactgggacaccatggacctactcccagaccgagacctgcactgttcatgcttgttcctccacctggaat

SEQ ID NO: 6767059 - DNA, 61 bp, Homo sapiens
tcctgtctttctaggcagaacaggttaatacttctttgctggttgcctggaaggaacagga

SEQ ID NO: 6767060 - DNA, 81 bp, Homo sapiens
gcagtcattatgtggggcttacaaaggcagatcatctgggcaaatgactctctactggtactgagtcccaaagatgagtgt

SEQ ID NO: 6767061 - DNA, 75 bp, Homo sapiens
ttattacttccatgtccttagagtccaaaaacttcaataagtcaaactgcacataaagggcatgggaggtgctaa

SEQ ID NO: 6767062 - DNA, 71 bp, Homo sapiens
ggctggatttggggggattcaggagatggagccaagggtaacaactcagtttgttccttgggaatcttgcc

SEQ ID NO: 6767063 - DNA, 82 bp, Homo sapiens
cgcatcaggcagctttcagtcattttgtttgccaaaggcagcttcctgtggccatgacatggaggctttgaggctttgtgtg

SEQ ID NO: 6767064 - DNA, 60 bp, Homo sapiens
gggccagctctgtgatgtaggggaagaaaaatatgttccttctacccttctaggctgccc

SEQ ID NO: 6767065 - DNA, 72 bp, Homo sapiens
agccctgtgctgtggcaagtggaggatggtgcccaccccatccatcatttcaccgccactagccctcaggct

SEQ ID NO: 6767066 - DNA, 71 bp, Homo sapiens
caggtaatgctggtgctagaaactggaagcagaaagatttctacagttactcagctcggtagagatacctg

SEQ ID NO: 6767067 - DNA, 58 bp, Homo sapiens
ggactgggccaggggttggactctgtgcaggacgctgagtcacccgtggaccagctcc

SEQ ID NO: 6767068 - DNA, 62 bp, Homo sapiens
tggacagtgcagatacagaatgacccttgataatccgtcatctttgtgctttgcattattca

SEQ ID NO: 6767069 - DNA, 55 bp, Homo sapiens
gttggatttcatgcagtaaagtaccaatacagtgaggttgctgccaagtcccaac

SEQ ID NO: 6767070 - DNA, 71 bp, Homo sapiens
cctcggaagccacaatgccaacctctacttggcaactcagcccagcagagttgggattgtgaagattgggg

SEQ ID NO: 6767071 - DNA, 75 bp, Homo sapiens
ggtcctaggctcagggtctcagaggctgcaatcaaagtgttagcaacactgtgatcctttcaggagcttggggct

SEQ ID NO: 6767072 - DNA, 68 bp, Homo sapiens
ggcatactgccttgagtttgcagagtagataacacattacagtgcaagggtgctgggggcaggctgcc

SEQ ID NO: 6767073 - DNA, 83 bp, Homo sapiens
atacaagctctttggcacagtaatctctcttcaggaaatttatcttgaggaataattggacatgggcacaaagatgtgtgtat

SEQ ID NO: 6767074 - DNA, 63 bp, Homo sapiens
tcatatccccttcaagaaagcctaaagatttggagagtcaggcctgtgctggaggagatatga

SEQ ID NO: 6767075 - DNA, 60 bp, Homo sapiens
actggttcatcgcggccacttatgaatcagctggctctgcctgtcatgccgcgaaccagt

SEQ ID NO: 6767076 - DNA, 71 bp, Homo sapiens
tattctcacacctccaggtattactgttttcccatcatacagatggcaaaaccaaggcttggagaggagta

SEQ ID NO: 6767077 - DNA, 89 bp, Homo sapiens
gttttgctgttgtcgggtggatcacgatgcaattttgatgagtatcataggagaaaaattgcacggtatccatctgtaaaccgcaggac

SEQ ID NO: 6767078 - DNA, 66 bp, Homo sapiens
acatagtagaatccaaaccaacagttcaagtaaacagaatgaggggatcctggacttccactgtgt

SEQ ID NO: 6767079 - DNA, 81 bp, Homo sapiens
ccttcacgatgttcagtgttagtccattgcactctgggcttgaaacagctgcccaaaggcagtgtgatactgtggttaagg

SEQ ID NO: 6767080 - DNA, 70 bp, Homo sapiens
ctggaggaatctggctatttctggtcggggcgcgcccgctggcccgggccagggttggccagtcctccgg

SEQ ID NO: 6767081 - DNA, 73 bp, Homo sapiens
agtttggcatttatctttaatcaaagtggagctattgcaagtatttgcttagataaatggtaagaccaatact

SEQ ID NO: 6767082 - DNA, 91 bp, Homo sapiens
cagcccacaccgaaaaccttgagccctgatctgcttccaaccaatggggtggccaggggagctgtctggggactctgggtggtgcaggttg

SEQ ID NO: 6767083 - DNA, 66 bp, Homo sapiens
ggatgactcattttctggttgttggagactcttaagggatctgctttcattcacaaaatagcatcc

SEQ ID NO: 6767084 - DNA, 88 bp, Homo sapiens
tgttagattcaaatgtatggcagtttcactctgggattccaccaaaaggaatctgtagggaacaactgtacagaacacagaactgaca

SEQ ID NO: 6767085 - DNA, 62 bp, Homo sapiens
gcttgtcacgtttctgccgccaggaatcatgtaggaatgattccagtcgcttaaacctgagc

SEQ ID NO: 6767086 - DNA, 73 bp, Homo sapiens
gctggcttgcaaacagaaacttgatgtaaaaatgttacttccaagttttgattttgcagtaaaaaataatagc

SEQ ID NO: 6767087 - DNA, 56 bp, Homo sapiens
actttgcagagccagaagagaagaattagatttattcctcctttcgttctgaaagt

SEQ ID NO: 6767088 - DNA, 71 bp, Homo sapiens
cagagttacattcattgttacgctgggttccaagtctagaatcaaaaagtcagggcaggaatttagctctg

SEQ ID NO: 6767089 - DNA, 57 bp, Homo sapiens
ttttgaaagccaggtttgtatggaaatgctctcactccacttggactgctttcggaa

SEQ ID NO: 6767090 - DNA, 61 bp, Homo sapiens
agctctcttccagtggctttgatttctcagagagagagcaaagggacatggaagaggagtt

SEQ ID NO: 6767091 - DNA, 79 bp, Homo sapiens
agaggtgaccttgtgctcatgcataggagggggtcagcacatgcaaacttcccttctgtgcagggcagaggccatctct

SEQ ID NO: 6767092 - DNA, 129 bp, Homo sapiens
gcaatgttgatcagttaaacagtaagttatcgtaaacatcttgtactgcacattttaccctaatcgggtggagtcaacaaatatgtaagtgatatctctgtttatatattgtcaatagtatttatttgc

SEQ ID NO: 6767093 - DNA, 59 bp, Homo sapiens
ctcctgtggtcaagggtgggactcaccctcagcaagtttcactttaaccccacaggcag

SEQ ID NO: 6767094 - DNA, 60 bp, Homo sapiens
atatgtgcaaagtgtacaaattaatgtctaaaatagtaatttagtgcattatgcaaatgt

SEQ ID NO: 6767095 - DNA, 56 bp, Homo sapiens
gagaaggagtagctgacctggggttagaacttgagtcctaggccagtatacttttc

SEQ ID NO: 6767096 - DNA, 94 bp, Homo sapiens
atggtttagatccagtcagctccaacagatagccctcggaattcccctaaggtcttgtcagtgttggcagctttcaactggtgttcattgccat

SEQ ID NO: 6767097 - DNA, 59 bp, Homo sapiens
ctaagttcagagttctcatttgtgatgcaaaaccactgcacctgtagaatctgacttag

SEQ ID NO: 6767098 - DNA, 129 bp, Homo sapiens
tgatggggcaggatttgggcagatgtgggggcggagctgttctgagatgcccggctttggcctgtggggcagctggctgaagctgggctctcctctgcctttctgtcctcccttcctgcgcaactccca

SEQ ID NO: 6767099 - DNA, 58 bp, Homo sapiens
tcaaacaggactacattctcatataatttcccaagaaagagtaagtagtcttgtgtgg

SEQ ID NO: 6767100 - DNA, 62 bp, Homo sapiens
tctctcatacatagacattttgttctgtccttggttagaacaaatggggccttgtatgaaga

SEQ ID NO: 6767101 - DNA, 55 bp, Homo sapiens
caaacagcatctgccaactctactttcacagtacagccccatgcaggtgtgtttg

SEQ ID NO: 6767102 - DNA, 56 bp, Homo sapiens
ttctggaaatgaatgctaggaacagaaggttttccgtggccagccatttcctggaa

SEQ ID NO: 6767103 - DNA, 56 bp, Homo sapiens
ctgtggtgacaatagtttttaaatctaatcatgatagaagaactatgtgattacag

SEQ ID NO: 6767104 - DNA, 59 bp, Homo sapiens
gtagctgcctttctggcccaggaccacaccatgagtgggcagactaaggtcaaagctgc

SEQ ID NO: 6767105 - DNA, 60 bp, Homo sapiens
ggtccagaaatgcaagccaggtgtagaggacaatagaactaccctaccagcttctggacc

SEQ ID NO: 6767106 - DNA, 69 bp, Homo sapiens
tccccatttcctcttcccaggccactgtgccatagaaatggagacagagtattggaaaggcagtgggga

SEQ ID NO: 6767107 - DNA, 58 bp, Homo sapiens
gacattggcccaaatctggggcagctgtaatgagagaagtcctgggctgggccaggtc

SEQ ID NO: 6767108 - DNA, 61 bp, Homo sapiens
tcattgaacacacttttctagttggccctttgtccaagctgactggtggactgttcattga

SEQ ID NO: 6767109 - DNA, 64 bp, Homo sapiens
cagaaagatgtgagttcaaacctcagtgaatggactgaggtgtccggctgcataatcttggatg

SEQ ID NO: 6767110 - DNA, 78 bp, Homo sapiens
gaatctgacctcccgccttggctcctcagacattgccaaagtagattctgtgagagtcaaagttaggagtttctattt

SEQ ID NO: 6767111 - DNA, 68 bp, Homo sapiens
tgttctagcaacacagttttggaaaaaactacaatctcattatttccaaaattaatgaagcaaggaca

SEQ ID NO: 6767112 - DNA, 100 bp, Homo sapiens
gaaaatgtgggaacatgggtaaggctgaaggaaagtgcacactcaagacacccttccccatttgttcactcttctctgtcacccatgtattcctattttc

SEQ ID NO: 6767113 - DNA, 63 bp, Homo sapiens
tggcatagctcttggaacgtgttaattttcaaggacaggggtttgcaagtcagagcaatgtca

SEQ ID NO: 6767114 - DNA, 64 bp, Homo sapiens
ttgtgctgtggctgaactctgaagaggcagttctgttgtgcctgttaatttcagcacagtgtga

SEQ ID NO: 6767115 - DNA, 73 bp, Homo sapiens
aagagagaggatgaattttttttaagttgcataggtgaattgaaataggcacgaatgaaagtttctctctctt

SEQ ID NO: 6767116 - DNA, 70 bp, Homo sapiens
gagtggactttctgtcatctagacaagtaacttccaagggtgacttcgagaggacggaaggttctggatc

SEQ ID NO: 6767117 - DNA, 67 bp, Homo sapiens
tctttagagttggtcccctgtgagccatgcaaggctggcttttcacaggaggataagcccttccaga

SEQ ID NO: 6767118 - DNA, 66 bp, Homo sapiens
tcccatctcagctttctgcttccactgcagacttccctgtctatcactagcagagagtgaatggga

SEQ ID NO: 6767119 - DNA, 100 bp, Homo sapiens
cccaggtggaagggtcaggctgctggagcttgggtagggcaggcagatccccaaggggagactgtggaccctgagtcagacagcctgacaccaacctggg

SEQ ID NO: 6767120 - DNA, 63 bp, Homo sapiens
agtgtctgtccttgtttggtatcaggtttatattaatttgacaaaacattttgggagagcatt

SEQ ID NO: 6767121 - DNA, 98 bp, Homo sapiens
ttgttttgcaggagtcatgatttcctttgagtttttatgtcagcttctttatgcgttggctggatatcagaggaagtgtagcccacattgctgaacag

SEQ ID NO: 6767122 - DNA, 130 bp, Homo sapiens
gtggaaaaatagcaacttagtatgatggagagagagagcagacaggcctgggttcaaatttgggctctctagtttgtcaggtttgcaacctcgggcaaattctctagcttccctgaacttgaatttcccc

SEQ ID NO: 6767123 - DNA, 58 bp, Homo sapiens
ctgatatctggaaaagctgaaatattttccccctttgttgctgcctttctaggatcag

SEQ ID NO: 6767124 - DNA, 75 bp, Homo sapiens
atggaaaaggtaactaaaaatatattcaaggctgggaagttcttatgcagaatgtctttttggtacttataccat

SEQ ID NO: 6767125 - DNA, 61 bp, Homo sapiens
aatgttatttcctctctgtgagttattttctaatctagaactcagagaagggactgagatt

SEQ ID NO: 6767126 - DNA, 66 bp, Homo sapiens
tcagggtttggggctacagccactcacttttacacaatttaagattggcagcttctatacccatga

SEQ ID NO: 6767127 - DNA, 128 bp, Homo sapiens
ccccttccccgccaccacctccgtcacaggccatctgtccctgcactgcccactctcagcccttttaatagcatgggccttggggaggatggtgtccagggtggtttcataacaggccgggggagggg

SEQ ID NO: 6767128 - DNA, 65 bp, Homo sapiens
gtggggagcaggcctggggtgaggcctgggaaccagggtcttcatctaccctgcagggcccccac

SEQ ID NO: 6767129 - DNA, 58 bp, Homo sapiens
gcagctgtcgctaggagctgtgactcagagccagagcagtgactcctcgcgaagctgt

SEQ ID NO: 6767130 - DNA, 72 bp, Homo sapiens
cagcggttattggagcagaacaggccgggtgggaagacagcttattcccaaagccactctgcctccctgctg

SEQ ID NO: 6767131 - DNA, 55 bp, Homo sapiens
agagttatcactccatgcagctctctcctctctgatgctgtaccctgaaaactct

SEQ ID NO: 6767132 - DNA, 65 bp, Homo sapiens
ggctcatgcctgtaatcccagtgctttgggaggccaaggcggggggatcacgaggtcaggagatc

SEQ ID NO: 6767133 - DNA, 58 bp, Homo sapiens
tgcactgcccaggaactgtgctgtggagtctggccacgttcccttattggggcaggca

SEQ ID NO: 6767134 - DNA, 61 bp, Homo sapiens
ggccagattttagtcaaatggccacaaaacttcaagagaggctaggaactatggtctggct

SEQ ID NO: 6767135 - DNA, 71 bp, Homo sapiens
ttagtttcacagccacactagctacatttgaagagctcagtcactatatgtggctagtggctatgatctga

SEQ ID NO: 6767136 - DNA, 81 bp, Homo sapiens
gcataaaaccttgaacaccttttattcgccaggcacataaaaagaatcttttgagtgttgataatggggtaggttgtgtgt

SEQ ID NO: 6767137 - DNA, 95 bp, Homo sapiens
tggctatttctttaacctttggcccatctcttttataataaaagcaggccatcaaatgaagtgctggttcttaggagagagatggcgtcaagcca

SEQ ID NO: 6767138 - DNA, 61 bp, Homo sapiens
agcaaagacagggacgaccaaggtaagtctcactaggagatctgctctctctgtatttgct

SEQ ID NO: 6767139 - DNA, 63 bp, Homo sapiens
tccaagttgtcctaacctttggtggagtaaagaaactatctacaaaacttaggtgacttagga

SEQ ID NO: 6767140 - DNA, 103 bp, Homo sapiens
agccctccgcaattatcttaaggggtccagaatatttgggaaagatgtcatattactatctttcccaaatattctgggccccttaaaataattgcagagggct

SEQ ID NO: 6767141 - DNA, 60 bp, Homo sapiens
catttgttaattactattatctatgactgctttgcagtaatatgacagagttgataagtg

SEQ ID NO: 6767142 - DNA, 59 bp, Homo sapiens
ccctgccggtccgagcccccacctgcgctgctcaggagggtgatccgggctggtcaggg

SEQ ID NO: 6767143 - DNA, 63 bp, Homo sapiens
cagacatacatcagtcaggaaaggtcttatgactaaggcatttctgatgagggatgtggtatg

SEQ ID NO: 6767144 - DNA, 92 bp, Homo sapiens
gatgtactggtagatataatttttctgtggccagttcttaaagggaatgtctaaaagaaattggtatagtaacattattttacttatatatt

SEQ ID NO: 6767145 - DNA, 61 bp, Homo sapiens
gtggagccaggatctccgcacatccctatgctgtgatagctacaggggatcgtggcttcac

SEQ ID NO: 6767146 - DNA, 75 bp, Homo sapiens
ccacagtgtctcagtgttaaatataaggtattctaataatatagaggaagaacacctaatttagactgaactggg

SEQ ID NO: 6767147 - DNA, 86 bp, Homo sapiens
gggacaaaataaggtaatatttgaaaactgtttagcagcgtcccacttcgctaatgaatttaaaataaatgtagtttgttgtaccc

SEQ ID NO: 6767148 - DNA, 80 bp, Homo sapiens
aacttccttctcccagtgattcattcatttacctgggatacaatcttcccatgaactcatttttgtgatgaaaggaagtt

SEQ ID NO: 6767149 - DNA, 84 bp, Homo sapiens
gactttgtagtgtcatatattacctgcctgatctatatctaaatgatgttatgaggatcaggtgaaatatgtggctgaaaagtc

SEQ ID NO: 6767150 - DNA, 66 bp, Homo sapiens
ccaatggctgccttaattcttcagcgggggcgttctttttcttcctcccaagcaggcggccgttgg

SEQ ID NO: 6767151 - DNA, 83 bp, Homo sapiens
ggtaatctcatggtggaggtgtattctggatcgactcacttttgaaatgtttatgaaagaaattccttcacctcgggacttcc

SEQ ID NO: 6767152 - DNA, 57 bp, Homo sapiens
gcccttggaagcggcaggtagcacatgaccctcacaccctcttctgcttccaaaggc

SEQ ID NO: 6767153 - DNA, 65 bp, Homo sapiens
gccttagctgtgaagctgcctggggctgtgactatatggtcctagctgtttctacactggaaggc

SEQ ID NO: 6767154 - DNA, 80 bp, Homo sapiens
ggtttgggaggagtggtaggcagtgttaggaaacttttagtatgggtttcaagctcgatgctatcatgggtcccaagact

SEQ ID NO: 6767155 - DNA, 116 bp, Homo sapiens
tcccattttatagataaggaagctgaggttcaagaaggttaaacagctctgccaaggtcatacagatggcatttgacctctggaccctctgaagctttctctctgctacatgagga

SEQ ID NO: 6767156 - DNA, 58 bp, Homo sapiens
gctcgcgcccggagccctgcccgcgcgactgagcatgcccagagctccgggcgccggc

SEQ ID NO: 6767157 - DNA, 101 bp, Homo sapiens
tcctggtgggggtcatctctctgggtctctctgctttcccccagaccctgaaccgaccagaggtcctggcacattgcaggggctcaggaaatgctcatgga

SEQ ID NO: 6767158 - DNA, 58 bp, Homo sapiens
gagaatctacaggaaaccgaagagattagacgttctaccatgatttcctgaagttctt

SEQ ID NO: 6767159 - DNA, 60 bp, Homo sapiens
aaaatctgcacaggtcagttttaggtctggattacttcagctggcttttgtgaaggtttt

SEQ ID NO: 6767160 - DNA, 87 bp, Homo sapiens
tagccctgtctaattaagcctggaatgtgtgtaaaatcactagcatagagttttgcaaagtacattatcaggctctggtttgagcta

SEQ ID NO: 6767161 - DNA, 72 bp, Homo sapiens
tcttactaggccttgaattgagggatgtgattaactcaatcctttgcactagaggtccaaaactagttaaga

SEQ ID NO: 6767162 - DNA, 57 bp, Homo sapiens
tacccagcaatccctagaggttctgattcaattgctttgtgtggtggatactgggta

SEQ ID NO: 6767163 - DNA, 64 bp, Homo sapiens
tgtcttctaccttgacagcattgcatgcgtttgtttcttgctatggctgtacagtaaggagaca

SEQ ID NO: 6767164 - DNA, 73 bp, Homo sapiens
tgggaggtgctgacaggaggcttgaggccaggcaggagcagcccatctggcccatcttctgccaccaccccca

SEQ ID NO: 6767165 - DNA, 76 bp, Homo sapiens
ttttctatttaaacaatattcattgctggcctcctgagaatcactggtgagacttgagtgctggctaaatagaaaa

SEQ ID NO: 6767166 - DNA, 78 bp, Homo sapiens
ggacttgtgactgtgaccttattggaaatggagtctttacagatggtcaagttaagataaggtgatcagggcaggtcc

SEQ ID NO: 6767167 - DNA, 56 bp, Homo sapiens
aactctgcaacctatgtagaccagtttaaaggttttaaaaaggtgatgacagggtt

SEQ ID NO: 6767168 - DNA, 82 bp, Homo sapiens
ttgtacttccgtgcctgaagaaaacttgcagcactggtatactgcctgtatgtcggggtttcttctggcaggaaggatacag

SEQ ID NO: 6767169 - DNA, 56 bp, Homo sapiens
tccctcttttacttgtctttccttatctttgaggattcagttattcagagaaggga

SEQ ID NO: 6767170 - DNA, 62 bp, Homo sapiens
ttgcatttgttcagtgaaatgttccttagcactaaaaaggaataaagtattgatacatgcaa

SEQ ID NO: 6767171 - DNA, 55 bp, Homo sapiens
gagtcctgaatcctgtggcaacgtgaaaagatgatgtaatgcagggcagggactt

SEQ ID NO: 6767172 - DNA, 83 bp, Homo sapiens
ttgagtctcagcacaggttaggtattatactatgcacttagaatgtagagactaatatatgaaccaagcctcaaggagctcaa

SEQ ID NO: 6767173 - DNA, 61 bp, Homo sapiens
ggctaggcaatgttctaaggaatgaggatacaacagctcaccgagatatacagtgcctgct

SEQ ID NO: 6767174 - DNA, 66 bp, Homo sapiens
tctttatgctgtttgttttcctaagcattttatgataaggatgtaaacttagataagcagtaagga

SEQ ID NO: 6767175 - DNA, 115 bp, Homo sapiens
tttttcccaggagagctactgttgtcactagtattgcctactgtacatttatatacacatatgtgtgaaagttcctaagactatatacaacataggttcccaccccttggaaaaa

SEQ ID NO: 6767176 - DNA, 55 bp, Homo sapiens
gcgccctctggtggccgcctcggctgtcccagcccaggtcaggcttcagagctgc

SEQ ID NO: 6767177 - DNA, 109 bp, Homo sapiens
cttcaactctgactgcagaaggagctattgtatttaggagaaaagggtaaagacaacagaccacttggcccttgttctgaacttaaatattctcggcagagcagtggag

SEQ ID NO: 6767178 - DNA, 61 bp, Homo sapiens
gctgtgagctgcctgtgtcacacgcgatgaagctgactactgcataggacagcttatgtgc

SEQ ID NO: 6767179 - DNA, 59 bp, Homo sapiens
ttgaagtccttgcctcttgcacctcagaatataactttatgtggaggtaaggtttttaa

SEQ ID NO: 6767180 - DNA, 74 bp, Homo sapiens
ttccatatcgttaaagttctgacattctaatcggaaaagaaatgaaccagcagactttgacaggttttgtgggg

SEQ ID NO: 6767181 - DNA, 113 bp, Homo sapiens
gtctctgtcaactctgctgctgcagcaggaggctcctgcagatgctgggtgaatgaaggcgcatggctgtgctgcagtgagcccttgttgcagaaacaggccccacacaggac

SEQ ID NO: 6767182 - DNA, 66 bp, Homo sapiens
gcctggcaggaatctggcgcccctagtgactctgaggatggcaaaggggcttatgtttctccaggc

SEQ ID NO: 6767183 - DNA, 69 bp, Homo sapiens
ggggaaacattcatttggcctctgcttaaaattctgggaagggtggcataatatccatgtgatttccct

SEQ ID NO: 6767184 - DNA, 57 bp, Homo sapiens
tggtgttttgttatggcagcctgagcagactaatacagctgcctttagagagaacca

SEQ ID NO: 6767185 - DNA, 74 bp, Homo sapiens
gctatacattataccagtgggtacattgagatcaatttgtaccatctggtatacagacaaattttatgaatagc

SEQ ID NO: 6767186 - DNA, 59 bp, Homo sapiens
tgggatggcctttgaaagccagctgagacaccagcttagagttgatagatggcgtccta

SEQ ID NO: 6767187 - DNA, 68 bp, Homo sapiens
gacaccagtaaatattcaaaaggagctaatatttactgattagctccttttgaatatttactggtgtc

SEQ ID NO: 6767188 - DNA, 103 bp, Homo sapiens
tctgcctggcatgaacacttctatttcagcacatctgtgattgccatatcaccagcatttgcagaaatggaggattaattttattgtgcattagctcagcaga

SEQ ID NO: 6767189 - DNA, 69 bp, Homo sapiens
ggttatcaacttagctttcagcctttctcacctacttggatgttggtggtggggctgaaagttttaacc

SEQ ID NO: 6767190 - DNA, 62 bp, Homo sapiens
actgtcactactatgtgtttgtggtttacttgtctgcagccacatcctagagaagtcacagt

SEQ ID NO: 6767191 - DNA, 56 bp, Homo sapiens
cctggatcttaggccaagactcaggtcactgaatttctgatctggaaggaaccagg

SEQ ID NO: 6767192 - DNA, 58 bp, Homo sapiens
gtagcacctgcaggatgtgcacacggtcgacccacgtggtcttctccagcagggccac

SEQ ID NO: 6767193 - DNA, 56 bp, Homo sapiens
agtatgtattttatacttacagcacatctcaatttgaatgtaagtggctacatact

SEQ ID NO: 6767194 - DNA, 57 bp, Homo sapiens
cctgagcccttgaacccaagtcctcagaaatgagcagacacttgaggtgggctttgg

SEQ ID NO: 6767195 - DNA, 66 bp, Homo sapiens
tcctgccccactgtttgaaagaccgtctgccccaaattcaggtctttctcatttttagggccaggg

SEQ ID NO: 6767196 - DNA, 65 bp, Homo sapiens
cagatataccaggaggccgaaactgctcctggaggctggggcaggagagggccacctggaatctg

SEQ ID NO: 6767197 - DNA, 66 bp, Homo sapiens
tgtatgcatttttgaggttaactcaatggagagtagcctcccttagtgaacctggaagatgccaca

SEQ ID NO: 6767198 - DNA, 77 bp, Homo sapiens
gatggttgtttgctgtgacacctgtgtgagtgttaacatgaacagtcaacagagtggccgcagcgtgtagcgccatt

SEQ ID NO: 6767199 - DNA, 78 bp, Homo sapiens
acagaataaggcctaaagaagggttcttcaatgttagtttattcagcatcaaggactccaattctttcatctttctgt

SEQ ID NO: 6767200 - DNA, 84 bp, Homo sapiens
aatgtgccaaaatgacatttcttgttgatataaaaatattccgaaaggctttatgtggggagaaatgttgggatgaggtatgtt

SEQ ID NO: 6767201 - DNA, 78 bp, Homo sapiens
tcatcagcttgtcttttgatagcatgagtattaactatgaaatggttataaattgctatgcagaatgaacagctgtga

SEQ ID NO: 6767202 - DNA, 82 bp, Homo sapiens
tacagaggagtgagataggcttgagctaagagagaacctgtaggttctggtttggtttgtctggtttctagctcccaaggtg

SEQ ID NO: 6767203 - DNA, 85 bp, Homo sapiens
atcacttctgtttcccgttcacttgctctgcatctgctctggttgctgccaagggccatctgagggcactgtgacgagatttgat

SEQ ID NO: 6767204 - DNA, 87 bp, Homo sapiens
atacctcttgtgatgttaggtgttattgactgaattatgttctcccaaaattcacatgttgaagccctaaccccaacacactggtat

SEQ ID NO: 6767205 - DNA, 80 bp, Homo sapiens
atgctgaggtccagagctggcacactgtcactgccacactttgccaatgcaagtgacaaggccagcctggattccagtgt

SEQ ID NO: 6767206 - DNA, 105 bp, Homo sapiens
agagagggacatgtcttgcccggggttacacagcaagtcaagactcagcccaaaccagagtcacagaatgatggctccaggctagaagacatttcttgactttct

SEQ ID NO: 6767207 - DNA, 58 bp, Homo sapiens
agtttcatattaccatgtcaccagagagttctttcgaggtgctgagtgaaatgagatt

SEQ ID NO: 6767208 - DNA, 104 bp, Homo sapiens
ccagaggagaggagcaggcgagggcagaggcggacacggaaggacccaggcagaaacgctgtcttcttctgctgtctccatctgcccttttcctccttctctgg

SEQ ID NO: 6767209 - DNA, 64 bp, Homo sapiens
ctaaataatccctctggtcttagtaaagcaaaagctctgagtagggctggaggtgaagatttag

SEQ ID NO: 6767210 - DNA, 64 bp, Homo sapiens
gctgagaacacaggttctagaatcagaaagacctggagtttggactatctgtgtggctttgagc

SEQ ID NO: 6767211 - DNA, 66 bp, Homo sapiens
tcatgattggaatggaatatgtaggggcttctggggtgttggtcatgttctgtttcttaatcttga

SEQ ID NO: 6767212 - DNA, 67 bp, Homo sapiens
agtcgtgttcgatatcagggtgttggatgccctcagatgggttctaaacattggtatggagcagatt

SEQ ID NO: 6767213 - DNA, 56 bp, Homo sapiens
tccttttatcttttgctttgtacatcgtgctgatgggtgaaacaaacttaaaagga

SEQ ID NO: 6767214 - DNA, 85 bp, Homo sapiens
aatgttttggaactggatagcagtggtggtggcacagtgctgtgaatggactaaacaccactgaattgttcactttcaaatggtt

SEQ ID NO: 6767215 - DNA, 75 bp, Homo sapiens
tggacaatcactctgcaacattcctgagaattgaataatataataatcttgaaagtcagcagagtggattatcca

SEQ ID NO: 6767216 - DNA, 57 bp, Homo sapiens
gcaggagtgacatggatgtggatcaacccaaaccatggctgcaccagtccttcctgc

SEQ ID NO: 6767217 - DNA, 57 bp, Homo sapiens
tattgtgagttgtagttctgttacacctctccttgtgaacagcacacattcgcatta

SEQ ID NO: 6767218 - DNA, 100 bp, Homo sapiens
gagagaaaataacagtttgaaagtagtttactgtttgatttgtttgttttattgtattattttatttcaaatgtaatttattgttttattgttgtctttc

SEQ ID NO: 6767219 - DNA, 71 bp, Homo sapiens
caaagaaccttcgagacagggcaggttcatggctgcctcgtccacaaaagccctgttttctgggttccttg

SEQ ID NO: 6767220 - DNA, 115 bp, Homo sapiens
ccgggccatcgccgggcccggtttcactgttaaggggttttcgtttgttccgttttcgcctcctgtagagctgaacgggaattccccgaagggtgctggggaacgggtggcctgg

SEQ ID NO: 6767221 - DNA, 74 bp, Homo sapiens
tgttccccggcagagtgtgtgcgtgcatgcgtgtgcctgtgtgagcagtgtgcgcgggctgctggccgggggca

SEQ ID NO: 6767222 - DNA, 81 bp, Homo sapiens
cttgttccactactcgaatggtaacaaacttttggtttcccaatagatttggaagatgttgcttttgaaagtaggaaatag

SEQ ID NO: 6767223 - DNA, 59 bp, Homo sapiens
cctgctttgcacttttccttctctgctcctggggcagtgccagggttgtgtaaatcagg

SEQ ID NO: 6767224 - DNA, 88 bp, Homo sapiens
gcatgtgatatttgaagaaaactaaataaaacctctcctcctgccttcggggtaaaattaggtaatctttagatacaccacataatgc

SEQ ID NO: 6767225 - DNA, 93 bp, Homo sapiens
accacgcccagccagatttattttgctaagtgcttgtgagaatttgaaataatatatataagatacttggcatagtgcctgggtggtggtggt

SEQ ID NO: 6767226 - DNA, 84 bp, Homo sapiens
tttgactcctttgtttttgacaactttctttttaaggtatgaatgaaaattgaagtgatcaggaactatataattggagtcaag

SEQ ID NO: 6767227 - DNA, 60 bp, Homo sapiens
ctgagaatagtaataatttctggcatttgtaggtgttagagaagctgtaattattcaaag

SEQ ID NO: 6767228 - DNA, 86 bp, Homo sapiens
agtaagttgactcatgtaatctttggatacagcttaagcttttgatgcttctgtcatctcactgatatagatgagctgtgcttact

SEQ ID NO: 6767229 - DNA, 103 bp, Homo sapiens
gtagactgcagggtcaaaaacaaattagatcagtggattttcttcctttactttcatagatgagtcagaagttattggtcaaatgtgcacatgacctttctac

SEQ ID NO: 6767230 - DNA, 84 bp, Homo sapiens
aatgtcatgggaatttattcatatttcaaagcaaattcagaggaaatatgtagaatagcttccttttttccaaagggtgacatt

SEQ ID NO: 6767231 - DNA, 66 bp, Homo sapiens
gcattgaaatggcaaaaagagaataaagttcaatcatcactatttctttccttgctgatttcatgc

SEQ ID NO: 6767232 - DNA, 130 bp, Homo sapiens
catgtagttatattaaagaatgttgaatcactgtgattactcattgaacttgttttcaaagacttcagagagtccagtatgcagtttcattccccattctcacactttttttttgttaatggcactgcag

SEQ ID NO: 6767233 - DNA, 91 bp, Homo sapiens
atcccatcctaagggtctgctttctgggaactcttttggtctcaactgacattctctgaaagcagagcctaaagaatatgatatcagggat

SEQ ID NO: 6767234 - DNA, 68 bp, Homo sapiens
gggaggtgcttgcgatacacagccattctgtttttccttagtggaaggcactgctttgctgcgccccc

SEQ ID NO: 6767235 - DNA, 55 bp, Homo sapiens
attctaagtcttgttcacattctctcttcatagggaagcattgaatgcttagaat

SEQ ID NO: 6767236 - DNA, 129 bp, Homo sapiens
atttcttgtgcagactcagaaaatagcttacttatcacactgtgcctgtcagctgcattgtaggtgccagcctagtgcagtggtatgatgggtaaggccggttctgggtgatgtctgtgctgctgagat

SEQ ID NO: 6767237 - DNA, 75 bp, Homo sapiens
ctggacttgctgcctgccctgggtcatctgttctggcccatcagcgccgaggacaaggagcagcagcccacccag

SEQ ID NO: 6767238 - DNA, 62 bp, Homo sapiens
agctggcagtatgactggtgactggtgaatctaggatgatctcactcacatgcctggcagtt

SEQ ID NO: 6767239 - DNA, 109 bp, Homo sapiens
gcgttttgttcattgttggtgtcactgatataaatcctacaaagtatattttaatattcactaaacaaatgtaactggtagattttaaatcggagccagatataaatgc

SEQ ID NO: 6767240 - DNA, 89 bp, Homo sapiens
gattctactgctgcaaaacaaattaacccaatactgagttgctttgcttaaagcagcaagtatttgttactttgtagtttatttgggtc

SEQ ID NO: 6767241 - DNA, 91 bp, Homo sapiens
gtctggtgtggaagggcattgagaggctgcctgcctgacactgccttgcctgtcacgcgggtgtagctttctcaattcccatcctgccgac

SEQ ID NO: 6767242 - DNA, 59 bp, Homo sapiens
ctgctgcaattatctgggtgtgagaggataagtagtctggacttggatggtggcagtag

SEQ ID NO: 6767243 - DNA, 58 bp, Homo sapiens
atgtttcccagagcaaatctggcttcaccaactgcacagaaaatcttatgggaaacat

SEQ ID NO: 6767244 - DNA, 89 bp, Homo sapiens
ggttgagatgggcaaggaacaaatgctctgcttctcgtctgctctctgctcgtggagcagaacgttggttcctttttacatccacagcc

SEQ ID NO: 6767245 - DNA, 115 bp, Homo sapiens
atttcgcactccactaaagaaaaatcaaaatgcttctctttacaaagactgtgtattcaataccttaaacgaacttgaagtggagcttttgaaatttgtgtccgaagtgcagaat

SEQ ID NO: 6767246 - DNA, 57 bp, Homo sapiens
tgcacatgtgcacatatatgtgctggggtatgttgcagatgtatgggtacatgcgca

SEQ ID NO: 6767247 - DNA, 74 bp, Homo sapiens
tggtgttggtgagtttctgatcacaagactgttccgcggtcctcttgttgccggaaagatctcgaccaccacta

SEQ ID NO: 6767248 - DNA, 59 bp, Homo sapiens
tcggggctcttctgctcgctttttttcctcttcagaaattaaagcagaggagcatctga

SEQ ID NO: 6767249 - DNA, 59 bp, Homo sapiens
gctgccttcccggaatgtcatctccctctttcacctggagccttcattttggaaggtgc

SEQ ID NO: 6767250 - DNA, 70 bp, Homo sapiens
gaatgtccctgcagttgctgcctaaccagattgcagttctgctgggctgcagctactggagggaacattt

SEQ ID NO: 6767251 - DNA, 80 bp, Homo sapiens
ggtcaccacagggcaggggttcggctgatggctgctgggctcagtggcaggtcagagtccccctgtcctaacaggtggct

SEQ ID NO: 6767252 - DNA, 91 bp, Homo sapiens
ttcaaaggcaaagtatcttgtcactactgttatgcatttctcaaccaatgttcatgattggttttggcgaatgaagatacttgtcactgga

SEQ ID NO: 6767253 - DNA, 71 bp, Homo sapiens
ttttctaatttagttaccctccctgttaaatttagttttctagtgtaaaaatggggtactactttggaaag

SEQ ID NO: 6767254 - DNA, 58 bp, Homo sapiens
ggaaaggagtgtgaattttctttggcatgttaaatgctgtacatatacatttttttcc

SEQ ID NO: 6767255 - DNA, 59 bp, Homo sapiens
tctcatgtgtgtgtgtgtgtatatgtgtgggcacatgttcatgcatgcacaggtgcaga

SEQ ID NO: 6767256 - DNA, 79 bp, Homo sapiens
tttcaatatgttaatgttattgtgggtttgtcgattctttatattttagacctacatacggaaatatttacgggtgaaa

SEQ ID NO: 6767257 - DNA, 68 bp, Homo sapiens
gcccttctgctcttctgttcggtgacacacagtgttcctcccctgaagaggacgcagcagcaaggtgc

SEQ ID NO: 6767258 - DNA, 85 bp, Homo sapiens
tcattcctgacctacagtggccctcagcagttgccaagatttgtccccaaagctcagggctggtggtcaggtgggttagggatga

SEQ ID NO: 6767259 - DNA, 67 bp, Homo sapiens
cagaggagactgtgggtgtgaaattgtaggcaattacattttatcactgctacacaagtttctgctg

SEQ ID NO: 6767260 - DNA, 89 bp, Homo sapiens
ttgttgcccaggctggtctggaactcctggcttcaagtgatccttctgagtcaccaggatttcaggcataagccaatatggctcagcaa

SEQ ID NO: 6767261 - DNA, 76 bp, Homo sapiens
tggagaataattatttcttaatttgttacccctccagagtaacttaagggcttgcagaaatgagaaatattttcca

SEQ ID NO: 6767262 - DNA, 72 bp, Homo sapiens
gtccctgggggtttaggactcagaaaaaagacctagttcagtcatcccagtccaaacaaacttcccgagggc

SEQ ID NO: 6767263 - DNA, 59 bp, Homo sapiens
caggagctcaagaccaccctgggtcttcctatgttgcccaggctggtcttgaactcctg

SEQ ID NO: 6767264 - DNA, 84 bp, Homo sapiens
gatgggttggaggaaggataacctggatataaacagatgggttagaagactcatgatgttgcttcaggctttagcttccccatt

SEQ ID NO: 6767265 - DNA, 72 bp, Homo sapiens
cttcgcttgtttatagatcaatatttagaaactttctcagtttcagagaaaaagaatgatctcaagctgaag

SEQ ID NO: 6767266 - DNA, 80 bp, Homo sapiens
gatatcgctaacacttgtacttacagatgacctggactgattctatggcagtatttcagtacagagtttttgctgatgtc

SEQ ID NO: 6767267 - DNA, 56 bp, Homo sapiens
ggtgaggggctcctctgcccggccgcccccactgggaagtgaggagcccctctgcc

SEQ ID NO: 6767268 - DNA, 97 bp, Homo sapiens
gagacaggagaattgcttgaaccagggaggcggaggttgcagtgagccgagatcgtgccattgcactccagcctggggaacagagcaagactgtctc

SEQ ID NO: 6767269 - DNA, 57 bp, Homo sapiens
gtatatctcttacatacacacatatgcacacacacgtgtttgtttgtgagagagtac

SEQ ID NO: 6767270 - DNA, 62 bp, Homo sapiens
tttcaaagtgctgttcaaagtagcatctcatgatgtttgctgtctgaaagtaatctttggaa

SEQ ID NO: 6767271 - DNA, 129 bp, Homo sapiens
cctcctcctcctcctcctcctcctcctcttcgctccaagggcgcctccgttcccccagcccttgtgggtggacggtgcttttgtttctcccgagctgtaaggagtagggggtggatgctagtgtggagg

SEQ ID NO: 6767272 - DNA, 56 bp, Homo sapiens
tctcatgaaaggtctctcctgggaggtaacatttgggatgagacccatgcatgaga

SEQ ID NO: 6767273 - DNA, 129 bp, Homo sapiens
tatgtagtgactgtaaagctaaccatcagatttcaagtgtagattatggagtgtcttattatgtggaaataggcttctgtgagctcatacaagtatgtgtgatggttaggttcactatgaaatacctta

SEQ ID NO: 6767274 - DNA, 56 bp, Homo sapiens
gaggcacctgctcctacttctgcttagcgtgtgagcagtgtggtgaccagggtctc

SEQ ID NO: 6767275 - DNA, 86 bp, Homo sapiens
cattgaagcttcagagggtactcttgcatcagtaggtctaaacactacaaaatgccactttgcaagatattcagagccttttagtg

SEQ ID NO: 6767276 - DNA, 68 bp, Homo sapiens
gaggcctgtgaagggacggatgctgctgctcactcgtaacagcttgctgcaccttaatagctggtttt

SEQ ID NO: 6767277 - DNA, 77 bp, Homo sapiens
aatgcctttgctcatgtcaccaaagcacaagcagaaacattactgcttagtgtcttccaggacatggtaatagtatt

SEQ ID NO: 6767278 - DNA, 57 bp, Homo sapiens
ggcagtccaaagtggctctcaccaaaattatttgggtagtgtggtctctgggctggc

SEQ ID NO: 6767279 - DNA, 82 bp, Homo sapiens
agacctcctccttcctggctaggagagctgggctctgggcagcagatcccagggccgctcccacagtagaaggatggaggct

SEQ ID NO: 6767280 - DNA, 76 bp, Homo sapiens
tggatgatgggactgaggtattaagatggcttgaagctttgtttaggcaacacttgcattttttagtctcagtcca

SEQ ID NO: 6767281 - DNA, 85 bp, Homo sapiens
ggtctctcagcagttcagcttgggaaattgagcaaggaagtttccttcttcctaaatttcctaatctaaataatgctgagatgtc

SEQ ID NO: 6767282 - DNA, 77 bp, Homo sapiens
aagtcctttaaagctttcaatcagactgggaggaactggtctttcccagggctgcagatggaggctaactgggagtt

SEQ ID NO: 6767283 - DNA, 106 bp, Homo sapiens
ttctaataaacataacatgaatgaacctcaaaaacatgttgagttgaaagtagctagatacaaaggactatatatactatatgtttttattcatatgtttttagaa

SEQ ID NO: 6767284 - DNA, 59 bp, Homo sapiens
ctgtcccacaagcagtgtgcacagttaacgtttactcaacaccacagaattggggacag

SEQ ID NO: 6767285 - DNA, 58 bp, Homo sapiens
cccaatcagaacgctcgatcttcggctctcgtccaatgaacgcgcgtattggggaggg

SEQ ID NO: 6767286 - DNA, 60 bp, Homo sapiens
actgtactgtgtattgtagaatgtttagtagcatccctggccactacccactagtacagt

SEQ ID NO: 6767287 - DNA, 76 bp, Homo sapiens
gatccccttccaagtctggaaaatgcatgtttcattatttagaatgatttaaatgttatttctaggcctgaagatc

SEQ ID NO: 6767288 - DNA, 62 bp, Homo sapiens
tattgattgagcatcaattaagtgagtttctaaaatgtgagaaattagatgtttaatcaata

SEQ ID NO: 6767289 - DNA, 63 bp, Homo sapiens
agctgatgtatatggagtgtttactctgtcaggtgctattcagacacttcatttgcagcagct

SEQ ID NO: 6767290 - DNA, 70 bp, Homo sapiens
gtggaatgaatagatttgcattggaggtacacaacaatgccattggtgatgaagatattcacgtttctat

SEQ ID NO: 6767291 - DNA, 80 bp, Homo sapiens
gggagtgacacggaaaaggagacagagggggagtgtgccaagttctctctataaactttcttcatttctgtggctgaacc

SEQ ID NO: 6767292 - DNA, 74 bp, Homo sapiens
gcatcttgtcaccactggctgaaacaccagcaataaacatcagctgaacagccagcagggtgacgggtgggtgc

SEQ ID NO: 6767293 - DNA, 63 bp, Homo sapiens
cacttgttttgtgaattacagaaatggtaagtgcccacatttctgtgaattataaaatttgtg

SEQ ID NO: 6767294 - DNA, 78 bp, Homo sapiens
taagattagtagaggaaacagggctttcttgttcttttacctttgactagcttcgtttcttttctctgcatactctta

SEQ ID NO: 6767295 - DNA, 57 bp, Homo sapiens
cccttggccactgcgccagtgaactctgggagacaggattgagtacgtggtcaaggg

SEQ ID NO: 6767296 - DNA, 56 bp, Homo sapiens
tattctaaatgtggtagtcataagagccccagttctgaatctgtcattttaggata

SEQ ID NO: 6767297 - DNA, 60 bp, Homo sapiens
gctttacaagtggtgcagattagaatgtcaagtccaatgtgttttattcacttgtagagc

SEQ ID NO: 6767298 - DNA, 59 bp, Homo sapiens
tgctaggactcccttgttggagtctacatgtaggacacacaacagaggggtctggagta

SEQ ID NO: 6767299 - DNA, 63 bp, Homo sapiens
ctgtcgccgtcaccgttcctgggaagctctcctcgcggtgcccaggtgtggaggcggtggcag

SEQ ID NO: 6767300 - DNA, 55 bp, Homo sapiens
atagatcagcagcccctcatctgtggccggtgggagggagagttgcctggtctat

SEQ ID NO: 6767301 - DNA, 81 bp, Homo sapiens
ctggtaaaggggtgggcattagagcagtacctaacgtgtagcaaaacagatggactgctctgagcccttatcctttgccag

SEQ ID NO: 6767302 - DNA, 68 bp, Homo sapiens
ggtgactggcatggtgttgctgtgagaggtgcagcgtaacctcagaggtgaacatcagtgctgggacc

SEQ ID NO: 6767303 - DNA, 80 bp, Homo sapiens
tagacagcactgttccagatcaggacaccgtctgggtcttaactgatagaacgccttgatcttggagcgtgctccttctg

SEQ ID NO: 6767304 - DNA, 62 bp, Homo sapiens
cctctgagccttccttgttatgtttcatgtgggtggaatatatgaccaggaagttctgcagg

SEQ ID NO: 6767305 - DNA, 57 bp, Homo sapiens
gtttccagagtgagggcacttgctcctcagcacaggcaaagccctttcaatggaaat

SEQ ID NO: 6767306 - DNA, 78 bp, Homo sapiens
gttagaagtagtagtataaaattgatgatatcaacaagttgatagcttctcataatttatgctgcccactaatttggc

SEQ ID NO: 6767307 - DNA, 69 bp, Homo sapiens
tggatttgtgagggtcacagtgcaccacaccatccctccctgcaccgggtggccctgccgcagtgtcca

SEQ ID NO: 6767308 - DNA, 81 bp, Homo sapiens
ctgctgcgtctttattgattccttcaagcttcacatccatgttagatatatttgtaggtattaatgagacagagcatgcag

SEQ ID NO: 6767309 - DNA, 65 bp, Homo sapiens
gtggctctcaggaagttgtgttccttctaagtgctggaagatacaccggaacctgaggctgccac

SEQ ID NO: 6767310 - DNA, 83 bp, Homo sapiens
tccctggggacaggctggaagtttccttcctggtcaggtgacagcctggctccaggttgaactttgggccctatccacaggga

SEQ ID NO: 6767311 - DNA, 99 bp, Homo sapiens
gcaccaaattccttgcagcttcaagcaggttgacagagctgagactgaaataaaaacaccaacaggattaggcctgttcctgactgtggagtttggtgc

SEQ ID NO: 6767312 - DNA, 78 bp, Homo sapiens
agggaagtatttgaacaggctggccttgaagcagtggtagacactgttgaagtgccagcttgattgagtcatttacct

SEQ ID NO: 6767313 - DNA, 125 bp, Homo sapiens
tgtgtccactcagggttaaatggattaagggcggtgcaagatgtgctttgttaaacagatgcttgaaggcagcatgctcgttaagagtcatcaccactccctactcttaagtacccagggacaca

SEQ ID NO: 6767314 - DNA, 70 bp, Homo sapiens
atcgcttaagcctgggaggcagaggttgtagtgagccaagatcgtgccactacactccagcttgggcgat

SEQ ID NO: 6767315 - DNA, 84 bp, Homo sapiens
catctctgctatactcaggtgttgtctaaagcttcagactaatttattgaatggacatggacaactgcctcagcttcagacatg

SEQ ID NO: 6767316 - DNA, 60 bp, Homo sapiens
tccccacatctctgcatcaggctgtcttgcaaattcctgacttgttaggggatgagggga

SEQ ID NO: 6767317 - DNA, 80 bp, Homo sapiens
gtgcatttgcaccagatgaatgtttgatgctatgaaaaactttccatagcatcaaaactaatttgtgtagatttttgcat

SEQ ID NO: 6767318 - DNA, 77 bp, Homo sapiens
gttcaataaattattggtgaattgaatggctagggtaatctccttgctcttacattcttttactagcatatattaac

SEQ ID NO: 6767319 - DNA, 66 bp, Homo sapiens
tctccaactcaggagtttaaggctgcagttcattaggattgtgctattgcactccagggtaggtga

SEQ ID NO: 6767320 - DNA, 60 bp, Homo sapiens
ccactctgctgtgctccatgatcaaggtttcctcaattctgtggggcttggcaggtgtgg

SEQ ID NO: 6767321 - DNA, 64 bp, Homo sapiens
tggagtcccaggatatgtgctgttcagacattgttgaaacaagagacagattctgggaccacca

SEQ ID NO: 6767322 - DNA, 56 bp, Homo sapiens
ctagctgtggttagatagagtcctcattccagagggctggcagtaagcacacgcag

SEQ ID NO: 6767323 - DNA, 66 bp, Homo sapiens
catcctaatggccactgttgcttggaccagggatgggtgtctggtctgagcggggccattcagatg

SEQ ID NO: 6767324 - DNA, 59 bp, Homo sapiens
cctgtgacttggcaaacctccatgaggaaggctcaagggattggaagagcagtcacagg

SEQ ID NO: 6767325 - DNA, 58 bp, Homo sapiens
aatggtgtagtgaccaggaactccagaaatctggggatcagcaagccactgcaccatt

SEQ ID NO: 6767326 - DNA, 67 bp, Homo sapiens
ctctgactcctctgttgctaggcccagcagcacctcgtggctcccagggcagcgcagaagagtagag

SEQ ID NO: 6767327 - DNA, 57 bp, Homo sapiens
gtgcaggggttccaggctgtagtgcaccaggatctcacctgtgaatagccactgcac

SEQ ID NO: 6767328 - DNA, 62 bp, Homo sapiens
ggaggctggtttgtcctcctcataccccaccagacagggcagagcccctcaagccagcctcc

SEQ ID NO: 6767329 - DNA, 93 bp, Homo sapiens
ggaatcccctttgtaggtttcatagtttatactgatatttctgatgtcgtctcagagaattagtcacaattataggaactcagaaggcattcc

SEQ ID NO: 6767330 - DNA, 58 bp, Homo sapiens
ttttagcttggcaggctttccactaaagttaattttttggcttctgccaatgttaaga

SEQ ID NO: 6767331 - DNA, 81 bp, Homo sapiens
gtggctaggtcggggagagtggacagtcaatgtggagtttctctcccacatctcggtcccctctttgcttgacctggaaac

SEQ ID NO: 6767332 - DNA, 96 bp, Homo sapiens
cgtgaagagcctcttgtttctgcagctgaggtgaggctggaaaggagctaccactcacttattgctcatctcatgctcagccaagggtttgtcacg

SEQ ID NO: 6767333 - DNA, 72 bp, Homo sapiens
agctggctcatcagaaatacctgacaaatggatcattctcgcctactgttatggtgttctgatgggaagact

SEQ ID NO: 6767334 - DNA, 76 bp, Homo sapiens
agtataacagcagctgcctgaatttgctcacatcaaattgcagcaacttgtttcattctggttttgctgtcttact

SEQ ID NO: 6767335 - DNA, 59 bp, Homo sapiens
aataaggtgtgggtgctaatatatcacaaactataatatatttgcaactacatcttatt

SEQ ID NO: 6767336 - DNA, 77 bp, Homo sapiens
ggcagaagaagggctggagactgggtcttcaagttcatccttgaagcccaagcttcacagctatctcaatctgaacc

SEQ ID NO: 6767337 - DNA, 116 bp, Homo sapiens
cttggaagaacttaattgctcataaaattaatttatggatggctttatttgatgtttggaaacaggaatacaaatgaaccaactttgatgtttatgagtttccatggttagccaag

SEQ ID NO: 6767338 - DNA, 55 bp, Homo sapiens
gtgcagtccctcctcccaaggcacaaagagagtcttggaaagagtggatttgcat

SEQ ID NO: 6767339 - DNA, 65 bp, Homo sapiens
tgttttttgtatgagaagtgctttaccaatgcagttgtgtagtaatgcaaattatacaaagagca

SEQ ID NO: 6767340 - DNA, 59 bp, Homo sapiens
cttctggagctcaccaacttcctacttacatctggactggtggtggtggctctcagagg

SEQ ID NO: 6767341 - DNA, 84 bp, Homo sapiens
aagtgtccattactattgtttgctctgactatcttgcgcaaagatgccaagtaaggctggagcaaaggccttggtgatactctt

SEQ ID NO: 6767342 - DNA, 59 bp, Homo sapiens
gcatccgggctgtcggggctgggcgaaggtaggctcagcgtggctccgacgggccgtgc

SEQ ID NO: 6767343 - DNA, 64 bp, Homo sapiens
cagagctgtgataaatagatatggttttaagatgctaaatttgtgataatttgttacagcagtg

SEQ ID NO: 6767344 - DNA, 75 bp, Homo sapiens
gggaatattagtgtaggtagctaatattagtgtaggtaatattaggtaggaatattagtataggtagcttgtccc

SEQ ID NO: 6767345 - DNA, 55 bp, Homo sapiens
gttgtgattgtagctaaactaggtggcaacactcgttgaatagcaatagcacaac

SEQ ID NO: 6767346 - DNA, 80 bp, Homo sapiens
gtgctggtggaatcaaggtaaagaagtggagcaggagctaaactttccctctccctattgcctggagctgcctgaggcac

SEQ ID NO: 6767347 - DNA, 75 bp, Homo sapiens
gttttaaaaatagttgctttgtgtacacaagaatcaacaccagttgattcttaactccaaggcataaaatgaagc

SEQ ID NO: 6767348 - DNA, 82 bp, Homo sapiens
gcaggcaccatgtttctgaccaccctcttcatccgtactcacatacctgctagacagtggatcgggatgcactggtggctgc

SEQ ID NO: 6767349 - DNA, 62 bp, Homo sapiens
ggtgtgtgtttgtgaatgtgtgtgtgtatgtgactgaacaccatttataacatttaagagcc

SEQ ID NO: 6767350 - DNA, 68 bp, Homo sapiens
gtagcacaggtactgaaagcaaatcttgcaaatgattcaagcagggttaccatctacatttgtgttgc

SEQ ID NO: 6767351 - DNA, 56 bp, Homo sapiens
ttcagtatattactcttgtcaacgcttaaagattttgtcaggaggaatttgctgaa

SEQ ID NO: 6767352 - DNA, 72 bp, Homo sapiens
tgtctctaaatgttcctcgagctcctaattcagcctgatagaaggttagaggtgagaggaactttggagata

SEQ ID NO: 6767353 - DNA, 68 bp, Homo sapiens
tctttaatgcattgctcaacagaatacagataagttctcatatctgcttctgcattcaatgttggaga

SEQ ID NO: 6767354 - DNA, 57 bp, Homo sapiens
gagaggtccattcccctgtcagaccagtctccgtgcctgcagggctctgcttctctc

SEQ ID NO: 6767355 - DNA, 97 bp, Homo sapiens
gaaattttaagttattccatggtacttctgcaagttcactgtgttactccaggacaccttagcacacagcttggggaccagggatttatatcatttc

SEQ ID NO: 6767356 - DNA, 76 bp, Homo sapiens
ttcattgagctaggccctaagagattgtggagtggagaacttcaaggtggctaaatggggccctgggttgggtggg

SEQ ID NO: 6767357 - DNA, 60 bp, Homo sapiens
ggaaatactgcacaccctgtaagcctaattgggtcatacataacttgtacagtgatttcc

SEQ ID NO: 6767358 - DNA, 89 bp, Homo sapiens
gttaaagcacagattctgaggtcacactgcttgggtccaagtcctgctttactcctgcctagcaggtgacctatagtaagttatttaac

SEQ ID NO: 6767359 - DNA, 67 bp, Homo sapiens
tggtgcaaaagtaattgcaattttgtagctgaaaggaattgcaaaaaccacaattacttttgcacca

SEQ ID NO: 6767360 - DNA, 59 bp, Homo sapiens
aagagtggtgcaggtgtcactgcagatcctcgatttgttgacatccctgtacttttttt

SEQ ID NO: 6767361 - DNA, 128 bp, Homo sapiens
ctgttttgcatctcctgttacaggatgtgaccatttgacatatccttgctgacaattgaacaaaatgctctaatacggcaaagaatgagtgagtacataattctgatgaatctgatgaagtaaaacgg

SEQ ID NO: 6767362 - DNA, 72 bp, Homo sapiens
tagacttttagcattgtacatttgtgcttctataggtcactcattgaagcacattgtacatttgtgcttcta

SEQ ID NO: 6767363 - DNA, 72 bp, Homo sapiens
agagccaatttatcttactcgtgctcaggaatactattgtgtaactaagcaactaaagacaaaatatggtct

SEQ ID NO: 6767364 - DNA, 120 bp, Homo sapiens
catttatacctagtaaaattcctcttcttgcttttgctattgaaacttgtaatggcaaattgaagctactttaaaactatggcagaagtcaagatgagtttttactccacatggtaaatg

SEQ ID NO: 6767365 - DNA, 96 bp, Homo sapiens
taagatgagctcctgctaggtgggcactgggaggtggacagaaggtaggaccaagagcctgactgtgccactgccccaggcctcaggggctccttg

SEQ ID NO: 6767366 - DNA, 80 bp, Homo sapiens
tctacttctgtcaaagacagaaggaaatgggggtagctctacattcctatttgcctcaagtcttcactggcagagttaga

SEQ ID NO: 6767367 - DNA, 120 bp, Homo sapiens
agcatgaaattttgttttgagtcaaggtgtttcattagctgtgaaacagcagaagaggttttactatttctattttggactcatagaaggaaatgcaaatgaatcaaaatctattatgct

SEQ ID NO: 6767368 - DNA, 70 bp, Homo sapiens
cttcctgagcttccagttcctccaggatgcctccagtgcaaggccctggcaagagactgaagataggaag

SEQ ID NO: 6767369 - DNA, 56 bp, Homo sapiens
agcatttagtctttattgcagctcaaggaaattttctgctgtggttaggccatgct

SEQ ID NO: 6767370 - DNA, 80 bp, Homo sapiens
agcagcctagaaaagagacttctagatttgttgaatgaatgaatgcttggatatcaacacatcgaggtgctctggctgct

SEQ ID NO: 6767371 - DNA, 97 bp, Homo sapiens
agaatctcagtttctcttccagctaactcacatcccttccccttcctcggatctaagaagaaatgctgatgttggatgggtgggaacctgggtttct

SEQ ID NO: 6767372 - DNA, 78 bp, Homo sapiens
ttgctggcctgcaggaaggggacggagtggggcgccagggatgaggaggcggcgccatcccccctcctgcaggagcaa

SEQ ID NO: 6767373 - DNA, 68 bp, Homo sapiens
attacaacaagaaaagggtaaggacgtttacgtgagtatattcagtcttgctcatttgcttttgtaat

SEQ ID NO: 6767374 - DNA, 114 bp, Homo sapiens
gggtgggaggcaggttatcaatccaggatgttaggatatgaaacagtataagtatatgtatatgtatttgtattacatctattctaaagctgaaactctgcctactttacacct

SEQ ID NO: 6767375 - DNA, 63 bp, Homo sapiens
gggccactatttattaacaggattgctacttatggggcaattctgtgttaggatagatggtcc

SEQ ID NO: 6767376 - DNA, 128 bp, Homo sapiens
agggagcggggtgagacagggcctagaagcagaaaggcccccagtggatgatttggctgctagggggtgggcgcccctggggcctcatcccactgctctgcagaggccgttaaatcaccccactccct

SEQ ID NO: 6767377 - DNA, 55 bp, Homo sapiens
aattcgatgcttttcactttgtggcttggttccacaaagtgaattgcatcgagtt

SEQ ID NO: 6767378 - DNA, 59 bp, Homo sapiens
gcttccgggatctggagttcggtttttctaaatacacctcagcccggagactcggaggc

SEQ ID NO: 6767379 - DNA, 55 bp, Homo sapiens
tccagtactgaagctccttcaatgcctaagtgatactagctactcagtgctagga

SEQ ID NO: 6767380 - DNA, 98 bp, Homo sapiens
gtgattctcctacctcagcctcccgactagctgggattacaggcgccctgcgccacgtccagctaattttcgtatttttagtagaggtggggtttcac

SEQ ID NO: 6767381 - DNA, 110 bp, Homo sapiens
gtaaatatcatagccatcactacaaaaggttatacagtcaatatatatatatgcaatatatttattgcatttttgactgtacaaccttttgtagtgatggcgatatttat

SEQ ID NO: 6767382 - DNA, 89 bp, Homo sapiens
gtatccctggagaaggactgtgcaggtgaactgtttgcctttccacgtgaaggcaaagagaaactgacttcctgggttgacagggatgc

SEQ ID NO: 6767383 - DNA, 107 bp, Homo sapiens
gagtcattaaaaattaaaccattatgagtacattgggatcaaagaactatgaagtatttagtagaagtctgaaggattttgtactcaaattgtaaattttggtactc

SEQ ID NO: 6767384 - DNA, 96 bp, Homo sapiens
caattctatactaagtgcaagcaggacttagtttcaaacaacaccatttatcatgtaaaattaaggttattagcttgccttgtttttgtagttttg

SEQ ID NO: 6767385 - DNA, 59 bp, Homo sapiens
gtgtttgttggaaaaggtgtcctgcccatactgaggtgagaccctaatttagcaagtgt

SEQ ID NO: 6767386 - DNA, 77 bp, Homo sapiens
tgccttctccctggcttctgcacacggacgggtctcttttggagctgaaagtgtgtgaaagttattggagaatggta

SEQ ID NO: 6767387 - DNA, 86 bp, Homo sapiens
agcctatttacttgatctatacccatcatgatttaagtaatggaaaactgtttaaatgattttgggtgagcaagtttaaagtggtt

SEQ ID NO: 6767388 - DNA, 75 bp, Homo sapiens
ctctgctgggttgatggtgtatagaaaatgcaaacattacttattttttacagaatcattaatcatggtgcaggg

SEQ ID NO: 6767389 - DNA, 64 bp, Homo sapiens
gcgaaatggggccagggaggaccagacaacacgcaaaggcgcctttctgctctggcccttgtgc

SEQ ID NO: 6767390 - DNA, 60 bp, Homo sapiens
catctctctgtctcatcccctctgaccgcctcagccagggggagagaatggagctcggtg

SEQ ID NO: 6767391 - DNA, 67 bp, Homo sapiens
tgttatttaactttgtagcatgggaaagatagttcctgtcaagtcatgtccacaaaattgaattaca

SEQ ID NO: 6767392 - DNA, 59 bp, Homo sapiens
aacatcttcactgtgtaggtagatgatgttaatcatgaattttgtcatggtgagttgtt

SEQ ID NO: 6767393 - DNA, 79 bp, Homo sapiens
tctaatgaaaaggagaattaaaaaaggagagcttgctttgttaggagcttgcggtcagttttgaccttcttgaattgga

SEQ ID NO: 6767394 - DNA, 62 bp, Homo sapiens
gcagggagtgctggccttagacagcttttttgtattgctgaatcaaggccacactgccgtgc

SEQ ID NO: 6767395 - DNA, 97 bp, Homo sapiens
tggggacttcccctctgcccattttctcacccactttgagagtgaacctcctaaagtccaggtgggaattgttcaatatccagagggaggagcccca

SEQ ID NO: 6767396 - DNA, 92 bp, Homo sapiens
ggctggcgcggcctgtgctggcgggaatcgtagctaccatctgcttcttggcagctgccatcctgttcagcaccctggctgcctgctttgtc

SEQ ID NO: 6767397 - DNA, 76 bp, Homo sapiens
ttaccactttcaggtccagtcactggtctgcagtaaccattttgtgcaagacactgtcctgggcatgaaggggtga

SEQ ID NO: 6767398 - DNA, 85 bp, Homo sapiens
tgcctattggtttgggagcattttaaatggcagatgcttttgatccacctttcttctgtctctgagatgactcccacccactgca

SEQ ID NO: 6767399 - DNA, 73 bp, Homo sapiens
gaggatgtacgtgaaggtgggagacaggtgagctggcaggccctgcaccccctggccttgacgctgccccctc

SEQ ID NO: 6767400 - DNA, 65 bp, Homo sapiens
ctcttgtgcaggagtgacaataagaagtgtgcactgtgaaaattgacatcctgagtacataagag

SEQ ID NO: 6767401 - DNA, 68 bp, Homo sapiens
ggctcatttggaatgaaatatgcttacagtatttttcttagtactgtatagtatttattcttagagtc

SEQ ID NO: 6767402 - DNA, 67 bp, Homo sapiens
cctaggtacatccttcctaccactgccctccgccaccccacaaccaggctttcaggaatgtcctagg

SEQ ID NO: 6767403 - DNA, 81 bp, Homo sapiens
tgaattggcagaaatgttcagcgagggatgctagggaacttcctctctgtctccttattctgaattgtcatgcctattgca

SEQ ID NO: 6767404 - DNA, 129 bp, Homo sapiens
gctttaaattaaaacctgaaaataaattcccatcagttaagaagagctaggcatctccttgtgaattgtccatagctgttcacaagctgattgtctttcttttctgcagggatttcagggaaaataagc

SEQ ID NO: 6767405 - DNA, 75 bp, Homo sapiens
aacttgaaatcatggtggaagaaacagacagtgttagctcatgatttgatttggttctacctttggccttgagtt

SEQ ID NO: 6767406 - DNA, 74 bp, Homo sapiens
tctgatgtgtttaagaaagaagttcaaaactgctactcaaagtagtaaaattatttctttctgttacatccaga

SEQ ID NO: 6767407 - DNA, 72 bp, Homo sapiens
aggtaagagtgagtgagataaagtaggttcaaggtgcacttccacccctggctttctcatttacaggcacct

SEQ ID NO: 6767408 - DNA, 71 bp, Homo sapiens
gtcaccctggctggaggtgcagtggcgtgatctcagctcactgcagtcttgacctcccaggcccaggtgac

SEQ ID NO: 6767409 - DNA, 103 bp, Homo sapiens
ttgagacggagtctcgctctgttgcccaggctggagtgcagtggcgctatcttggctcactgcaagctccgcctcccgggttcacgccattctcctgcctcag

SEQ ID NO: 6767410 - DNA, 129 bp, Homo sapiens
ttgcatgaaactcttgagtgcatgccttcatgatggggaatgttaagggagggcaatttatataacatgtgctctttgaccaaattatcctgttaaataggcttgaaaagcgcttagaaccactgattg

SEQ ID NO: 6767411 - DNA, 87 bp, Homo sapiens
taaaacaatgcctcttggaagaagacttagttcaagacaacagtagccacaacttatcagagtttattgtcttccaggcttgtttta

SEQ ID NO: 6767412 - DNA, 81 bp, Homo sapiens
gggagacccactgtcacttgcaactgtgaggaacggcagagcagccccttgccccagctcagtgcagggacatggttttcc

SEQ ID NO: 6767413 - DNA, 56 bp, Homo sapiens
cattttacctagaagctgaaagtccagcattttccacctttagcttaggtaaggtg

SEQ ID NO: 6767414 - DNA, 58 bp, Homo sapiens
gactccatttctgtccctatggctttggctactccaagtgcatcagatcagtggagtc

SEQ ID NO: 6767415 - DNA, 58 bp, Homo sapiens
ctgagggagaaggaaggctgaagcaatagtgtttgcagttgttgccttccctgattag

SEQ ID NO: 6767416 - DNA, 90 bp, Homo sapiens
gacctacggcacatccagctgtgactctaatttgcacaaaggcaccatatgtgctagcagcagtccaactgaggtggcataatgaaggtc

SEQ ID NO: 6767417 - DNA, 97 bp, Homo sapiens
tggcatagatctgaaatttagagagccagttgtcatagttctaacatgccccttcatcatgtgactgcagcttctctttccaaattatctcctgcca

SEQ ID NO: 6767418 - DNA, 74 bp, Homo sapiens
gctgtaaacatgaattcagcatggcacttgatcatctttttaaatgcctctgaatcttcatatagtacattagc

SEQ ID NO: 6767419 - DNA, 68 bp, Homo sapiens
gaaatatttgttataggatcagtgtcactttatttaaatgtaagtgtatttgcctataaaaatgtttc

SEQ ID NO: 6767420 - DNA, 71 bp, Homo sapiens
attttggtccatctttgatgaaaacttatagctgaaaaaattgtaggttgcaaggaaggacatttcagaat

SEQ ID NO: 6767421 - DNA, 70 bp, Homo sapiens
tctaggtataatgaatgaggtggcagaaagtttttcggttaaaaggactaaaatccatttaatgcctgga

SEQ ID NO: 6767422 - DNA, 89 bp, Homo sapiens
aagaccacacatgtgggggattcatctcagagcgtaatgatctagtgtctcagatacatgtatgagagattcttttattgtgttttctt

SEQ ID NO: 6767423 - DNA, 101 bp, Homo sapiens
tagcagtagctgtgagaagatggggtccagcatgccctgtaggaagttcccaagcctcagggcaggacagtgtaggccctagttctggctgtgtgctgctg

SEQ ID NO: 6767424 - DNA, 130 bp, Homo sapiens
cccttcttcttcctgcttcctgcggcgtcgtcctgggccgagccccggctcccggctttcttctcgggagtgacgccccggcctcggcctcggccgcccgcgcgggttttgcgggccccggaagcggtgg

SEQ ID NO: 6767425 - DNA, 64 bp, Homo sapiens
gagacagacgctgcctggccctgctgccattaatatgtgtcccagccctgtccaatgtctgctc

SEQ ID NO: 6767426 - DNA, 55 bp, Homo sapiens
ttgagatggagtctcgcactgtcacccgggctggagtgcaatggctcgatctcgg

SEQ ID NO: 6767427 - DNA, 58 bp, Homo sapiens
ttctgcctgatgtagtcatacctcagatccctctaggcagagctgcattcatgtagaa

SEQ ID NO: 6767428 - DNA, 56 bp, Homo sapiens
tctttcttggaacggttcctcaaaaagattggagaactgtcatctttcaaggaaga

SEQ ID NO: 6767429 - DNA, 67 bp, Homo sapiens
tccagatcatgaagtttggttcttaacctgtagaagacagaaatatgatcagacttgcatttcagga

SEQ ID NO: 6767430 - DNA, 56 bp, Homo sapiens
agactcagagtagaaaataggttccaggcatggactttcattgttactcagagttt

SEQ ID NO: 6767431 - DNA, 62 bp, Homo sapiens
ggtttctggttcacagagcttgttcatggcctccctgaggctatcgactctgtgcaggctcc

SEQ ID NO: 6767432 - DNA, 68 bp, Homo sapiens
caggacatcactcgccgcctgtctcgaagtggtgagcgccaccacatcgggcggacactggggtcctg

SEQ ID NO: 6767433 - DNA, 60 bp, Homo sapiens
gtaaacaggaatgtggtcatggcctttattcctcaaccctgactataaattttctgttac

SEQ ID NO: 6767434 - DNA, 89 bp, Homo sapiens
aggggagaatatatgactgcaagactaaacaggccagtgaaggaagccatgaaataggttcttgctgtaccataccattatttttccct

SEQ ID NO: 6767435 - DNA, 95 bp, Homo sapiens
ggagagtaaaggtctaaagtgcttgtttatgcaatgtatgcagccaacaaaataagctgtaagctggcaaacaagcatcatttgtctttgcctct

SEQ ID NO: 6767436 - DNA, 58 bp, Homo sapiens
gtgcagaggctgagaaaccctcttctgtgggataaaggcaggagatcagtctgggcgc

SEQ ID NO: 6767437 - DNA, 130 bp, Homo sapiens
attgatataaagggctaatagcaaagccattggcatttctgttagactctcattgacttgcatttaatatactctgctgccagtgggagctgaagggccaatttgctttggtgcttttttgtgcattagt

SEQ ID NO: 6767438 - DNA, 75 bp, Homo sapiens
gtgttagtgctctcgttagatgtttctgttgatgttagatgtcagatgattccgttgacgagaagggctgaccac

SEQ ID NO: 6767439 - DNA, 63 bp, Homo sapiens
ttcatgacagggcaggcttactggttttaaataatctagtggcccgtcttgtttttagatgga

SEQ ID NO: 6767440 - DNA, 60 bp, Homo sapiens
ctgcctggaatgccagcttctcccagtgtgcaaattactagctcaatcattcctgggtag

SEQ ID NO: 6767441 - DNA, 55 bp, Homo sapiens
acaagtgtattgtgcttcacagcctaagtgtttctagggctcagagtacacgtgt

SEQ ID NO: 6767442 - DNA, 63 bp, Homo sapiens
ggcattaaggaatgtaggcaagaagtctgttctgatttttcaagtatgtattctttgtatgtc

SEQ ID NO: 6767443 - DNA, 61 bp, Homo sapiens
gttggccagagttttgacaattttgcatcatagcttgacttgatttcactctctgtccaat

SEQ ID NO: 6767444 - DNA, 56 bp, Homo sapiens
gctttgcacaacctttaagacaataataattctaaattgagtcttgtgtgtaaggc

SEQ ID NO: 6767445 - DNA, 73 bp, Homo sapiens
gctggtaaaataaagagtttagtttgggatttttgagatatcttggaacatccaggacagatattttgaaggc

SEQ ID NO: 6767446 - DNA, 93 bp, Homo sapiens
tccctgcccaaacactaaggtttgcccttttgagggctaatagtgccatctgtgtgcctagagggtggccgacaagtggttgtttggcaggga

SEQ ID NO: 6767447 - DNA, 56 bp, Homo sapiens
gcctctttgatgattaggcaattttttaaaaattggaaaatgaggcacagagaggt

SEQ ID NO: 6767448 - DNA, 57 bp, Homo sapiens
gaggcctttatgtacatctagtagaatgaacatctggaaggtatagaacaaggcctc

SEQ ID NO: 6767449 - DNA, 76 bp, Homo sapiens
gttctgtcactgaacctgaaccaatactcagattggcaaatctattagagaaatgatggttgggttctggcaagac

SEQ ID NO: 6767450 - DNA, 59 bp, Homo sapiens
gggagcagaagaatggagatgctgctcttaatcgcctgcaccagctgccttctgtgccc

SEQ ID NO: 6767451 - DNA, 95 bp, Homo sapiens
gtggcagtcagggcctcctgggtatagaagagccgctgggtcaaatacttccatcatgcttcattataccctagttaggagttgacttcttccac

SEQ ID NO: 6767452 - DNA, 71 bp, Homo sapiens
tattaggttggtgcaaaaagtaattgtggtttttgccattaaaagcaattattttttgcgccaacttaata

SEQ ID NO: 6767453 - DNA, 56 bp, Homo sapiens
agtagaaagttgcaggaggaatgaaaaataatacctaatgacctgcggcattctct

SEQ ID NO: 6767454 - DNA, 72 bp, Homo sapiens
caaagggaaaagccatgtgggccaaagtgtagtagaaagcaggcacaagctcccacgtgtcttctccctatg

SEQ ID NO: 6767455 - DNA, 79 bp, Homo sapiens
aggtgggggctcctgatggaatgttggcctgtctttcatccggcaaggtcacttcctgtctggataagccatcccacct

SEQ ID NO: 6767456 - DNA, 72 bp, Homo sapiens
ttcttactgcagcagcccatggacacctagagatggaaacagtgctgggtccttggctgtggctgtaatgga

SEQ ID NO: 6767457 - DNA, 58 bp, Homo sapiens
cagtgcctgtcttattcttacaagctgacctaacatgcaactggagaatcaggtattg

SEQ ID NO: 6767458 - DNA, 80 bp, Homo sapiens
gccctacccaccagcccccaggtgaggcttccagctgggacctgcccagacaggctgagcctgggcgtggtgggtggggt

SEQ ID NO: 6767459 - DNA, 55 bp, Homo sapiens
aactcactttgtggcttctgaagaagggacctttgtggactgtcatggagtagtt

SEQ ID NO: 6767460 - DNA, 70 bp, Homo sapiens
aggtaacatgtggtgctataagatggaaagaaaattgtatatttttaagtaaagcgatccacaattacct

SEQ ID NO: 6767461 - DNA, 87 bp, Homo sapiens
tgatagatcgatcaggaagcctgcactgagctggcacaactttatattttatgtcaggtccagaggctccttattactttgctatta

SEQ ID NO: 6767462 - DNA, 76 bp, Homo sapiens
gttctcttgtgctccacagagcatgcttatagggttcttctgtgttctgagtgcttagtgggtacgagctatgaac

SEQ ID NO: 6767463 - DNA, 109 bp, Homo sapiens
gcaggaggttccagcctcttctggccggctaccctcagacccctgctgagcttcaccatccttgggggacaggctaggctgaaggtggtggctggggctgtccacctgc

SEQ ID NO: 6767464 - DNA, 57 bp, Homo sapiens
ttgagcttagaactgtcctcgtaattagaaatctggttacttggattctaagcttag

SEQ ID NO: 6767465 - DNA, 62 bp, Homo sapiens
gtggatatttgacgaaacaacatgcatggacatctatgtaagaacaactgtcaaatgtctat

SEQ ID NO: 6767466 - DNA, 56 bp, Homo sapiens
ccctgcagggaggattctgaaggtgggatgatgcttcagagttgttctgagttggg

SEQ ID NO: 6767467 - DNA, 63 bp, Homo sapiens
ggggcagggctgccaggatggtggtgggcagagagagcccatacttttcacccagcccgcttc

SEQ ID NO: 6767468 - DNA, 57 bp, Homo sapiens
caggaatgtccttgtcatttcagttcagcgtgaaatgcttttacaggatattatctg

SEQ ID NO: 6767469 - DNA, 64 bp, Homo sapiens
tgtgagagcagaagacacatagaactcatatttatagtagagggttagattttcttgctccaca

SEQ ID NO: 6767470 - DNA, 80 bp, Homo sapiens
aatttctgactgacagagctcatcccagaggcgagaacatcctttctgtaactgccatgtagcctgtctccaaagaggtt

SEQ ID NO: 6767471 - DNA, 59 bp, Homo sapiens
gcatctgtgtgtattttatgaagccaaagactaccacttcataagtttgtcactgatgt

SEQ ID NO: 6767472 - DNA, 56 bp, Homo sapiens
cctgagggaacatgcacccaattgccctgttgggagagtgggccattccctcaagg

SEQ ID NO: 6767473 - DNA, 70 bp, Homo sapiens
tcctgagcacaagggagctttgagtcattccatcagcccaatggtgctcaaatcctaatgtgcatcagga

SEQ ID NO: 6767474 - DNA, 67 bp, Homo sapiens
gtgaaatggaactgctaataatagttgcttcataaggtgatagctattgttggtagttacccattac

SEQ ID NO: 6767475 - DNA, 56 bp, Homo sapiens
aagctgaagacacagctccagtttcatcctagactttggaaaatgctctttagttt

SEQ ID NO: 6767476 - DNA, 64 bp, Homo sapiens
gcacacatgcatgtgtgcatccatgtgtgtttgtgcatgtgtgtgtgcatgcgtgtttgtgtgt

SEQ ID NO: 6767477 - DNA, 67 bp, Homo sapiens
tctggatgaggttatgcatcatggtaatggaattatgccatgtccttctcattgcctcataccatgg

SEQ ID NO: 6767478 - DNA, 64 bp, Homo sapiens
gattcccagaggagttctgggatgtatgcctctgagatcatcttagaatcctggactgggactc

SEQ ID NO: 6767479 - DNA, 84 bp, Homo sapiens
atgtgtgtcaggttttgtggaagaagggaattatttatacttatattaaatagttaggaaagtccagggagcttggacaggcat

SEQ ID NO: 6767480 - DNA, 55 bp, Homo sapiens
acagggcttctataccaattcattgtaaataagagaagtgagagagaagctctgt

SEQ ID NO: 6767481 - DNA, 82 bp, Homo sapiens
gtgacctgcctatggagccacatggaaaaggcctgagaatggcctctaggaggtggccagtggctatcaaggaaagggacac

SEQ ID NO: 6767482 - DNA, 78 bp, Homo sapiens
ttgaggcccacagtggattgggtgatgcccacccccattggggagggcaaatccactttactcagtttactgattcaa

SEQ ID NO: 6767483 - DNA, 68 bp, Homo sapiens
cagaacattcttgccagtacattcttgggtgtaagatactattccctgtttgtttggctgatgttttg

SEQ ID NO: 6767484 - DNA, 64 bp, Homo sapiens
tagagtgagcaaagttctatgttctcaacaatgattgccaacatgtcttactttgctttctttg

SEQ ID NO: 6767485 - DNA, 83 bp, Homo sapiens
agtgtttgggggtgtccgctgccgctcagcgccctctggtccccacccaagaggggaagggccgcagccaccctctgggcact

SEQ ID NO: 6767486 - DNA, 79 bp, Homo sapiens
acgtaaaaacagcagcctagaatctggcacttagttgttcgtcactgaaatgtgttatctgggcctgctaacttgacgt

SEQ ID NO: 6767487 - DNA, 58 bp, Homo sapiens
ctccgttgatctggatatgggagtttcatggcccaggggctctctttcctcagtggag

SEQ ID NO: 6767488 - DNA, 66 bp, Homo sapiens
tatccttcttcttcaatggcacagtgctactctatgtggggcactgtactgtgaataaggaggata

SEQ ID NO: 6767489 - DNA, 76 bp, Homo sapiens
caggagatacaggaatcgcacagtcatgctgacttaaaatacacatgtaaacactcactgtgcccctggtgtcctg

SEQ ID NO: 6767490 - DNA, 60 bp, Homo sapiens
ttctcttttactgagtactacagctgtgaacaaagccaagtactttcttccgagagagaa

SEQ ID NO: 6767491 - DNA, 69 bp, Homo sapiens
ttcaatttaatttaagaacactgttgtgtactgtgtgaagtgcctcaggtaaaacttgagtttattgag

SEQ ID NO: 6767492 - DNA, 74 bp, Homo sapiens
tgtattgatatttatggtactatagaattcttggcacacagctgagagataaagtgctcataaaaatggattca

SEQ ID NO: 6767493 - DNA, 83 bp, Homo sapiens
ggttaataatagtggccagtgtctattggtttcctgccttttggctaaggacaaaccaatagacactggccactactgtaacc

SEQ ID NO: 6767494 - DNA, 60 bp, Homo sapiens
ttatatgtctattgcttgggttacatcagtagatttgagtagctgcaacagactgtatgg

SEQ ID NO: 6767495 - DNA, 127 bp, Homo sapiens
tttattggccacctactgtgcaccaggcagtgaacttggaactggggctactgggttacagcagtgaccaagacagaggtccctgttcttaaggagcaagtgagggcaacagaaaagagcaggtaaa

SEQ ID NO: 6767496 - DNA, 55 bp, Homo sapiens
ggagatattgcctgatgaagaaaaatggtcctgtctttatcaggaggtgttgtcc

SEQ ID NO: 6767497 - DNA, 68 bp, Homo sapiens
tgagccccccaggcagcccttctgacgcacacatgcgccatgtgctccaggccgcctggggctgctta

SEQ ID NO: 6767498 - DNA, 61 bp, Homo sapiens
tgtgtcctggggtggggatgggtgacaaacggtagcatcaggccagcaatccctgggcaca

SEQ ID NO: 6767499 - DNA, 63 bp, Homo sapiens
gattctgggaagttggcagccagctgcactaggagtgagttatgatgtcagctttccagaatt

SEQ ID NO: 6767500 - DNA, 66 bp, Homo sapiens
ctggaatctgagactatggagaaaaagtgacttttgtattttttctgtaaactggcctttctccag

SEQ ID NO: 6767501 - DNA, 55 bp, Homo sapiens
tcagcaagagactgttctctaagtccactgggtgtgctgggtgctgtctcactga

SEQ ID NO: 6767502 - DNA, 69 bp, Homo sapiens
ggctgtgtaatactccattgtatggatggaccatattttgtttatcctttcatctggtaatatatagct

SEQ ID NO: 6767503 - DNA, 67 bp, Homo sapiens
atactgagtacataaattgtgaagtcagaagacctgactccatccaatctgtgttctacaacagtgt

SEQ ID NO: 6767504 - DNA, 82 bp, Homo sapiens
tctactatgtctatctcttagcaatgttttttaacagaaagccaccatatatctctgtaattatgttgttagagtatgtaga

SEQ ID NO: 6767505 - DNA, 129 bp, Homo sapiens
ggtctgtaatttcatgtgggtaatggtttacatggatgtgcatatttatgaagtttagtgagctgtgccaataaaatctgtgcatattattttatgtaatctatacttcaacataaaagttataattcc

SEQ ID NO: 6767506 - DNA, 129 bp, Homo sapiens
ctcaggtgtattcattcattctgccaaccactgttgagcacctaccttgtccagtgcctccatggggcactaagaatacagacagggattaggtgtagaccttgtccttaggcaacatgtggatttgtg

SEQ ID NO: 6767507 - DNA, 78 bp, Homo sapiens
tcatttgtcagcaagtgatggaaatcagagctggccgtgttacgatttcctcctccaggtctccaacacttgcaatga

SEQ ID NO: 6767508 - DNA, 78 bp, Homo sapiens
caatatgatgaccttaaaattttaattctagggtggagagaattgtcttagttctcatgaattttaagtcatgatttg

SEQ ID NO: 6767509 - DNA, 62 bp, Homo sapiens
agttctgttcggtgccttttcttgtgtgttctggagctcacagggttctatcgaagagtgct

SEQ ID NO: 6767510 - DNA, 61 bp, Homo sapiens
gggccttctagttagccccaattcagttggaggtatgacgtgggacagctttaggaggcct

SEQ ID NO: 6767511 - DNA, 99 bp, Homo sapiens
ctgtactattatttctcatggagcaagaactcattttcacttttcttagtgcctaagactagttgaatggttttctgttgccatagtaacactactcag

SEQ ID NO: 6767512 - DNA, 107 bp, Homo sapiens
cagcttaaacaacaaaatggtgcgggctccctcatcatgagctggtatgtgttgtgatggtgtacacatcagaaccagctgggtgaggagtagccattagggggctg

SEQ ID NO: 6767513 - DNA, 68 bp, Homo sapiens
aaattagaaatactttcaaagctacctcacatactaatggtagagttgtttgagtatttaggtgattt

SEQ ID NO: 6767514 - DNA, 95 bp, Homo sapiens
tgtattgtttattcatacattcattgagctcttcctgtgtgccaggtttcaacctgggtaggtgctggggattcagtggagaataaaacagtgca

SEQ ID NO: 6767515 - DNA, 56 bp, Homo sapiens
acccatgggccagttggggtggtctgcatgtgaggcatcccaagcagctcatgggt

SEQ ID NO: 6767516 - DNA, 74 bp, Homo sapiens
catcgtgtgtggatttcaccagtttaacaatcaaaagatactatttatcagattgggagatacttcacattatg

SEQ ID NO: 6767517 - DNA, 73 bp, Homo sapiens
acccaccgcactattcaacgtttctcgaccctagtggagtacccggtcccctggagatgttgtgcaggagggt

SEQ ID NO: 6767518 - DNA, 105 bp, Homo sapiens
gcctcaggaggaaaaggggggcacggagcttgtcactggggggcagagggagaagcaagcccctgcccccagctctcaagctcaaaggccttcctgagctgaggc

SEQ ID NO: 6767519 - DNA, 96 bp, Homo sapiens
tcggggtcagctaggccctctgggcagcctcaggccagggtggggaaggatgctcccccctgctccccacaggctgcccgcaggccacctgcccga

SEQ ID NO: 6767520 - DNA, 76 bp, Homo sapiens
tcacttgaacccaggagctgaaggttgcagtgagctgagatcacaccactgcactccagcccgggcaacagagtgg

SEQ ID NO: 6767521 - DNA, 68 bp, Homo sapiens
cgccactgcccaccccgacgtctaccctggcggagaagctcctgggcgacggggcgggcgggcaggtg

SEQ ID NO: 6767522 - DNA, 60 bp, Homo sapiens
tttctctgtgtgatttggtgtgtgcgcagagtgggtacacagggcggaaagcatgagaag

SEQ ID NO: 6767523 - DNA, 65 bp, Homo sapiens
tgtacaatatatatgattttgagtactaatattacacagtgaattcagaattgtgtgtttgtata

SEQ ID NO: 6767524 - DNA, 74 bp, Homo sapiens
gaggtatatggagaattcgtaatactgcatgtgtaccaaagaacacctgtattgttataatttgtatgtaaatt

SEQ ID NO: 6767525 - DNA, 70 bp, Homo sapiens
ggcatgcatacgtagtgattttctaacaatgggtatcatgaaacagaatcactcatgtaggcagtttgcc

SEQ ID NO: 6767526 - DNA, 78 bp, Homo sapiens
gtgtctaagtgacattcttggagcagtcaaagaagtttccgtgaatttctcacatgtgctccagaattcacaaaccac

SEQ ID NO: 6767527 - DNA, 55 bp, Homo sapiens
cacagcttcccgtgcatggagagttcctgtttctggccatgcagagggatctgtg

SEQ ID NO: 6767528 - DNA, 66 bp, Homo sapiens
cagaaggtttacactggactgtagtgagaatagataaagtaataaggatccagtgtgaagtttttg

SEQ ID NO: 6767529 - DNA, 56 bp, Homo sapiens
tacagcttatccagcttgataggcagctagcctgaatcttggctagatgggctgta

SEQ ID NO: 6767530 - DNA, 91 bp, Homo sapiens
gggatgtgtttaaaatgtgggagacaggagctgtatggaaatcattattttcaaatgcggtcatggcttttaggttgtgaatttttgttcc

SEQ ID NO: 6767531 - DNA, 56 bp, Homo sapiens
agaagaaagattgaaggttccttttcagcatgaggtcattcttcctcctttctttt

SEQ ID NO: 6767532 - DNA, 56 bp, Homo sapiens
gaccttcttccaccaaaaacgtcctctatctagagaccacaggtggcagaaggatc

SEQ ID NO: 6767533 - DNA, 62 bp, Homo sapiens
gtgggagtaggaggggtctgagtttgaatccttttaatctagcaggctttcttttctctcac

SEQ ID NO: 6767534 - DNA, 57 bp, Homo sapiens
ggtagcatgcactgttgagcgccatccatccacatggctgcccaaccctgcatctcc

SEQ ID NO: 6767535 - DNA, 67 bp, Homo sapiens
ctcaaagtagatgcaaacttgtgtacatgacacagacacgtgtgcacacactctgcatatacttggg

SEQ ID NO: 6767536 - DNA, 59 bp, Homo sapiens
ggtctctggccttggagattgaagcgtttcacttgtgcatctcacagcccagagaagcc

SEQ ID NO: 6767537 - DNA, 68 bp, Homo sapiens
aaccagttaagctaattagttccagcatggctatgtccaagcagagagcagaattaagttttatggtt

SEQ ID NO: 6767538 - DNA, 61 bp, Homo sapiens
gttctccaggtcgagatggtgtagaaacacgaggatgggatgtcttgacagaaggggcaat

SEQ ID NO: 6767539 - DNA, 96 bp, Homo sapiens
gcactttgatatactcaatatgatcttaaaataatgttgtgaagaaggaagctcagaatgcttcaatattgtttcaagatcacagaggacaaatgc

SEQ ID NO: 6767540 - DNA, 71 bp, Homo sapiens
tttctcttttggtccattatatgctgtcatgggctctactcctgcagccccccagatggccgtatgagaag

SEQ ID NO: 6767541 - DNA, 66 bp, Homo sapiens
gcttatctccaggcacttggctgctactgaggacagagtccaagtgagtctggatagttttgtagc

SEQ ID NO: 6767542 - DNA, 75 bp, Homo sapiens
tgagactttgggtgatccagtccatggcagaacccaaatgagaactgcctggctgagaccttcccaaattctaca

SEQ ID NO: 6767543 - DNA, 96 bp, Homo sapiens
caccgttactagaagtggtgtgtggccgagcttgtgcagaatatcatatcaggacatacctgcaacagttagtctaggccagatcttttgactgtg

SEQ ID NO: 6767544 - DNA, 62 bp, Homo sapiens
atccctagagtgatatttctcacaagattgtccttcagtcttctgaataagaatcactggat

SEQ ID NO: 6767545 - DNA, 70 bp, Homo sapiens
ctgcattgttgagggcagaatgaaggtgggcaagggcaaggtcaggttcagactagtcccagtggtgtag

SEQ ID NO: 6767546 - DNA, 84 bp, Homo sapiens
tgtaggctttctccaaatattcatctacttctgcaatgaaacagaggttgttgctgggattagaaagtgtttgaaaggcctgca

SEQ ID NO: 6767547 - DNA, 66 bp, Homo sapiens
ctttgaagtgtatttttgtactaacatttgaatgtgtgtctgatgttctgagaaattacttcaaag

SEQ ID NO: 6767548 - DNA, 62 bp, Homo sapiens
tggacccagaggtgctctttggaagtggaaggctcttctccgctaagttctctgcaggttca

SEQ ID NO: 6767549 - DNA, 64 bp, Homo sapiens
tctatctcccttattcctggcccagtaatttataatactgacaacagtgagtaagaggaataga

SEQ ID NO: 6767550 - DNA, 85 bp, Homo sapiens
caagacccattggttgttagaggttctgtaataaactaagacatgtatgatactattgaatcattgtcaatcaagcatggtcttg

SEQ ID NO: 6767551 - DNA, 111 bp, Homo sapiens
gcctatatttttcttcttgaccacaggatattatgagagaccttgctaagtgccttgctgaagtcccaagctaatagccagttttcttcctgtggagtcaagaagaagggc

SEQ ID NO: 6767552 - DNA, 101 bp, Homo sapiens
cttggttgagtatttatggtattgcacttacacaaccctgaaaaatcttttaatcttcccagtttgacaaagtttagtaataatcgtttgtactcaaagag

SEQ ID NO: 6767553 - DNA, 57 bp, Homo sapiens
tgcctgccaggtgcttcttcattatcccttccatgcaatgagcaactttagcaggcg

SEQ ID NO: 6767554 - DNA, 63 bp, Homo sapiens
gggcagggaacaggagctggtgtgggggagccctcaggtcctccagctgtatcctgcctgtcc

SEQ ID NO: 6767555 - DNA, 73 bp, Homo sapiens
gcaacgctctggcggggcagaaagttgtcttttgctcccacaaaagcaaacacttttcctggtcaggcgatgc

SEQ ID NO: 6767556 - DNA, 67 bp, Homo sapiens
ttggggttcacaacacccggctgtccccagacttgtgtccagggaagatagtgttgagggccctcaa

SEQ ID NO: 6767557 - DNA, 61 bp, Homo sapiens
ctcagtactttgatcattttggcctattgaggtccaaacaggtcaaaatattaacttaggg

SEQ ID NO: 6767558 - DNA, 75 bp, Homo sapiens
agagaaaagagatccattttccatgagaggtctcaatacttcaaaagccctactagaaatgtatctcttgattct

SEQ ID NO: 6767559 - DNA, 59 bp, Homo sapiens
tccttcagggctgaccacaggcgatcacaaagactttgcctggcaggcctcatgagggg

SEQ ID NO: 6767560 - DNA, 83 bp, Homo sapiens
tcttggagaaagttgttcagttgacttggagaggaatgcgtgggaatgcagttccaagaatcactgacacagctctcctggga

SEQ ID NO: 6767561 - DNA, 56 bp, Homo sapiens
ggagctcaggagttgattattttcccaaagcaggaaagtccaatacctaaggctcc

SEQ ID NO: 6767562 - DNA, 57 bp, Homo sapiens
gacacttttgacccttacctggacatcgccctggatatccaggcagctcagagtgtc

SEQ ID NO: 6767563 - DNA, 64 bp, Homo sapiens
ccctcaggatgcttggatcacctttatagcacactcctaaaaggtcttctcaaacatcccaggg

SEQ ID NO: 6767564 - DNA, 57 bp, Homo sapiens
ctgtgcatgtgttctctggtaatgacagccaccgtcttcacagggatgcaggcatag

SEQ ID NO: 6767565 - DNA, 80 bp, Homo sapiens
gggcatgtgtagggagacacttgctttagagggcccctgggttgtgggctcctccctgcgattgctctgccttacagctc

SEQ ID NO: 6767566 - DNA, 60 bp, Homo sapiens
gcccagccaacaggaagcccagcctttcagaaagagcctggcaaggccctgttgactagc

SEQ ID NO: 6767567 - DNA, 104 bp, Homo sapiens
cggggctgctaatatgattgtgctgcctggaaatgcaaaagccatgagtcggttaaacatcaaggtgaagttatttccagcggatcgattgcagcatctccccg

SEQ ID NO: 6767568 - DNA, 61 bp, Homo sapiens
ccacactacctaataatttgatattcagcacctgctgtcatacagattttgggttgggtgg

SEQ ID NO: 6767569 - DNA, 74 bp, Homo sapiens
ttcattgcaaactcctgggttccggagattctgctttaataggtagggttgaggcccaggaatttgcacatgag

SEQ ID NO: 6767570 - DNA, 129 bp, Homo sapiens
gcaaagcaaacagtatttgattggtcatagtggagcagtagccttatttggatcatttcagtggaaagtccctagttagaggttagttgacagtttctgcttggttaagcttaaattttgttttactgt

SEQ ID NO: 6767571 - DNA, 70 bp, Homo sapiens
cagcagcctactcctgcttcttccctgaggatggagtttcctacagaaccaggctaggtgtgggcagctg

SEQ ID NO: 6767572 - DNA, 130 bp, Homo sapiens
ggatcgggggaccctgggggctcaggatctagcaaggggcggcaggagtaaaggaggaaggaatgacaggtgcaaataccttcccaccaaagcccttgttgccctctggctcctccccagagttgtcccc

SEQ ID NO: 6767573 - DNA, 62 bp, Homo sapiens
ggagcgagatcctgctgtcctggagaagtgcagagttagaacagctgtggccacttgcatcc

SEQ ID NO: 6767574 - DNA, 91 bp, Homo sapiens
gctgctcaggcttcaagaagctgcctctggtccctccttcttcccagatatcaagtagttggagagggatggggctggggggcctggtagc

SEQ ID NO: 6767575 - DNA, 79 bp, Homo sapiens
catgaaatctattatgttcccttaagagaacagttttcaatgagaaattgctgcatttgtaaggaacatattgaccatg

SEQ ID NO: 6767576 - DNA, 63 bp, Homo sapiens
gcagatcttctgaactggagtatctgggaagagagctcccaaatattcttttttagtaagtgc

SEQ ID NO: 6767577 - DNA, 73 bp, Homo sapiens
cagagatagtaagtgatggtgctgaatttgaatccaggcagtctggctccagagcccatcctatactctcctg

SEQ ID NO: 6767578 - DNA, 128 bp, Homo sapiens
tcattaaaatgggaacagcagtttatgcagtttgaagaagattctagagtaactggatgattagtatcagaagtattgggtctgagagtctttcttcaagtgatgaacattgctgttaatatcaatga

SEQ ID NO: 6767579 - DNA, 55 bp, Homo sapiens
gggaggtggctgcggcgcgtgctcattggctggtgtatggcttgcagccaccctt

SEQ ID NO: 6767580 - DNA, 59 bp, Homo sapiens
tcatgctgacattgtggctgatgtactggaggcgtttagcagcttcaatgtcagcttga

SEQ ID NO: 6767581 - DNA, 55 bp, Homo sapiens
actaaaactagcccctcctcccagccctacctggggaggggttgcatgtttgagt

SEQ ID NO: 6767582 - DNA, 65 bp, Homo sapiens
gaagcctcaacatctctgcgtctgcaactaattatttataatgacctcaaagatgatggggtttc

SEQ ID NO: 6767583 - DNA, 55 bp, Homo sapiens
gggtgctatgtgctaggcactgaattcatagtttaattctggcataatagctctc

SEQ ID NO: 6767584 - DNA, 130 bp, Homo sapiens
agccttagaagcacctgtagagcttggagatggaagggggtgctacttccagagtttctgactttagtaggtctgggatgaggacctgagaatctgtatttcctacaagtttctaggtgatgatgataat

SEQ ID NO: 6767585 - DNA, 69 bp, Homo sapiens
gagattgctctgtcaaagcctgtggatagtttggagataatttgcttcaaacaggtttcagagcatctt

SEQ ID NO: 6767586 - DNA, 60 bp, Homo sapiens
tttattaagtgcctacttgtgagttatgaactgatggctcttatacaggcatttaataaa

SEQ ID NO: 6767587 - DNA, 56 bp, Homo sapiens
tgtcaggcaagcgggtgccctgcttgatccccccggcttggccccggagcctgaca

SEQ ID NO: 6767588 - DNA, 58 bp, Homo sapiens
ggctctggagacactcccagcggttcctccccaaggctgtgtcccttgtcccagagcc

SEQ ID NO: 6767589 - DNA, 63 bp, Homo sapiens
tccagcagggctcattctagtacaattaaataacggttgtgcaaacactggggtctgtctggg

SEQ ID NO: 6767590 - DNA, 71 bp, Homo sapiens
aattatttaacaatcataggaccatttaggttatctactttatcatgaatgagttttggttgtttgtggtt

SEQ ID NO: 6767591 - DNA, 79 bp, Homo sapiens
tatgtttgtgtttatatgtgtatccatctgtctatttagaattttttaaatatgcaggggtgcacttggatcacacatg

SEQ ID NO: 6767592 - DNA, 65 bp, Homo sapiens
ggagaatgcagttgcattgcgtcagaatcaagtggactttggcagctaaggcagctcgctgctcc

SEQ ID NO: 6767593 - DNA, 68 bp, Homo sapiens
ctgagtactttgatgctgttgtatgtgtgagaccatctcataagcaaataatgcatcaagggttttgg

SEQ ID NO: 6767594 - DNA, 69 bp, Homo sapiens
aagtcaggagatgtaaccttagctgtgctggttaaaagccagctttgagagttgcattttacctccctt

SEQ ID NO: 6767595 - DNA, 64 bp, Homo sapiens
gaaatagtgctgtcttgggtagaaagaggtccccaaaggacaatcttaaaacccaaatagtttc

SEQ ID NO: 6767596 - DNA, 55 bp, Homo sapiens
gctttcctggctgtcactcgggttgaagcttgctttgctctacagtgagggcagc

SEQ ID NO: 6767597 - DNA, 96 bp, Homo sapiens
ccacacagccttcacttaatgagaaatgggtctgctgaagacgtgtcctttgtgtgccacctcccagagacatcatttctccgggggagctgtggg

SEQ ID NO: 6767598 - DNA, 75 bp, Homo sapiens
tgggttatatttctcatatggtgatcagttatatttgaacaataactagaaatcatttagaagtattgaaaccta

SEQ ID NO: 6767599 - DNA, 63 bp, Homo sapiens
gacacaggaactcaagctcgcttgcttgtaaagtgaataaaattgtgttcttatgcaagtgtc

SEQ ID NO: 6767600 - DNA, 72 bp, Homo sapiens
gcttttgtgcctttgcttttacaagtttggaagggcctcattgtaccctgtgattgagctaggtatttaagc

SEQ ID NO: 6767601 - DNA, 129 bp, Homo sapiens
atttctcatttcatagttacatagtgtattcagttcttaaatgactgataagaggaagtcacagtgcacttctaagagctgctgtcatcatttgaatgctgtaggacctttggctgaaatgaaaagact

SEQ ID NO: 6767602 - DNA, 91 bp, Homo sapiens
aaaactagaggccagaggttgggtctgaggtgagaaaaatgatagggacaacactgcacgactctccctagactgcttggtgtttgatttt

SEQ ID NO: 6767603 - DNA, 88 bp, Homo sapiens
agacagacaggaagagggcccaggagcaggagctggacagagcagagctgctcctgtcctgaggctccaggcccattcctttctgtct

SEQ ID NO: 6767604 - DNA, 85 bp, Homo sapiens
tgtaggtttatagtcactttcacatgttgggatcagtaaatgtaaaatcacagatttgtcagtggaagtgattcaaacagctaca

SEQ ID NO: 6767605 - DNA, 99 bp, Homo sapiens
gggtgaggaaattgaagcttagagcgcttaagtcaattacctatgatcatacagctgtggcttaagcgcaactctgtctccaattctgaattcttaccc

SEQ ID NO: 6767606 - DNA, 97 bp, Homo sapiens
ggtcccatgtttcatgtaaaagattattttcctgtttagtcttaggtgatattgggtgagtatatggaagataatcttgaactagagggaagggact

SEQ ID NO: 6767607 - DNA, 61 bp, Homo sapiens
cagcagtggccatctgtgtggtcccagttcccaactcagctgttttcacaccggcctgttg

SEQ ID NO: 6767608 - DNA, 86 bp, Homo sapiens
cccttgcaggttttttcctaaggctcattttaaaatgttacatcttgagttcatcctgggtaagaggagaaccttttaggcagggg

SEQ ID NO: 6767609 - DNA, 61 bp, Homo sapiens
cttccttggccatatctgaagaggttattaaaggatatgcccttcttggtggctcagatgg

SEQ ID NO: 6767610 - DNA, 82 bp, Homo sapiens
cctttgtcttttcttcccaagcagtttcagagtcttggatatgacttgagctgcctcagttgggttgagctgaagacacggg

SEQ ID NO: 6767611 - DNA, 74 bp, Homo sapiens
gacatagaacagaaacagatgcacagttccatagacccagatgatttctgtagctttctgatttttctctggtc

SEQ ID NO: 6767612 - DNA, 76 bp, Homo sapiens
tgaggacatgagatttgggaggggccaggggaagaatgatatagtttagctctgtccccacccaaatctcatctta

SEQ ID NO: 6767613 - DNA, 67 bp, Homo sapiens
ccatcctaacagcaagggtgggggtctatcataccctacttgcatgattaatttggtgaagggatgg

SEQ ID NO: 6767614 - DNA, 78 bp, Homo sapiens
aggctgcgctcctgccactctgggtgggcctggcagcctaggcagcctaggcagcctggggtgcgctagaggcaggct

SEQ ID NO: 6767615 - DNA, 62 bp, Homo sapiens
ccaaggctgggaaacatgcaggcctcagctccacccccatgctgagccctcttccagcctgg

SEQ ID NO: 6767616 - DNA, 69 bp, Homo sapiens
ttttccatttagcactgtctagccaagagacaccactatttacaagttcttagacagctgaaaggaaaa

SEQ ID NO: 6767617 - DNA, 74 bp, Homo sapiens
gcagcgctccgcagagggagccgcgggctgcttggtcggcctgccccgccggcccctcatgttggagccgaggc

SEQ ID NO: 6767618 - DNA, 71 bp, Homo sapiens
atgccatcacactgcctcgcctgtgctattaccaatggaggtgctgagcatcatgaggcacttggtggcat

SEQ ID NO: 6767619 - DNA, 61 bp, Homo sapiens
gccaggatttggctcttgggtttctcgtccattctggggagcactgagaggcaggtagggc

SEQ ID NO: 6767620 - DNA, 58 bp, Homo sapiens
cctcaacagtggcatagtaagtgtcagggctagccactcactgtgcaaatgttgatgg

SEQ ID NO: 6767621 - DNA, 69 bp, Homo sapiens
gttgccagggtgctctgtggcgtcgcattctcattggtgggcgacggcgaggatcacccccgaggcagc

SEQ ID NO: 6767622 - DNA, 69 bp, Homo sapiens
ccaggtctgcgggcggcaggcagatagcctggccaggccctcacatgcccaccgccagcaccagcctgg

SEQ ID NO: 6767623 - DNA, 82 bp, Homo sapiens
ggcttgtatttgtgtacaggatgactgtacttattttggtaaatagatactcgtacattgtgtacacatgtgcttttgagcc

SEQ ID NO: 6767624 - DNA, 71 bp, Homo sapiens
agcagcagcctctgggcacgcaggaagagccatatggccagctccatccagctgcaaggggcacagctgtt

SEQ ID NO: 6767625 - DNA, 72 bp, Homo sapiens
ttcttcattcatcagttcatgtctagctgcttcatgtcagaacgctagaactctgtacgatgccttgcagaa

SEQ ID NO: 6767626 - DNA, 116 bp, Homo sapiens
aggccccacttaatgttcttgtcagtctttgtctagagagcaaatattaatggcaaatactctttatctgttatatgttttttctaaagtcacatgaatagcaaataggaaggcct

SEQ ID NO: 6767627 - DNA, 84 bp, Homo sapiens
gtttattgggagtggtttgcacagatgggatacagcaaaaggctttgggactgttctcgtctgtgctgtgtgctcctggtcaac

SEQ ID NO: 6767628 - DNA, 77 bp, Homo sapiens
ggaggtaatccagtagaaagcaacgtggcatcatgatggaatcggaggtggtgtttgttttgtgttgggatttttcc

SEQ ID NO: 6767629 - DNA, 61 bp, Homo sapiens
gaacaaagtgtacttccatactgtttgcctgaaggcctcagtcatgggagttactttggtc

SEQ ID NO: 6767630 - DNA, 63 bp, Homo sapiens
tgtgcctggcatgtagaagttacttaagataaaagctctagagtaatgaagatttgttgcaca

SEQ ID NO: 6767631 - DNA, 89 bp, Homo sapiens
cagggtcctggctataattctcctgttcaataaatagaaaaatcttttttacagacaacttaataggggatttagtagtgagggctttg

SEQ ID NO: 6767632 - DNA, 55 bp, Homo sapiens
agacatagacaaagtcattgtcatacagcgttctgtggcatgaatgtttatgtct

SEQ ID NO: 6767633 - DNA, 58 bp, Homo sapiens
agaatgcagaagcaccaggattcaagactagaatatctgacctcgtttgctgtgttct

SEQ ID NO: 6767634 - DNA, 55 bp, Homo sapiens
agttagtatgcagttggccagaataactctttttccccgctgcctgcaactgact

SEQ ID NO: 6767635 - DNA, 59 bp, Homo sapiens
ggcgcagggatttcaaggggcctttgcggaggcggtaatgaggtcaccgtcactgcgcc

SEQ ID NO: 6767636 - DNA, 104 bp, Homo sapiens
ttgcttttaaaaatgcctgtacagagttctgagtgtactggtcactatttttcttaagctgagaggatttttgtagtacttagcaattttgtataacatagcaa

SEQ ID NO: 6767637 - DNA, 73 bp, Homo sapiens
agaggggccgagggggggttatggagatggggactaagattttcctgcattccactcttctctggacttatct

SEQ ID NO: 6767638 - DNA, 73 bp, Homo sapiens
gcatggtggtgcctaagacactgactccaattttccagtgagaacaggaaggctttaagcaccaaagccatgc

SEQ ID NO: 6767639 - DNA, 94 bp, Homo sapiens
tcccccaaagatattcacaccctaatcccttaaacctgtgaatatattactttatgaggtaagagggacttagcagatgtggattttgaggtga

SEQ ID NO: 6767640 - DNA, 55 bp, Homo sapiens
gcaatgagcacccagagggcagtggcgacgatgttctgagtcaggtgctccttgt

SEQ ID NO: 6767641 - DNA, 64 bp, Homo sapiens
cagatgaactctatcctgtggctttaagtaggaaactctccttatattcagatggggttctctg

SEQ ID NO: 6767642 - DNA, 77 bp, Homo sapiens
tcttcagcatctttctcttctggagttgtagcttgttctttgtgtcaccactcaagcaggtggggaaggtttggagg

SEQ ID NO: 6767643 - DNA, 77 bp, Homo sapiens
tctgatttctgcacccttctgggttggaacaagcccttttgcttcctttttccctcccagggtgctggtaggtcaga

SEQ ID NO: 6767644 - DNA, 65 bp, Homo sapiens
gacagagcggcttgcctggactattatagccactaattgatttccttgcctcctgtccttctgtc

SEQ ID NO: 6767645 - DNA, 56 bp, Homo sapiens
agtagcaatgtttgagaagcactgacatacagcaaggcttctcaaagggtgctcct

SEQ ID NO: 6767646 - DNA, 58 bp, Homo sapiens
ggggtaagaagatgaatccaggctgtcctgcaatggaatggatttattttcttgagct

SEQ ID NO: 6767647 - DNA, 76 bp, Homo sapiens
tgctaaggaagctacagtttacccatggttgcagaaagtaaatatgtgagtagatgtgcaatttatattcttagta

SEQ ID NO: 6767648 - DNA, 117 bp, Homo sapiens
gttcccttgcttgataccccactccaattttatctcaggaggttcctctgtcccaggatgttgggtagaagaagattcctgagtttagtttgatggttagcaccaacaaccaggaac

SEQ ID NO: 6767649 - DNA, 87 bp, Homo sapiens
gttgaacatgattctgaaagcaatggcacatgatggtacctttagatttctgaatatgatttgtcattgtttaaaaagtgtttcaac

SEQ ID NO: 6767650 - DNA, 62 bp, Homo sapiens
tggcatgcgcagggtttcatggcaccccttccagggagttagcgtgacaccctcgctcccca

SEQ ID NO: 6767651 - DNA, 72 bp, Homo sapiens
caggtcatcaaagtccgcctgctgccgtggcaggaggccacgctccactaggcgccgggtggctgtggcctg

SEQ ID NO: 6767652 - DNA, 122 bp, Homo sapiens
gtggatgatgtttttagcccctggggtgggatgtcacagacggctgtttttatgttgtaggggagccagtcaacaaagtagctgctgttcttattttgaatgttgaacatttgttcatccac

SEQ ID NO: 6767653 - DNA, 125 bp, Homo sapiens
ttcctttcctttgttatctctgtggcatcttttgacctacacctggtaattctctgtgatgaaaatgtgcagaagaaaacagctgtgtgcagatagacaatagggaaaaggcacaggaagaggaa

SEQ ID NO: 6767654 - DNA, 65 bp, Homo sapiens
ggaaggatgagtggtcagaatcttcaggagtactgttttcctggtgaatgactttttatttcccc

SEQ ID NO: 6767655 - DNA, 56 bp, Homo sapiens
gccagaccagctgtgattccagcctcctttgggtgatcccagcccttggctctggt

SEQ ID NO: 6767656 - DNA, 80 bp, Homo sapiens
tgttggcatagatttctttaggtttatcctgttggagcatctttcagcttcttgaatctgcaggtttatgtatcttaaca

SEQ ID NO: 6767657 - DNA, 84 bp, Homo sapiens
tttccaacagaatctgccttcagtgtcctctctagtagacacaatcagtagtgctgtagaggatttgaccactgctgttgggga

SEQ ID NO: 6767658 - DNA, 60 bp, Homo sapiens
attcattgtctgcatatatgaggaagtaaatggctttccttatatcttcagagaagcagt

SEQ ID NO: 6767659 - DNA, 61 bp, Homo sapiens
cattagctaactacactcaatgttcccgacatatggggtaagtgtaggtcattagctgttg

SEQ ID NO: 6767660 - DNA, 68 bp, Homo sapiens
tagtgagaagaagttgctttccggcgggcagggggggcaccctctccaaaaatggcagcttttcatta

SEQ ID NO: 6767661 - DNA, 73 bp, Homo sapiens
ggaggatcccagctcacttacttggtatgaccaccacttggttccccttcccaaaagcgagtctgttgttccc

SEQ ID NO: 6767662 - DNA, 63 bp, Homo sapiens
tttggtctcattcactcatgggcacccttctgtttcgtggttgcctgttggatgaggtccaga

SEQ ID NO: 6767663 - DNA, 79 bp, Homo sapiens
cctctgtgtcctccccttggctcttggccctctcacctgtggaagtggccatgcaggtcagaggtgggggacccagggg

SEQ ID NO: 6767664 - DNA, 77 bp, Homo sapiens
cagagctggagagatagtcattctagagcctggccctagtggtgccttttcagaactgtctgtccttttcagaactg

SEQ ID NO: 6767665 - DNA, 56 bp, Homo sapiens
taggctcagaaggcactgaaaagaatttcctggactgatcgtgcctaccaagccta

SEQ ID NO: 6767666 - DNA, 60 bp, Homo sapiens
gagagagagggaggtgggccttgagatttttgtctcaaggtcctaattgtcctttttgtc

SEQ ID NO: 6767667 - DNA, 59 bp, Homo sapiens
tgccagtggcctgtgtggtggcctctattctcaggctccaggcaagagaggctctggca

SEQ ID NO: 6767668 - DNA, 78 bp, Homo sapiens
ttaagtaacagaaacttattttatcacagttcagttctggaagtgaaaagtctaagattaaggttctggaaaacttgg

SEQ ID NO: 6767669 - DNA, 62 bp, Homo sapiens
tatctggctcctacacttgaagaggcaatattcctccactctaattatcctagggccaggta

SEQ ID NO: 6767670 - DNA, 62 bp, Homo sapiens
gaaaccctgtgagattggattccccattttacagatggggaaactgcaactcagagaggttc

SEQ ID NO: 6767671 - DNA, 73 bp, Homo sapiens
gtgctaggggctctaggatggctccagcctgctgtcaattgctgggctgttttctgcctcagggcctttgcac

SEQ ID NO: 6767672 - DNA, 62 bp, Homo sapiens
ggtccttgcttcggtccagtacagtgacatttctttcatgtttgggctgactgccaagggcc

SEQ ID NO: 6767673 - DNA, 62 bp, Homo sapiens
tgaaatattgcttactaatcatcttcagaggaactttgtgagctatgagtaagcaagtttca

SEQ ID NO: 6767674 - DNA, 68 bp, Homo sapiens
actggcttcccaaaactttagttgggggtactcttgcatttctgaagctctggcgttggggaggtagt

SEQ ID NO: 6767675 - DNA, 63 bp, Homo sapiens
cacctgcccgtttgcttcagagacattccaggggcttcacttctctaggcaggcaggctcgtg

SEQ ID NO: 6767676 - DNA, 86 bp, Homo sapiens
gtattcggttggtgcaaaggtaattgtggtttctgccattgaaagtaaaggcaagaacctcaattacctttgcagcgacctaatac

SEQ ID NO: 6767677 - DNA, 70 bp, Homo sapiens
gctaatttccgattctcataggtgtttctgaaaatacagagactgtgccacacatgggagtgggaagagt

SEQ ID NO: 6767678 - DNA, 67 bp, Homo sapiens
gaagaagtaggtgctaatttcatctggaaacttgatcgataaattagtgttattagcaagcttcttt

SEQ ID NO: 6767679 - DNA, 73 bp, Homo sapiens
tggagcccagtaggcaaagctgcagaccgggacttccgtctttgagcatgtacgctctgcttgttgggctcta

SEQ ID NO: 6767680 - DNA, 60 bp, Homo sapiens
tttctgtggattttccattcaaagatcttaatcagtctctggaggaataaagcacagaag

SEQ ID NO: 6767681 - DNA, 130 bp, Homo sapiens
agggtgaggcaaacgaggtgcctggggtcagcgttgaagggcgtactcactctcaggttccggcatgtggtcccctgagagtgagtgcctccttaaattttgtgccctaggtgcctcctagcttcacact

SEQ ID NO: 6767682 - DNA, 129 bp, Homo sapiens
agttaaatgttctgcttaaggctacttattgattggaaggcagggtatagtcttggggagccctgagctcctagaatgcacctctgctgtcacaagctatagccatgtggtctgtgaatattatgtcct

SEQ ID NO: 6767683 - DNA, 129 bp, Homo sapiens
caggttgtttctcagagaccatttaaagtctgtgctatagagtaggcatggctccagttccagaaggaagacttgggtcaagtagctcacaggcaaatgacttaaatgcttcttataagatactacctg

SEQ ID NO: 6767684 - DNA, 62 bp, Homo sapiens
gaggccagaatgagctgaatgccatcctttggcctccacagctcagttcagctcctggtgtc

SEQ ID NO: 6767685 - DNA, 80 bp, Homo sapiens
tgcagatgaatattgaaactgcaacctggggtatcgaagcttccatttgttgtgtattaatattgctatttatttctgca

SEQ ID NO: 6767686 - DNA, 70 bp, Homo sapiens
cttggtcatttcttgtcctgttgtgtcccatatataaccgacagacaaaatcaggaagaggtgatctaag

SEQ ID NO: 6767687 - DNA, 69 bp, Homo sapiens
agagcctgcagctgtgaagaaaagctctcagaattctcaaagacaagagcacatagtctgagaggtttt

SEQ ID NO: 6767688 - DNA, 68 bp, Homo sapiens
gcccaggcattttcaactttagtttcctattagaatcacccaggcactgaagtgtactaatgcagggc

SEQ ID NO: 6767689 - DNA, 58 bp, Homo sapiens
tctaactttttcaagagatgctcattctgccagtgatcccagatctgagagggttaga

SEQ ID NO: 6767690 - DNA, 64 bp, Homo sapiens
gtctgaagagttaattatgaggtgccctttactgaagagcaattattatgtgacttttacagat

SEQ ID NO: 6767691 - DNA, 105 bp, Homo sapiens
ctgtccaaagctcctggttcagcgaatgatggaagtgaatgtctccctgaggaattctacctggagtcactttctcttccagtgagaccctgagttttgagatgg

SEQ ID NO: 6767692 - DNA, 89 bp, Homo sapiens
ggcaggattaaggtgaggggagtaaagccatgttacacagatacaaaaaacattcagtaatcgcaatggttccctcacctcacctggcc

SEQ ID NO: 6767693 - DNA, 58 bp, Homo sapiens
tctttcctgatgaaaagtcttctgacttctgcctagtctaagaaaggcatcaggatga

SEQ ID NO: 6767694 - DNA, 89 bp, Homo sapiens
ctcacctttattttgttttcgtcatttctggagtgggtcaattacttaaccctgaatagagatgtgatatagcagagtcttagggtggg

SEQ ID NO: 6767695 - DNA, 77 bp, Homo sapiens
gtgtttactgccccaagctttatccgccatgtaggattacttttcctactaggaaacgtaaaacttctagtaagcat

SEQ ID NO: 6767696 - DNA, 109 bp, Homo sapiens
ctgcagcctcagggcaaacctggccttaacctgctcagccccagctcaccctgggcaggccaggggtgttggcattgaggggcagtcagagtctgccaggatggtgcag

SEQ ID NO: 6767697 - DNA, 82 bp, Homo sapiens
atctgtcagattttttatgacctaaaactattctatggcatacagtaatggtttataatctaggtgtgaagccctgctagat

SEQ ID NO: 6767698 - DNA, 93 bp, Homo sapiens
gcaaaatgtaaggaggcactcaagctcagctttacgcaagggcagggccagcagttgcaggaaactgagtgtgagcccctccttacattttgt

SEQ ID NO: 6767699 - DNA, 62 bp, Homo sapiens
cagaccactcaaaattagtgtctttgacagattttttaaagtagcacatcttgtgtggtttg

SEQ ID NO: 6767700 - DNA, 60 bp, Homo sapiens
gaggttaggctccttcgaaagcaatcatatggttaattgcattagtgtgaacctagcctt

SEQ ID NO: 6767701 - DNA, 64 bp, Homo sapiens
tgagagtaaaggggcttcatctaatcagtatgtttaaatatgatactcccttttagttctctca

SEQ ID NO: 6767702 - DNA, 76 bp, Homo sapiens
gaggctgccctggccatccaggttgactgtgactgacacaggcttgcactagggtggcagtggtggaggtggcctt

SEQ ID NO: 6767703 - DNA, 56 bp, Homo sapiens
gcaatttggggaggttcagactcttggagcgagaggctgcatgtcccctaaactgt

SEQ ID NO: 6767704 - DNA, 56 bp, Homo sapiens
aattctgtaaagcttgtcatgctagatgtctttgtgtgacatagctttgcagagtt

SEQ ID NO: 6767705 - DNA, 66 bp, Homo sapiens
gggagggaaggaccttatgaatagtccatttagcctaagaaatggcagatttagttcttctcttcc

SEQ ID NO: 6767706 - DNA, 90 bp, Homo sapiens
gtcaagatcggaatgtctgggttgggagtgatagactgaccaggttacctgctcatcacatgtgtagtcatcccaatctctgttcatggc

SEQ ID NO: 6767707 - DNA, 56 bp, Homo sapiens
agtcgcctgtgccatatctctgagcggtcctctggtcctgtgatggtacaggggct

SEQ ID NO: 6767708 - DNA, 85 bp, Homo sapiens
cagagatgaaaagccctggccagacaccagttcattagtggaaataaaagcttcctaaattgcagggaactggctgggctttctg

SEQ ID NO: 6767709 - DNA, 61 bp, Homo sapiens
ggcatcctggccacagtacctgactgagcaatagaggacaggttaagaagtggaggatgct

SEQ ID NO: 6767710 - DNA, 66 bp, Homo sapiens
tcagtgatacctctggcactcaagacttatccctggtgagtccagtgtttaccaggggtgaattga

SEQ ID NO: 6767711 - DNA, 95 bp, Homo sapiens
agatagtgtgttggtggaaaagtaattgtggttcttgccattaggtaatggtaaaaactgtaataactcttgccccaatctaatagatacagtct

SEQ ID NO: 6767712 - DNA, 59 bp, Homo sapiens
gcagaggggccattgttctgcccgctccccaaaggaccgtcagccgagtggccactcgc

SEQ ID NO: 6767713 - DNA, 55 bp, Homo sapiens
ttctagaggctgggaagtcctaggtcaagggactgcatctgcttggcctctgggg

SEQ ID NO: 6767714 - DNA, 84 bp, Homo sapiens
aataattctacgtggttttattcacccactcagcaagtggtacataatcaattgtcaagaaaaatggatgaagcgtaaattatt

SEQ ID NO: 6767715 - DNA, 64 bp, Homo sapiens
tgtaccagatgtctaaagccatctcagctaagcatgtgaaaaactgagcttcagatatcgtgca

SEQ ID NO: 6767716 - DNA, 68 bp, Homo sapiens
cagggagtgcaccctcactctgcaggtgagtcagaatcaggcaccacagagccagggttgcacccctg

SEQ ID NO: 6767717 - DNA, 63 bp, Homo sapiens
tgttctgtgcccattttaaaatggaaatttggtattttatcattttgatggggctcagagtca

SEQ ID NO: 6767718 - DNA, 100 bp, Homo sapiens
ctcaatttattttggtcattttggcatcttgggtttgcaccattaactgttgtctaaaacatgaaaaatctaatgtcatgatggctaaggataagctgag

SEQ ID NO: 6767719 - DNA, 59 bp, Homo sapiens
ggtgaggttggtatcactggccgcaagtcctctcagtggccctgtgcatgctgcttccc

SEQ ID NO: 6767720 - DNA, 86 bp, Homo sapiens
gtgagtctgaagccctgaacacataaggctttcctgtattttacatatggagaaaaccattgtgttatatatgggatcagactgac

SEQ ID NO: 6767721 - DNA, 82 bp, Homo sapiens
gggcaggtgtgagggctcccaatcagcctctggctcctggtttgtctgggctgtgctgtcttgggagccttaaccaccgcct

SEQ ID NO: 6767722 - DNA, 127 bp, Homo sapiens
atgagccatatttacggtgaacggcggcaactccatgcccaggaacagggctcagacccgcactgagactttagcgggtttcttaaccttttctgtgccacggacccctttgccagtctggtgaagt

SEQ ID NO: 6767723 - DNA, 62 bp, Homo sapiens
agcctccatctcccatctgtgaggcatgataacactagtttcaacaggttgtggtgggggtt

SEQ ID NO: 6767724 - DNA, 81 bp, Homo sapiens
ccttcccatttcaatgctggttgttttatggtcacacataactacaaggctactcatacagctgcattcttaacaggaagg

SEQ ID NO: 6767725 - DNA, 118 bp, Homo sapiens
tgtgtttcatatgtctttcattcctttaagatagcatacatgttgttacttgttttgcacagaagaaactagggcttggcaatttgtatgtcggtaatgtcagataagtgatgtcaca

SEQ ID NO: 6767726 - DNA, 55 bp, Homo sapiens
gcccagtccgcacctcgccaccatcgaatgtgatgccctgctgggcggacagggc

SEQ ID NO: 6767727 - DNA, 59 bp, Homo sapiens
gagattgagtttcctactggtccagcagaaggggcccagagctgattaaacttaatctc

SEQ ID NO: 6767728 - DNA, 91 bp, Homo sapiens
gatacttagtttctcactgtagttcttggccaagtcactacttttctggagttccttgtgccatgaactgtatgaaggactgaatactatc

SEQ ID NO: 6767729 - DNA, 100 bp, Homo sapiens
taggtgtgttgtcaatatgctatgtatgtaaatgagttttagcattcttacagtttccctgcttctctttcattaaagtgtttttgataactagtttcta

SEQ ID NO: 6767730 - DNA, 64 bp, Homo sapiens
gaatatcagtatattgtatcagtgagtgatagagctacaaaactgattaacatgtgtgatattc

SEQ ID NO: 6767731 - DNA, 62 bp, Homo sapiens
gtagggatgaggccctcattccttgctgaccctcagctcctggaggtcgcctgcattcctgc

SEQ ID NO: 6767732 - DNA, 60 bp, Homo sapiens
tgtttggggctttttgtgaacttcctgtttctaaggaagaacctaagaaagtctcatgta

SEQ ID NO: 6767733 - DNA, 93 bp, Homo sapiens
aaattctactctaaattggtatgtattctgaaaactgattggaaagtaagataatcccccactttttgagtataactaattagactggtattt

SEQ ID NO: 6767734 - DNA, 79 bp, Homo sapiens
tttttattcttgtgtgtgtgtgtgtgtgtgtgtgcacgtgcgtgcgtgcatgcatgtatatgtgtataaacaataaaga

SEQ ID NO: 6767735 - DNA, 78 bp, Homo sapiens
ggagtacgtggcagtgaaaacgagtggatcaaaaccaaacactatgaggacacttgggagcattgcacatgtgcctcc

SEQ ID NO: 6767736 - DNA, 56 bp, Homo sapiens
tccctggacaacagacttcactgatacgagatagtggaaggaaagggtcccgggga

SEQ ID NO: 6767737 - DNA, 77 bp, Homo sapiens
cttgaatgtttggcagtctgggttggcagttagctagttggaggaggtgactgaaagctagctgtccagcacccaag

SEQ ID NO: 6767738 - DNA, 64 bp, Homo sapiens
accatgaacatgaagcagaagaatgaagatgatgtgctagtcagttctaagtgctttacatggt

SEQ ID NO: 6767739 - DNA, 77 bp, Homo sapiens
agaggaggcagggggactcctctgacacacctggggaggtctcgtcaatggcaggttccctctacaatgctttctct

SEQ ID NO: 6767740 - DNA, 57 bp, Homo sapiens
agcactctttcagagccagggctattttttaaaaagcatttggcactctgaagtgtt

SEQ ID NO: 6767741 - DNA, 62 bp, Homo sapiens
taactgtgtgaacgtgatcatttgtgtgcaaaccaacaaaccagacaggtttacatatgtta

SEQ ID NO: 6767742 - DNA, 63 bp, Homo sapiens
aatactcattagcactctaaggaagagatcctattgggtctcttctctgtgctgagagatatt

SEQ ID NO: 6767743 - DNA, 57 bp, Homo sapiens
ccaacccaaaatacagtggaactgagaaatagacacttcctttactgttggggttgg

SEQ ID NO: 6767744 - DNA, 57 bp, Homo sapiens
tgccactggaggcactttcttcccactcaccaatgaagaaactgactcctagaggca

SEQ ID NO: 6767745 - DNA, 57 bp, Homo sapiens
aagtgtttttggtttgtcatgcttctaaaggccgcatgtcatgggccaaaaatagtt

SEQ ID NO: 6767746 - DNA, 77 bp, Homo sapiens
caggaagctagattttgttgcttaacaaatagctcacaaatctctatgtcttaaagcagcaaaaatttatctttctg

SEQ ID NO: 6767747 - DNA, 84 bp, Homo sapiens
gaaggctgtgagaaggggcattgtgtctgggttcctccttaaagcagatctgaggaaaacctaagccagtagctcccacccttt

SEQ ID NO: 6767748 - DNA, 59 bp, Homo sapiens
agtcagtgtagaaagcccaggcattgtcccatagctggccctgtgtgtttgcactgatt

SEQ ID NO: 6767749 - DNA, 74 bp, Homo sapiens
ttcaagataagaggctgaaggagaaaaatacatttttttgtaaatgtcagtagtttctttgagtttttctagag

SEQ ID NO: 6767750 - DNA, 73 bp, Homo sapiens
actcagactcagaagcagcctcattctcttttctacttgtactggagattgataactttaatttgatctgagt

SEQ ID NO: 6767751 - DNA, 59 bp, Homo sapiens
ccaggaaagcttgttgaaaatgtagcttcatttcatcagtttcaactgagccagtctgg

SEQ ID NO: 6767752 - DNA, 71 bp, Homo sapiens
ctgagccctgaacaacagcaggaaaaaagagagcttaggtgttcttttcatgatgattgttgggggctgag

SEQ ID NO: 6767753 - DNA, 79 bp, Homo sapiens
ggtgtctgttgcctcctggttacctcagcagctccctagggttcacatggctagtttagccaggcccagcatggacacc

SEQ ID NO: 6767754 - DNA, 55 bp, Homo sapiens
cctttcctgtgctttctgttttatgatttgaatatgacagagtccagaggaaagg

SEQ ID NO: 6767755 - DNA, 112 bp, Homo sapiens
cagctggagccgctgggcaacagcccaatgggcctggagagagctggcttcccaccgggcctgggatcggacctgcagggctgtgctgggcctgtggcgtcagcggctgctg

SEQ ID NO: 6767756 - DNA, 75 bp, Homo sapiens
atgtattgggaaagccacaaattggagtgtataaaaactgaagtgttatattttattttagtggccttaatttat

SEQ ID NO: 6767757 - DNA, 118 bp, Homo sapiens
tttctattgatgtggggtggccaggactttaagtccagcactactgctgtagggagactcctaacaaggctatgagagctatggcatgaagtcctgagcttctacaagataatggaaa

SEQ ID NO: 6767758 - DNA, 61 bp, Homo sapiens
gcacagaaccctatctttcggaacagagtcacagaggtgcgacagaagcgggttttgctgc

SEQ ID NO: 6767759 - DNA, 79 bp, Homo sapiens
catttgatggagggacatagttagcttagagatacttgacaaggtatctccttcttatctgtttctaaactatcacctg

SEQ ID NO: 6767760 - DNA, 59 bp, Homo sapiens
ccctcagtgtgtttggggtgaggcagtgggttctgcctcccacgaccacacattggagg

SEQ ID NO: 6767761 - DNA, 71 bp, Homo sapiens
tttttaagaaatgcacacaactgctggagggagtccaacttccccagtgtggtggtgttgttttataaaaa

SEQ ID NO: 6767762 - DNA, 80 bp, Homo sapiens
gccttattttaaaaattaaattcctgggcttcaccccagacctcgtaaatcagaatttgaggtggagctcaggaaagggc

SEQ ID NO: 6767763 - DNA, 75 bp, Homo sapiens
gtgtaaaagctggtgctaactgcgactgcatgactttcatacaagacatcagaaggctttataccagtataacat

SEQ ID NO: 6767764 - DNA, 72 bp, Homo sapiens
tatatgttttgtgcttcattggtagagcagttgcaacagagattgtatggcctgcaaagcctaaaatatata

SEQ ID NO: 6767765 - DNA, 78 bp, Homo sapiens
atgaagggattttgatgctatctaatgaatgcttgcaatacattttatttagtatagtatataaaaattgcctttcat

SEQ ID NO: 6767766 - DNA, 98 bp, Homo sapiens
gaggcaggagaatcgcttgaacccgcaaggcagaggttgcagtgagccgagatcgtgccactgcactccagcctggtgacagagcgtgactctgtctc

SEQ ID NO: 6767767 - DNA, 64 bp, Homo sapiens
gtctactgcagtgtaaatggagaccatatggggaacttggactttcatgctacctggcagtgac

SEQ ID NO: 6767768 - DNA, 58 bp, Homo sapiens
gtaacatccagatatgtaacatttgtaacatccagatatgtaacaatctggatgttgc

SEQ ID NO: 6767769 - DNA, 85 bp, Homo sapiens
ggagtgaggcccagagaagtgaagtgacttgcccaaggtcatctagccagggggtaaagggttcattagctggggttcttactcc

SEQ ID NO: 6767770 - DNA, 73 bp, Homo sapiens
ctgagcctgcagtgagggaggtgagtccttttccctgcaggggtcaagagagaactcccttcgccaggcgcgg

SEQ ID NO: 6767771 - DNA, 109 bp, Homo sapiens
gtacttcgtagaaggatatagaaactgttaattgaaatgatgtgtttggatagcctatgagttactagtcacgtctttcagttacctctggctcctgttaatgaaatac

SEQ ID NO: 6767772 - DNA, 69 bp, Homo sapiens
cgcctgaatcatgttctgagcacacaagatgagaatgagagaatgtgatggccaggaaagaatcaggcg

SEQ ID NO: 6767773 - DNA, 62 bp, Homo sapiens
atggagacattacactaagtgatagaagccagacacaaaggccatttattgtatgattccat

SEQ ID NO: 6767774 - DNA, 65 bp, Homo sapiens
tgtgactatttcatgtctaatgtctatggagtatctacaatgcaccaggcatgatgtggagcaca

SEQ ID NO: 6767775 - DNA, 101 bp, Homo sapiens
tgaggcaggagaatcgcttgaacctgggaggcggaggttgtagtgagcagagatggtgccattgtactccagcctgggtgacagagtgagactccatctca

SEQ ID NO: 6767776 - DNA, 66 bp, Homo sapiens
gggaagtgtgcagagttctcttagaacacccagtcacatggtgtagagactgctcttacacttcct

SEQ ID NO: 6767777 - DNA, 108 bp, Homo sapiens
gtgcaagccaacttcagacctcatgtatatgtttgtggctctccttgtaataaagtgaaaataaaggaaggagctatgcataactgatcagagaagaagagatggcac

SEQ ID NO: 6767778 - DNA, 78 bp, Homo sapiens
tgtctcttcgtggcatttgggagatgcgtgggcggcctgccccccgaccgccgcccctgcccaccacatgctgggaca

SEQ ID NO: 6767779 - DNA, 93 bp, Homo sapiens
cttgctagtggacttgcaagtccataggcagttcataacatagcagcttgcttctatgttatgaactgcctatggagaagaccacatagcagg

SEQ ID NO: 6767780 - DNA, 59 bp, Homo sapiens
ggaggtaagaggccctgggccaaggtgcagtgaccctgcaggccagccctccaacctcc

SEQ ID NO: 6767781 - DNA, 70 bp, Homo sapiens
tccggtgcctggtttggggaatgttcatgggatatgttccaaaggacttacggacctatcaggtactgga

SEQ ID NO: 6767782 - DNA, 58 bp, Homo sapiens
tctgcccttggcatgtttgctctgcgtgtcccaaaatgccagctgagccaaggggaga

SEQ ID NO: 6767783 - DNA, 56 bp, Homo sapiens
aacatagaatggctccagagcttctactaaaaataagactcagagctatatatgtt

SEQ ID NO: 6767784 - DNA, 55 bp, Homo sapiens
caccctgacttctgacgatgtttctggaatacagttaattgtcagaagtcatgtg

SEQ ID NO: 6767785 - DNA, 63 bp, Homo sapiens
tccttcacctcaagcttttgaagtgaatgctgaactatgtcggagggaatggggaaaggagga

SEQ ID NO: 6767786 - DNA, 81 bp, Homo sapiens
tccccaggttgagctgacctgaatcattcggggtccagagaggacccaggagccgtgagaggttattccaaccagagggga

SEQ ID NO: 6767787 - DNA, 83 bp, Homo sapiens
cattagggaattttatcttcacttatatctttctttggttgcaaaattgaagagactaatcagggagaaactattatttgatg

SEQ ID NO: 6767788 - DNA, 68 bp, Homo sapiens
taaacgatgataaattgttctctgcttcactatcaacatccaagtagcagaacaatagtcaatgatta

SEQ ID NO: 6767789 - DNA, 55 bp, Homo sapiens
aggtggcccagctgacagatagcaccaagtgctagacatgtgaatgaggccacct

SEQ ID NO: 6767790 - DNA, 82 bp, Homo sapiens
tgtgaaatcaatgtcttctgtctcttccttccagagaaaaattataataattcttttaatcagggcagcaagacatttgaca

SEQ ID NO: 6767791 - DNA, 129 bp, Homo sapiens
ggtctgctccactcctctgttctgtgccgctcggttctgcctgtggcttctgtggcattcctctgcagtcttttctgccataggacccaggttgaacaccagaggtggaggccagaggcggggcacgct

SEQ ID NO: 6767792 - DNA, 69 bp, Homo sapiens
aggctgaagtgtagtggctcactgcagcctcaaccaccctgggctcaagtgatcctcctacctcagcct

SEQ ID NO: 6767793 - DNA, 75 bp, Homo sapiens
accctatcgatgatagtaattattgctgataatattaatggtagttttactaatgattattgtcattgtgagggt

SEQ ID NO: 6767794 - DNA, 129 bp, Homo sapiens
gtttctcttcacatctaaatttgacattggctagctcttatgattatatatgtatctcactttatgtgtgaaatatgcataatacaaagagtatttagtcatttaaaaaggagaagtctaggataaaac

SEQ ID NO: 6767795 - DNA, 92 bp, Homo sapiens
gtatgatgtacatttagagctcaatagaacaggacttctggaattttaacaacataatgagggtcttctttttggctttctgtacatcaagc

SEQ ID NO: 6767796 - DNA, 68 bp, Homo sapiens
gcctggtgggaggtgtttggatcatgggggttgatacctaatgaatggcttggcaccatctccttggt

SEQ ID NO: 6767797 - DNA, 63 bp, Homo sapiens
actgtactaatgcatttaactaacacagatatggagacactgtgttgatgccagagtatctgt

SEQ ID NO: 6767798 - DNA, 74 bp, Homo sapiens
ctgaccctgtggctctgtggcagaggcgccttctcacaacaccgccatgccttggccccagtgcctcagggcag

SEQ ID NO: 6767799 - DNA, 69 bp, Homo sapiens
ctcgactattgacttgggcattgagagagatgatatatacatctttggaaagtgaagtcaatgttcaag

SEQ ID NO: 6767800 - DNA, 83 bp, Homo sapiens
gcttaagagcttggattccatgaaaggggattttctctcacccttaacaaaagatttccattcatacaattttgttctaaagc

SEQ ID NO: 6767801 - DNA, 59 bp, Homo sapiens
caaatggggtgaaacaccaagacagttaaaagtatttgtctttatgacttgcccatttg

SEQ ID NO: 6767802 - DNA, 61 bp, Homo sapiens
tcagcacagtgaccagacccactagcatgtggacatagggcagtggggtggctgtgaatga

SEQ ID NO: 6767803 - DNA, 74 bp, Homo sapiens
cagatttcagctcatatattatctttgatctgctgctcttgccttccagaagtgatatattgagaaggattctg

SEQ ID NO: 6767804 - DNA, 60 bp, Homo sapiens
gggggtgtctcagttcgctctggaagcttactgccctctgcagagaactgagggacagcc

SEQ ID NO: 6767805 - DNA, 62 bp, Homo sapiens
ctgcatcagcttcacccagagttgtagaccttactgctgtcagcagctacttggagcagcag

SEQ ID NO: 6767806 - DNA, 58 bp, Homo sapiens
catgcattgtaatttttagtctgctgtgaaattagagacttgaggaagaacaatgttg

SEQ ID NO: 6767807 - DNA, 55 bp, Homo sapiens
ggggcctggcagctcaggtggctctgcaccttctgtccttgagctaagggacccc

SEQ ID NO: 6767808 - DNA, 58 bp, Homo sapiens
cttgattacctctgtaaagaccctattcctaaataaggtcacattctgaggaatcagg

SEQ ID NO: 6767809 - DNA, 58 bp, Homo sapiens
tcctggcctgtctggagtagctccttactagtctggccacagctcctgcaggtcagga

SEQ ID NO: 6767810 - DNA, 76 bp, Homo sapiens
gggtgcttctggccctcgtcagtttcactgtgatgcaaagctgtggaggtatctaatgagggtcccagaatgaccc

SEQ ID NO: 6767811 - DNA, 84 bp, Homo sapiens
ggttaaaagtgctttataacttagtttatggtaatattagcatataattttctatttgaattatgaagcactgtatgtagaacc

SEQ ID NO: 6767812 - DNA, 68 bp, Homo sapiens
gcttctcctgggagctgtggcagagcgctctctgctgctcaccccatgctccgcaggcctgcaggagc

SEQ ID NO: 6767813 - DNA, 70 bp, Homo sapiens
acgcaagtcttctcatttcacatgctttcacaaatgcagagtaagaagaaaagagatgggggaagtgtgt

SEQ ID NO: 6767814 - DNA, 68 bp, Homo sapiens
ggtaacttagctcatggctgtgaaaaaccagaccgctgaccagtcttagcctgtgggtcatagttgcc

SEQ ID NO: 6767815 - DNA, 71 bp, Homo sapiens
tgtttataccttggtataaccactctcctgttttggggaactaggtttctggttttgctccagtataaata

SEQ ID NO: 6767816 - DNA, 130 bp, Homo sapiens
gggtgaggcagaggcagccccagagggagcatgagggctggaagagtgggcagcagagtctctggtctggaagctgtcactctccggccttcccagggcctggctctgagcactcacaaccatgaagacc

SEQ ID NO: 6767817 - DNA, 76 bp, Homo sapiens
gccagccccttagtcagccaggtggggaggttttggagaagacttctgcaggtggtgactgaacttaaagttgagc

SEQ ID NO: 6767818 - DNA, 78 bp, Homo sapiens
agcagcaaatggctggatttgatccatgggctgtagtttcctgacccctggtataaaccattattttttgtgcatgct

SEQ ID NO: 6767819 - DNA, 72 bp, Homo sapiens
tggacaaggggtcactcacgcctggaatcccagcagtttgggaggccagggtgggtggatcgcttgagccca

SEQ ID NO: 6767820 - DNA, 65 bp, Homo sapiens
ccatttgccattggcaggcctcttgtattagtcccttataggaacaatggcatgctagcaaatgg

SEQ ID NO: 6767821 - DNA, 58 bp, Homo sapiens
tgttcacacagtctatacggatggcctgggactggctgccttttatggtgtctgaaca

SEQ ID NO: 6767822 - DNA, 95 bp, Homo sapiens
gctctagacctcagaccagtaaaattagtgggagtgtttaccctggtttaaacagatttttccccttttttgtggttgttttgggagttgagggc

SEQ ID NO: 6767823 - DNA, 70 bp, Homo sapiens
gtttcactaaaacatagccagtcagtgtatgttgaatacccactgggtgccatatgtttgctggtgaaac

SEQ ID NO: 6767824 - DNA, 89 bp, Homo sapiens
tctctgtcctggtttatactggccctgctgctttccacagcatccagatgccaggatgactatacaacagccgagaaagatgacagagg

SEQ ID NO: 6767825 - DNA, 92 bp, Homo sapiens
ctggtcacaggaattatgaaggatccaaagggtctctcttgacacttacagagcaagaccctgggttctctctccgctttcttgctcaccag

SEQ ID NO: 6767826 - DNA, 56 bp, Homo sapiens
gcactatagctgcagcacagagcaatgatagctaatatttgctgacagctgtgtgt

SEQ ID NO: 6767827 - DNA, 72 bp, Homo sapiens
ttcatttactgtaaactgtaacttccttacagcaaggtgcttagtattgggggatggagtttacagaatgaa

SEQ ID NO: 6767828 - DNA, 57 bp, Homo sapiens
gcttggcctcatccatttcagtttaacttttgtataaattgatggtatgggttaagc

SEQ ID NO: 6767829 - DNA, 73 bp, Homo sapiens
gtgaccgggttcttgttctaggatgtggagggagcagggactttgaaacaaactgggataggatcctgtttat

SEQ ID NO: 6767830 - DNA, 83 bp, Homo sapiens
ggtccatgtgatgtgcattcactttaggagcactgacaaatgtatttttttcagtctgtaaaggtgaggacagatcacagacc

SEQ ID NO: 6767831 - DNA, 67 bp, Homo sapiens
ttaaaattgcggtgaatatttccaaggacaaacaaaatgctgagggaatgaggtactgcaactttaa

SEQ ID NO: 6767832 - DNA, 55 bp, Homo sapiens
agggactgcctgccttcctcctaggcaaaggccacgaagagtcacaggcagccct

SEQ ID NO: 6767833 - DNA, 62 bp, Homo sapiens
cacagctgccctaactgtactcaactctctcttttttgtctacatcaaagtacgcagctgtg

SEQ ID NO: 6767834 - DNA, 65 bp, Homo sapiens
ctcacattccacttgtgccaacctttcccaaggaatgagttcctctacaagtgaaatgttcagag

SEQ ID NO: 6767835 - DNA, 105 bp, Homo sapiens
gccgcctttaataagtccttcatgtgtctaaatggttccttaatcaagaaccaacttgagttgagaatttcttagatcctgaattttggaatacagtcaaggggc

SEQ ID NO: 6767836 - DNA, 60 bp, Homo sapiens
tactcaccatatgactttactaacagtctgatcattgcagtgagggggtatgtgtgtgtg

SEQ ID NO: 6767837 - DNA, 83 bp, Homo sapiens
cctagtcttggttaaataacttttacaaattgtcatcatcatcatgattatcatgttgtaatgaggtattactctacgctagg

SEQ ID NO: 6767838 - DNA, 59 bp, Homo sapiens
ccagcttggagtaacaaatggtacaaccattttacaacctaattttactctccagctgg

SEQ ID NO: 6767839 - DNA, 83 bp, Homo sapiens
ggtgggcagggaatttgaactgcatgtatgttggataggtagcctctcggtggcttcatctgcagcactgcctcctgcccatc

SEQ ID NO: 6767840 - DNA, 71 bp, Homo sapiens
tgctttctatccattgccctgcatttctagtgggtgtctaaccttgattcctactcaggcaatgagaaaca

SEQ ID NO: 6767841 - DNA, 85 bp, Homo sapiens
tttcaggaggaaatgaacgtgcaaccatagagtgctcagaaaggtgtctggctctgtaagtgttgcaggtatggttccccaggaa

SEQ ID NO: 6767842 - DNA, 57 bp, Homo sapiens
gaggaagggactttattatctggaatatctccaaggaagaagagggtccctatcttc

SEQ ID NO: 6767843 - DNA, 55 bp, Homo sapiens
gcctccagcgcgatccactccggggcgcagcggcctccccggagcgctaggaggc

SEQ ID NO: 6767844 - DNA, 55 bp, Homo sapiens
gcctcctcacaatgtacccacgtacaggtggtgtcttcggcactgtgcagggggc

SEQ ID NO: 6767845 - DNA, 57 bp, Homo sapiens
aagtccagcatttgggtagattgatcacaagcaacaggtctaacccaaagttgactt

SEQ ID NO: 6767846 - DNA, 58 bp, Homo sapiens
attcttcacataagtgctgtactccaattggaacggaagccagtactatgagaaggat

SEQ ID NO: 6767847 - DNA, 76 bp, Homo sapiens
gcagaatgtgggctgagtgtggaactagtttggtaaaattttaaaatggaaattttgtactcattttacattttgc

SEQ ID NO: 6767848 - DNA, 59 bp, Homo sapiens
cttgtagtgtgctcttcatattgtcagaactggattggccctggaaggcttactgcagg

SEQ ID NO: 6767849 - DNA, 75 bp, Homo sapiens
ggttcagatagtttaggtaactgtcttgagttcctacagatagataataagtaacagatctacattgtctgaccc

SEQ ID NO: 6767850 - DNA, 93 bp, Homo sapiens
ggccaggctggtgttgaactcctgaccttgtgatccgcccgccttggcctcctaaagtgctaggattacaagcgtgagccaccacgcctggcc

SEQ ID NO: 6767851 - DNA, 76 bp, Homo sapiens
agggctttttgtttatgaactctatttaccctactaaaccacaggttgggtagtctaatctagagttaaacacctt

SEQ ID NO: 6767852 - DNA, 81 bp, Homo sapiens
aggtctggcctctttccccagctgtagaacaaaaggctgtctgcaggcttcagcctagagctggaggtgaggaaggaacct

SEQ ID NO: 6767853 - DNA, 72 bp, Homo sapiens
ggttgtgtaactggaaattcccaataagtaggtgttattacctttttataaaagttttccgttttggcaact

SEQ ID NO: 6767854 - DNA, 96 bp, Homo sapiens
actggaaattccttaaaaagacctgccatcacgataggagattgcctttatgataactctgggagtctatgattggcagcttttctttattccagt

SEQ ID NO: 6767855 - DNA, 76 bp, Homo sapiens
gcttggaattggcacagccacttctgctgcattcttttggctgaagcagttcacaaggctggcccagattcagggc

SEQ ID NO: 6767856 - DNA, 84 bp, Homo sapiens
ctccttagggctgggatgggaactgagaatcatttgagggcttaataagtgattttggaggccccagtccccaccctatgggag

SEQ ID NO: 6767857 - DNA, 68 bp, Homo sapiens
ttactacaagggccctaaaaggtagtgcctcctagactggagaagggacctttgagagcccctagtga

SEQ ID NO: 6767858 - DNA, 63 bp, Homo sapiens
actgttcctgttttcttgagcacgctgccagcagagaaggcctgagacaatggggttggcagt

SEQ ID NO: 6767859 - DNA, 103 bp, Homo sapiens
aagttcctatggcacctgtcccatattagcctccactgggacacctaacccactgggtagtttctagtttgagagttattttggatggtgcttctctgaactt

SEQ ID NO: 6767860 - DNA, 82 bp, Homo sapiens
tcgcttgatttgcctgtattgtgcccagaatctcagctgccatagccagagagggcccaccagtacagacattgacaggtga

SEQ ID NO: 6767861 - DNA, 83 bp, Homo sapiens
cctgagctaaccactgggcgggcagcctgctgtgggcttgtctgtgcccctcagcctggccaggcctgcccagggcggtgtgg

SEQ ID NO: 6767862 - DNA, 58 bp, Homo sapiens
ttgctatttcctgaaataagcactactcagctttggggagctgcttcaggcaatgtaa

SEQ ID NO: 6767863 - DNA, 58 bp, Homo sapiens
atgaagctaaaccctgcagccactgctcaggacctgctggctgcactgtggctttcat

SEQ ID NO: 6767864 - DNA, 74 bp, Homo sapiens
gccccctttgctggtgattaaatcctgaaggtacacgaagtatttcagtgaatgaatggctaacagaaaagggc

SEQ ID NO: 6767865 - DNA, 76 bp, Homo sapiens
ggtacaaaataaattagacagatttgtcttgttttatgagcaagatcctgtttttctatttcattttctttgtgct

SEQ ID NO: 6767866 - DNA, 89 bp, Homo sapiens
gggtaaacatttaaggaagagcttggtaataggctaaaaacaattttatcaaccctagcctgtaccattttccctagtcttttctaccc

SEQ ID NO: 6767867 - DNA, 67 bp, Homo sapiens
gatgaagagaatgggatgctcttagatattttatggcaaatgatctaagaatactcatatcttcttc

SEQ ID NO: 6767868 - DNA, 77 bp, Homo sapiens
gctttcagaagttacaggagaaagagatcacttcagacccagatgatcctaagatgtattttgagatagttgaaagt

SEQ ID NO: 6767869 - DNA, 89 bp, Homo sapiens
gtgggtccacaggggctgcgctgctggccgcctggctttaacacccttgctgcaggctagggagctgcagtccccagtgtcctgcccac

SEQ ID NO: 6767870 - DNA, 59 bp, Homo sapiens
agtggaaggctgggaaatgcggctggtccagggcttagcagtcatccagcctttccact

SEQ ID NO: 6767871 - DNA, 67 bp, Homo sapiens
gaaacaaatttggagagaaacaagtaggaggtgactggcctattgtttctctctaatttcgtgtttc

SEQ ID NO: 6767872 - DNA, 95 bp, Homo sapiens
atgcacagttataatggagcaaggaagtgccaggaaggtgcccagtgtatcacctcggttccacaggtatttctccttgctcccatcttgtgtat

SEQ ID NO: 6767873 - DNA, 61 bp, Homo sapiens
agggagacacatgaggaagtcatttaacatccttgagtcccactttctcggtttctcacct

SEQ ID NO: 6767874 - DNA, 65 bp, Homo sapiens
agggagtggttaagaaggtgcagagaaaagcgtgtctgacattgataaggtgcttaaccctctct

SEQ ID NO: 6767875 - DNA, 130 bp, Homo sapiens
tcagtcttgtcaggtaatggaggggggagttccctgatcctgggactgaatgggtgcttcagcattagctgcgcctgtagaagtcctgtgatagccgagcaccctccctcagatggcctgttgagattgg

SEQ ID NO: 6767876 - DNA, 58 bp, Homo sapiens
gtggttgccttttttcaacggtagtaatattaagcctaccaagaagaaggaaaactac

SEQ ID NO: 6767877 - DNA, 84 bp, Homo sapiens
gatctgagacttgtttttattaccaagttgcaggggatatgccaaccctcgcctacctctacatatttggtggtttctgagatc

SEQ ID NO: 6767878 - DNA, 85 bp, Homo sapiens
ttattttaaaggaggacatagtggactagggttcatcttgacaataagttctagttaacagtcctcttgcctaccttcggaataa

SEQ ID NO: 6767879 - DNA, 89 bp, Homo sapiens
gtagagaagaggaatagtagtgttttgattaaagttgttcttcactggaacaagtttccaaattataaccttgctttccagaactttgc

SEQ ID NO: 6767880 - DNA, 59 bp, Homo sapiens
tctagaatagattctgctgatcaccatataacttactggtttagagagctgttactgga

SEQ ID NO: 6767881 - DNA, 69 bp, Homo sapiens
gtttagggtagtttgttacatagctttttcgtgccaagaaatgagtgatacagcaagctctcaataaac

SEQ ID NO: 6767882 - DNA, 76 bp, Homo sapiens
ggtgtgtcctgcctgcaaaatgggacaagctgcgcgtcaacgctgctgtcccttgagtaggaacggaggcctcgcc

SEQ ID NO: 6767883 - DNA, 85 bp, Homo sapiens
tgttatttttggggtttgcttctgtttatggaaagatactgatttcctatatcttgctgctacaaagtgcccctttaaaataata

SEQ ID NO: 6767884 - DNA, 57 bp, Homo sapiens
gccccagggaaagatcttggtcagagttgtccaccaaaaccaggaacttccctaggc

SEQ ID NO: 6767885 - DNA, 55 bp, Homo sapiens
gctatccctggctcatctcttggtgtaatgtgctgagggctgagaagggactagc

SEQ ID NO: 6767886 - DNA, 59 bp, Homo sapiens
gccgtcagtgcatttttaaggtatttcgagatgttcattataccaaattgcattatggc

SEQ ID NO: 6767887 - DNA, 75 bp, Homo sapiens
gaggaaaagatgggggcctggctgcagggaagcaggctgagcagtccctagtagcccggtgtcctctgacccctc

SEQ ID NO: 6767888 - DNA, 66 bp, Homo sapiens
caatgaggagtccaggactcattcagctttcctatcataagcaacagtccttgaaactctttcttg

SEQ ID NO: 6767889 - DNA, 62 bp, Homo sapiens
tacaggacatggcttctgtgacgctgatgcatttagaggaatgtggcaaagccgtgcctgtg

SEQ ID NO: 6767890 - DNA, 60 bp, Homo sapiens
gggagggaggagccccggccatccccaccctcgtggatgtaactggttttcttccctctc

SEQ ID NO: 6767891 - DNA, 103 bp, Homo sapiens
atgggtaaccgtggatggcacatttttctgatttgacttgaagtatccataactatgatggactttgcctgactcagaaatcagctgcctttcagtctcccat

SEQ ID NO: 6767892 - DNA, 63 bp, Homo sapiens
gctttgttctggcttcacactgaagtttggctgctgagccagaaggtgaaggcagaaccttgc

SEQ ID NO: 6767893 - DNA, 82 bp, Homo sapiens
tcttgatttaaatgtagattttggagtctacaagtagctttgaatatttgaaatggattttgaaactaatttttaaggagga

SEQ ID NO: 6767894 - DNA, 59 bp, Homo sapiens
attagctttggtggaaaggagtgtaaaatgattccttttctaaagacaccaatgccaat

SEQ ID NO: 6767895 - DNA, 88 bp, Homo sapiens
ccagatgacaggtgctgtgtaaaaatgaagcaagtttttcatgttctataaaacatgataacttcattacacaatagtcagagtatgg

SEQ ID NO: 6767896 - DNA, 64 bp, Homo sapiens
ttcatatgatgtaaatagagcctaggtagcaggagtttcctacctaggtattttacacagtgaa

SEQ ID NO: 6767897 - DNA, 77 bp, Homo sapiens
gttcttttaagattgacatgagaagcattgatgggcagtaagtaaacatcagtgctgctttatgacagtttctgaac

SEQ ID NO: 6767898 - DNA, 60 bp, Homo sapiens
tttacagcattgctgaaagttcagcagaaaatacagcagaattttcagctttgttgtaaa

SEQ ID NO: 6767899 - DNA, 59 bp, Homo sapiens
cacatacattcatgttactctacaacttattttataaagggtgtgtgtgtgtgtgtgtg

SEQ ID NO: 6767900 - DNA, 65 bp, Homo sapiens
gatgcctcttttggctgaattatatccaccataccatcactctggtgagcaaaaagagaagcatt

SEQ ID NO: 6767901 - DNA, 64 bp, Homo sapiens
aggtgacttaggctgtggctcgctctgtggtgtgcgctgggtgggccatgggctgggagcagct

SEQ ID NO: 6767902 - DNA, 84 bp, Homo sapiens
ctctcactatcctggctcccgtctggtggccatccctgagccaatcactgtggcagcagaggggtggtatggagtggaaaagag

SEQ ID NO: 6767903 - DNA, 87 bp, Homo sapiens
ccagatggcgtcacctcagttaccatggcttggtccaagcagtgacttctgttcatgggctctggaattgagtggccaaaaatctgg

SEQ ID NO: 6767904 - DNA, 68 bp, Homo sapiens
gccatgttccaagtgtataaagtgccatatctactgagattatttgtataaattggagcaatgttggc

SEQ ID NO: 6767905 - DNA, 107 bp, Homo sapiens
cagcagcggtggctgcagaacagcggtggctgtagaacagcggtggctgtagaacagcagtggctgtagaacagtggatattggtgatctgcaaatgctgctgcctg

SEQ ID NO: 6767906 - DNA, 57 bp, Homo sapiens
ggatagtgggagaatgctatgtgctgagagggttaaactagcaaaagcctattatcc

SEQ ID NO: 6767907 - DNA, 80 bp, Homo sapiens
aggtaacaagaagaatgatcctgggaaggatgacttttctattggttaattcatgggcccagtgatatcattaattacct

SEQ ID NO: 6767908 - DNA, 55 bp, Homo sapiens
gcattagagcccatcacctgtaaccaagcgaaaggagacattgatggctttaagc

SEQ ID NO: 6767909 - DNA, 55 bp, Homo sapiens
gccgtgtcatccaagaccagtgtggttgtgggcacattagcttggagacagtggc

SEQ ID NO: 6767910 - DNA, 66 bp, Homo sapiens
gcgccgcccgctgcagcgccgccgtccagggaccgggccctggaggccaggaaggcagcgaggcgc

SEQ ID NO: 6767911 - DNA, 62 bp, Homo sapiens
aagccttccctttttgagctcaggtccaaaaaagcagttttggcattaaagagaaaaggttt

SEQ ID NO: 6767912 - DNA, 61 bp, Homo sapiens
tgtctgctagctggtggcaattgaagtaagcattctcttctcccacagagactagaagaca

SEQ ID NO: 6767913 - DNA, 125 bp, Homo sapiens
gtagcaatgtacttcagaaattagtcagtaattaaaatgcagtggtttggactaaagtgagattaaaaaagctcaactggctttagtttgtcactggcattgactttgagtatttttcatactac

SEQ ID NO: 6767914 - DNA, 68 bp, Homo sapiens
ggaaccatttatgtagcttaacattccccaatgtgtggaggcctgtgagcccttgcatgtactgttcc

SEQ ID NO: 6767915 - DNA, 121 bp, Homo sapiens
aggagactgagaggaggaagttgagtagcttctctgaggtcacatgaggagtgagagagagccccagtcataatgaccccagagtccgcattctttactgccgccttgctttcagtgtcct

SEQ ID NO: 6767916 - DNA, 61 bp, Homo sapiens
gtgctgagcacagctgcccaggcagaagaggaaggaacccagggctcctgtggctgcagcc

SEQ ID NO: 6767917 - DNA, 106 bp, Homo sapiens
ggctccttgtgcaagactgactgcaagctttatctgcatggacactttcttggctcacagaattgttttggaacaaaagctattcatttcagcttgatttggagcc

SEQ ID NO: 6767918 - DNA, 87 bp, Homo sapiens
tccgttggcatatactcacactgataggcttgacaggcagataaacctgtatttgaaggtcagcaggattagttgtgtggccttgga

SEQ ID NO: 6767919 - DNA, 69 bp, Homo sapiens
gggtcagcggcgggggcaggagatgtctggaggaggagaggcccagcatccatgctccctcggggaccc

SEQ ID NO: 6767920 - DNA, 72 bp, Homo sapiens
ctgaagctttggaagggcagggttgagcagagtgcatcctattttccagcccttcttccaaccagctttcag

SEQ ID NO: 6767921 - DNA, 60 bp, Homo sapiens
gtagggatgactcttggctgattcctaatgtggggggtagggtgttggggtcatctctat

SEQ ID NO: 6767922 - DNA, 63 bp, Homo sapiens
ttgttttaatggctttagtcacttcatttcttttgaagtttcatgacttggttattaattcag

SEQ ID NO: 6767923 - DNA, 66 bp, Homo sapiens
gaaccatggactctggtttggggagctgatctcttggctctaaagcagcaggagttcataaagttt

SEQ ID NO: 6767924 - DNA, 56 bp, Homo sapiens
gacccatgattatatctttgaccctaagttcaggtataagcatagttgtcagggtc

SEQ ID NO: 6767925 - DNA, 75 bp, Homo sapiens
ttatgcctttgacagctattttgctttgatatttttgtagtgaaaatcatagaactgtggttgttagtgctataa

SEQ ID NO: 6767926 - DNA, 80 bp, Homo sapiens
gtgagttggatttgttgctagcagcactgatccatttgtatgtatgtttgtcagtgggcgtggcgacatcgcttactcac

SEQ ID NO: 6767927 - DNA, 88 bp, Homo sapiens
agtactacttcagtgcttctggtgggcgtgagggagaaaattaaacataagccacactccttcattcagcaagtatttattaagtgct

SEQ ID NO: 6767928 - DNA, 55 bp, Homo sapiens
gccaaagtacctagccctctgctcacccttctgtggcatccgaggtatctttggt

SEQ ID NO: 6767929 - DNA, 57 bp, Homo sapiens
gatgcctggcatgggaagtgtccagctgagaaatggaggctcccagaaatgggcatc

SEQ ID NO: 6767930 - DNA, 81 bp, Homo sapiens
tggtggagaatagaatcaagacattgtcattttataattagaagtaatatgtaatagaagatgtattgtatgttcctacta

SEQ ID NO: 6767931 - DNA, 59 bp, Homo sapiens
acccagtgttctgtaccccgatgcctggaagttcaaggtcatgggctggagcactgcgt

SEQ ID NO: 6767932 - DNA, 59 bp, Homo sapiens
tatctataagtactaacatggtatttgtcactgaaaatctatgtgtgtgtgtgtaggta

SEQ ID NO: 6767933 - DNA, 59 bp, Homo sapiens
aaccacatggctcagtggacatacttatccattaagtatgcttatcctgaccattggtt

SEQ ID NO: 6767934 - DNA, 74 bp, Homo sapiens
aggcaggaaatagttttcagttactgctatatcattgtcctcaattaggagctgactgatgacactgtccttct

SEQ ID NO: 6767935 - DNA, 56 bp, Homo sapiens
aggaaagtagattgtagtactagtactactgctagtactacgttttctactatctt

SEQ ID NO: 6767936 - DNA, 80 bp, Homo sapiens
ccggctgagactctgctacaggccgaggttggttgattgtcttggcagctaacaaaagccgaagtaggtgtctcagtggg

SEQ ID NO: 6767937 - DNA, 64 bp, Homo sapiens
gtttcaagcagttaagcagtctccatgcagcagcatggtggaggctcctaagctgacttgacac

SEQ ID NO: 6767938 - DNA, 74 bp, Homo sapiens
ggcaggaaaacaaggcagctcagctcatggcagtcctgatgatgatccctgagggctgatcttggcctctagcc

SEQ ID NO: 6767939 - DNA, 66 bp, Homo sapiens
tgattatgctagtatagtccttagagtcatttactcatttctttagactcttcgggagcaaaatca

SEQ ID NO: 6767940 - DNA, 86 bp, Homo sapiens
cagcctcttctctgtgtaggatttcctggagccttccagtaagctggtgggctcattaaagaagtcctgcgttgagctagagtctg

SEQ ID NO: 6767941 - DNA, 68 bp, Homo sapiens
gggagaggctgagcccactgcccacagggcctcccggcctttattgcaggagggcccgagactcttcc

SEQ ID NO: 6767942 - DNA, 112 bp, Homo sapiens
tccgtagttgaagatcttgaaacctgctagaagcaaatgtctgattacataagaagaaatcagattcttaatttatgggatttaagatttatatttatgagtcttttatgga

SEQ ID NO: 6767943 - DNA, 59 bp, Homo sapiens
ggtgaacagttgtttcaaatatgtgagcagcctccatattagaagattctgtgattatc

SEQ ID NO: 6767944 - DNA, 84 bp, Homo sapiens
gtgtctcgaagtttctgatgcaaagcatttgaatgggcttgactacttgctcagaacaaatgcatgagaaataagagggaatac

SEQ ID NO: 6767945 - DNA, 61 bp, Homo sapiens
gggcagccggactgccgctgcacccgccaaaccacgcgggaaccagccgcttccgcctccc

SEQ ID NO: 6767946 - DNA, 55 bp, Homo sapiens
aagccaggtgttgtggtaagagatgcctccggctattttttcccaggcctggctt

SEQ ID NO: 6767947 - DNA, 63 bp, Homo sapiens
tgtctctggttatgtcattaagcagtttggtgaacgttttgtatgaggcatacatcaggcaca

SEQ ID NO: 6767948 - DNA, 78 bp, Homo sapiens
tgctattgtgaatagtgccgcaatgaacatacgtgtgcatgtgtctttacagcagcatgatttataatcctttgagta

SEQ ID NO: 6767949 - DNA, 86 bp, Homo sapiens
aggattgcttgcaccaaagaggttgaggccgcagtgagctgtgatcatgccactgcacttcagcctgggaaacagagcaagatcct

SEQ ID NO: 6767950 - DNA, 83 bp, Homo sapiens
tgcaaggctgtatgagtaatttatccagtgaagtaatgcccttagcatctcttactgtctggcaattaagaatcacccttgca

SEQ ID NO: 6767951 - DNA, 65 bp, Homo sapiens
agggagtggaaggcacttaaactaagatgcagttttggatgaagtctagctttagtctattccct

SEQ ID NO: 6767952 - DNA, 85 bp, Homo sapiens
atggattcagtttcaagacattgattttgtacagattagaatgttttattttggtacattttcaagtagtctagaaacagttcat

SEQ ID NO: 6767953 - DNA, 55 bp, Homo sapiens
gcgaggcagtgcattgtctaggggagattaaagccccagggccgtattgtctggc

SEQ ID NO: 6767954 - DNA, 63 bp, Homo sapiens
ctatctgacaatgcagctgcagctttccaattggaaccaagctgcttattcattgatcgatgg

SEQ ID NO: 6767955 - DNA, 69 bp, Homo sapiens
agtgaaagtcttggtgtgtttttatccttcaggtaaagtctggtaaatgatgagaagcacccctttcct

SEQ ID NO: 6767956 - DNA, 72 bp, Homo sapiens
gctgtttacagtatgagagttgaatcaaggagacagagtattgccttgctcaatctcagctgggaactaggc

SEQ ID NO: 6767957 - DNA, 56 bp, Homo sapiens
gtatgaggcaggatattaacttttacaagcaaagagggaatgtattgcctcagcac

SEQ ID NO: 6767958 - DNA, 61 bp, Homo sapiens
gagagctggatgaaaaggattccgaactgcttttcaggacatccatgaatcatctgctttc

SEQ ID NO: 6767959 - DNA, 82 bp, Homo sapiens
cagaaagagaaccaaagagccatatatgcagctagaccttgtgagtcatgctgggtactatggctgctgttttctctttctg

SEQ ID NO: 6767960 - DNA, 107 bp, Homo sapiens
ccctatataagtagactacatcttgtaaaactgcttggtatggtctaatagcacattagatgtacagagctgttttaaccatttgacctagtttttactgcccaggg

SEQ ID NO: 6767961 - DNA, 77 bp, Homo sapiens
tccaaggtcagagtgccctgcagtcacacaagctgaatgctggtggtgactgattggtgttctctactgttcttggg

SEQ ID NO: 6767962 - DNA, 58 bp, Homo sapiens
ggacctggagtagccggacgggtctggggccttctcagtccctcgtctcctccattcc

SEQ ID NO: 6767963 - DNA, 96 bp, Homo sapiens
acctaattctgtcaaagagagaaggttgttaagatttggtggtcagaaacacatgacttccaatcaaatttagcagtcctaactatcgaattaggt

SEQ ID NO: 6767964 - DNA, 72 bp, Homo sapiens
tggtggccctgtcccaggcctcctctaggctccgcccccgcgcccgaggacggcgggaggcggggtccgcca

SEQ ID NO: 6767965 - DNA, 74 bp, Homo sapiens
gggggtggccagaggcagatgcccaatgctggcagaaggtgtgcagagcattgagggtctgccaagttaccctt

SEQ ID NO: 6767966 - DNA, 59 bp, Homo sapiens
tcatactcagctggatgcaaagcacaggcatctgtcacttaaattcaggctgaaaatga

SEQ ID NO: 6767967 - DNA, 69 bp, Homo sapiens
gcccatctctgccctccagcctttgtgcagctgctgagcagttcagggagagcgggacgggtggtgggc

SEQ ID NO: 6767968 - DNA, 59 bp, Homo sapiens
tacaggcatgtagcatggtgattaagaatcaaagctgggcatggtgactcgtgcctgta

SEQ ID NO: 6767969 - DNA, 85 bp, Homo sapiens
tgtaaaagtgctgccagtacagaatgtgtatcattaccattttatggataaatgtgtattaccattttgtctggataactgtaca

SEQ ID NO: 6767970 - DNA, 59 bp, Homo sapiens
tctgcagccatcacgatgaactcagagatgcccctgttgagggttttggtggctgcgga

SEQ ID NO: 6767971 - DNA, 87 bp, Homo sapiens
aactacatctaacctcagttattgggttgtgggagtaaaataatttaaggtttacatgtaatctaaaataattgaggatctatagtt

SEQ ID NO: 6767972 - DNA, 90 bp, Homo sapiens
gcttctgagtttctgtgaattctgcagtaatggccccccactcaaccttgcttactgtttcaagccctcacagacaatgagcattagagc

SEQ ID NO: 6767973 - DNA, 63 bp, Homo sapiens
tcagccctcactgggaagggaggggagcagagccccgtggctcccaccccggtcaagggctga

SEQ ID NO: 6767974 - DNA, 69 bp, Homo sapiens
gcagtgaccttcgagctgcgggttgttggagcatcctcctgcctgatacactgcggtgcgaggtgctgc

SEQ ID NO: 6767975 - DNA, 61 bp, Homo sapiens
tagctacatttatacactgtagttaccattttctacaaaagcatgtgtatagaataggcta

SEQ ID NO: 6767976 - DNA, 81 bp, Homo sapiens
tggtacttggagagaggctggccgtgatgaattcgattcatcaaagcgagtcatacacggctctcctctcttttagtgtca

SEQ ID NO: 6767977 - DNA, 60 bp, Homo sapiens
agggtggccatgagggagagattgtcatataattaattttctcttctatggctttgccct

SEQ ID NO: 6767978 - DNA, 55 bp, Homo sapiens
cagctccagcctgcagtgccagaattcctcggtgaggtggccagggcaggggctg

SEQ ID NO: 6767979 - DNA, 106 bp, Homo sapiens
caggatgtagatcattgatccctaccattgctgagacattgctaatctgatatttatccagagcgcactgtctgcaggcaaattagggttttaattcaccatcttg

SEQ ID NO: 6767980 - DNA, 65 bp, Homo sapiens
agctagagcccaatacatttggttgccatcctgatttggtagctccttcctcttgggctccagct

SEQ ID NO: 6767981 - DNA, 84 bp, Homo sapiens
ggttcccctccaacttctttttatatcgccagtgccaaaacagcgtatagcacaacttggctgtaaagaagaagtgcagggacc

SEQ ID NO: 6767982 - DNA, 90 bp, Homo sapiens
gcagcatgggtggtcctctgagcacgccaggcacgagtgtgcagggagctggtgcaaatgcctctgtgtgcaggtgagcatctgtgttgt

SEQ ID NO: 6767983 - DNA, 60 bp, Homo sapiens
tagctatcaaaccaggagtttgctactaatttaggtatgttaatttattcatgatagcta

SEQ ID NO: 6767984 - DNA, 79 bp, Homo sapiens
aggtgaatttgcacctagaggtcccggcaggacttcgttaatgagcgtgctcctgcctcaggactctgcatattctcct

SEQ ID NO: 6767985 - DNA, 122 bp, Homo sapiens
ctcagccttccttactcccttgtatattgaaggctttctaaggaaagtacctgggattctccatctgagggctttctttggaatgttcagtccacaggtgtggggcagaaggaagtgctgag

SEQ ID NO: 6767986 - DNA, 64 bp, Homo sapiens
tgcgagtctatagctctgcagatttgctatctctgggagtggaagagcagagctgggattccca

SEQ ID NO: 6767987 - DNA, 63 bp, Homo sapiens
ctggagatgctatgtagtttggttgcaaggtggctgtcaatcacaaatgcaagttgtcaccag

SEQ ID NO: 6767988 - DNA, 60 bp, Homo sapiens
ggtgggatccttagccataacattcttgagttgcagagaatgtgtatctcagatcccatt

SEQ ID NO: 6767989 - DNA, 79 bp, Homo sapiens
gtcactcatagcgtttgcttccctgattgaactttaaatttgttcaagccgtgttaaggatgcagagcatggaagtgat

SEQ ID NO: 6767990 - DNA, 55 bp, Homo sapiens
gccatcaaggtgaagccctgaggatcccccggggccagtccctccactttgatgc

SEQ ID NO: 6767991 - DNA, 103 bp, Homo sapiens
tcaatgaaatcagagatttttgtttgtttactgatatattgtcagtccctgccatacagtcacttaaaaatgtgttgaataaattgtgcctcgattttgttga

SEQ ID NO: 6767992 - DNA, 56 bp, Homo sapiens
ggagttcactttcattctggcttctggttaagagccaggatctgatattgggctcc

SEQ ID NO: 6767993 - DNA, 61 bp, Homo sapiens
tttcctttgggcacccgagctcacagtgcagcatggagcatcagggtaggtctgtgggaga

SEQ ID NO: 6767994 - DNA, 84 bp, Homo sapiens
taggaaatgcattagctacatatgtctttctgtggatgtctgtgattgtcatcctctagacagatgtggctatgaggttcacta

SEQ ID NO: 6767995 - DNA, 57 bp, Homo sapiens
aacatatttggttaactgctgagtcaactttctgtttagatcttaggcaaatgtgtt

SEQ ID NO: 6767996 - DNA, 61 bp, Homo sapiens
agcagctacacatctgtgctctgctagcaagcatgtgggctctgtggatgtgagagctgct

SEQ ID NO: 6767997 - DNA, 91 bp, Homo sapiens
atttcctacaatgttgcatcttcctcagagacagtaactggaattgtttacaatactgtagataaactgtaactgaagggtgcagggaaat

SEQ ID NO: 6767998 - DNA, 55 bp, Homo sapiens
agcaactgctctgggcaacagcctccctcaataggcaaggcccccagagtaagct

SEQ ID NO: 6767999 - DNA, 67 bp, Homo sapiens
cccaccagattctcaaatatctcctgccatgaaaggacagctgtgttagtctgaagattctgttggg

SEQ ID NO: 6768000 - DNA, 65 bp, Homo sapiens
aaaaatgcatattcttagcccctcctgcagataagaatcttcaggaatgaggaatctgtattttt

SEQ ID NO: 6768001 - DNA, 126 bp, Homo sapiens
ggaagtttggtggtggtggccagggctgtgggcgggtcgggggaagggggtctaaatgcttgctggatgagtggatggatgtgtcgccctggctctccagggggccctagacacacacttgctttc

SEQ ID NO: 6768002 - DNA, 70 bp, Homo sapiens
ttgtactgccctcctcctgagcccatgttagacaggtcttatagtcaaggcagggtaggagggtggacag

SEQ ID NO: 6768003 - DNA, 68 bp, Homo sapiens
ggctgcagtctggggatggctggagggtcctggaagtgcgcagctcacagcctcccccggcctgagcc

SEQ ID NO: 6768004 - DNA, 57 bp, Homo sapiens
ttctttagctgcgaagggagtggaaaagacgactaagccaagagcatgcatgaggaa

SEQ ID NO: 6768005 - DNA, 66 bp, Homo sapiens
aggtgtgtgtgtgtgtgcatgtgtgtgtatgtgtgtgtgtgtatgcatacacacatagaagtgcct

SEQ ID NO: 6768006 - DNA, 67 bp, Homo sapiens
ctacgcgatattccctcctgtgcggatccacctctgcgcagctcagtgagggaacttgtgtctgtag

SEQ ID NO: 6768007 - DNA, 97 bp, Homo sapiens
gtacttaacacggtcttggatggtgagggtgaaaaacaattcaagtagcttgaattgttccctactgttcaactggagaataaacaaaattaaatac

SEQ ID NO: 6768008 - DNA, 61 bp, Homo sapiens
tctaaacatgtgtgctgaaccatctttgcagatctctgcatggtgaatacagttcattaga

SEQ ID NO: 6768009 - DNA, 102 bp, Homo sapiens
gctgtggtgagcaggtgaggcccccagggtggatgcaagcagcagatggcttctgtgctgctatgtgccacctgggaatggattagctttgctcctgacagc

SEQ ID NO: 6768010 - DNA, 80 bp, Homo sapiens
ggctcaggtctgtggtggccgcgggagagccagctccacgctgtgtggctggtgacatttccggctgccagggcccagcc

SEQ ID NO: 6768011 - DNA, 57 bp, Homo sapiens
cactttacccttgttactcatggcttcccgtcaagccatgggtattaggtgacagtg

SEQ ID NO: 6768012 - DNA, 67 bp, Homo sapiens
tgcaagccacctggtctgttacaactatttacctttgtcccctctaagcagccatggatggtatgta

SEQ ID NO: 6768013 - DNA, 87 bp, Homo sapiens
gaagacagatgaattctcatatatttctgcattcaatctgttataatatgttgtcttggttgaaatatatgaagaaaatctggcttc

SEQ ID NO: 6768014 - DNA, 97 bp, Homo sapiens
gtgacaggtagagtggagatacttgaagaaatggagacaggatatgggattattatatttttcttcaatttttaggagactgctttacacatgtcat

SEQ ID NO: 6768015 - DNA, 91 bp, Homo sapiens
caagattgaaggccaactggtctgttaggttactggttctgtgagcagatcaaagaagatggagacctgactatcagtgggggcagttttg

SEQ ID NO: 6768016 - DNA, 106 bp, Homo sapiens
cggaggcgcggcgagtggatcgcggcgcggtgggtgcggggagccgaggcgggcggcccccgccgccgggagcgctcgccggccttggccgccgccgccgcctccg

SEQ ID NO: 6768017 - DNA, 69 bp, Homo sapiens
tgagtcagtatttattacttagctgtattgaattctctgccagactgagatcaataaataactgactca

SEQ ID NO: 6768018 - DNA, 81 bp, Homo sapiens
gaccgctgtaaataaagtcatctttacatctttgccagaacccatttgtcagttgtatgtggctgtatgagacagtgagtc

SEQ ID NO: 6768019 - DNA, 78 bp, Homo sapiens
gcacagaaccaggaattgcagggctgcatatcttgttgaatgctgtagacttcctgacagctctctggttccttgtgc

SEQ ID NO: 6768020 - DNA, 71 bp, Homo sapiens
gccaaatgtgaagcagggaaggaaaggatctgatcagaagggacagaactggccctgatcttcaccatggt

SEQ ID NO: 6768021 - DNA, 93 bp, Homo sapiens
tctgctcctctcctttgtaatttatatggaattgttgctcagaaaggcagttatctgaagtaccattagattaggatgacaaggaagagcaga

SEQ ID NO: 6768022 - DNA, 55 bp, Homo sapiens
ggaagggggcagaggcacatggtaatcttcaaaaccatcctgtgactccgcttcc

SEQ ID NO: 6768023 - DNA, 61 bp, Homo sapiens
tctgggttttgtaccgtgctcgtcccaaagggcaacatgactccttggtgtgaaatctaga

SEQ ID NO: 6768024 - DNA, 56 bp, Homo sapiens
ccttctcctttcttttaaaatgtcaggttaagtctgataaactggagaggtggagg

SEQ ID NO: 6768025 - DNA, 88 bp, Homo sapiens
acgtccagggaagagctgtggatagtcctggattgtcctgcgtttggcagcggaggtggaccaggctgttccagtctaaccctgatgt

SEQ ID NO: 6768026 - DNA, 59 bp, Homo sapiens
gctatttctcatttacagacagtagccttttataattctgtctggaagtgggggattgc

SEQ ID NO: 6768027 - DNA, 129 bp, Homo sapiens
tacattgatagaattaaacaggctttggaaatgcatttgttattatctggctacttttgttagttcctcagatgctaatcaaactttctgcaggtattttcaattactatttaattattttacagtgta

SEQ ID NO: 6768028 - DNA, 114 bp, Homo sapiens
ggagtatagatttaatctggataattcatcattttatagctagttggattaatcagaccagttctacactagcaaaatgaaagtgatgaaccaagttaattatctagaccatcc

SEQ ID NO: 6768029 - DNA, 64 bp, Homo sapiens
aaagttgtggtttgatgcagttgctggcatagatttatatgcaattgcataaattatatacttt

SEQ ID NO: 6768030 - DNA, 81 bp, Homo sapiens
acagattttcctggaaaacatgggaatcacactgattatttcacatatgtgtcaaattgttttacacaggaagaggtctgt

SEQ ID NO: 6768031 - DNA, 71 bp, Homo sapiens
ctgactagcaagtttaaaatcatttggaaaccaggtttgtgatccaagggaatttaaagttgctgacacag

SEQ ID NO: 6768032 - DNA, 61 bp, Homo sapiens
gtttgtccactcccgtatcccagcaccaagaagagtgcctgggacatggtaggggcacaac

SEQ ID NO: 6768033 - DNA, 88 bp, Homo sapiens
ggagtcttgctttgttgcctaggctggagtgcagtggcacaatcttggctcactgcaaactgtgcctcccggcctcaagcgattcttc

SEQ ID NO: 6768034 - DNA, 117 bp, Homo sapiens
gcactctgcacctcggggacgttattgcgcgtggaacggctgcttttggaagacttttgcccagaagaaaagatgtttggttttcacacgccaaagatgtaccgaagtatagagggc

SEQ ID NO: 6768035 - DNA, 57 bp, Homo sapiens
gtttactgttaaccaacgaatggggaaggagaaccacattacatggttttagtgaac

SEQ ID NO: 6768036 - DNA, 77 bp, Homo sapiens
gatgaagatttttagaggcatttttgttgtatattatgagtaaaattctctttggaaatgctttgagaatcttaatt

SEQ ID NO: 6768037 - DNA, 84 bp, Homo sapiens
gcatgaggccagggatataccataatgtctgacacagtaagatatcagtatctgcttgttaaatgttgattcctgctttattgc

SEQ ID NO: 6768038 - DNA, 88 bp, Homo sapiens
gcaccctcctccccacatcccttgttagtgacccccaaggtattcagggatctgcagcatcctagggtctgtgaggaaggcaggatgc

SEQ ID NO: 6768039 - DNA, 61 bp, Homo sapiens
atgcctatgccattttgagatgttaatgattcatttcactacaattcacaagtggtggtgt

SEQ ID NO: 6768040 - DNA, 73 bp, Homo sapiens
tctgtgggtagcaaaaaaactggcatctcccagtatggtccttggggatctcagtacttttggtgtctaaagg

SEQ ID NO: 6768041 - DNA, 71 bp, Homo sapiens
gctgtgctccctccagaggctgtaggggagaatccattccttgcctctcccaacctctggtgggtgctggc

SEQ ID NO: 6768042 - DNA, 119 bp, Homo sapiens
tgctttcatccccatctggcattcagtgttccaggtccttccccacctctacccctagcacctgccttctcaaggacatgaaagctagaatttgaaatgaaattgaggactgataagta

SEQ ID NO: 6768043 - DNA, 71 bp, Homo sapiens
tagatgatacctcagctgggctttaggagctacagaagaagctgcatctccatgagctcagcgtgtttcta

SEQ ID NO: 6768044 - DNA, 78 bp, Homo sapiens
gtccctgagacatatcgttggatcctgtggaataactacgttcccagcgtcccgtgatattctgcaggtctccccggc

SEQ ID NO: 6768045 - DNA, 72 bp, Homo sapiens
gtgatttgttattctgtaattactgtgtaaagtactgtgctaggtactgtgaatacaaaataaattggtcac

SEQ ID NO: 6768046 - DNA, 63 bp, Homo sapiens
tcctctcagcagccagatccagagctctcctggggggcgagggttgggggttgctgcactgga

SEQ ID NO: 6768047 - DNA, 66 bp, Homo sapiens
gacattgaaaataatgtgtagagctttctaaataaaataagactttatgagtttgttttctgtgtt

SEQ ID NO: 6768048 - DNA, 56 bp, Homo sapiens
gcctttaaagccccgagagcccttcttcccagtggggcctcggacccctttgttgc

SEQ ID NO: 6768049 - DNA, 62 bp, Homo sapiens
tgctttctccatttaaatcttatgtcttcagaaatgctcaagaactgcgaatggagaaagta

SEQ ID NO: 6768050 - DNA, 56 bp, Homo sapiens
aggtgatgggaaaagaaattttaagaatgaaacagggatgtcttttctggtctcct

SEQ ID NO: 6768051 - DNA, 60 bp, Homo sapiens
ttcagaaggtaggaatgtccctcttgatagggctgaatcaagggattcctggctttagaa

SEQ ID NO: 6768052 - DNA, 90 bp, Homo sapiens
cacagggaccaggccttgtttctctcccagataagctaaggttggcaggggctgaggggagtgaggcagggaggatgcatggggtctgtg

SEQ ID NO: 6768053 - DNA, 77 bp, Homo sapiens
gatattcagagctttatatttagtaagggattcacttggtttatattgtccatattataatttagggcttggatatt

SEQ ID NO: 6768054 - DNA, 128 bp, Homo sapiens
agcacagaccccacaaaccctccactttctttatttcaggcctggcgtaaaggagatgggactcacacccaagaggatgcatttccatacacccatttctgaaatatgaagaggtgtccagtctgttt

SEQ ID NO: 6768055 - DNA, 57 bp, Homo sapiens
taactctcacagtgcaacatgaagagggccaggtgaccctgcacgtgaagagagttg

SEQ ID NO: 6768056 - DNA, 57 bp, Homo sapiens
ccactacattgagtgctttctctggctccttgcaaagaaagatactttttgtaatgg

SEQ ID NO: 6768057 - DNA, 83 bp, Homo sapiens
acctcagagtaaacagagatcttgaggtcagcagattgtatgtaaatttgatgagtttgtaagtcttcgtaaggctttggggt

SEQ ID NO: 6768058 - DNA, 55 bp, Homo sapiens
tttgtgtagcaaggcattgagtctgaaggtgattcataggcacattgcgcacaga

SEQ ID NO: 6768059 - DNA, 129 bp, Homo sapiens
acacatacacagtgctaatgcatatgcccgccctgaattttctcctcatgactggttgtggcacaactttaaacccagcagagcatggggaggaagctggagtttgtattttcagttttgttcaactct

SEQ ID NO: 6768060 - DNA, 67 bp, Homo sapiens
ggagtcacagtttccctgagagagctgagggcataaacaatgataagttctccaggggatggacttc

SEQ ID NO: 6768061 - DNA, 130 bp, Homo sapiens
gagccttcagaaatgaagacccattatcccccaaagcaaggcgccacagtgattgcaaagcggtagtgatttgtagttgtggatgctgaagttgtgtgagatgttgattctgaacctctgtttggcaatc

SEQ ID NO: 6768062 - DNA, 60 bp, Homo sapiens
gagtctggccctgatgcatcatattctatctggtgttatttctcagtcaggtatagattc

SEQ ID NO: 6768063 - DNA, 121 bp, Homo sapiens
catacacacgagttcaaacctctaggactggtatttggtataattcgattctcatattattatgaggggtatattaaatgaccagttttaatacatggtgcactttgaattggttgtcatg

SEQ ID NO: 6768064 - DNA, 57 bp, Homo sapiens
acccactgtcttctggtcaccttgcatgtggtactgtggtcagagatgacagtgggt

SEQ ID NO: 6768065 - DNA, 91 bp, Homo sapiens
gagggttgccgagaagaaatgtggacccagtgttgcgtttctgattttttacaagagaagccaaaactcccatattttaatggaaatcctc

SEQ ID NO: 6768066 - DNA, 73 bp, Homo sapiens
gttgcccatttcttatgctgagaatgaaagaatgtgacattattttttaaaagctctgcatgttgtgggccac

SEQ ID NO: 6768067 - DNA, 68 bp, Homo sapiens
gactaaagtaagttcccctggcagccttgagctttcttaggtaggcattgtcatgggagcctagggtc

SEQ ID NO: 6768068 - DNA, 78 bp, Homo sapiens
gtaagagcacagaagtagttctcaggacgtcaaggttatagattacccttggcaattccaagaactttggatttttac

SEQ ID NO: 6768069 - DNA, 69 bp, Homo sapiens
acaggaggccgctttggtgacaggtgccgacaggaaagcacatctgtcaacagagacggtcaaccctgt

SEQ ID NO: 6768070 - DNA, 74 bp, Homo sapiens
ggatcgggagtgtagaaagctttctgaaagttctcttcccttcttagaacaccattctatattacccatgatcc

SEQ ID NO: 6768071 - DNA, 69 bp, Homo sapiens
ccttcgccccggaggctgacggcaccatcttcttcccagagaggaggccgtcacccttcctgaagaggg

SEQ ID NO: 6768072 - DNA, 55 bp, Homo sapiens
ctccccaagccttggcttctccatgtgaaatggggcagtgggaggttctggggag

SEQ ID NO: 6768073 - DNA, 56 bp, Homo sapiens
gcattcctacaggctgctatgagagccttacctaacttatggtagtcacagagtgt

SEQ ID NO: 6768074 - DNA, 69 bp, Homo sapiens
gggaaaattcatctgagtctcatctgggattcccactttggctttatccccagactttagatttctccc

SEQ ID NO: 6768075 - DNA, 66 bp, Homo sapiens
tcaaagagaagtttttcttattacatgtaatacatagttcatgacggacaaagacttctcttgtga

SEQ ID NO: 6768076 - DNA, 79 bp, Homo sapiens
tacactttccattacagaatttaggatattttagagaaactctgttgcctataatcctggtgagtttgaaaaaagtgta

SEQ ID NO: 6768077 - DNA, 69 bp, Homo sapiens
gactatggtttagttagggcttttcagatttgaaaagtgtatctgagggaatttgacaaaattattttc

SEQ ID NO: 6768078 - DNA, 120 bp, Homo sapiens
gggcctgagatggctgggaagcaggcgggtttaggacaatgctttttaaagttcattttaagtacttttaaggatttccaggcctgcgcctcgagcggccctaagtaagcttctaggccc

SEQ ID NO: 6768079 - DNA, 64 bp, Homo sapiens
tcggatggggtgggcatgcgctgtccttcccgtttatttaggaaggaggggtctttcccactga

SEQ ID NO: 6768080 - DNA, 60 bp, Homo sapiens
ggcctttagggcaggggaggctggggagtcccctttcctacctctctgccctgcaaggcc

SEQ ID NO: 6768081 - DNA, 74 bp, Homo sapiens
ggatgttccagtggtctatttaatagttttcaatgttcctgtagagagctcattgatagccactttgattgtcc

SEQ ID NO: 6768082 - DNA, 74 bp, Homo sapiens
gctcatttgcccaggcttggctaatcttggctaagctctttcacatgtctgaagccttgcctgggaaactgggt

SEQ ID NO: 6768083 - DNA, 74 bp, Homo sapiens
gggctgagtgtctcgggagaaaggagtgggggcatgttttccttccatcaccatttctgcgagctgtccggccc

SEQ ID NO: 6768084 - DNA, 77 bp, Homo sapiens
tcagtcctatatagcagtgcacagtaggacaccataatgatttggttgagccttttgtgtatgttctcaggttttga

SEQ ID NO: 6768085 - DNA, 81 bp, Homo sapiens
ggttgcccagctaggaagggaaaggcttcaactctaggttagactcccagcctcttctctttctcctctgctgggcagacc

SEQ ID NO: 6768086 - DNA, 55 bp, Homo sapiens
ggctccaagctgcgctcccagcaacatggagctgctgggatgacagcccagagcc

SEQ ID NO: 6768087 - DNA, 59 bp, Homo sapiens
ctgtgtgagcatcaaagcctgtcatcacttttattggcaggtgccatgggctcagacag

SEQ ID NO: 6768088 - DNA, 57 bp, Homo sapiens
ctgcagccatttccccctcctgggcctcctatccttgcccagtagagacagctgcag

SEQ ID NO: 6768089 - DNA, 62 bp, Homo sapiens
gtctcagactttcagggtaggccaaccttcaggattagccttttctagaagtgtctagggac

SEQ ID NO: 6768090 - DNA, 106 bp, Homo sapiens
gcagggggagtgaatagggggtaggagaggttggccatgggattagttacagctgagggcctggcttcactttctcagttcctctgttagaaaatcaccactttgc

SEQ ID NO: 6768091 - DNA, 63 bp, Homo sapiens
gaggctttacgtcttcccctgggaccagcttttagtgacatcccaggtgctgcgtgaagcctc

SEQ ID NO: 6768092 - DNA, 129 bp, Homo sapiens
tttgtaatgtcccaccaaacaagttataaaatacatatttatgaatttgtctcaggctgaagtctcactagctgttagagaggattttaaaagcatatgtgtattgtatcgtggctaaacgtgggtaaa

SEQ ID NO: 6768093 - DNA, 61 bp, Homo sapiens
gggactgtctgtgtggttctctgcctaaggaaggaagaatctaagtacacagacagatctt

SEQ ID NO: 6768094 - DNA, 70 bp, Homo sapiens
tgaatattcagatgacgtgcttagaatgtattcactaatggcattgtctcagaagtgatcaggatgttca

SEQ ID NO: 6768095 - DNA, 84 bp, Homo sapiens
agtttctactttggagtcaggcagacctagttatggaccctagtttgatcacttaccagtttgtgtgatctcagacaagtaact

SEQ ID NO: 6768096 - DNA, 55 bp, Homo sapiens
agggctcataattcctgacttcaaaggctacaggaagcaggacatatgatgccct

SEQ ID NO: 6768097 - DNA, 72 bp, Homo sapiens
tgtggaagtgcaaaaccacatggtaaacaattgatatgtttttgtttatttttcttgtttgtcattaccaca

SEQ ID NO: 6768098 - DNA, 76 bp, Homo sapiens
gcgtgacacatccttgtggcatgtgagaactagaaggtgcttaggaatcttctagttttgccacaggataccatgc

SEQ ID NO: 6768099 - DNA, 57 bp, Homo sapiens
gaagagaggcaggaatcctgggtgagggcaggggctccctgggtcctgcttgctctc

SEQ ID NO: 6768100 - DNA, 59 bp, Homo sapiens
ctgtcagaggagctgcagaacgctgggctgctggagcacatcctggagcacctcaacag

SEQ ID NO: 6768101 - DNA, 67 bp, Homo sapiens
aacattttttagagtcccacatttccttatttatactgtgtttgaatgtacggctttggatagtgtt

SEQ ID NO: 6768102 - DNA, 73 bp, Homo sapiens
aaacagctattaaacagcaagtcccatgcacagaaacttaatggtgcatgacactgctgattagatgctgttt

SEQ ID NO: 6768103 - DNA, 62 bp, Homo sapiens
agcgaccctgctgtgaaactggcatatgatttttaaattatgtgaatacagcagtggatgct

SEQ ID NO: 6768104 - DNA, 72 bp, Homo sapiens
gcagagaaaagccatcccagccaagccacagaactatttcctaataaatggtttgggggtgttttgttctgc

SEQ ID NO: 6768105 - DNA, 88 bp, Homo sapiens
tcattcttcatggcagtcctgaaattgtgatttcttggcgtccccttcagcaagttggctcattttatagacagcgattgcaggatga

SEQ ID NO: 6768106 - DNA, 66 bp, Homo sapiens
gccaaaccaggaacttttgtgagagccataagaagatactgtttttactaaggttgctaagttggt

SEQ ID NO: 6768107 - DNA, 75 bp, Homo sapiens
ttttgaataactctcatgtttaggaatgggattttcttatttatttacatttctgattacttgagttatttagaa

SEQ ID NO: 6768108 - DNA, 67 bp, Homo sapiens
gtatctatctcttggctgctagcaggggtcaaatgacttgtgatatgtaaagcactaaggataatac

SEQ ID NO: 6768109 - DNA, 77 bp, Homo sapiens
tacattgttggtggcacccagaataaggacaggacttggagtgtcaggaagcctgtgagctgggtccttacagtgtg

SEQ ID NO: 6768110 - DNA, 88 bp, Homo sapiens
agatttatttcttggataaatgcagagatattgatatagatttttttctggatttttaaaaacagtatcttttttaagaattgagttt

SEQ ID NO: 6768111 - DNA, 69 bp, Homo sapiens
agcagacaatttattagcagattctgtaggctgcagggttgtcatttgctgttatagtgattgtctgtt

SEQ ID NO: 6768112 - DNA, 73 bp, Homo sapiens
cacatcctgtcctcatgcccagagccactgttggacaccccataccgggtctgggtctgagagcaaggttgtg

SEQ ID NO: 6768113 - DNA, 70 bp, Homo sapiens
ttgcagccaaagaggttctccttggagtggggtcgcctccaaaccccaaattcccggcgcttctctgcaa

SEQ ID NO: 6768114 - DNA, 59 bp, Homo sapiens
tggctgtggtttatcccagttcctgggctggaaaggtgcagtggttggggatccagcca

SEQ ID NO: 6768115 - DNA, 74 bp, Homo sapiens
gtatacttacttatcacagccttttggtgagggaacaatttcactgttctctcctattgtgtggtaaggaatac

SEQ ID NO: 6768116 - DNA, 60 bp, Homo sapiens
ccccatcacatcaaacctactctcagaaaagaactgatgagtcctctgatgtgtggaagg

SEQ ID NO: 6768117 - DNA, 67 bp, Homo sapiens
caataagagttgtgtggttattcagtgtgtaagttggcacatttcagaatcacacagcttgggtttg

SEQ ID NO: 6768118 - DNA, 62 bp, Homo sapiens
cctctgggccagcctggaccctgaagctgttggcttcctagttgagaccactgggccagagg

SEQ ID NO: 6768119 - DNA, 55 bp, Homo sapiens
ggaagattttccattcctctttccaaaggataggagggttgaggaggatacttct

SEQ ID NO: 6768120 - DNA, 97 bp, Homo sapiens
gaggagaagcaaatgatttctgtctgatagaaaagataaacacaaaatgtacagttatattgacctattggacatgaaacagttttgtttctaactt

SEQ ID NO: 6768121 - DNA, 78 bp, Homo sapiens
agtgcagaatcagtacagaacgacaaagataaagttgctgctcctactttggttcttgcttctgtgcaattcagtact

SEQ ID NO: 6768122 - DNA, 69 bp, Homo sapiens
ggattttgttgatggtggagtagcctcctgatactgtatggtggctatcttcctcaatgtcagctttcc

SEQ ID NO: 6768123 - DNA, 71 bp, Homo sapiens
taagttcctcttctctgcagggaacattgggagctccttaccaaattcctggtcagcagaagagtaacttg

SEQ ID NO: 6768124 - DNA, 78 bp, Homo sapiens
gattcaagttccctgggggctcatatataggaatggtcatacccctaatctgtctgtgacctctttggagcctggttt

SEQ ID NO: 6768125 - DNA, 69 bp, Homo sapiens
gccaaggctccaggtttaagggtatgttcaaggttgtcatgatcacattcccttggcttgaagcagggc

SEQ ID NO: 6768126 - DNA, 75 bp, Homo sapiens
tcatctttttactaacactgcttataatttcaactggatcatttgtgatgcttaatgcagtgctgtagaaaatgg

SEQ ID NO: 6768127 - DNA, 64 bp, Homo sapiens
tggagagtaatttctgaagaccatttattactattatcattaggttttgagaagttattatcta

SEQ ID NO: 6768128 - DNA, 74 bp, Homo sapiens
ttcgttttaatgaacatgcatcgtgtgtacgtgtgtgcgcgtgcatgtgtgtgtgtgtgtgtttatataatgag

SEQ ID NO: 6768129 - DNA, 103 bp, Homo sapiens
gtggggcaaggtgggccagtagagctgtgattggtgtctcactttgatgtgtaggagagagaacaaatcacaagtcattctctggaaaggagccatggtccac

SEQ ID NO: 6768130 - DNA, 60 bp, Homo sapiens
ggtctctctcatcaactctgacttgacagaacaaggcaggcaagattagagatgagcacc

SEQ ID NO: 6768131 - DNA, 57 bp, Homo sapiens
gggcaggctgtcctgggcctgccttcaatgataaggctgtgcacagggcacctgcct

SEQ ID NO: 6768132 - DNA, 70 bp, Homo sapiens
ctccttccaacaagagaaagagcccttccccttgaatctggcttgtcctgttacttgtttggatcaggag

SEQ ID NO: 6768133 - DNA, 57 bp, Homo sapiens
ggttgtgaggccacgtaggactgaagaaattgtttcttcctgtgtgtctcatcaacc

SEQ ID NO: 6768134 - DNA, 87 bp, Homo sapiens
agagcactgctgggtagttacaaccatgacacaagcaggttaaatcatgtgtctccctgtggggtggatgtgtcccagtacttctct

SEQ ID NO: 6768135 - DNA, 64 bp, Homo sapiens
gtttgatacaggccttctagatgatagggatttaaacttattttttagtttttctgtgttttgc

SEQ ID NO: 6768136 - DNA, 81 bp, Homo sapiens
gtccagccaagcagctccttgattcaaggccattgcattttctgagtatggcctgactgtccagccagggctgctctggac

SEQ ID NO: 6768137 - DNA, 57 bp, Homo sapiens
gaaagctgaaccaggaaccatgcgttgtttcagatgcattgatttttatcagctttt

SEQ ID NO: 6768138 - DNA, 92 bp, Homo sapiens
gaagacctcatacgattttcatcgctaggttggccttttaaattaggaagtaggtataactttatgcatggaaaaccattgtttgtttcttc

SEQ ID NO: 6768139 - DNA, 80 bp, Homo sapiens
gagatctttgagaattactggataaatgcaggatacaatgtatgacagcaaatatccatgagctcattcaaaagatactt

SEQ ID NO: 6768140 - DNA, 79 bp, Homo sapiens
tttaagagctatgtgccaagaaatggggaaagaagaccaaaatatatatttcttatcatatcatacatggctatttaaa

SEQ ID NO: 6768141 - DNA, 102 bp, Homo sapiens
tgaaatgtattctatgggctcatgtattcagcaggctcttcctgagcctgttaggaggcagccctgtgctggatgctgggcccaaaaacagttggcaagtca

SEQ ID NO: 6768142 - DNA, 71 bp, Homo sapiens
tgttggtaagcagcgtaaaagccagggagtgtctgctgcaagaatccctgggcatcacgttgcttccgaca

SEQ ID NO: 6768143 - DNA, 69 bp, Homo sapiens
catctgatgggaatataagagctctgatgggaaaaggatttggcaggtcttttacattcagtcatgatg

SEQ ID NO: 6768144 - DNA, 71 bp, Homo sapiens
gcaaccgggtggaattagaattgttctacatgtatgtgtcagaactctattgatgtccaactggtctcagc

SEQ ID NO: 6768145 - DNA, 91 bp, Homo sapiens
aaggatttttgcagaaatcacatttaaccctttcaatgtgtagtatgaaggaaggttttgtaaaaatgaaatgattaactgatagatcctt

SEQ ID NO: 6768146 - DNA, 62 bp, Homo sapiens
cttattagaatatcccagtgcagggatgtaccataatttctttcactggtcttctatttagg

SEQ ID NO: 6768147 - DNA, 87 bp, Homo sapiens
agtgacaaatcatgcttaatccttcttgtgttcattagcgtgacattaatcctgatagactcaattggggtataaggtgagagcact

SEQ ID NO: 6768148 - DNA, 72 bp, Homo sapiens
gggaccaggtctttggaacagcaatttttggaaggtttataatctaatgccgtctctacaagactccttccc

SEQ ID NO: 6768149 - DNA, 90 bp, Homo sapiens
gtcgacattttgaaatacctctgaagttcatcaactctgaccaaaatattttgatagaatttggggtgtgttatttcattgcgtgttgat

SEQ ID NO: 6768150 - DNA, 72 bp, Homo sapiens
aatgaactaaaatatgcattaactgtgtacattttaaatgtgcattaaatgtcaatgttggaaaggttcatt

SEQ ID NO: 6768151 - DNA, 76 bp, Homo sapiens
ggccatactcttttgtgtatgtactgctcttcatactataatagaatttggcagttttaacagaggtagtatggtc

SEQ ID NO: 6768152 - DNA, 78 bp, Homo sapiens
ttgtcctgatagctgaaacttcccattaattgtccaagaatactgtgctggtgggttagagtttgcgaagcaggacaa

SEQ ID NO: 6768153 - DNA, 79 bp, Homo sapiens
gccatttggatgctggactttcccaggaaagcaggagctactccagcaagatcctggcaagtcagaaccagcacttggc

SEQ ID NO: 6768154 - DNA, 78 bp, Homo sapiens
cagccaggggcaccctgcccagaaaagcctggcgtggtcccgcgtcctcaggcggtgaggaggggccacctgcagctg

SEQ ID NO: 6768155 - DNA, 101 bp, Homo sapiens
tggctgtgttgtgtgtcttgtttgatgtaaagatagtttctgtaatagttttgcagtttgattgttcatctttaggtcttcaattacaacctgcacatcca

SEQ ID NO: 6768156 - DNA, 65 bp, Homo sapiens
catgcattatggctgagtctctcagtggccaaatccactgaattagaacactcaataatgcactg

SEQ ID NO: 6768157 - DNA, 86 bp, Homo sapiens
cagaggagatgtagcatttagaacaccttgagacatgacattgtaaaatagcttgttttatgttcctgaagctatcttgttctctg

SEQ ID NO: 6768158 - DNA, 63 bp, Homo sapiens
gcaccagcttcaccagggccatggttgtgaagaagatcgagacccgtgatgggaagctggtgt

SEQ ID NO: 6768159 - DNA, 61 bp, Homo sapiens
gagggctgagactaaggccagatgtggtattttatctgcattctaccccttctctgccctc

SEQ ID NO: 6768160 - DNA, 66 bp, Homo sapiens
tcacgttcacctctccctgggatttatcttactttccaccacctagacaggaaggggcgaatctgg

SEQ ID NO: 6768161 - DNA, 66 bp, Homo sapiens
gcctgaagcacccggagctggcactgtagctctgctctgcatttgccactcccaggtgcctctggc

SEQ ID NO: 6768162 - DNA, 74 bp, Homo sapiens
gttttatcctttcattgatttaacaaacaagtactgaacacatacaaagtgctaatcaatgttaaggctgtgac

SEQ ID NO: 6768163 - DNA, 56 bp, Homo sapiens
tttccaccagagtttgatggaaacagagctgtttcctccattcagcattgtggaaa

SEQ ID NO: 6768164 - DNA, 76 bp, Homo sapiens
cttgcgtgtgtgtacctgcgcatttattgagctttcagtccgctctggatgtctgttggcaggagcacttatcgag

SEQ ID NO: 6768165 - DNA, 76 bp, Homo sapiens
gcctgagtgtttaatttggcccctgggctgccagttttacaacctttgtctggaagtaccagggaagcagtcaggt

SEQ ID NO: 6768166 - DNA, 83 bp, Homo sapiens
gttgatggcttgccttctgttcctatagaaagaggaaaacagagctcttgctaggtggaggcagagatggcacagcaagagac

SEQ ID NO: 6768167 - DNA, 105 bp, Homo sapiens
gctgacatatgccaattatattcagcaatattgttcccccagcctgttgggtcacgtaacagcctgagagaacaatgatgctgaattaacgattgcaatgaaagc

SEQ ID NO: 6768168 - DNA, 56 bp, Homo sapiens
tccagagagggcgccacctggagcccaaggcggttcaaatgcgcagcccctttggg

SEQ ID NO: 6768169 - DNA, 70 bp, Homo sapiens
aagttagcagctcaagtttcccaggtcagcgagagtaagattttctgattggcttacatgatgctttctt

SEQ ID NO: 6768170 - DNA, 67 bp, Homo sapiens
atgtctatttctgctgtagggaacggaagcaaagaaatctgatttgtaaccacagcggaatggacat

SEQ ID NO: 6768171 - DNA, 71 bp, Homo sapiens
aggaggaggaggaggagctgccatcatcccatccagagatgggatgacatgttccctttttctcatgtcct

SEQ ID NO: 6768172 - DNA, 103 bp, Homo sapiens
gggtgggggtgctgagagagagagagagagaacacaaagggccagctcccacttggagctcccctcgtttctctccattttgctcttcaggatgtccccaccc

SEQ ID NO: 6768173 - DNA, 63 bp, Homo sapiens
tgagcataaggattttgggttcatactatagcatgcatgaacttcattcctttttatgactca

SEQ ID NO: 6768174 - DNA, 117 bp, Homo sapiens
gagaagacagtgatggacatgcagtgtctccagccttgatgactcaggaggaggagatggaacagctcccctcaaaagctctcaggggaggtcacagctgtgtcctcatctggtctc

SEQ ID NO: 6768175 - DNA, 101 bp, Homo sapiens
ggctgataggtgcaaggtgcttcaaggagtcagattgtttgaatgtcacacatgtgacattcaaaatatttctgatgttgaaatgatctctaccttcagcc

SEQ ID NO: 6768176 - DNA, 130 bp, Homo sapiens
aaggtaaacattgtagttgattaataggaaggaagtcaattgtccatgtagccactgctatatgccatactgtacaatactgctttatttttataaacccccaaacaaagtctctctccatgttaatgtt

SEQ ID NO: 6768177 - DNA, 60 bp, Homo sapiens
ggggaagcgaagctctggaaggggcccaggtcccgattggggatccagagaggcttccct

SEQ ID NO: 6768178 - DNA, 78 bp, Homo sapiens
tccacctcttccaccttgtagtcttgggaatgctaaaagcaataaggccaggcatctgcagccgcgtggggacgtgga

SEQ ID NO: 6768179 - DNA, 77 bp, Homo sapiens
ggctttgaggctgggagaggccctgaagtgactcattttccatttgtttttcagactcatctcaagcttttatagcc

SEQ ID NO: 6768180 - DNA, 69 bp, Homo sapiens
tgggatacaagcagaggtagggtgtgcagtttctgagaagtgcattgcatctctgcttcaatcctccca

SEQ ID NO: 6768181 - DNA, 80 bp, Homo sapiens
gggattattgacatgcaacaatttggcatttttttgagggaaagaagcaagtctcaaatagttacatgctgtatgattcc

SEQ ID NO: 6768182 - DNA, 69 bp, Homo sapiens
ttttgcccagctccctgaagcctggtcttggttaactgggagcgtgtcgtagggagtggggttagggaa

SEQ ID NO: 6768183 - DNA, 58 bp, Homo sapiens
gtaagaaaggtaggctttctgaggtttaaggcagcagaaaagttcatacctttttaac

SEQ ID NO: 6768184 - DNA, 83 bp, Homo sapiens
ctctggcctagaaatgaattaactaaaattcactttatgccgaaaggataaaggtaataatagttgcattttctaggccaggg

SEQ ID NO: 6768185 - DNA, 106 bp, Homo sapiens
gctcccattgctgagggttcagaaaccaggcagtggaagctaaaatttcaggggaaatcgggcggaactattgcagatggtttcccccttgaatagagatgggggt

SEQ ID NO: 6768186 - DNA, 85 bp, Homo sapiens
gacagtgagatatatgagaattacaaatgagtcacattactgaaaaaaatttgctcagtttgataatttgaaatatgttttcttc

SEQ ID NO: 6768187 - DNA, 55 bp, Homo sapiens
gatagtgagttgattaggtgattggaaacaggcttcagctttgcaactgcacatc

SEQ ID NO: 6768188 - DNA, 71 bp, Homo sapiens
cccttcagtttcaggtttaggcacctggacagatggtcttgccctctccagcggcaaaaagcactgagggg

SEQ ID NO: 6768189 - DNA, 69 bp, Homo sapiens
gtgtcactggtggtgaacagttctggctttccaacatttaactgcaaaagctatgtcccaccatgacac

SEQ ID NO: 6768190 - DNA, 86 bp, Homo sapiens
gcataaggcactgtagcacccactacttttcgcttccgtatttttggattgtttggggaaaggggtgtgtgtgtgtgtgtgtgtgt

SEQ ID NO: 6768191 - DNA, 123 bp, Homo sapiens
atatgtattttccagtttgattgagctcagttttctagggttgtagcccccagttctgtttcattctgatatgctgctgcctcatacccagagaggagcaaacaagcctggagaaaatcatgt

SEQ ID NO: 6768192 - DNA, 62 bp, Homo sapiens
accaggggtgtcaacagcatttcccaacatcagagatggcttctttgtgacagctcttaggt

SEQ ID NO: 6768193 - DNA, 78 bp, Homo sapiens
atgaggggaggcacagagtaggtgcacacagtaggtgccgaatctgagtggttttattcgttcctctgtagacctcgt

SEQ ID NO: 6768194 - DNA, 63 bp, Homo sapiens
ctatgcctggaccccatctaccattatttaatttatttggtataggatgagggtcaggcatag

SEQ ID NO: 6768195 - DNA, 82 bp, Homo sapiens
cctactggatcagaatctctgagagtttggagatggagaaatcatttttactaaattcttcaggtaattttgatcatcaagg

SEQ ID NO: 6768196 - DNA, 79 bp, Homo sapiens
gttaggagcccagctgggcctgatttgcaggggctgctaactgtacaagtttcctacaaaaggccaagttgctcaaggc

SEQ ID NO: 6768197 - DNA, 84 bp, Homo sapiens
tagttactcttatcttttgagttctcaagatgtatgaagacataacacctgtatctaagaattccagagaaaggaggaagacta

SEQ ID NO: 6768198 - DNA, 65 bp, Homo sapiens
cagctctgaaggggttaaaatgcttcaccaatgcaaatagatttaattaatcctttcatcagctg

SEQ ID NO: 6768199 - DNA, 94 bp, Homo sapiens
tagtagcattgttgtttcactaagcagaaatataccaaggtgttaaaaatgctgttttgttcatctgttagtgaaactaaaaaacatattacta

SEQ ID NO: 6768200 - DNA, 60 bp, Homo sapiens
gggggcaggtgcccagggccagaggcttctgcttcaggctgtagtgggcacttggctgcc

SEQ ID NO: 6768201 - DNA, 106 bp, Homo sapiens
gaagtccaagatgaaggtatggcaagtttcacagggccatggaggaagtatctgttctaggcttctccccttggcttgtagacgggtatcttctccttgtgtcttc

SEQ ID NO: 6768202 - DNA, 58 bp, Homo sapiens
tcttgagggtctggatctgctgctggaaggccagctgcaccggctggaccactgagga

SEQ ID NO: 6768203 - DNA, 72 bp, Homo sapiens
ctgttgaggtgggtgtcaggtcagagcccatggactcctctacacagctttgagctggcagcttcccagcag

SEQ ID NO: 6768204 - DNA, 68 bp, Homo sapiens
agtggttgtttctctggtcttgagtgactgtgtccacagttcatttttttccggtaggaataactcct

SEQ ID NO: 6768205 - DNA, 61 bp, Homo sapiens
tgtgattagattgagtcaaccttgataatccccccatctcaagatctttagtttaatcaca

SEQ ID NO: 6768206 - DNA, 67 bp, Homo sapiens
gaaacatttgttgagtacttgctttggactcatgaaaaaagtaatgatgagtactttacaagttttc

SEQ ID NO: 6768207 - DNA, 59 bp, Homo sapiens
ttcttctgtcctaagtcaaagcaactggcaaggcctcctgcagacagggacagaatgga

SEQ ID NO: 6768208 - DNA, 73 bp, Homo sapiens
cttcatgctaaatagtttaggaggctaagtggtttgagaataaggcaaagtgatttcttaaaaaggcatgaag

SEQ ID NO: 6768209 - DNA, 71 bp, Homo sapiens
gcatgatgtttgggctggtttgccatgcccccaggtctcagaggggtatgcaggtgggcctagatgcatgt

SEQ ID NO: 6768210 - DNA, 114 bp, Homo sapiens
ggcggcggcgggcgaggcggcgcccacagcactcgggactcagctgccggagggacaaactaacttcctgagcgcgggacctgaggctggcgcggccgggagccacctgcagcc

SEQ ID NO: 6768211 - DNA, 61 bp, Homo sapiens
agacaggagagggaactgccggactggcaggacaggaatgcgcaggccctctctctagtct

SEQ ID NO: 6768212 - DNA, 70 bp, Homo sapiens
gtggttgagacagaggctggctgagtcaggccttggggccttgctgccttcccaggcctttgctggctac

SEQ ID NO: 6768213 - DNA, 74 bp, Homo sapiens
aggaaccaccgcggagtgatggagaaactggtctaagacaagcgacagcgttttgttatccgccccggtggcct

SEQ ID NO: 6768214 - DNA, 74 bp, Homo sapiens
tctgagggtgtggggggaagcatgggtctgcccggactgaagctgggcaggtgggaaccctccccaccctgaga

SEQ ID NO: 6768215 - DNA, 57 bp, Homo sapiens
accagaggcctctagggcccctcaggaccttgtcttgcccctggccaggcccctggt

SEQ ID NO: 6768216 - DNA, 56 bp, Homo sapiens
taaggaaggggaaagacatgtctttgactaggatgatatgtgtttcaccatccttg

SEQ ID NO: 6768217 - DNA, 76 bp, Homo sapiens
cctgccaggggctcctagactgtcagagtgtggagtggttgctgcatctgctggcatctctagcccacctgtcagg

SEQ ID NO: 6768218 - DNA, 79 bp, Homo sapiens
aaagacttgagctacacactaggcatggggcaaagggatggtgctgctaccagtgccaggtgtggtagttgatgtcttt

SEQ ID NO: 6768219 - DNA, 55 bp, Homo sapiens
gtttccaggcagggtgattctcctctgctggatggagaaagcatgcagtgggaac

SEQ ID NO: 6768220 - DNA, 108 bp, Homo sapiens
tgcttccctgagttaattttatgccaggtgaggtcttttatagtgtgtcagtttgtttgctggaccctaagaagaccttctggcatgtaataccgttaactcacagta

SEQ ID NO: 6768221 - DNA, 102 bp, Homo sapiens
atagagccaatgaatgtttgactaaaggtagctaatgtgtccctaagcccagcaacaatctgacaggaagctcactcctggtcaaactactcttggaaatgt

SEQ ID NO: 6768222 - DNA, 76 bp, Homo sapiens
gaacatttgtatttgaacaagatccttggtgtgtagttcagtcttgcagtatacaagcttttgtgtataaatgttt

SEQ ID NO: 6768223 - DNA, 101 bp, Homo sapiens
aggtgagaaaaatgtacctggtccttacgtcattgctttatgtcaaattgaaatgagaagtaaaacgctaaggaaactaagtaaacatcagaaagtcatct

SEQ ID NO: 6768224 - DNA, 90 bp, Homo sapiens
taaatttaaggcccatcagttttatctgacaaaatagttattatctatgtcaaactttttgtcagataaaacggatgagtcttgtattta

SEQ ID NO: 6768225 - DNA, 72 bp, Homo sapiens
gtgactagaaagagaggccagaaagtatgccacctttagagaggggtcatgtaatcaaggcttagttctcac

SEQ ID NO: 6768226 - DNA, 74 bp, Homo sapiens
gagtcacggtaatctaggactcccaggctttcaggaagcttaagccctggcccaaccttgattttacgtgactt

SEQ ID NO: 6768227 - DNA, 63 bp, Homo sapiens
gtggataatacctttttgatgttgttttgaagagttaatgaaataatttagaaggtattccat

SEQ ID NO: 6768228 - DNA, 61 bp, Homo sapiens
ttaagaattgtttgcagtgggctttgcactttacaaagcaccatcagatgcaatatcttaa

SEQ ID NO: 6768229 - DNA, 90 bp, Homo sapiens
gattataaagttaaggtgagtcaatcttttggagtttatgagcatataagcaatgacactcgaaaaattgatgctttaatgaaaataatt

SEQ ID NO: 6768230 - DNA, 128 bp, Homo sapiens
gtccattccatgagaggcatctttcctcagtgggcccatggcgtcctctgcacagctccatctttgctcctgacccctggcatgggagtcatctccactgagccttggtgcttcactggactctggac

SEQ ID NO: 6768231 - DNA, 101 bp, Homo sapiens
ggcggctgacagcggtcatttgtcatcactgagctgcccaaactcctcagactgcactgcggatggctgcttagggtgacttatggccctgtcgggctgcc

SEQ ID NO: 6768232 - DNA, 80 bp, Homo sapiens
ccaggtgtccggttcctcggctgagggctcgcttgactccatggtctaggcagcagaggttgaggaaaggggtgctctgg

SEQ ID NO: 6768233 - DNA, 57 bp, Homo sapiens
tgatcactatgtagataatttgggtcatgttagttagcctggattactgagtggtca

SEQ ID NO: 6768234 - DNA, 71 bp, Homo sapiens
cacaccctgacatgacactgcacaccaggaaaacaaggtgtgcagctctgaacagtcatgaaggtggtgtg

SEQ ID NO: 6768235 - DNA, 70 bp, Homo sapiens
tctttaggctaggtgcttagacattgaactgctgaggcgaacagtgtctgcctatttttcaagcctctga

SEQ ID NO: 6768236 - DNA, 96 bp, Homo sapiens
tgttaggtagaattcagaatatttgttttacatggcaacaattaaactatatattgctatctatttaaaatcgtgttctgcccattctctctaaca

SEQ ID NO: 6768237 - DNA, 60 bp, Homo sapiens
gcactgaagacaaagtcaggcccagagtcaggcgctcttttgtcttgtgtctccagcagc

SEQ ID NO: 6768238 - DNA, 124 bp, Homo sapiens
ggaccagcctcagcaaaaacaaggagaaacgggctttttaaatatatatatatatatatgtatgtatatgtatgtgtgtgtgtatgtatgtatgtatttggggcaatattgttgaagtagggcc

SEQ ID NO: 6768239 - DNA, 61 bp, Homo sapiens
cactttgttaatttggtatggtggtgccacacattatcactgtacagcattaacaaggctg

SEQ ID NO: 6768240 - DNA, 80 bp, Homo sapiens
ggggcctgagataatagcaggcaggttttgaaaccagtagacttgactttaaaggttctgctgcttccaagttaggcctt

SEQ ID NO: 6768241 - DNA, 63 bp, Homo sapiens
aaggtaaatcggaactcttggaaataaggctaccagcaggaggctctaggagatctgaacctt

SEQ ID NO: 6768242 - DNA, 81 bp, Homo sapiens
tgagtttgacaggatcatgaaccactggaattccagtccaccctggggaaacatgttgttcagacctgtgatatatgctca

SEQ ID NO: 6768243 - DNA, 57 bp, Homo sapiens
tccaacttctgcaatcagtttgaatctatattctgaatcagaaaagcaggacttgga

SEQ ID NO: 6768244 - DNA, 67 bp, Homo sapiens
tctgactgactttggactttattctttaaacaaattgcagagaatagagaaaaaggttatttacaga

SEQ ID NO: 6768245 - DNA, 61 bp, Homo sapiens
ttctttgtctggcagctgtgagaactttttaccccatcccctcacagaaacaaatagagaa

SEQ ID NO: 6768246 - DNA, 72 bp, Homo sapiens
tctggccaacagtcttgaaaacagtgacccagtagttgggaaactgaattcaggactcttttagcaagtaga

SEQ ID NO: 6768247 - DNA, 56 bp, Homo sapiens
gtctttgctgatccagaaacccagagctgagctttggggttggcaagagcagagac

SEQ ID NO: 6768248 - DNA, 71 bp, Homo sapiens
gagagtgctcactgcagtcttcatcaaccaacttctaagtgggtgtcaatgaggagcagcctcacgctttt

SEQ ID NO: 6768249 - DNA, 129 bp, Homo sapiens
agcacgttcgcgtcccaggtttctgtccgctgggttttcctccgcctcactcgccttctccccagcggcgcgcggaggagctgggctgagagggtcgcggggagccgggtcggccgcggctgggacgct

SEQ ID NO: 6768250 - DNA, 86 bp, Homo sapiens
tgcctgctgcccccttactgataactgccagaggacaacattatgtttcaagtcagtagctaatcatgagaggctggtagttggta

SEQ ID NO: 6768251 - DNA, 75 bp, Homo sapiens
gtctatgtaaagttgttgcataaagtaggaaatatataaaccgtatgtctaatatattcaacagcttatatgagc

SEQ ID NO: 6768252 - DNA, 106 bp, Homo sapiens
tcccccctcaaataccctagtggctccttcaatctgggccacttcctcaggggaaacaggatgtcttctccaggcttgggccaggtctctggggtctggggtggga

SEQ ID NO: 6768253 - DNA, 55 bp, Homo sapiens
gtacctactacctatttaacatattaaccactatggtaggtaggtaggtaggtat

SEQ ID NO: 6768254 - DNA, 64 bp, Homo sapiens
ttacagagaggtgacccttgggcaaaccagtaaaacttgtgtgccttggtttcctctaatgtaa

SEQ ID NO: 6768255 - DNA, 130 bp, Homo sapiens
ttttgttgttttgtttttgcttttaaaatgaaggactctggtatttcactcttgaacagtaatttctctgtagcagtggttttgagattcagggtttttctatttgttagggagaaaaaagagccctgag

SEQ ID NO: 6768256 - DNA, 64 bp, Homo sapiens
ggtcagtctctcccgagtgttgtagtggggagagttgacccagatgatgcggatgagactgatc

SEQ ID NO: 6768257 - DNA, 55 bp, Homo sapiens
cttcccagacggggtggcagccgggcagaggctgcaatctcggcactttgggagg

SEQ ID NO: 6768258 - DNA, 96 bp, Homo sapiens
tagctgaatcaggacacagatcgctctccgtgagtgttgggaaaggaaggtctgcacactcaaagcagggagtgttctctttatctgaggtggctg

SEQ ID NO: 6768259 - DNA, 71 bp, Homo sapiens
ggccccactggacagactgtcccaccacatggagtggctcctcaatggaggaacagtgtgatctgggggtc

SEQ ID NO: 6768260 - DNA, 81 bp, Homo sapiens
gctttcttttattctacatcacttaacatgctaatttcttagtaaataattaagtgatgggtaattttaggtaaggaaagt

SEQ ID NO: 6768261 - DNA, 68 bp, Homo sapiens
gtaggaggcattcttgtcagtggggtcagggtacaggccactggccctgtcagcacagaatccactac

SEQ ID NO: 6768262 - DNA, 57 bp, Homo sapiens
ccctctgcctgcgccctggtgtgtgccttggctagccagggtccctggggcagaggg

SEQ ID NO: 6768263 - DNA, 55 bp, Homo sapiens
gacccatataggaccctccaaagacattacatgtcccagggctctctgctgggtt

SEQ ID NO: 6768264 - DNA, 65 bp, Homo sapiens
ggatttatgcataagacacgcacaaggctttactttttaattgtgatttacttctggataaatcc

SEQ ID NO: 6768265 - DNA, 59 bp, Homo sapiens
gtagactacttagccatcttatctgaaggtatcaagcttaagttggcatgagtggctac

SEQ ID NO: 6768266 - DNA, 112 bp, Homo sapiens
gggaaaaagctgagtgttgggagggaaactgaggcagggcttgcatttgtcctctggaatgtgtctagacttgctggctccttgcttctagcccttctagactcctattccc

SEQ ID NO: 6768267 - DNA, 84 bp, Homo sapiens
ctgaaacgtgaagctaatgatacatgctccacaccctttgcggttgtggtggtgaatattaattagataagcttcaaaatgcag

SEQ ID NO: 6768268 - DNA, 79 bp, Homo sapiens
agtagtcagataatcttaagctgaattctctcccctgagttaaagttagtggaagtaatgtcttaagattctgaaaact

SEQ ID NO: 6768269 - DNA, 57 bp, Homo sapiens
tgcaggcatgtacacatgttctctggacaaatccatgagcctgtgtacttgcctgtg

SEQ ID NO: 6768270 - DNA, 62 bp, Homo sapiens
ggtgttagcagttttcttttggttgggcagaatcccagttggcacagacctgctgcgatatc

SEQ ID NO: 6768271 - DNA, 76 bp, Homo sapiens
aggaagctgatctcacttcttaggagactgaaaaaaatacatctgtgtcattctcctctggaaaaggcagtctcct

SEQ ID NO: 6768272 - DNA, 60 bp, Homo sapiens
tcctggttttcctgggacaggggttactgggatgtgaacctttccatgataaaaccagga

SEQ ID NO: 6768273 - DNA, 74 bp, Homo sapiens
cgccacgtgacgctccgccctctttgagatcacatgatttaactcaagtcccgcagtgttcctccgcgctggcg

SEQ ID NO: 6768274 - DNA, 69 bp, Homo sapiens
acttctgataccttgcaggatccttattattattagacttagagattcctaaagtaagatatcagctgt

SEQ ID NO: 6768275 - DNA, 65 bp, Homo sapiens
tctctaagtgggtactggggcttggtggggcgggtcccagagcctaaaacgactccactggaaga

SEQ ID NO: 6768276 - DNA, 56 bp, Homo sapiens
atacagtaatttgtaactcatcatttaggatgagttgggcagaaacttactagtat

SEQ ID NO: 6768277 - DNA, 71 bp, Homo sapiens
gcagggcttgcagcagctagactggcagcacacggggacacagcagctggactggcagcagcagggattgc

SEQ ID NO: 6768278 - DNA, 97 bp, Homo sapiens
ctgctgggccagcatccgattgccagccagaaacgtcacactgcccaggatggccaggtacttcaaggtctggaacatgttgagctgagtccagtag

SEQ ID NO: 6768279 - DNA, 64 bp, Homo sapiens
gtgaggcaggcactgttatcagcaccattcctactgagaattgtgcaggacatgtctgccttat

SEQ ID NO: 6768280 - DNA, 55 bp, Homo sapiens
aggctcgctcatctcagccgccagaagtgtcatcccagggaaggtgagcgaggct

SEQ ID NO: 6768281 - DNA, 70 bp, Homo sapiens
ggattttatcaatctatgtcatcatgacctctgaaatccaacctttggtcaggagcatatattgatgtct

SEQ ID NO: 6768282 - DNA, 61 bp, Homo sapiens
ccccaggacgtggccctcataggggggttgagcttctaggtctgaggccgcattctggagg

SEQ ID NO: 6768283 - DNA, 63 bp, Homo sapiens
ataccaccatctatgaaaggtaatagccaccgctattgacacatctggccatttggtgagtat

SEQ ID NO: 6768284 - DNA, 74 bp, Homo sapiens
ctttcacaaaacactattttctggaaaataatcttatgcttgaacactttcagagttgagctgttttgtggtgg

SEQ ID NO: 6768285 - DNA, 94 bp, Homo sapiens
gcctagaaggtagataattaaggtgttcaaactatgacttcagctaccaggaagtgttgatccaagtggtttgtatatctctctctttctatgt

SEQ ID NO: 6768286 - DNA, 69 bp, Homo sapiens
ctcagtgtggctagaagtgtcttgttgagggcaaagaccaaacacgaggtctctggctactaggctgag

SEQ ID NO: 6768287 - DNA, 73 bp, Homo sapiens
aagtaatttggcctgcctcacttgcttatttgaaatctgtggagagtgcgcttgtaggctaggccttatactt

SEQ ID NO: 6768288 - DNA, 55 bp, Homo sapiens
tcagactggattttcacgttttcaaatttgaaactcatggaaaatgccagactga

SEQ ID NO: 6768289 - DNA, 58 bp, Homo sapiens
ggtgataagagcatggccccggggcccggcgccttggcccccggaacgctctgtgacc

SEQ ID NO: 6768290 - DNA, 68 bp, Homo sapiens
ggctccacagtggaggcactaattggatttcattaaagtgaaatagatttcctagcattggaagagct

SEQ ID NO: 6768291 - DNA, 56 bp, Homo sapiens
aagtgttaagaatgctctggcggtcctaggtgaccgacacagtaatcttggggctt

SEQ ID NO: 6768292 - DNA, 67 bp, Homo sapiens
tgaattcacctgaaagtctggagtccagctgactgctgctgaatccaggcccactcagctgaaatca

SEQ ID NO: 6768293 - DNA, 72 bp, Homo sapiens
tttgaaagtcctaggagagtcccacccttaatctctttgaggcctctatgagtttccatagcactttacaaa

SEQ ID NO: 6768294 - DNA, 60 bp, Homo sapiens
ttgttttggaaatacagcagttactttcttgtggagaggatgccttatgtttccacacaa

SEQ ID NO: 6768295 - DNA, 57 bp, Homo sapiens
ctggaaggagaaggaggctgtgtccctctggctggcatgtttcccagtctccttcag

SEQ ID NO: 6768296 - DNA, 66 bp, Homo sapiens
agtcttgtctggatgctttataggtattaactcgtttaatgcctttaaccagtctagacaggtact

SEQ ID NO: 6768297 - DNA, 81 bp, Homo sapiens
gaggattcaagaggagaaaggctggctttgaagatggagaaagtgccacaaagcaagatgcagtttctcctctagagcctc

SEQ ID NO: 6768298 - DNA, 60 bp, Homo sapiens
ccagctcatctcagtgaaatgccctcagtccaatgaacacattctcaggagatgccttgg

SEQ ID NO: 6768299 - DNA, 66 bp, Homo sapiens
tcatcatctgcaagctcatgtcagatatttaatgctcagcatgagtatatgatgcagcgttgatga

SEQ ID NO: 6768300 - DNA, 95 bp, Homo sapiens
tgaacaagctactgacaaatgtgattttattgaatcccaaccctctcttctgtaggttgtcctggaggttaatagagttacttctagccagttca

SEQ ID NO: 6768301 - DNA, 129 bp, Homo sapiens
ccactgggtcagtgccagcttctgcaggatgaccatgcacagcagtgagttcagtgccttctcatcctctgcagctgacagctgctgctgcgtctcctccagctgtgatgtactcatttcacctggtgg

SEQ ID NO: 6768302 - DNA, 91 bp, Homo sapiens
agaattgaatgtcagcctgtaaaaaccttcattattttgttcaacaaagatttgttaagcaagcaatggagggtaggcagacacactttct

SEQ ID NO: 6768303 - DNA, 73 bp, Homo sapiens
atgggatcatatggttcatagtgtttttgcagtgcatttttcacgtatcaatatattgtggccatctttccat

SEQ ID NO: 6768304 - DNA, 55 bp, Homo sapiens
tgcagggattagaggccggggatgcggagaggggcagcgcctggttatccttgca

SEQ ID NO: 6768305 - DNA, 69 bp, Homo sapiens
ggtctgagatgcgtgcagcctgacaatttgcatttctaagtattcagctactgctgctggttccagacc

SEQ ID NO: 6768306 - DNA, 80 bp, Homo sapiens
cattctattttgagcccctgacatctattttcttgccaaaactgctgcacaattggttgtagaggggtcagagaagggag

SEQ ID NO: 6768307 - DNA, 81 bp, Homo sapiens
cctgcgacagagagctccgtgcctggctgccagcagtatctgagctgattggcagaaggaggctggggtttgctgttcagg

SEQ ID NO: 6768308 - DNA, 70 bp, Homo sapiens
aggagattggtatggatgcttaaggtttaatgagttaaacgtgaaatctcattatttataccataatcct

SEQ ID NO: 6768309 - DNA, 77 bp, Homo sapiens
gggaagcggcggcacgggaggcgtcctcgggagccggggtctcacggtccagggaacgcccccgccgccggcttgct

SEQ ID NO: 6768310 - DNA, 62 bp, Homo sapiens
caagcaatgctatactcattatgctcatggaaaattatgagacaatgagcttaagcagcttg

SEQ ID NO: 6768311 - DNA, 95 bp, Homo sapiens
agatgtaagtttttattgttctgattttagcttctagaacaatcagtgctatgactgattgggctaataactgattttaggaaaagacaaaatct

SEQ ID NO: 6768312 - DNA, 83 bp, Homo sapiens
ttgctggtttcatgaggtgggcttggtgccaacatgcagaaaggatactacaggttggattccatagtctacagcatgagcaa

SEQ ID NO: 6768313 - DNA, 65 bp, Homo sapiens
ctgaagcaattccacctgtgtttctagggggaaccgaaccctgagaaacctggtgcaattaccag

SEQ ID NO: 6768314 - DNA, 89 bp, Homo sapiens
ggagtttcggtcttgttgcccaggctggagtgccatggcctgatctcggctcaccgcaacctctgcctcccaggttcaagcgattctcc

SEQ ID NO: 6768315 - DNA, 60 bp, Homo sapiens
acaggtacatgttccagatacgtaacttgaaacttaaagatgccttgggacagtgcctgt

SEQ ID NO: 6768316 - DNA, 77 bp, Homo sapiens
gacctggggtttgggatggggccggtaccagggggctgtccccagccctcagcacactcccatctaattcccaagtc

SEQ ID NO: 6768317 - DNA, 91 bp, Homo sapiens
tgattgaatggcaatgttgctgtctttttagagagtaggatttaaaattttgagttgctgaaaaggcttgcgtgatgtgctagaaaaatta

SEQ ID NO: 6768318 - DNA, 65 bp, Homo sapiens
agaatgatggagtcttctgagttattggatagtatatactgcaattttcagaaattccaaatttt

SEQ ID NO: 6768319 - DNA, 129 bp, Homo sapiens
gattaagccttctttgaaagcacagtttaggacaattcaggagggtctctattttcctccagttggctggcagctcctgtggcagctcttctgggttctgtgtgtaggaattggcggaggctatgatac

SEQ ID NO: 6768320 - DNA, 59 bp, Homo sapiens
agtttttcttaactttagtttactcatctatattgaggtcctgatgttccagagaagct

SEQ ID NO: 6768321 - DNA, 58 bp, Homo sapiens
ctggaattcttattctgacttcagagggtccatcttcttagtcttcttagaatttgag

SEQ ID NO: 6768322 - DNA, 63 bp, Homo sapiens
actgcaacccacaggtgtctatacctgacaggtataaactatgacatccatgtgagtggcagt

SEQ ID NO: 6768323 - DNA, 77 bp, Homo sapiens
agcctctcttgtaatgtataagatggacaaggttttacaaacagacattgatctgtcaggttcatccgcaaaaggct

SEQ ID NO: 6768324 - DNA, 114 bp, Homo sapiens
aagcttacccaaggtcagaattcattcaagatgcattggtgtctttttgagcattaatttccaccagttgtgcacattctaggactagtagcggtttgagtttcctggtagctt

SEQ ID NO: 6768325 - DNA, 63 bp, Homo sapiens
gagagggttgcttgagcccaggagttcaagactagcctgggcaacatagcaaaacactgtctc

SEQ ID NO: 6768326 - DNA, 86 bp, Homo sapiens
tgtctttggagaatatttttagctttcctcactctgatagttgcttctgttttaggggtttgctgcagtattgatcccaaagaaca

SEQ ID NO: 6768327 - DNA, 63 bp, Homo sapiens
agggtggcagagaggaggtagtttagagaagtctctacactatcttaatttttctgtaaacct

SEQ ID NO: 6768328 - DNA, 65 bp, Homo sapiens
gagggcacagcctaaagcctatgggagacaggagctatggatctataagtaggggcctgaccctc

SEQ ID NO: 6768329 - DNA, 78 bp, Homo sapiens
gactgttaggtggaagcaaccctggcaggaggtgccttggaatctcacagcccctggaagggggcttccccaaatgtc

SEQ ID NO: 6768330 - DNA, 78 bp, Homo sapiens
gtcttccaaagtggctgtactattttttcattcctatcagcaatgaatgagacttcctggtactgtcagtttggggat

SEQ ID NO: 6768331 - DNA, 60 bp, Homo sapiens
agggtggttggagtggatgttgagggccaccccaccatatccaccattctgcaccttcct

SEQ ID NO: 6768332 - DNA, 81 bp, Homo sapiens
ccagctgtgaccagttattatcttagagagacagtgtagcaactgcctgacaatcacctgatggtcactggacattgctgg

SEQ ID NO: 6768333 - DNA, 84 bp, Homo sapiens
ggaaataaagaagctgcgtggtatgtgaactatctctataaagataaactgtacaccttactcataataacagcatctatttcc

SEQ ID NO: 6768334 - DNA, 59 bp, Homo sapiens
gaatgctggtgttcagaattttttgtgtattgacatggattctgcatgccatgctattc

SEQ ID NO: 6768335 - DNA, 56 bp, Homo sapiens
gtgcccaccacgggctgtggcggagctcccgccccctacgccctaatggtgctaac

SEQ ID NO: 6768336 - DNA, 62 bp, Homo sapiens
cttccacagataaaaacagaggttctgggaagatacatgaattcctggcctgtatgtggaag

SEQ ID NO: 6768337 - DNA, 129 bp, Homo sapiens
tcccatggcagaagggactttgtagatgtggatgagtcgccgacctttggtggagatggttctggattatctgggggcgcacagtcaccacaaaggttctgagaaggagatggcaggaaggtcagagga

SEQ ID NO: 6768338 - DNA, 61 bp, Homo sapiens
agtgacaggaccaggtctggaacctaggtttccatactcctagttcaggtctcctttcact

SEQ ID NO: 6768339 - DNA, 90 bp, Homo sapiens
ccagtgcaggggcttctaagtgcagttaagtttagatttggttttaaagaagggacagactgcctctggactgcagccctgaaaaactgg

SEQ ID NO: 6768340 - DNA, 121 bp, Homo sapiens
gctgtcgagtctgctcttaggaagaggagctgagctttggccctggaggttactggggggaaagtggccagtacagcccaggccaggctggctccgagaaagagctaaggcgggggacagc

SEQ ID NO: 6768341 - DNA, 94 bp, Homo sapiens
gtatcctcttccgagtcatatttagcttgtggaattgcagaactgtccccagttatttcagtcattccaggagctaactgtggtctcagtttac

SEQ ID NO: 6768342 - DNA, 78 bp, Homo sapiens
ttttcatttctcactgtgtcatgccaattatatggctggtcctaagcagtgtacatgacagagagagccaattggagg

SEQ ID NO: 6768343 - DNA, 56 bp, Homo sapiens
tccacatcttgtgttcatatgtgagagtttccctggcatatatacctagaagtgga

SEQ ID NO: 6768344 - DNA, 107 bp, Homo sapiens
cataccagagactcccctaatttgcatactggtgtatattcaagtgttgatttcaaagcagcctaacacttaagcatgaagtataaaattaatgagttgaacctgtg

SEQ ID NO: 6768345 - DNA, 67 bp, Homo sapiens
ctgattctattttgccctggtcccccgcaggctcgcacaggcttccctggggaccgggcgttgtcag

SEQ ID NO: 6768346 - DNA, 102 bp, Homo sapiens
gttgggtgtagtggctcaggcctcaggcctgtaatcccagcactttgggaggtcaaggtgggaggatcacgaggccaggagttcgagaccagactaaacaac

SEQ ID NO: 6768347 - DNA, 78 bp, Homo sapiens
tcagggcagaatccaaagaatttttaagaggatgtgaaaaaaatgactagagagagctttccttggattgtgtcttga

SEQ ID NO: 6768348 - DNA, 67 bp, Homo sapiens
tgcctctgagtttggagaagagccttcagccctgaggattagcctgctgcttttctccttcaagcca

SEQ ID NO: 6768349 - DNA, 111 bp, Homo sapiens
gagattacatgctttgttttaatactttggtcactattattggctttgtccttcttgatacaattctaaagtacatatggctaaatagtggaacaatgtcttgtcttgctc

SEQ ID NO: 6768350 - DNA, 80 bp, Homo sapiens
gttcagagggtgatccagaggtgtcttgagcctgggatgtgaggaggtagggggtactggctggagccccacatttgaac

SEQ ID NO: 6768351 - DNA, 88 bp, Homo sapiens
gtggtcgggacctccagggggcggatccggggcctcccccgtggccggggtggcccatcacgtttcgccttcgtgggcttgcggccac

SEQ ID NO: 6768352 - DNA, 75 bp, Homo sapiens
ctaagttgcatgaggctctctctcctcctggttttctgacctagaaggaaaacctgtcttatgtcccctgcttgg

SEQ ID NO: 6768353 - DNA, 56 bp, Homo sapiens
tttctaggcacagtgtcttccccggctgaagtgggaactgcacctgtgtttgggaa

SEQ ID NO: 6768354 - DNA, 55 bp, Homo sapiens
tctgattccagtgaccctaggatgggcaagagccgcagtcaagactgtagtcaga

SEQ ID NO: 6768355 - DNA, 127 bp, Homo sapiens
aagctaagtagtcttaaaatagacaaaatagaaaagctatttgctcacctgatcatgtttctcaatatggtgtcaggatgacaagtgctttcatgcatctcatttgagttttaagttgtctcagctt

SEQ ID NO: 6768356 - DNA, 61 bp, Homo sapiens
gaaaggcagacaaggacacagtgggccacaggactggccttctgtgcatttgtctcccctc

SEQ ID NO: 6768357 - DNA, 90 bp, Homo sapiens
gcatttgctagtatctctagtgcaatgatgaatacaagcaaaacattgaatgtatattttgtttcttattcatttggattatgcgtttgc

SEQ ID NO: 6768358 - DNA, 58 bp, Homo sapiens
gcctcctatggggccatcgcagctgccgtgctccagctgccctcagcctctgggaggc

SEQ ID NO: 6768359 - DNA, 61 bp, Homo sapiens
ggaaaacactttgcagtgaagcaaccacttttaaattgctgtctgattcagggtgatttcc

SEQ ID NO: 6768360 - DNA, 79 bp, Homo sapiens
ggacaaaggtcaatcatggatcctgggtaccagtcaaaagatgagggaagggtacagaggaggggattttaatatgtct

SEQ ID NO: 6768361 - DNA, 73 bp, Homo sapiens
agacagaaacactttgggcacagtgaggccaggagggaccccacttggcgctgcaaatggtcagagtctgtct

SEQ ID NO: 6768362 - DNA, 56 bp, Homo sapiens
agaatgtcaacagcctctcaagctgggtcctgcgttgattgcttttgtgacattct

SEQ ID NO: 6768363 - DNA, 61 bp, Homo sapiens
ctgctgtgctatacagattgtactgcacaattcagctaacagccattcatatagacagcag

SEQ ID NO: 6768364 - DNA, 56 bp, Homo sapiens
ggcttgtggaggtgacgagtgtgctttgggtcaagatggcttggtttccacaaacc

SEQ ID NO: 6768365 - DNA, 62 bp, Homo sapiens
catttccacttctgaaaactggaataatagcacctgcttcacacagtttttaggaagaaatg

SEQ ID NO: 6768366 - DNA, 78 bp, Homo sapiens
tcaacttgtacaaagtcctgcttcatactcggaaggcatttatttgcttatgaaggatcaggtacttggacaggtaga

SEQ ID NO: 6768367 - DNA, 76 bp, Homo sapiens
actgcagttgggacaaagactccttgaattcagagctgtgctttgaaattcaaggagtcttcgtcccaattgcagt

SEQ ID NO: 6768368 - DNA, 61 bp, Homo sapiens
ctgaagtgccagacatttgttaaaattagaggtagtaaaataacacattttggtactttgg

SEQ ID NO: 6768369 - DNA, 63 bp, Homo sapiens
aatcattctcatgccagtttcctgtgaaggacacgcatcttggaatggcgtgaagaggagatt

SEQ ID NO: 6768370 - DNA, 73 bp, Homo sapiens
tcttttccagtggaaccttcttgtcttgtgtctcattacctcaagtcccaagatttccaaccctgggtaaaga

SEQ ID NO: 6768371 - DNA, 83 bp, Homo sapiens
ggactatctaataagcatgattaccgggagcatgtcagaacattctgtgtatccatggtggtcaatgacttaaatctacatcc

SEQ ID NO: 6768372 - DNA, 84 bp, Homo sapiens
tgatgatattttagcaagttctctgagagaaaagttttttaaaatctcttttttcccccaacatggaaaatgctgacatcctca

SEQ ID NO: 6768373 - DNA, 59 bp, Homo sapiens
tctattccttgaggcttgctcagtggcaaatgctcaccattggaggcctcaggaaaaga

SEQ ID NO: 6768374 - DNA, 58 bp, Homo sapiens
gagcactgcctctgtggagaatgtataaagagatacaaaggaacacaggcatgtgctc

SEQ ID NO: 6768375 - DNA, 79 bp, Homo sapiens
aaggagtatgccttttgtgctgaagatccagagcaggggttgccaacttctctgaagagtcagacataacaaattcctt

SEQ ID NO: 6768376 - DNA, 75 bp, Homo sapiens
tggtttgtccctagagaatcaaattttttcttcactcccatatttcagaacttgatacatttttaggataaacca

SEQ ID NO: 6768377 - DNA, 99 bp, Homo sapiens
gaggcaggagaatcgcttgaacctgggaggcggaagttgcagtgagctgcgatcgcgccactgcacttcagcctgggcgacagagtgagacatcgtctc

SEQ ID NO: 6768378 - DNA, 82 bp, Homo sapiens
gggcagacacacttctcctagctctggccagcctggcactgccagtcccagccaggcagctgggagggtgcctgaactgccc

SEQ ID NO: 6768379 - DNA, 77 bp, Homo sapiens
catgtcctactcatttttctctcacacttaccagtgctggcactggaaggaaagaatgaaaactgagtgaccacatg

SEQ ID NO: 6768380 - DNA, 68 bp, Homo sapiens
gtggccaaatcatgtcaaaggcacacacttccaaaggagtccttcctgttgacgttgaccttggccac

SEQ ID NO: 6768381 - DNA, 71 bp, Homo sapiens
aatatggtcagtaatgattctgaataatggttatgtagcagatgccattaagtattattaatgattatatt

SEQ ID NO: 6768382 - DNA, 68 bp, Homo sapiens
gtgcacatgaaagttgggggctataggcctgatgggggctcaggccaaacccagctctcgtggtgtgc

SEQ ID NO: 6768383 - DNA, 55 bp, Homo sapiens
tcctaaggagattgttaaagctatatgaaaaatgtaagctaaaaatctccttgga

SEQ ID NO: 6768384 - DNA, 56 bp, Homo sapiens
gaatgaaactgagtaacagagatcaccagataaggtggtgttactgagttatgttc

SEQ ID NO: 6768385 - DNA, 73 bp, Homo sapiens
ttcagtctaaattatctttctcagatttactacctaccactggtgaggctgacaaaagatgaggttagctgaa

SEQ ID NO: 6768386 - DNA, 73 bp, Homo sapiens
ggctctcatttgctgaggccttcagaggcatgagctcatgccatccttgcaaacctccagcaaaatgagtgtc

SEQ ID NO: 6768387 - DNA, 57 bp, Homo sapiens
tcagtgtcaggcgccccaaagcatttattctgtgccaggccctgtgctggatgctga

SEQ ID NO: 6768388 - DNA, 104 bp, Homo sapiens
acaattactcagaaatagaatgcttgagataccagaatgcatgcatatcaagtaataaatgcatgcaggatgtcaacgcatcctaggctttcaaataaaattgt

SEQ ID NO: 6768389 - DNA, 57 bp, Homo sapiens
ctgggaggtggaggttgcagtgagctgagattgggccactgcactccagccttccag

SEQ ID NO: 6768390 - DNA, 81 bp, Homo sapiens
ttcttttccaatcctggtaattgattatatggagtcaaataagccatagcaattaagctccagaattcactggggaaagaa

SEQ ID NO: 6768391 - DNA, 88 bp, Homo sapiens
aggaaaaagatagaaataaaggtactaagggaatatagataggaagttgtatctttctgtacttttatgattgactacattttctcct

SEQ ID NO: 6768392 - DNA, 130 bp, Homo sapiens
tttgcttcacaaagaccaaacagcatgttaaaccgcttcatgatatagagtttgtttttcagatattacacataaacaaagctttatgacttggagacagttatagaaagtagtttgctggtaaagcaga

SEQ ID NO: 6768393 - DNA, 87 bp, Homo sapiens
gccagtggagactttttaatcactaaggtcctcatgtaacccatgtctgaggttacaggggacattggggacatcagtctcagtggc

SEQ ID NO: 6768394 - DNA, 130 bp, Homo sapiens
cattctttcattaaagtggctgttcataggatatagctaagaaagtgtgatactttgtcattgtggtgtcaaaatggcagggtggcaacttttggtggtaactttatctgttttctagttagagggaatg

SEQ ID NO: 6768395 - DNA, 70 bp, Homo sapiens
gtgagttattatttatgtaaacatattaaaacttatgcgtgtttgcaatattatgaatatcctaactcgc

SEQ ID NO: 6768396 - DNA, 81 bp, Homo sapiens
gtatcaggtgatttttgtccactcagtagagtctatgtctcattaagctgggcaacgggcagaaagattacagatcggtac

SEQ ID NO: 6768397 - DNA, 68 bp, Homo sapiens
ggtgaggcagagggagtaacctttggcgtcaacagaaaagccactaggtttcctcttcttttcttccc

SEQ ID NO: 6768398 - DNA, 56 bp, Homo sapiens
ccagtgatctgacaccaaatcaatagtattatggttcattgaagtcagatcaatgg

SEQ ID NO: 6768399 - DNA, 55 bp, Homo sapiens
ggaggtgggagtttagttcttgacctgtgctgctcaatgctggcttcccacctcc

SEQ ID NO: 6768400 - DNA, 69 bp, Homo sapiens
gctagcatactatgagcatagcgcatagcaaaaacacggtgtcctttgagctaagctatgttatgcagc

SEQ ID NO: 6768401 - DNA, 87 bp, Homo sapiens
aacagggcaggttggatgctgtagtgatgacaaagttaaaggaaagtcactcttcagttcagcatcagacagccaaattgctctgtt

SEQ ID NO: 6768402 - DNA, 125 bp, Homo sapiens
cgggagggagcccagccatgtggaagaccctacaggaaggagcacatcgggagtcaggccatgtccccgccatgtcttcttccttccctgtgggcagcgctgtaccacaggctgatgctctcccg

SEQ ID NO: 6768403 - DNA, 59 bp, Homo sapiens
ttcctggagcccttcccagagatactgaatcaaaaatctcttgggataaacttcaagaa

SEQ ID NO: 6768404 - DNA, 68 bp, Homo sapiens
actattaattaccacagtcccctttcctgaaaaaagatattttggttttggagtgggtagttagtggt

SEQ ID NO: 6768405 - DNA, 63 bp, Homo sapiens
actctgagcgcctccgcatctgccagatgtttgttgggatgcggagccccaagcttgaagagt

SEQ ID NO: 6768406 - DNA, 70 bp, Homo sapiens
catttaccttctgtcaatgggatgagattgggttcagatatttgcatcttcaccatcaacagaatgaatg

SEQ ID NO: 6768407 - DNA, 66 bp, Homo sapiens
atacacacttcacccttgagctaaggcttgggtagcagttggtttaccagagggaacgtggggtat

SEQ ID NO: 6768408 - DNA, 58 bp, Homo sapiens
ttgcctcccccagagaggatatctaagagaatggctgaggctctctgggtgaggacaa

SEQ ID NO: 6768409 - DNA, 76 bp, Homo sapiens
agcaggcgggagatttattattttggggtgattaaaccgaagcttccaacacctcagtgagtgtttccttcttgct

SEQ ID NO: 6768410 - DNA, 59 bp, Homo sapiens
ggcgacctcgtggccctggaaggtctggtgaatgctgggccacccctggcacaggtgct

SEQ ID NO: 6768411 - DNA, 59 bp, Homo sapiens
ctattttatggtgtctcataatagcaatttctatttgttttatgtacttcatagagtag

SEQ ID NO: 6768412 - DNA, 72 bp, Homo sapiens
gagaagtggctgacaactgggttaacaacctgcagcatctggtaggagttaggctactgtcacccatttatc

SEQ ID NO: 6768413 - DNA, 80 bp, Homo sapiens
gatgctgaagaatgagctcaaagatcttaagccccagaagcatggggagtgtgggtttgtagttaagttcttagagtgtt

SEQ ID NO: 6768414 - DNA, 101 bp, Homo sapiens
atgggaggtaataaatggaaatgctgttataaggtacttgtgtgctattcataaagtggtatagtattatttgaaagagaatttggattagttataaacgt

SEQ ID NO: 6768415 - DNA, 106 bp, Homo sapiens
tggttctcttttgaaatgcttgattgtacttattgagctaaacaagtcttggtgactgttgttgatttgcctcaaaagttttaagtcctgggttttcagactactg

SEQ ID NO: 6768416 - DNA, 61 bp, Homo sapiens
gggaagcaggtgcagctcgccttaggtaaccccaaccttccctgttagcttcctgttgccc

SEQ ID NO: 6768417 - DNA, 59 bp, Homo sapiens
agaaaaggaaccagtagtaagctttatgagatagcttaacaaagctctgttccttttct

SEQ ID NO: 6768418 - DNA, 69 bp, Homo sapiens
acacagtaaatattgtctcctctgtgatcataatagtgatgaaaatgatggtgacagtgatgctgatgt

SEQ ID NO: 6768419 - DNA, 83 bp, Homo sapiens
gatggtatttaatataatccatgtaattttaaggattttaggaataaggttattgtagattataggcagtttaaaaggccatt

SEQ ID NO: 6768420 - DNA, 83 bp, Homo sapiens
gctgaacacaggctacatgaactcttgctttatttcagcacagggcttctgatattgcaatttataccatgtttgtttctagc

SEQ ID NO: 6768421 - DNA, 85 bp, Homo sapiens
agtaaaacatcttcaagttcaacattttttcaagtagacttacctactagtgaagaagatttgactgaaatggatgtggtttgct

SEQ ID NO: 6768422 - DNA, 70 bp, Homo sapiens
ttaatttacatgtagttcactggtggcattatgaaatgctagaggtacaaactacatcataagggattga

SEQ ID NO: 6768423 - DNA, 84 bp, Homo sapiens
tatgttttcatgctttgcattcatcttcttttaaatcattaagaggtagggaagaaggcatgaaattactatcataaatacatg

SEQ ID NO: 6768424 - DNA, 84 bp, Homo sapiens
ttgcaccctaaaataactttctgtgtatagtcaggcagctgatgcctagaatttgtgctcaggaagattagaggaatgtagcaa

SEQ ID NO: 6768425 - DNA, 70 bp, Homo sapiens
tgggggaccctcaggactgcgtctccaggtctcggaagggaggggaccggtggcttcctcgggtccccca

SEQ ID NO: 6768426 - DNA, 86 bp, Homo sapiens
gctggcgggggcctggaggccggactgagaggcatccattttgtctagagcctctcactgtcaccctcccactgttcttgctgtgc

SEQ ID NO: 6768427 - DNA, 70 bp, Homo sapiens
accactacagatgtgactgggcaagttacttcacctctctgagtctcagtttccatatctgcaagctggt

SEQ ID NO: 6768428 - DNA, 67 bp, Homo sapiens
gttccaggcaagtgggataggacgtgctatgatacggaggcacagataggtccgctatgtctggaac

SEQ ID NO: 6768429 - DNA, 116 bp, Homo sapiens
gctcttctcttcttgtcatatttttaatattgcatgcttttttccagcctgtataccagtgctatttaaaggaaaagaattgcagtgaagtaatagtttgacggctcctgaactgc

SEQ ID NO: 6768430 - DNA, 56 bp, Homo sapiens
gtaaggctttgtgcttattccaaaatatttgctatggaatgcaagcatagtgttac

SEQ ID NO: 6768431 - DNA, 107 bp, Homo sapiens
agagtggaatgagtggaacttgcgtcagtagcccttggcttaggcattcctggcatggtgcaggactctgagctgggcacagaaggcgtccacctggttctcgcttt

SEQ ID NO: 6768432 - DNA, 64 bp, Homo sapiens
tcaaatgtttgtttatgtatatatacgtgtggtgttatgtatgaatgctgggacaaatatatga

SEQ ID NO: 6768433 - DNA, 67 bp, Homo sapiens
gtttttggaagatgccactgtatcagttataatttcttttgctagatacttataatcttccaagagc

SEQ ID NO: 6768434 - DNA, 80 bp, Homo sapiens
ctgaaggaaaggtttcatctacttttcatcctaaaaattcttaaaggcttgggaaatggattggagctttagaacttcag

SEQ ID NO: 6768435 - DNA, 87 bp, Homo sapiens
tcagctgtgtcaaatgctgctgatgtgataggttgctagatcaataacagaattgcctattatatttagtaatgtggagttagttgg

SEQ ID NO: 6768436 - DNA, 68 bp, Homo sapiens
gtgctaaagaattttgcttgaccagaaccagaccacaatatgtttgtcaagcttgttcttctagacgc

SEQ ID NO: 6768437 - DNA, 120 bp, Homo sapiens
ctcttgtatattcacaagtgctcatggtagaactacagaagtttcccttgcttacatcaagagcttttaacaattgtagcatactttctttagtttgcccacacgtgtgacatttaggag

SEQ ID NO: 6768438 - DNA, 62 bp, Homo sapiens
cagtgtagaatacaatctaggtgaagctgtcatccatggcttcactgactggttctaggctg

SEQ ID NO: 6768439 - DNA, 58 bp, Homo sapiens
tattctagagcagtgattctcatgtacagtcatggcagagaacttctgttctagaata

SEQ ID NO: 6768440 - DNA, 65 bp, Homo sapiens
aaagtgcatcaaatgacttcccccacctttcccatgaattagggtgaaactgtttggggcatttt

SEQ ID NO: 6768441 - DNA, 69 bp, Homo sapiens
gctgaaccacacagtgcagtcaggaccctttctctgggtctgctctttgctgcctgtgcttggtaaggc

SEQ ID NO: 6768442 - DNA, 71 bp, Homo sapiens
aactgtggaattgtcaagcatctgaaggccagatctggctgtctctatagactgtggataaaaacatagtt

SEQ ID NO: 6768443 - DNA, 90 bp, Homo sapiens
ttcaggatagtgaggtaatgaggggagaaggcactaaccaggtgtttagccttcatccagtgctcttcccccatcacactatttcttgag

SEQ ID NO: 6768444 - DNA, 78 bp, Homo sapiens
gtgttgattgttggattggttcacttggagtctgtacttgggttacagagcagtaagaacacagctgactttcagcac

SEQ ID NO: 6768445 - DNA, 67 bp, Homo sapiens
ccatggctgccaggagggaggccagtcgcgggactggggaactggcaggctgctggccggcgcgtgg

SEQ ID NO: 6768446 - DNA, 90 bp, Homo sapiens
aggagaatcgcttgaacccgcgaggtggaggttgcagtgagctgagattgtgccactgcactccaacttgggcaacagagtgggactctt

SEQ ID NO: 6768447 - DNA, 126 bp, Homo sapiens
cacctgcacctagccacagggagactctcttgcctcccattggcttgagaggcaggaaaggaaactgcattaccagagtcaggtgggggctgcagtggaggaaggggcctgggcttggagcaggtg

SEQ ID NO: 6768448 - DNA, 82 bp, Homo sapiens
ctccctaactttcatgttcatttggaacctgctccctccccaaggcactctgaatggtctcaaggacataaaagctagggag

SEQ ID NO: 6768449 - DNA, 68 bp, Homo sapiens
ctagtcctggaccgagacagggtgggctcgggccacacatgagacctcccgtatatgtcctgggctag

SEQ ID NO: 6768450 - DNA, 64 bp, Homo sapiens
gcagtagttgaaactcctgtaggttcttggagaaattgaataatgaggaggttcaggctactgc

SEQ ID NO: 6768451 - DNA, 57 bp, Homo sapiens
agacctgcttttccaaagaccattacagggaactcctgtccttaaaaaagcagttct

SEQ ID NO: 6768452 - DNA, 79 bp, Homo sapiens
ccagaggccggcacagtggctcacgcctgtaatcccagcattttgggaggccaaggcgggcggatcacttgaggccagg

SEQ ID NO: 6768453 - DNA, 58 bp, Homo sapiens
cattttccacaggcctatttccaagatggtgctacaggtattaggtctgtggaatatg

SEQ ID NO: 6768454 - DNA, 67 bp, Homo sapiens
ttttatgctaacctcatcttctccttctttctcacttggagagggagaagacaagattagtataaaa

SEQ ID NO: 6768455 - DNA, 66 bp, Homo sapiens
cagtatgtcttttgcttgcaaatagattgctcattgccaactgcttccaagaaagagatagggctg

SEQ ID NO: 6768456 - DNA, 71 bp, Homo sapiens
ccatctatggtaaaattggagtattatgtccctggatatgagttcttcactgccagttttaccacagacgg

SEQ ID NO: 6768457 - DNA, 68 bp, Homo sapiens
tgaggactgtctactaacaagaagcccagacctttaatgggccttggaaagctggagcagtttgctta

SEQ ID NO: 6768458 - DNA, 84 bp, Homo sapiens
gaacacacacctttgtagttgtgtttttctgctggaagctgcagatcagtcttcattttgtggaatatttttacaaatgtgttt

SEQ ID NO: 6768459 - DNA, 57 bp, Homo sapiens
gggccctgtgatttcttgaggattgttccaggaaacacacttaagacacctgggctc

SEQ ID NO: 6768460 - DNA, 60 bp, Homo sapiens
cctctgctctggcaaagtggacattcaggccctcttcttccatgtgccaaggggcagagg

SEQ ID NO: 6768461 - DNA, 61 bp, Homo sapiens
caggtaggttttaggctaaacagagagttatactcttccttattgtttgggactctgcctg

SEQ ID NO: 6768462 - DNA, 91 bp, Homo sapiens
gcatgtgtgtgtataagtgtgtagagtaagagatcttccagaaatataacttttcttttccctttagcacttgttttctgtgtacatgtgc

SEQ ID NO: 6768463 - DNA, 78 bp, Homo sapiens
agctgtagattaggagttgggaggtgaaaccaataagcggttttgtggttctgggccaatctcttaatctctgcagct

SEQ ID NO: 6768464 - DNA, 66 bp, Homo sapiens
agtcagctccagggtcagctcagaactgccctggctgggcagtgttgtgtgggcccggagcaggct

SEQ ID NO: 6768465 - DNA, 78 bp, Homo sapiens
agttgctttgttgtctgtgtcagttagcgtcttactccaggtgggctgctataacagactggcatagcctgggtggct

SEQ ID NO: 6768466 - DNA, 85 bp, Homo sapiens
gtgaaatgtgtatcttctctcttactgccatgctgtcaggtagaaagccagtggtatgagagaaaaggcagttacacagtgttac

SEQ ID NO: 6768467 - DNA, 57 bp, Homo sapiens
tttatcagagtccccaaaagaaatagaaggctatttcaagtggggacatttgagaag

SEQ ID NO: 6768468 - DNA, 59 bp, Homo sapiens
gctgcacttcaatgtagcagctattggccctgtgttgctactggctgcctggaatgcgc

SEQ ID NO: 6768469 - DNA, 72 bp, Homo sapiens
cagccagttctctagtgatattttacagataaacaatatatttttattcagatgtcttagaaactgaagctg

SEQ ID NO: 6768470 - DNA, 55 bp, Homo sapiens
ctacagaaacactggacatgtgttcaggggatgtgtacaagagtgtttactgtag

SEQ ID NO: 6768471 - DNA, 58 bp, Homo sapiens
acgtgctgggtctgcggggccgtggcccggtggccaggcgagctcttctccagcacgt

SEQ ID NO: 6768472 - DNA, 63 bp, Homo sapiens
aaacctggctttaggaccaaggggctcctcagcagactctttaagctcctaacagccatgttt

SEQ ID NO: 6768473 - DNA, 76 bp, Homo sapiens
gggacaggcagcctgctgctcgaccagtcccaggcctgaggaggtccacggggccagcgagggcaaggcctgtccc

SEQ ID NO: 6768474 - DNA, 67 bp, Homo sapiens
attcttcttttactcatatgttttattccagggactgagaaaatagcagtgagtaaacagataggat

SEQ ID NO: 6768475 - DNA, 63 bp, Homo sapiens
ctgggaaggcagtcactgtcctattcatacttctgctggggctagaatgaatgcctattccag

SEQ ID NO: 6768476 - DNA, 91 bp, Homo sapiens
ggccctccagagaggcattgattatcccaaggcctctagttgattagttcagggattgcaactagattttgggatatctgcctgctgatcc

SEQ ID NO: 6768477 - DNA, 66 bp, Homo sapiens
ggtctttctttgtcctcgtaaaacgtcaagaacaggtttggctacagaaggagaaagaaatggatc

SEQ ID NO: 6768478 - DNA, 57 bp, Homo sapiens
ctgtcccatccttactctaccctcttgcttctggaagcagagaaagagaaggggcag

SEQ ID NO: 6768479 - DNA, 70 bp, Homo sapiens
gttgatatcaatggatctggaattcaggaaaagtgtctgagatatccaggagattcattaggtcatcagc

SEQ ID NO: 6768480 - DNA, 70 bp, Homo sapiens
ttgccttctctgtcgggctgggcagcgtgtggcgttctccttacctgtgtcaccggaacggaggaggtaa

SEQ ID NO: 6768481 - DNA, 57 bp, Homo sapiens
accaaaggcattgggggtcaaacacgttactgtgattgctgaattgaatcctttggt

SEQ ID NO: 6768482 - DNA, 94 bp, Homo sapiens
ggaaaagtccaagtctaggcccaagaatcactggatgttgctcctgtaagagtgctttcagaaatacactagtctcttcttgacttgggcttcc

SEQ ID NO: 6768483 - DNA, 71 bp, Homo sapiens
taggtacctcataaatactactatgagagataaataagatagttacatataaagtgtttatgtagtgccta

SEQ ID NO: 6768484 - DNA, 129 bp, Homo sapiens
gtgagaaaggacaggtgcctgtgaggcaggacttaaaggaggcgctggccctcaggggcatgcgagggcagggtgagcacctgagagtgagggcctccttaaagtctgtggtccagggtcctttggtcc

SEQ ID NO: 6768485 - DNA, 65 bp, Homo sapiens
tcttcaatttctcaataggcatgtgatctcagaaaaaaggtcctgtgtcccagagaaagagaaga

SEQ ID NO: 6768486 - DNA, 85 bp, Homo sapiens
tgctaaacactgctagattgcaagaaataatcgaatagactaatttattctagtttaaggttagatctttccaggggtgtttgca

SEQ ID NO: 6768487 - DNA, 77 bp, Homo sapiens
tcctgtgtgatgcacaactaatatttcagtgttgctgttcctcaaagattgggttttagggtgcatgcagctcagga

SEQ ID NO: 6768488 - DNA, 67 bp, Homo sapiens
cagatagggttacaatgtggtctcattttcatcttgccccattgtgatcacagagtagccttgtctg

SEQ ID NO: 6768489 - DNA, 87 bp, Homo sapiens
cacagcccagattaaggagtcaggagttatgctccacctctgtgagttgccctaagaggtgggcatcctgagtttattatggttatg

SEQ ID NO: 6768490 - DNA, 56 bp, Homo sapiens
gtgtgtgctttgggatcacatgtccccaccctaggaccctggttccaaccatacgc

SEQ ID NO: 6768491 - DNA, 81 bp, Homo sapiens
ggagaaacttgcctgccaggcaacctgggagtcttaatctgatcagacctcactcttgtcctggcaggtctagtccctgcc

SEQ ID NO: 6768492 - DNA, 67 bp, Homo sapiens
ttcacagttaagttggacacattcctaaaaaacagcctgggttggaaggaagtggccagattgggaa

SEQ ID NO: 6768493 - DNA, 66 bp, Homo sapiens
tagggtttatttcattttcttagtatctcatgctattggtgactctgagctgtggaataaacactg

SEQ ID NO: 6768494 - DNA, 55 bp, Homo sapiens
gtggtcacttgaaatatttggcagcttgagctctcaaataaggagtcatgaccat

SEQ ID NO: 6768495 - DNA, 66 bp, Homo sapiens
gttagggttaggtgtagtctagggaaggaaacaaggattccgtgagagctgccacgtgaccatgac

SEQ ID NO: 6768496 - DNA, 55 bp, Homo sapiens
tgatttggtttccatgtctagaggccagatgcctactgggaggtcttccaaatca

SEQ ID NO: 6768497 - DNA, 58 bp, Homo sapiens
gccaaatatggtggacagtttgagcaaaaaaaggctgaaattgtacattgagtttggc

SEQ ID NO: 6768498 - DNA, 59 bp, Homo sapiens
atagagtccaggtcttcctattccaggtagttctcattctacctggtacctggctttat

SEQ ID NO: 6768499 - DNA, 77 bp, Homo sapiens
ccagcctgcctggatcagccatcctgagctggaacctcccacagctgcatcccacaggagggcccgggcaagcatgg

SEQ ID NO: 6768500 - DNA, 70 bp, Homo sapiens
cacacttgcttcagagtcaagttttaatgggaatctttcaagttagtgaactttggggccaaaaagtgtg

SEQ ID NO: 6768501 - DNA, 119 bp, Homo sapiens
gagctcgatagagagggagcagagggttagcagatttggaaaatgagatgaaatgaagttcaaattaggaatttgtacaaatttatgttagttcttctgttactattactagtgggctt

SEQ ID NO: 6768502 - DNA, 60 bp, Homo sapiens
cctacatgctttaccaaagcagtgatgagagtgatcagtgcatgtggtgtgagtggtagg

SEQ ID NO: 6768503 - DNA, 93 bp, Homo sapiens
gcacggagtgggcttccaggtcacagagaaatgtggcacaaacggttgcaatcttttgagtttccttttttttgagatgaagtctccttttgt

SEQ ID NO: 6768504 - DNA, 61 bp, Homo sapiens
aatccaggcaaaaaccaactacagcttgcattaaaataagactgatagatgttgctggatt

SEQ ID NO: 6768505 - DNA, 67 bp, Homo sapiens
ttcacttcctgctctgggctcaatggcagctccagctggggtccaggagcccatgagagactttgaa

SEQ ID NO: 6768506 - DNA, 88 bp, Homo sapiens
atccagctcagccccctataatgacacatggtgagtccttcctatatactcactgaaagaatgacattatggaaagattgagttggat

SEQ ID NO: 6768507 - DNA, 69 bp, Homo sapiens
ggcgtctcaaggcccccaggccaagcaccagatccccgcccatggcccccggggtcttggggctcagcc

SEQ ID NO: 6768508 - DNA, 77 bp, Homo sapiens
gccagggcatcggggccttcttttggttttacccaaataagggagtcagagtaacagaaaggctcaggtgctctggc

SEQ ID NO: 6768509 - DNA, 97 bp, Homo sapiens
cagggcctggtgctctctgaagcacctggacggtgcctggggacttacggagcccagggctggaccagtgcttgggaggccagagcatggggtcctg

SEQ ID NO: 6768510 - DNA, 69 bp, Homo sapiens
aggaggtttccagtttctccttgttttatcttgcttaatgttgaatgataggaaatgtggaaacatcct

SEQ ID NO: 6768511 - DNA, 127 bp, Homo sapiens
aattgctagataagtgactacttaggtactctaatttggaatggtctggcatttggaactgtatcacagtatagaaagttttaaattggtagctctcagtcttattcatctttctgtctagttaatt

SEQ ID NO: 6768512 - DNA, 65 bp, Homo sapiens
catgctgtcctgaaaagatattcattactatggttaagcataaatgtaagttctagaacagcatg

SEQ ID NO: 6768513 - DNA, 56 bp, Homo sapiens
tcctttgttactgctgaccttctcctccctgggcctttctcagcaaagacaaagga

SEQ ID NO: 6768514 - DNA, 64 bp, Homo sapiens
tggtggcccagaataaagaatacatttctcatctaggtgtggacatgtgttaaaattctcacca

SEQ ID NO: 6768515 - DNA, 64 bp, Homo sapiens
tggggagaatcctgagctttatcccagaccaacattcatcagaatatctggaaggcttccccca

SEQ ID NO: 6768516 - DNA, 122 bp, Homo sapiens
tgggaggaacaaggtgaggctgtgaaggacctactgatatcttagcagggggcacagcctccttctagcaatggcagagtgtctgtgcacaccaggcctcacctgttggacaggaaccccca

SEQ ID NO: 6768517 - DNA, 82 bp, Homo sapiens
aagcaaggtaattctagccagatgattcccaaataggaggtgctgctctccttgttgctttctggttggattaattttgttt

SEQ ID NO: 6768518 - DNA, 83 bp, Homo sapiens
gaagtttagtttcattagactgatttagaagcagtctttagatggtaaagatacagcttttttgtcagtcacatataggcttc

SEQ ID NO: 6768519 - DNA, 106 bp, Homo sapiens
ggttaactgcaaagcaggaaaaggcggctcggggctggaacgttactccctctgctcatgatccagggagaagttttgggcccccttctctctgctgctgatggcc

SEQ ID NO: 6768520 - DNA, 81 bp, Homo sapiens
actgtggctggtactgtgggcctttcctttgaccctgccatggaagcaaggtcaagtattttggccccagcagtgagcggt

SEQ ID NO: 6768521 - DNA, 63 bp, Homo sapiens
cctggagtttgtggcttgctcaagctctggctgttcagttctcgagccagcaccaattccagg

SEQ ID NO: 6768522 - DNA, 64 bp, Homo sapiens
gcagggtcaggagaagggtgcggcagatggagaatctgtatcacccgttcccagaacgtcccgc

SEQ ID NO: 6768523 - DNA, 58 bp, Homo sapiens
ggcagggtatgaatttggtgctctggaatacagagtgataaccacatgatatcttgcc

SEQ ID NO: 6768524 - DNA, 61 bp, Homo sapiens
ccacagtggtggctttgctatgctcttctttgaagggtctgatcagttcccactactttgg

SEQ ID NO: 6768525 - DNA, 96 bp, Homo sapiens
gaatcggcctagcttctgagctgacattgtactcttagcgttgtttttgtaaaaaatggtataggtagtatatgtacgcgaagacttggtttattc

SEQ ID NO: 6768526 - DNA, 79 bp, Homo sapiens
gtgagattctatagtatctgttttgatacagttttatacaaatatgaatattgttttaaagcagtatgactagtagcac

SEQ ID NO: 6768527 - DNA, 55 bp, Homo sapiens
agcaagggaagtcgacagaatagcacctcaaatgatgtggactcagtttcttgct

SEQ ID NO: 6768528 - DNA, 92 bp, Homo sapiens
ttatgggggataattgttcagtagagagattattaacccttttatctactttttaataagagttttattgagctttaattcacattccataa

SEQ ID NO: 6768529 - DNA, 62 bp, Homo sapiens
ccattaagattgtgcttaagaagacattttgcctcatgtcttcttaagtatgatcttaacgg

SEQ ID NO: 6768530 - DNA, 64 bp, Homo sapiens
gcagtgaagcctcggaaccaagctccaaacacttctgagggccgtgtctccaaggcttccctgt

SEQ ID NO: 6768531 - DNA, 61 bp, Homo sapiens
cattcactgaagctttattgaatgccttttatggatcagcagtgtgaagctttattgaatg

SEQ ID NO: 6768532 - DNA, 73 bp, Homo sapiens
tgaggcaggaggatcacttgagcccaggagttcaagaccagcctgggcaacatagtgagaccttgtgtctaca

SEQ ID NO: 6768533 - DNA, 86 bp, Homo sapiens
aggaaagcaggactgtcatgatcgaagatgtcacagagtgcacacaattttgataggaatgatcatgatcagggaatggttttctt

SEQ ID NO: 6768534 - DNA, 89 bp, Homo sapiens
cggtagcctcttggaggtttctatgctgtttatcttttttcaagcaaagggaagtaaaaagcaataggagaactttctttaggccactg

SEQ ID NO: 6768535 - DNA, 99 bp, Homo sapiens
tgcactcatccatccacttagtcacacactcaacttttcatcttgggtgatggaggttgggatgcttgtgattttggtgaggatagagattgagatgca

SEQ ID NO: 6768536 - DNA, 69 bp, Homo sapiens
agggtagtcttcatgctggggtcctctggctgtgggagcagcatggggctccgcaatgaacaaggccct

SEQ ID NO: 6768537 - DNA, 72 bp, Homo sapiens
tcatgttctgctggctccagtgacaagtcgatgaaattctatcactcgtccgacaggagacctcagaagtga

SEQ ID NO: 6768538 - DNA, 71 bp, Homo sapiens
acttctcatcagtcgccttgagagtttaatggatataaatgtcccctagatgaaagagggcctgtgagtgt

SEQ ID NO: 6768539 - DNA, 71 bp, Homo sapiens
gcaaacagaactgaattggttatactgggctcccagctgaaggggaaaggcccacagtcagtctaccttgc

SEQ ID NO: 6768540 - DNA, 61 bp, Homo sapiens
ttattattgattcgctctcaaactgtcaatctggggacagctctgaggcagtcagtgatgg

SEQ ID NO: 6768541 - DNA, 61 bp, Homo sapiens
catacattgaatttgcacgtgtaaaaggattttctatcacagcactgaaattcaatgtttg

SEQ ID NO: 6768542 - DNA, 101 bp, Homo sapiens
agcacggcttggcattggaagttttatttgaatcaggggagaatattatttgagatattttcctaaatgacaaatgaatgatttacctgcagcaatgtgtt

SEQ ID NO: 6768543 - DNA, 71 bp, Homo sapiens
gagacaaagacaagcatcaaatcaggcagtgcttttccatcactcatgtttggttctcttagtcttgtctc

SEQ ID NO: 6768544 - DNA, 73 bp, Homo sapiens
ggcttcggctggctcttctcaagcattggctatttggcactcaagtaaccaggcgagagagcggtcagtagcc

SEQ ID NO: 6768545 - DNA, 106 bp, Homo sapiens
ttctctgtcattgataccactctgtcatttgtctgctccctctggccacaacctccctgagagcagagagcagaatagaaggcagggtctttattctggctatgaa

SEQ ID NO: 6768546 - DNA, 79 bp, Homo sapiens
gggcctgcctgtggctgccccgctgttggcatcctacccagagccacaatgctagtgggccacaggtacagatggactc

SEQ ID NO: 6768547 - DNA, 70 bp, Homo sapiens
gaattaataatggggggaagatatcagggacgtttattttgcatccaagaaaattttctctctatgattc

SEQ ID NO: 6768548 - DNA, 63 bp, Homo sapiens
gttttccttttttcctatgggacatgagggaagaacaccttgtgggccagtagaaaggaaggc

SEQ ID NO: 6768549 - DNA, 61 bp, Homo sapiens
ggatcatggagctggttctggggaagctggccaccaccaccactgacaccagctcggttcc

SEQ ID NO: 6768550 - DNA, 102 bp, Homo sapiens
gctcccagggccccagacattgcagggactggtgattgaggagtttcaccttagaccaggaagcatccctttgtaagtgactttctggaagctactgaaagc

SEQ ID NO: 6768551 - DNA, 66 bp, Homo sapiens
agccaagaatcgggtaggccaatgcatgtctaagtgctacaggctcagatatctgtgttcctggct

SEQ ID NO: 6768552 - DNA, 62 bp, Homo sapiens
gatccgagtcaggtattgaatttgcagtgaagatgtctgtctttcaatacattactttgatt

SEQ ID NO: 6768553 - DNA, 92 bp, Homo sapiens
ggccttctggctgtggtcagaggcttttctggtctttggctgagccgtgcagctctgggaattcagaaagcctctgactacaggactaggct

SEQ ID NO: 6768554 - DNA, 69 bp, Homo sapiens
agtcctcatttctgcaaccctgaaaggcggctattccatccccattttacacttgaggaaactgaggct

SEQ ID NO: 6768555 - DNA, 94 bp, Homo sapiens
agaattggtgtatatcacatctctggcttggattatggttggaagtggcccagtgcctgtcaaacctcatctctcactgaatataacaccatct

SEQ ID NO: 6768556 - DNA, 73 bp, Homo sapiens
gctaaggtgaatgtctcttagtctcattttctgctcacttcagcatgaacagcttgagagatgcacacttagc

SEQ ID NO: 6768557 - DNA, 71 bp, Homo sapiens
ggcttgtgtcaccatgcgaggctaatttttatattttagtagagatggggtttcatcatgttggccaggct

SEQ ID NO: 6768558 - DNA, 63 bp, Homo sapiens
cacaattccatggcattctttgtcagtacctgtcaaaatatacctaagccgttaggagttgtg

SEQ ID NO: 6768559 - DNA, 55 bp, Homo sapiens
aggccaaagctcacctgcagctcatttatccttagagaagggagggcaatggcct

SEQ ID NO: 6768560 - DNA, 64 bp, Homo sapiens
aagtggtatcctcagagcgcgtggcattattctggttcagaaataatgtcttgtgctctcactt

SEQ ID NO: 6768561 - DNA, 113 bp, Homo sapiens
ggtggaagcttacagaaagaagggcatcttcacatatttccaatgattattcaggaaaagtcttttggtgacttgtgggatgttaaatttaactttcttcttatgttttggct

SEQ ID NO: 6768562 - DNA, 76 bp, Homo sapiens
gtggaagagcgctctccaaggtggcccgcttcctgttggtgttgccggagccgtgcctggagacctgctcctctac

SEQ ID NO: 6768563 - DNA, 130 bp, Homo sapiens
ggtctgcctccccaacccctgcctgaaacagtgcagggagaaggtggaagtgcagagtgggctcacctctcgcccacactgtccccttctccccagcgagctgaggctgcccagcgggaggtggaaagtc

SEQ ID NO: 6768564 - DNA, 69 bp, Homo sapiens
ttcccagctctctcttcacaatacctggaccaatatcctcaagttcagtcctgaggaagagctgctgaa

SEQ ID NO: 6768565 - DNA, 103 bp, Homo sapiens
gcgatgtggaaaagttttattgccatttcaaggtgcaggagggtttttttcgaagatgatatgaggattaactgacctagtgtttgtaaagattttacgttgc

SEQ ID NO: 6768566 - DNA, 61 bp, Homo sapiens
aatacaggaagttacagactatgaacactggttaccagcttcagtctgtggcttccttatt

SEQ ID NO: 6768567 - DNA, 73 bp, Homo sapiens
cagacacgtggagatggttgacaaatgttgcccgaaaatttgggatcttggcaatcaattctgacgtcttctg

SEQ ID NO: 6768568 - DNA, 65 bp, Homo sapiens
ctggggggcctggtgggtgggggcagtaggtgagctccgcctgcccctcttgctggccctgtcgg

SEQ ID NO: 6768569 - DNA, 70 bp, Homo sapiens
cgcccctgcagcgcggctggaactgggacgccgggctgggggccgtgcccaggggccagctgccgggacg

SEQ ID NO: 6768570 - DNA, 56 bp, Homo sapiens
ggaattgaattgacattcaggtgcaaacagccagccactgaacacagtacaattcc

SEQ ID NO: 6768571 - DNA, 57 bp, Homo sapiens
agcagctttctgggacagaaaggaatcaaagcttcttctctgagctaggaatgctct

SEQ ID NO: 6768572 - DNA, 80 bp, Homo sapiens
accactgcctggggtcagccagccagcaagaggtcaagccactgcctgggctctggtttcctggctggggcggtactggt

SEQ ID NO: 6768573 - DNA, 67 bp, Homo sapiens
cctgccatttataaccagtggcctttgggcaaatctttcagccctgatgcttctctgtaaatgtagg

SEQ ID NO: 6768574 - DNA, 61 bp, Homo sapiens
acattcggcgttcgcagggcctctgaattgtaaaacgagaggtcacttcacacgttaatgt

SEQ ID NO: 6768575 - DNA, 55 bp, Homo sapiens
tgcagggtcccgaagggaagacgaacactcctcatcctctgatcctggatccgca

SEQ ID NO: 6768576 - DNA, 91 bp, Homo sapiens
gtagtgtcttagaagactggataaatggatgatttgtctcccagagcttgaattcatccatttatgcaagatgttttaagagaatggctgc

SEQ ID NO: 6768577 - DNA, 62 bp, Homo sapiens
ggcaggagaggaggtgagggcttcatccacgacaggaaattgagctcatttcctctgttgtt

SEQ ID NO: 6768578 - DNA, 64 bp, Homo sapiens
ctcctacttgtaattgtttcctccccagtattctttctggggacagaatactcataagaagggg

SEQ ID NO: 6768579 - DNA, 87 bp, Homo sapiens
gtaggtttgctctgtgtccccagagccggtggtgctcacagcgctgctagaggggtctgtgtactgctctggggaggccagcacctc

SEQ ID NO: 6768580 - DNA, 81 bp, Homo sapiens
tttccacatcctttgtgtcccatgcggcctacactccagggaggtggcacaaggcttacacagcagcaggcaatgtggaga

SEQ ID NO: 6768581 - DNA, 59 bp, Homo sapiens
agtccagggaaatagcgacaggggagttcaagactgcccctgctagtccttccttggct

SEQ ID NO: 6768582 - DNA, 74 bp, Homo sapiens
catctgtagctccatgacaatttggcagaatacacattaaagtgaaagctgctgccgtcatgcggaaataggtg

SEQ ID NO: 6768583 - DNA, 81 bp, Homo sapiens
agagatttgggctattttgaataatgctgctgtgcacacttgtgtacacatttttatgttaacatatgttttcacttctct

SEQ ID NO: 6768584 - DNA, 127 bp, Homo sapiens
gaaaaacattttcattaaacttcagaaagtggctagtacagaatatgcgtcagtaaaagacaaaacaaaacaacggatgatgttaccagtacttagagctatagtttgcttttaaaaaatatttttc

SEQ ID NO: 6768585 - DNA, 69 bp, Homo sapiens
ccagctttccagggttgactggggggcttaaacaatagaaatttactttctcacaattctggaggctgg

SEQ ID NO: 6768586 - DNA, 57 bp, Homo sapiens
ttggaaagggaggaatgtagaccgaaaagaatctctgcagacttgtacctttaccaa

SEQ ID NO: 6768587 - DNA, 130 bp, Homo sapiens
tttggccagttggaggcatttagtaagagataggaagagctggaaaagagtaaggtcacagtacttattcctgcagcccactttctgccagctcaccatgggtctattgagtgcctgtccagtggtcaag

SEQ ID NO: 6768588 - DNA, 61 bp, Homo sapiens
tcagaagcgttgtgggaacttgtcagcccagcatgattgttttagttccctgatgtactga

SEQ ID NO: 6768589 - DNA, 68 bp, Homo sapiens
atgttatttttggtgatttttcaatatcagaacagtatagttttggctagagaaattactataagcat

SEQ ID NO: 6768590 - DNA, 69 bp, Homo sapiens
tgatatgcaggcagaactgagaatcactgatgtagaagaacaatgtttctcagtttggtctgcagacca

SEQ ID NO: 6768591 - DNA, 57 bp, Homo sapiens
cagcatgcaggggcctgagcacctgtggaagccatgagctctggcctctggatgctg

SEQ ID NO: 6768592 - DNA, 64 bp, Homo sapiens
gacaaaacatttgctgctatctgaagagtatattccacacttcgtttttagtagcaatgttgtt

SEQ ID NO: 6768593 - DNA, 63 bp, Homo sapiens
gatagtggcacagccaagcctcactcgttttgactaatgagagcctcaaagctttgctatttc

SEQ ID NO: 6768594 - DNA, 72 bp, Homo sapiens
tgccacaagctttatggctttaaacaacttaggtgtatcaccttactgtttgcctgggccacagtctgggca

SEQ ID NO: 6768595 - DNA, 75 bp, Homo sapiens
ttgcttgcatctatttttgcatagttatgctagtatcttttaagcataataacacctgaataggaaagtaggcag

SEQ ID NO: 6768596 - DNA, 72 bp, Homo sapiens
atgagtttgtagaactatacttacattttccaaccttggaggatctatctttggatagttttataaacacat

SEQ ID NO: 6768597 - DNA, 57 bp, Homo sapiens
attatgtctttagatatttggtcttccctgcaagagtccaagcttcttaagcatagt

SEQ ID NO: 6768598 - DNA, 62 bp, Homo sapiens
catccactcgtttaaaaatatcattgctaccactgggacaccaatgaatgaacgaatggatg

SEQ ID NO: 6768599 - DNA, 59 bp, Homo sapiens
gatgtagtagaaacagccaagttttagagtcaaacagacctggctctttttatgacatt

SEQ ID NO: 6768600 - DNA, 86 bp, Homo sapiens
agcttttctgacagctgaattgcttgcatgcagagaaattctttgaagcttaatgttagtactcatttacctgcttcagggaagct

SEQ ID NO: 6768601 - DNA, 98 bp, Homo sapiens
tatggtttggctctgtgtccccacctaaatcttatcttgtagctcccataattcccacatgttgtgagaaggacccggtgggagatgattgaatcatg

SEQ ID NO: 6768602 - DNA, 85 bp, Homo sapiens
tacatttaaaactcttgtaaatatcatgttttagaagggtgcatacatatccaaaaagctgatgtctactagagaaggaaatgtg

SEQ ID NO: 6768603 - DNA, 57 bp, Homo sapiens
ggatgtcaatcagtagaattaacttgagggtccaaggccatttttattgtgacagcc

SEQ ID NO: 6768604 - DNA, 63 bp, Homo sapiens
gtcaactacagctgccatctttgccatctcaggcagcctacaggtgggggctgtgtccttgac

SEQ ID NO: 6768605 - DNA, 67 bp, Homo sapiens
gacatttctcagggagttttgcttaaagaagattagagtaattgagcaggaaaccgagggtgatgtt

SEQ ID NO: 6768606 - DNA, 70 bp, Homo sapiens
accttagcattagagatagaaatagtctagatttttaagactgttgctgattctttctggtggaattggt

SEQ ID NO: 6768607 - DNA, 55 bp, Homo sapiens
gctctggtggtgatcagacgctgggtgagacagcagaggggatttctaccagagt

SEQ ID NO: 6768608 - DNA, 58 bp, Homo sapiens
ctggaggggctggcatggtagccattttgatctctgtcatgtgtaatagcctctgggg

SEQ ID NO: 6768609 - DNA, 129 bp, Homo sapiens
taatttgtatttatatgtttgttggggcataagagaaatatctgtcttaatcactggatagtaagatttgtaaaggtaggacagagatttgttttatgtactatcgagcttccaataattggcaagtag

SEQ ID NO: 6768610 - DNA, 68 bp, Homo sapiens
tgtccccttggcctgcagtctcctcatcccgcgatggtgtggggagtgacgcagggccatagggagca

SEQ ID NO: 6768611 - DNA, 60 bp, Homo sapiens
ctgtccctgcctgcccactctgtacccctggaggcccagacagcagggctggcatgacag

SEQ ID NO: 6768612 - DNA, 98 bp, Homo sapiens
agaaattgaagaaataagagctttccttgggaggatccaagagtctgcatttgaaaacagtgttatctcagggacggcatctcatttctttaacctct

SEQ ID NO: 6768613 - DNA, 76 bp, Homo sapiens
catcacttggctcatatcccggccatcattaggaggaattccccgaaatgatgctgacgttttagttgacatggtg

SEQ ID NO: 6768614 - DNA, 109 bp, Homo sapiens
tccagtgagtttatcaggaagtggaaatggagagctacattggaaatctgttttcagacatcccgtgtccatttctgtttctggaaaccacttctagatgaaccttgga

SEQ ID NO: 6768615 - DNA, 72 bp, Homo sapiens
agatcctatattggtggccatttggaaaagaagaccacaactttgcttttggtttggctccaaatagggact

SEQ ID NO: 6768616 - DNA, 73 bp, Homo sapiens
ggggtaacaatgaatactaagcaccaggcccttatcagtctctggcaccctgacttagtgtttggattactcc

SEQ ID NO: 6768617 - DNA, 55 bp, Homo sapiens
gtgcaggagccaggggtaggaacatttactaacatgagccacccaggacttggac

SEQ ID NO: 6768618 - DNA, 108 bp, Homo sapiens
ggaagacaaaggatgacttcttgagtcggcaccttgacactagatgggcagaggagcctcctgttcattccggggagggctaacttgggagaagtttaagagctggcc

SEQ ID NO: 6768619 - DNA, 84 bp, Homo sapiens
gaaggcagcaagctgcctgctcggctcctgggagctctggccaggctggaagaatcaccaacccagcaggcagcctttgccttc

SEQ ID NO: 6768620 - DNA, 75 bp, Homo sapiens
gctccagcaaattttaatactgctttaaatatcatgacaccatgaactctaaagaattgaaaagtgcttgtgagt

SEQ ID NO: 6768621 - DNA, 69 bp, Homo sapiens
taaactgctgtgcatacacaaacatgtcacgtgaaaaccaacctccatgcagtatatgtcagtagttta

SEQ ID NO: 6768622 - DNA, 73 bp, Homo sapiens
gctcatggattttgcaaatcaggaattcatacaggccacagtggaaattgcttgattctgcaaaagcattggc

SEQ ID NO: 6768623 - DNA, 56 bp, Homo sapiens
gctgctttctgaaggtgcactggcacattcagtatccttgaccttcagtaaagagt

SEQ ID NO: 6768624 - DNA, 68 bp, Homo sapiens
ctcaagtgtgttgactgaattggggattatactcacaactcttccctagacagacaagatgctaagag

SEQ ID NO: 6768625 - DNA, 71 bp, Homo sapiens
ttcactggggatgctagaaattgctcccggtttttcagccaagataaaatcagcattccaagcagagtgaa

SEQ ID NO: 6768626 - DNA, 65 bp, Homo sapiens
tgatcataccagtttccatcaggatttatcagatctgaaacatcctgcagataagctggttgaca

SEQ ID NO: 6768627 - DNA, 58 bp, Homo sapiens
acccaggctggcgtgcagtggcgtgatctcggctcactgcagcctgtgcctcccgggt

SEQ ID NO: 6768628 - DNA, 72 bp, Homo sapiens
tttaagttccattccacctgcagcacattccctgcctgggaggcatggcaggaactggagctggatgttgaa

SEQ ID NO: 6768629 - DNA, 96 bp, Homo sapiens
caggttgcagtgtgtacattaagggtgtggtcagatgctgagagatgacatctgtggctgcagaccttaaacaaagtcagcatatctgcaagactg

SEQ ID NO: 6768630 - DNA, 58 bp, Homo sapiens
tcagcaagcagggggatgttcagggggcccaagtctccctccctctgggggttgttga

SEQ ID NO: 6768631 - DNA, 69 bp, Homo sapiens
tctgtgcacaataggcattttttttcagattccttagtaggataaataggagaatgtttggaacacaga

SEQ ID NO: 6768632 - DNA, 86 bp, Homo sapiens
aagtgatgtcattccgttctggagataagtaaagaggcaattctgtgagttgctcctgaatttgtcctttacagcatgacacattt

SEQ ID NO: 6768633 - DNA, 64 bp, Homo sapiens
ggtggtagaattgcacgaactgctggggaaggaaaacatatcctagctggccaattctattact

SEQ ID NO: 6768634 - DNA, 63 bp, Homo sapiens
tacattgctcattatattgcttcagattgaggataaaacatagaagcaacctgggccaatgta

SEQ ID NO: 6768635 - DNA, 80 bp, Homo sapiens
gttaagggtggtgtaggagatcaaataaattatcctttaacatccagactataagattttgacttctacctacccaaagc

SEQ ID NO: 6768636 - DNA, 57 bp, Homo sapiens
tagttggttaccttttcacaaggactcctagatgggaggcaagaggtaactgtacta

SEQ ID NO: 6768637 - DNA, 68 bp, Homo sapiens
ggttttcagtcttgtttttctggtccagctatgaaattgtactaatcacagaaacagactgtttggcc

SEQ ID NO: 6768638 - DNA, 72 bp, Homo sapiens
gcttgacctctgacctggcccctcaaagctgggcaactgaggacattccagccaccaggtctgaggccaggc

SEQ ID NO: 6768639 - DNA, 66 bp, Homo sapiens
gtcatttatttgcctgggaattcaagaagcagagaaattagaagaaacttctcaggcacgtgtggc

SEQ ID NO: 6768640 - DNA, 85 bp, Homo sapiens
gggcctagaataatcagaatagtgggggacagtctttaccagctggtgtgaaaatacttcagtgttctggcaatgactagagccc

SEQ ID NO: 6768641 - DNA, 60 bp, Homo sapiens
ccacatgcagctagtagctatggtatcagacagtgctgagttatatatactggctctggg

SEQ ID NO: 6768642 - DNA, 66 bp, Homo sapiens
tttatggctggctacatttatactctcattagttttctgatgattgaataaatatggtcacataga

SEQ ID NO: 6768643 - DNA, 73 bp, Homo sapiens
ccaagtctgtgaccattgggtgtccttaaacaggcagctggagatcccagaatttggatcatgattttactgg

SEQ ID NO: 6768644 - DNA, 67 bp, Homo sapiens
cttatttatgtctgtctctaatatctagcatggtgtgtctcattgatagcagacatctataaatgag

SEQ ID NO: 6768645 - DNA, 67 bp, Homo sapiens
actccccacagccctggactggttggtctcctcagaagcctgggtctccagttcagggcagggcagt

SEQ ID NO: 6768646 - DNA, 64 bp, Homo sapiens
actgcattggagagcatgaattttttcaaacctatttgacacaggtctttgtttttcaagtagt

SEQ ID NO: 6768647 - DNA, 105 bp, Homo sapiens
ggagctatgggtgtcttagggattgcttcgggctctgtgtgtatgaaagaaacggagagagatcagcttcaaaagccagaagcctgcgtccccagcccatgctcc

SEQ ID NO: 6768648 - DNA, 72 bp, Homo sapiens
gctgcaggccttgagggcagtacttgggatagtatatctgctggcccaggccaaagccctggacgctgtggt

SEQ ID NO: 6768649 - DNA, 80 bp, Homo sapiens
ctagcattcaacagagcttgggtcatctcatgcatgaaaattatgtttccacaatgagatctcaagtttcctgaagtcag

SEQ ID NO: 6768650 - DNA, 84 bp, Homo sapiens
ataggatgaaattgttcattcatcaaatatttactgtgtgcatagactatgcaaaaagtaagatacttgataatgagctcctgt

SEQ ID NO: 6768651 - DNA, 77 bp, Homo sapiens
ttcctgaagcgcctgcggtgtgagcctgctgtgaacagcctcatccagtgtaggctgaccccagagcggcccgggga

SEQ ID NO: 6768652 - DNA, 64 bp, Homo sapiens
ttttcacattctctggttatcgattcattatataacataatatttgggatctgagaagtgaaaa

SEQ ID NO: 6768653 - DNA, 65 bp, Homo sapiens
gcttctaggttcctaggtgaataattcagactttacttatttatttataccaggtgatcggaggt

SEQ ID NO: 6768654 - DNA, 63 bp, Homo sapiens
cctagaggatcctaagaagatatgacaactaaatgtaatgtggtatcctggatgggatcctgg

SEQ ID NO: 6768655 - DNA, 65 bp, Homo sapiens
gatatgaaaagagctgggaactacatgacaagtgtcccattgtttcacagcttttattctgcatc

SEQ ID NO: 6768656 - DNA, 62 bp, Homo sapiens
cactcttggcggactttggatcacatgtttgtccccctaatgctgaagagctgtcaaaagtg

SEQ ID NO: 6768657 - DNA, 63 bp, Homo sapiens
gttctcctcttgtcccaggctggcccacgatgggcaggcgaggtagccggggcacaggggagc

SEQ ID NO: 6768658 - DNA, 63 bp, Homo sapiens
gatccctcatgtggatttccattggctgtttagtcacaaccactggaagatgctgaggtcatc

SEQ ID NO: 6768659 - DNA, 83 bp, Homo sapiens
gccctggccctttcctggctggcggttttggtgtggctgactacctaccaccttgggcgcccaggaaagaagggggccagggc

SEQ ID NO: 6768660 - DNA, 59 bp, Homo sapiens
ctcacgggaagggagacagtaggataaatatcacagccttctgctccagctcctctggg

SEQ ID NO: 6768661 - DNA, 127 bp, Homo sapiens
cagtgtatggggaagacttttgtgtcctcacttcttgacttctgggtgccctctgggggaacacagcccggggaaggggtgcccagagaggcaaggcctaggcccagatgatttcccctcctagctg

SEQ ID NO: 6768662 - DNA, 78 bp, Homo sapiens
taaaactcttcagaacagcacagggtgatttgggtatagctatctccagataccttggcccttgttcttggagtttta

SEQ ID NO: 6768663 - DNA, 101 bp, Homo sapiens
tgaggctggagaattgcttgaacccgggaggcagaggttgcagtgagccgagatcgcgccactgtactccagcctcggtgacagagcaagactccgtctcg

SEQ ID NO: 6768664 - DNA, 62 bp, Homo sapiens
gtcctgcttcttagttccttctttgtgacaaaccaaaagaataagaggatttagaacaggac

SEQ ID NO: 6768665 - DNA, 84 bp, Homo sapiens
gggttgggctttgttgccagccctcagggactgactagcattctgcttctcccaaggattgtgctgagccaaacagagcctccc

SEQ ID NO: 6768666 - DNA, 72 bp, Homo sapiens
ttttaacttgattacctctgtgatgacattagttccaaataaggacacattcggaggtagttgaggttagga

SEQ ID NO: 6768667 - DNA, 69 bp, Homo sapiens
tttgccagctggctttctatttggtgctatctctccataggaagtcccggagaaggatcggaaggcagg

SEQ ID NO: 6768668 - DNA, 115 bp, Homo sapiens
ccttgtcacctgcctttacactcagcctgccccaccctcgctccatttcggtgatcaattcatccactgaatggacatttgggggtggagcgagtggtgataaatgcacattagg

SEQ ID NO: 6768669 - DNA, 77 bp, Homo sapiens
ctcatcccagaacggttgcgcttatattaaaattttatatatgaaatgtacataaaaacgcacacagatgggatgag

SEQ ID NO: 6768670 - DNA, 72 bp, Homo sapiens
agaggagaaatttggggacctgaaagagaaactgctctcagtcatatctccttaattttctgtcaacccttt

SEQ ID NO: 6768671 - DNA, 59 bp, Homo sapiens
gaagtgttttgtggttgtgaatcacttttaatggaagtgacaactttacaaaattcttc

SEQ ID NO: 6768672 - DNA, 68 bp, Homo sapiens
ggaataatcatgagagccaccatgcttctgtgtcctcatagtcacacagtggctttcattattatttt

SEQ ID NO: 6768673 - DNA, 56 bp, Homo sapiens
gcaagcagatctccggagggaagagaaagtcccacatctccgggccactgctctgc

SEQ ID NO: 6768674 - DNA, 66 bp, Homo sapiens
cagtttagccagtggtcactgaggaagaatataagttagcctcgtagtgaccatgtggaagtcctg

SEQ ID NO: 6768675 - DNA, 56 bp, Homo sapiens
ctgccctttgaagtaagctggtgttattaacattggcttcatttttgaggtctcag

SEQ ID NO: 6768676 - DNA, 96 bp, Homo sapiens
aggtggcccaggtggggaaaagaggatgtcagtcagcttggatttcattgtctcctgaaatcaagtctgagactccagtaccttcctggggcatct

SEQ ID NO: 6768677 - DNA, 76 bp, Homo sapiens
aagagttgtaggaaaggtaaaagtgagagaaacaggtaacttctgtgctaagttcaatgcctttctctaagctctt

SEQ ID NO: 6768678 - DNA, 70 bp, Homo sapiens
aggattgggcttgggcctgggtctttgctgccaggtggccctgcggtaatcatccaggcctcccatgcct

SEQ ID NO: 6768679 - DNA, 63 bp, Homo sapiens
tcacctccgcttgtgtatacctccaactgtcggttgatgttggatttgtctaccagggaatga

SEQ ID NO: 6768680 - DNA, 130 bp, Homo sapiens
gacttttcagagcttgtggtacggggagacaggcaggacaggcatgtgctctaggctacagggatgcgacaagtagtactggctctggaagcacttttccttcctttcttctctctgcctctgaagcgtc

SEQ ID NO: 6768681 - DNA, 67 bp, Homo sapiens
ggtgcaggacgaagtgggggttcgcaaataccacaatataaagcagactctgccagtctcctgcact

SEQ ID NO: 6768682 - DNA, 55 bp, Homo sapiens
cttctggaagctgtaggggaaattctattttgttgccttctccagcttctagaag

SEQ ID NO: 6768683 - DNA, 65 bp, Homo sapiens
gaataccatgaattcttgcctccacagtcaagatgaacagaaaaggtaggagttgatggatgttc

SEQ ID NO: 6768684 - DNA, 62 bp, Homo sapiens
gtgtagaagaggcaagtcagtggatgtttcagccagagcctggcttgcttccccattctcat

SEQ ID NO: 6768685 - DNA, 56 bp, Homo sapiens
tgtgatctgaaggagctctgaaccctccagtgagacatcagcccatcagactcaca

SEQ ID NO: 6768686 - DNA, 76 bp, Homo sapiens
tgtgaagccacacgtggcatataaagatgtgttcaatttcacattgagcacctattatgtgtcaagtatacgcaca

SEQ ID NO: 6768687 - DNA, 70 bp, Homo sapiens
gctttgggcccatcattgctgtgggcatgtggacacttgacactggccctgccattgatcggcccagggc

SEQ ID NO: 6768688 - DNA, 63 bp, Homo sapiens
ggggtaggtgtagcgctataaccagtttatgggaacaccaggaaatagcttgtcagctgctcc

SEQ ID NO: 6768689 - DNA, 73 bp, Homo sapiens
tgattctgtgttagccttgtagagcaccttcccagaaggaagaacaggggcttctattctggcacaagaatca

SEQ ID NO: 6768690 - DNA, 97 bp, Homo sapiens
ggtataaccagttgaatgtagaattggagaagaacatgaattagcgtggatattgctgtatatggcttactttatattactgcattttcatcttacc

SEQ ID NO: 6768691 - DNA, 72 bp, Homo sapiens
aacatcatagacacatcaaggatcagttttgccagctggcaaggactggaaaaggtgtagtgtgtgtgtgtt

SEQ ID NO: 6768692 - DNA, 61 bp, Homo sapiens
tccactggtcagagaaaaacgttaaacaaattaaatttaacgggatttaattgagcaggga

SEQ ID NO: 6768693 - DNA, 64 bp, Homo sapiens
cctatggagtggcatggtagagtggagcctatagggtggcacactgccacattcactcttcagg

SEQ ID NO: 6768694 - DNA, 87 bp, Homo sapiens
ggaatggtggaattccaaacacttgcgactagccagtagagaggttgttcaagcctgggctgatttagtcacgtttttccccaatcc

SEQ ID NO: 6768695 - DNA, 70 bp, Homo sapiens
gtcctgaatattagatgatgagtccttcatattttgagtggtttcagcatctacatatttagaaagtgac

SEQ ID NO: 6768696 - DNA, 61 bp, Homo sapiens
gctgaacacatgcttagatttcagtggattccttcatccatgcacctaacatttgttgagc

SEQ ID NO: 6768697 - DNA, 63 bp, Homo sapiens
ggctgtgcagggcagagtctcaacacaggaattggaacataacaaatctgccgactgccagct

SEQ ID NO: 6768698 - DNA, 56 bp, Homo sapiens
ggacaggtgcgtctgtggtgggccatgacaagccaaggcagccacagcccctgtct

SEQ ID NO: 6768699 - DNA, 69 bp, Homo sapiens
cagtttttcaagacaacctgcatgtgataaagtctggcatggggactacaggaggttgcttggcagctg

SEQ ID NO: 6768700 - DNA, 68 bp, Homo sapiens
cagtaggtctgagtatggcctgagaatgtgcatttctaacaagttctcaggtgatactgaggttgctg

SEQ ID NO: 6768701 - DNA, 55 bp, Homo sapiens
caatagcagcttctgaatgcaaataatttttttgagttgcatggctgctgctttg

SEQ ID NO: 6768702 - DNA, 65 bp, Homo sapiens
tgatgtaagcactttcaactctggatctcccattcacatgtctggttggaggtgcagtgcatgca

SEQ ID NO: 6768703 - DNA, 82 bp, Homo sapiens
ggaataaaattggcgctcagctgcattgtgtatgatatttcgaaacattaaacttgcttggctgtaatcccaaattaattct

SEQ ID NO: 6768704 - DNA, 71 bp, Homo sapiens
ctgtgcattgtcttgtctgtagtgccaatttttatggttcgatggtgtatttacagacatgacaataatgg

SEQ ID NO: 6768705 - DNA, 125 bp, Homo sapiens
gctttctctaggatctcaacaatcttgttcactttgggtctgtttagctgagaaggggagtgaagatccacctttcattgacctggaagaccctaaggcgaggccaacctgaccttgtggctggc

SEQ ID NO: 6768706 - DNA, 68 bp, Homo sapiens
gattgtagacatattagactgccatagtccaaatcaatgctgatcacattttaatgtgtgctgcaatc

SEQ ID NO: 6768707 - DNA, 119 bp, Homo sapiens
ctgggctagattgggctgggctggactgggctaggctgagctgggctgagctgagctggactgagctgggctgggctgggctgggctggcctgggctggcctgggctgggctggcctgg

SEQ ID NO: 6768708 - DNA, 106 bp, Homo sapiens
gggagattcgtggttattgccggattcaggaatctagacttaagccttatgcagggaaaggttcagagttgttgatgtttgtcagatgtaactaggagattctctc

SEQ ID NO: 6768709 - DNA, 96 bp, Homo sapiens
aaaatcaagaatgctctgtatagggctgctgcagatgacaggaagcttatgctgcctagtgcagatggctgcgtcccttgctgaggtcttgatttt

SEQ ID NO: 6768710 - DNA, 65 bp, Homo sapiens
tggagtcaggagggctgggagggtgtagcctctgccaaccctgcctctgcttcctgtagcttcca

SEQ ID NO: 6768711 - DNA, 80 bp, Homo sapiens
gatttcctatgagttcatatttaggcagcccagccactctaaaagtctgagggttcttatagtatcagagctaggaaatc

SEQ ID NO: 6768712 - DNA, 71 bp, Homo sapiens
tccttttgccgttttcatatcgttgcctgtcaaaagcacacaagttacagatttgatctgagaacaaagga

SEQ ID NO: 6768713 - DNA, 86 bp, Homo sapiens
gctcttctctccaaggccagctggagggatgaggcatgacaagtccatccctacagctggcacttcccctacagctgagagggggc

SEQ ID NO: 6768714 - DNA, 82 bp, Homo sapiens
agtcacatgaccattcctaaccacatgtgggctgggaaatatactctactgtttgtccagttaggaaaggggcatgaagatt

SEQ ID NO: 6768715 - DNA, 69 bp, Homo sapiens
ctcacagcagggtaacaggaagaccccctcctccagccaaaagagtcccactgagcccctgctggtgag

SEQ ID NO: 6768716 - DNA, 59 bp, Homo sapiens
agaaggcagatgggacggagcaggtggagagacgagagcttggattcgtccagccttct

SEQ ID NO: 6768717 - DNA, 63 bp, Homo sapiens
tattgcgaatgtttagcccatcgtgattattacaaaatcagaacagcgagaatattcacagta

SEQ ID NO: 6768718 - DNA, 81 bp, Homo sapiens
ggggtgggtcatctggaccttggccctgccctggtgctgcagggcgctgtgtgaggcccgaggttcgtgtgcacccacgcc

SEQ ID NO: 6768719 - DNA, 84 bp, Homo sapiens
gattatagatgagagtgtgggatagttcatcagcatgtgagtagatgctagataaactggaaccattgcctcttctctgtcttc

SEQ ID NO: 6768720 - DNA, 80 bp, Homo sapiens
gctgaagcatttatttccaagagcttatttctgaatgacaaacatcttcatacatgaaataggattctggaggtttgagc

SEQ ID NO: 6768721 - DNA, 70 bp, Homo sapiens
ggttcagaggtaagaggcttgagaatattctgttatggggaaagcagtgaagcttccaaactgctggact

SEQ ID NO: 6768722 - DNA, 88 bp, Homo sapiens
tctttcatggcacagttgagagactgagacctatagaaatgtcatgtaattttctcaagtttctacagttaagtagtggcaggaaaga

SEQ ID NO: 6768723 - DNA, 55 bp, Homo sapiens
agtcacatagaagtgggtttaaatgtcagttgagtaactcacttgctgtgtgact

SEQ ID NO: 6768724 - DNA, 56 bp, Homo sapiens
agaggcacccagaggttgtatttgaccatgactttaaactactctgggttgtcttt

SEQ ID NO: 6768725 - DNA, 122 bp, Homo sapiens
agagaaaactaggtgccaataggctcatgcagttactgtcttatatggctagagcttttgttctttgaactaagctcttttcataagagcaaacgtatgtaaagcaggtatttgttttcttt

SEQ ID NO: 6768726 - DNA, 77 bp, Homo sapiens
gagataggtacacatatattaaaaattgttatatcttcatggtaataattttttactgtatgaagtggctttaactc

SEQ ID NO: 6768727 - DNA, 84 bp, Homo sapiens
tccaggcaggtacagcaagaggacaaaggacaacaggcaaagaatactgggatcctgtttgtccctgcccctgcttgcttgtga

SEQ ID NO: 6768728 - DNA, 62 bp, Homo sapiens
agtcatgacaactgcaaaacatggggtaacaatatttaccttgaaagctggttgttaggatt

SEQ ID NO: 6768729 - DNA, 81 bp, Homo sapiens
ttgatttctgaccctaaatctagtacctttttgattatactccatgtaaaagaagggaaatctaggaaagagagaaatcaa

SEQ ID NO: 6768730 - DNA, 66 bp, Homo sapiens
ccagcttattaagcaggtaagacccgtctttttgatataaaaacaataggctatatgctaggctgg

SEQ ID NO: 6768731 - DNA, 74 bp, Homo sapiens
ccgagcagagccctctgagcctgggttgtaaagtgatgaactttgtggttataagcctgtcttagtctgtttgg

SEQ ID NO: 6768732 - DNA, 60 bp, Homo sapiens
gccaagctgtttttcagagacgtaatgcagacacgtgtttgatcactttagctatttggc

SEQ ID NO: 6768733 - DNA, 55 bp, Homo sapiens
ccgaggctggagtgcagtggcgtgatttaagctcactgcagcctccgcctcctgg

SEQ ID NO: 6768734 - DNA, 93 bp, Homo sapiens
ttcctattccccggtgatgtggtttctccactatcttgtaacttaatagaatttacaagataacggagaaagcacatcattggagaataggaa

SEQ ID NO: 6768735 - DNA, 68 bp, Homo sapiens
tgctgggctcatgtttctttgaggacaagaataaggagtgatttttttggagagtcatgtgcccagta

SEQ ID NO: 6768736 - DNA, 62 bp, Homo sapiens
tctgattctctccagttatttatgggaaaaatagtctctatttgtacctgtgggaatacaga

SEQ ID NO: 6768737 - DNA, 77 bp, Homo sapiens
tcccctaatgcacttagtatgaatgccttaataagatcctttcctgggcaatatatactagtgcagcgtgagggtgg

SEQ ID NO: 6768738 - DNA, 61 bp, Homo sapiens
ggtcaaaagctgccctacacggaagcacttaataaatgcttactgactgggcagtttttcc

SEQ ID NO: 6768739 - DNA, 76 bp, Homo sapiens
acatgccaacccagccaatagcaagggaagctggttggagaggcggagccttatgctgattggctgatttggaggt

SEQ ID NO: 6768740 - DNA, 76 bp, Homo sapiens
ctctggaccacagtgcatggcctgtaggctgactgcttgtttctgctttaatctacattctgctctgtgttcagag

SEQ ID NO: 6768741 - DNA, 66 bp, Homo sapiens
tattgaagagataagtgacagaactttccctggttattttgggggagtattatttatcatttagta

SEQ ID NO: 6768742 - DNA, 57 bp, Homo sapiens
gagttgcttggattattcctttgggctctgttgggtatccagtataaccagcaactc

SEQ ID NO: 6768743 - DNA, 64 bp, Homo sapiens
ggaaagactagtctgaaggtttttttcctgggaagagggagatataacctgtggacggttcacc

SEQ ID NO: 6768744 - DNA, 60 bp, Homo sapiens
tcagtttgggaattgtagctgtcttgctgtagatcaggcctgttataattcccagcttgg

SEQ ID NO: 6768745 - DNA, 90 bp, Homo sapiens
ggaaagcaagtggggccattgaggtgggcagagggagatgtttattttctgcattcttctgcctactttcatccatccacttacccagcc

SEQ ID NO: 6768746 - DNA, 99 bp, Homo sapiens
gcttctccatggcagcagcacctccattgtttttagtccattccaggagcaagcccatgatgtagatgctgaaacatggaggcgtgttgtacgaggagc

SEQ ID NO: 6768747 - DNA, 61 bp, Homo sapiens
gagtggagtggtaagggggaggaattggactgcttccctttagaattctgcccctcctctc

SEQ ID NO: 6768748 - DNA, 65 bp, Homo sapiens
tgggcacctgttcttgtgctgcctgcagagaagattggagcacataccagaaccacaggtttcca

SEQ ID NO: 6768749 - DNA, 89 bp, Homo sapiens
atgcacaagccccacacatttttcacttaccgtaggaagatttaaaaagaaacccttttgtgtgtgtgtgtgtgtgtgtgtgtgtgtgt

SEQ ID NO: 6768750 - DNA, 76 bp, Homo sapiens
gtgaagatgctggcagggtatgattacctctgaggcctttagcttgcagatagcgtcattcttgctgcctcttcac

SEQ ID NO: 6768751 - DNA, 64 bp, Homo sapiens
ttcccatggcatctaatcccagtgagtgctccaaagccaggctgtgtatcagatgccacgggaa

SEQ ID NO: 6768752 - DNA, 59 bp, Homo sapiens
gtctttgttctttatctgactgtgagctggtgaaaagagaacagtcagggaataaagac

SEQ ID NO: 6768753 - DNA, 76 bp, Homo sapiens
aatttagagaaacgggattttgatggtagtgctactaattatgcttcatcactatctagatttctttctctgtgtt

SEQ ID NO: 6768754 - DNA, 66 bp, Homo sapiens
tcagaattgcttaattctgaaaatatagtgtgggcaggcacctatgtcctgagagtggagcattga

SEQ ID NO: 6768755 - DNA, 56 bp, Homo sapiens
ttgattacttaaaccttctgttgagcttttagacagatggtcttttgagtaatgaa

SEQ ID NO: 6768756 - DNA, 79 bp, Homo sapiens
aggttttttgaaggtcagaatgagattaggttaatttgttaagttattaatctactcagtaactgcttaggaagaacct

SEQ ID NO: 6768757 - DNA, 55 bp, Homo sapiens
ggcgcctcccaccgtgtgcagctgaggaaggctgtgctctgagcgtggggttgcc

SEQ ID NO: 6768758 - DNA, 109 bp, Homo sapiens
cttgcgggctggggctgcggtaggcgcctgcgggatccttgccctccgagtttggtgggcctacgccagtatccccaggcgccgggggcagcggctccagagccccgag

SEQ ID NO: 6768759 - DNA, 82 bp, Homo sapiens
gcgtttgcttgtcccagatttttcatgagatgagatttttcatgagatgaagtctctttttcatgagatgaagtctaaatgc

SEQ ID NO: 6768760 - DNA, 63 bp, Homo sapiens
ctgctgcgggacccactgtgggcctggcttgctgccagccagcaaggacggattctgcaggag

SEQ ID NO: 6768761 - DNA, 98 bp, Homo sapiens
gcagctgtgacactgatgtattttatattggatattacttgtcagtaagttcacttacaagcagctacatatcacagaagaggcatggtttcacctgc

SEQ ID NO: 6768762 - DNA, 72 bp, Homo sapiens
gacagctatgctgtgcatcttgcctggatgttttttcagaggagggtgcaggcaagagcaaaagcagcagtc

SEQ ID NO: 6768763 - DNA, 103 bp, Homo sapiens
ttgaggcagagtcttgctctgttgtccaggctggagtgcagtggcgcgatctctgctcactgcaagctccgcctcccgggttcatgccattctcctgcctcag

SEQ ID NO: 6768764 - DNA, 105 bp, Homo sapiens
agcattgctgtcttttttgtcatcattccgttttgcattgttatcattctcttttgcattgttaatatcagaatgtaatggtccttaggaaagcacagtgtggct

SEQ ID NO: 6768765 - DNA, 76 bp, Homo sapiens
gtcaaattgtctagaattgcttggcagatgcactgagaataatttccctatctttcaactagcctgatgatttgac

SEQ ID NO: 6768766 - DNA, 72 bp, Homo sapiens
actgcaaaaatgggtgcattcagtaatttcagattttcagtgctatttttattgcaactcattttgtgtagt

SEQ ID NO: 6768767 - DNA, 92 bp, Homo sapiens
gtatgtattcattcctgattcacaaacaatgctttggaatttatagtgtatgtagtttcaaatcctgtttggatacatgaggagtatcatac

SEQ ID NO: 6768768 - DNA, 71 bp, Homo sapiens
ggttctttctgttacttttaccttagatattctggtcccatgaatgtacctgaaatagcctagaaagcacc

SEQ ID NO: 6768769 - DNA, 76 bp, Homo sapiens
tggctcgcacagttgcctcgggaggcagggaactcatagagaagggccacactgcagctgaggccagctatgcccg

SEQ ID NO: 6768770 - DNA, 72 bp, Homo sapiens
gtgggagtttgaacttcatgttcttgatgcagtgaaaagaccaaaacatctacatggagtcaagcccttcac

SEQ ID NO: 6768771 - DNA, 60 bp, Homo sapiens
ccactgtcgctttcacacaggttagcttggaagacaaaagagctttggttaagccagtgg

SEQ ID NO: 6768772 - DNA, 97 bp, Homo sapiens
cctgaaactaaaaatgaatttccagatcagatgactcaattttactttgactcaattcctgtaatgcatcatcttggctggagttccagtagacagg

SEQ ID NO: 6768773 - DNA, 59 bp, Homo sapiens
cccagtcatacctaaaatttttacttagagctgagtatttggtgtggtattgacctggg

SEQ ID NO: 6768774 - DNA, 107 bp, Homo sapiens
atccccagctttgtcagcccagtccagctctcagcgggagactcacttcctgggatgtgtgagatccagctgcagggctgtgatgctgtcaggcattgataggggat

SEQ ID NO: 6768775 - DNA, 75 bp, Homo sapiens
agtgggctccctcacatacctgttttccctttatttgtgttataaggggatggatatgtagagaaaggagctcct

SEQ ID NO: 6768776 - DNA, 64 bp, Homo sapiens
tttgttgaatgaataggtgtccagatgggaggaaggtctcagcccctattcaattcaaaccaaa

SEQ ID NO: 6768777 - DNA, 78 bp, Homo sapiens
tccctctgctgttcttctactgccattctctaagctttaggaaagtaggcagggaataatacaaataataaacaggga

SEQ ID NO: 6768778 - DNA, 81 bp, Homo sapiens
tttcaaggcctattacagaaaacttcaagcagcagtcaccaactcatgacatggcttttttattctgaatgaggcttgaga

SEQ ID NO: 6768779 - DNA, 77 bp, Homo sapiens
cctaaattcatttgttaaggccttaacccccaatatgactatatttggagacgaggcctctaaggaagtaatcaagg

SEQ ID NO: 6768780 - DNA, 93 bp, Homo sapiens
tgcagtgaatatgccacagtagatagaaaagggatttgtcttctggtctgtcttccacagagactaagcttttcatcaacgtgctttactgca

SEQ ID NO: 6768781 - DNA, 80 bp, Homo sapiens
gcggggagaggacaggctctcagccagttggcaggactctgccaagcctgtcccggcctcagagcctgtcctgttgctgc

SEQ ID NO: 6768782 - DNA, 58 bp, Homo sapiens
gcccatcccttgagagagcacaaggccctgaggtctttctgcagcacaggggcagggc

SEQ ID NO: 6768783 - DNA, 57 bp, Homo sapiens
tcaggaagacaatctttggctcagtcagctgggctgaagtagccaggttttccctga

SEQ ID NO: 6768784 - DNA, 69 bp, Homo sapiens
tgaggtaatagttccattgccgaaattcctttatgtttcaataattttggtcattgctattgtttctca

SEQ ID NO: 6768785 - DNA, 80 bp, Homo sapiens
gtgagtagtccttgtgaagacgctggacttcttcctgcagacaaggggagctgccagcaagtttcaaacagggcacttat

SEQ ID NO: 6768786 - DNA, 58 bp, Homo sapiens
gctgtgtgctctggtctttcttagcataatggagtggaaaaagctggggcatgcatgc

SEQ ID NO: 6768787 - DNA, 59 bp, Homo sapiens
ggatgtcattgctttgtagagagggtctgctttctgatacatctgcctgcagggcatct

SEQ ID NO: 6768788 - DNA, 86 bp, Homo sapiens
gtgtactgcttttttgttgcattcatggcataaattttgtggacgcatttctacaaaaaccgtggattcagcatgttgcagagtac

SEQ ID NO: 6768789 - DNA, 64 bp, Homo sapiens
atcctggtagattgctacatttgcatagaaatcctgcttgtgaaggtaaggtttgcttgaggat

SEQ ID NO: 6768790 - DNA, 76 bp, Homo sapiens
aagggaagtataatacagagcagtaatagaggagaatttaaagttataagaaaattctctctgtctctcttccttt

SEQ ID NO: 6768791 - DNA, 123 bp, Homo sapiens
ggcttcttaaaggctggagtatttattctgtcagcttgtcagcagttaatgatagagctgaaaaaattctgtcatgaaaaacagtttgaaaagctgtttgaaaaatacataggctttaaagtc

SEQ ID NO: 6768792 - DNA, 57 bp, Homo sapiens
cacctggtaacctgcctgactaatggattaattgtcctttggtttgttgcttaggtg

SEQ ID NO: 6768793 - DNA, 59 bp, Homo sapiens
tctaggctggaggaagcagtgcctgggaataagctctccagggtcccctcctgcttaga

SEQ ID NO: 6768794 - DNA, 57 bp, Homo sapiens
ggaacggtccgactccatgggctccatctgcctaagattggtgtgcactgtgcttcc

SEQ ID NO: 6768795 - DNA, 85 bp, Homo sapiens
ccctagatagaaggcaagtgtcatatgccactgcatccccaactctgaggacaaagcctggtggcaggtggaccttcattcaggg

SEQ ID NO: 6768796 - DNA, 73 bp, Homo sapiens
tagagaagttacttgataggctacagctaagtatttgccttatttgagcatggtctgatcaggtggctgtctg

SEQ ID NO: 6768797 - DNA, 59 bp, Homo sapiens
tggcaaattcatctttagttctctgaaacagttctaagagacctgaccagaggttgcca

SEQ ID NO: 6768798 - DNA, 55 bp, Homo sapiens
cctggccagtttccaggccctgttcctgcacatgctctgtgagtattggccctgg

SEQ ID NO: 6768799 - DNA, 85 bp, Homo sapiens
gagccagccaggcagccttacatggacatctcagggacatggtatttatgagatgaggtatccagtgaagcagccatgcaagctc

SEQ ID NO: 6768800 - DNA, 59 bp, Homo sapiens
ggtggggaggggctggcaccaggcagcactgcctggccctgcttatgtctctcttggcc

SEQ ID NO: 6768801 - DNA, 86 bp, Homo sapiens
atacagtgctcaaataacatgcttatccaaggaaaaggtaaagcaagtcatttttgctatttggaaaagcatttggggatgtgtgt

SEQ ID NO: 6768802 - DNA, 67 bp, Homo sapiens
gttagttaaaattctgctgacataattctgcagctacttcagacagaatgatagtcagaaaactagc

SEQ ID NO: 6768803 - DNA, 74 bp, Homo sapiens
caatttcctaatctgtgaaataggtatgataattgtagaagctacctcattagcctattttgaagattgagttg

SEQ ID NO: 6768804 - DNA, 57 bp, Homo sapiens
caattttatcagtagttgttccctggcaccttactgctaaagctgcagatgaagttg

SEQ ID NO: 6768805 - DNA, 56 bp, Homo sapiens
tcctggccttagcgaggcggtccgagggtcacctagagctttgcacagagccggga

SEQ ID NO: 6768806 - DNA, 124 bp, Homo sapiens
gctctcctccctggagggcttttcagccccagaaccaaggagctcggtatggcctccgctttctaaactttctggccctgagtcctggctttgggatgtaaaagtcttctttctagaggagagt

SEQ ID NO: 6768807 - DNA, 67 bp, Homo sapiens
gggactggggaaggacccgagaccctctcggaggacttgggcaggtttcgacttctttttcattccc

SEQ ID NO: 6768808 - DNA, 65 bp, Homo sapiens
ggattagatttctcactttggaggtatccttaacagttgggctaattaaagttgaaatcaagtcc

SEQ ID NO: 6768809 - DNA, 68 bp, Homo sapiens
gaaccatatgaaattgccctgtttgtaagttaaaaaaaccattgaatacaggcaatttcatatggttc

SEQ ID NO: 6768810 - DNA, 56 bp, Homo sapiens
gaaggagggtgcggatctgagcgctgaggctctctgatcgattacgccttttcttt

SEQ ID NO: 6768811 - DNA, 70 bp, Homo sapiens
ttaggatttttgatgaggattgcattgaatctgtagatagctttgagtattattgtcatcttaatcttaa

SEQ ID NO: 6768812 - DNA, 64 bp, Homo sapiens
gacacagagacttgcagttgtagagctagaaatccttacagattatataaccaggtctcctgtc

SEQ ID NO: 6768813 - DNA, 130 bp, Homo sapiens
tagtgccctccaaggctctgcattcatggatccaattacgttttttgtcatggtaaaagccacagtggatatattaaatgagagtgtggtttaagaatgaaggcccaggagtctggagatctggtttcta

SEQ ID NO: 6768814 - DNA, 68 bp, Homo sapiens
tgtctggagaaacatcaggcataggcatacattagataaatgtttgtgttttcctttcatcacggacg

SEQ ID NO: 6768815 - DNA, 78 bp, Homo sapiens
ggcccgagttgcatacttggggcctccactctgtactaactgaacttcagggtgaactccattatgccttgcctagcc

SEQ ID NO: 6768816 - DNA, 56 bp, Homo sapiens
aggataaggtcaaaggctaggcaagggtagaccatgtagagcttaggttttattct

SEQ ID NO: 6768817 - DNA, 70 bp, Homo sapiens
gaaagggatggcagtctgcatgagaaaggacctgaaatggtattttctgtgtgattgactattttctttc

SEQ ID NO: 6768818 - DNA, 57 bp, Homo sapiens
cacccctagtgtttgtgggccccctccaggaagcgcctccaaacctctaggctggtg

SEQ ID NO: 6768819 - DNA, 104 bp, Homo sapiens
ccggcgcatgcgtgtcccgctccggcgcggtttagtgggtgcggcctggagagcccacgccagccggacactgggccacgtcggagccgccggggcggcgccgg

SEQ ID NO: 6768820 - DNA, 56 bp, Homo sapiens
atccaggcctgagtctggtcctgggtttgggcctgggcctgggacttaggctgggt

SEQ ID NO: 6768821 - DNA, 73 bp, Homo sapiens
ttcaattacacaaagctccccaaatagtaggtcattcagccttgcctataaccagagcttttgtagacttgag

SEQ ID NO: 6768822 - DNA, 71 bp, Homo sapiens
gaaagttgtatggaagcaacagtgcatgggcacatgggtgctagcatctgttctttcattaaacaattttt

SEQ ID NO: 6768823 - DNA, 65 bp, Homo sapiens
aatttatagcagttacagcatttattttgcatccaggcagatttatgagagtaatgctataaatt

SEQ ID NO: 6768824 - DNA, 92 bp, Homo sapiens
ggcaggtaaaatgtctaactgaaaccaaacactttagggagaaaagaaaatactttttacgtgaagggtttcatggactgcatctacctgct

SEQ ID NO: 6768825 - DNA, 88 bp, Homo sapiens
tacagggactatttaggggccaggccttctgggagcctctttggaccaagtgtgtcaggaggcctgagtagctctagaaagccatgtg

SEQ ID NO: 6768826 - DNA, 66 bp, Homo sapiens
ttcactgctgggggacacaggtccgggtccagcaccatccccgaaaccttccccctcggctctgag

SEQ ID NO: 6768827 - DNA, 56 bp, Homo sapiens
tctaccactttgacctctctgtgcagaggctaaaggtactggtcaggggtggtgga

SEQ ID NO: 6768828 - DNA, 55 bp, Homo sapiens
gccatttctgccttgtgccactggacagatgattcctgcatttggtgagtttggc

SEQ ID NO: 6768829 - DNA, 85 bp, Homo sapiens
gccaaatccagcagctggcttacttgagatgcatctggcaaattccagggcaaagccagtgactcccagcggctccagtgttggt

SEQ ID NO: 6768830 - DNA, 57 bp, Homo sapiens
acattcttccagctggctgttgtcgggtctggtgagatggagagtctggaagagtgt

SEQ ID NO: 6768831 - DNA, 73 bp, Homo sapiens
ctcattattgtgcatttttgtgtttaaagcattagaatagctgttgtaagggatacaaagattaatagtagag

SEQ ID NO: 6768832 - DNA, 70 bp, Homo sapiens
gtgacaagagtctcaagagaaatattaacaatgattttgggggttcagaggtctctggggacactttcac

SEQ ID NO: 6768833 - DNA, 83 bp, Homo sapiens
ggccagtgggagaaaggtggccggtgccagccgggccagacacccataggccagccctggcctggccgccagccacctgggcc

SEQ ID NO: 6768834 - DNA, 58 bp, Homo sapiens
gcagaggtgtcaccttccaggactagctgctgttggcctgggagtgtgccatctctgt

SEQ ID NO: 6768835 - DNA, 63 bp, Homo sapiens
ggacaaagggttgtatataatgggtaaatttctggcccagtttatctgtgatcctaaatgtct

SEQ ID NO: 6768836 - DNA, 66 bp, Homo sapiens
gtaagtatatgcttgtgcatgtctttgtgtgcatgttgtatgcaaaggcatgtgagtatatgtggc

SEQ ID NO: 6768837 - DNA, 73 bp, Homo sapiens
gggtgggtgggcggggcctctcaagctgcccagaaaagggggcagcggagggcagccttgcagcctcccactc

SEQ ID NO: 6768838 - DNA, 55 bp, Homo sapiens
tggtgtaatcagtttctagctctaaaatttgttgaatagatactgatgaactcca

SEQ ID NO: 6768839 - DNA, 60 bp, Homo sapiens
gttcccaagctctgcctcttggcatggcaccagaccagtcctgccaggaagcatggggac

SEQ ID NO: 6768840 - DNA, 70 bp, Homo sapiens
atgatctgtggggcctgtgggctctgacctcactctgcagcagcaaagcccagaggcctcactttttcat

SEQ ID NO: 6768841 - DNA, 77 bp, Homo sapiens
gccgtgtcctgcaggccaggaatgggtccggagcagtttccacatctttcccacagtccgggctggcaggacagagc

SEQ ID NO: 6768842 - DNA, 73 bp, Homo sapiens
gaaaaatgaatggactgatccctgggagggtgactatgggctagcagtgctcctatggatcagttgttttgtc

SEQ ID NO: 6768843 - DNA, 78 bp, Homo sapiens
tttgttcaccctcttacaagagtcacagatttctgcttgtgtgctacagatactgatgctgtcaaggaggtgaacaga

SEQ ID NO: 6768844 - DNA, 58 bp, Homo sapiens
atgaggataaagtatgttgcagggcatgtataaaggatgtgatatgctttgtatttat

SEQ ID NO: 6768845 - DNA, 109 bp, Homo sapiens
ccattctggctagactgttgtttatcaaatagagtagtagagtctatttaactctgaatattacttgatttgaaaatcatagcccttttattaattagccctgacttgg

SEQ ID NO: 6768846 - DNA, 60 bp, Homo sapiens
aggatgtgtgtaggctggttaatttcgaagatgaaaaccttttcctccctgccacatctt

SEQ ID NO: 6768847 - DNA, 103 bp, Homo sapiens
tgtcttttacaagaaaattttatcaatgatgcaccattataagagtttgttcatctaccttatcctgagaaacctagatgctgtattattctaacatgagaca

SEQ ID NO: 6768848 - DNA, 79 bp, Homo sapiens
cctgcaggagttttgtgttttctgttttctctttatctttttagggtatctttggaaagccaagcacagcttgtttagg

SEQ ID NO: 6768849 - DNA, 76 bp, Homo sapiens
gataggtaaacttccacgtttgatcatgcagctggaaaacttaatagtgaattaaatgttggacgtatacattgtc

SEQ ID NO: 6768850 - DNA, 61 bp, Homo sapiens
ccattgggaagctgaggcccaagtggcagtcattactgccagtagcacagttacccagtgg

SEQ ID NO: 6768851 - DNA, 57 bp, Homo sapiens
atgtaacagtaagcctgtgagctgcagaagaacagcagttccaaggatctgtaacat

SEQ ID NO: 6768852 - DNA, 55 bp, Homo sapiens
tttccttgttcatttgccctattctaatgggatggggaatgcacaaacaaggaag

SEQ ID NO: 6768853 - DNA, 64 bp, Homo sapiens
ttgtacttccagacctagcagggctatgatagaaggagggacgccctctggtcagggaggacaa

SEQ ID NO: 6768854 - DNA, 100 bp, Homo sapiens
caatcttgaagcctggttctcctgtgtaagatgtaaaggcaatataaaggcaatattctttccttacatacattttgaatgagtactatgtgcaaaattg

SEQ ID NO: 6768855 - DNA, 85 bp, Homo sapiens
tcccagaatccaatctccagtgaggcagattctgcaagctccttggcagtgcctgattctgatgcctcatggatctgatctggga

SEQ ID NO: 6768856 - DNA, 71 bp, Homo sapiens
ggaatataggctcttggtaaacaaaattatcccatcctgatcttttttccccaatgggctctatgtgttcc

SEQ ID NO: 6768857 - DNA, 65 bp, Homo sapiens
caagcacagggtgtggctgcagtgtgaggtctcagagccctggatgcacagccataccctccttg

SEQ ID NO: 6768858 - DNA, 57 bp, Homo sapiens
tagtttgtaggatccagtctaaactgccagtattattaggctgggctacaacaactg

SEQ ID NO: 6768859 - DNA, 64 bp, Homo sapiens
tgtgcctagttctgtgctcactctaccccacccgaccagggtgagacgcacacaggaaggcaca

SEQ ID NO: 6768860 - DNA, 57 bp, Homo sapiens
gcatttccattttcagccattactgagaaagccagttgtggtgcttggatgggaggc

SEQ ID NO: 6768861 - DNA, 103 bp, Homo sapiens
cttgcagagatgatgataagcctgcagcaggtgacaacgagtggactcacctccaagctcttcattttttgcatacctgtgtccattgccatctctctgccag

SEQ ID NO: 6768862 - DNA, 71 bp, Homo sapiens
gagatcctgttagctttttcactgagctgataatgaatttatttattaatttaggaatagctgacaatctt

SEQ ID NO: 6768863 - DNA, 76 bp, Homo sapiens
gatgattttctatgaataaatggtaaagactcattaatgtgattttagaggctcatttgttctgcagaagatcatt

SEQ ID NO: 6768864 - DNA, 57 bp, Homo sapiens
cctgcagatgtgggacagctgtttgtacttagcagttaagtgtccctgcaatgcagg

SEQ ID NO: 6768865 - DNA, 90 bp, Homo sapiens
cagcacatgaacgtggaatcctcacattggcccagccaaggcattctctcaccctggctgcagtgcttgagatgtcacgttcacactctg

SEQ ID NO: 6768866 - DNA, 97 bp, Homo sapiens
ggctgtgttgttcccatgtggggctgtcaggcaactggtaagcacgccttgtgtccccagccagatgataagctctatgtgggctgaactcacggct

SEQ ID NO: 6768867 - DNA, 58 bp, Homo sapiens
ggcctgctttgagatgggcagcagctactccagggtgcgttgacctgcagagcaggcc

SEQ ID NO: 6768868 - DNA, 57 bp, Homo sapiens
gctttggctgtcagtcaaccaccaaagatttattgaacattgacttaacagcaaggc

SEQ ID NO: 6768869 - DNA, 55 bp, Homo sapiens
gaagaggaggggttagcagggcactccaatctttgtctggtgcctttcactcttc

SEQ ID NO: 6768870 - DNA, 78 bp, Homo sapiens
tggttgttggctgacctgatcatgcctttctcttttttaaaggcttatagagaaatgtacaaaagtcagccaactcca

SEQ ID NO: 6768871 - DNA, 56 bp, Homo sapiens
agactctggtcctcttgaattttattttctagaaaaatcaccaggctcctgagtct

SEQ ID NO: 6768872 - DNA, 64 bp, Homo sapiens
ggacgggtggctgaggaggcctctcatatatgtggtttggtggggcctcctcagccccgtgtct

SEQ ID NO: 6768873 - DNA, 68 bp, Homo sapiens
agtgtgagtttggggtgcggggttccggagccttctctggcagccctcgggtactcacgtgctccact

SEQ ID NO: 6768874 - DNA, 57 bp, Homo sapiens
cttctgccatcaagatgctctggctatccctttggcttaaagaggatgaggcataag

SEQ ID NO: 6768875 - DNA, 87 bp, Homo sapiens
aggaggcactgtgggagcatttttgtctgcattttagcaaatatgcttgattgccagaggtgctcacgttgtggtttttcccttcct

SEQ ID NO: 6768876 - DNA, 67 bp, Homo sapiens
ggagctagcctgtctctgtttattcatgatgcttaaggctatttgttaagcatagaagagtggctcc

SEQ ID NO: 6768877 - DNA, 56 bp, Homo sapiens
ttttcctctgcaataaaagcagcctttttcttaatgttttctttgatagagggaag

SEQ ID NO: 6768878 - DNA, 74 bp, Homo sapiens
gtctccaggaatgtgtgtgggctagtgctgaacctggacaggtttctgtgcttcctacaaatattcctggctgc

SEQ ID NO: 6768879 - DNA, 67 bp, Homo sapiens
cttgcagtaatagtcccactttacaactcaagggggccaaactgtaaagtggcgctgttactgccag

SEQ ID NO: 6768880 - DNA, 65 bp, Homo sapiens
tccaccacacgagttcttttcttgatatctgcaaagaaaccaagaggctggcattgatggtagga

SEQ ID NO: 6768881 - DNA, 88 bp, Homo sapiens
ttagcagagagtctagctgcagaggaccctcagttgctcaaagctcattttttaatgaggagtcttcatcagctagatactctggtga

SEQ ID NO: 6768882 - DNA, 67 bp, Homo sapiens
gggcccagtggagataggagtgtggcaaaaaaggagttgggtgacaaattagactctaactggaccc

SEQ ID NO: 6768883 - DNA, 130 bp, Homo sapiens
ttaggatgtgatatgctttgtctgagcaggggattctaggacttgagagctaagctgggctggatccatcttgatctggaaagttttgggaggccaaggaactatgttcagcagaaagtttcaatcctga

SEQ ID NO: 6768884 - DNA, 56 bp, Homo sapiens
tcttgaagaggaagtggagtagatattcatttatcagttcactcatcctttcaaga

SEQ ID NO: 6768885 - DNA, 97 bp, Homo sapiens
ggctgtctagaagagtcagttgttgcaccactagtgtctgttttatttctacatgggtgttatgggcgatgcaaacctgattttcttcgaatcggcc

SEQ ID NO: 6768886 - DNA, 61 bp, Homo sapiens
cagttgttcctaagtcatcaacttaatagactcatttctagaagacaaatgggaatagctg

SEQ ID NO: 6768887 - DNA, 66 bp, Homo sapiens
gtgtgtgtgtgtgtgatcattgctattcacctgtggtggggggaagtcttgaaacacaaactagac

SEQ ID NO: 6768888 - DNA, 95 bp, Homo sapiens
gtgaggggtctgtgctcagggcttggtatagggaggagggtgaccagtcgtggagccttccccttatcaccagcctgtctcccactgcccctgac

SEQ ID NO: 6768889 - DNA, 89 bp, Homo sapiens
ggagaatctcttgaacccgggaggtggaggttgcagtgtgccgagatggcgtcactgcactccagcttgggcaacaagagcaaaactcc

SEQ ID NO: 6768890 - DNA, 57 bp, Homo sapiens
ggccacggtggggcaggaggatagcttgaggccaggaattctaccttactgtaggct

SEQ ID NO: 6768891 - DNA, 79 bp, Homo sapiens
aggctagaagttcaagatcaaggtgtggcagggttggtttcttctgaggcctctctccttggcttgcagtcttctccct

SEQ ID NO: 6768892 - DNA, 63 bp, Homo sapiens
ttgacgacctttaatgtttctaccactgtgctaggcagtgagagagacacaaaggaatgttaa

SEQ ID NO: 6768893 - DNA, 78 bp, Homo sapiens
gccaagacgctcgggtatgtgcagtcctagaatcccccagcagagcctgaggacacatgcacaccctgcgtccatggc

SEQ ID NO: 6768894 - DNA, 57 bp, Homo sapiens
tgtgtatactgggtgccagacatcattctaggtgcagaggaggcaccagtgaacaca

SEQ ID NO: 6768895 - DNA, 94 bp, Homo sapiens
atgactaatggtattgagcatctttttacaggtttaagggccacttgaatatcttctcttgtgaagtgtttgaattattttgcctattatttat

SEQ ID NO: 6768896 - DNA, 57 bp, Homo sapiens
gttcttaatatctctcttcctttcttggtggcaaagaggctgcagggtattgagaat

SEQ ID NO: 6768897 - DNA, 66 bp, Homo sapiens
atgttgagatactttgcctctatgcttgtcagctcatgaccagtcctagaagaggagtcgagacat

SEQ ID NO: 6768898 - DNA, 55 bp, Homo sapiens
tgtggtccaggtttgcaatgttaagtggaaaagaacgactaaatctgtgatcaca

SEQ ID NO: 6768899 - DNA, 62 bp, Homo sapiens
tcagaagagtcatagagacattgatttcattcataaaatcatgtactgctgtggctttctga

SEQ ID NO: 6768900 - DNA, 61 bp, Homo sapiens
ctggagcctcttccctgtggcttggcatcgctggatcctggcatcaggacagggtttctag

SEQ ID NO: 6768901 - DNA, 67 bp, Homo sapiens
gaggtcatctgcttcttctggtcagtgccttttaaggcaatgatattgaagtgatgaagacaccctc

SEQ ID NO: 6768902 - DNA, 57 bp, Homo sapiens
agtccatggttgtagttctctccattatcatggctggaaggaactcacccatgggct

SEQ ID NO: 6768903 - DNA, 63 bp, Homo sapiens
ggtctttctctcaggtacagataacagctaaacagaatgttttagctccttggagaagaggcc

SEQ ID NO: 6768904 - DNA, 86 bp, Homo sapiens
ggcgcaggcttcagaattaatgtcacatctgggatggccctgatgtggtcagaggcacaacagtcccattgtgtttgacttgtgtt

SEQ ID NO: 6768905 - DNA, 56 bp, Homo sapiens
attctgtctcccatggccgaaggcttattccacaaagccgtcatggagagtggggt

SEQ ID NO: 6768906 - DNA, 57 bp, Homo sapiens
ctctaggagctgagagtagtcccttttgctagcaaactgacaatctcagtcctatag

SEQ ID NO: 6768907 - DNA, 64 bp, Homo sapiens
catggcattaggaccatgagcctggtcagagagatacgtatgtccaggtcacccctgagccatg

SEQ ID NO: 6768908 - DNA, 83 bp, Homo sapiens
tcatgtaaatgtaagttgccaaaggtcatagtcttggatcatatactccagtgagaattctaaacttcttggcaattttatgg

SEQ ID NO: 6768909 - DNA, 128 bp, Homo sapiens
agcctgttgtgatatattttgaccattggcttgcacactatggattgtctgtggtgtaataccttgcacaatttggacttcactggttggcggccgagactcttgaagttgtagatgtacaacaggct

SEQ ID NO: 6768910 - DNA, 102 bp, Homo sapiens
cccggtatcttattaattctgcatgttatgaaataaatatagatcagacaattgcagtgatggttctatctttttattatgcatttggttcttggtgccggg

SEQ ID NO: 6768911 - DNA, 68 bp, Homo sapiens
ttaagctttttcccttcaccagttgtcctaatgggcctggcattgcttctgaagtggagagagtttaa

SEQ ID NO: 6768912 - DNA, 76 bp, Homo sapiens
cagcccatcccatgtgtccctgtctggttttcatgctttgctgtgacaggaactatgtggatggttttctttgctg

SEQ ID NO: 6768913 - DNA, 125 bp, Homo sapiens
gaagggggttagatggaggaagtaataattgggcctcaaatcctattatatttcttttggatagtgtaatggagcttagagttatcccaaggatgttatcgccgacatctttctttacccctttc

SEQ ID NO: 6768914 - DNA, 79 bp, Homo sapiens
tgtcagatctagctggtcttaaatgtgtccagccacaactgtgttgctatggacaaaagagactggtggacaactggca

SEQ ID NO: 6768915 - DNA, 60 bp, Homo sapiens
tactggtcttacctaatttttatcatgccaccaggtggcagcatgttatgtaaggaagta

SEQ ID NO: 6768916 - DNA, 96 bp, Homo sapiens
tgagaaatttcacttcagacagtaagaaagaggttaatgagtcagacctttctgcttttcccaactgctattttatctctgacggtgacgttctca

SEQ ID NO: 6768917 - DNA, 103 bp, Homo sapiens
tagtatctgggaaaatggaacttaataagttttgtaattatggggcaaatctatgcaaattgcgatttttattaggtaattttccatcttcatctaggctcta

SEQ ID NO: 6768918 - DNA, 58 bp, Homo sapiens
gcaaaacactggtttggcattagatggtagccatctaatacttgctcagtggccatgc

SEQ ID NO: 6768919 - DNA, 60 bp, Homo sapiens
tgttctcactggatgcttcacaggcacgttggttgcctagtcatgttgcctaggagagca

SEQ ID NO: 6768920 - DNA, 57 bp, Homo sapiens
gccttgatgatagcaggcagggaagtagtaatttccctttattgttcagcaaatggt

SEQ ID NO: 6768921 - DNA, 60 bp, Homo sapiens
tgctggagtgcagtggcttaaccatagctcactgtagccttaaactcctgcactcaagca

SEQ ID NO: 6768922 - DNA, 62 bp, Homo sapiens
tcctacccagtgtgtgccatgttgataataactcgttcctacagagcacagtcgggatggga

SEQ ID NO: 6768923 - DNA, 68 bp, Homo sapiens
ggcaaccttagttctttgatctgagagttttccacggggtatctcacagacagaagggatgggatgcc

SEQ ID NO: 6768924 - DNA, 65 bp, Homo sapiens
ggaggcagagcacactgacgtcagtctgcagatgtgcctgggctgcgtcgggtgcgcatgtgtcc

SEQ ID NO: 6768925 - DNA, 56 bp, Homo sapiens
cagggccccagaatcccccagcacctacccctgtgggaacctgccccaggcctctg

SEQ ID NO: 6768926 - DNA, 55 bp, Homo sapiens
ttgtgttcagtgcggcggaaatctgagcctccctccaccagctgcgctgaaccga

SEQ ID NO: 6768927 - DNA, 99 bp, Homo sapiens
atgcattaggaaaaagcaatagtaatggtaatagctaaagttaattgaacacttaccgtttgttagctatgctgtgtcttacaagcactttatatgcat

SEQ ID NO: 6768928 - DNA, 75 bp, Homo sapiens
gtcagcctatctgtgctgattcagcacaggcctctctacgctgcagtcctgagccctcagcacagcatggctcac

SEQ ID NO: 6768929 - DNA, 62 bp, Homo sapiens
gccatagccaaagaccttttcaaccccaagcatctgtctcttggtaggtactggcttcaggc

SEQ ID NO: 6768930 - DNA, 73 bp, Homo sapiens
atgacatatatgtgtgtgtgtgtatatataaaatatatgcatgtgtatgtacacatacacttgtaattttcat

SEQ ID NO: 6768931 - DNA, 59 bp, Homo sapiens
tatagtctttattttgggtggccatggatccaggtcaaaacaaagttaagaattctgta

SEQ ID NO: 6768932 - DNA, 57 bp, Homo sapiens
gtcacatgctgggtttctttaatggcttttttgttcattgagattttcagctgcgac

SEQ ID NO: 6768933 - DNA, 58 bp, Homo sapiens
ggaagctttctctgtttccttacttttgacatgtggggttgtgaatttgagagcttcc

SEQ ID NO: 6768934 - DNA, 84 bp, Homo sapiens
cctgggaattttgttaaagtacagattctgattcaaacaggctggagtcgggtctaagggtctgtatttctggcaagccccagg

SEQ ID NO: 6768935 - DNA, 84 bp, Homo sapiens
tactcgtttttcaggagggctgctggtgactcagacccggtgtggctgggcctggctctgagggagctcctgagagcctgagta

SEQ ID NO: 6768936 - DNA, 58 bp, Homo sapiens
gatgcgtgcaactggctctcaggaacctcatgagccagttccagcacaccactgcatc

SEQ ID NO: 6768937 - DNA, 101 bp, Homo sapiens
ttgcattttataaagtcctcttaaaagctgtgggggcaggaatctgtggtgatcattcatcaccctgcccacacagcaattttaagttactttaaaggcag

SEQ ID NO: 6768938 - DNA, 76 bp, Homo sapiens
tcaaggacttctcacaggatttcttttagtaaattttgataggtatgcttgaggagacttttgggggagactttga

SEQ ID NO: 6768939 - DNA, 59 bp, Homo sapiens
gaatggccccagagcaccactgtgacagactgttttagtgagtggtaatgggccatctc

SEQ ID NO: 6768940 - DNA, 129 bp, Homo sapiens
cccaccaccaaagtcctcctcttcctccctctccatctgcctcttgacagatcgtggctgtgccgtgactcagccgtctcatacatcttcaggtctggaggggaggtttggatgacatctccggttggg

SEQ ID NO: 6768941 - DNA, 76 bp, Homo sapiens
aggggtgagggagctctccagggtctcttttataaaggcactaatcccatttgtgagagctccatcctcatgacct

SEQ ID NO: 6768942 - DNA, 115 bp, Homo sapiens
cttcatgtctatagaaaattttcttcagaggagctgaatatatttatattaatttctctttatgggcaaatgtatattttgctatttttggcagggatttactttttgacggggg

SEQ ID NO: 6768943 - DNA, 60 bp, Homo sapiens
tggctcactaatgtctgttccagaccaggactggaaatagcagcctttagttaacagcca

SEQ ID NO: 6768944 - DNA, 67 bp, Homo sapiens
aggaccatttgctgagtgctgggctggctttacattacacccgggagtacaaggagcaggtcgtgct

SEQ ID NO: 6768945 - DNA, 55 bp, Homo sapiens
gatcttgtttcagttccagagaacatttaagatcctctgggttgaaatcaagatc

SEQ ID NO: 6768946 - DNA, 71 bp, Homo sapiens
tccttctgcctttgaaagttctgttgagaagttgcacataatgacgttagcagtcttcgctaggcatagga

SEQ ID NO: 6768947 - DNA, 90 bp, Homo sapiens
tgcctgcatcactggtggccctcagtgttctcctaggttgattgcattaccttcctaggtggacatttggccactagttcctatcagtca

SEQ ID NO: 6768948 - DNA, 70 bp, Homo sapiens
gtggtgctggcaggaataaattatggacttatgaatataacataagattctttattacctggtctcaccc

SEQ ID NO: 6768949 - DNA, 65 bp, Homo sapiens
cctggccgatggagtaggctctgatcctgtaagtacaggatgcggcctgactctaagcaggcagg

SEQ ID NO: 6768950 - DNA, 96 bp, Homo sapiens
tggcactgagcacccatcctgctccctctgcctgagctgagctgcctttcaggaagctctggtttagaaggggaaagatgtcatatgctcagttca

SEQ ID NO: 6768951 - DNA, 69 bp, Homo sapiens
agtgttggctggccacctcacagccagatcttcctcctctctgctaatagaggtggccatgtccagcct

SEQ ID NO: 6768952 - DNA, 56 bp, Homo sapiens
gagccctcattgaatctgcattttatagcatgtactgtgcaaatttcgggggtatc

SEQ ID NO: 6768953 - DNA, 88 bp, Homo sapiens
gggatagctggtgttttggctgctgctcttgtgcattagtgagcagtcataggtcacagagacagcagagtcacctctgagctctccc

SEQ ID NO: 6768954 - DNA, 59 bp, Homo sapiens
tatagtccttctaaaggtcctttctccatagagaaaggtgccccataggcaggaacata

SEQ ID NO: 6768955 - DNA, 127 bp, Homo sapiens
tacaagtgagaaggagaagagagccaaaaattaatgtggaaagctcttgagttctactgtgaacaatcaattggacccatgttttaaaattttgagtcatttaatttttttttttttttttactgta

SEQ ID NO: 6768956 - DNA, 58 bp, Homo sapiens
gccagagagatggaaaagcttaacagaccttctagtttgcatttctttttcatttggc

SEQ ID NO: 6768957 - DNA, 66 bp, Homo sapiens
cgcctccatgtttcagcatctacatcatgggcttgctcctggaatggactaaaaacaatggaggtg

SEQ ID NO: 6768958 - DNA, 116 bp, Homo sapiens
ggcagagtttgctattttgtgtgtgtgcttttttgctattgaagtggtgaagctctcttttcaaactaattctcatgcagaagctggcacatgaaacagatacaagcagagctgct

SEQ ID NO: 6768959 - DNA, 120 bp, Homo sapiens
gtcagtcggctctccgcacgtgtccgcggcctcgcggagcaggtaatcagactctggggaaggagttaccagcactctctccggcgagggggtgggcacagcggcggagggcggagggac

SEQ ID NO: 6768960 - DNA, 62 bp, Homo sapiens
tgacctgaaatatgagggtgatgcccagagccagttttggcagatgaccctcaagttggtca

SEQ ID NO: 6768961 - DNA, 80 bp, Homo sapiens
gtctcaagtttatttgaatgattatctttcggcattctctggaattgcttgttgaggtgttatttaattttttttgagac

SEQ ID NO: 6768962 - DNA, 60 bp, Homo sapiens
ttccaaagtgttaagttcagttcagggtagcttccctgctctgttaattaaactttggaa

SEQ ID NO: 6768963 - DNA, 72 bp, Homo sapiens
ctaagcgggatatcttaagctgtattgtcaactaccatttgaaatgcagttttcaaagactattctgactag

SEQ ID NO: 6768964 - DNA, 57 bp, Homo sapiens
gcccaacaggtaaacttaaaatagggagttaccacctgcttgctttgtctgatgggc

SEQ ID NO: 6768965 - DNA, 130 bp, Homo sapiens
catcttgaactgtgttatacaaagtacctggagaaaaaggaagtgggagtattattttacttcatcttggtagacaatacatttattcccttttcattcagcagacatgttaggtataaacactgttgtg

SEQ ID NO: 6768966 - DNA, 130 bp, Homo sapiens
gtgggaaaaaactttatcagcaagatcattaataacttgggactcagcttttcaagttacaattagctgctcaacagctgtgaccttcaagagctactcattattgttggtcctgattgttcactcccac

SEQ ID NO: 6768967 - DNA, 82 bp, Homo sapiens
ggctctgtgaggccaggtccagtggaaggcccagcaagaggcacagcctgggtttggatctgatctggctgacttcagagcc

SEQ ID NO: 6768968 - DNA, 61 bp, Homo sapiens
tcctttgataaccaattttaagggcccataaaaaagcccttggcattgccaatctggagga

SEQ ID NO: 6768969 - DNA, 95 bp, Homo sapiens
ttgtaatcatgccaaaattaataacattgtgtatcacccagagagactctcagggaggaaagtgaaatggttattaacttgggttattattgcag

SEQ ID NO: 6768970 - DNA, 108 bp, Homo sapiens
gggcgtggggacaaggtttgcatgggagaccaggcaattccagttagtgggttcccgtctagcccaggaatgccgtggcctctggtcagctccttctgtctccggcct

SEQ ID NO: 6768971 - DNA, 58 bp, Homo sapiens
ccagcctcatcatattcctgcttactgatccacatctgctggaatgtggacaggctgg

SEQ ID NO: 6768972 - DNA, 81 bp, Homo sapiens
gttggcagagccagaggtctctctatactgggaataagcaatgagctggaagttccattaggggatctggctcttgaggac

SEQ ID NO: 6768973 - DNA, 78 bp, Homo sapiens
atgacttgggaattccttcactgaatggctatggaaataaatgtgccaagatcaaggttagggaatgatctcaggcat

SEQ ID NO: 6768974 - DNA, 106 bp, Homo sapiens
tggatggcttatttcagagaatgaggcagtattctccattccaagaggctaccaagtgccttatggaaacaggagaatatcttcttcccccaaatgtccctctcca

SEQ ID NO: 6768975 - DNA, 67 bp, Homo sapiens
gctaacagcttagatggatacaaaggtttttataaaacaccattagtattcatttagtataggtagc

SEQ ID NO: 6768976 - DNA, 63 bp, Homo sapiens
tcggatggcaaattttggcagagcagttccaacagcactgctggctacattattgctgtctgg

SEQ ID NO: 6768977 - DNA, 73 bp, Homo sapiens
cttccctggtgttctgtctgtttgggaaacagttgagaattcccatcttccagctttcagggctttagggaag

SEQ ID NO: 6768978 - DNA, 65 bp, Homo sapiens
cccagtttttcctaccctagggtggactgtattttttacaattaactctgtgaagggtgactggg

SEQ ID NO: 6768979 - DNA, 68 bp, Homo sapiens
gttcaggaaagcttgctaggtttccacgccggaaagcccaaggagaaggagccagcaggcctctgagc

SEQ ID NO: 6768980 - DNA, 74 bp, Homo sapiens
gaaggtatttttctgtgttaaaatttgtcttgttgatgtaacagaatttttacacagggtaaatatgtgctttc

SEQ ID NO: 6768981 - DNA, 74 bp, Homo sapiens
agtggggcctggcctctgtgttcaccataggtactctgagtactgagaacctcatgcaggccatggtctctgct

SEQ ID NO: 6768982 - DNA, 115 bp, Homo sapiens
tctgggtatccaggcctcatcccaccaaggcagaagccagccagggtcccagggcaggttgtgagggccccttgctgctctgctggtttggggagggagcaaggcctggcccaga

SEQ ID NO: 6768983 - DNA, 130 bp, Homo sapiens
gctctggagcatccgccacatcttaggctggacagccaatcacatgccaagggaggctgggctcccccttccaggggctctcagggtgtgtgctgtggatgtgtgcccaagaaggtgtgtgtgttcatgc

SEQ ID NO: 6768984 - DNA, 64 bp, Homo sapiens
ccttcttctggacaggcagctcccgaggcagccccgcactaaggcagcgccgccagtcagaagg

SEQ ID NO: 6768985 - DNA, 86 bp, Homo sapiens
gctggggtcccagaggcccccacaggcttgaggcagccttgacttcccttgtggctgccaggatggccagggggccagccgccagc

SEQ ID NO: 6768986 - DNA, 73 bp, Homo sapiens
agataaattttagtgctggggtcatattgatttttatccattgcactgtgatttccagccattaaaaaagtct

SEQ ID NO: 6768987 - DNA, 64 bp, Homo sapiens
gtgttttcaacctcatacctggaggttacagtgagacatggattctagaagaggttgagaatat

SEQ ID NO: 6768988 - DNA, 81 bp, Homo sapiens
tccaggatctaaagtgtttatttagagtaggccatgggctctttccccaggccagccttgtaaatgcctctggctcttgga

SEQ ID NO: 6768989 - DNA, 81 bp, Homo sapiens
gaacacagaaaaggattgatggatcagatcacaagttacttcgatgcttaattttctggctttattccttcactgatgttt

SEQ ID NO: 6768990 - DNA, 60 bp, Homo sapiens
ttttagaagtgcctatcctatgccaaggagaggcataggatactattctcatttttgaaa

SEQ ID NO: 6768991 - DNA, 67 bp, Homo sapiens
atattttggcattaagaatatcattaaaagccaactgtttttgagaaaacttttaatgttgggatgt

SEQ ID NO: 6768992 - DNA, 62 bp, Homo sapiens
gctatggaaggccctgtttgtagaaggtcttgaatgccaatctcagcagggccatcctgagc

SEQ ID NO: 6768993 - DNA, 64 bp, Homo sapiens
tgatcttttcccttttagtctttttggaacacttctttggcgccctaacaggggaaaatgatca

SEQ ID NO: 6768994 - DNA, 86 bp, Homo sapiens
ggaggcgccggaggaggagacggaggcctggggacggcagaagaggcttcgcctgagccgagcgctctttctctcgccgcgccgtc

SEQ ID NO: 6768995 - DNA, 68 bp, Homo sapiens
ctgcagcccctggagatggcttggtggagaatatccctacaccagccagccacagtggctcctagcag

SEQ ID NO: 6768996 - DNA, 59 bp, Homo sapiens
ggccatagcagtgactaataggatacaatcaccttgttcattcgctattgtctatggct

SEQ ID NO: 6768997 - DNA, 72 bp, Homo sapiens
gttccacaggccagcgtccagaacaagctcatcccccagatgtgtcttgctggacctggctgggtgcagaac

SEQ ID NO: 6768998 - DNA, 109 bp, Homo sapiens
tgtgcaaagtgattcctggggttgtagctgtgtgattcccattatagtccatgaggatcactgactttatcaggaatcacacagctaaaccctcatgtaacacttcaca

SEQ ID NO: 6768999 - DNA, 72 bp, Homo sapiens
tggtggattttctctcaaaccttaaaatgctctcaattaaaaaacatttccagagagagaggaaaattgcca

SEQ ID NO: 6769000 - DNA, 57 bp, Homo sapiens
ggtcagcagccatgccatgaatcttgcccgagagcccaaggtgcacggtcgctgacc

SEQ ID NO: 6769001 - DNA, 76 bp, Homo sapiens
ggctgcggaaggctgcctggcttgagcatcttaacagcgcccaagtttatggttcagcagtgcagccccggcagtc

SEQ ID NO: 6769002 - DNA, 124 bp, Homo sapiens
gttctaaagtaggttaacctagaggagcaaaagctgtcaatgtatctagtctaaatggtattcactccctgtagggtagcttttactgaatggctctttgtttcgtgatgcctgccatctgtac

SEQ ID NO: 6769003 - DNA, 67 bp, Homo sapiens
tagaagggaaatgcagtcttcactgaggagcagttcacacacatcactcgtacctgctttccttcta

SEQ ID NO: 6769004 - DNA, 129 bp, Homo sapiens
tgtatatgtggtttatgtgtgtgcacacgtacatgcatatatgcatatatgtgtgtatatgtctatatgtacatacatatgtgtgtatatgcatgtacgtgtgcacaaatgtacatacatatatgtaca

SEQ ID NO: 6769005 - DNA, 79 bp, Homo sapiens
gaagctattactgcatgcacctaagcttctagaagtttgcacctgaaaagcttctgaggtccatgcagtactgagtctc

SEQ ID NO: 6769006 - DNA, 71 bp, Homo sapiens
ctttcacctttgttctcggccagagtgggggcttccctgcccagctctgcacctgggaaaagggttgagag

SEQ ID NO: 6769007 - DNA, 75 bp, Homo sapiens
gctcggtagaggtactcccctcaaagttaataagaaactaagaaattaatttcctgtcaggtgcctctgcccagc

SEQ ID NO: 6769008 - DNA, 85 bp, Homo sapiens
catagtctggcctcctctcttctgcacactctgccccttcttcagatcacgctcatgggcagagtgaagggagaggtgtgctgtg

SEQ ID NO: 6769009 - DNA, 97 bp, Homo sapiens
tttctagctcagttctcctcagactctgatgcagccttgtgaggcaaagccacatatcttatccatgctcagatttgggggcttctgagctatggaa

SEQ ID NO: 6769010 - DNA, 87 bp, Homo sapiens
cgagaggcgggaggccggggccagacagggagccgggatctgtaccgtccctggcgctttcgagccttccacggctaccgcctcttg

SEQ ID NO: 6769011 - DNA, 130 bp, Homo sapiens
cacctctgaacacgagcgatgaagtccaggctcaggatgaaagtcatggtgaggatgaatgttatcacacgtgaggttctatcctgatttgattttgcctgggatttcagaggctatgtggaagtttttg

SEQ ID NO: 6769012 - DNA, 78 bp, Homo sapiens
ttttcagggattcatgattatatttggcactcaaattagaaataattggacttagaaataaagttagatcactgaaag

SEQ ID NO: 6769013 - DNA, 93 bp, Homo sapiens
caccaaagaaagtgactaacgaggcatttctgtatttgggtaggaggagaatactctaagtgctacctggaaatggctttagttactttggtg

SEQ ID NO: 6769014 - DNA, 82 bp, Homo sapiens
aacagtgagccactgctgtgtactggctgtgctgctaggatctggggctgagccatgggcactgcagagtagctttcctgtt

SEQ ID NO: 6769015 - DNA, 102 bp, Homo sapiens
accgggataacagtgaattctgagctcctggattgctcctagggtgctggatggggattctgggacagtcaggagtttagggagtgatgctgaagttttggt

SEQ ID NO: 6769016 - DNA, 60 bp, Homo sapiens
ttgcttttgtagatgaatggggttttttattattgtaaaagttttcattaataaaagcaa

SEQ ID NO: 6769017 - DNA, 59 bp, Homo sapiens
actgtgatgttctctatcttggctccttccagaagaagaagaagagaagttatctcagt

SEQ ID NO: 6769018 - DNA, 79 bp, Homo sapiens
aaatgctgggactgagacagtgacctgggttttctctctcatctaatgtacctatggttgctgtaacactcttacattt

SEQ ID NO: 6769019 - DNA, 89 bp, Homo sapiens
gggggttgaatttcctgggcctttgcttattaattttattttaaaatacggaattataggcaaagcagtcatttaaaatgcaaatcccc

SEQ ID NO: 6769020 - DNA, 57 bp, Homo sapiens
acaggtcagataaaggctggtggttttctccaacaggcctcattatactgatcatgt

SEQ ID NO: 6769021 - DNA, 77 bp, Homo sapiens
catgggactagaagagcgggtggaatcacttgcaaaacgctaataaatctgcaggcccagctgttcctcgtccgatg

SEQ ID NO: 6769022 - DNA, 67 bp, Homo sapiens
gccatgctggaggcttcgattttgcgcattattgtaaaagagcagagtggaagtgctccaggtgagc

SEQ ID NO: 6769023 - DNA, 65 bp, Homo sapiens
gcacattcgaacaggagacctactccttaatattaaggagccacctaggagctgtttgtttgcgt

SEQ ID NO: 6769024 - DNA, 57 bp, Homo sapiens
ggagagagaggtgctgccaggcacgaggtggggcagctgcctgagcacctctgtccc

SEQ ID NO: 6769025 - DNA, 101 bp, Homo sapiens
gtggtggtatgcacctgtggtcccagctactctagaggctgaggcaggaagactgcttgagcctgggagatggaggctgcagtgagctgtgatcacaccac

SEQ ID NO: 6769026 - DNA, 76 bp, Homo sapiens
cctagcctcctttttagccttgggtggccatgagtcatagttctggccaataagacctaagcacaagtatgctagg

SEQ ID NO: 6769027 - DNA, 55 bp, Homo sapiens
agtaagttccagtttcattatgccatttttcaggtttgatggctggaactatact

SEQ ID NO: 6769028 - DNA, 60 bp, Homo sapiens
actcttctagagctggagcaaatgtcactgctctgtgtaccttctcctcctctaggcagt

SEQ ID NO: 6769029 - DNA, 69 bp, Homo sapiens
aggaagggggttaactgggtgccaggcctgggcttccacggaacaggcttcatctcgttgacacctcct

SEQ ID NO: 6769030 - DNA, 96 bp, Homo sapiens
cttcatcccatccccagcttcccatccccagcttccaacaccagctgaaagcgtagctagtgggctgggagaggaagtcacggagagcagatggag

SEQ ID NO: 6769031 - DNA, 107 bp, Homo sapiens
ctccatttgtcttctctcttacagaaatggtcaagctgcaggatagtattgtaatttatacttccatcaggtggccattttcccccttcagagagagaatattgggg

SEQ ID NO: 6769032 - DNA, 89 bp, Homo sapiens
tcaaactggatgatttcaacagatctgtcttcaggtttgctcattctttcttctgccagcttgaaactactgttgagaccctctaatga

SEQ ID NO: 6769033 - DNA, 57 bp, Homo sapiens
ggctcttttcccattttgcttatgctgctgtcttgaccagtctaggcaatgggggct

SEQ ID NO: 6769034 - DNA, 55 bp, Homo sapiens
ggccctctgtggctgccatggagactggggggccatgggcagaggcagagaggct

SEQ ID NO: 6769035 - DNA, 63 bp, Homo sapiens
gcagtctccagatggccacaggatgcaggccttgcttcctgagatgctgatttcgggggctgt

SEQ ID NO: 6769036 - DNA, 58 bp, Homo sapiens
tcatctttgtttcatggatcattaaccccaaggtgaccagaagcctgaaataaagtga

SEQ ID NO: 6769037 - DNA, 62 bp, Homo sapiens
gaaggcaggatgcggacccatcttggtagcccagaagacagggccactcatcctcacccttc

SEQ ID NO: 6769038 - DNA, 59 bp, Homo sapiens
gcctgttggtgactttctgttggccaacatgggctgactggaatgttctccagcatggc

SEQ ID NO: 6769039 - DNA, 59 bp, Homo sapiens
caggctggatttctaatacccctacaagcatcttgaacgggtgtggaaattacatcctg

SEQ ID NO: 6769040 - DNA, 67 bp, Homo sapiens
tcctgagttcatctcttatttaagttattaaacacaatcatttgtctttagataagaggtgatagga

SEQ ID NO: 6769041 - DNA, 59 bp, Homo sapiens
ggccctgagctgaagtactgtgcccaagggtcagccaaggacagcactcagacggggcc

SEQ ID NO: 6769042 - DNA, 78 bp, Homo sapiens
tatctgtttctagaagatggctaataagcatttgttgaacccaactgacttgtagaccatggtcgtctttgccagata

SEQ ID NO: 6769043 - DNA, 57 bp, Homo sapiens
gctaggcccagctgggccaggaacaggaaccctgtagaaggatccagagggccctgc

SEQ ID NO: 6769044 - DNA, 87 bp, Homo sapiens
acgtataaaagcatgcaagtattcacaggcttccctttgagtggtttcaaaggagaatttggcttgtgatgctctaacatgatgcgt

SEQ ID NO: 6769045 - DNA, 63 bp, Homo sapiens
ggagtgtcccgattttccaggtaccgtctctcacggcttctcttgactaggaaagggaattcc

SEQ ID NO: 6769046 - DNA, 87 bp, Homo sapiens
ggtatgctgagaaatgtgcttggcttggtgtgacctggtttggcttgtcctcctcactgtcacatgaagccaacatagccagaatcc

SEQ ID NO: 6769047 - DNA, 129 bp, Homo sapiens
gaaagctacaataaatttggctttgatgcaaattagattggttttatcctacccacacagccctccaaaattaggaagagggggataagagagtatttatgcattaatgacctattgcttgtgactttt

SEQ ID NO: 6769048 - DNA, 107 bp, Homo sapiens
tctccaagcagcaagtgatgatgtctgcataaggacagttatctgcaatgataaatactaaaagttgtaggtcaagtccattgtgctaacttttcttctgctgggga

SEQ ID NO: 6769049 - DNA, 61 bp, Homo sapiens
gcctttggtggcttcaaaatggctgtcttgcccctaagcattggcctgcagtcacaaaggc

SEQ ID NO: 6769050 - DNA, 61 bp, Homo sapiens
gctggttggcatcgctgtcctcctatcagtggattaagaaaaggcacagcgaaaaactagt

SEQ ID NO: 6769051 - DNA, 70 bp, Homo sapiens
tgtgtctgagctggggcagacagattggtgcagggtttcttaaaaacaattttttgctccatcagacaca

SEQ ID NO: 6769052 - DNA, 69 bp, Homo sapiens
cctcggctgcccagcccagctgagagctggccaacctgggcccatgcagaggggttgggctggcagagg

SEQ ID NO: 6769053 - DNA, 63 bp, Homo sapiens
tagaatagtggctggcatatttatccaataatcaatatttaccatgtgccaggcactgctcta

SEQ ID NO: 6769054 - DNA, 55 bp, Homo sapiens
tctcagatggcatcagctagagtcagttttgctcgctgtagttgatggtttgtga

SEQ ID NO: 6769055 - DNA, 80 bp, Homo sapiens
tataggtttcaaagttctatatatgcatgtgttgaaaataaaacacatggtaaattggtaaaggactttagaaacaagta

SEQ ID NO: 6769056 - DNA, 61 bp, Homo sapiens
tgctttgaatgtggctaacctacaaaggaaatcatgtagtccagttagtcttttcagggca

SEQ ID NO: 6769057 - DNA, 67 bp, Homo sapiens
gatacatttcaaggaggactgggcagctgcacttgtgagcggtgacagatctctgtgaaatataatc

SEQ ID NO: 6769058 - DNA, 96 bp, Homo sapiens
tctctaagcaattgagtggtgactctaaattgtgccaatatgccaattccatttgcatatctttgtaatttggactcttcctctcctgctgaaaga

SEQ ID NO: 6769059 - DNA, 81 bp, Homo sapiens
gcatagaggacattcttttcccaactgctttaaggtgaatgagtccttggatagtagaggagaggaacaaggtgtccgagc

SEQ ID NO: 6769060 - DNA, 113 bp, Homo sapiens
gacaagctctctttgattttccttgcacagggtggaagatggtcacgcaagatccatattcatatgaccatcagtcacatgtagagaaggtctcagctagcctagcttaagtc

SEQ ID NO: 6769061 - DNA, 73 bp, Homo sapiens
gaaggcagtgtccagcttcctggagtccctttgtcttctgcatctccctggctccagcagctggcctgctttc

SEQ ID NO: 6769062 - DNA, 62 bp, Homo sapiens
ttggtacagatgaggtattctcccaagaagggcaagagcaaaccttatctcttctgtgctga

SEQ ID NO: 6769063 - DNA, 81 bp, Homo sapiens
atggccttcatcctaagcacaatgctttgagtatgcagtatttgtttattaagtgcttttcgttttgctttaggggctcat

SEQ ID NO: 6769064 - DNA, 69 bp, Homo sapiens
agcccaatgggagagccattttctgcacaaacattaaggagaaagtggtcctgcaaacccgtgtggtct

SEQ ID NO: 6769065 - DNA, 70 bp, Homo sapiens
ttctggccctgtcctcatttcatctccctttgacacaatctcattgatggaggagtaaggacaggctgaa

SEQ ID NO: 6769066 - DNA, 61 bp, Homo sapiens
ctgcacatgttcatcatgacaatgtactcaggagttctaagtcatgatgagcatcctgcag

SEQ ID NO: 6769067 - DNA, 99 bp, Homo sapiens
gcagacctccgcgcagcggccgcgggcgcgaggggaggggtctggagctccctccggctgcctgtcccgcaccggagcccgtggggtggggaggtgtgc

SEQ ID NO: 6769068 - DNA, 58 bp, Homo sapiens
atttccttggaaagagacgtcgctttcatccccaagtgcaccgtccctccgaggggat

SEQ ID NO: 6769069 - DNA, 86 bp, Homo sapiens
ggcactattggcttaagtaacttatttgcaaacaggcattattaggcagtgccttttgctgcagttgcttccctttatttgtagcc

SEQ ID NO: 6769070 - DNA, 80 bp, Homo sapiens
gccccatgcctgccacagtaccccaagagtgtctgccatggctgtccctgactgtcacctcctggggttggggctggggc

SEQ ID NO: 6769071 - DNA, 56 bp, Homo sapiens
ttctgtaacacatttttgtaccttaaagggcagaggaccattatgtggttatagaa

SEQ ID NO: 6769072 - DNA, 64 bp, Homo sapiens
ggctataactgcaaaaatggtagtcttaacaatgctgttttcacacttgatttgcagttaagtt

SEQ ID NO: 6769073 - DNA, 73 bp, Homo sapiens
atgtaatcacttcctgtgtttaaactgtctgtgaatagatcatgtatttagctttgcaaaggaagttttacat

SEQ ID NO: 6769074 - DNA, 66 bp, Homo sapiens
attatatcatgctattttagtatctgctacctcaaaagaatggcagctagatagtgtgtttataat

SEQ ID NO: 6769075 - DNA, 77 bp, Homo sapiens
gtcccaagagcaagaacttgctgtaagaaggatacatgtcatgcagttctctgttgtttttgctctgagagtgggac

SEQ ID NO: 6769076 - DNA, 59 bp, Homo sapiens
ccagcatgaccatctggcagcaggactcttgaggagccctgtgcttggatggcagatgg

SEQ ID NO: 6769077 - DNA, 62 bp, Homo sapiens
atctgtggcgcaaacaaaggctctactttatttggaggctgacctttttgctgttacaagat

SEQ ID NO: 6769078 - DNA, 99 bp, Homo sapiens
taagtaaaatagactggtaactaggatacaaattctgtaatttaacatctcagaattgaaaagtgcattgtttgtgttcctgcagtctgttctttcttg

SEQ ID NO: 6769079 - DNA, 81 bp, Homo sapiens
ttgtcagtaaatcttgttatgaagatggtgggctgatcaagatgacactgagtaacccttcagaactagatgaactgataa

SEQ ID NO: 6769080 - DNA, 70 bp, Homo sapiens
ttttgttgttgttgaagtttgagggttaagcagaaaataacagtaaccaggaaatttggcaacaaagaga

SEQ ID NO: 6769081 - DNA, 67 bp, Homo sapiens
ggaacttgaggattgccttgtcagctcctgtctctacctaggcaactgacagcatatcctgttttcc

SEQ ID NO: 6769082 - DNA, 73 bp, Homo sapiens
tgaccactataaaacttgggtatgatccctaattaatattaggtaagcatccttaagtgttattctttggtca

SEQ ID NO: 6769083 - DNA, 61 bp, Homo sapiens
gtgttcccatacagtatcagtgctccaaaggcgggaccgtgatacctaatgtatggaaggc

SEQ ID NO: 6769084 - DNA, 60 bp, Homo sapiens
ccctcggggctcgccccgcccctgcccttaaaggtacagctcccggggagcttcgtaggg

SEQ ID NO: 6769085 - DNA, 128 bp, Homo sapiens
tgggatcagcttgttatgtccagccatgataaagtgaagtggagttcaggaaaggagccagaagagctcgtctctgtttcttacttcagcattaacttcaccctcagaccaaaacaatgcctgttcta

SEQ ID NO: 6769086 - DNA, 88 bp, Homo sapiens
gattttcaatatatggcaaaagtgtgaaattaaggaaagatttctatgaaattttttgcacactctgctaaatgaattattgaaattc

SEQ ID NO: 6769087 - DNA, 76 bp, Homo sapiens
ttctgtgaaaactacctgatgggtcttggtccaacctgaaggaacacatgaatcactggtggaagattatatagaa

SEQ ID NO: 6769088 - DNA, 80 bp, Homo sapiens
tagaacctacgactttaagagatgagccagttcctcctccctgaagacaaacaggtggttcagcttggctgtaggtttta

SEQ ID NO: 6769089 - DNA, 62 bp, Homo sapiens
gcctttgagcagcagtctgcaggccctgggaaacactgggctgagagtgactgttctgttgc

SEQ ID NO: 6769090 - DNA, 101 bp, Homo sapiens
tgaggcaggagaatcgcttgaaccaaggaggcagaggttgcagtgagctgagatcatgccactgcacttcagcctgggtgactgagtgagactctgtctca

SEQ ID NO: 6769091 - DNA, 61 bp, Homo sapiens
gagggtgtctggatgctagacttattttgagaaccttctgtgctgagtatccagagtcttc

SEQ ID NO: 6769092 - DNA, 55 bp, Homo sapiens
gccttctcagagagggtaatatccagagacaaccttggaccagctttcaggaggc

SEQ ID NO: 6769093 - DNA, 72 bp, Homo sapiens
cccctgcagctgggccagggccaccggcacctcccagtacccgctggtgcctctgggtcccaggtgctgggg

SEQ ID NO: 6769094 - DNA, 81 bp, Homo sapiens
tatgtgacagctggccgggaaggactggtgcctgcatatggagagtgcacttgtgacagttcctggcatagaataagcata

SEQ ID NO: 6769095 - DNA, 55 bp, Homo sapiens
gccttgctggtttctgatcctgcgttgtcatggacagccttattgcgagcaaggc

SEQ ID NO: 6769096 - DNA, 74 bp, Homo sapiens
cgaaggtaaagccttagttaaaagaagtagaatcctgacactcgggatactgaattaggtaaagcatacttttg

SEQ ID NO: 6769097 - DNA, 56 bp, Homo sapiens
ctgtgactgcagcaccaagtaactaggagtgggctggggacttggcacagtgacag

SEQ ID NO: 6769098 - DNA, 79 bp, Homo sapiens
ctgggtgaagatgaatggttcaagttttaatcatcctcgtttgcaacatctgaacatttatccacatatgtttccccag

SEQ ID NO: 6769099 - DNA, 69 bp, Homo sapiens
cttaggaagtcagagcaactgagacattggagatcatctagtgtgttcccagctttggacctctttgag

SEQ ID NO: 6769100 - DNA, 85 bp, Homo sapiens
agatacctgaaacaaaatgtcagcattgatgaaatgtgggtagtgtgtccatccatggtgttggttgtatagcttctggatattt

SEQ ID NO: 6769101 - DNA, 61 bp, Homo sapiens
tccaactgggccttgccatggcagcctccaacaggactagcttctggcgggcccacgtgga

SEQ ID NO: 6769102 - DNA, 86 bp, Homo sapiens
caacaggcattccccatcacctgtcttgtcagtctggcacactgtgcttggagacaagactaggcagttgttgggtatgaatgttg

SEQ ID NO: 6769103 - DNA, 59 bp, Homo sapiens
cccagcatgctcagtctaaattgtatatatgtatataatagatagggagagttgctggg

SEQ ID NO: 6769104 - DNA, 57 bp, Homo sapiens
acttggggtatgggcttgccttagcaccagatcctgctctagcccccactcccaagt

SEQ ID NO: 6769105 - DNA, 68 bp, Homo sapiens
ggacatgctctcctcacatttccctgtgtctacacctggcaacaagacagctgggaaatggagtgtcc

SEQ ID NO: 6769106 - DNA, 58 bp, Homo sapiens
aagcactgtccctgtttcctggaaaattttttaattttgctgaggttgggacatgttt

SEQ ID NO: 6769107 - DNA, 56 bp, Homo sapiens
gctgggagtggatgatgcagcaacgaacaaaatgctcacagggtgtaactcctagt

SEQ ID NO: 6769108 - DNA, 92 bp, Homo sapiens
cagaggaaagtattagatcaaaatcaagattagagagaccaagtagttttcatttaatttgtgtattaaccgttgatcataccagttctttg

SEQ ID NO: 6769109 - DNA, 55 bp, Homo sapiens
ccagtgtgttagtggatttccctcagacagaaacacagacccgctgacacacagg

SEQ ID NO: 6769110 - DNA, 57 bp, Homo sapiens
tgaaaagagctggcagctggatccttctagcacagactcagctgccttttctttgca

SEQ ID NO: 6769111 - DNA, 71 bp, Homo sapiens
atacattggatgtaaagcttcagagccggcagcctgcagcggatgccacctctctcttgactcgagtgtgt

SEQ ID NO: 6769112 - DNA, 76 bp, Homo sapiens
tggggccgagtgagtggagactcatcacgtccagcctcctggaggctgcctgggagccctcctcttcctcgcccca

SEQ ID NO: 6769113 - DNA, 97 bp, Homo sapiens
ttacttttgcacctatcaaggctctggcactgtgtaccatggggaatttaaaatttggtggtgaccaatgctatggccagtgaatctgtaaaactga

SEQ ID NO: 6769114 - DNA, 71 bp, Homo sapiens
tgttcattactgctgtttgccactgtgacattcattcctatgtatgaaggtgcagggagcaattgtgaaca

SEQ ID NO: 6769115 - DNA, 75 bp, Homo sapiens
gaccccttccctcagctgccgccaagctgctcggtccttccgaggaagctaaggccgcgttggggtaaggccctc

SEQ ID NO: 6769116 - DNA, 63 bp, Homo sapiens
gagaaaagagtaagggtgggggcttgtaaagctgtttttcctcatctgaccccatctattctc

SEQ ID NO: 6769117 - DNA, 122 bp, Homo sapiens
aagaaaagctttaggacagggtcatgcttgaagatgagtacttagaagcctgaaagtccgtgacatcttccatgggtggctctcaagtccttttgctcagggaccattccttaggaaatctt

SEQ ID NO: 6769118 - DNA, 56 bp, Homo sapiens
ggcttgtggcaagtgttttaagttcaagcaacttaatgcagctctaccacacagct

SEQ ID NO: 6769119 - DNA, 75 bp, Homo sapiens
ttttgcctattgacaaatctgaacatacggaacatgttctgtgttctgtatgttccgttttgtcactaggcaaga

SEQ ID NO: 6769120 - DNA, 86 bp, Homo sapiens
gcacatccccaccctcatttatccaaaagccagtttattctagaaaatgtgaactagtctacagtgatgatgaggtgggggtttgc

SEQ ID NO: 6769121 - DNA, 56 bp, Homo sapiens
gaggcctgaaaggggacctatggctgtcactgaggcctgtgtgccttctgggcctc

SEQ ID NO: 6769122 - DNA, 72 bp, Homo sapiens
gcactagcacttctggggaatagaatgatgaagaaaatggacaaaatttttatcctcatgaagagtaagtgc

SEQ ID NO: 6769123 - DNA, 65 bp, Homo sapiens
tatacaggaaattttggaacagtgagagatgaaaccaaggagcattgattcgagatttttgtgta

SEQ ID NO: 6769124 - DNA, 69 bp, Homo sapiens
ggaaaggaagcagctgtagtaggaggtggggtgccctctagtggtcatgctttggttgctgtcctttct

SEQ ID NO: 6769125 - DNA, 84 bp, Homo sapiens
cacagattttaacatgtaattgctgctttttcccaaaataaggcccattagctggaaagcagcaacagctgttagaatgctgtg

SEQ ID NO: 6769126 - DNA, 83 bp, Homo sapiens
gagatctgctttagggacagcttctagaggaattggtgacaaaacacagagacttggagcaggctgaccagagttcaaatctt

SEQ ID NO: 6769127 - DNA, 78 bp, Homo sapiens
aaaagttacacgactatttatgtgacatggagtcgtattagtagtgacgtgcccacataaatagcactgtgaattttt

SEQ ID NO: 6769128 - DNA, 70 bp, Homo sapiens
tagaatctaaatatgcaatttgaagagcctgtaacaggctcaaggtattaatttgtttatttcagatcta

SEQ ID NO: 6769129 - DNA, 78 bp, Homo sapiens
gacctgtggctccagctgctgccagccaagctgctgtgaaactagctgctgccagccaagctgctgccagaccagctc

SEQ ID NO: 6769130 - DNA, 73 bp, Homo sapiens
taacttgacacctggctctgggctaagctcccaccctgatcttgtgggatcttcccaagagccctgcaggttg

SEQ ID NO: 6769131 - DNA, 97 bp, Homo sapiens
gaacttgttaaaatacagatttctggggccctcttacagagattctgattgagcaagtctagggtggggtccacaggcttatatttataacaagttc

SEQ ID NO: 6769132 - DNA, 92 bp, Homo sapiens
aataaagctgtacttatctatgaatgttagtatgtgtgggtgtacacatatacacccatacacacatatttatgtgataagtatgccttatt

SEQ ID NO: 6769133 - DNA, 57 bp, Homo sapiens
ggattgagaatctgagagcctaggacatctcaaaattgaccttgctttttctcaacc

SEQ ID NO: 6769134 - DNA, 69 bp, Homo sapiens
catccaattactatgatttgatcattacacactgcataacgtgtaatgatgtctgagaagtatggggtg

SEQ ID NO: 6769135 - DNA, 73 bp, Homo sapiens
agcaatgtttgacagttttctgggtaaggtcttgctcacaccttgctaaatttattttcgaacatttcatgct

SEQ ID NO: 6769136 - DNA, 87 bp, Homo sapiens
gggctgggggaaggattgtttagcacttactgttttctgtgacagtatcaggagtttagccaatttggtccccatttgaatcagttc

SEQ ID NO: 6769137 - DNA, 82 bp, Homo sapiens
gccagccccagcccctgtttttccagtcagagccggagctagatcggctgggccctggggataggggtgggtggggtatggc

SEQ ID NO: 6769138 - DNA, 99 bp, Homo sapiens
gaggggtgagcctcaggcagaatggagggcgcttagatggagggggcagtgggctctccgcattggtggagcgccctcggtgtgccgggctcagctctt

SEQ ID NO: 6769139 - DNA, 68 bp, Homo sapiens
tcagactgctagtgcccaaatcccagctctgccaccttctggtagtgtgattctgggcaagaaactga

SEQ ID NO: 6769140 - DNA, 118 bp, Homo sapiens
gtcattgctgtaattgttaggatcatattaccttggaaatgctagagtaacttaaacagagaaagtgtattttagttccgggtaaaacaaatctaatagacccatttaactcagtgat

SEQ ID NO: 6769141 - DNA, 67 bp, Homo sapiens
tctgagtgtccaccttgctgattactacggtacccccgcgtgtggcacagggtgtggcacacacaga

SEQ ID NO: 6769142 - DNA, 92 bp, Homo sapiens
gagacggtgtctcgctctttcacccaggctggactgcagtggtgctatcttggctcactgcaagctccacctcccgggttcacaccattctc

SEQ ID NO: 6769143 - DNA, 68 bp, Homo sapiens
gccatttaagtctctattatgtcttggtaacttcaggtgtagcttgatgtggtaggacattaggtggt

SEQ ID NO: 6769144 - DNA, 60 bp, Homo sapiens
atgctcagctcaaaacagtacttccgttattatcagagagctgtactttgaactgggtgt

SEQ ID NO: 6769145 - DNA, 57 bp, Homo sapiens
ctgacctgtggagggctgcttgctgtgtattgaataaaggaggcttcttggggtcgg

SEQ ID NO: 6769146 - DNA, 94 bp, Homo sapiens
tgagcttgaggaatccacaattttatgatttaggagcctgctttgcataacactggtttcactttcctgggagttgaagtgattttcaggctta

SEQ ID NO: 6769147 - DNA, 72 bp, Homo sapiens
gaatagatgggcgtgactctgggacaagtatgaagacactgctcccttcttccaagcttatgctcaatgttc

SEQ ID NO: 6769148 - DNA, 55 bp, Homo sapiens
ggagttctgggaggatatttgcatgtaagtttgcaaattcacctagtaaaacttc

SEQ ID NO: 6769149 - DNA, 62 bp, Homo sapiens
cacagggcctgtgaattctccctgctctgtccctgggcagtttgaaattgtagtctctagtg

SEQ ID NO: 6769150 - DNA, 59 bp, Homo sapiens
acagggaaggacatgacttggcagtggtccaaccaggtggacagtctgtctttccttgt

SEQ ID NO: 6769151 - DNA, 61 bp, Homo sapiens
caccctgctgtcccacagcgctgaccacagggagagaggtttgctggggacatacagggtg

SEQ ID NO: 6769152 - DNA, 59 bp, Homo sapiens
catcatctctggcccttgaagtccccaagacagagaggtaatacaaggcctgagatgtg

SEQ ID NO: 6769153 - DNA, 56 bp, Homo sapiens
tgggacctgccctggccccatcttggctttcacaaatgggagctggtgaggtctca

SEQ ID NO: 6769154 - DNA, 63 bp, Homo sapiens
aggtatgaggaaaaactactgcactttctttgagacttgagagtttgtgggcttttcctccct

SEQ ID NO: 6769155 - DNA, 86 bp, Homo sapiens
ggagagggagcagggaggatgagggagggcacgctttgaggcccccagagtctgtgctaatttatccttcctctcaaattgcctcc

SEQ ID NO: 6769156 - DNA, 123 bp, Homo sapiens
cagagttggatgctaggaaagattgattttgtatcttacggggactaattgaaagaggaccctgctatcacttttcattatggttcacgtgatgtagatagtctttgatgggtttcagctttg

SEQ ID NO: 6769157 - DNA, 55 bp, Homo sapiens
ggctagagctctcttacatgggattataaaagaaaccccagagagatctcttgcc

SEQ ID NO: 6769158 - DNA, 62 bp, Homo sapiens
gatctctctagtgccaggaaagaacatttaaagatgtgactaacttggtaccagatcagatc

SEQ ID NO: 6769159 - DNA, 98 bp, Homo sapiens
ggtggcccatttcctgtaatcccagctactcaggaggctgaggcagaatcgcttgaacctgggaggcggaggttgcagggagctgagatggcgccact

SEQ ID NO: 6769160 - DNA, 75 bp, Homo sapiens
tagcttctatgatccactcctctgtgtctcatgggtggggaagcagctggggacatgggagggacatggaggctg

SEQ ID NO: 6769161 - DNA, 58 bp, Homo sapiens
tcacactgggattgtccatcatgatggaccatcatgatgatggaccatcccaatgtga

SEQ ID NO: 6769162 - DNA, 71 bp, Homo sapiens
tttaactttggcttgaaaaattaattcaatacacttaacctttttgttcttggtttgcggccaaagttaaa

SEQ ID NO: 6769163 - DNA, 69 bp, Homo sapiens
ctgtagaagtcatcagggacatgtgtaaatgttaagccacaaagatgttcatgatggcagcatttatag

SEQ ID NO: 6769164 - DNA, 130 bp, Homo sapiens
gggtaaccctttacacttacagtgtacagttcctttcccttccctagtagacccagatcatttccaggttatcctaagatttgaccctaactaggggtctagtggctaggaggtaggtgagggtagaccc

SEQ ID NO: 6769165 - DNA, 90 bp, Homo sapiens
catatgatttgggagttgactttatgtgtatgtttacttgtttatagcataagttgagggtaaatactaaactcacttttggattatttg

SEQ ID NO: 6769166 - DNA, 79 bp, Homo sapiens
ggtacaagctcagtggccatggtgcggccacagataagtcttgctggcctgcaaagcccggctgttaactggcgtgtct

SEQ ID NO: 6769167 - DNA, 127 bp, Homo sapiens
gatagatttgaggtttgactttctactgcctgtattttccaaaaaccactcaagtagatattaacaaaagaacagttctatgttagtaatactggggcacttggtggaagcaaacaccaaatctatt

SEQ ID NO: 6769168 - DNA, 67 bp, Homo sapiens
tcttttcctcttgcttatttccaaatggaaggaattcttatgaggtaatagggcagtggggaggaga

SEQ ID NO: 6769169 - DNA, 58 bp, Homo sapiens
atagctaacttttacttaccatctgaggcttgattcatcctctttgagggttggctat

SEQ ID NO: 6769170 - DNA, 64 bp, Homo sapiens
tggaaacttgcctgttacatttctagtatattattattatactagtgagggctccaggcttcta

SEQ ID NO: 6769171 - DNA, 90 bp, Homo sapiens
gttatacaaatcgcactcacttgctttcttcctgttgcacagcatacaactggcaggatctttgagagtgaagtgaggtatcagtgtaac

SEQ ID NO: 6769172 - DNA, 85 bp, Homo sapiens
tctaggaaatgggtaataacttgtgattaaatgcagatgttaacctgaaaaattcagttaatcacagatattaaacatgcctgga

SEQ ID NO: 6769173 - DNA, 56 bp, Homo sapiens
acagggagatatcttcaatatccaaagaccgtgaagggtaggaaatatctccctgt

SEQ ID NO: 6769174 - DNA, 63 bp, Homo sapiens
gtgtggagcctcaaggccatctcaggaattcaaggtatgggagcagggacccaggctccagac

SEQ ID NO: 6769175 - DNA, 56 bp, Homo sapiens
ggttcctcccagcaataaaacgctatctctacctgctgtttatgagctgtgggacc

SEQ ID NO: 6769176 - DNA, 64 bp, Homo sapiens
gtattccttcagaagacgtttactaagcgcttgctgtattggggttgctcttctcgaggagtat

SEQ ID NO: 6769177 - DNA, 59 bp, Homo sapiens
gggggacaggatgaatatctgtctgataagctcactgagatatgttaggcttgttccct

SEQ ID NO: 6769178 - DNA, 67 bp, Homo sapiens
tgatagaaggtatgtgaattagacagttggaacagccaaagtgtcttttggagcatctttcttgtca

SEQ ID NO: 6769179 - DNA, 65 bp, Homo sapiens
gtggaagtcatgtagtagtatttttgtttgcctttatggctattatgtgattatatgacttttac

SEQ ID NO: 6769180 - DNA, 129 bp, Homo sapiens
cactcctgcagatgaggtacaggggaagccaccagagagaagctgtgcaggtccccactgcctgccagggcactggagagggcaggggccagcagagccctcctgatccccgtcaatgggcagatggtg

SEQ ID NO: 6769181 - DNA, 81 bp, Homo sapiens
aggagagcagctgtgacatggacagtgattgattacctgtcatttattgcaatttctgatctctgagtacagcagcttcct

SEQ ID NO: 6769182 - DNA, 130 bp, Homo sapiens
ggcgatgcttgccagcctgagatgggcctgtaggcctgtgggccaaggacctgccatctggagcatttggcaaagttgaggggcccatgtgtcttcgagacccgaatctcaggctgaacagggctccgcc

SEQ ID NO: 6769183 - DNA, 57 bp, Homo sapiens
ggatgtggtgctcgggcctggctctgccccacccagcgaggcaccgagggccactct

SEQ ID NO: 6769184 - DNA, 80 bp, Homo sapiens
ttctcctcgtggctgcagcggctgtggagaaaccaggtgtggccagtgtcttagtgcggctgctgcagccacaaggagaa

SEQ ID NO: 6769185 - DNA, 72 bp, Homo sapiens
cctcaaaatgtgtgcctgttaaggggcaaataaatgtaatggatgtacttagagggtaacatggacttgagg

SEQ ID NO: 6769186 - DNA, 68 bp, Homo sapiens
gaaattgctgacaccaagtagtagccagctccactggaatctgctatcttgttgttaaaagagcgttc

SEQ ID NO: 6769187 - DNA, 89 bp, Homo sapiens
gctgggtcatgctgtgatgagggggcagcagccctctgcctccgcccagcctcctcctgctgctccccagcacacagcacccacccagt

SEQ ID NO: 6769188 - DNA, 78 bp, Homo sapiens
gccacttattggagagtcagaaagcagacaggggatcctagtgagctggttgcctttgtcctttctcactgtcctggt

SEQ ID NO: 6769189 - DNA, 68 bp, Homo sapiens
tgcggtgtttccagtggggaaagagtaatttttgaacatagcccctgttttcccactgaaagctccca

SEQ ID NO: 6769190 - DNA, 61 bp, Homo sapiens
ctcacagatacggctattcctggtccaaaattcattcgcaaggagtaagagaatctgtgag

SEQ ID NO: 6769191 - DNA, 83 bp, Homo sapiens
aggggtcggtccatgagtattttccctatcaatgtcactggtctccaaggaacaataggtgaatgtgcttgaaaggctcccct

SEQ ID NO: 6769192 - DNA, 57 bp, Homo sapiens
cttaggtctgagattgacataaaggggaaccggtccctagatttcctcagggctgag

SEQ ID NO: 6769193 - DNA, 62 bp, Homo sapiens
agaggcatcactaactggaccttcttcagggagaggaaataggtattcagagagatgctttt

SEQ ID NO: 6769194 - DNA, 58 bp, Homo sapiens
agattagcctaaaaatgtatagagttagtttcatttctatgcagaatggaactaatct

SEQ ID NO: 6769195 - DNA, 68 bp, Homo sapiens
gtaggtaatggcaacagtccagaagtgtggatgccaaaaattcacattctttatttgccatcctttac

SEQ ID NO: 6769196 - DNA, 71 bp, Homo sapiens
ccttcattttcttctaacttgtatgtatagttttctcatcgaaaattcatttttgtaggttagtatgaagg

SEQ ID NO: 6769197 - DNA, 60 bp, Homo sapiens
ggctcacgcctgtcatctcaactactcaggaggctgagaggtgaaaggatagtttgagcc

SEQ ID NO: 6769198 - DNA, 74 bp, Homo sapiens
gacattggctgttcattgggatcggaactctagtttgcttcattcctacttcacaactgccatagccagtggtc

SEQ ID NO: 6769199 - DNA, 129 bp, Homo sapiens
ggcattaattggcaaacaacttaattaaaatgctttctcaagtaattagcaacaaatacgtccctatctgttttgcatgccatttgtcttgttgtgtttgttaagctggcctgtcagtcaaactttgct

SEQ ID NO: 6769200 - DNA, 70 bp, Homo sapiens
tcagggaccctcctggcctttggcagccagcttcctattgcaggagctgagggtctaggagggttcatgg

SEQ ID NO: 6769201 - DNA, 61 bp, Homo sapiens
ggaatgtaacgtgaccaagttcctacacgataagaagtgggaacgatggtatttaaattcc

SEQ ID NO: 6769202 - DNA, 63 bp, Homo sapiens
catagtgtcctgctaatgggtgaaataaattttatttagggttttatttatataggacacatg

SEQ ID NO: 6769203 - DNA, 56 bp, Homo sapiens
tcaaagaagtgcaaacctcatcagatgccagattgggttgttcccacattctttgg

SEQ ID NO: 6769204 - DNA, 58 bp, Homo sapiens
atcaatagtctggaaagttctgggtagtgtcactttccttaactttcataactttgat

SEQ ID NO: 6769205 - DNA, 77 bp, Homo sapiens
ggctgttgcccctgagagactgggcagggccggcagctctttgcttgctgattctctcatctcccagagcaacagcc

SEQ ID NO: 6769206 - DNA, 62 bp, Homo sapiens
gaggccccacactcagttccccttggggcagaaacaagaggcccaggctgggtatgggactc

SEQ ID NO: 6769207 - DNA, 82 bp, Homo sapiens
taaatgccagtgtaaagaattgtggtgtcagttataggcaatagagagtttccatcattaacaccacaaggagcagcattta

SEQ ID NO: 6769208 - DNA, 93 bp, Homo sapiens
agagttccaaaagcttattgataatatagtgcataacatttaaaggtcctcatgtctctgagggcttttatatgccttagctcatggaattct

SEQ ID NO: 6769209 - DNA, 55 bp, Homo sapiens
acagaggtaggacatgagatatctatatcatgtatctcagtgaatgtatctctgt

SEQ ID NO: 6769210 - DNA, 69 bp, Homo sapiens
tagccagcaaggctgctgatgactaggtcttttaggtatttctaggagccaaattactagctctggtta

SEQ ID NO: 6769211 - DNA, 63 bp, Homo sapiens
ttagtcaggaaaagctttcctggaaggttcctagcagacttccttttatgtcttcctggctag

SEQ ID NO: 6769212 - DNA, 127 bp, Homo sapiens
taaagcttcgctggtgaatctagaccatgttttgagccattgttttaataaaagcactagtgcttccttcatctaaagcagtggttctcaaacttgcctgttcttcagaatcacttggaaagcttta

SEQ ID NO: 6769213 - DNA, 57 bp, Homo sapiens
agctcaaacctttggcactattaaatcctaaaagtcatctgccaggaggtttgagct

SEQ ID NO: 6769214 - DNA, 78 bp, Homo sapiens
taggttggtgcaaaaataattggggtttttgccattactttcaatggcaaaaaccacaattacttttacactaaccta

SEQ ID NO: 6769215 - DNA, 64 bp, Homo sapiens
agctgctggattcagcccttttctgtgtccctcagagagctatgagaactgaaccagagcagct

SEQ ID NO: 6769216 - DNA, 73 bp, Homo sapiens
tgcatttgtaacattcaagaatgctcataaccttcggggaaataggtctttgttcctgagtattacaaatgca

SEQ ID NO: 6769217 - DNA, 65 bp, Homo sapiens
ggagagcttagggggctttgcatcagggaaagcccctgggagagagaagccttgagatcctctcc

SEQ ID NO: 6769218 - DNA, 63 bp, Homo sapiens
ggcttaggtgtctctctgcaccagtctcagactccaagttgctgcaggtaaggaacctaagtc

SEQ ID NO: 6769219 - DNA, 64 bp, Homo sapiens
ggttgggcttgaggtgaaggtagggagcagctgagtgctcccggtcatatgcaggtcacacacc

SEQ ID NO: 6769220 - DNA, 55 bp, Homo sapiens
gcgggccctgagctctgtcccggccgcacgctctttatgaagccccagggcccgt

SEQ ID NO: 6769221 - DNA, 68 bp, Homo sapiens
ctgtatgtgtacaggacagaaaggaggggagtttcttgttccgccctcctcttcggctggccatgcag

SEQ ID NO: 6769222 - DNA, 56 bp, Homo sapiens
aaactgttcctttttcagcaactgcaattttgttgttgttgctttaggaaaagttt

SEQ ID NO: 6769223 - DNA, 60 bp, Homo sapiens
aggctgaggctttccttggagaaagaagagattcttgcttgtggacagtagcttcagcct

SEQ ID NO: 6769224 - DNA, 65 bp, Homo sapiens
agcctctccctcattgggttccatttctcagctgggaaaactgagaccgaaaggggtaggggact

SEQ ID NO: 6769225 - DNA, 67 bp, Homo sapiens
tcagatgtctccaagggctgggcaagttacatgaatcagtaagagatggccaaactggagcatttga

SEQ ID NO: 6769226 - DNA, 72 bp, Homo sapiens
ttgggagcaggtgtgctagggaagctaccaataactaagagctgaagtttctaactctacactagctttgga

SEQ ID NO: 6769227 - DNA, 73 bp, Homo sapiens
ggctccaaagggcagtgtgaggaacctcggaagcctcccttgacccctttttgcctccacttcctttggcgtc

SEQ ID NO: 6769228 - DNA, 65 bp, Homo sapiens
atgatccctcaggacagtgtgatgaagtttttggctcccttctcagaacaatgccttaggggcat

SEQ ID NO: 6769229 - DNA, 61 bp, Homo sapiens
cctgaaaaacctcagttctgctcttaaggcccttaaactgcttgaattgggtttacccagg

SEQ ID NO: 6769230 - DNA, 58 bp, Homo sapiens
cagtaaaggttttatggggctttcctggaagcttcccattatggaaactcttgtgctg

SEQ ID NO: 6769231 - DNA, 59 bp, Homo sapiens
gaaatgcaccttgctgtgagactgtggagataaaacaggatttaaaggcaatgcatttt

SEQ ID NO: 6769232 - DNA, 64 bp, Homo sapiens
agggcaaaatacttataaaggctatgcttatttgtccacgtaggtcggccttagtatgtgcctt

SEQ ID NO: 6769233 - DNA, 87 bp, Homo sapiens
gtgagggcacttccttctcagggctccatttcctggtttgtgaaattaaggtcttcagatatggagcagagatgggagcccaaaaac

SEQ ID NO: 6769234 - DNA, 58 bp, Homo sapiens
ggctgcagtcgtggtcagacaccagaaaacccagctgggtgttgtctaccatgaagtc

SEQ ID NO: 6769235 - DNA, 73 bp, Homo sapiens
gggctgattgtgttcctgggagctggaagctgttactgcagggttaaatcagcaacaggagagcatcactccc

SEQ ID NO: 6769236 - DNA, 69 bp, Homo sapiens
agccggaatggactgagatagggctataggcacagcctctcaagccactgcccttagccatttgaagct

SEQ ID NO: 6769237 - DNA, 78 bp, Homo sapiens
cccaggtttaggtggacgtgcaggctagctggctcccaggtgccatggccagtcctgtggtccctgtctgtgcctggg

SEQ ID NO: 6769238 - DNA, 86 bp, Homo sapiens
ctgactgcactctgctcggctcatgcttctgttgcggcactgtgctccttgctgttctaggagctgtgagcatgcctctgcctcag

SEQ ID NO: 6769239 - DNA, 55 bp, Homo sapiens
tggccctgtgactgagttctagtgcaagaaatgtaagcagaagtgacatgggcca

SEQ ID NO: 6769240 - DNA, 119 bp, Homo sapiens
taaaatgagataaagaatgaaatatgtttgatatcattatacagacgtatacataactctgtgtgtgtgtgtgtgtgtgtgtgtgtgtgtgtgtgtatactcttttttgttttatttta

SEQ ID NO: 6769241 - DNA, 77 bp, Homo sapiens
aaatatgtttctgggcttgatatttaaaatgatcatctctgactatgcttgtaaatataaagcagcagaaattattt

SEQ ID NO: 6769242 - DNA, 73 bp, Homo sapiens
agaagagtgggaatgttctaagaattctttttggcttaatctttgttgaattgaaaatatgtataactcttct

SEQ ID NO: 6769243 - DNA, 83 bp, Homo sapiens
acagccgtgctcacagagcctctgtgtcttcatcgctagaatggggatgggagttgctttgagactgcagtattgaaggttgt

SEQ ID NO: 6769244 - DNA, 81 bp, Homo sapiens
tgaacattacatcagacaatgattattccatgatattttaattaattaagggaaagccaggtgctctggtgtctcagttta

SEQ ID NO: 6769245 - DNA, 129 bp, Homo sapiens
ttaatactaatacattggtaactttagtaaatttaatttctagaagtgtctatgtctgtatagttgatagttcaaaggacagaagtgacaatttcttgggtgaaactaaaccagtatatgtactgtcaa

SEQ ID NO: 6769246 - DNA, 98 bp, Homo sapiens
tagctcatcacctgacaggcagggtcttgagaggcagccaggtttaaggacttggaggtcactggaagatgctgtggtctgaagcaggagaggagcta

SEQ ID NO: 6769247 - DNA, 95 bp, Homo sapiens
ggtataacaacttggggtgttgtgtgtttctggtggccctgaggtcctgtctgaagtgtccagaagcagtgcacatcacagggattgatttcacc

SEQ ID NO: 6769248 - DNA, 60 bp, Homo sapiens
agtcagaattcgatcccaggtctaccagacatcaaaacctgggcgcttgacctctgcact

SEQ ID NO: 6769249 - DNA, 57 bp, Homo sapiens
gaagtagccctaaggtgacagtgagcatgacgctcggagttatcaaggggctacttt

SEQ ID NO: 6769250 - DNA, 57 bp, Homo sapiens
accacttatcatcactatctcaggatctctcagcaagaggtagtgtggtgcagtggt

SEQ ID NO: 6769251 - DNA, 57 bp, Homo sapiens
gacccagcatgacacctgcacatggcagctgtgtggtaggcggtcactgctgttgtc

SEQ ID NO: 6769252 - DNA, 62 bp, Homo sapiens
gtgaagagtgattcatgcagtcactgcaaagtaaaatggtgactccaaaggccgctttccac

SEQ ID NO: 6769253 - DNA, 57 bp, Homo sapiens
gccatgcatttcgctgggaggggaggaaagaaagtcctaatagcattttgtataggc

SEQ ID NO: 6769254 - DNA, 55 bp, Homo sapiens
tgaggtcaagcccagagcagcactgacagctcaactacatgctcttctgacctca

SEQ ID NO: 6769255 - DNA, 127 bp, Homo sapiens
gctgggaaaggttgtgactgccctgaggcccagccgccctgagagcttggtcctgtccttgttttctgggctgggctgtgtctgcatgttgaagggctgtctttgaaaatggccttcactttctagc

SEQ ID NO: 6769256 - DNA, 60 bp, Homo sapiens
gggtgactcagactataagcttatttttagggaaagctaagaattcagtcagagccactc

SEQ ID NO: 6769257 - DNA, 80 bp, Homo sapiens
gattttatcaaatgggagctctttaccaggtcaggactatactagatctgactacaaagtagggagaatcatataaagtt

SEQ ID NO: 6769258 - DNA, 59 bp, Homo sapiens
gtttctgtgcttcctagatgtgattagacacaatagtcaacatctgtaaggacagaaac

SEQ ID NO: 6769259 - DNA, 86 bp, Homo sapiens
ggcatctccatcagggacttggcagcaatatggagtgagaaacagatctaagacttcatttgtctgctatagatcctgggcatgct

SEQ ID NO: 6769260 - DNA, 76 bp, Homo sapiens
gtgtatgcaccacagcttgtttagtgactcacctatccagtttgggttgtgatgaataaagctgctgtgtgaacat

SEQ ID NO: 6769261 - DNA, 57 bp, Homo sapiens
gcctgtttggctgctgacattggcagtaaggagccatgatccaggcagagggcaggc

SEQ ID NO: 6769262 - DNA, 84 bp, Homo sapiens
ggtaatgagagagtctggtgatggtcattgtcatggaccctgtgggtcagagggcactgtcataggctaacccacttaattatc

SEQ ID NO: 6769263 - DNA, 65 bp, Homo sapiens
cttattaatggaatcctaatgagtctgctggtgcccagcctgagctattggatctaagaaatggg

SEQ ID NO: 6769264 - DNA, 100 bp, Homo sapiens
tgaggcaggagaatggcgtgaacccggaggcggagcctgcagtgagccgagatcgcaccactgtactccagcctgggagacagagccagactctgtctca

SEQ ID NO: 6769265 - DNA, 55 bp, Homo sapiens
agaaagccaatctgtaaagtctgtatgctatgcgattccaacaacatggctttct

SEQ ID NO: 6769266 - DNA, 66 bp, Homo sapiens
tggggcagagcccggtgcctgtgagggataggaagctccagttcaaagcaggcttgggtctcccca

SEQ ID NO: 6769267 - DNA, 66 bp, Homo sapiens
gtgaggaagggtgtgacggcacctggcacaagcctggtgctcagagttagaccaggattcactcac

SEQ ID NO: 6769268 - DNA, 95 bp, Homo sapiens
tatgaggtagtacaggttatgtttgccatcatgagattgtccagaccatctctgcagctctatgtgatggtaaatgacacatttgctgccttgtg

SEQ ID NO: 6769269 - DNA, 59 bp, Homo sapiens
ttgagggagcacagattcttattgcctcactggagagaaacttagactgtgccctttaa

SEQ ID NO: 6769270 - DNA, 55 bp, Homo sapiens
tctgaagcagaaaatggggatactgcatatttgttttctctatatttgtttctga

SEQ ID NO: 6769271 - DNA, 65 bp, Homo sapiens
gacaaagtgacaaggcctgaagctcctgaagccaggtggtccaggattgaagccttttatctgtc

SEQ ID NO: 6769272 - DNA, 130 bp, Homo sapiens
gacttgctgaagaccgcatggctgggagacggctgaggtcaggcagcctgattctaacattccatgctttttccgctgtattatcctacagatgtttctccgtcacacactgcactacttagctgccctc

SEQ ID NO: 6769273 - DNA, 65 bp, Homo sapiens
ctatctgatgacaaactttcctgatgcccgtttcttgtctgggcattgagaattgacattcatag

SEQ ID NO: 6769274 - DNA, 65 bp, Homo sapiens
cacctcgcaggcgcagcaccaggtgcagggtggactccttctggatgttgtagtctgagagagtg

SEQ ID NO: 6769275 - DNA, 56 bp, Homo sapiens
caggctcggtccagtggcacccagctccctacctcctgtgccagccgactggcctg

SEQ ID NO: 6769276 - DNA, 63 bp, Homo sapiens
tgtgaaaatgcagattctgctgcagcaggtctggctgggacctgggattctgcagttttcaca

SEQ ID NO: 6769277 - DNA, 74 bp, Homo sapiens
aggtgagattccttagattcatggaatttgaaaatcaactggatggatgcatttccagattctgaaactcacct

SEQ ID NO: 6769278 - DNA, 62 bp, Homo sapiens
tggaggatacgttttttgtcctcatggagcctactatatagaggggaaaatgcgtattaaca

SEQ ID NO: 6769279 - DNA, 58 bp, Homo sapiens
gttgcataagaccacaaggagcaggcttaagatagcttggtcagtggctaatatcaac

SEQ ID NO: 6769280 - DNA, 63 bp, Homo sapiens
ggacaagcataagtgagatgaataaggtgactttagccttgtctgttttcccctgtgttgtcc

SEQ ID NO: 6769281 - DNA, 74 bp, Homo sapiens
ggtgagggagtggcaggagggcttggaggtcaactctttagacccttcccacagttctcttgtcacttcctccc

SEQ ID NO: 6769282 - DNA, 66 bp, Homo sapiens
ttgaggaggtagtacagagtattcctgtgtaccccacccaggttttctctattattaatttcttaa

SEQ ID NO: 6769283 - DNA, 65 bp, Homo sapiens
agctgtcactgggtaagggctgtgtgccatgactgtgctagcccagctaactcggtgagctagct

SEQ ID NO: 6769284 - DNA, 60 bp, Homo sapiens
tgtatgtgtatgtacatatgcatacatatatacttgtatgtgtatgtacatatgcataca

SEQ ID NO: 6769285 - DNA, 55 bp, Homo sapiens
caatgactggaagggaagcagagctgctgtgcttcatcacttctcagttaacttg

SEQ ID NO: 6769286 - DNA, 89 bp, Homo sapiens
aagcacaatgtgactagcattttctatgtatatgaagtattgaaaatgcccaatagctttaagacatggtgaatgtattacatgtggtt

SEQ ID NO: 6769287 - DNA, 55 bp, Homo sapiens
agtcatatctgaggaggaatccttgggtcatcaacttcttcctaacaatgtgact

SEQ ID NO: 6769288 - DNA, 75 bp, Homo sapiens
gatctcagacaaactaaacatgtagcttttgtggttttcaagagaatccattgcaaacagtttggtttctaggtt

SEQ ID NO: 6769289 - DNA, 65 bp, Homo sapiens
acttgtgaatgaagcttgcattgaggggccattagaaggggtggcgtgggcatcagtcacagtgt

SEQ ID NO: 6769290 - DNA, 55 bp, Homo sapiens
cattgggcttctcctggacccactgtttggtggcgttgcggaaggcagcccagtg

SEQ ID NO: 6769291 - DNA, 74 bp, Homo sapiens
gaaggtcttaccatgctgaggaggtgggacttgatcctgtagtcaggggaaatctctcagcgaagctggccttc

SEQ ID NO: 6769292 - DNA, 55 bp, Homo sapiens
ggcctgtagcatctgactcctgcgtgcttggtgacagggtcagtagcacagagct

SEQ ID NO: 6769293 - DNA, 66 bp, Homo sapiens
gaaagtgcttttgagtgtgtgcatgcatgctcatacattcacgtgcttaacttaggaggcaatttc

SEQ ID NO: 6769294 - DNA, 66 bp, Homo sapiens
tttttctacatgtgatgcgtgcctggatgcagcccttgtttatgggcaggcctcagtgtgggagag

SEQ ID NO: 6769295 - DNA, 122 bp, Homo sapiens
gctggatgtggtggcatgcacctgtaggagtcccagctacttgggaggctgaggtgggacgatcccttgagcctaggaggttggggctgcagtgagccaagatcatgctactgcactccagc

SEQ ID NO: 6769296 - DNA, 55 bp, Homo sapiens
gctgagaacactgaaggttcatttggctgagaaacctttttgttctgttctcagc

SEQ ID NO: 6769297 - DNA, 75 bp, Homo sapiens
gggcccgcgggacgcacggggccgccaggggaggacaacaagcctcaggccctgtccctgcgccccgcccggcct

SEQ ID NO: 6769298 - DNA, 76 bp, Homo sapiens
tagtcgcctgattctttcctggccatcacattctctcattctcatcttgtgtgctcagaacatgattcaggcgctg

SEQ ID NO: 6769299 - DNA, 70 bp, Homo sapiens
ggcagaactcccaccctgggctacacatccagggtgcaggcccttgggtgtctccaggagggaaagagct

SEQ ID NO: 6769300 - DNA, 58 bp, Homo sapiens
gacaactgccccattttaaatgaggtaaccaaggcccagagaggttgggtgagttgtc

SEQ ID NO: 6769301 - DNA, 59 bp, Homo sapiens
agaatttgacaaatatttattggcacatattttaagtgccaggcctattgttaaactct

SEQ ID NO: 6769302 - DNA, 62 bp, Homo sapiens
ggtctcaactgaactgatatcaactatcagatgtgtgaatagtgatatctttagatgattcc

SEQ ID NO: 6769303 - DNA, 101 bp, Homo sapiens
ccccagccagagccccgcccgccacattcctgcctccccggagatggccgtggccagggccgtcgccagggggccgggaatgcagcgctcaatggcttggg

SEQ ID NO: 6769304 - DNA, 77 bp, Homo sapiens
ctacacaatgcataagtttctcccagaagatcttagaagtgttgtgccatttcctggagaagcagtgaattgtgaag

SEQ ID NO: 6769305 - DNA, 111 bp, Homo sapiens
caggtctgtttaagagctctctttacagtcaatactaggaccatattttttaaataaactgtatctttctttaattggcatgtctgagtagaagcagaaaaacaggatatg

SEQ ID NO: 6769306 - DNA, 77 bp, Homo sapiens
atacttcagtgagtttttagtcttgtctgcttttcaaacttaagagggacatctcacaaacaactttattgaggtat

SEQ ID NO: 6769307 - DNA, 59 bp, Homo sapiens
cccagggatgtggcagatgttacagaatattagtatatcataaatgcacagtccttggg

SEQ ID NO: 6769308 - DNA, 86 bp, Homo sapiens
gcagtgggggaagagcttgttaaagtaaacgatccaaaaactacaaaaatgctggaggacttttgtgcaggtctctcccaagctgc

SEQ ID NO: 6769309 - DNA, 73 bp, Homo sapiens
gatgagacctctttattgacttgtttgtcctggtgggctgtttctctaccaggcaactgtgaatgggctcatc

SEQ ID NO: 6769310 - DNA, 61 bp, Homo sapiens
gctgaatgaagctgaaaaaggcatatattgatattgatataggtaacacattttattcagc

SEQ ID NO: 6769311 - DNA, 69 bp, Homo sapiens
gctttagctgactagaaaacagctcagtagaaaattattttacaaagattatattcagttagctaaggc

SEQ ID NO: 6769312 - DNA, 71 bp, Homo sapiens
ctcaaatcctcacatttgggcaggtgatcaatgcttagggagcatctcctgcccaaatgcgaggatttgag

SEQ ID NO: 6769313 - DNA, 65 bp, Homo sapiens
gaggccagaagtgcctcgggctgagggggacccagaccctcagctcaggcaactctgggcccctc

SEQ ID NO: 6769314 - DNA, 99 bp, Homo sapiens
ttaactaatttttgttgagtattttcttatgagcaagactctatattagttactgaaatagtaaattatcgtggagagaatgctgggaaacttggttga

SEQ ID NO: 6769315 - DNA, 97 bp, Homo sapiens
ctgcatttggtattgggactgttgtctaaaccataacctaaactactttatgcagttaggtaatagtctcatctcagataacaaaaggaagaagcag

SEQ ID NO: 6769316 - DNA, 103 bp, Homo sapiens
taaatgcactttatcatctgttcccctctactctgtgagctaggttctattattgtgcccattttatagaagaggaaactgaggttgaataatgtgctattta

SEQ ID NO: 6769317 - DNA, 62 bp, Homo sapiens
gcttgttttcatctttatctgagacatgtgatgaactgtctgaaggcaggtggagaacaggt

SEQ ID NO: 6769318 - DNA, 67 bp, Homo sapiens
atgtcaacttgggctggggtctcatctgaaggcttgattgggaaaggactcacttctaagttaacat

SEQ ID NO: 6769319 - DNA, 57 bp, Homo sapiens
gcatgtaggggacccagcaagtgagtggcagccgctgccaggatcccctgccggtgc

SEQ ID NO: 6769320 - DNA, 56 bp, Homo sapiens
gaagaagagaggggagtgacttatcagagtatctgtggtcctgccttcatcacttc

SEQ ID NO: 6769321 - DNA, 55 bp, Homo sapiens
tgctgcatttatcttctcaaacatatcttggtcgtgttgagaagattgtgctgca

SEQ ID NO: 6769322 - DNA, 61 bp, Homo sapiens
ttgttgccaccctcccttcctaaaaatgacctcatgagaaagggataagggggaaaaacaa

SEQ ID NO: 6769323 - DNA, 61 bp, Homo sapiens
tatttttcatttgcggcatggagttcaagctcctagatcagagatgctgctaattaaaata

SEQ ID NO: 6769324 - DNA, 90 bp, Homo sapiens
ggagcgttctgggtattccatcgtcccctggaagtctggcaggtacaaccccctcaacactccagggagggagggaatccacaggaagcc

SEQ ID NO: 6769325 - DNA, 95 bp, Homo sapiens
ggccctggctccaactctgtgtctctgccatctcactgggtcctgaaatgtcagcctgtgtctgtggcgtgaggctcggctttgcctcctgggct

SEQ ID NO: 6769326 - DNA, 73 bp, Homo sapiens
agaaagtcaaccctagaagcccagcaaactgtgatcatatcatttatatcacgataaatgggctggtttttct

SEQ ID NO: 6769327 - DNA, 101 bp, Homo sapiens
tcttgctgaaatagccaaagtatgtaatatggaaatcgaggagaaatctgcttctcagtgctatccatattccaggaacattgagctgtttctgataaaga

SEQ ID NO: 6769328 - DNA, 65 bp, Homo sapiens
gataggcaagtgtgaggggttctttgatatgaatattcatggaaaagggtctttcatttcctttc

SEQ ID NO: 6769329 - DNA, 81 bp, Homo sapiens
gtaactattatgttttataggctgttgctatatggtaacaattttatatggtaaatctaattgtggataaataataattgc

SEQ ID NO: 6769330 - DNA, 75 bp, Homo sapiens
tcagagtatgtacgggccccaggacacccggatgttcattctagccctgtccttggcctgtgctttattctctga

SEQ ID NO: 6769331 - DNA, 66 bp, Homo sapiens
tcctgatgcacttgcccctcctcagaccggcctgatgggcgtctgtgggactcaggagcgtcaggg

SEQ ID NO: 6769332 - DNA, 57 bp, Homo sapiens
tgcaggcagggccagcgtgaggtcaggattaaccagagaagctgtgctcttcttgca

SEQ ID NO: 6769333 - DNA, 71 bp, Homo sapiens
gtgtttatgtgcatgctgacttgaggagacgttagcacacatctccatgttatctgtatgtccataagtgc

SEQ ID NO: 6769334 - DNA, 81 bp, Homo sapiens
aaggaggggtgactgtgtatcttatcctggccctgtttggaaggaagagggcataaaatagagcacgtgtcactgctcttt

SEQ ID NO: 6769335 - DNA, 79 bp, Homo sapiens
taaccaggctatatatatttattaggcactagaatgtcaattggtatgccaaacatctggttacctagggtctggctta

SEQ ID NO: 6769336 - DNA, 59 bp, Homo sapiens
gctgagtgatggtgattcaacccaaagcaataagagtaaggaggtcaccatcatgtagt

SEQ ID NO: 6769337 - DNA, 74 bp, Homo sapiens
acaggcctatgttccattgcagggattaagaaatacgaacttgaacacaaaatgtagtgaagcagagggcttgt

SEQ ID NO: 6769338 - DNA, 56 bp, Homo sapiens
ctgtgagttcattgtgccacctcagggtaccttgttgcacagtttgggaaccatgg

SEQ ID NO: 6769339 - DNA, 66 bp, Homo sapiens
gtgaaagacgatggaatggctccccttccttcccccaggattataagggtttattgtccttttcat

SEQ ID NO: 6769340 - DNA, 74 bp, Homo sapiens
ctcacagccctgctgtcttcagagtataaactggagacagatgtacccagaattgaggacgggtgggaaatgag

SEQ ID NO: 6769341 - DNA, 57 bp, Homo sapiens
atttgatagatctttaatccagaagttatttagtactctggcagtggtctttcaaat

SEQ ID NO: 6769342 - DNA, 63 bp, Homo sapiens
tctcttctgtccaggtgggatttcaaagcctgctggagaagggaatcctgggacagaggcagg

SEQ ID NO: 6769343 - DNA, 64 bp, Homo sapiens
gctggacatcagcaggtgctggtggagaccactcactggttgttggctggttgctgagatcagc

SEQ ID NO: 6769344 - DNA, 64 bp, Homo sapiens
tgaaagaagtcttgtttactgttgtgagagtcatcagtttcatcagaatcagggctttgaatca

SEQ ID NO: 6769345 - DNA, 108 bp, Homo sapiens
ctactctcccacttgctgctttgaggagggcttccatggggagccccctaccacctgagttgtatggggtaccttatagaagcccaacaaagggtgggctcccagtgg

SEQ ID NO: 6769346 - DNA, 112 bp, Homo sapiens
ctttcaagtaagtgcaataaatggttctgttggaatgggaaagaagggaggtgcatacatacatgcatatatcttatttttctgtatagccagtaattccactctttggaag

SEQ ID NO: 6769347 - DNA, 81 bp, Homo sapiens
ggctgttttcagtgttccttggagcgctaaagctctaaggttccgtaactttatagcgagctctccaggaaagcataagcc

SEQ ID NO: 6769348 - DNA, 87 bp, Homo sapiens
ttggcaattatgaataaagctgctttaaacatctatgtgcagattttgtatgtgcataagttttcagcacctttgggtaaatgctaa

SEQ ID NO: 6769349 - DNA, 55 bp, Homo sapiens
gaggtcccccatggctgtgacttagaaaggtcaagccaattttatgggagacctc

SEQ ID NO: 6769350 - DNA, 70 bp, Homo sapiens
caggctgaaatctatgcttgagacagatggggaagagcctggccctgctgtgtagcggaggaacagcctg

SEQ ID NO: 6769351 - DNA, 91 bp, Homo sapiens
gatttttttaagttttattattgggagattttttcctaggcaagtatgttctctaagtctctaaagaagcctccctaaaactggaaagttc

SEQ ID NO: 6769352 - DNA, 114 bp, Homo sapiens
gcgttgtttctctctggctcctagggcgctcagtagcttcctccaccttcaggctgtagcccagtcgggggcaggctggtgggcagctgggggctgaggcagggaaacttgagc

SEQ ID NO: 6769353 - DNA, 105 bp, Homo sapiens
gagcatgcttgtcattgcagcatgattacatgtggagtctgattgcagaggggttttgcttttggtccacatttgattttcatgtaagtaaactaggttatgctt

SEQ ID NO: 6769354 - DNA, 90 bp, Homo sapiens
ttgaaaggtgcgatattccaatcttgtggttcaggatggcactgggaatcgatcacaggcttttctgacataggcttgggattagttcaa

SEQ ID NO: 6769355 - DNA, 78 bp, Homo sapiens
cttaacagcacttactaggacttagtctaatttttctctttatattcttaggctgtgtggatgagtcttactgttgag

SEQ ID NO: 6769356 - DNA, 84 bp, Homo sapiens
aagaggcagtcctatgtgtattcttacaggacatgtacattatattactgctttgattagaagagtacatggaggactaatctt

SEQ ID NO: 6769357 - DNA, 76 bp, Homo sapiens
agtttttgcctgggtagactttgaagcattctgtaaaccttttaaagaaaggagtgcctttgaaacctcaaaaact

SEQ ID NO: 6769358 - DNA, 59 bp, Homo sapiens
acacctcctgcccaggtaaggaacctgtctgtccctgcctttgcaattgaggaggatgt

SEQ ID NO: 6769359 - DNA, 84 bp, Homo sapiens
gctcttaaccctgcaatccacagtgttatttccaggactgagttgttcttcaggaaggctttgtagaagtgccaggacttgagt

SEQ ID NO: 6769360 - DNA, 110 bp, Homo sapiens
atcataaggtgatacttccaaagcaagtgcccaaaattcttcagttggttcccatttcttttaaggaaaaactcaaacattttggcataccttacaaggtgtcttatgat

SEQ ID NO: 6769361 - DNA, 72 bp, Homo sapiens
cagctgctctgaaaatgactgttggccttccttatattcctacatggtagcagaagaaattcagagttgctg

SEQ ID NO: 6769362 - DNA, 55 bp, Homo sapiens
gattacaaaggtccttttctcttcccatgcctgaagagaaaggaggcctgtggtt

SEQ ID NO: 6769363 - DNA, 61 bp, Homo sapiens
gtttcagatcacaaggggccacataattgccatggctgagcttcaaagttggatctgagat

SEQ ID NO: 6769364 - DNA, 60 bp, Homo sapiens
cacgtcaggagcaaggattgacagcctataccccaagatgtcagtgattatctctgagtg

SEQ ID NO: 6769365 - DNA, 86 bp, Homo sapiens
gatcattacattttgtcatcctgagagatgtgttaaattcagacaatttattatatcctaggggaattatgtcataagctgtggtc

SEQ ID NO: 6769366 - DNA, 68 bp, Homo sapiens
tggacagcagagcaccagggccacttgcagagtcacctgtgtgatgtttctgggttctgccttgtcca

SEQ ID NO: 6769367 - DNA, 63 bp, Homo sapiens
tgtataatttgtgtacaatttagcatagtgacattaactaatttggaccatacaagttatgca

SEQ ID NO: 6769368 - DNA, 105 bp, Homo sapiens
gtgagcctggaaaaagtaggtagtgacactttgtgactctgagaaaatattaagaaaggaaatcaatatgcttctgtttaaagagtcacaaccttggaggctcac

SEQ ID NO: 6769369 - DNA, 101 bp, Homo sapiens
tggggatgctggtctctccctcagctgccagccatcgtcgttgcttttccctcggagctctgaggatgcattggtgggggagagagcaccacgtgttccca

SEQ ID NO: 6769370 - DNA, 61 bp, Homo sapiens
tgttttctgaataaaggcatgagtcaatgagttcaatgagttcagctcagttcagtgagca

SEQ ID NO: 6769371 - DNA, 82 bp, Homo sapiens
cgcaggcctgcagggcgtggtggtgctggagcagtaccgcactgaggagctggctcaggcctacgacgccttcacgctggtg

SEQ ID NO: 6769372 - DNA, 94 bp, Homo sapiens
ggggtagactcctctcggggagaaggtgtcccaggccagctgtgtgtgctggggccgaccacacagctgctgagacaggccctggaggaacccc

SEQ ID NO: 6769373 - DNA, 59 bp, Homo sapiens
gtctgcagcttcttgccagagaggctctatctgattttctgatgcaagaagctgcaagc

SEQ ID NO: 6769374 - DNA, 76 bp, Homo sapiens
gggatcccagagaggtagcttaccctcttctgccacgtgaggctctgacgagaaggtggctggctgtctgtgaccc

SEQ ID NO: 6769375 - DNA, 102 bp, Homo sapiens
gctctgcgcttccacgaggctccactggacctttcttgaattctttcctcaagccttggaggagctgaaattcacaaggatccaaagcccctgctgcggagc

SEQ ID NO: 6769376 - DNA, 57 bp, Homo sapiens
tcagctaggcacttctcactgagagtcatgcagtgtggtcggatagtgctgggctgg

SEQ ID NO: 6769377 - DNA, 59 bp, Homo sapiens
cgagctggcctccgggtgcctgggatgtttctcgcagaacaaaaggaagccatgtctcg

SEQ ID NO: 6769378 - DNA, 108 bp, Homo sapiens
ctgagatttagaaaggttatagtaagaggcaaagtcacagctaaatagctaagtcttctgaacttcaagctctgtgaccttaacctctatgtaataaaatgattttgg

SEQ ID NO: 6769379 - DNA, 57 bp, Homo sapiens
ccccttggctgctctcaagtccctttacgatgaggctggcttgtagcagcgaagggg

SEQ ID NO: 6769380 - DNA, 70 bp, Homo sapiens
atgttggcatatatattatgaggaaatacgttgatagaaattcaagaaaccctcaaataagtgccagcat

SEQ ID NO: 6769381 - DNA, 66 bp, Homo sapiens
gtcagctgctagacagtgatctgttgatactgaaatgcccactaatattaatatgtctaagctgat

SEQ ID NO: 6769382 - DNA, 69 bp, Homo sapiens
tttcctacattctctgagttttcctatttactatttgtgcagagagagaaaggcagagagagagagaaa

SEQ ID NO: 6769383 - DNA, 125 bp, Homo sapiens
ggctttaaggatatagtattggcccagctggggtggctgcccatccctgaaccaactggggtgagtaggacactctgtttcgttggggtgggctgccactgtgtctggccagctcactagaagtc

SEQ ID NO: 6769384 - DNA, 57 bp, Homo sapiens
ctctcctcaccaccagcagcagaccccaaattcagagggtttgggtagagaagagag

SEQ ID NO: 6769385 - DNA, 110 bp, Homo sapiens
gatgcctcagttttcctacagcttacctatgccttatacagttaagcaatggtcagaaatgtactactgtatcaaggccaggtattacttgcagaaaaaaataaggtgcc

SEQ ID NO: 6769386 - DNA, 80 bp, Homo sapiens
acatatgtatgattgattgtataacagcatgtattttcatttggaaaatgtctgagttatgcagatcttacaaatattgt

SEQ ID NO: 6769387 - DNA, 72 bp, Homo sapiens
gatccttcagttcgatggggatctctggatctggaatgaccttctggagttgtccccgttgagtcaagggtt

SEQ ID NO: 6769388 - DNA, 80 bp, Homo sapiens
ctcacatgtgggttgcactttgaaataacagtgggttgaacccactgatgtgatttttaggttagctcttttgctgtgag

SEQ ID NO: 6769389 - DNA, 59 bp, Homo sapiens
gagtggtttacttcatctcatttgtgccttttcattttcatgtctgaagtaatccattt

SEQ ID NO: 6769390 - DNA, 80 bp, Homo sapiens
gaggcggggccttttctggaactgtctgcgttcgggtaatctccccccagaatgcattgcttctgatggggcgccgcctt

SEQ ID NO: 6769391 - DNA, 55 bp, Homo sapiens
aggccaccaccctatctcctggaataagaacctccacagagatattggtgagcct

SEQ ID NO: 6769392 - DNA, 60 bp, Homo sapiens
tgcctgtgttgattactttgtctaaaaagtgatttgaatgatctaggatttatacaggca

SEQ ID NO: 6769393 - DNA, 71 bp, Homo sapiens
gactgggggagaggtgaaggctgccctgggttggccccagccctggggaggagcgttcaccctttccagtc

SEQ ID NO: 6769394 - DNA, 56 bp, Homo sapiens
ttttattgggagtcctctactgctcaattgaaagttgacacaggctcccagtgagg

SEQ ID NO: 6769395 - DNA, 70 bp, Homo sapiens
gtttggcataaatattttcaccaagccccatcccagccacacttggaatctggaaatctttgtgtgaaat

SEQ ID NO: 6769396 - DNA, 64 bp, Homo sapiens
atagattttgctctgcatactgactttttaaatgtgtcaggtttacattgacagaaagatctat

SEQ ID NO: 6769397 - DNA, 70 bp, Homo sapiens
tcactcccacagatctcaagcaggccaggagctgtgataccgcctggaagtgtgtcgtgggaatttgtga

SEQ ID NO: 6769398 - DNA, 58 bp, Homo sapiens
agggctgctcctccttcaggcctaggtttattgtctgcacctgggggtaggcagccct

SEQ ID NO: 6769399 - DNA, 109 bp, Homo sapiens
gcaatcaggaggaaaggaaatgaacagcctcagtgagattaggatataaaatataagccctaggttctatgctctttctgaggttgcacataaatttggcctcaaatgc

SEQ ID NO: 6769400 - DNA, 93 bp, Homo sapiens
cccaggtttccatgacttcaagttttgtgttctttttctgctacttcagtaagagtatttagagacacaagatggccaatcatagaatctggg

SEQ ID NO: 6769401 - DNA, 83 bp, Homo sapiens
cagaggttggaaacattgcctagagttgcacatctgggatccaatttcaggcttgtctctagagcaatggctatagctctctg

SEQ ID NO: 6769402 - DNA, 55 bp, Homo sapiens
ccagaagtcaagtaagatgaagattgaaaaatgtccattggacttggcttcatgg

SEQ ID NO: 6769403 - DNA, 87 bp, Homo sapiens
tctcaggcagtgaccctctagatggaagcactgtctgttgtataaaagaaaagatcgtgcatccctttagagtgttactgtttgaga

SEQ ID NO: 6769404 - DNA, 57 bp, Homo sapiens
ggctgatgagcttagctagagaagttgtacgatgtcctgtctgtcctctcatgagcc

SEQ ID NO: 6769405 - DNA, 72 bp, Homo sapiens
acaccatcctgctcctgctattcttctggtaagagcactgccagaataaaatgcatgagcatcagacggtgt

SEQ ID NO: 6769406 - DNA, 69 bp, Homo sapiens
agggacgaggctagaggcaggctcggccgccgaaatgatggcctgtcacggcttctgcctgcgctccct

SEQ ID NO: 6769407 - DNA, 83 bp, Homo sapiens
aatgctaggtgctcctccctaattcatcaatcagttaagtttctccttttttctgcgggaggttggggagaagcactagtgtt

SEQ ID NO: 6769408 - DNA, 66 bp, Homo sapiens
tctgtgcaggatttgaggaacccagcagttttaagtacctgtatttaatttagatcctgagacaga

SEQ ID NO: 6769409 - DNA, 71 bp, Homo sapiens
gccttgagaatcaattagattctatgagttttatagtaaaagcctcatataacatgattggtctataaggc

SEQ ID NO: 6769410 - DNA, 58 bp, Homo sapiens
gaatgaggttgcatttgtttgtgtagttactatacaaatttatagatgcattttgttt

SEQ ID NO: 6769411 - DNA, 59 bp, Homo sapiens
ctgcctctccccagagtggccccaccaaccccttctgtagccctctgttcaagaagcag

SEQ ID NO: 6769412 - DNA, 98 bp, Homo sapiens
agaacaggatgagcatatgacctgggcattttggatgattaagatagcccatcttacatgttgataatctttgaatgccagattgtgctccttgctct

SEQ ID NO: 6769413 - DNA, 58 bp, Homo sapiens
ttgcttatgcctcttgacaaagttgctctcatgcatgccttgtaagagtgatgagcgg

SEQ ID NO: 6769414 - DNA, 73 bp, Homo sapiens
tcacactctgcttaactgttttaaatatcaagatattgaatagttttgatgaacacagataatcagtgtgtga

SEQ ID NO: 6769415 - DNA, 81 bp, Homo sapiens
gaaagccctgtttcttaatctgtgtgggttcgacctaatcaggtggacacttaaaaacagataaagcatcagagagctttt

SEQ ID NO: 6769416 - DNA, 66 bp, Homo sapiens
ttcctgaccttggagtgctgcatcacatccctgagggtgtttgagaaactttccaggagtcaggga

SEQ ID NO: 6769417 - DNA, 62 bp, Homo sapiens
cttcatggcccatcagacccagggctggcaggaggctagacagtcttgaaggggtcatggag

SEQ ID NO: 6769418 - DNA, 65 bp, Homo sapiens
gagctattggcagcatccaagtctcgggatccagttgttcctgagaccaagttgcagccatgctt

SEQ ID NO: 6769419 - DNA, 73 bp, Homo sapiens
atcaattactgtaacctctgtgggtgtgtaaaatatgaaattaccagcaccctcacagagccacagaattggt

SEQ ID NO: 6769420 - DNA, 100 bp, Homo sapiens
ccacagtggtcttgtttcatctcttctgtaggtcagctggccgaagccacagggctgaagcagatggctgagcctgcagatggtgcaaggcttctgatgg

SEQ ID NO: 6769421 - DNA, 68 bp, Homo sapiens
ctggctgtggtcattaggaggttgtgggggactctgttcctgcttttcagagctgagatcaccgctgg

SEQ ID NO: 6769422 - DNA, 65 bp, Homo sapiens
atgtgcctggcttagaggttgcctttcaggtttaccaggaggggcagttgaaaggcaagcatcgt

SEQ ID NO: 6769423 - DNA, 64 bp, Homo sapiens
agtattctggaattctatgtgagggacaaacactcagaagccagcagcagtgttctagaatact

SEQ ID NO: 6769424 - DNA, 60 bp, Homo sapiens
ctggtccccagactgggcttagctttagtctgaattctgggctctgggtctgtgggctag

SEQ ID NO: 6769425 - DNA, 61 bp, Homo sapiens
agcactgaaagaaccttcctgttgcttcacatttttacaagcatttggttttgtcaatgct

SEQ ID NO: 6769426 - DNA, 71 bp, Homo sapiens
gtgtttgaccatgcttctccctggtgtgcacatcctctgtgcacatctgctctgagaagtgtggaagacac

SEQ ID NO: 6769427 - DNA, 55 bp, Homo sapiens
ctactagtggaagattgttaacttttatcctggtagacagttaaactactggtgg

SEQ ID NO: 6769428 - DNA, 75 bp, Homo sapiens
gccatatgatgagcgcttcagatagggaagtgtttttattgcccctaattgatttgcttctacatcttgtctggt

SEQ ID NO: 6769429 - DNA, 57 bp, Homo sapiens
tgggtatgtgaggccttccatattttatgagatacaatactgaacctcataagccca

SEQ ID NO: 6769430 - DNA, 67 bp, Homo sapiens
gtggaggcctctgtgtttagcctgaccatatttggggctcagttccatcagcaaatgcctgtctccc

SEQ ID NO: 6769431 - DNA, 57 bp, Homo sapiens
aggaagcctggggctgccctcgtgtcacccagtcattggaaagtctcagtgcctcct

SEQ ID NO: 6769432 - DNA, 63 bp, Homo sapiens
agttactgtgcttggcacattgtcctgattcaattaatggggcttctccaagcagcagcagct

SEQ ID NO: 6769433 - DNA, 56 bp, Homo sapiens
tgtgagagtataatctctctgtttcacaaaatgacagacagaacaactgctctcca

SEQ ID NO: 6769434 - DNA, 63 bp, Homo sapiens
tagctagctgaaccaacccctgcaactaaatagtaattagcatggggcaggtttttatggcta

SEQ ID NO: 6769435 - DNA, 64 bp, Homo sapiens
tttgatgtggacaagttcaagtaatgcagctaagtattaaaaattacaaattgtcctcatcaag

SEQ ID NO: 6769436 - DNA, 71 bp, Homo sapiens
cctaagccctggaggtctacagtggtagctcccatgcctgtctgagtctactctaggctataggtctttgg

SEQ ID NO: 6769437 - DNA, 71 bp, Homo sapiens
gtctgtatctctattactacatcagccaggttgttaaactgaggttgaaatagtgatgtatgaccccagat

SEQ ID NO: 6769438 - DNA, 60 bp, Homo sapiens
tcaaggttttatcctagatcaccactggattgccgacagatagaggaggtgggaccctga

SEQ ID NO: 6769439 - DNA, 69 bp, Homo sapiens
ccattttaatctcaagcattgtattttgtttattgccatggacaaacagcaggttttggtcaaagatgg

SEQ ID NO: 6769440 - DNA, 113 bp, Homo sapiens
gattcggtgtctggtaagggtccctttcctagatggccatctttccaatacaacctcacatgatggaaggggtgaagggtgtctctggggattcttttataagggcactaatc

SEQ ID NO: 6769441 - DNA, 70 bp, Homo sapiens
tgtgcaatctgttgactggacttcataggtttgttaagaatgtcagggagggtccatcaaggactgcaca

SEQ ID NO: 6769442 - DNA, 95 bp, Homo sapiens
tgtccctttctttatcctagtcccaatgtcacatggttctggggcctcatcttcagtgctagagtttcaaggattatgtgtacttggaggggaca

SEQ ID NO: 6769443 - DNA, 89 bp, Homo sapiens
tttgaatggggccagtattaggtaaaggacttgcaggctggagccaagcctaggaccctccctgatgtcaaggctgcatccatatcaga

SEQ ID NO: 6769444 - DNA, 79 bp, Homo sapiens
tagggctttttggagtggtgtggaggtgaagggcaagtcccttcccttgtcacctcacactatgttctgcaagcaccta

SEQ ID NO: 6769445 - DNA, 68 bp, Homo sapiens
ttgcagaacacttcccataccctcccacctccagccccaaggaggattaggatgcagggagtctgcag

SEQ ID NO: 6769446 - DNA, 70 bp, Homo sapiens
gcagaagccactggtaaactggtaggaacacttaaatcttaatttttacaaattgctagaggctgaatgt

SEQ ID NO: 6769447 - DNA, 129 bp, Homo sapiens
cgttccggagatagatggtggtgattgcacagcaacgtgaatgtacttaatgccactgaactgtacacttaaaagtggttaaaatgtcaacttttacgttatgtgtattttaccacatttacaaaaatg

SEQ ID NO: 6769448 - DNA, 93 bp, Homo sapiens
agcggatgggctagatattggctttctggctgaattgggctgggcctctctaataatagctctcagagggaaaggccaatttgctctcctgct

SEQ ID NO: 6769449 - DNA, 80 bp, Homo sapiens
gcttgctgcccgggtggggtgacagcagtccaagggtgaaggagctagcagggcactttgtgcctcactgtgcagcatgc

SEQ ID NO: 6769450 - DNA, 88 bp, Homo sapiens
tgtttgaattatttagcttttgtattcttctggtctgctaatgtttagatacaaatctacagccagatgcagaaagttaacccaaaca

SEQ ID NO: 6769451 - DNA, 88 bp, Homo sapiens
atctatttaggaaacattcgcagtgtacatcagaacatatcaatagcacctttggtgagtgctatgtaccacatgttcagaggttgat

SEQ ID NO: 6769452 - DNA, 81 bp, Homo sapiens
gggtgggattctgacgtctggtttccaccccgctgtttcagatgaggaaactgaggcacagatgcgcaaagaatcacaccc

SEQ ID NO: 6769453 - DNA, 60 bp, Homo sapiens
ggaaactcctcccacataggacaatgggcaagtagagcccgccttccatgggaggagccc

SEQ ID NO: 6769454 - DNA, 72 bp, Homo sapiens
ttaaacaagatagcttagaagattcatatttattccaaatgggaggctgaatctctcagatgtcgattttga

SEQ ID NO: 6769455 - DNA, 71 bp, Homo sapiens
tgtagacacctggattttgcttagacatgacgtgctagtgtatcaacatgtgcaaatgtcctgtggttgca

SEQ ID NO: 6769456 - DNA, 99 bp, Homo sapiens
gcttcagctggactttgagcctcttcatgccgatctggaagccgttcatggcctggatggctgcctgggcgctggccgggttatcaaagctcacgaagc

SEQ ID NO: 6769457 - DNA, 68 bp, Homo sapiens
gatgcttcctgttttaaataggatatagttacttcttttccaaatctagagtttgaaacggaagcatt

SEQ ID NO: 6769458 - DNA, 62 bp, Homo sapiens
ttttcccagccctctttctttgatctccttcttaatctttctaagaggggagagtgggaaga

SEQ ID NO: 6769459 - DNA, 97 bp, Homo sapiens
tttagcctgacatcagcatgtggattcctcccactcaaggtctcaacttggaggaaatcagaactgggaggaatccatgctatatgtcagggctgga

SEQ ID NO: 6769460 - DNA, 83 bp, Homo sapiens
gcctcagtctcccgagtagctgggactacaggtgcccgccaccatgcccggctaatttttggtatttttagtagagacggggt

SEQ ID NO: 6769461 - DNA, 60 bp, Homo sapiens
ggggtgaggaaagatggtgacagtgatgaaataaataccatgactgttctctcctgccct

SEQ ID NO: 6769462 - DNA, 130 bp, Homo sapiens
ttggatcctgagagaaaggagtagcaggaactgaccctcctggggcacttagaagcaaactgacagtattgctccagcctgcttcagcagttggtcatgtccttgagacctaatcctgatctaagcccaa

SEQ ID NO: 6769463 - DNA, 109 bp, Homo sapiens
tatattgtcaaccaaccacagctagactaattgctgggaatctcaagataaattttataaaatgtctctacccacaagtggtttactgtctgttaaggaagatagagta

SEQ ID NO: 6769464 - DNA, 89 bp, Homo sapiens
gtgtgcaattcttttctctccaggtggggtgatgtcggtcagcaacttctgaggttttcccagttctggcgaggatgagcctggtagac

SEQ ID NO: 6769465 - DNA, 117 bp, Homo sapiens
gagttcacaagccagtggcttaagacttctcttgatgttcccagacagctctgttcagaggcattagctgtcagagggaatattctgcaagatttgaagctgtggcatggtttgctc

SEQ ID NO: 6769466 - DNA, 93 bp, Homo sapiens
gaaagcatgaagtcaggatttccatgatttaaagatagaaatattctccgaatgtcttggtttcataacaggtacctgcactttaggactttt

SEQ ID NO: 6769467 - DNA, 73 bp, Homo sapiens
acagatctgcccagggtacaaaggagaccaaagcagggtgccttcactcctctgcacactgcgccaggtctgt

SEQ ID NO: 6769468 - DNA, 83 bp, Homo sapiens
ccaaagggactgcagtttgactacatcatggtttacattttcagtttgtgaagaataaatggttgagactgagtcccagctgg

SEQ ID NO: 6769469 - DNA, 69 bp, Homo sapiens
ggctggggtgaggactgggcacctcatgtgcactaaagtatcagaggcaactaggcctctgcctcagtt

SEQ ID NO: 6769470 - DNA, 87 bp, Homo sapiens
gatgaaacagtcacacaagtcattttcagcaggctttaattctcccgtagaacttcagttgagaaaggcatggatgccagtttcatc

SEQ ID NO: 6769471 - DNA, 73 bp, Homo sapiens
atatccagagaagatatgcatatatttatacatttatgtacataacatcactgtgtatgtatatgcagggtgt

SEQ ID NO: 6769472 - DNA, 84 bp, Homo sapiens
ttcttattactcttagtggaaggtgacatattctgatcttgagaaaacaggtaacctaatattaaggtacctatgtagtaagaa

SEQ ID NO: 6769473 - DNA, 63 bp, Homo sapiens
gactcagttctcttacctgtgcggaagatgctaagatctgatcagcagatgatgaggctggtc

SEQ ID NO: 6769474 - DNA, 64 bp, Homo sapiens
tactgagaaatttattggttggaaaactgctatctacaggccttccactacctatttcttagta

SEQ ID NO: 6769475 - DNA, 60 bp, Homo sapiens
ggaggctgagggggaggccacctgggactaagcaagaccccattggacccttgggcctcc

SEQ ID NO: 6769476 - DNA, 76 bp, Homo sapiens
tgccaaccaactagagccctcagtccagaatccagaactgggtcaaaaactctcagactctttagtgaaggtggca

SEQ ID NO: 6769477 - DNA, 99 bp, Homo sapiens
gaggcaggagaattgcttgaacctgggaggcggaggttgcagtgagtcgagatcgcgccactgcactccagccttggcaacagagcgagactctgtctc

SEQ ID NO: 6769478 - DNA, 82 bp, Homo sapiens
gaaagatttttcatgaaagcaaaaatgggtggagtcatgggactctatgcacagaagtttgctgaatcatgatttatttttt

SEQ ID NO: 6769479 - DNA, 84 bp, Homo sapiens
gctcttcctctctaatcctttgtccctgggtgagagtgctttctgaatgcaatgcacccgggcaaggattctgagagggtgagc

SEQ ID NO: 6769480 - DNA, 63 bp, Homo sapiens
tcagtggccagcagcctagcctaggcccttcttttggtcagtgccagctgcttggcctactga

SEQ ID NO: 6769481 - DNA, 88 bp, Homo sapiens
ggcagcccagaagcaaggctcagagcctggagctgctgacctcttggggacactgcagccctggcctggcctacttttctcttctccc

SEQ ID NO: 6769482 - DNA, 96 bp, Homo sapiens
ggcctaagctctgtttcgtctttttcatttcaggtgatggagtccagaactaaactgcacaatgaaagcaagaagacggcccccaggcaggaggcc

SEQ ID NO: 6769483 - DNA, 73 bp, Homo sapiens
ttctgttctcacctctactcagcctagttcaggccctcctgaactctctcatctgtcagttgtgagagctgag

SEQ ID NO: 6769484 - DNA, 60 bp, Homo sapiens
ctggtcagggctctttgggagccatctggccctccatcccatagagctgtgctgagccag

SEQ ID NO: 6769485 - DNA, 74 bp, Homo sapiens
gcagagcacagtgatcttgctgatttaggagacagagatctgagtccaggtaggccaagacagctataatttgc

SEQ ID NO: 6769486 - DNA, 97 bp, Homo sapiens
cagagaatagctgtctccactgtgccatttcggaattcctgagccaagaatctgtgaggataatgaaatggtagtggttttatctagctgagttttg

SEQ ID NO: 6769487 - DNA, 78 bp, Homo sapiens
ttcttttgctctttctcattgtcagcagaacaatacgcaaaatgtgactgacaagaaagagaaagaggagcaaaagga

SEQ ID NO: 6769488 - DNA, 75 bp, Homo sapiens
tcttggttatctcttttcatgtgtaaatgaggttctaggttgaacagtattggtatctgagacagagtttcaaga

SEQ ID NO: 6769489 - DNA, 80 bp, Homo sapiens
aatcttttcagtgttgagggactcagaattcagcctctgggcagaggctagatcatgagtcttttactctgtggaggatt

SEQ ID NO: 6769490 - DNA, 100 bp, Homo sapiens
ttgtgttctgatggtttcaagttattctccaatatggtattgactcaaaacgttgactcagagaactggattagaggaagtacattgaactgggaaccga

SEQ ID NO: 6769491 - DNA, 74 bp, Homo sapiens
gtgtcccgggctctgggatgcaaacagaatctgcctatactcagaatactcactgtaatcccggcgcctcacac

SEQ ID NO: 6769492 - DNA, 70 bp, Homo sapiens
agggtagtatttgtctgtcctactctggggccttttgcagagtctggtgcatgataagcacttggtccct

SEQ ID NO: 6769493 - DNA, 59 bp, Homo sapiens
actctaactaattaataaagccaagtagtgtgtgttggctataggaaaagtgttagggt

SEQ ID NO: 6769494 - DNA, 58 bp, Homo sapiens
gcccaggctagagtgcagtggtgtgaacatggctcactgcaacctcagactcctgggc

SEQ ID NO: 6769495 - DNA, 66 bp, Homo sapiens
tggggttacctacaagtctgagtagaaataacattattttccagtcagctgagcaaggtggcccca

SEQ ID NO: 6769496 - DNA, 69 bp, Homo sapiens
gcaggtggccggcagttttagaaatccaagcacactagggtctcagaggtttctgctcagcccccttgc

SEQ ID NO: 6769497 - DNA, 65 bp, Homo sapiens
agcagaatggggctgggaatagtgccatagccatcctcagggcaaggagctctgagccccctgct

SEQ ID NO: 6769498 - DNA, 64 bp, Homo sapiens
gagattttgtgggatttaaattgaggtcaacctgttgttttggtttcttaagttacaaaatctt

SEQ ID NO: 6769499 - DNA, 92 bp, Homo sapiens
aaaagacggacaagcagaagtaatagcctaatagtcacccataatcccaccatggggagataacatggttagtgtttttatgtctgtgtttt

SEQ ID NO: 6769500 - DNA, 56 bp, Homo sapiens
tatgccttttggctcaagaaacattgccatatatgttgcttgaaccaaaaggcata

SEQ ID NO: 6769501 - DNA, 59 bp, Homo sapiens
tgtcctgtaggaggcagaacaaggattagactgcctatctgtactgtcatcctgggaca

SEQ ID NO: 6769502 - DNA, 57 bp, Homo sapiens
tttgcatattaatatctgcgctttgcataatctgacccgcgctttattgattgcaag

SEQ ID NO: 6769503 - DNA, 83 bp, Homo sapiens
ggaaggagatgggagtctcgggcagagctctgaggacagtggtgttgctcagggagcttcctggtggaagtccttctccttcc

SEQ ID NO: 6769504 - DNA, 57 bp, Homo sapiens
gcacctttttctaggagaatgtgatgtacaaaatattcaattttttttaaaaggtgc

SEQ ID NO: 6769505 - DNA, 66 bp, Homo sapiens
ggtgactctcaaaagtgcagtctttaaacaagatcaagttatagattgttagagtttgatagtgcc

SEQ ID NO: 6769506 - DNA, 62 bp, Homo sapiens
tggttcttttttgtagtaggtggtgtttcacaaggcgcttaattttctatagaaaagtatca

SEQ ID NO: 6769507 - DNA, 60 bp, Homo sapiens
tcttgagtgtggacaggtgtcctggacaggtaggtgtctggatgccacgaagcaccagga

SEQ ID NO: 6769508 - DNA, 67 bp, Homo sapiens
ccagaacatctgactagtctagctagggtaacaggcctacaccttggccaggcataaaggtgggtgg

SEQ ID NO: 6769509 - DNA, 75 bp, Homo sapiens
gtatggagacctgaagacctgggatggccctgaagaactttctcaaactggggcaagtgggtcgagtcttcatac

SEQ ID NO: 6769510 - DNA, 58 bp, Homo sapiens
gcagttgtaatatgatgtgaggtctgcaatagaaatacacacacgatgttaggattgc

SEQ ID NO: 6769511 - DNA, 63 bp, Homo sapiens
gaaatctcactgtagtcaaagtgcccaggcaaaacatattgggcagctcacagaaagagtttc

SEQ ID NO: 6769512 - DNA, 99 bp, Homo sapiens
gcaattgcctgatagaagtgtcagggcctggaactgtgggcagggcccgaaagcctccctgtgtccagttccaggttgtggagcatttggcaaggctgc

SEQ ID NO: 6769513 - DNA, 69 bp, Homo sapiens
agggcagcagcccatggctctgacggggcagctctcttcctgtttaccatcgtggtggactgctgctct

SEQ ID NO: 6769514 - DNA, 55 bp, Homo sapiens
tggcattgtggtgtgtgcttcctagaacaataggccatcaaatcatgtagtgcca

SEQ ID NO: 6769515 - DNA, 76 bp, Homo sapiens
ggaataaaactgaattttaaatacaggccccatcccttgttagatagaaggccttgggaaaattagttaatattcc

SEQ ID NO: 6769516 - DNA, 64 bp, Homo sapiens
tcctctctttcctgtcccactggggtcctaccattctgggatcctgtgcatggggtgatgggga

SEQ ID NO: 6769517 - DNA, 67 bp, Homo sapiens
agcacacagtgacattagtgagaaaactagggctgtcagttttctctatattgtctgtgaagttgct

SEQ ID NO: 6769518 - DNA, 59 bp, Homo sapiens
taatgttaaggaactgcccttcctttccagatgagaaagaggggcagctcttagcatta

SEQ ID NO: 6769519 - DNA, 129 bp, Homo sapiens
atttacacaccatggctttttaaaagggttgtccttagatgtggcctccagggatagttaagctgtaaatggaaggcttcatatgtaaagacattttccttttgaccttgtttcttatggtgagtgtgt

SEQ ID NO: 6769520 - DNA, 70 bp, Homo sapiens
tgattgcagatgtgtcctgatcaattgagctggttttattggccagatctgaggatactgagcagagtca

SEQ ID NO: 6769521 - DNA, 126 bp, Homo sapiens
acatctggctgaagggtgaaaatgaacacaatcacccaggtgtttggcctgcatgatgacagatatcaaacacttagaaccatctgggtgattggcatattttctttttcacttttatccagatgt

SEQ ID NO: 6769522 - DNA, 95 bp, Homo sapiens
gaagaataattcatgaacatgctgttgatggcctgagtgttttcactggtgctacagtgctgtcatcagtgtgtgcattgtcctgagagttcctc

SEQ ID NO: 6769523 - DNA, 62 bp, Homo sapiens
acccacgagctgctcagtactctgctaaatattgcaggggagctgccacagttctctgaggt

SEQ ID NO: 6769524 - DNA, 86 bp, Homo sapiens
aattctcatttttaatggtgtgttcatggtgtaattgatgtgttattgcattggtactccacacgctattataatgttttaggatt

SEQ ID NO: 6769525 - DNA, 79 bp, Homo sapiens
gtgctttccgtggaggcagtgcagtggtgcctgaggatctcacaggcagcagggccactggctgaccactggatggcat

SEQ ID NO: 6769526 - DNA, 76 bp, Homo sapiens
gctgatagattttcttgtcatcagaagtcatcttttatcgtggaaagttactcttctcctgtaagaagatcaaagc

SEQ ID NO: 6769527 - DNA, 77 bp, Homo sapiens
agaattagaacacttggctttggatttaatcattatccctagcaatgttttagagatagccaagtgtttcacatttt

SEQ ID NO: 6769528 - DNA, 57 bp, Homo sapiens
ccccgtgactgtgcccatcttgtggcctgtacctgggctggtggctcagtcatgggg

SEQ ID NO: 6769529 - DNA, 57 bp, Homo sapiens
gcatttataggaagaatgtaagattgggttgtcagtaagtattctgtcctatgaagc

SEQ ID NO: 6769530 - DNA, 62 bp, Homo sapiens
tcatctttgtttgggaacttaaaggatcaagatataatccttgatctgcccaataaagatga

SEQ ID NO: 6769531 - DNA, 95 bp, Homo sapiens
gtttgaggtaaaattcttagaacagtgtctgacacattgtagctcaggagctgtgagtggaggaggctgagactaagaatgattctactttttat

SEQ ID NO: 6769532 - DNA, 76 bp, Homo sapiens
cctgttgataaaatgaaactagtagaatctttgtgtcaagtattacagtctgctggctttttcagcattgaccagg

SEQ ID NO: 6769533 - DNA, 61 bp, Homo sapiens
ggagagctggggccagagtcaaggcaggcaaagagactcctcgaccccctccagtctttcc

SEQ ID NO: 6769534 - DNA, 75 bp, Homo sapiens
ctttggatcactgttcctctgggaaaaaaacaggaagaaactgtagagtccagaaaataatagtgatggctaaag

SEQ ID NO: 6769535 - DNA, 78 bp, Homo sapiens
cctgtgggaggcacagtgtttggtcagtggggcctggatattcccatgaccctgaccctgtgctcctcccctggcagg

SEQ ID NO: 6769536 - DNA, 67 bp, Homo sapiens
cacacatatgccattacagcaaaaatgcattgagatgtatgtgtttgtttgtatgtgtgtgtgtgtg

SEQ ID NO: 6769537 - DNA, 67 bp, Homo sapiens
gctctttagtccaagccatgtctgcctctttccccgacccagctcagggccatggaccagcagcagc

SEQ ID NO: 6769538 - DNA, 80 bp, Homo sapiens
gtctgccaaacagagtacagacaaaggtcagatgacttaacagtttctcatctgtaccctgatgctttgtcaaggtttgc

SEQ ID NO: 6769539 - DNA, 58 bp, Homo sapiens
cctgctgggactcctattttatatatatatattagtatacttggtggtgttccatagg

SEQ ID NO: 6769540 - DNA, 61 bp, Homo sapiens
gccccctggtctactcctttccccggactccggagtccctggagaaggggacgcggagggc

SEQ ID NO: 6769541 - DNA, 59 bp, Homo sapiens
agtctcttccttcaaggctggtgggtaaaattctcccttgtgcctttgaatgagggatt

SEQ ID NO: 6769542 - DNA, 66 bp, Homo sapiens
ctcaggaaatgttttacaaggcatacttcagatttaaagaagtatgattctaaaaatattcttggg

SEQ ID NO: 6769543 - DNA, 80 bp, Homo sapiens
gcccggtgagtggggccacactgatctcccagagcagaccgtggtctgactgggctgtggtgtggcccaaatctcccagc

SEQ ID NO: 6769544 - DNA, 66 bp, Homo sapiens
tttcccttctttcctgagtaatcgtagactgctttattttactttgtgacagaggaagaggggagg

SEQ ID NO: 6769545 - DNA, 78 bp, Homo sapiens
ttcacaaaggttatgagtgtgaagtgagaatagctaaggttagcaggttcgtaggtgtacactcctgaccgttgagag

SEQ ID NO: 6769546 - DNA, 82 bp, Homo sapiens
gctgaatgcaagagtgaggttgggattttgaaaaaagcctataccagagacttcttcctggcctccgttctctgcatatggt

SEQ ID NO: 6769547 - DNA, 84 bp, Homo sapiens
tcctgcttaatcattaggcattctgaatgaggtcctctgataactgacaagatcgattcagtgtgcctaccccagaagtagtga

SEQ ID NO: 6769548 - DNA, 68 bp, Homo sapiens
cttcactactgaaaagctacgggaagacacagttgttctaaactgaagtattttaaatgtagtagaag

SEQ ID NO: 6769549 - DNA, 109 bp, Homo sapiens
tgttctaaaaagcgggatgcagggcccagtgagctgcagagtgatgaagtgggggaagttccccagtgtcgctgctgggacacaatgcctgactcccgtaagtaaagca

SEQ ID NO: 6769550 - DNA, 62 bp, Homo sapiens
aacttgtgacctagctgtggatttgctttcactgtttatcggcagtgtcatggtttcaagtt

SEQ ID NO: 6769551 - DNA, 70 bp, Homo sapiens
ggaacttccatactgttttctataatggctgtactaatttacatttccaccagtagcgtgtatgggttcc

SEQ ID NO: 6769552 - DNA, 82 bp, Homo sapiens
gtggatctaaagaaggagggtgtagtgggttgaatagtgttcctttctgcctggccctccccatcccccaattcaggtccac

SEQ ID NO: 6769553 - DNA, 66 bp, Homo sapiens
gcgtgcctgggcagcttagcaccgtaaatccaccgctgctggctggcagagcagtgcccaggcggc

SEQ ID NO: 6769554 - DNA, 58 bp, Homo sapiens
ggtgtcctcaaggagccaagcagcctccatttctctgcttttctctccgcaggacatt

SEQ ID NO: 6769555 - DNA, 60 bp, Homo sapiens
cattccttcctttctaaattccaggctcttgatggagcaggaccaagaaggggaaaagtg

SEQ ID NO: 6769556 - DNA, 68 bp, Homo sapiens
gcatttggaccattgacctgatctacaaagttgcaatagctcagtgagctcagtggatccaattaggc

SEQ ID NO: 6769557 - DNA, 89 bp, Homo sapiens
agaacagccttttctggccaccaagcgctgagcattcatgaccttagccttgggacaggccaaaagggggataaaggtaacactgtttt

SEQ ID NO: 6769558 - DNA, 76 bp, Homo sapiens
gccttgtggtgtgttgagtcattgctctggcaaaagatctgtttgctccagcaacaggcttagctttcaacaaggc

SEQ ID NO: 6769559 - DNA, 91 bp, Homo sapiens
cacctgtggctgtggccggaccacgtggccatgctgcagttcatcagcagtgggctgcccaaggtggccatgccgtccaccatccactgtg

SEQ ID NO: 6769560 - DNA, 59 bp, Homo sapiens
tggagtgagctctaagaaacttcagagccctcactggtcaccttaggtagctcattcca

SEQ ID NO: 6769561 - DNA, 70 bp, Homo sapiens
acagatatgcaaagcaaatggagctttattttcctctaactgatgtgtcctcctgtgctctgtgttctgt

SEQ ID NO: 6769562 - DNA, 57 bp, Homo sapiens
gtcttgaatctctctgagattcagtttctttagctgtgaaacggagacgatcatgac

SEQ ID NO: 6769563 - DNA, 61 bp, Homo sapiens
acacagctcctgggccatcacaaccatctctagggagtggccagagtccagtgagccttgt

SEQ ID NO: 6769564 - DNA, 61 bp, Homo sapiens
gagggtcactggaactgagcagccaacctgatttcaaggcctggctttactagtggcactc

SEQ ID NO: 6769565 - DNA, 57 bp, Homo sapiens
gcttaccagcttccttcaagatgtgtatttatataaattggtggtgggttggggagc

SEQ ID NO: 6769566 - DNA, 73 bp, Homo sapiens
gcccccatcccctgaaggagctggctgtctcagtcctgggctcgcgcacttcaccccggcagatggagggggc

SEQ ID NO: 6769567 - DNA, 59 bp, Homo sapiens
atggatgatggtgtgtcctgtgtcgccttgccaggggcttctcagcacactgtccacat

SEQ ID NO: 6769568 - DNA, 113 bp, Homo sapiens
agaattaattttattttatctaatatgcttcgaattgggcttctggaattcaacatgcaaatgtatgctcctagtgcaaattggagcatgcccagattaatggagaaaattct

SEQ ID NO: 6769569 - DNA, 57 bp, Homo sapiens
cggccctccagctggggtccttgcccacaggtgacaacctcccagctggcagtgccg

SEQ ID NO: 6769570 - DNA, 71 bp, Homo sapiens
gccatagcttaggggttaaactcacagacatttaagtcacatgttcttgagttcaagtccaagttgctggc

SEQ ID NO: 6769571 - DNA, 119 bp, Homo sapiens
gcctcctgccttcagaaggtctctggcttgtgtgggaaaggagatattggagagtgaaaagggcttttcctctgctttgcactgactccttcctgtacccaccatcagaggctggaggt

SEQ ID NO: 6769572 - DNA, 69 bp, Homo sapiens
tcacagttctagaggtaagcagtccaagatcaaggtgtcagcagggatagtttcttctgagggctgtga

SEQ ID NO: 6769573 - DNA, 99 bp, Homo sapiens
agggaatggctcatggagtctgatggccagggtttgaaaactggctttgccatttgtgaacttaggcaattaggtaacctccctgtgcctggatttcct

SEQ ID NO: 6769574 - DNA, 60 bp, Homo sapiens
ctctagttagtattcttcagtggttggaaatctctctaaactgttaagacgtagctgggg

SEQ ID NO: 6769575 - DNA, 64 bp, Homo sapiens
ggtaaccatattttccattaagttcccactattagatgggaacttacagatgggagaatggacc

SEQ ID NO: 6769576 - DNA, 77 bp, Homo sapiens
gctgactgactacatgtcctgtcattttctttacatgcacgattgataaaacaatgacagtggcacagtcacttggc

SEQ ID NO: 6769577 - DNA, 62 bp, Homo sapiens
ctggcgttctgtgaacatccctgaaatgaaaacagtggatgcaggaacacagcgacctccag

SEQ ID NO: 6769578 - DNA, 69 bp, Homo sapiens
ggaggccttacagggttgcagcattgacgggtggtgcgtctgtcactcgctcagtccctgtggccctcc

SEQ ID NO: 6769579 - DNA, 66 bp, Homo sapiens
ggaagccgcgggtcaggtctaggctagggccttcttagacattcctgggcattggctgcagcttct

SEQ ID NO: 6769580 - DNA, 66 bp, Homo sapiens
gcctcttaccaaattctaaaccatcacaaccttaccctgtgggtgttggaacatggtgagattggt

SEQ ID NO: 6769581 - DNA, 76 bp, Homo sapiens
ggtctttgttgggaataacctctggttgagtgacagatatagacacatcagcagatgatttccatacaacaaggcc

SEQ ID NO: 6769582 - DNA, 114 bp, Homo sapiens
ggagtggggcaggccctggactggctgtgtggcctcaacttgtcactgttctttctctgagcctcagtagactcaactgcaagtggggcttgtcattcttggcctgcttgcttc

SEQ ID NO: 6769583 - DNA, 91 bp, Homo sapiens
catgattaagcaggggagtgagggtagaggcaggagtgcaaaattgtaaagttttagctttttgagctattctcagtccctgtgtggtatg

SEQ ID NO: 6769584 - DNA, 78 bp, Homo sapiens
agatggcttattcacatgcctggcaagttacagctgactcttggcaggagtcctttgttccttgccacatggacatct

SEQ ID NO: 6769585 - DNA, 68 bp, Homo sapiens
tcagcataggcatcacctaggagcttgttagaaatgcagaatctgaggcagtgccatggacctgctga

SEQ ID NO: 6769586 - DNA, 55 bp, Homo sapiens
gggggggtgataatgctaaattaacaacaaatagtccagcacagatgacctcccc

SEQ ID NO: 6769587 - DNA, 70 bp, Homo sapiens
ggcagtaccctacagagttcacagctgtgggctatttgttatagctgtgggctatttgtgggtcattgtt

SEQ ID NO: 6769588 - DNA, 94 bp, Homo sapiens
gacatgctattttataattgcttattagacccaatttatatgacttccttttatatttaagtggagttaatatgcaatttgaagagaggcagtt

SEQ ID NO: 6769589 - DNA, 60 bp, Homo sapiens
gtggcagagccaggctttgaacacaggcagactggatccagagtctgagctcttaaccac

SEQ ID NO: 6769590 - DNA, 80 bp, Homo sapiens
ctggaagctggttagaaatgcagaatcttggacccaacccagacccgtggatcagaatcttcattttcagtggatcccag

SEQ ID NO: 6769591 - DNA, 63 bp, Homo sapiens
tggccagctcagtctccatcagggatttgggtttagtcaccttggagacctgggtctgtgcca

SEQ ID NO: 6769592 - DNA, 68 bp, Homo sapiens
ccatctccagtttattcttccttagcatttggggctccttccccctcaggacgggtccctgggagtgg

SEQ ID NO: 6769593 - DNA, 63 bp, Homo sapiens
cccttcctgtgagacagattgaccatcaggactcagtaaatgtgtctgtggcacctgggaggg

SEQ ID NO: 6769594 - DNA, 67 bp, Homo sapiens
actcctggggctgccatcacagtgtaagtaacaaataaacaagatggctggtttgagctttagcagt

SEQ ID NO: 6769595 - DNA, 81 bp, Homo sapiens
tcctcccacagcatctaatcttcatgccggagtcacattctcaggctccggacagaccccaggtgctgtgcagcctgagga

SEQ ID NO: 6769596 - DNA, 66 bp, Homo sapiens
ctcatcaggcttgctagaggagccaaatccaggggtgagtttgactcttctagcaagtgtgatgag

SEQ ID NO: 6769597 - DNA, 87 bp, Homo sapiens
actctcagttgctgtgtcacttagcaatttgattaaaagatgtgcccatctttcttacctgttaagtcaggaagtagtacctagagt

SEQ ID NO: 6769598 - DNA, 68 bp, Homo sapiens
ggcagtgcagttggtggcaggggttggggaggtccaggaatcaactccctctaccaatttcacatgcc

SEQ ID NO: 6769599 - DNA, 80 bp, Homo sapiens
tttttagcctgttgtctgtgaaaaggtgaacttactgtaaatttcagtaactctcctttgacatatttaaaggttaagag

SEQ ID NO: 6769600 - DNA, 68 bp, Homo sapiens
tatttcctttgagactgagctcttttagaatcttttatagattcagtgcacagtactgagactaaata

SEQ ID NO: 6769601 - DNA, 75 bp, Homo sapiens
ctggaaagttctatgtagataaggctgctctctatcactaggatctgtgttgtctaggtggaaagtgttttttag

SEQ ID NO: 6769602 - DNA, 67 bp, Homo sapiens
ctagctgtgcccgacccatgcggagcagctcaaagaatgctttgcaagaagaatggcacaaagctgg

SEQ ID NO: 6769603 - DNA, 55 bp, Homo sapiens
tagcaacaggtaggggagagctccaacatgttgtgttggtgcccccttctggctg

SEQ ID NO: 6769604 - DNA, 72 bp, Homo sapiens
ggccattagcggtatatatattatttgctcttatttcaacaataaacatgatgtcatatatgccattaggct

SEQ ID NO: 6769605 - DNA, 85 bp, Homo sapiens
gagcatcctgcagtgggctgggccatctcctttgtgtggccctttgccaggccactctgagatctggcttatccttgaagggctc

SEQ ID NO: 6769606 - DNA, 74 bp, Homo sapiens
ggaaccgataccttctgcaagagcatcagttgtgaaatggcctaggtacaaggatgttcttagaatcaggtttc

SEQ ID NO: 6769607 - DNA, 64 bp, Homo sapiens
tccaagtgggactttgttgctgcatcctctggaggggacagacactgtgtcctcacttaatgga

SEQ ID NO: 6769608 - DNA, 56 bp, Homo sapiens
tttgctgtgggatatccatgtgcaccctgcctaaagcacgtttttccactagcaaa

SEQ ID NO: 6769609 - DNA, 65 bp, Homo sapiens
ttatcttctgcacaagccaatggtaagttctgtttacttacttatcttggcttatgcacaagtaa

SEQ ID NO: 6769610 - DNA, 73 bp, Homo sapiens
gtgctctgatgtgactttttcatcaagtcagtattcctgggatctcttgtacatgataatctcactcttgcac

SEQ ID NO: 6769611 - DNA, 61 bp, Homo sapiens
caactgcctgggtccaattctggcttgtttacttactggacaagtgaccctgggcaagttg

SEQ ID NO: 6769612 - DNA, 95 bp, Homo sapiens
atgaaagactaagctgtgcagagctacatggagaagaaaattcttagaagtaggaactccacgagtgtaggtcctgagacagaaaagtctgttgt

SEQ ID NO: 6769613 - DNA, 69 bp, Homo sapiens
cagtgagacatttcagagctgagatgccacaggaatcttgttccttggagggctgtgagttgggcactg

SEQ ID NO: 6769614 - DNA, 89 bp, Homo sapiens
gagggcaagtgaaacatccctagttacagtggtcatttgggaaaatctaaatgtgctcccaaacgacctactgtgtttacatttgaatc

SEQ ID NO: 6769615 - DNA, 79 bp, Homo sapiens
gggtggccaggccaactgacatggcaaaggggctggatctttcttcacttgctatgtgggttgtgcactcagcacacct

SEQ ID NO: 6769616 - DNA, 86 bp, Homo sapiens
agtttgaagaggacagagtttcggtaagcatagaatggctttctctattttaagcaagattttatggaaatgactttctttaaact

SEQ ID NO: 6769617 - DNA, 96 bp, Homo sapiens
atcaagggccatctctcttcaaatgcaggagagcatgtttaagagcctgggctcttgattcatgttccctgcattggaatcacgactcccctaggt

SEQ ID NO: 6769618 - DNA, 61 bp, Homo sapiens
ggttcccggatctccgagtcccactccaccagcttctggggcggcatggggtccggggacc

SEQ ID NO: 6769619 - DNA, 63 bp, Homo sapiens
ttctgaaaaaagtagtgcttttagttttttaatttggagactgaattttcacttattttagaa

SEQ ID NO: 6769620 - DNA, 97 bp, Homo sapiens
gcaatacaaatttaaaagaactgtaatttttacatagtaagctagctaaagttgttttaaagctgttaacaatgtgagggtgcagtggacaggttgt

SEQ ID NO: 6769621 - DNA, 79 bp, Homo sapiens
tgaggtggatgcaactggaagggttatgtggggctggatgagtttgttcccacgtagaggacagtgtggacctttctta

SEQ ID NO: 6769622 - DNA, 65 bp, Homo sapiens
atttgacaacacaatagaacacttgtcagtgtgctttctgacatctcattttgttgttgttcggt

SEQ ID NO: 6769623 - DNA, 97 bp, Homo sapiens
gaggcaggaggattgctgtagcccaggggttcaaggctgcagtgagctataatcacctaactgtactccagcctgggaaacacagcaagactgtctc

SEQ ID NO: 6769624 - DNA, 65 bp, Homo sapiens
acagatggctgggatgcttctagcaaactgatagttctacctcaagcaccagcctcttattctgt

SEQ ID NO: 6769625 - DNA, 69 bp, Homo sapiens
tgtgcattgcgatgcagacgaccatatagatatattaacattttggcaaggtttttctttgcaggcaca

SEQ ID NO: 6769626 - DNA, 60 bp, Homo sapiens
cagtctgtcccctacccggtcctcccacgctgttggagtgagtggccaggaggcagaatg

SEQ ID NO: 6769627 - DNA, 68 bp, Homo sapiens
tggcaaattccaaagttaattcaaggtcaaaagactgaatttagaatttgattttaggaagtttgtca

SEQ ID NO: 6769628 - DNA, 64 bp, Homo sapiens
agggtgggaagagggtctggtagtcactagggttccccagccattccttgctctcatcaacctt

SEQ ID NO: 6769629 - DNA, 79 bp, Homo sapiens
attttatatggaaaaaaattggctagcttcaggtaattttaatgaattggaagaaagcctattttgtttcatctgaaat

SEQ ID NO: 6769630 - DNA, 57 bp, Homo sapiens
gctctggtctgagctttggcccacgctctctccactgggccacatcttttccagagt

SEQ ID NO: 6769631 - DNA, 124 bp, Homo sapiens
gggtggcttaaagcaacagagatttatttgctcacagttttgggaaccagaagttcaaaatcaaggttttggcagggttggttccttctggaggctctgagggaaaatctgttccatgcctctc

SEQ ID NO: 6769632 - DNA, 94 bp, Homo sapiens
tctataagtaacagataagaaacctgaagatgagggacagctaatcacgtatttggccatatttccattttttggtttttgtgatgctggaaga

SEQ ID NO: 6769633 - DNA, 62 bp, Homo sapiens
aactaactgctcatttgagagtatgctggtgacggcaggcatctgggaatgaggcagaagtt

SEQ ID NO: 6769634 - DNA, 79 bp, Homo sapiens
tcttttctgttgaaatctgcttcttgcatagtacaatgtaccatttacaaaggcttaaagagatttcttgtagtaaaga

SEQ ID NO: 6769635 - DNA, 61 bp, Homo sapiens
ttggtcacacaatacaaaggaaggctacaagaagtcaaatgctgtcatttgttgtgactag

SEQ ID NO: 6769636 - DNA, 118 bp, Homo sapiens
ttgctggttgacaagaaaatgggtgaggagtgaggggcacaggtcctggtgggtgaaaatgattgccctctatcagaagcttgtagtctctcttcagttgtgtttcatcagccagcag

SEQ ID NO: 6769637 - DNA, 60 bp, Homo sapiens
gcctggtgtctcctctgagcctaggctgtagtccaacaggggtgggaggacacagcaggc

SEQ ID NO: 6769638 - DNA, 78 bp, Homo sapiens
atgacctggcaccatctgtgtgaccaaaacctctgtgcctgcctagatcctggagcagagatggtggccttctgtcat

SEQ ID NO: 6769639 - DNA, 97 bp, Homo sapiens
gaccttacaaatcattaggatcaacctgccctgaggttacagatgaataaactgaggcccagagatgggaggtgatcgggctggtgagttgttggtt

SEQ ID NO: 6769640 - DNA, 85 bp, Homo sapiens
cagccttggtgaccttgagcacgttgaagcgcactgtcttgctcagaggccggcactcgcccactgtgacgatgtcaccgatctg

SEQ ID NO: 6769641 - DNA, 122 bp, Homo sapiens
atgttacaggttaatttataattttatttcatgcactacttggctttactgattaatatgccccatggcattcaataaagtcaggcagtggaggaaataagagtggtattaatttctaacat

SEQ ID NO: 6769642 - DNA, 82 bp, Homo sapiens
agaggggcaaactggggaggggaggggagacttgtaaacatgagtgcaattttcctctggtttccccagaagttgcccgttt

SEQ ID NO: 6769643 - DNA, 126 bp, Homo sapiens
tgatttccagcagccaagacagtgactgattatcaaatgcactgaacacatgttgttacataaaggaataattatgctatagagatgggtttagttataaggtgatacagttaagctgggaaatca

SEQ ID NO: 6769644 - DNA, 117 bp, Homo sapiens
ggaaaatctcagaatcccttctctagacaagagccataattttgagagttcttgagtctttggtagaaacatcctattctctagataatgagctgttggaaaggggtggcattttcc

SEQ ID NO: 6769645 - DNA, 60 bp, Homo sapiens
ttcccacactcccagttaaacacagtgattttcctggtgttcaagtgtcaagtgttggaa

SEQ ID NO: 6769646 - DNA, 109 bp, Homo sapiens
tctttccttggtgcaggaaggcagtctttgttacatacagcagaacataggttaatgtggagatgtgttctgctttgtgttaatagctttaagcattgtggaggaaagg

SEQ ID NO: 6769647 - DNA, 82 bp, Homo sapiens
catggaggggtccatgtgacgttgttctggattcccattgtaacttcaagggaaactttcacaatgtccagagcccttgatg

SEQ ID NO: 6769648 - DNA, 66 bp, Homo sapiens
gggccgtgtgtgccaactttatgtgcaagtgcaatgacctgtcttagggatggctgcatatgaacc

SEQ ID NO: 6769649 - DNA, 60 bp, Homo sapiens
gatgtaccttttggatctggatatgtagatttgttcccagaaagtttgagaagatacatc

SEQ ID NO: 6769650 - DNA, 56 bp, Homo sapiens
attatccattaggtctatggtcaactattggtgtggccagttcattagtgggaggt

SEQ ID NO: 6769651 - DNA, 71 bp, Homo sapiens
ctgtttctcagaagtcccttgcatcttagtctgctgcagctgctaatgccaagactgctgtaaagaaacag

SEQ ID NO: 6769652 - DNA, 105 bp, Homo sapiens
aaacacagcttgcctaccttattattttagcactgaggattacaggctaggcttggaaagatgttcagtggttgaccataaataaaggcagcaggttttgtgttt

SEQ ID NO: 6769653 - DNA, 88 bp, Homo sapiens
ctgactcacaggtgtgtagtacagctgctgcctcatccactttattccaccacaaggtcatttaaggccagctggctctgtgcgtcag

SEQ ID NO: 6769654 - DNA, 85 bp, Homo sapiens
gcctcccagcaggaaacctgtctgattatggagactgccaatagcaagtttcagttaacccagactaattgggctgctgggaggc

SEQ ID NO: 6769655 - DNA, 79 bp, Homo sapiens
taaatggagaagaacatgtttttatctgtgctaggatcatgttatttctttgttttagaaacatgttctgttctgtttg

SEQ ID NO: 6769656 - DNA, 71 bp, Homo sapiens
actttttctcatacatctcataagagcagtggtgttgctgaggcctgattgagatagtatatggaaagagt

SEQ ID NO: 6769657 - DNA, 75 bp, Homo sapiens
agcatggggttctgtttgacctgtttggctaatgtttctaggtgccttaacatttaggaaggacctcctcaggct

SEQ ID NO: 6769658 - DNA, 59 bp, Homo sapiens
cttgtggagatatccatgtctgccccacacatagggaaggcaacttgcatctcggcaag

SEQ ID NO: 6769659 - DNA, 75 bp, Homo sapiens
tgtccgggaagcgtatgcccagttgttcacaggacacacacacagatccaaagacaccaggcgtggccctcgaca

SEQ ID NO: 6769660 - DNA, 60 bp, Homo sapiens
aagaccagcagacatcatttgaaacttttgaaatactttgagtgattttgatatggtctt

SEQ ID NO: 6769661 - DNA, 83 bp, Homo sapiens
ctttaggcggctcagtttgaatagcataggattacatttgcttgtctgcaggtcaaacctcactatttagattgtcactaaag

SEQ ID NO: 6769662 - DNA, 70 bp, Homo sapiens
gctgtgtgaaatgtgctgtggcattcactgaaggaccctgctgaagagcttgctcattctatcacacagc

SEQ ID NO: 6769663 - DNA, 79 bp, Homo sapiens
ggggcctccgcgcctcagcctgagggctccaggagccccccgctctctgaggccccgaagctgaggtttgttgggtctc

SEQ ID NO: 6769664 - DNA, 101 bp, Homo sapiens
tgaggcagaagaatcacttgaacccaggaggtggagattgcagtgagccaagatcatgccactgcactccagcctgggcaacagagtgagactctgtctca

SEQ ID NO: 6769665 - DNA, 77 bp, Homo sapiens
gggatcaagcatatataaaactgcaggggagaagagcagctcttaccttaatttttacatgtttgagttattgcccc

SEQ ID NO: 6769666 - DNA, 99 bp, Homo sapiens
tcctccccctcctcccaggagcgctgcctcctgccgtgcagcttcctcctcctaggtgggacttgtgggtaggtggctgatgaaggaggaggaggagga

SEQ ID NO: 6769667 - DNA, 84 bp, Homo sapiens
tgtctgtttgttttgttttcattgtcaataaactgtatctagatgctgggtgaagttctacagaaaaatttgacataaaagaca

SEQ ID NO: 6769668 - DNA, 107 bp, Homo sapiens
tccaaccttgagctgcgcgggttccaagagccaggcccgtacttgctgttgatgtcattggcttggggagttggggtttggtgcccagcgcggtcgttgggggaggg

SEQ ID NO: 6769669 - DNA, 56 bp, Homo sapiens
gctgtgtatgatgcaggcacctgggccgtcactcagctggctgtctcttacacggt

SEQ ID NO: 6769670 - DNA, 98 bp, Homo sapiens
tggggagaggcccttgagaatgggttgctttccacagcctagaactctagctttggtcagataccccattcttactcctgaagaggtcagaatcccta

SEQ ID NO: 6769671 - DNA, 59 bp, Homo sapiens
tttgttcattaaaagtgctgtaaataacagtttctgtgatagtagttttaattaacaaa

SEQ ID NO: 6769672 - DNA, 72 bp, Homo sapiens
gctctaggatttcacgggattctcataaatcatccaagaaaatttggatgaggttgagaatcattttagggc

SEQ ID NO: 6769673 - DNA, 89 bp, Homo sapiens
ggtgtggtggtaggcacttgtagttctaggtactccagagcactatttgagtccaggagtttgagactgcagtgagctatgatcacgct

SEQ ID NO: 6769674 - DNA, 130 bp, Homo sapiens
ttaaatttactgaggcttgctttatggagtaacatatggtctactctcgtgaacataccatatgtaattgaaaatgtttattttgcagagtagggtatactataaatatcaattaggtcacggtagttga

SEQ ID NO: 6769675 - DNA, 104 bp, Homo sapiens
gtagtggcacatgcctgtggtcccggctactcgggaggctgacgtgggaggatctcttgagcctgggtggtcgaggctgcagtgagctatgattgtgccactgc

SEQ ID NO: 6769676 - DNA, 73 bp, Homo sapiens
tctttctggtgtgaattggttctcttccatcggtgtcaaacacgtgagcccaggagacccaatgccagaaaga

SEQ ID NO: 6769677 - DNA, 81 bp, Homo sapiens
agatagctttctcagacttttaaagactgaatgagggaccgcttctacatatttccatgaagtttggagacacacctgtct

SEQ ID NO: 6769678 - DNA, 97 bp, Homo sapiens
ggttaaagttcaacccatgcctttcccaacagggtgggtccacagggattagtggcctctgctggggacaggccactcaggtcactgggctttgatc

SEQ ID NO: 6769679 - DNA, 68 bp, Homo sapiens
ggcccaggctctgtgcagcctgcatctgaggaagaatgcccacagaggccggcacagggcctcaggcc

SEQ ID NO: 6769680 - DNA, 70 bp, Homo sapiens
caaaaactggaaatagcccaggtgtcctagttttagaaatggagaactgattagcatttgccagggtttg

SEQ ID NO: 6769681 - DNA, 97 bp, Homo sapiens
agagatgatgcttatttcatatctatgtctgcacaaaggagactgtgatctgaccagaaaggttgttagctttctttggcagacgtgtgtcatctct

SEQ ID NO: 6769682 - DNA, 56 bp, Homo sapiens
tgtgacagtgccagcttcatagcctagtctaggcatgccagttgcccactgtggca

SEQ ID NO: 6769683 - DNA, 61 bp, Homo sapiens
ttggattaactgttatatgccagcactgctcaaggtcttagtatatcagcagtgaattcaa

SEQ ID NO: 6769684 - DNA, 108 bp, Homo sapiens
ttcatgtaatcttctggataatatattgaaaaggacagctggctcaggagggatcatttgcctgggttagtatctgtttccatttatattaagaaaatattgcaagaa

SEQ ID NO: 6769685 - DNA, 116 bp, Homo sapiens
atgggaaaatggatgttaacatttctgcctgactgataatctctgatgttacccttgggaagccccagctttcagaatgatttatttgtcaggttttggcgtttttttagtcccat

SEQ ID NO: 6769686 - DNA, 100 bp, Homo sapiens
gacatgttttattatggcagaatctgaaagtatggagcagtatgacgtattaaatatctgcagcaccatatgtttagatctcttcatcttgataaatgtc

SEQ ID NO: 6769687 - DNA, 55 bp, Homo sapiens
tgtgtgcacttaatgcaatcatcttcttcctgatcattgctttggctgcatcaca

SEQ ID NO: 6769688 - DNA, 61 bp, Homo sapiens
ctagggtggcctgctgggatcagacaccatgtggaggacaccatctcagaggccatcctag

SEQ ID NO: 6769689 - DNA, 62 bp, Homo sapiens
agggttcagtccagggcctgggacaggagggtatttgtgtacagggcttggggctgaagcct

SEQ ID NO: 6769690 - DNA, 69 bp, Homo sapiens
gggtcttgctttgttacccaggttgtagtgcagtggtgcattcatagctcagtacagactcaacttccc

SEQ ID NO: 6769691 - DNA, 103 bp, Homo sapiens
gctaagggaaaggctggaagtataggggagatgattttatgctcaatatttttccttttctgagttatcttttcctgatataagtttttaccttttcctgggc

SEQ ID NO: 6769692 - DNA, 77 bp, Homo sapiens
ggaagacttttgtaggtagatcccatgtaagaattgttttctctctgcaaatcctactctgactatagaacccttcc

SEQ ID NO: 6769693 - DNA, 69 bp, Homo sapiens
gtcctgccatggtgtcccttttgcagataagtgaagtgatttgcgtaaagctccctactttggcaggat

SEQ ID NO: 6769694 - DNA, 70 bp, Homo sapiens
tcaacctgcagctgtatggccaattcttgcctggccagaatgggccttggtgttggcatatggtggttga

SEQ ID NO: 6769695 - DNA, 72 bp, Homo sapiens
acttgaaccccggaggcggaggttgcagtgagccgagatcgtgccattgcactccagcctgggggacagagt

SEQ ID NO: 6769696 - DNA, 60 bp, Homo sapiens
tttagtacttaacggaaggagaattgattacgttgctcccaagctctgttaggtagtaaa

SEQ ID NO: 6769697 - DNA, 58 bp, Homo sapiens
gttttgttgctgcagagctcaaaatgaaaaccaaggccaggagcttcagttgcaaaac

SEQ ID NO: 6769698 - DNA, 56 bp, Homo sapiens
ttataaacgagaagactaagtcttggagggatcatgagagtgttctcgttttataa

SEQ ID NO: 6769699 - DNA, 78 bp, Homo sapiens
cctgtcccatggctctgcagctatgaggcagctttcctagggtgggtctcctggctgcagctaagaccaggcaacagg

SEQ ID NO: 6769700 - DNA, 106 bp, Homo sapiens
gagattaagtggcttacccaaagtttcacagttagcatgaggactactggggattcaaattcaagtctgtgactcattggatctcactttttaagcctttaatctc

SEQ ID NO: 6769701 - DNA, 64 bp, Homo sapiens
gggacatggaggcgcgcaggcactgaggacgaaagggccctggagcctggacgccgtccatcct

SEQ ID NO: 6769702 - DNA, 61 bp, Homo sapiens
gggccgcgccgacgggctggcggtggacacgggcgtggacgtgtgggccttcggcgtgctc

SEQ ID NO: 6769703 - DNA, 61 bp, Homo sapiens
atgtctgccatgcacccggacagctgagccctagggatacagctgtgagcaaggcagatgt

SEQ ID NO: 6769704 - DNA, 55 bp, Homo sapiens
gggtcagtttggaggttttctggctaaggcgttggatgagtctacacactggctt

SEQ ID NO: 6769705 - DNA, 68 bp, Homo sapiens
gtctagctgtccgtgcatcttttcccccattatggaaatgatatggaaggaagatgtacacagctgat

SEQ ID NO: 6769706 - DNA, 85 bp, Homo sapiens
ttgctctgtggggattatttttgttctggaaaacattgttatttgcaatagttggtccatgaaaaaagtctattttcaaatgcaa

SEQ ID NO: 6769707 - DNA, 66 bp, Homo sapiens
gagccacgagctgtaattgctgctgtccttctaagcaggggaaaagcagaccacgctttgtggctt

SEQ ID NO: 6769708 - DNA, 88 bp, Homo sapiens
ctgcttgggcagctgcagggcgggcgcgccgcgtctctggaaggccccgtccacgaagacgccgttcttgccgaggcagcgcaggtag

SEQ ID NO: 6769709 - DNA, 58 bp, Homo sapiens
agtacattaattttgctcaatggcctttctataaaatgagcatcaaattgatgggact

SEQ ID NO: 6769710 - DNA, 92 bp, Homo sapiens
cagatgatcagataattagatgtaagattagatgcgccagaagagatggctgcctcaattaatcttacagtctgtgcctctgcaaatcactg

SEQ ID NO: 6769711 - DNA, 57 bp, Homo sapiens
tcacagcctggtcactctgcccaatagcaaatctggtgctgagttgaatggctgaga

SEQ ID NO: 6769712 - DNA, 55 bp, Homo sapiens
ttggctctgaactatgcagtttctaccaggaccataggaagcaattcagagccag

SEQ ID NO: 6769713 - DNA, 56 bp, Homo sapiens
gccgcggctccgcgctcccgctggatggggttgcgctcgccagggaggggccgcgc

SEQ ID NO: 6769714 - DNA, 62 bp, Homo sapiens
tttgatcccagatttctgtgattgcaaatttcagtttgtttattacagttcttggaattgaa

SEQ ID NO: 6769715 - DNA, 77 bp, Homo sapiens
gtagtggggccatcctgggcactgcagggtgttgagcctcatccccgggctccactcaccagatgccaggaccacac

SEQ ID NO: 6769716 - DNA, 66 bp, Homo sapiens
ctagaattggggcaaggacaggtatggcagggatccagcctccagggccagtccttgtctgtctgg

SEQ ID NO: 6769717 - DNA, 73 bp, Homo sapiens
tcatttaacttctttgagctccagttttctcatgtacaaaatgggaaaaatcctatctcacagagttgtgtga

SEQ ID NO: 6769718 - DNA, 63 bp, Homo sapiens
tccagttgcctgtctctgattatggtttggtttctagaaggttctaatcagagacgggcagga

SEQ ID NO: 6769719 - DNA, 59 bp, Homo sapiens
gttgttgctggcaaccagagttggaaaagcattttgttttctagggtggctgtagcagc

SEQ ID NO: 6769720 - DNA, 78 bp, Homo sapiens
cttggtaggcgcctgttttctgttgattttcccatcactatttggggtttttcctaccagcaagacatgtttatcaag

SEQ ID NO: 6769721 - DNA, 68 bp, Homo sapiens
aaggactagtaaagtactcaaatagcccctataaagaggcttctttgtttctttgatctctggccctt

SEQ ID NO: 6769722 - DNA, 97 bp, Homo sapiens
gtgctcctttgctgtgaccccacatcgctgtcctgaggtgcagctgtcggaggctgctgagtcacgacagtgaatgggcagagacagaggagtcagc

SEQ ID NO: 6769723 - DNA, 64 bp, Homo sapiens
agttttttaggatgatcttgtagagagatcagcttgctggggttaccaaggtcattctgtgact

SEQ ID NO: 6769724 - DNA, 63 bp, Homo sapiens
tctctgtcacctcagtcctgtgactatccccacttcacaaaagcaaagactgaggctcagaga

SEQ ID NO: 6769725 - DNA, 80 bp, Homo sapiens
caaatacttctgacaattcagtaacagcatgccttttttggtgattgttgtaaaatttgagatgtcagctttgtatattg

SEQ ID NO: 6769726 - DNA, 67 bp, Homo sapiens
gtgctataggtcctaggtggcagtttcaggtcaggtatgaccatctcctctgggcctatttgttcac

SEQ ID NO: 6769727 - DNA, 70 bp, Homo sapiens
gtcaatatttttggttttcctttgggtcaaactgggtaccgttgcagaggttgagcaaaaatgatatgac

SEQ ID NO: 6769728 - DNA, 72 bp, Homo sapiens
gtagaaccatgtgatgttgctgatattatgttgtttttgacccagaggaacagcaatttcatttggtttaac

SEQ ID NO: 6769729 - DNA, 80 bp, Homo sapiens
ggtattccctttggtatggtcaaagcctgtgtaatacttaagcatgtctcatacacggcttgaccattttgattgaattc

SEQ ID NO: 6769730 - DNA, 86 bp, Homo sapiens
tcccatttcatctgcttcttcctttctgaccatttctaagtgacctcaggctcatgccacacagatggtaagggagggagctggga

SEQ ID NO: 6769731 - DNA, 64 bp, Homo sapiens
gaggctggggactccccaccatagctcggtcccagctgggttaaagtggctgtcactcagcctc

SEQ ID NO: 6769732 - DNA, 114 bp, Homo sapiens
aatgttaatgagttttgttatatcggttccaatatttctcatatatggaaaatgtcattttccctgggaattaatatttggagctggtgtttaagaaaaaccatgtttgatgtt

SEQ ID NO: 6769733 - DNA, 64 bp, Homo sapiens
attcatccaaacatccattcatgcctgttctgtgccaggcattgttctaggtggttggaggaat

SEQ ID NO: 6769734 - DNA, 62 bp, Homo sapiens
actttccctctagccaaattttaaaactgtagctgtgtttcaaaggaggctgagaggatggt

SEQ ID NO: 6769735 - DNA, 70 bp, Homo sapiens
gctgtagtcccagctaccccggaggctaaggtgggaggatcacttgaacctgggaggctgaggctgcagt

SEQ ID NO: 6769736 - DNA, 130 bp, Homo sapiens
ttttgaaacctttattatctatatctgtgatgacctcaaagttcaagtagtgttacatggaaaatgttagttttatactgtgcaagacttactttaatacaggttcactctttggattctgtttgtaaaa

SEQ ID NO: 6769737 - DNA, 69 bp, Homo sapiens
gatttcttgataagtagtgtgatattcccaggtatagccttcatggggagagctcttggcaatgaaatt

SEQ ID NO: 6769738 - DNA, 59 bp, Homo sapiens
gcacagactctaggttcagctgcagtaatcgttactgctgccaaatgcgagctctgtgc

SEQ ID NO: 6769739 - DNA, 59 bp, Homo sapiens
ctcagagaagtctttgctaaaccccctatcgatgaggaggccatggcgtggcttttgag

SEQ ID NO: 6769740 - DNA, 66 bp, Homo sapiens
ggaggagctatagagctgcagcttactaaagccactagcctctgtcattgttctgtttgttcctcc

SEQ ID NO: 6769741 - DNA, 58 bp, Homo sapiens
cacctttcctatgtttcatatattccttggagtgctggggtgggtggaattaggagtg

SEQ ID NO: 6769742 - DNA, 61 bp, Homo sapiens
gttccattcttttgcttcagtgttcaggttttctctggattatggagaagaacaatgaaac

SEQ ID NO: 6769743 - DNA, 60 bp, Homo sapiens
gtaaagccgtttggttctgcaatctgtaagattattcttcagtagaatcaaatattttac

SEQ ID NO: 6769744 - DNA, 72 bp, Homo sapiens
tgtcaatataggtttcaaacatgactcttggggagatgatttgaatgtcttgtttgatatcaaatattggta

SEQ ID NO: 6769745 - DNA, 55 bp, Homo sapiens
cctctctgagaggtcacagctgtgcccttttgtactgagacctgcattagagagg

SEQ ID NO: 6769746 - DNA, 71 bp, Homo sapiens
agtgctttttaacaaacttactgtgtttaaagaggaggaggaacccccagatgaagtaggtgacgagcact

SEQ ID NO: 6769747 - DNA, 59 bp, Homo sapiens
tgatgtatctgagctgcttaggtttatgaaaggtcacctggatattttcagttgcatca

SEQ ID NO: 6769748 - DNA, 59 bp, Homo sapiens
tttcgccatctacctgcacccaagctggcacaggcccccagctgcagctgatggggaaa

SEQ ID NO: 6769749 - DNA, 67 bp, Homo sapiens
ttccaagggtaggtcatataagacaaccagctttctcctggttctctggggatgcttattcttggaa

SEQ ID NO: 6769750 - DNA, 74 bp, Homo sapiens
tgccactgaggttttgtggttatgtgttgcacagtattgtgatggtgagatataactcatacagccaggtggta

SEQ ID NO: 6769751 - DNA, 92 bp, Homo sapiens
ggcacagagcttgtaagaggggtggttatgtggccacaggaacacgaacagaattgctgtccatccaggcccatagacacttctcgtgtgcc

SEQ ID NO: 6769752 - DNA, 67 bp, Homo sapiens
ttctgcaaaactctcccaagtgccctatgatgtgccagttagtgtcttaggcactggtgatgcagag

SEQ ID NO: 6769753 - DNA, 64 bp, Homo sapiens
taggaaggccatttttaggtagaatatacaaagaaagtaattgagcctaaagaggacctaacta

SEQ ID NO: 6769754 - DNA, 98 bp, Homo sapiens
tcacagggacttcccagggggcagtaggcatagaaagaagcaccaagatgaaggcttggtcaatctgaaagtagcctgggccccatggagctcagtga

SEQ ID NO: 6769755 - DNA, 61 bp, Homo sapiens
cacagtgctcgggttttatgtctcttgttttatcctgaattatttatcctgagcatctgtg

SEQ ID NO: 6769756 - DNA, 88 bp, Homo sapiens
ttctatcaggaaagctcttgcatctgttgtattggtctgacttggatgacatgactaacccaggaggcaagagattccaaagatggga

SEQ ID NO: 6769757 - DNA, 57 bp, Homo sapiens
ctccagagatacacggtcttgcagcctcactggtggtttaggttgtgggctttggag

SEQ ID NO: 6769758 - DNA, 102 bp, Homo sapiens
ttttggtgggccagccttgcacagcttttgtcattgacatttgtatcctagcaaaattacacattacttcatgacataaacctgtggggttgcttaagaaga

SEQ ID NO: 6769759 - DNA, 56 bp, Homo sapiens
attaaccagcattcttcacaacttgctccccaagcaatgaggagcagctggttgat

SEQ ID NO: 6769760 - DNA, 63 bp, Homo sapiens
agctgtcaagttcacatgcatccttgctacccccaggtgagcaatgccaagtgaactcctgct

SEQ ID NO: 6769761 - DNA, 59 bp, Homo sapiens
aggtaaattatgttccatgtcctttggggtgacaagaaagtgggtaatatgatttccct

SEQ ID NO: 6769762 - DNA, 115 bp, Homo sapiens
taatcattgaaaaaaaaaatatgctcacaatatttatgacattggtgcatgatattctgaaatgtaacaaatggtatacatgtcaatgcgatgtaatatttatcttcaatgatta

SEQ ID NO: 6769763 - DNA, 72 bp, Homo sapiens
gatggggctgctgtgccatgaccctgtgggctcacgggcagtgcttgtgggcctcatgcccagccacccatc

SEQ ID NO: 6769764 - DNA, 64 bp, Homo sapiens
actgcaattactgggaggttttatagacaccataaaattgtaaaactgcagaggtgatttcagt

SEQ ID NO: 6769765 - DNA, 77 bp, Homo sapiens
cttttatttaagccagtttccagatattaactctgtcccccaggaccaagtgataactgaagaggcccagatgcaag

SEQ ID NO: 6769766 - DNA, 64 bp, Homo sapiens
actgtttgctttttgcaccctttgccgttacaaaaatataatggatgtgcagaggtaggagagt

SEQ ID NO: 6769767 - DNA, 82 bp, Homo sapiens
ctgggagagtcctgttgtctcttcctgttgacgagaccgaggttttgccagacagtctgaaggaggcgctgcttgttctcag

SEQ ID NO: 6769768 - DNA, 125 bp, Homo sapiens
caagtatcacagactgggaggcttgaataacagaaattgatttcttacagttctagggggctggaagtccaagatcaaagtcctgataggatttagtttctgttgagggccctctttcttgcttg

SEQ ID NO: 6769769 - DNA, 66 bp, Homo sapiens
ccagctgcctgatgggggggacctgctaattggagaagtctgctctggtcccctgtcaccagttgg

SEQ ID NO: 6769770 - DNA, 68 bp, Homo sapiens
ttatgtctcccagaggcagttggtaacttatttacaactttaggttcctctcagctctgggaacatag

SEQ ID NO: 6769771 - DNA, 67 bp, Homo sapiens
ttcaaagagaactcagtctacactggaagatcaagattggtaaccactggagactggtctctgtgaa

SEQ ID NO: 6769772 - DNA, 61 bp, Homo sapiens
gcacacattcggattcttaaccaccagcttaccagatagcttgctgtgtccgtgtgtgtgt

SEQ ID NO: 6769773 - DNA, 55 bp, Homo sapiens
ggtccttctgtaggggtccccttctcctggagggcagacttcttgggcagggatc

SEQ ID NO: 6769774 - DNA, 59 bp, Homo sapiens
cctcagaagctcaaggacattgtctgtaaaacagaaataatattccttgtcttgtgggg

SEQ ID NO: 6769775 - DNA, 96 bp, Homo sapiens
gaggcaggagaatggcgtgaatctgggagcggaggttgcagtgagccgagatcgcgccactgcactccagcctgggagacacagcgagactgcctc

SEQ ID NO: 6769776 - DNA, 80 bp, Homo sapiens
aggcttctgggttgcttccttgggaaaattagatgcaatttatgggttgtgtcttgcaagacaggcaaataccctggcct

SEQ ID NO: 6769777 - DNA, 60 bp, Homo sapiens
gccattgttttagtaggtacactgaggccaggaaggtcttgttgccaagagaatagaagc

SEQ ID NO: 6769778 - DNA, 65 bp, Homo sapiens
ttgttggtgtgaaaataatgctaatttttactaacacgaaactgatgtataacttacaccagcaa

SEQ ID NO: 6769779 - DNA, 94 bp, Homo sapiens
tgcctctcctgccaccttgggactgctcacccctcggcccccctcgtccacagggagtggacagcagccccccaggtgcgatcagacagaggca

SEQ ID NO: 6769780 - DNA, 57 bp, Homo sapiens
ggctgatgagcccacagagtgcagcccggatgggaccacctgtgagactctcagacc

SEQ ID NO: 6769781 - DNA, 80 bp, Homo sapiens
gccggccgtacctccgagagcatgacgtactgtccccttctgcccaacgtgatgctcaggaggtcatagatggctgcggc

SEQ ID NO: 6769782 - DNA, 90 bp, Homo sapiens
gtttttctcaacctggctgccagcaatgtgtccagcctcatctctttttcctgctgaaaagcattctgtgctacagccattcagaaaaac

SEQ ID NO: 6769783 - DNA, 59 bp, Homo sapiens
caggcatggagaggcagagactctcccttggacgtaattctttgcctattctctgcctg

SEQ ID NO: 6769784 - DNA, 75 bp, Homo sapiens
gggttgctgtgtctgatggctgagacttgtgtatgctccaggtagtgacatttctggccttagagacggcttttc

SEQ ID NO: 6769785 - DNA, 81 bp, Homo sapiens
ttgagctaatgagagcactgtcacctaaattttcattgttttaagagcaagtggaggctgacagtttcctttcaagcttga

SEQ ID NO: 6769786 - DNA, 100 bp, Homo sapiens
acggagaggttgagtaacttgcctaaagtctcacagagtcagggctgggatttgaacccagcccatctagctttagagattatgcgcgaaacccctgcgt

SEQ ID NO: 6769787 - DNA, 66 bp, Homo sapiens
gttcagtgattctcggtgttcatgactgtagctctgcagggagttttgaatctgggaagtctgaac

SEQ ID NO: 6769788 - DNA, 64 bp, Homo sapiens
tagagctatttatcagccagaagtagtcaaatccttgacttattctggttcttggactgtttta

SEQ ID NO: 6769789 - DNA, 71 bp, Homo sapiens
tcatttggtattaattttcagaacctgttgttctaaaaccttaatacagtttgaagattatgccagagtga

SEQ ID NO: 6769790 - DNA, 70 bp, Homo sapiens
catggccctgtttatggtaaggcttagccttgagaccaatcattttctttgccttctttgaacattcatg

SEQ ID NO: 6769791 - DNA, 76 bp, Homo sapiens
cttcctggtgccaatttgcccctttgctgaagcacactcttcggtgcatctaaggggcaagcttggtgccgtggag

SEQ ID NO: 6769792 - DNA, 61 bp, Homo sapiens
tcaccacccccagacaggaaaatgcaggcaaaaatgagactggattccctgggagtggtgg

SEQ ID NO: 6769793 - DNA, 87 bp, Homo sapiens
gggcagcatgtaagccttgcagcattaggctctgtgacctaagcttgcacaagaacctgattctggcaactgagcaaacatttgccc

SEQ ID NO: 6769794 - DNA, 78 bp, Homo sapiens
ggtgacgccctttgtgtgtgtataggaaaggacggtgtacacatttggttagttccttcttttacaccataaattatc

SEQ ID NO: 6769795 - DNA, 113 bp, Homo sapiens
gtgaagtacagtaattaattttagctaaagccttttatgatcagttaatgatatatctttatttgatttataaatggcaggatagattaaggttaataaactattcatttcat

SEQ ID NO: 6769796 - DNA, 55 bp, Homo sapiens
cctctcagcgattcctcttggagggcttacatctccaggcttcgccagtgagagg

SEQ ID NO: 6769797 - DNA, 66 bp, Homo sapiens
aagatcctgccattgcccctggcttccaggaactgaactggattctgagcatcatggcagaatctt

SEQ ID NO: 6769798 - DNA, 65 bp, Homo sapiens
tgtggcatttatgacaaccaaagagtgaaacaattttattaagtggtaatgttcatggggctgca

SEQ ID NO: 6769799 - DNA, 55 bp, Homo sapiens
tccccagggggtgggtgatgacagatggactcatgactctcccaagtttgaggga

SEQ ID NO: 6769800 - DNA, 95 bp, Homo sapiens
tatactgtatttatttcatcctctctgttttcgtgtatgtgctgaaatgcatatcttgatcaagtagaagaggatatgatatataaatacgtata

SEQ ID NO: 6769801 - DNA, 64 bp, Homo sapiens
ctcaggtggtattatttggagtctggtatatatcagatttagggtgattaccttaaaaccttag

SEQ ID NO: 6769802 - DNA, 76 bp, Homo sapiens
ccatgtatgtacagtacctgccacgttgttggcactaagtaaatgttaagtaacaatgggaaggactgatgaatgg

SEQ ID NO: 6769803 - DNA, 69 bp, Homo sapiens
tccaaagagcaagagtgttggactttgaataatctgagttcaaatctttgaccacttatgtgacttgga

SEQ ID NO: 6769804 - DNA, 76 bp, Homo sapiens
agatgctaactctgaaaaacgggatttggctggtagcacctgacacagccaatcttgaatttccactaaagtatct

SEQ ID NO: 6769805 - DNA, 55 bp, Homo sapiens
cctgagctggagacattacatattagaaataatagtaagttttgatagcattagg

SEQ ID NO: 6769806 - DNA, 73 bp, Homo sapiens
tggtaattgatcagctcacagtgggatttgctaaagcatattgtgactttgagctgaaagcacatcataatca

SEQ ID NO: 6769807 - DNA, 90 bp, Homo sapiens
gtgagagggatgtgccggtgctgagatttccttcaaggctctgaaagctggaagcgagacagagatctcctgcagagcatctctcctcac

SEQ ID NO: 6769808 - DNA, 70 bp, Homo sapiens
ggtggtactgctggctggatcagagattggcatccttactgccatgtcctatgaccgctatgctgccatc

SEQ ID NO: 6769809 - DNA, 89 bp, Homo sapiens
tgggtgggaattctttggcagggccagctgcagaattagcattaatgtgatactaatccctgggatggcccctcagagcagtgtaccca

SEQ ID NO: 6769810 - DNA, 63 bp, Homo sapiens
gtgccatccagaagggtttgaaagaagcataaaattgatccaaacttcacacttctggagcat

SEQ ID NO: 6769811 - DNA, 64 bp, Homo sapiens
tgatctaaaggaagtaccttcgtataagcccaagaaacaaaagggttttgcttcttttgcatca

SEQ ID NO: 6769812 - DNA, 101 bp, Homo sapiens
ttaggtaatattcctgcacccaaggtctcactttgtggaagtgacagtggagatagaaaaaatgttatttccatcaaaactgagaaggaaaacaatcctaa

SEQ ID NO: 6769813 - DNA, 65 bp, Homo sapiens
ccatgtggggtagcagtttccgtgtggggtagcagtttccatgcggggtagcagattccatgcgg

SEQ ID NO: 6769814 - DNA, 88 bp, Homo sapiens
acacccatgagagcagagcagagggtgcagctgggccccacggaccctgtgggtgctcagagtacccccaggaagtgcacgtgggtgt

SEQ ID NO: 6769815 - DNA, 56 bp, Homo sapiens
ttcttttctcctcagggaggcctcagccaactgccacaactcctgagtgaaaggga

SEQ ID NO: 6769816 - DNA, 95 bp, Homo sapiens
aatgtccttagtatgtttggaaggtgaggcatgaaggagcccagcttatttgggggcctgtgggtcattttatcaggtgcagtacaaggtatatt

SEQ ID NO: 6769817 - DNA, 64 bp, Homo sapiens
gtctagtctgaagcactgcaatgctttattgatctggatagagaagaaagtgctcagaggagac

SEQ ID NO: 6769818 - DNA, 70 bp, Homo sapiens
gaggataaagtctttaggtggacagattaggaaagtcctgtgctgtctacttaaagactttttgtcattc

SEQ ID NO: 6769819 - DNA, 56 bp, Homo sapiens
tgcagaaagtcacattccctttagcatttgtaggttttgtggtgtctctttctgca

SEQ ID NO: 6769820 - DNA, 72 bp, Homo sapiens
gctgctgctggcttcctgctgttttgaggcctctgatgctggaagaacaggaggaagccagctccccacagc

SEQ ID NO: 6769821 - DNA, 86 bp, Homo sapiens
cacctttgcaattgagtgaggaggaagttttcatttattcttcaagatagagtaaatcactcttctctcaccaccttgtctttgtg

SEQ ID NO: 6769822 - DNA, 67 bp, Homo sapiens
gaaaggggagcttcattttgacctgggacagggacctgtaggtctcagtgtctgagctacttctttt

SEQ ID NO: 6769823 - DNA, 74 bp, Homo sapiens
cttctttgtcctctgatttctaggtatatccagccaatgagatgcattttaagaagatatgagggtcaaagaag

SEQ ID NO: 6769824 - DNA, 71 bp, Homo sapiens
tgggttgaatgttagctgtgctttaagttctttgagaaatctccaaactgctttccacagtggctaaccta

SEQ ID NO: 6769825 - DNA, 73 bp, Homo sapiens
ccagagtctttgggcaaaagagtttcccagtgcccaggctgggtcggaatgctctttggtcctagactcctgg

SEQ ID NO: 6769826 - DNA, 92 bp, Homo sapiens
tttaggcttttaaaaaattgtcctcatgctgagttcttgtttgccaagtttcagcttggagagaatttttatagcttttataaaaccctgaa

SEQ ID NO: 6769827 - DNA, 56 bp, Homo sapiens
aagcccagatgagatccctggatgtggataaagatccaggttctcatagggggctt

SEQ ID NO: 6769828 - DNA, 61 bp, Homo sapiens
ccagttccccaagtgtgctaccttttgttataagaggagacttcagcaacttgggagctgg

SEQ ID NO: 6769829 - DNA, 102 bp, Homo sapiens
taaatggtagtacatcttggcagtggaataccaggaacagtagaaaagaactgaagttctggagtcccacagccagggtttaaattctggttctgccattta

SEQ ID NO: 6769830 - DNA, 57 bp, Homo sapiens
ccaccgagggggcgggaggcggcaggaccagcaggggcagcccgttctcttcgctgg

SEQ ID NO: 6769831 - DNA, 113 bp, Homo sapiens
gcctgggcttgagactccaggttttctgtggtcagagcttgagcttataactattgggttttcctgttaaatctgggcacagtgtagaatcttcaccttcttataagcctggc

SEQ ID NO: 6769832 - DNA, 72 bp, Homo sapiens
ggaaggtcctgggcaggaatggttaatctaaagtggtgggccaccttggccttgctatttctccaaccttct

SEQ ID NO: 6769833 - DNA, 78 bp, Homo sapiens
cttagaactggcacaatgtcacttttgctacatgctattattagccaaagcaagtttcagggacacccagattcaagg

SEQ ID NO: 6769834 - DNA, 72 bp, Homo sapiens
gggcaatctgcttcacttccccaagcttcagatttgatgtttggaaactggaagtgatcatagtacctgccc

SEQ ID NO: 6769835 - DNA, 57 bp, Homo sapiens
ccaggggagtgtgtgataatgtgcagattcgcatgaatgcacacatacaccctttgg

SEQ ID NO: 6769836 - DNA, 85 bp, Homo sapiens
atccaaagcatgttaaggtagctcactaaatatgtatttacagataatggtatgtaaaagtgatctatttaattcttttttgggt

SEQ ID NO: 6769837 - DNA, 96 bp, Homo sapiens
ttttatttggcattaaaactgcactttattttgtcaaaggagaggtttccccttgaattgtaagtacaaaaaaagtgtttttaatctttagtgaaa

SEQ ID NO: 6769838 - DNA, 79 bp, Homo sapiens
ggtgtcctgggattcatgaaaagattctttccacaattactgatttgttaagaaaatttattcatgttagttctatacc

SEQ ID NO: 6769839 - DNA, 57 bp, Homo sapiens
cagacagggtcctgtccgtcactgtatatttcatggtgcctaatggtgctttgtctg

SEQ ID NO: 6769840 - DNA, 122 bp, Homo sapiens
actgttctagaaaatgacttattattaagtgtggttgttttaggattcttttctatgtgttcaagtgacagaaattcaattctaattagcttattatcttaatagttcagacccagagtggt

SEQ ID NO: 6769841 - DNA, 84 bp, Homo sapiens
gggatctgcatatgtgtgggggctgggaaggaagccaggccccctgcagccaggccaagcctccccagctccccaccgggtctc

SEQ ID NO: 6769842 - DNA, 77 bp, Homo sapiens
agtaagagcgaaaaatgtgtaaatatgtttgaggactacaaaaagctgtggcataagtacatatttttatagatgct

SEQ ID NO: 6769843 - DNA, 129 bp, Homo sapiens
tttatttttaattttataacagatttacagattgtattcttccaaatgaatatggttttcgatttaacacacttttgaaattgttcattggaagtgcattataggctctgtgtaagccataaaatacaa

SEQ ID NO: 6769844 - DNA, 85 bp, Homo sapiens
ccgtcctgtccctgtgctcggtggcccaggcgtcagcaagacggctggtccctgcgttaagagcactttcaataaggacagatgg

SEQ ID NO: 6769845 - DNA, 64 bp, Homo sapiens
aggaccaaggttgtcttttatactgaacacttcctctgccccagtgctcaacagctcgggtcct

SEQ ID NO: 6769846 - DNA, 80 bp, Homo sapiens
ttgtctttcctgaggagtatggctgtagttacagatacatatctaacagaaagcagtcatatcattccaacagggaacag

SEQ ID NO: 6769847 - DNA, 88 bp, Homo sapiens
gccggaggctgagccagatctgtctatgagtgccaaattgctgtctcagcgctgctgctgatgcatagtctgctcgcctgccccaggc

SEQ ID NO: 6769848 - DNA, 57 bp, Homo sapiens
ccaccgctgtgcccctgaaagtaggtcagatcactgtctgctacagagccatggtgg

SEQ ID NO: 6769849 - DNA, 78 bp, Homo sapiens
gaggaggggtcagtgatgtcaggtgcctcagcaggctgattgccactgagttccctgacatttcaaggcagcctcttc

SEQ ID NO: 6769850 - DNA, 73 bp, Homo sapiens
gcagcccaagctgacctgctgggctagtggccctgtcccgggagcgctcacaggcagtgttgggagagactgc

SEQ ID NO: 6769851 - DNA, 67 bp, Homo sapiens
gggggccacctctgcctcaagcttcccaagttctcagaaagtgtggggagtggttagaacggctccc

SEQ ID NO: 6769852 - DNA, 77 bp, Homo sapiens
atatacctcacacatcagaaatatgaatgagatgccaatacatcagttacttgtgaatgatgtctctgatggtatgt

SEQ ID NO: 6769853 - DNA, 61 bp, Homo sapiens
caagtggggcctggtggtacagtcaagtgagagtaagccatggctggccacgccccagttg

SEQ ID NO: 6769854 - DNA, 80 bp, Homo sapiens
ttcatttcccagacagccaatgcctgcagcccagtgtgcatcttttcacatactgctgagcatttgcagggacagatgaa

SEQ ID NO: 6769855 - DNA, 60 bp, Homo sapiens
tctcacctcccagttccaatccagaatgaatttgtcctgagtgagagctgggaggtgagg

SEQ ID NO: 6769856 - DNA, 65 bp, Homo sapiens
aaccactcggtctgtgatcttttgttatggcagtcctagcaaactaatacaggctcaaagaggtt

SEQ ID NO: 6769857 - DNA, 55 bp, Homo sapiens
gcctgttacttctctgcaggcatctttcccacagctctgcagggatgtgcagagt

SEQ ID NO: 6769858 - DNA, 77 bp, Homo sapiens
gctggtctgggccaaggcctctgcaggatgagtagtagctgttcctgctgggctttgggcagcccctagaccctagc

SEQ ID NO: 6769859 - DNA, 58 bp, Homo sapiens
tttatgggttgaatcccaacactctattgtaactgtgtttggagatacaacctttaag

SEQ ID NO: 6769860 - DNA, 71 bp, Homo sapiens
cccatgatatttacaaccctgcaaggaagttggaaatgcatcttccaggctgcagttgtagttattgtggg

SEQ ID NO: 6769861 - DNA, 64 bp, Homo sapiens
agcttctcatgtttatttttacatatttcaaatccctcattatgtcttgtaaacaagaggggct

SEQ ID NO: 6769862 - DNA, 78 bp, Homo sapiens
ccaggaatgatgctggagcgtgatccttgatcttgaggagtccacagggcatgcttcaagtccttaaatctctcctgg

SEQ ID NO: 6769863 - DNA, 87 bp, Homo sapiens
ggccgctggtgcctgccggacaccctcgctccgggagagcaggatccccggccttgcgcggagcagagggacgaaggcgccgcagcc

SEQ ID NO: 6769864 - DNA, 61 bp, Homo sapiens
cacagatctttgagatgattctattgtgtttagactaataacttcatcttcaggataggtg

SEQ ID NO: 6769865 - DNA, 81 bp, Homo sapiens
gctgtctagtggtttataaaatcagattcctctcgacaatcaggactttaaatgtatttttagacctttagaccaactggc

SEQ ID NO: 6769866 - DNA, 57 bp, Homo sapiens
gccgtcgtgatgaacacgcctccaccagttccctgagccatttctgtcacgtacggc

SEQ ID NO: 6769867 - DNA, 64 bp, Homo sapiens
gaggagggcagttcctcttttatgttttatgaccagtttttcattgaggggtattgcttttctc

SEQ ID NO: 6769868 - DNA, 73 bp, Homo sapiens
cagacatacagtaagtgtccctgaaaccttagaccttgtctctctggctttaaatactgtactgttttgactg

SEQ ID NO: 6769869 - DNA, 60 bp, Homo sapiens
ctagttggatgcagggcccagagaggagggaacatgttcctggctcaagcatccaggtag

SEQ ID NO: 6769870 - DNA, 65 bp, Homo sapiens
tcagtggattggatgagatctgctcacattatggaggatgatctgcttcattcaaagtctactga

SEQ ID NO: 6769871 - DNA, 65 bp, Homo sapiens
agtcagactgactgcagtgtggtcatttttctaacccataactgctcacactgcagcagtctgct

SEQ ID NO: 6769872 - DNA, 56 bp, Homo sapiens
tgcttgctgtaaagcttggtcagggaatttctttgaaataaccagcgcagtaagca

SEQ ID NO: 6769873 - DNA, 59 bp, Homo sapiens
ccctcaccagccccaggtcctttcccagagatgcctggagggaaaaggctgagtgaggg

SEQ ID NO: 6769874 - DNA, 64 bp, Homo sapiens
gcaacagtgaggtgaatatgctcccttgttcgggtccaacaggagacatactgcctcatcttgc

SEQ ID NO: 6769875 - DNA, 77 bp, Homo sapiens
tggactgatgaatggaccttaaattgcttcaggttgttcaacttgaacagttttgtcaggttcactttcatctttca

SEQ ID NO: 6769876 - DNA, 121 bp, Homo sapiens
ctgctggtcttgcttttgaaaactgtgactttgttattctagggcctcaagtcctgatcagagcaggttctagaacctaggagtactaaagtcagtgtaagaaaaattgaaagagaagcag

SEQ ID NO: 6769877 - DNA, 97 bp, Homo sapiens
cattgttgtgagttaggtggaagacaaagattcaatattcagttattaacacctaattaaaatgttcattgttttccatatgttgtttatagctttg

SEQ ID NO: 6769878 - DNA, 83 bp, Homo sapiens
cctcctctgcagggcagtgtgtctgtggggcagtttgcttctgtcctgtttctgggatgggcctacactgccctccagggagg

SEQ ID NO: 6769879 - DNA, 65 bp, Homo sapiens
tgtatgttctttgaaatattttagaaagatatcatgagctgtttgaagtaatttaaagaaagaca

SEQ ID NO: 6769880 - DNA, 60 bp, Homo sapiens
caggttcttgaagccttctggcacctgaagaatgttggaatgacttcttcaagaagcctg

SEQ ID NO: 6769881 - DNA, 62 bp, Homo sapiens
gatgagtcctggaaccctgaatgctttctccaaagcatactctggttttcagagattacatt

SEQ ID NO: 6769882 - DNA, 76 bp, Homo sapiens
tggccagggaagctggtcacgcaggtaatctggctatttctccttacagacccagctgaccactttccttgagcca

SEQ ID NO: 6769883 - DNA, 73 bp, Homo sapiens
gaatgatattttgtcctggtttttaagttttatgtttttaatttaaggcttatatacttagacattgtcattt

SEQ ID NO: 6769884 - DNA, 94 bp, Homo sapiens
ttatctctcctcccagtagtctccctccatcttcccatccaggtctggaggatccagcagcctccagggtagaggaggaagagaggagagatag

SEQ ID NO: 6769885 - DNA, 73 bp, Homo sapiens
tcctcacatgtagatttttttagatcatagaatcaatctacttctgggcctatagaagtctacccattaagga

SEQ ID NO: 6769886 - DNA, 55 bp, Homo sapiens
gggcatgttcaaataagtagtttctatggcaacacgtggagtgagccaggtgccc

SEQ ID NO: 6769887 - DNA, 69 bp, Homo sapiens
aagactcagctgggagaaagttttaggtttctgctctaacacctgaaatgagttctgctcactgctctt

SEQ ID NO: 6769888 - DNA, 84 bp, Homo sapiens
ggtgaggaataagccaggtgggaaggcagcacctgagatctgcctccctcagcctgcaggcctcacacctggcaccttctctcc

SEQ ID NO: 6769889 - DNA, 59 bp, Homo sapiens
tgtgtggactctatcagaaccaaccgtcacttttacctggtttatggacagtccaaaca

SEQ ID NO: 6769890 - DNA, 55 bp, Homo sapiens
atgtctttggctttgacatggcctttgaaatgagtccatgcgaggttgaaggcat

SEQ ID NO: 6769891 - DNA, 57 bp, Homo sapiens
catgatgtagttgttggtagatagaggtttgttctctgaccatttgacaacatcctg

SEQ ID NO: 6769892 - DNA, 57 bp, Homo sapiens
gcctgggtgcccggcccttctctgggcagaaacccaggggctggccgggctccaggt

SEQ ID NO: 6769893 - DNA, 103 bp, Homo sapiens
ctggtgtaaacactgaaacagagttgtatggcttgatacctgttggtctttcttctggcttctaggtcatgaccatacatatccttgtccaggtttttaccag

SEQ ID NO: 6769894 - DNA, 86 bp, Homo sapiens
aggaactggagcattctgtgtctgccgtcattgtgtaactgggctattgtgactcctgatatagaaatggagatgttcttgttcct

SEQ ID NO: 6769895 - DNA, 81 bp, Homo sapiens
gtgttggagaggatgttgatcaacctaagctcttatacactgctggtgggagtccaaattggtacaatagcttttgaagac

SEQ ID NO: 6769896 - DNA, 65 bp, Homo sapiens
tattagtgtggaagattctaattgggcttcctatgtagccgaagatcaaatacttccaactagtg

SEQ ID NO: 6769897 - DNA, 58 bp, Homo sapiens
agcggccctgaatactggttggaagcccaaggctttgttaccaggcctcagaggccct

SEQ ID NO: 6769898 - DNA, 67 bp, Homo sapiens
tgtcttcctccagcaggactgaggcccagggaagaatagtcagcggggtctggggtgttgagggaca

SEQ ID NO: 6769899 - DNA, 98 bp, Homo sapiens
cagaatacagtgaatataccagtgaggtagacagctttttctctctcatgagaaagagaaagcttaggtatctcaacttttagtagtcaaaacttttg

SEQ ID NO: 6769900 - DNA, 57 bp, Homo sapiens
gtccttggagtcaggcaaggctgcgcagtggtgggcagaccagcctggtttcaagac

SEQ ID NO: 6769901 - DNA, 77 bp, Homo sapiens
gacttttacagacagcaagtggttgtttttggtgggctctttaaattactaaatacacacatttgttcaatgttgtc

SEQ ID NO: 6769902 - DNA, 84 bp, Homo sapiens
ggtcatgcatgtttagagtctctgtcaacatctataattttgcaacgtatctgtgtttgtagttctggacatttgtagtttgcc

SEQ ID NO: 6769903 - DNA, 63 bp, Homo sapiens
cctggaaggcaggcatggattggctaagtttaggtcatattgtccaccccctgctttactagg

SEQ ID NO: 6769904 - DNA, 87 bp, Homo sapiens
caagaagttcagagattggcagtccaggattaatatagcagcttctcgatgttatcagtcaacaacatgccagctctgccttgcttg

SEQ ID NO: 6769905 - DNA, 85 bp, Homo sapiens
tcctcacaatttgttttatcagtatttgaaaatcttaagaaaaaagctgagaatctgatagaagcaagtttttttagtgcaagga

SEQ ID NO: 6769906 - DNA, 56 bp, Homo sapiens
gcacatctagaacaattacaggtgggaaatttcttgccacctacttttggatttgc

SEQ ID NO: 6769907 - DNA, 87 bp, Homo sapiens
ggggtccatttcatttacatttcctgttgccatcaagaatggctctttaatgagttttccgcagcaggatgtagagacacagatgcc

SEQ ID NO: 6769908 - DNA, 74 bp, Homo sapiens
ttttgtgctacaatttctactgaacctgcatttggaggatcagcagcagattcagcaggaatggaagcagagaa

SEQ ID NO: 6769909 - DNA, 71 bp, Homo sapiens
cttcccaaagtgctgggattacaagcgtgagccatggcacctggccacattgtttcctatacttgtagaag

SEQ ID NO: 6769910 - DNA, 70 bp, Homo sapiens
tcggtgttcactgtgaactttgctttctcctcccaggtgagcaggagccagctgtaagcagtgattctga

SEQ ID NO: 6769911 - DNA, 96 bp, Homo sapiens
ggagggcctcaggttctggagaagggccaggtatttccatgtcaaccctgctttttataaccagagagaacatatgaggtagcaccaatgacctcc

SEQ ID NO: 6769912 - DNA, 61 bp, Homo sapiens
ggttgggtctctctgtctctccctgggtcgagagctgagaggaaagaatatagatgcaatc

SEQ ID NO: 6769913 - DNA, 67 bp, Homo sapiens
ctgtgaagtgaatgctcctagtcaccctcacgctggagggatcccagtgggagctgttcctttgcag

SEQ ID NO: 6769914 - DNA, 56 bp, Homo sapiens
gttcagaagtcagggtaaatgacatcatgggtatttttgttgccctgatttttaac

SEQ ID NO: 6769915 - DNA, 125 bp, Homo sapiens
ccctgtcccaaatattctaatttaatggctgtacggtggggctaggacctcaggatgattcactccaccgaggtatccggtcgtcctgaagtatagccaaggttgagaagcaccgatagacacgg

SEQ ID NO: 6769916 - DNA, 63 bp, Homo sapiens
gtctccacccaaatctcaccttgaattgcaatccccataatctccaggtgtcaagggtgggac

SEQ ID NO: 6769917 - DNA, 74 bp, Homo sapiens
tggatgtccaaagtgcctgactcatagttagcactccataaaggttaactattattagcatctttgacattcca

SEQ ID NO: 6769918 - DNA, 77 bp, Homo sapiens
gtgaacttggacttggtgaccatagagtagagtttccttcttgtccaaggaatagctttggtcaccatctggagcac

SEQ ID NO: 6769919 - DNA, 61 bp, Homo sapiens
cctgagcatgctttctgacctgtgtttagaaaaaatggacactaaatggaagtgtctgagg

SEQ ID NO: 6769920 - DNA, 57 bp, Homo sapiens
ttttgagttttcttggttctgtggtttggacctccacagacctagaaaagttcagaa

SEQ ID NO: 6769921 - DNA, 79 bp, Homo sapiens
atatgatgcaagcagaggtttatgtattaggacatgttttatcttgctgcttttggaaaccctgtgatcaccatcatat

SEQ ID NO: 6769922 - DNA, 68 bp, Homo sapiens
ggccatgggcagttggcagggctcagaaaaagggcttcatgggctgtgacggatcagcagctctggcc

SEQ ID NO: 6769923 - DNA, 75 bp, Homo sapiens
acacataaatattagtgtgtaggctggaaaaaagcttgaagtatttttccttttcatgcacaagtctttatttgt

SEQ ID NO: 6769924 - DNA, 84 bp, Homo sapiens
attactttgcagaaataaagatattatcaggcaagaaaagctacattatgctgcagtgacaaaatcttattgacttaaagtaat

SEQ ID NO: 6769925 - DNA, 86 bp, Homo sapiens
ggcttcttggtaagggcatatctaaagtatttggggtattagggaaaacttccttggtaactgatgttcccttactgtagggagct

SEQ ID NO: 6769926 - DNA, 76 bp, Homo sapiens
gggcctgaccttctcagtttcactgataacagagtaactaacacttgctgtgatttatgagatagagaaaaggtcc

SEQ ID NO: 6769927 - DNA, 79 bp, Homo sapiens
gtccagaacctcaagagctggcagagagcagaagcctcgtggcaaagtgttcagcctgttcatgctgttgcagggggac

SEQ ID NO: 6769928 - DNA, 60 bp, Homo sapiens
tcattagaaccgtcaatagtaaatgaaagcagtgagatgcctcatttacggttttgatga

SEQ ID NO: 6769929 - DNA, 98 bp, Homo sapiens
gtaagcatttattgttgtaatagcagtaattgtcatcgtagtaaacattttttgaatgcttactatgtgatagacactatactaaatattttgctggc

SEQ ID NO: 6769930 - DNA, 62 bp, Homo sapiens
tatcagcagcagtggctgcagaacagcagatattggtgtaccgcaaatgctgctgcctgata

SEQ ID NO: 6769931 - DNA, 58 bp, Homo sapiens
gaaacccttcctagagggcaagtggaatttcaacactgaattattttaggagggtttc

SEQ ID NO: 6769932 - DNA, 64 bp, Homo sapiens
gctagtaacttttgttataaatcatcatagtctaaaagactcctgagttacaaggcttgctagt

SEQ ID NO: 6769933 - DNA, 84 bp, Homo sapiens
acctctctgtgcttcagtttcccatctggaaaatgggtaatgtaatgctcacctgggagggctgtggtaggtttacagggaggt

SEQ ID NO: 6769934 - DNA, 66 bp, Homo sapiens
aggcccagcccttcccaactggccaggacctgacccaggagctggtctgcgggaaggcgtgggctt

SEQ ID NO: 6769935 - DNA, 108 bp, Homo sapiens
taatctggtcctaggtgtaagtttttgacagtcacggttctctaaaacaggaattgctaagtaataaaactcttacattaagagctgtgaacttacaggaaattattg

SEQ ID NO: 6769936 - DNA, 60 bp, Homo sapiens
gctgagcagggtggggaaaggcgagaggcaatctggttccttaaatgcccaactgttcgc

SEQ ID NO: 6769937 - DNA, 95 bp, Homo sapiens
ggtggaatttcttcttccttgtagggctggggagtgaataagggactccttgtcttgtctcttaaaggtcttcagctgactggatgaggcccacc

SEQ ID NO: 6769938 - DNA, 74 bp, Homo sapiens
aaactgtttttgcattatgtttaattgttggtctttcatgataagactaacagagatagaaatgtaaagagttt

SEQ ID NO: 6769939 - DNA, 67 bp, Homo sapiens
gtgcccttgaggacagctcccagggaagccagttccccactgccagctttgtcctccccaggggtac

SEQ ID NO: 6769940 - DNA, 55 bp, Homo sapiens
ttctgtcttctctaacttcccctttggggcaggagtcacacagagaagataagaa

SEQ ID NO: 6769941 - DNA, 71 bp, Homo sapiens
actctggaaagagttttggtatatttgaatgcaattgctccagatgttctacataactctttaatcacagt

SEQ ID NO: 6769942 - DNA, 59 bp, Homo sapiens
gctctggtgccctgtgtggcaggagctctttttcaacaattccaccagggcaccactgt

SEQ ID NO: 6769943 - DNA, 129 bp, Homo sapiens
gcttgggaagactatgtgagggagagtgctggggtatgagcagagaagagtctggcctctcttttggctgatctgccccaactagagaaccatgctcttttccatttccaatcctttccttccccgtcc

SEQ ID NO: 6769944 - DNA, 71 bp, Homo sapiens
gtctttttatttaatataaaacagcaacagcaacaagaaattacgatgctgtatgatgttaagtggaaagc

SEQ ID NO: 6769945 - DNA, 60 bp, Homo sapiens
attcttgtttaatttgcatcccctatccccaaatttaggacagtgtggtcaggcaagaat

SEQ ID NO: 6769946 - DNA, 88 bp, Homo sapiens
tcattgtcatccaatgtcctattaagacttggggttttgagggccttgagaatataattgataggttttgatgttggagtgagaatga

SEQ ID NO: 6769947 - DNA, 63 bp, Homo sapiens
gttgctaatgattcctgatctcctgtcaccggacaccttgtggcatgacagtgaatgggcagc

SEQ ID NO: 6769948 - DNA, 130 bp, Homo sapiens
tcaaatccactggggcaagcctgcatactcagtctctatcttggtgattcacaagtggttaaggctttgagaaacctggcagtagagacctgtggccttgtgcactctggcattctctacatctgtttga

SEQ ID NO: 6769949 - DNA, 82 bp, Homo sapiens
taaaaaacgcaatttctgggatttcattccagatctactcaatgagactctgcaggtgggcccctagaatctgcatttttta

SEQ ID NO: 6769950 - DNA, 84 bp, Homo sapiens
tcacgggctagtaaattccttgagacgcaggtttcttctactgaggctaataacaaaacctcttttaaggagttgttgtttgga

SEQ ID NO: 6769951 - DNA, 58 bp, Homo sapiens
gagggagcttgatggatgtttgtgaaataatacaggggctctgctgcaagtcttcctc

SEQ ID NO: 6769952 - DNA, 55 bp, Homo sapiens
cggggaatgctggaggctggtcccggttatccgaggccttcccctgcagtctccg

SEQ ID NO: 6769953 - DNA, 59 bp, Homo sapiens
cagtgtctcccccaggttctgtgagttaagacaacaaagcagccggctgggtggtgctg

SEQ ID NO: 6769954 - DNA, 55 bp, Homo sapiens
atgagctgatttgtgcttatcccttgataagcacaggcaatagatacagctacat

SEQ ID NO: 6769955 - DNA, 65 bp, Homo sapiens
gtccctgtgcccagagaggcggttttatttacagttctttctcatctctttgactaggtggggat

SEQ ID NO: 6769956 - DNA, 84 bp, Homo sapiens
cagcgaggggcataggcggggaaggtgcgaagcgaggcggccgcgggtccctggcatccctctccttacgcccaggctaagctg

SEQ ID NO: 6769957 - DNA, 89 bp, Homo sapiens
ggtaaactgtgatttgattcttcttggagtaagaaccaaacagaaatcttgttgctcccgaggagaaatgaagctaatggaaacagtcc

SEQ ID NO: 6769958 - DNA, 57 bp, Homo sapiens
aagggtgggcaccgccaggtcatccatgccagggatgcacctgtggccccaatcctt

SEQ ID NO: 6769959 - DNA, 67 bp, Homo sapiens
ctgcaagccaaggagagaggtcttgggagaaaccaaacctgccaacaccttgatcttggacttccag

SEQ ID NO: 6769960 - DNA, 85 bp, Homo sapiens
ggacagacatatccatcggttcctacattcaaacggtgtcatttgaatgtaggaaccaatggaaccagtgtccccaagagtgtct

SEQ ID NO: 6769961 - DNA, 64 bp, Homo sapiens
atgggaacctttctccaggttgtaggactgatagaagcctggatttggaggaagagttgatcat

SEQ ID NO: 6769962 - DNA, 123 bp, Homo sapiens
accacagtgcagggctgccagcactctctcctgatgactttatcttggctcctggaaggatgggggtgacaacagtgtgtcggcaggagaggagagcctaaagcagggactctggaccctggt

SEQ ID NO: 6769963 - DNA, 63 bp, Homo sapiens
catagatgggaggaacctgggtccctgacttaaagtatcatggatttggatgttcccttagtg

SEQ ID NO: 6769964 - DNA, 90 bp, Homo sapiens
cttctagggcaccaatccttctctcggctctgtgtcagtgtttgtcgactgtgtgcctgtgcagaaactgggaaggaaggagctgggaag

SEQ ID NO: 6769965 - DNA, 115 bp, Homo sapiens
tgaaataatttcttatgttaaatagcttctaacatttatggccactggactgattcttagcacattaattcttcctgtcatgaggtttggggatacatcagaacaatttatttca

SEQ ID NO: 6769966 - DNA, 59 bp, Homo sapiens
caccctgactggccctgcaggagagggtggctctttcccctggagacaaagacagggtg

SEQ ID NO: 6769967 - DNA, 65 bp, Homo sapiens
tttcacagctgatacctcttcccacaaaaaggaaaaaaagggggaagatgatattaattgtgaaa

SEQ ID NO: 6769968 - DNA, 62 bp, Homo sapiens
tgctgggtgcttactttgtgctagacactgtaaagtgctaaagataaggaaagtatccttca

SEQ ID NO: 6769969 - DNA, 65 bp, Homo sapiens
gggctcatgctttgggtcagaaatgccagggggccaccactgtgtgtttgcccacagcagacccc

SEQ ID NO: 6769970 - DNA, 58 bp, Homo sapiens
agacttcacctctgaggagggggctgctgctttagttcagggcctcagaggtgaagct

SEQ ID NO: 6769971 - DNA, 79 bp, Homo sapiens
gcccatccttggagagtttgcctttaccttgggggattaggatggggaccagtgtattagcaagctctccaggtgaggt

SEQ ID NO: 6769972 - DNA, 77 bp, Homo sapiens
gaggtgaggggcaaggacacgactggtatctagtggatagaggctagagatctgtcctacaatgcacaggtcacctc

SEQ ID NO: 6769973 - DNA, 97 bp, Homo sapiens
tcttttaggattttctctaaatgtccctaaatgtcactcagttttggttgattgacagtggtgttctggggaacgtttaactgaatatctggaaaga

SEQ ID NO: 6769974 - DNA, 83 bp, Homo sapiens
gagaagtattcacaatcataatgtatgtacatatatgcattccatgttttcaagtttgcacatattatgttggttggcttctc

SEQ ID NO: 6769975 - DNA, 67 bp, Homo sapiens
ttgactactaccaaggctctgaggtggtattagaaacctccaggaagctcttggtacctctaggcaa

SEQ ID NO: 6769976 - DNA, 61 bp, Homo sapiens
ccaagttttgatgatcattgatctaaattccaatgcatgggcagtcatcatcaagctttgg

SEQ ID NO: 6769977 - DNA, 88 bp, Homo sapiens
aaagcttaaataatctatataggatgataaaattagaaactggggaaccaagaagtttgatttttctcctagacctctggatagcttt

SEQ ID NO: 6769978 - DNA, 55 bp, Homo sapiens
tggcatttattactattgccgtggggtttccatgggccagttctgttgaaagcca

SEQ ID NO: 6769979 - DNA, 71 bp, Homo sapiens
aagtgaggaaattgtctttttccttgtcagattctaaaccctggcatggagtctgactgttttcttttctt

SEQ ID NO: 6769980 - DNA, 70 bp, Homo sapiens
gtttgatactccatagattctgcttcaaggaaatcctgttccctgaagaagttgttatggtctattggac

SEQ ID NO: 6769981 - DNA, 59 bp, Homo sapiens
aagtagcaatctcattagttggaatacaaagtccaggatttctaaggagattgttattt

SEQ ID NO: 6769982 - DNA, 67 bp, Homo sapiens
agaatatggaaacaataattggaattgtcttttcaaaggcctttcaacttgtttgcttccatagtct

SEQ ID NO: 6769983 - DNA, 59 bp, Homo sapiens
tttgggtgctaagggtgtgggctccaagaaataatcacacatcttccagagtagctaaa

SEQ ID NO: 6769984 - DNA, 55 bp, Homo sapiens
gagggccaggcagcaagaaggcctcccagagaggacaatctttggcctggctctt

SEQ ID NO: 6769985 - DNA, 69 bp, Homo sapiens
ggtgccgttgaggaagtaactgccttatctttccatgacctgcaattgccatgctcctgagatggcgct

SEQ ID NO: 6769986 - DNA, 64 bp, Homo sapiens
tggcagaaagtgctttctctccagcataaacaatgtactctcaagagaagaggactttctcaca

SEQ ID NO: 6769987 - DNA, 73 bp, Homo sapiens
ttgttgttattccaagataggatagcatcactatttgatatgtttgtgctgttaagacttggacccacagtaa

SEQ ID NO: 6769988 - DNA, 120 bp, Homo sapiens
gttgtggttattgttattatagttgatatatttatggttgattttccacaaatatttagatattctggttatctgttcttagctatagatgtgaatcctagcctgaatgaaaatcactgc

SEQ ID NO: 6769989 - DNA, 88 bp, Homo sapiens
agatcaatgactattttatttgctcaaccctgcctccagtccatggctgtggcctccatcatgaagtagctggaatgattaatgatct

SEQ ID NO: 6769990 - DNA, 86 bp, Homo sapiens
gaagatacaaaaaacataacacacataaagcactggcgcaatgcctgactcagtgagtgtttcctgagtgttatcattgtgtcttc

SEQ ID NO: 6769991 - DNA, 93 bp, Homo sapiens
gctgaccaggaggccaagatgagctggctccatggatgacccggtggggaagcctgtggagactcgttcacttgaatgccacctagtgccagc

SEQ ID NO: 6769992 - DNA, 80 bp, Homo sapiens
gaagtaaagcacaaacactgagtatcagagttgggaatcacctcaggtatcccagcctgtacccagtgcaaaatgccttc

SEQ ID NO: 6769993 - DNA, 57 bp, Homo sapiens
gatgtctgccaaagaatcaagcttcatgctgtgcttgattcagacctgtcagacttc

SEQ ID NO: 6769994 - DNA, 55 bp, Homo sapiens
ttgcttctggatcttaatgtttgcatgaacaaaacattaagaaacgagagagcaa

SEQ ID NO: 6769995 - DNA, 64 bp, Homo sapiens
tacacttataactctgtgtgtgtgtgagagtgtgtgtgcgcacacgcgtgggggtgtgtgtgtg

SEQ ID NO: 6769996 - DNA, 87 bp, Homo sapiens
ttcttggagaaacacctcttacatatagcatgagtacatactattgtgttcaggttaatatgctcagcaatgtgtaagtttcaagaa

SEQ ID NO: 6769997 - DNA, 74 bp, Homo sapiens
tcccaatgagatgaaccaggtacctcagttggaaatgcagaaatcacccacttcctgtgttggtcttgctggga

SEQ ID NO: 6769998 - DNA, 82 bp, Homo sapiens
cccttctggaccccagagcctcattctgttgggacccaggagctattggctcaagagaggcaggattgtggggctggatggg

SEQ ID NO: 6769999 - DNA, 72 bp, Homo sapiens
tgtcccaaaactacatttcctgacccctgtgtcaccttggtgccagggaaacagcccagtgtgatgaggaca

SEQ ID NO: 6770000 - DNA, 85 bp, Homo sapiens
ttggcacttgtgaagcaccatgcatctttttacatttaaaatagaatgtaactgaaggaaatgcatgtttgagtttataagccaa

SEQ ID NO: 6770001 - DNA, 68 bp, Homo sapiens
gcaatgagtaagataggcaatgtgttagtctactcatataacatcatgccataactaacttaacatgc

SEQ ID NO: 6770002 - DNA, 96 bp, Homo sapiens
gaaaggtgtggttgggccagatgtgcctgctcagaaagccaccagagcgctttccaagtctttggggcatctgggagattgtgcccggcccctttc

SEQ ID NO: 6770003 - DNA, 64 bp, Homo sapiens
acttgtgtaacttgagcaaacacaagagaaataagaggtttctgtgtgttcagatacagcaagt

SEQ ID NO: 6770004 - DNA, 84 bp, Homo sapiens
cccacgggtgctggcaagtgggggtgccagcttctggggtatttgacctcagcagacacgcttctcacagtgcccacctgtggg

SEQ ID NO: 6770005 - DNA, 92 bp, Homo sapiens
gtagttgtctacactttgttttcctaggttagctttttgggccctcattagcagaagatggcagccaggagggtgtagttttccacaattac

SEQ ID NO: 6770006 - DNA, 129 bp, Homo sapiens
aatggggcaaggtgagaatgaaccctgtgggattggatttgatttgtagatagtgtagatacattaatatattatattgtgttatatatcacatcttatcctatcttatcttattctggcatgttgatt

SEQ ID NO: 6770007 - DNA, 67 bp, Homo sapiens
ataaagtctcatgggtaaatgtctagaaaacaatccttattgcagcaatgtttacccaggattttgt

SEQ ID NO: 6770008 - DNA, 69 bp, Homo sapiens
tgaaatagtcctctgttccttgattatgagctgatagcaatcatatgaagttcaacagagatgaagtca

SEQ ID NO: 6770009 - DNA, 70 bp, Homo sapiens
caggggcctgccagggctctccgtggtgatgggtgtggcctgcaaggagggccactgggaaggattactg

SEQ ID NO: 6770010 - DNA, 59 bp, Homo sapiens
gagagaatgtacatgctaggggaattgcttttcttccctgcttttgcaacacttctctc

SEQ ID NO: 6770011 - DNA, 57 bp, Homo sapiens
cctttataagcagtttgctcacattgattctgatgtggacagttctggatgtaaagg

SEQ ID NO: 6770012 - DNA, 72 bp, Homo sapiens
tgtgcctagtgatacagttaattaacattaaggggtaggccccttgtattagtttgctgtcgctatataaca

SEQ ID NO: 6770013 - DNA, 81 bp, Homo sapiens
tgcagaaaaaaccagacaggtgctcgcccaagtccagcaaaactctgtgtgaccttgggcaagttccttctcttttctgta

SEQ ID NO: 6770014 - DNA, 86 bp, Homo sapiens
tcacgtgtcagcaagggagctaattccatacactcagacaggctgggtctgactgtcttgctatgagctcccatcacggcgtgtga

SEQ ID NO: 6770015 - DNA, 68 bp, Homo sapiens
tctgcttactcttttgatgagctcaggggctgagaattatgcacccagctggtaaaggggaaagcaga

SEQ ID NO: 6770016 - DNA, 65 bp, Homo sapiens
ggaaagagcaaatgagatgtgaattacagggtgacgaggcttgtatgaatctcatttgtttaacc

SEQ ID NO: 6770017 - DNA, 86 bp, Homo sapiens
tccagattatgattggccttgtacatcatattaagagatttaatcttgtagatgatcaagagctagaggagaattataagtaggga

SEQ ID NO: 6770018 - DNA, 67 bp, Homo sapiens
atcattctggagtccagatccatttggctgcaaaggtttgggtaatggatgatggacctgaactgat

SEQ ID NO: 6770019 - DNA, 93 bp, Homo sapiens
gggcctcgtgtacaagactgcgcatgaccgccatcctgacgggactctcaccatgagtcaggaaatggcttcatggtttctggtctggggctc

SEQ ID NO: 6770020 - DNA, 59 bp, Homo sapiens
gtttcaatttgaatgcgaggctatcacataagtgagctccaaagtacataagttgaaat

SEQ ID NO: 6770021 - DNA, 102 bp, Homo sapiens
atagacccagcaggacagaaaactaggtttaactttcacagaaactgatgaaataaaatggtttctttcaagttaaaactgtttctttcaagttgaaactgt

SEQ ID NO: 6770022 - DNA, 56 bp, Homo sapiens
ccttggcctcagattattgcacagttggacaatgactgtggttctgtggctcaagg

SEQ ID NO: 6770023 - DNA, 69 bp, Homo sapiens
gtattcactgttgacctggaagtgggtcgggtcaatacttcccatggtgactatggtcaacagcggtac

SEQ ID NO: 6770024 - DNA, 94 bp, Homo sapiens
cggtgtagggttttgtgtggacacaagctccggggctgcagctgtcttgcccgatggggcctgtagcttctgctttccatgcaagcttacatcg

SEQ ID NO: 6770025 - DNA, 88 bp, Homo sapiens
ccgatagaccctcttccttacctggcactatggggagaaaaacttccaatcttgtcatttggtgccaggaaagattcatggtctctgg

SEQ ID NO: 6770026 - DNA, 55 bp, Homo sapiens
acctccggggcctgatgaatttccaaattcagaacatttgggactttgggaaggt

SEQ ID NO: 6770027 - DNA, 99 bp, Homo sapiens
ttgagtgtctactgtgccagttagtgtgatggaggtacgatggtaagcatgcagaatcattcctcgccctcacagtgcactaatcaagtgatcatttaa

SEQ ID NO: 6770028 - DNA, 55 bp, Homo sapiens
ggtgtcctactgcttggttgctcagtgtgggttggggacttggcaagggaacacc

SEQ ID NO: 6770029 - DNA, 70 bp, Homo sapiens
cacccaacactagcgcaaatacgcccatgagctgctctatttatagtgtgtaaagtgcagtgattggatg

SEQ ID NO: 6770030 - DNA, 93 bp, Homo sapiens
gactgatttctgccttgcctcgtttctatgttttctcctttatttcagaaatacagagaaggggtagaggatggaggaaagggaaaatcagtt

SEQ ID NO: 6770031 - DNA, 98 bp, Homo sapiens
tggaagaccagttccaggaattcagctctcagtcacgacctggggcccgtctcagcctggagatgctgagatgctgtttcctggaaaacagggtccca

SEQ ID NO: 6770032 - DNA, 88 bp, Homo sapiens
tttactgatttcgttaacaagaggtaaagctctcatttaatatcaggcccacctgggaagagagaatttgctgacattaatgtgtgaa

SEQ ID NO: 6770033 - DNA, 68 bp, Homo sapiens
caaattgatctgtctttatgaacagggcacagtaaagcacccatgctgaaataaagatggtcactttg

SEQ ID NO: 6770034 - DNA, 113 bp, Homo sapiens
gcagagttgggttaaggaatcattacacatgaagtatcctagttaccagaaaaaggtcactggactgaagcaggaaacttcttgttttggttctttaaggtattctactcagc

SEQ ID NO: 6770035 - DNA, 107 bp, Homo sapiens
aagtggctggtttaagcttcctctctgtagaatagccccagggtatgtggacttcttacacactggctcagagttcctagagatcaaagtggaagctgccagtcctt

SEQ ID NO: 6770036 - DNA, 73 bp, Homo sapiens
ctctaaaatccagtatgaggtagggcttgggcaaaaacaaacaaatcttaagactatttttaactgtttagag

SEQ ID NO: 6770037 - DNA, 63 bp, Homo sapiens
tttggaatctgagggcttagtttggagtgaaggaaatccaagactcagtgatgtgatttcgga

SEQ ID NO: 6770038 - DNA, 86 bp, Homo sapiens
ggcgcgccagcagcgcgggccaggcgcagaagcgcagcaccagcaggctgcgcgccagctcccaggttcgccagctgcagtacgcc

SEQ ID NO: 6770039 - DNA, 82 bp, Homo sapiens
gggaagccagtattctgtctttctaccacttgattgttatttttctattagtcctcagaaagacaaaatgcagtggcttttc

SEQ ID NO: 6770040 - DNA, 83 bp, Homo sapiens
tgatccaagggcaggagtttgccaaagtaatgcactcgagtatttgtcctactgcccagcaaacatccactgcccttgtatcg

SEQ ID NO: 6770041 - DNA, 79 bp, Homo sapiens
cccaaaagaaccctatctttctgaggttttgacaggtataggaagggcctctaaccacagaagaagaatggggcttggg

SEQ ID NO: 6770042 - DNA, 56 bp, Homo sapiens
gctcagggaatgagaagatgttgatttcacttattttcttctttgatcttctgggc

SEQ ID NO: 6770043 - DNA, 66 bp, Homo sapiens
gggacgacaaatgtggtgactgagagtgacagcatcctcccagattctcagcacctgtccagtccc

SEQ ID NO: 6770044 - DNA, 82 bp, Homo sapiens
attttaccaagtcacttatgtgcagatatcctcaaatacaaaggccttgggattaagtatatttgcaagtgattggtaaaat

SEQ ID NO: 6770045 - DNA, 69 bp, Homo sapiens
gggggtgagcctgccaggcccagagctgcaaacacccctccctccctaagggctcccaggctcacctcc

SEQ ID NO: 6770046 - DNA, 60 bp, Homo sapiens
accactgctgctgcctcccttgctgggctctgccagtgttagtggctgcagctggtgtgt

SEQ ID NO: 6770047 - DNA, 78 bp, Homo sapiens
tctctactaaaaaatacaaaaattagccaggcatggtgatgggcgcctgtcccaggctgtttttatgttatgtgggga

SEQ ID NO: 6770048 - DNA, 108 bp, Homo sapiens
ggaggccaccagatgtccccacctccagggtcaggccagcaaaggggcccaccttcatttgaccaccccgactgctggtcctggagctgggttcctggaggggcttcc

SEQ ID NO: 6770049 - DNA, 77 bp, Homo sapiens
ttttcagcaggacttcccagggaacatctgacattagcagagaggaaatgctgattggcctgggagtcagctgaagg

SEQ ID NO: 6770050 - DNA, 59 bp, Homo sapiens
agccagcatcttgcttcttgagaaaagtgttttttaaaaaggtaatggtgttccaggct

SEQ ID NO: 6770051 - DNA, 82 bp, Homo sapiens
tcatgaaggcagctcctattagacactgaatgctaagataaacaaccagtcttgtctagttggaaccaagcagacctcgtga

SEQ ID NO: 6770052 - DNA, 81 bp, Homo sapiens
tttgggggtatttctttggggagatcagaaagtgggtttagattaccatgattactttctgccttacaggagtcccttgaa

SEQ ID NO: 6770053 - DNA, 82 bp, Homo sapiens
acataacccagcggaagagctggagctgctacaggaaaagttttgtaatcttgaaatatgttcagcttttttgtaggtatgt

SEQ ID NO: 6770054 - DNA, 58 bp, Homo sapiens
gtcttattttaagtcagtttgggttagggaaagctggccattgatgtgaaagtaagac

SEQ ID NO: 6770055 - DNA, 61 bp, Homo sapiens
acatgatcatacatacatggtcctcagtcacagagacaagagaggtccaatgttgagatgt

SEQ ID NO: 6770056 - DNA, 85 bp, Homo sapiens
gtcaggtcttgatttaattgttctcttatttctacccaagggacatgtttccctcagtgttaggataagagaaagtcaggttggc

SEQ ID NO: 6770057 - DNA, 79 bp, Homo sapiens
gacaaactaccaaggaactgcctcagcctggtaccagtcctccctcacccaccttctgtctaggttcacttggtttgtc

SEQ ID NO: 6770058 - DNA, 67 bp, Homo sapiens
ctgtcaatgttcttggtatatcctttctggtcttgccttgtagaagatagccaggtacattgaagag

SEQ ID NO: 6770059 - DNA, 78 bp, Homo sapiens
gctgtcttgagcctgtggtatcaccatccactagttcaactaaaattgaaggacaggggttgatacccagagaacagt

SEQ ID NO: 6770060 - DNA, 96 bp, Homo sapiens
gcggagaatagacatgggaacagagagtcaggggcaaatggagaaacctgtctatttctgccatatgcaaatactttcttcttgcatttctcaggc

SEQ ID NO: 6770061 - DNA, 81 bp, Homo sapiens
taaatttatatatgttttctgggaagaaaagctattttacaatattaagtctttctatctgagaagatatctatttgttta

SEQ ID NO: 6770062 - DNA, 117 bp, Homo sapiens
cagactgcgaaactgaatgctaaggtccacgtagaggactcaatgtaacacaagagcttacatttccttgactcctcaacaccagtggccttgccttcttatcctcccctgcagctg

SEQ ID NO: 6770063 - DNA, 62 bp, Homo sapiens
ctcagcccggtgctcgtgccacgccttccccacttctgcgggcacgcggggccgcgggcggg

SEQ ID NO: 6770064 - DNA, 74 bp, Homo sapiens
ttgctgtcagataggctggagtgcagtggcatgatctcggctcactgcaacttctgcctcctggtctcaagcaa

SEQ ID NO: 6770065 - DNA, 78 bp, Homo sapiens
gccttttccaaattactgatctacaaaatccatgagtataatcaaatggttgtataatgtcactaagctggagatggt

SEQ ID NO: 6770066 - DNA, 79 bp, Homo sapiens
tacctttctagtctattcattcaatttagctcttgactggcagagagagtgtgaagaaagtgcaatggcctaggaggta

SEQ ID NO: 6770067 - DNA, 56 bp, Homo sapiens
ccttgggaggctcccagggagaattctctttcctggcctcttccagcttctcaggg

SEQ ID NO: 6770068 - DNA, 77 bp, Homo sapiens
tctgagaacatcattcagatattttatagtggacttttcttaatttcttcccataatatcaaggtgatgttcccaga

SEQ ID NO: 6770069 - DNA, 55 bp, Homo sapiens
ttcatctctgggtccatagaagagaacagtgtttctgcatctccccagatgtgag

SEQ ID NO: 6770070 - DNA, 79 bp, Homo sapiens
tcccatctgtttaggtgagttgattccatttttcactttggaaatgtgagtggcatcaactttatctgtagcagaggga

SEQ ID NO: 6770071 - DNA, 99 bp, Homo sapiens
aggtggggagatgagtgaggtagctggtacatgtttaggtgtgagttttgtgtactacttaggcttggttcagctagatacagtttcccatattcacct

SEQ ID NO: 6770072 - DNA, 63 bp, Homo sapiens
ccatctggatctgtccactgacgtgaatcttttccatggaattccttagttggcagaggatgg

SEQ ID NO: 6770073 - DNA, 70 bp, Homo sapiens
ctaagttactaacatttggaaggcttatgaaagtgaagcatagttatgagccagcaatgtttttatttag

SEQ ID NO: 6770074 - DNA, 63 bp, Homo sapiens
ggatatgttgaatttgggggtttgcagagccttctgtcctgcagcctttagaagttcagatcc

SEQ ID NO: 6770075 - DNA, 81 bp, Homo sapiens
aggaggctagtgtcggatcccacacccaccgagggtgctaatgtcctgggaagggtggcactggggtctagctggccacct

SEQ ID NO: 6770076 - DNA, 70 bp, Homo sapiens
cttggcgaagccgtctgcaggacacgtgcccctttcatcacaaggccacgtctccttccagagcgccgag

SEQ ID NO: 6770077 - DNA, 69 bp, Homo sapiens
gagctctgtgcatggcagaggatagcatatgaacctctggtgaccagagggtcttgcaggtacggactt

SEQ ID NO: 6770078 - DNA, 56 bp, Homo sapiens
gtcaagcgccctccaggtgagaaggcaccccggccagaaccttgatggcagcttgc

SEQ ID NO: 6770079 - DNA, 85 bp, Homo sapiens
ttgtagccagggacccctgactcattaggactcaagacacctacctggtttcatagccttctaatgagttgtcgccgggttgcaa

SEQ ID NO: 6770080 - DNA, 61 bp, Homo sapiens
gttcacagaaggccagatggtaggaagtctacacttattcctccttttgtcttttgtgaac

SEQ ID NO: 6770081 - DNA, 56 bp, Homo sapiens
agtctttattgtcgtcactagaagggccacagggccacagtcatgacgatatggct

SEQ ID NO: 6770082 - DNA, 59 bp, Homo sapiens
tggagtgaagggttggcacggtacctgcccttggcagtcctcgtgttcccctcgctcca

SEQ ID NO: 6770083 - DNA, 74 bp, Homo sapiens
tgactgtccctagcttcaagaaagatgggcaaaccacatattttattttccagcctctgtgctgggaggcagca

SEQ ID NO: 6770084 - DNA, 73 bp, Homo sapiens
caatgtgtatcaccaaaggttttcatcacagcaagaagtacttctgaagctggaggaagctttgggcacattg

SEQ ID NO: 6770085 - DNA, 73 bp, Homo sapiens
gtgtatgaaagggttattcatctcgagggctgagcatgaaggtcctcagtcctcagtgagtgatcctgtgcac

SEQ ID NO: 6770086 - DNA, 70 bp, Homo sapiens
aagtctttgctattgtgagtagtgccgcaaaaaacatatgtgtgcacgtgtctttatagcagcatgattt

SEQ ID NO: 6770087 - DNA, 65 bp, Homo sapiens
tcatgggattgctgtgtaatctaaatgagataaatgtgtaatatctcacacatggtaagctatga

SEQ ID NO: 6770088 - DNA, 88 bp, Homo sapiens
acagcagtcaagggaaaatagttgatgaccaactgaagcaatcagagctcaccatcttggtcttcagctgttttccctggactgaggt

SEQ ID NO: 6770089 - DNA, 121 bp, Homo sapiens
atggtcccactctactctgcaattggtcagcttatatttttagtgtaatagtctgttctgggtatcacattttatgtagaatataggtacaccaagaagtattcagaggagggaggaccat

SEQ ID NO: 6770090 - DNA, 72 bp, Homo sapiens
caaacaaatttagctctgagtgctggggtctcttttctaattactcagcttttagtacgttaaaattggatg

SEQ ID NO: 6770091 - DNA, 61 bp, Homo sapiens
ggcactttggaaaaatacctggcatatatagtaagcagtatgttggccattaccaaaggcc

SEQ ID NO: 6770092 - DNA, 80 bp, Homo sapiens
tggtatatgttaagcaaaggaaagctgacttttcctgatagggatgagtcagtttccttctgcatcaagatgtttataca

SEQ ID NO: 6770093 - DNA, 111 bp, Homo sapiens
ctcctactgtattggagaggggttctcatctttagtaggttctggagattcagctgaagtctcctgttgaactggtaaaggtccagtctcttccgatgactctgtaggcag

SEQ ID NO: 6770094 - DNA, 66 bp, Homo sapiens
tatccccaaatttccttggaagggtaattgcaaaggatacttggctcctatcaaggagtgggtttg

SEQ ID NO: 6770095 - DNA, 71 bp, Homo sapiens
gcctatcaagtggcagcaaatgcctggactaaatccctctgtggaatggagcaggactgctgccctcaggt

SEQ ID NO: 6770096 - DNA, 78 bp, Homo sapiens
ggcttcttaatacttaactgtacaactggttagtcatattatctgacattccgcagtaaggttaaatcaaggtcagcc

SEQ ID NO: 6770097 - DNA, 59 bp, Homo sapiens
gctcagctcacctgtggaatgccctcatctactgtgtggctcctgggatgggactgagc

SEQ ID NO: 6770098 - DNA, 77 bp, Homo sapiens
aaggggattcatatgcatgagagctagtagcaaatattaataagaaggtaagtgttgctctctctcagctcactctt

SEQ ID NO: 6770099 - DNA, 107 bp, Homo sapiens
aaccccactctgcccaagccaccactgcagtggtccagggagcggcccacaccctgggccttccacctaggcctctgctttgtggggcacagggtcagggtgtggtt

SEQ ID NO: 6770100 - DNA, 66 bp, Homo sapiens
ctgctgccttccaaaggccaggaactgctgaaattaaaccaaggcaggggccaggggagcagacag

SEQ ID NO: 6770101 - DNA, 84 bp, Homo sapiens
tgaggttaggtagtcctgccctggtatcatgtggaatttgttatagtgacttccattgatatcaggctgtacaacccagtttca

SEQ ID NO: 6770102 - DNA, 85 bp, Homo sapiens
agtgaattaggcagaaagattttcaacaggaggtgaaaaagtttctacctcttgtttgaaaatgtttctaaaatctaagttcatt

SEQ ID NO: 6770103 - DNA, 64 bp, Homo sapiens
taattcagttactctagacacttcatgtaagtggaatcatgcagtcttttctgtgactggctta

SEQ ID NO: 6770104 - DNA, 77 bp, Homo sapiens
tcagctcgcatccaggataccctgagcatagtgttgcaatatgcagaggatatactatctggaaaggtgtcagctga

SEQ ID NO: 6770105 - DNA, 86 bp, Homo sapiens
caagccaaccttttgtcagcttccctttggtttattaatactacttttattgttgaactaaaacagaggctttttatgggtgtttg

SEQ ID NO: 6770106 - DNA, 73 bp, Homo sapiens
cgtgtcccaggccctctgcaccctcgtcttggggcaggccctgggcgctggggtcagagtggagcaggtcatg

SEQ ID NO: 6770107 - DNA, 73 bp, Homo sapiens
ggaggagaagggtatgtgtggcggagagtctgcacttcctctctaggccattctcggtgccctgctgacctcc

SEQ ID NO: 6770108 - DNA, 76 bp, Homo sapiens
gcctgtggcctgtcgggaggcgctcccttcttgtggaggaaggaaggtcaagaaggagctcccggcagaccagggt

SEQ ID NO: 6770109 - DNA, 63 bp, Homo sapiens
gcataaaggactataaggatcaaaaagcaagcagaaatgaatccacattctagtcctttatgc

SEQ ID NO: 6770110 - DNA, 79 bp, Homo sapiens
gacagagacataaagtgctgggtttaggaactaaaatatataatattttcattcagtcagcacatttatactatttgtt

SEQ ID NO: 6770111 - DNA, 57 bp, Homo sapiens
tatcagcaggccaaagctgcaaggtcacagacagattgtgttttgggcctgtggata

SEQ ID NO: 6770112 - DNA, 78 bp, Homo sapiens
ctatgtcatagaacacagatgggcgtggcgcttgctgtctgggcaaagccacgtctacatttggtttttataatatag

SEQ ID NO: 6770113 - DNA, 69 bp, Homo sapiens
tttctcaatccatctgtggtgtagaggtatggaaggaaaacttttgcaaatcatcctggattagagaaa

SEQ ID NO: 6770114 - DNA, 76 bp, Homo sapiens
tagagctgaatgtttttcattggtgactcttcttacctagtgttgtctctgaaaaagattcagaatcctggctcta

SEQ ID NO: 6770115 - DNA, 122 bp, Homo sapiens
agacgcagtccttggcacatggtaagcactaaataaagggcagctattatcgtcatctcatgcaacaactgagatgggcgtggcagtccagctgtttgcttatgttgagaggaagaatgtct

SEQ ID NO: 6770116 - DNA, 66 bp, Homo sapiens
tcagtctcatcaactctattcctttgaatcccaaatactaaacagttcagataggtgatggattga

SEQ ID NO: 6770117 - DNA, 88 bp, Homo sapiens
ggagtctcgctctgtcacccaggctggattgcagtggcatgatctcagcacactgcaagctctgcctcccgggttcgagtgattctcc

SEQ ID NO: 6770118 - DNA, 61 bp, Homo sapiens
ggatacctcaggctctcagaccaacagcatgttcacatcttggtttcagatcctgaaatcc

SEQ ID NO: 6770119 - DNA, 69 bp, Homo sapiens
ccattcaaattccagaaactcagtatattagcaacattaagagcttaatagtatgaggtggaggggtgg

SEQ ID NO: 6770120 - DNA, 55 bp, Homo sapiens
gcgcagctctgcatgctactatcatgagtgtaggtggcaggagtggatgctgagc

SEQ ID NO: 6770121 - DNA, 60 bp, Homo sapiens
gatgttgtataggcaggccaaccacatactgtaatgttgccctctgtctgtacaagtatc

SEQ ID NO: 6770122 - DNA, 61 bp, Homo sapiens
atggcagggcccttggctcccatgccagcgcatgggactggacagtggagggccatgtggt

SEQ ID NO: 6770123 - DNA, 62 bp, Homo sapiens
tttctttatcctcctttgcacatggccaaactcaggctcagcaacacagaaggctaaaggaa

SEQ ID NO: 6770124 - DNA, 73 bp, Homo sapiens
gggtgcagcatagggcaggggaggaatctgaacaagatatgagtttagctcagttctagccccatcctgatcc

SEQ ID NO: 6770125 - DNA, 100 bp, Homo sapiens
cttatgacaaagtttaatcatcttgcttataactcagggcttagaggatataacaaatttcagagtgtttagtgatgaaagagaagatatactacataag

SEQ ID NO: 6770126 - DNA, 73 bp, Homo sapiens
aatcctaaatgtcccagtggttgtttacaagatgttttgtcagcagatgaaactactgagactatttagtgtt

SEQ ID NO: 6770127 - DNA, 57 bp, Homo sapiens
agttcagtgcttacaggtttctttggaaccttttcagaagaatctacagtctgaact

SEQ ID NO: 6770128 - DNA, 58 bp, Homo sapiens
ccccactctcggccagataggctcttctcggcctgattctgagaagtcaaggatgggg

SEQ ID NO: 6770129 - DNA, 58 bp, Homo sapiens
tggacccaggcaggtctgtcctgcaaagtcttggtgggacacctcaactctgggtcca

SEQ ID NO: 6770130 - DNA, 62 bp, Homo sapiens
gtgtgtgcactgatgataacaggatcttggatgataggctccatcaactcttgtgctcacac

SEQ ID NO: 6770131 - DNA, 59 bp, Homo sapiens
tcacttctctttagaaatagaagtgtaatgctacgacttcttttcttggcaggagtaga

SEQ ID NO: 6770132 - DNA, 57 bp, Homo sapiens
gcttttagttacttcttaaggctggattatagcctttccagtttgtgtaagaaaagc

SEQ ID NO: 6770133 - DNA, 109 bp, Homo sapiens
tgagacctctcagaatcttacgaggttggagagttgtttggaatgctgggttctggtcttgtctctgcttccaaccagctatggaatcttgtgtattctttcagtctta

SEQ ID NO: 6770134 - DNA, 76 bp, Homo sapiens
tgtgctctggtgtcaggctgtcctcggcctcatgggtggattggctgagggccctgaagcttggcatttaggtcca

SEQ ID NO: 6770135 - DNA, 59 bp, Homo sapiens
tttcatagtaacagtaactatggtaggtaacttatttatagtgttcctttactatgaaa

SEQ ID NO: 6770136 - DNA, 106 bp, Homo sapiens
aagcaaaggtattgggaggaagtgggatagaactgagctttgaagaccgtgctaaaatatttacagactccccaggttatctcaagttctctccaggaattagctt

SEQ ID NO: 6770137 - DNA, 57 bp, Homo sapiens
gctcccacaaccttcttgctccaagtggacagtccagcaaggcaggtttctgggagc

SEQ ID NO: 6770138 - DNA, 57 bp, Homo sapiens
tcatgcttgccagcagagctgtcccatcactttaaattatggctggcagagcagtga

SEQ ID NO: 6770139 - DNA, 55 bp, Homo sapiens
gggagcaaggtgagaaatgggaaaggaccagcttgaacacatttacctggctccc

SEQ ID NO: 6770140 - DNA, 61 bp, Homo sapiens
gctacaggatttgagaagttacagttctccagcccatgttggagacttgtcaaattatagt

SEQ ID NO: 6770141 - DNA, 67 bp, Homo sapiens
tgtccctgctatcctctgcggagcccagctgacagctcagggctgcgtgtggaggatgtaatggaca

SEQ ID NO: 6770142 - DNA, 57 bp, Homo sapiens
gtctggctccgaggagtggcaggcgggactccccaggcacagtcagggaggccaggc

SEQ ID NO: 6770143 - DNA, 68 bp, Homo sapiens
gtaaatcctttggaggacatgatgctttggaaaagaagggaaaaaggaggtatccccaaaggatttat

SEQ ID NO: 6770144 - DNA, 70 bp, Homo sapiens
cagagcaggtctcctgaggtggcccgtggagcctgtggacccggtggcatttcagagaaaatctgctttg

SEQ ID NO: 6770145 - DNA, 71 bp, Homo sapiens
ttagcacacatgcttcatgcaaaattctgagcaaaagaactgcagagcgacctggagcattttactgctga

SEQ ID NO: 6770146 - DNA, 66 bp, Homo sapiens
gactattaaacagcctcccctttcactctcaaaaatgtctgagtgtggatgataggttgtgtggtt

SEQ ID NO: 6770147 - DNA, 62 bp, Homo sapiens
gccatagggatagaaggggtagtgatggccacaggattgtctctcttagctatgcttatggc

SEQ ID NO: 6770148 - DNA, 62 bp, Homo sapiens
ggcatagaatgtaataaagagtagggattttgctttattcaactttatatgttctgtaggcc

SEQ ID NO: 6770149 - DNA, 66 bp, Homo sapiens
gactccaacctgcatcattaaggtacagttggctccagtggattagtgctgaaatgatgggaagtc

SEQ ID NO: 6770150 - DNA, 71 bp, Homo sapiens
tcccagacattgtgtctgtattagtttcctagggccgtcgtaacaaactatcacaaacagagtgtcttaga

SEQ ID NO: 6770151 - DNA, 55 bp, Homo sapiens
ttctgcagtgtgcagggcctgtttccctcctcaagcccagcccattcatgcagag

SEQ ID NO: 6770152 - DNA, 65 bp, Homo sapiens
ggtccctctgatgaactgttttaacagcatatttttatgttcctgaggcatgtgtcaatggttct

SEQ ID NO: 6770153 - DNA, 62 bp, Homo sapiens
aattctgcatcttcagctgagaacgaacaaaatcttgatcagaacagtgaggatgaagggtt

SEQ ID NO: 6770154 - DNA, 95 bp, Homo sapiens
gcgaggggtctgaattcgttgcaagtctctgctgagaagggctggcacatttctttcctgtgtcctctgttaggggatagcgatagactcctcgt

SEQ ID NO: 6770155 - DNA, 81 bp, Homo sapiens
tagtgtgcagccacaggactggctggacagtgggcagtggacaggggtccattgcaccctcctcgcccctggcagccacta

SEQ ID NO: 6770156 - DNA, 80 bp, Homo sapiens
tgcaaagattattttgactattaaaccaacagaatcttatcagagacccatgtggcaaatggtcaggaagaaagtctgca

SEQ ID NO: 6770157 - DNA, 114 bp, Homo sapiens
aaaagactagatagggggattaatgatgagacttttctgttatttagcatgatttacaactattgctggcaaccatactaagtagtttcacatataatgtcccctcagcctttt

SEQ ID NO: 6770158 - DNA, 108 bp, Homo sapiens
tttctaatcacctaaatcactttaagtctcatctttttgacatggtgatggtcaaagattggcacattattcttatcaaagcacaggatagggtgctaggtggaggaa

SEQ ID NO: 6770159 - DNA, 91 bp, Homo sapiens
ggaaacggaggggggatagtgaggatatggataacttggaacataagaaaatggctctagggtgttacatacctgctatctccctctgtcc

SEQ ID NO: 6770160 - DNA, 55 bp, Homo sapiens
ggctgtgggtgtgacaggcctctgattaataggactgtccaataagcccccagcc

SEQ ID NO: 6770161 - DNA, 60 bp, Homo sapiens
cctcagggaatgggaggctgggtatttatccaacaacttcctgcaccccattgcttgagg

SEQ ID NO: 6770162 - DNA, 82 bp, Homo sapiens
ctttagggggtatattttctggaactatgcctgatagcaattctgcagcaatctggatagtcaggagatatataccagaaag

SEQ ID NO: 6770163 - DNA, 57 bp, Homo sapiens
gtgttcattgctagtgaggtgtgtcactcttcccaggccctcagagctagtgaacat

SEQ ID NO: 6770164 - DNA, 63 bp, Homo sapiens
gcccaagtcaattagtaaacttggaaactggaatacagtttagcaggaagagttggctggagt

SEQ ID NO: 6770165 - DNA, 67 bp, Homo sapiens
cttgttaaaatgcagattccaatgccgtaggtctggctggggctagagagtctgcatttctagcaag

SEQ ID NO: 6770166 - DNA, 64 bp, Homo sapiens
gtgtatatatttattagaactactgcatgggtcactctaagcagtagtgataaaaatgtatcac

SEQ ID NO: 6770167 - DNA, 84 bp, Homo sapiens
tcctttcagcagtttaggttcttggaatcagtctcccagtgacagatgtgaggacattgagctgtcaagaacttaatgaaggga

SEQ ID NO: 6770168 - DNA, 116 bp, Homo sapiens
gctgacaggaagtggctttttatcctgcagcagatggctgaggacaaggcctctgtgaaagcccaggtgacgtccttgctcggggagctgcaggagagccagagtcgcttggaggc

SEQ ID NO: 6770169 - DNA, 78 bp, Homo sapiens
gggtggttccatcataggtgctcaattaaagtctgctgaatggactggaataaagtgctttgatcagaggaatcttcc

SEQ ID NO: 6770170 - DNA, 63 bp, Homo sapiens
cacttcaaataagctcttctcagcgtatactacccccctgaggagagtatgttctgtgaagtg

SEQ ID NO: 6770171 - DNA, 60 bp, Homo sapiens
gctcctctgaaaaagcaatgtttagaattgagacctgaacaatgagtcattcaggtgagc

SEQ ID NO: 6770172 - DNA, 66 bp, Homo sapiens
cttgagactctgtagtgggtgtttgagcaattaaaagtacccaagaacagagtgagctgtctcaag

SEQ ID NO: 6770173 - DNA, 81 bp, Homo sapiens
aatatcagaaagagctattattttttagactggacaaagttggctctttggaagtaatgaagaggtgggtctgactgtatt

SEQ ID NO: 6770174 - DNA, 64 bp, Homo sapiens
aagtatttgctaaataaactaatggaatgcatatatgtattcatgggttaatgttaggatactt

SEQ ID NO: 6770175 - DNA, 56 bp, Homo sapiens
tcctggcttccacacctgtcatttctcatttactgtgcgggcgggccgggccagga

SEQ ID NO: 6770176 - DNA, 81 bp, Homo sapiens
ctgtggggtagttactataatgagtccctgttttataaatgaagaaacgaggctcagagagggtgacttgccccatgtcag

SEQ ID NO: 6770177 - DNA, 93 bp, Homo sapiens
gtgtagttttaagccattaaatttgtggtaattcattacaacatcaataaagtagtagtacactaccatcaggttttacatatggcattacac

SEQ ID NO: 6770178 - DNA, 80 bp, Homo sapiens
gcttcctcatgtgcagcccctcacagagctgtcctgaggctcagagaagctgacaggggcgtgcatctggatgacaaggc

SEQ ID NO: 6770179 - DNA, 58 bp, Homo sapiens
acctgtggcaggtgatgtgtggatgtttgttagcgcaccatacacaatttgcaacggt

SEQ ID NO: 6770180 - DNA, 86 bp, Homo sapiens
gcctttctgtttatgtacctgaattagtaaagccagaatgcattcacctgcttacttgtttacacaggggagacattggcagaggc

SEQ ID NO: 6770181 - DNA, 61 bp, Homo sapiens
tgtgcctactggagcttgcagtgagccaagatcgtgccactgcaatccagcctgggcgaca

SEQ ID NO: 6770182 - DNA, 67 bp, Homo sapiens
agactgctaagcccaggtatagtctggggaatcagatgacctcaactcctggctgttaggcacatct

SEQ ID NO: 6770183 - DNA, 100 bp, Homo sapiens
tgaactgaataccagatgtgcagggaccaatcaccgacaggctttcagagaagtgacatgattggtcattggtcgtgatacacatctgttattcacatca

SEQ ID NO: 6770184 - DNA, 68 bp, Homo sapiens
tcttccttttctcatgagtctgtgagggtttgaaaaagacacactgctcatgaggagcattttgaaga

SEQ ID NO: 6770185 - DNA, 102 bp, Homo sapiens
cctacaaaagtttagaatgtattgattctttggagagctatatagattaacgactttctttatgctcatccaaggaaggtatttaatcataatgtaaatggg

SEQ ID NO: 6770186 - DNA, 66 bp, Homo sapiens
gttacacagctaagcttctcctgggtagaacaaactatttgcggaaatttggtttagttttgtaat

SEQ ID NO: 6770187 - DNA, 63 bp, Homo sapiens
aggaagtttgtgcaaatgtgggaaacaggactataatcctgcttgaagtttgcttagattcct

SEQ ID NO: 6770188 - DNA, 80 bp, Homo sapiens
tcagaaatcctggagtaggccttagccatctgtgttttaacaattcctccagatgatactgatgcctgcttgagttttga

SEQ ID NO: 6770189 - DNA, 92 bp, Homo sapiens
caggcaacaaggtttttagaaagcaaacggagtggctggactttgtaataaattaagagtctggttgattcctttgcactactcccggcttg

SEQ ID NO: 6770190 - DNA, 78 bp, Homo sapiens
gactctgaggaagatactgttcctctgtgtttcagatgaaggcattgaggctcagagaacagtgacttgcccaaggtc

SEQ ID NO: 6770191 - DNA, 87 bp, Homo sapiens
ctgtagttcagatttcaaaggctttgctatgatgcattggatttatcttgtgtaagcacagcttagaaattatcttggaacttgcgg

SEQ ID NO: 6770192 - DNA, 64 bp, Homo sapiens
tgaatttctcctataatttatataattaacaaagaagagattgtatggatttgtgggtgagtca

SEQ ID NO: 6770193 - DNA, 72 bp, Homo sapiens
caattcaggcttcacagcttggagcctatggaagccaggagggtcacaatgtgtgaattgggcctggtgttg

SEQ ID NO: 6770194 - DNA, 67 bp, Homo sapiens
ctcctggggtggggttactcattctgcctagggtgaggtggaaggatgaaatggccccacagaggag

SEQ ID NO: 6770195 - DNA, 81 bp, Homo sapiens
ggaggaatactatataggtgatattatttgaggcagcacctccgatacctctgaataatgtccttgtatcattgttccttt

SEQ ID NO: 6770196 - DNA, 60 bp, Homo sapiens
gcagatgattcctgtaggatgtctttaagcaatgatgcgcacctgctggaatcagtctgt

SEQ ID NO: 6770197 - DNA, 71 bp, Homo sapiens
gcgatggtaggggctgggcaggagttggagcatgaacatctgagacaatggcttagctcagcgctcagcgc

SEQ ID NO: 6770198 - DNA, 83 bp, Homo sapiens
gggcagatgcttccatctccacctgaaccctccctgatgcatattcatgaggctgtgtcttggggtggaagtgccttctgcct

SEQ ID NO: 6770199 - DNA, 63 bp, Homo sapiens
gctcgatttccgcttgatctgatctgtccatcacaaacacagattagagcctgggactcgggt

SEQ ID NO: 6770200 - DNA, 84 bp, Homo sapiens
taggaacacaagaaacccaggcagtcatctggtccagggctttcaagcttttctttggaacagaactgcgttcatttgtttgta

SEQ ID NO: 6770201 - DNA, 78 bp, Homo sapiens
gtacccaggaccttgccagataaacagtggagactacatgcatctgctgaaatctgcatgcaaagtcctataaggtat

SEQ ID NO: 6770202 - DNA, 87 bp, Homo sapiens
ctcaaagtttgtagcctctacaaagtcccattgccatggaagggaacattcacaggctccggggttgtgggcaggggcatctttgag

SEQ ID NO: 6770203 - DNA, 81 bp, Homo sapiens
ccccttcctcttcatccacatccaatgtgggaggcagttaccagctcagcacttatactttggatgtggatggaattgggg

SEQ ID NO: 6770204 - DNA, 88 bp, Homo sapiens
ggtgggcagagggcaaggagagggctctgtgtgggtactggggagactcggtgtccaagctctgtctccaggcctcagtttgtccatc

SEQ ID NO: 6770205 - DNA, 82 bp, Homo sapiens
caacttcatattcaacgttaatattttttgccttctctcagcttgacagagattcaggctgcagtggcaaaagacgtggttg

SEQ ID NO: 6770206 - DNA, 98 bp, Homo sapiens
aacagaaatgagagtaaaaattgaggtgcaaaatgtctgatttatggatgaaatttgttatgcccagtgattttttttgctactttaaatattctgtt

SEQ ID NO: 6770207 - DNA, 61 bp, Homo sapiens
ggggctttggtgatggatgagcagctacagggtagcatgctgcctgtgccaggagggtccc

SEQ ID NO: 6770208 - DNA, 61 bp, Homo sapiens
ggctgaaacagatttcaagacactgcaatgtcagtgacttgaaaagaatctgtttcttgcc

SEQ ID NO: 6770209 - DNA, 63 bp, Homo sapiens
cagattctcactgtattcaggttgtaaacacttgcctgacaacaactgaaagcaaggaatttg

SEQ ID NO: 6770210 - DNA, 84 bp, Homo sapiens
tgacaggaagctgtgaaggagacggagaaacctgaacactatatgccaacatttgggctagctgcttttacacatttcctctca

SEQ ID NO: 6770211 - DNA, 95 bp, Homo sapiens
gtaactctgcgtgatttaagagtacttaactccaaataggatcttaggacatacgagatctctcataagatgagtacttaaagacgttgaagtgc

SEQ ID NO: 6770212 - DNA, 76 bp, Homo sapiens
gatactgaagtttttcaatttatgttatttggtgtaaatctaggcagtctttaacaaaattggtgcttcatgtgtt

SEQ ID NO: 6770213 - DNA, 119 bp, Homo sapiens
attataatgatgatgatctataccatttattaagtgcgtactgtatgccaggtgctcttcttggcccttcatataacagcagcagtggcagttaatatttgtggaaattacattatagt

SEQ ID NO: 6770214 - DNA, 80 bp, Homo sapiens
ttgaaatcataagatgttttgaatgtgagcaaatattgggaaattttaaaactctatttatggcatctttatggctttga

SEQ ID NO: 6770215 - DNA, 64 bp, Homo sapiens
gccgggtgcagcgggcccgccagttccccgcggaagtccgcgccgccgcccgcgctgcccgcgc

SEQ ID NO: 6770216 - DNA, 64 bp, Homo sapiens
gggttcttggcataatgtttagattaagaaaacggtctaaacacaatgcaagaagtatctcccc

SEQ ID NO: 6770217 - DNA, 79 bp, Homo sapiens
actagatatagacagctgttccttcatgtttgaaagataaaaatcacaggaaatacaaggaaagttttctttattcagt

SEQ ID NO: 6770218 - DNA, 60 bp, Homo sapiens
tatcaattgggccaaatggtacaaaggatcatgtaactagaggagtggcccaggatggtg

SEQ ID NO: 6770219 - DNA, 90 bp, Homo sapiens
gcctttctcaaaagaccctcaaattatttctgctggaggagtgtcttccaggaaggactaatggtttgtggaatacactttgggaaatgc

SEQ ID NO: 6770220 - DNA, 64 bp, Homo sapiens
atgttagctactctcatgtgcaaacagaaaaaaacctgaatgcacatagtaagtaagcagacat

SEQ ID NO: 6770221 - DNA, 89 bp, Homo sapiens
ccgtgagtttggggctggctggagagaggccaactgggggacacagaggattcctcaggatccatctcctgccctcctcacacttttgg

SEQ ID NO: 6770222 - DNA, 86 bp, Homo sapiens
aagcaacccaatatcagtatcctgcagtttctatgggccctttctgcagcctttactcatggaagacaagggatctgggtttgttt

SEQ ID NO: 6770223 - DNA, 65 bp, Homo sapiens
ctgtctgccctggccagagcccccaggactgactgccctgggcactgccacgggcccatagatag

SEQ ID NO: 6770224 - DNA, 63 bp, Homo sapiens
ttgtggggagtggtgatggtattcgtggttaaagatccatagagcattatgacaaccccatga

SEQ ID NO: 6770225 - DNA, 79 bp, Homo sapiens
ccgaatgtttctgtctccctaaaattcatgttaaagctgtaacccccaatgtgatgtttttggaaatgggaacatttgg

SEQ ID NO: 6770226 - DNA, 84 bp, Homo sapiens
caggttagagatccttttaacagatacttctctttacaaggtacagtgaagttgaataattcatagaagctattctctgagctg

SEQ ID NO: 6770227 - DNA, 89 bp, Homo sapiens
tctgtcttcacctttgctgtttctctccctttcttgtgatccagttggagcatcagttttagaggggtgaaaagagctgaggaggcagg

SEQ ID NO: 6770228 - DNA, 58 bp, Homo sapiens
tgacaattgcagacacagaagtagttcagtttctatgcattctggttggcaatggtta

SEQ ID NO: 6770229 - DNA, 100 bp, Homo sapiens
ctaggaactagaaagtgggtggtgaagacaagtggaagtaaatgcaaacctattcccatatatgtttgtcgctagattgttcccaccaattcgttcttgg

SEQ ID NO: 6770230 - DNA, 82 bp, Homo sapiens
ccacccaagatgctaggagaagtcaccagtgattggggtgattctagcagaggctactgctccttggcactgaagtgggtgg

SEQ ID NO: 6770231 - DNA, 67 bp, Homo sapiens
ggatagaggcttctgttctggcccagaccaaggtggggctgcacagcaaagaagcctttctctatcc

SEQ ID NO: 6770232 - DNA, 85 bp, Homo sapiens
tcattaggttggtgcaaaagtaattgtggtttttgcaattcctttcagctacaaaattgcaattacttttgcaccagcttataga

SEQ ID NO: 6770233 - DNA, 74 bp, Homo sapiens
gggtattgggtgagggcaaagggttgcaaatcagagaaatttgcattagagccccagctctgccacaactagct

SEQ ID NO: 6770234 - DNA, 91 bp, Homo sapiens
tctaatttttagctggcttgataggaaagtttttattagctcggaggggtcagtaggatctatttgtatttcaggcatgttaggaaaagga

SEQ ID NO: 6770235 - DNA, 76 bp, Homo sapiens
tcctgtctgtcttttgtgaatggaatccacagactgacctcatccagtcttaggatgctattagcaagaaacagga

SEQ ID NO: 6770236 - DNA, 70 bp, Homo sapiens
ggaaatattaatgtaagactaggttccagtgtgtgttcattatacactgttcactagatcttcagtttcc

SEQ ID NO: 6770237 - DNA, 83 bp, Homo sapiens
tatttagctgatggtagctgtccacatcaggaatgattagaccacgtgattttcccatggggccagccgccatcagttaaata

SEQ ID NO: 6770238 - DNA, 58 bp, Homo sapiens
tctcagggcagcaaggaagcatagtccaaggagagacctgttccttgctgctcttgga

SEQ ID NO: 6770239 - DNA, 69 bp, Homo sapiens
tctaggtctgtgtcctggaaatctagttctgacttttatgaagtgaatatttttagacacccaactaga

SEQ ID NO: 6770240 - DNA, 74 bp, Homo sapiens
cactacatgcaaggcactgtgggtgtggccggacatacagaagaacttgtccctgcactccaagtgttgtggtg

SEQ ID NO: 6770241 - DNA, 69 bp, Homo sapiens
tcatcctgaacttgccagatacaccaaaaagtacaccacgtggctttactgtctggaaagtttggttga

SEQ ID NO: 6770242 - DNA, 59 bp, Homo sapiens
tttccaggcagaggagttgtgataatgaggattaaggcatacagcctattgcctgggag

SEQ ID NO: 6770243 - DNA, 61 bp, Homo sapiens
gatttttatccttcatacttttctttgactacatcagagcatggtggcaggaataaaggtc

SEQ ID NO: 6770244 - DNA, 72 bp, Homo sapiens
gctctgtcgcccaggctggagtgcagtggcgccatcttggctcactgcaagctccgcctcccgggttcaggc

SEQ ID NO: 6770245 - DNA, 84 bp, Homo sapiens
ctttaactgcagccaaggcatgctgagtcctaaaagggaggttatttccttgagggactctatgacttagtttaacagttggag

SEQ ID NO: 6770246 - DNA, 71 bp, Homo sapiens
ctatctgcatgctaagtcttggttttgccaaacttcagggctgagccagagagtgttggagatgtgggtag

SEQ ID NO: 6770247 - DNA, 82 bp, Homo sapiens
ggctttgggtccacagtcttcacagttcccaaggcatgttcaccttggtttagccttactgtggccttgtgggttcagggtt

SEQ ID NO: 6770248 - DNA, 59 bp, Homo sapiens
tctggtctttatcctaaaagcaaaaagaagcctgaaaagttttaagcatagaggccaga

SEQ ID NO: 6770249 - DNA, 64 bp, Homo sapiens
tcattctccttatttttattatgtactcttcaagcaaatgtggtacattgaagaatgggaatga

SEQ ID NO: 6770250 - DNA, 78 bp, Homo sapiens
cattcagcacagtccccataccacctgtcctacagcccggtgtatttggagaggatggagtggaggaagggttgtttg

SEQ ID NO: 6770251 - DNA, 83 bp, Homo sapiens
ctgcctgggtgaaggcttcttttattaggctgaaatgggaagtacatgaggcttccttgcaataaaaggagcccttcccgtag

SEQ ID NO: 6770252 - DNA, 70 bp, Homo sapiens
attatcagtatcaggctggaattaagtcataaaagattattgactgattcattagggctgatgctgtaat

SEQ ID NO: 6770253 - DNA, 62 bp, Homo sapiens
tgggtgatgcatgccatagaacttgaaagaactcttccaggcagttctcgtgtgtgtcccca

SEQ ID NO: 6770254 - DNA, 62 bp, Homo sapiens
gcttacccaggaggatggttgttaggtggaaatttaaattcataggaaccaacttttggtgc

SEQ ID NO: 6770255 - DNA, 124 bp, Homo sapiens
atattcttaaagaactcaggaacatcttaagagatacagatgttgaatgttatatctcctcttccctctggtatatttttggcatgtatcttctgttgtttctttaaaagttgcttttgaatat

SEQ ID NO: 6770256 - DNA, 55 bp, Homo sapiens
tgggaagggtctgaatctgagactccagagggtctcttacctgagacatttccta

SEQ ID NO: 6770257 - DNA, 62 bp, Homo sapiens
ttttatgacaggaaaatcacagaattgatgttggatccttttcagtgtatcttgtcagggag

SEQ ID NO: 6770258 - DNA, 65 bp, Homo sapiens
gctcctcacacccactgcaaccatggtggctgcctgtggttcttgtgttgtgtgaggatatttgc

SEQ ID NO: 6770259 - DNA, 84 bp, Homo sapiens
tctctgccttccactccactggacttgaatcccttggtccatgagaccaggaaactctcgtctagtttagtctggcggcagggg

SEQ ID NO: 6770260 - DNA, 104 bp, Homo sapiens
ctgcagtgtcatgctctgtcctgtcttcaggacctggaattttggggtctgagtgacaccagcattcactggacctgcagagaagaacaaagctgatgctgcag

SEQ ID NO: 6770261 - DNA, 58 bp, Homo sapiens
ttatttatcacttggtgagttgcagaaaactgcccaaggtcacacagctggtaaatag

SEQ ID NO: 6770262 - DNA, 91 bp, Homo sapiens
tcttagtaggtcaatgattatttggggtgaacatatgctgattcctattgctaatgtattcaacttcttaaaaattgctgactatacttga

SEQ ID NO: 6770263 - DNA, 76 bp, Homo sapiens
actgacagagctacatagtaacccacaaatctaagcaactgtatgggtgtgtgtgtgtttgtgtgtgtgtgtgtgt

SEQ ID NO: 6770264 - DNA, 60 bp, Homo sapiens
gacactctctcaggctttccttgtttttgatgacctggagtcatttgaggagtactggtc

SEQ ID NO: 6770265 - DNA, 96 bp, Homo sapiens
gtggaatgtcacccttacctcaactagagcaaactcctggagttctgcaagtccaaggacattgttctagttgcctacagggccctggcatctcac

SEQ ID NO: 6770266 - DNA, 93 bp, Homo sapiens
tgggtaaatggaggtcatgatattctctttatttttgtataggtttgaaattttacgtaatataagaaagtgtggtgaatagatatatactta

SEQ ID NO: 6770267 - DNA, 77 bp, Homo sapiens
acttggcaggttcgggtccaggttttggtcagccttgcaaatgaccaggcactcagagactgggacttgttttgagt

SEQ ID NO: 6770268 - DNA, 78 bp, Homo sapiens
aatgcttctaatcagctctagtttttgtataacaactgtagtaatatggttacctgaacaagatgttaatagagcatt

SEQ ID NO: 6770269 - DNA, 63 bp, Homo sapiens
gcccttactgagctcagcatcatctgatagtggcttcaaacaatgccaagtcttaatgagggc

SEQ ID NO: 6770270 - DNA, 60 bp, Homo sapiens
tataaacaggtccttgcaataatctcaaatggttcaggccagttttgcaaggcgtttata

SEQ ID NO: 6770271 - DNA, 57 bp, Homo sapiens
tctgctcaatactgctcatgaacacctgtctcttgttcatgttgcaatttgagcgga

SEQ ID NO: 6770272 - DNA, 79 bp, Homo sapiens
cccaggcacaccacccgtctgcccactgctctgctgcccatggaactcaaggggacagacagaaagtggcatgcctggg

SEQ ID NO: 6770273 - DNA, 77 bp, Homo sapiens
cctctactggaacactgataggccaatggaacaggtcagcctaatacctgggctgtcagttttgttttattttgagg

SEQ ID NO: 6770274 - DNA, 78 bp, Homo sapiens
taacgatgatatatctacacattatatggctggctatctttagtttgtttttatatcctgtggagtgtgacatctgtg

SEQ ID NO: 6770275 - DNA, 61 bp, Homo sapiens
ccctctacagggaagcgctttctgttgtctgaaagaaaagaaagtgcttccttttagaggg

SEQ ID NO: 6770276 - DNA, 79 bp, Homo sapiens
ctgctgcctcatgacccggacctggcctatcgcctcgcgctgcgagctatgaggtgaggataggtggccaaggcagtgg

SEQ ID NO: 6770277 - DNA, 129 bp, Homo sapiens
ttgtttattatgcagaaaccaaacaaatgtaattaaataccaactggtttgggacaatttgtgcattataaaatgccaatgttcatcaggccaacaactaggtaacatttttttcttttcattgaacaa

SEQ ID NO: 6770278 - DNA, 64 bp, Homo sapiens
gagaaatggctgggctccaggcttgtgtgacagcccgagagtggacagggcgcagctatgactc

SEQ ID NO: 6770279 - DNA, 102 bp, Homo sapiens
ttgagacggagccttgctctgtcaccaggctggagtgcagtggggtgatctcagctcactgcaacctctgcctcttgggttcaagcgattctcctgcctcag

SEQ ID NO: 6770280 - DNA, 109 bp, Homo sapiens
gcccatgttggggaacagatctgaaagcattgtgaattgtaagtattttatgtaggaaagttaaatgcaacagttcatagttttatgttctgccaacttaaccatgagc

SEQ ID NO: 6770281 - DNA, 70 bp, Homo sapiens
tggaattataaatgccaggactttagatcccataagcaatggggtcaggtggagggcatatatggtttca

SEQ ID NO: 6770282 - DNA, 55 bp, Homo sapiens
agtctgttgcagattttcaggccttaggtgaggaaggcctgggatgggcagaact

SEQ ID NO: 6770283 - DNA, 76 bp, Homo sapiens
ggtcaggattgaatgggagggggaggagaggccagactttggtgtccactcagcccgtcctgagccagcactgtcc

SEQ ID NO: 6770284 - DNA, 76 bp, Homo sapiens
tcggatgtacagagactaccattaatattgcagtgtgtgtcttttgtattaagttggtttctgaaaatatctctga

SEQ ID NO: 6770285 - DNA, 75 bp, Homo sapiens
tttaatgaggcatctgcagtcactagaaaattaccaccaagggtgaaagctagtgccttggggagtttcaataaa

SEQ ID NO: 6770286 - DNA, 57 bp, Homo sapiens
tgagagcctagtaggtggaaaaacttggtgccaaaggtctcccacactgggctttta

SEQ ID NO: 6770287 - DNA, 66 bp, Homo sapiens
gggagcttccgggttcaagccagctgcttcaaaggccaaagcttccctggcttcttcggtgttccc

SEQ ID NO: 6770288 - DNA, 59 bp, Homo sapiens
ggggtggatcaggcaggcccaggcacgtcagaagcacgggaccctgccgcctccaccct

SEQ ID NO: 6770289 - DNA, 64 bp, Homo sapiens
caccaggctggagtgcagtggcaagatctcggttcaagccattctcctgcctcagcctcttgtg

SEQ ID NO: 6770290 - DNA, 61 bp, Homo sapiens
gttgtactgtggatctgtatttgggactaggtcatacccacaccagggacgcagctgcagc

SEQ ID NO: 6770291 - DNA, 69 bp, Homo sapiens
cacttcatgccttgggtttgtcttctgtcagtatcctcagcacccagaacagagccgggcacaaagctg

SEQ ID NO: 6770292 - DNA, 57 bp, Homo sapiens
tggaagttgaatctcagtcatgtacaccagaatatgaatgcgagatgacagctccca

SEQ ID NO: 6770293 - DNA, 57 bp, Homo sapiens
ctggaagagtgactttgcatttactctttgtttctgactgtgatgtctctcctccag

SEQ ID NO: 6770294 - DNA, 60 bp, Homo sapiens
ttatctccatcttctgttagactccttaaaaacagcagcccacagcaggtgtggggataa

SEQ ID NO: 6770295 - DNA, 63 bp, Homo sapiens
ggctaatgaggaatcttcctgaagtttaaaaccaattaagcaacaaatggtttctgattagtt

SEQ ID NO: 6770296 - DNA, 87 bp, Homo sapiens
acttaatctgtgttataaactgttatagcagaaaggactttggtggattttagaggcccagctgtatattacagttttagagagagt

SEQ ID NO: 6770297 - DNA, 111 bp, Homo sapiens
caaaaataacagttgttataattatacaaaaaggcatgcagctccatgtgcttctagaagtttctttgttttgcaggtctatttaaatgattgaatcactttatatttttg

SEQ ID NO: 6770298 - DNA, 61 bp, Homo sapiens
ttgtaggtatggaggggactagggatggtgtcattttacattcagccttctcatcctgggg

SEQ ID NO: 6770299 - DNA, 60 bp, Homo sapiens
gcagtggcaaaggctctaggcccagactatctggaatcaaatcctggcttttctacttgc

SEQ ID NO: 6770300 - DNA, 66 bp, Homo sapiens
ggtttaataattgtggtgttggtttttttgcatagctttctatgtaccaaacccatcataactacc

SEQ ID NO: 6770301 - DNA, 59 bp, Homo sapiens
cctcacctatagagagaagaagaaaccgtccacttctcagtgttgttctgcagatgagg

SEQ ID NO: 6770302 - DNA, 130 bp, Homo sapiens
agaattaaatgagaagctttaaactgataccgatcattgggctccattactagagatgccgattcgataggtctggtgtgcggcccaggactcaatgttttaaagactcctcatttgacttttatatgct

SEQ ID NO: 6770303 - DNA, 100 bp, Homo sapiens
gcatctcaagctttccgttcattattttaatttatcaaaaggtaagaattaagctttgaagataacagtaaggtattgtactactaagcatatgagatgc

SEQ ID NO: 6770304 - DNA, 85 bp, Homo sapiens
ttgctttcctcagtttttcagcaaagcttgtctattgcttaaatagcaatatttggtgaaggttattgaggaccttaagaagtaa

SEQ ID NO: 6770305 - DNA, 81 bp, Homo sapiens
ggtttgctcagctgtgagatatccattaaccaagcagaagtttgcctgcacacactgtatgtttgcacagcttgcagtacc

SEQ ID NO: 6770306 - DNA, 80 bp, Homo sapiens
ctcctgagagcagaggtgggcagcctgccccaccccttctatagccaggctgaatccacaccctctctataattcaggag

SEQ ID NO: 6770307 - DNA, 61 bp, Homo sapiens
gtagtgggtactgggcaggcagagagagaaatttcttggtacaaacctcatgtcccaaggc

SEQ ID NO: 6770308 - DNA, 58 bp, Homo sapiens
atgcacactgggattcaactggtctacacagagatagcagagggatcccaggtgacgt

SEQ ID NO: 6770309 - DNA, 72 bp, Homo sapiens
gtgtgcatgcacacatgtgtgaggtgtgtaatatatatataactttatatctgaccaagttttgcatgccac

SEQ ID NO: 6770310 - DNA, 57 bp, Homo sapiens
cacagtttggttttgctgtaatctcagaattaaagagcacaggcagaattgggtgtg

SEQ ID NO: 6770311 - DNA, 65 bp, Homo sapiens
gcagcagagccagaattggaccagtacctctctgactggggaacctgatttttctgttttgctgc

SEQ ID NO: 6770312 - DNA, 67 bp, Homo sapiens
ggggtgagttggggttcacaggtcattcaatgggaagaggttgacctgggaaccttatctcaatccc

SEQ ID NO: 6770313 - DNA, 62 bp, Homo sapiens
cttatctgagaaagatgctacatgactacaaagaggttatttagtttcttagttcagataag

SEQ ID NO: 6770314 - DNA, 109 bp, Homo sapiens
aatattttgataactgtatttcaagatatttggtttcctttgatagctgtttcaatataactggtttccttggtgcccgatgtatttatgttatgggtttaaaaatatt

SEQ ID NO: 6770315 - DNA, 62 bp, Homo sapiens
aaggttagtaagtatcttatgtccctggaactacgctaggcacatacataccttaccacctt

SEQ ID NO: 6770316 - DNA, 58 bp, Homo sapiens
gttgatttgaagagcagaaagtctttttcattactacgttttgctcttctatgtcaat

SEQ ID NO: 6770317 - DNA, 62 bp, Homo sapiens
ggtgaacagataatagaaatgaactctctctcccagccatgttcttgctttatctgttcctc

SEQ ID NO: 6770318 - DNA, 59 bp, Homo sapiens
gacccagcctctgaaatgaacgcccctctattttgttctcctggagtgcttgttgggtc

SEQ ID NO: 6770319 - DNA, 116 bp, Homo sapiens
tttctgttttgctctctcacagccccactgtctgcaggcctcagcatgtgtaaccccattctgcgtctgctcctgggcttggctggctggtctggggtgagaggacagagcagggg

SEQ ID NO: 6770320 - DNA, 81 bp, Homo sapiens
cctctgcatgcattagattaaaagcgggtttgatcaaataattcccaggtcctgcctgtttaagtattctgacatcagagg

SEQ ID NO: 6770321 - DNA, 66 bp, Homo sapiens
gtcaacatggatcaacctattttcttggtaagtggatatcaaagaaaataacttggtttgtttgat

SEQ ID NO: 6770322 - DNA, 73 bp, Homo sapiens
gtgctatttggctgtgaggttgtttgtgaattaacctcaaaatatttacaattacttgatctcagctctgcac

SEQ ID NO: 6770323 - DNA, 65 bp, Homo sapiens
actgggaaggagcaggatctgtgcagagcagcctctcctgacctcagcccagcttcttccccagt

SEQ ID NO: 6770324 - DNA, 60 bp, Homo sapiens
gcagggaggacgagatacctgggtcccccttccggacaagacacctctctccatccctgc

SEQ ID NO: 6770325 - DNA, 63 bp, Homo sapiens
atggcctatgaccgttatgttgctatatgcaaacctctccactacatgacagtcatgagccgt

SEQ ID NO: 6770326 - DNA, 56 bp, Homo sapiens
ggcttttcaataaaatcctgcttcccttggaggcagtctttgaatgtgaaatagtc

SEQ ID NO: 6770327 - DNA, 56 bp, Homo sapiens
cagtagcactagatatgtgtggctaatgaacacttgaaatgtggctagtgctactg

SEQ ID NO: 6770328 - DNA, 63 bp, Homo sapiens
atcacagggtgaggattagacccctagtttcttgacacttaattttatcctctgcttggtgat

SEQ ID NO: 6770329 - DNA, 55 bp, Homo sapiens
gcccctgaaattcatagggtgatatataatcaccaatgtgatgatattaggaggt

SEQ ID NO: 6770330 - DNA, 82 bp, Homo sapiens
cacatccctgtgaattttaattactgctgaaacacagtgtttcagataatgactgagttttacatagatttggggagatgtg

SEQ ID NO: 6770331 - DNA, 86 bp, Homo sapiens
ggtcactttccgcctccatgtgcacctgagtcgcgcaggggcggacatgctcctgcgcgccagggccgtcgaggccgatcttgccc

SEQ ID NO: 6770332 - DNA, 97 bp, Homo sapiens
ggtacctggtagctcatcaaagactagataatccaagattgcctcactcacgtttttggtgaatgaggctggctatggattaattggtccaggggcc

SEQ ID NO: 6770333 - DNA, 55 bp, Homo sapiens
tctttgctgagtttgagaaacactgctccaagacagtaattttcaagagcggaga

SEQ ID NO: 6770334 - DNA, 57 bp, Homo sapiens
gcagctcttttcttaaagagatggaatccattttcctactccttgaatcagggctgc

SEQ ID NO: 6770335 - DNA, 100 bp, Homo sapiens
gagttccaagcctcagggcaagttgtctctggctggcaccccagggagtgcacgctctctggagggctccaggcgggcactgtggcctttggggacactc

SEQ ID NO: 6770336 - DNA, 61 bp, Homo sapiens
atgaacaagagagggaagattctcaataagcaagtgcttttagagcctctgcttgtgtcat

SEQ ID NO: 6770337 - DNA, 125 bp, Homo sapiens
gtttaccccaagagcccaccaagagctcccccagctcagagaatagggcttgaggggaccctgagccccctccctgtcctcggaggtgtcatctttgggagctccagggaggggtctggggaaac

SEQ ID NO: 6770338 - DNA, 66 bp, Homo sapiens
tactgatatgatgtgctttagaggataagcagggcaagaatgctttgatctgaatattatgcagtg

SEQ ID NO: 6770339 - DNA, 72 bp, Homo sapiens
gtgaccccagaaagggttctctgaggtgctgcggtccctacccagcagccaggggctctgtctggaagtggc

SEQ ID NO: 6770340 - DNA, 82 bp, Homo sapiens
ctgtccctggaggctgaggccatgaggctctaaccctaggaagagttggcaaagccctgagcctatgagcctctcagggcag

SEQ ID NO: 6770341 - DNA, 78 bp, Homo sapiens
gtggatgggtatcctgtttcttaatcagtcttgacaggcttagggcttgtcttgactttagagccaggaatattccac

SEQ ID NO: 6770342 - DNA, 92 bp, Homo sapiens
gctttcaaaaactcccaagtccaggtgggcaaataaagaaggaaactaattttgtttctgcaatacctatagattttcaagttgtttaaagt

SEQ ID NO: 6770343 - DNA, 55 bp, Homo sapiens
aggaaggtgtagagaggctatgatccttttcgtggctctagaaggccattttcct

SEQ ID NO: 6770344 - DNA, 100 bp, Homo sapiens
tgactccagggtcctattaagaggtaggcatgtgtttgccatagccaagtggtttgtgcagtggatgagaacacgtgtaaagtctgaatgccttggttca

SEQ ID NO: 6770345 - DNA, 61 bp, Homo sapiens
aggtgatcgctttacttgtccagaggcctgaccaaggtaggcctctctgaagaggtcatct

SEQ ID NO: 6770346 - DNA, 68 bp, Homo sapiens
tttccagatgctaggttgaaaggctcatggataaagcatagagaaatatttgatgagtggtctgggag

SEQ ID NO: 6770347 - DNA, 57 bp, Homo sapiens
ttccgaacccggatctgctgctcccagcctggagagccacagcagccaccgaaggaa

SEQ ID NO: 6770348 - DNA, 74 bp, Homo sapiens
catgtggttactacattatgaggaaagagtggaattaatgctaacttgtatattctcatatgtacacatacatg

SEQ ID NO: 6770349 - DNA, 75 bp, Homo sapiens
tctgtgcttctactgccctttatttcacaaagtagtctttgatgtattctgtgtatctgggggtaagagcataga

SEQ ID NO: 6770350 - DNA, 74 bp, Homo sapiens
ccagttttcataccaactttaggattagaaccctttccagggttcactgtcctttggttcagggttgctgctgg

SEQ ID NO: 6770351 - DNA, 60 bp, Homo sapiens
ctgctcttatttgtaggatgaaactgtgtaatcactgtcagttcttccagatagaggcag

SEQ ID NO: 6770352 - DNA, 61 bp, Homo sapiens
ggagggttagctgttactggttacacggaagcccgtgtccagggggcttacctggaggtcc

SEQ ID NO: 6770353 - DNA, 60 bp, Homo sapiens
accactgaaacaggtattgctggtgatttttgttcaccttggatacatttttcacatggt

SEQ ID NO: 6770354 - DNA, 71 bp, Homo sapiens
tctagtatacatagtgcttcctcttggtagatttttacctactgtgagaaggaatgattttgatactcaga

SEQ ID NO: 6770355 - DNA, 55 bp, Homo sapiens
tgcctgggtgcccaatgatgagacctcctgcccgtctcatgatggtgcccagtca

SEQ ID NO: 6770356 - DNA, 76 bp, Homo sapiens
ggtagcctgcaggctgggcggggccttgggctctggaggagcttaaagggccgatttccaggccaaggtgggcacc

SEQ ID NO: 6770357 - DNA, 87 bp, Homo sapiens
ggactggtcccacaagatgtcctcagagtgggcaggtcctcaaaacaagaagacgcaccctttgagggcacaatgcaggtacagctc

SEQ ID NO: 6770358 - DNA, 84 bp, Homo sapiens
tcattaggactttggcattttaaatagttcagcttgtaaacccagggccatctgtgcaggtgacctaatccatgtctctgatga

SEQ ID NO: 6770359 - DNA, 87 bp, Homo sapiens
tctttcaggaaaactaaaggccattattctgatatattcactgtattgaactataaaccagtgatgccctctagtggtactgatgga

SEQ ID NO: 6770360 - DNA, 59 bp, Homo sapiens
tccttcggtcaggatattaggctaaggtcccttcttgattctggtgactgatggaagga

SEQ ID NO: 6770361 - DNA, 60 bp, Homo sapiens
gggaaggaagattctaactggagccctcaatgctccagaaagattatctttccggttccc

SEQ ID NO: 6770362 - DNA, 60 bp, Homo sapiens
agcatatggtaaggagtcagaaggcctggattctggtcctgactccattctccatctgct

SEQ ID NO: 6770363 - DNA, 57 bp, Homo sapiens
gtagccctcatctgctcaaaagggtgtctgtagcacttttttgagattgagggttat

SEQ ID NO: 6770364 - DNA, 62 bp, Homo sapiens
ggatttactatcttgaaatatatggaaaatacactcagatatattgtagggaaagtaagttc

SEQ ID NO: 6770365 - DNA, 74 bp, Homo sapiens
caaaggattctggagaggaacagaaaggtaaagcataattggacacctttgtgagttctccagaacaccctttg

SEQ ID NO: 6770366 - DNA, 56 bp, Homo sapiens
cacttgaatgagaatttcctggggatggtcctgggaatgtgtatttttaacaagtg

SEQ ID NO: 6770367 - DNA, 99 bp, Homo sapiens
gaggcaggagaatcacttgaacctggcaggcagaggttgcagtgggccaagattgcgccattgtactccagcctgggtgacagagcgagactctgcctc

SEQ ID NO: 6770368 - DNA, 62 bp, Homo sapiens
agcctggagaatgagagttgggaccttttgagcccaggacagtctttcctcattccttagct

SEQ ID NO: 6770369 - DNA, 58 bp, Homo sapiens
atgtttatcccaaatgccaggagtggacgaggcggacgagtggcagtgaggtaggcat

SEQ ID NO: 6770370 - DNA, 95 bp, Homo sapiens
gaataatgtgagcagcagatcatgtacttgacaaatatgtgactttggtttaaaagcagaatgttcatgtatgtgagctgctattaactgtattt

SEQ ID NO: 6770371 - DNA, 68 bp, Homo sapiens
gggtctgttaaatgagaaagcagactagaagattctgctaatttgctttctcaatttaatagtaaccc

SEQ ID NO: 6770372 - DNA, 86 bp, Homo sapiens
aggagcctccccagctcgcgggtgacgggtgtggtttgtaaatagtttatgcacctgttacatccacgtgttgcgggactgctcct

SEQ ID NO: 6770373 - DNA, 70 bp, Homo sapiens
cacctgcctcctgggacaggctggcacaggcacattcttatgctggaatctgtgtcccaggggtcaagtg

SEQ ID NO: 6770374 - DNA, 96 bp, Homo sapiens
cttgcctgttagagaaatggcataagttttatggtattgtgcatctagaatgttcttagcaccacctgaaaattattatttccgctgatagttaag

SEQ ID NO: 6770375 - DNA, 82 bp, Homo sapiens
ttgaggacgacttggctctgacattaaaacaatggcatattaccacagccatgaggatgggaagggagccaagatgttccaa

SEQ ID NO: 6770376 - DNA, 87 bp, Homo sapiens
aatgaggctactaggagtcaggagtggctttagttttgctttgcctttgcaggcaggcagagtcaatttgatccaagtagccttatt

SEQ ID NO: 6770377 - DNA, 84 bp, Homo sapiens
tgccaggcaatcttgggacatgtgctctgggagccttgggccgccatatcaggagccagctgtcccaaccaggatctgaaggta

SEQ ID NO: 6770378 - DNA, 60 bp, Homo sapiens
gctgtcccgaacccctggtaatagaattgtttatctttataccaagaagtttgggaaagc

SEQ ID NO: 6770379 - DNA, 67 bp, Homo sapiens
gtgcacctgaatggaactttgaacctccaggccagcctgcacaggtgttcagagctattctgtggac

SEQ ID NO: 6770380 - DNA, 109 bp, Homo sapiens
agtacagggcctcgtagtactcatcaattaaggccatgacatctgaatcattgcctcagaattacacagggccttgatagaatttaagagtggagtggggtctggtatt

SEQ ID NO: 6770381 - DNA, 65 bp, Homo sapiens
ccaggatctgtacacctctgagtgtcccaccatgcctctctgccagcagtgtgtatggaatctgg

SEQ ID NO: 6770382 - DNA, 63 bp, Homo sapiens
gagagagcatgcttattttatctcattcctggggaagaagaaggagtaagatgtgtccatctc

SEQ ID NO: 6770383 - DNA, 76 bp, Homo sapiens
ttctctagctggaagggcattttaaggcctccagaagatacggccagacaaataaatgtcttctagctcttgagaa

SEQ ID NO: 6770384 - DNA, 85 bp, Homo sapiens
catgcagatgcaggtcacctgaggttagagctgaagtgcaggtttcgatactgcagacctggagtggggcctcaggttctgcatg

SEQ ID NO: 6770385 - DNA, 76 bp, Homo sapiens
cactcccctcaaagttataacatctcccatcaacatcagctcagaatggcagtgatgcttatggtttgtgggggtg

SEQ ID NO: 6770386 - DNA, 89 bp, Homo sapiens
gcagtgccttcaaacacccaggctattgtgcagcgtgttgctactgtctgtgatgcctgcgaggcatgggtgagaggaggaggcggtgc

SEQ ID NO: 6770387 - DNA, 129 bp, Homo sapiens
aatacagcatcatcattgattactgccgcatgttagagcaaacatatttatttctctttttttctcccaaagaaataaaatctttatgtgctctgcacgtgggttagggaagctaataatggtctgatt

SEQ ID NO: 6770388 - DNA, 67 bp, Homo sapiens
atgaggcagctgacagctgttcatccagatatagccctgatgtcctaagaacatgtcagcttcttat

SEQ ID NO: 6770389 - DNA, 119 bp, Homo sapiens
tcagaatcccctgggagcttatttaaaatgcagatttctgggcttcaccacctctgaccaggaggtccaaggtagggcccagacatggacgtttctgtcaagatcccagggaatgctga

SEQ ID NO: 6770390 - DNA, 66 bp, Homo sapiens
gcagtggcaagagcctggtctcgggaaccacacagacctcagctcaaatccaggctccatcactgt

SEQ ID NO: 6770391 - DNA, 60 bp, Homo sapiens
tcttgtaaaaggtacattatgcttgtaggtaaactgataatcataatagccttttcgaga

SEQ ID NO: 6770392 - DNA, 58 bp, Homo sapiens
aggcagaggaaaagtaaattctaggatcacaactcatgagttaatttgacccctgcct

SEQ ID NO: 6770393 - DNA, 58 bp, Homo sapiens
tcctaagaaatgttgtgaatgccatgttaaaaacctggcatttctaagatttttgtga

SEQ ID NO: 6770394 - DNA, 76 bp, Homo sapiens
ggaggaatgcgacactgtttgaggccctagttgagtcatctcttctgctcttaagacagttatgttggtttctgcc

SEQ ID NO: 6770395 - DNA, 92 bp, Homo sapiens
cttgtcccaggtcagccaggctggcctcggcagcaggaacagcgggttcaagcccctgcttctccctgagatagtgtggcacttggggcaag

SEQ ID NO: 6770396 - DNA, 84 bp, Homo sapiens
gcgtctcccaggcccaggggctttcctgtttatggaagagcttattctgagagctgtagaagcctattggattccctgtcacgc

SEQ ID NO: 6770397 - DNA, 67 bp, Homo sapiens
gacattgacagtcctccttataaatggccttttctgggcttaagatgacagggcactgccatctgtc

SEQ ID NO: 6770398 - DNA, 56 bp, Homo sapiens
ctgtattttttaagtgatctggatgtccagatacacagctacattgaacaatatag

SEQ ID NO: 6770399 - DNA, 72 bp, Homo sapiens
cttccacactttcatgtcagtgagcttctggatgggtctgaccagtgagaagtactggcagaagattggagg

SEQ ID NO: 6770400 - DNA, 81 bp, Homo sapiens
tccagttgccttgaatttttgctaatccccagccactgccccttttggggcacttgtcgttacagaatgcaggaaatgaga

SEQ ID NO: 6770401 - DNA, 59 bp, Homo sapiens
tagaactaaagaacaactttgaaaatgtgtgatatttcaaagtgttcagaccagttctg

SEQ ID NO: 6770402 - DNA, 103 bp, Homo sapiens
gcagaaaagcaactgggctgctctgaaggggaagggatgggcagcaggtcacaggaccatggtcttcaccagccctgcctctcagggcccctgcttttactgc

SEQ ID NO: 6770403 - DNA, 78 bp, Homo sapiens
ctgaagaggatgctaaggcactaccttctcaggtcttaacagcaggctttaaaggcacagtcttggctttatctttag

SEQ ID NO: 6770404 - DNA, 66 bp, Homo sapiens
tcttatgtgcaggggcaggagctcagacctagtcttgtggatggtgctgccccattgcaaaggagg

SEQ ID NO: 6770405 - DNA, 70 bp, Homo sapiens
gggtattgtgttttgcttctctctggtaaaagatgagaattctttgaatacaggaagcatgagataaccc

SEQ ID NO: 6770406 - DNA, 82 bp, Homo sapiens
agctcagagatataataatttacaagtgtacagagcgctgcagtttacaaagcatttttgagtgtattatctcatttgggtt

SEQ ID NO: 6770407 - DNA, 59 bp, Homo sapiens
ttccgcgccttggagaccgtcttccggtaccaccagtacttgggctctcaagagcggaa

SEQ ID NO: 6770408 - DNA, 119 bp, Homo sapiens
cttcttagcacttttattctttgcttccaaagtagaatcttcaactcagagagtgctgctgatgagtcgatagtactcattttgggctgggtgggggaggagagtgaaatgtctaggag

SEQ ID NO: 6770409 - DNA, 120 bp, Homo sapiens
gtaggatggaggccagagagggcacgtggcctgtggtcctggtggtgccggtgcccggagggcttccctgggctctggggtcccggtgcaaggcgcacctgtcctggctgctcctcctgc

SEQ ID NO: 6770410 - DNA, 95 bp, Homo sapiens
ttgttctattaggttgatgcaaatgtaatggcaggttttgctattaaaagtgatggcaaaaccacaattacttttacaccaacctaacagaacaa

SEQ ID NO: 6770411 - DNA, 102 bp, Homo sapiens
gggaagtagggaggaggagggcagtgtgggatggaggtggggttacagggtcagccgacttggctttaggcatccacatagcaactccatccaccccttccc

SEQ ID NO: 6770412 - DNA, 129 bp, Homo sapiens
ttagctgtttttttttcaatttagtacacccaagcataatcagtagtagatttattagatgaccaaagaagttttaaaaaatgatgctcacagattagtggtggattcaaacaaggtggaaacaaatga

SEQ ID NO: 6770413 - DNA, 82 bp, Homo sapiens
agattggatctgtgaatgatgtttctttctccacagctgcaggacagagagaacatcttcatttctttcttagattcatttt

SEQ ID NO: 6770414 - DNA, 72 bp, Homo sapiens
acaaatttactatctttccagtttggctgcaatgactgctgtaaggctgggctgtagaaatagttgaattgt

SEQ ID NO: 6770415 - DNA, 71 bp, Homo sapiens
ctgaattttgtaattgaacgtctgtgtctgcagcaaaagcacagaacatttttagatgcagatagtatcag

SEQ ID NO: 6770416 - DNA, 78 bp, Homo sapiens
cagtggtgcctttcaggcagagctacctgggaacttcacccaagggccccagaaggcttgccaggaagcccaccactg

SEQ ID NO: 6770417 - DNA, 77 bp, Homo sapiens
gctccggggctgctgggaggtctcttgcggcctaggccaggctcagggccgccggggatctcgcctccatcccgtgc

SEQ ID NO: 6770418 - DNA, 121 bp, Homo sapiens
ggcttgtctttccctctcagagcttggtccactgaccttccttgtctacaaaagctcttaagaagtgtttgctgaaaggaagcagggcagggcttacagaggagggagcatgggggaagct

SEQ ID NO: 6770419 - DNA, 70 bp, Homo sapiens
gagtaacataccaaaattcacatgactattctgttacagatctggactttgaattttggcttgtttgctc

SEQ ID NO: 6770420 - DNA, 75 bp, Homo sapiens
acagatagaaaggctcacgcagttagtgatgctggagaaggagtattcaattgcaaggtgggcaaggttatgtgt

SEQ ID NO: 6770421 - DNA, 59 bp, Homo sapiens
gccagcattccttggctcctggctgtctatttgcatcttcaaagccagcagtagctggt

SEQ ID NO: 6770422 - DNA, 82 bp, Homo sapiens
catctctgcccaccctcgctgtgttctgtgatgaagacagacatgtgctgctcacacacagtgaatgtgaaggtaagaggtg

SEQ ID NO: 6770423 - DNA, 79 bp, Homo sapiens
ggccgggcacggggcaggaggtcacagcagctaatcaagtccttgctgtgttctcctgactcaccgccgagctctggcc

SEQ ID NO: 6770424 - DNA, 80 bp, Homo sapiens
ttccccaattaccaatattttagagctgagcttacagtcaaataactctacttgcttaggaaaatggtggagttgaagaa

SEQ ID NO: 6770425 - DNA, 129 bp, Homo sapiens
ccattggttatttgattcacagacaattcccatagagctataagaattttgtgttttcctagaaagtcacatatttgatgaagctttgttgttttctgtgtccttaacaaatgacattcagtaatgtgg

SEQ ID NO: 6770426 - DNA, 73 bp, Homo sapiens
tgaacatgaacagtctggctgggggctttgaagcagtaaatattggaaaccccagcagattgtaaagtgtcca

SEQ ID NO: 6770427 - DNA, 97 bp, Homo sapiens
gatatggaataaaatcaatctatagagctttagactatatcaaaagaaatagctcttgaaatctggttgaagttttgggttgaattctttccgtgtt

SEQ ID NO: 6770428 - DNA, 59 bp, Homo sapiens
tattgtgccaggtaatgtgttcctttactccaggagcaaaaatcacatctggtacaata

SEQ ID NO: 6770429 - DNA, 84 bp, Homo sapiens
gtccaccctccactgcagcctagggaccacagtattgtactgttctgtacacacggggctcagggtctgtaggtgaaaatggat

SEQ ID NO: 6770430 - DNA, 74 bp, Homo sapiens
atgtgttaatggggtcaggaggagaactgaacttgcagcttgcagcacttcaatctctgcctccatcatcacat

SEQ ID NO: 6770431 - DNA, 122 bp, Homo sapiens
tgaaatccagcgatggtgccatgggagtgaataggatgatgtgtgtgaagagcctggctcagtgtctgctgtgcatatttatctaggaggtgtttaatacatggcagaatttggggattaca

SEQ ID NO: 6770432 - DNA, 65 bp, Homo sapiens
gcagaggctgtttatttggtttctcattaaccaaaggaagtgcctggatcagatggagcctctgc

SEQ ID NO: 6770433 - DNA, 79 bp, Homo sapiens
gtgatgatttcaaaagactaagaagagtattattccttgttctttggaggttttgcttttcagtctcaatatctgtcac

SEQ ID NO: 6770434 - DNA, 129 bp, Homo sapiens
gtcaatgggctaaaaatcaagatattgagcagtctgtgttccttctggaagccctaagggagaacccattacttgccttttccagcttctagaggctgcctgcattccttggctcatggtccccttcac

SEQ ID NO: 6770435 - DNA, 76 bp, Homo sapiens
tcaaagttaggattgagttagagttcaatgggaattaaaatcctagagaatattttagcttctgaaatcatgttga

SEQ ID NO: 6770436 - DNA, 55 bp, Homo sapiens
ctcctgcagtccaaacctcagagctcctttggggaggaggcgaggcgtgcaggag

SEQ ID NO: 6770437 - DNA, 60 bp, Homo sapiens
aatgatatcttactcaaaggtactgtctggaggcagccttggttgtgagatgaagacatt

SEQ ID NO: 6770438 - DNA, 80 bp, Homo sapiens
ctccatgagataaaaagtcgaggtaaaacggttcctttgggggaaagacttattttgacttcacctggtgtttcgcggag

SEQ ID NO: 6770439 - DNA, 74 bp, Homo sapiens
ggcctgggctatcgtggcctcctaggctcactcctggaagacagagacaacctgaggtcagcggttcccacacc

SEQ ID NO: 6770440 - DNA, 55 bp, Homo sapiens
gccactgattccaagtcaatttctgggcctcagatttattgggtgagtcattggc

SEQ ID NO: 6770441 - DNA, 55 bp, Homo sapiens
gttagtaagtggggaagtccggaattcaaaccaggctccagaactctatgctaac

SEQ ID NO: 6770442 - DNA, 64 bp, Homo sapiens
tacatagaaggaggctggcagctctagctgagaggtagcaggagctggtgcctgcttttgtgtg

SEQ ID NO: 6770443 - DNA, 57 bp, Homo sapiens
ttagtcttcttccttatatgttgtttatgtatattcaagaatgagggacaaggctga

SEQ ID NO: 6770444 - DNA, 64 bp, Homo sapiens
gagctctggtcactgagttggcaaagtactcaaatagtaacttaatccaccttagggctatttc

SEQ ID NO: 6770445 - DNA, 55 bp, Homo sapiens
gcttggacgccgtgtggaagatccagcgccgctggtttccacacagctctcgggc

SEQ ID NO: 6770446 - DNA, 57 bp, Homo sapiens
tcagataccattgaatttgttgtatggtctttggcagcactcagtatgggcgtctga

SEQ ID NO: 6770447 - DNA, 62 bp, Homo sapiens
gccaggagaatgctagcagaggattcggatcaaaggagctgttctgtaggttttcttatggt

SEQ ID NO: 6770448 - DNA, 74 bp, Homo sapiens
gctggagggaggaagtggggcagggctgctaggattcacagcagtccatagaggctgctttcatccacttcagc

SEQ ID NO: 6770449 - DNA, 84 bp, Homo sapiens
ttgaagaacactgcattgaggtttcatacttccttaaatgctcataaatcttctaggaattatccttaatgcagtaagctacaa

SEQ ID NO: 6770450 - DNA, 93 bp, Homo sapiens
ttgggtcagttgacagggaaaagggtcctggttctcaagagcaaggagagagatttgcctgggagtgaccaagactctaggtcaaggaaacag

SEQ ID NO: 6770451 - DNA, 84 bp, Homo sapiens
taagataaacctgtaattcttgttcagaggtagtaagctgtaggtcgggttattgaagaacagagaattattaggtttcttttg

SEQ ID NO: 6770452 - DNA, 58 bp, Homo sapiens
ggcactgtctatagaatgtcaaagtaatttcttatgaagacatcatgtacacattgcc

SEQ ID NO: 6770453 - DNA, 56 bp, Homo sapiens
ttcctcattctggggcatgttgaagcacatgtttctcctgcccaccagaagaggga

SEQ ID NO: 6770454 - DNA, 85 bp, Homo sapiens
cagattcaagaacaataattttagaggaatagtagttcttaaaagtgaaaaatctattgttataattgttgacattgttgaactg

SEQ ID NO: 6770455 - DNA, 67 bp, Homo sapiens
gttaattgttacactgtaagaactccacaaacttgatcagagaggtgagtagcagtgtgacattgac

SEQ ID NO: 6770456 - DNA, 63 bp, Homo sapiens
agtggcaaaagcaggcttaggcctacgtctttctgatgtttaagcccatgtgttttctgtcct

SEQ ID NO: 6770457 - DNA, 92 bp, Homo sapiens
ctaccactcagagctgtcctaccaggagtccttccacagctccataaaccaaggtgagagggccctggatgagggcagtcgggggtgagtgg

SEQ ID NO: 6770458 - DNA, 80 bp, Homo sapiens
gagttgatatttgactatactttttattgcccttggagtgttcagtccaagagtccaaatgtgcagttatgtaagaattc

SEQ ID NO: 6770459 - DNA, 59 bp, Homo sapiens
gtcatgaacatctacagtgagatgttagactttgtcgatatctcaaaagtggagtagac

SEQ ID NO: 6770460 - DNA, 55 bp, Homo sapiens
gcacagttgtgacaaccatcgcaaacatgagtgtcctggagtcacgctgttgtgc

SEQ ID NO: 6770461 - DNA, 61 bp, Homo sapiens
tcacttctggtcagtctgcaaagtggtcttacctgaggcctgagaatgtaccagatcttga

SEQ ID NO: 6770462 - DNA, 56 bp, Homo sapiens
tgaagatttagacctctttgcccttttcttggggcctttgagagttgggattttta

SEQ ID NO: 6770463 - DNA, 56 bp, Homo sapiens
tgtgcctggagtccctgaggagtcagtgcccctgcttacatggagcccaggccaca

SEQ ID NO: 6770464 - DNA, 62 bp, Homo sapiens
tcttcagcaactccccaatctgcctgcagccaagcctcagaatctgttggggttgcagaaga

SEQ ID NO: 6770465 - DNA, 95 bp, Homo sapiens
gattcttattttctcccatacaaagtcttgggttctaggctgggcgcggtggctcatgcctgtaatcccagcactttgtgggaggcaggacggtc

SEQ ID NO: 6770466 - DNA, 69 bp, Homo sapiens
caggattgagaatgaagggacattttggagcccttgtggtggtacagttctttttatatctagatcttg

SEQ ID NO: 6770467 - DNA, 68 bp, Homo sapiens
ggtggcacagtggcagctgcagctcgagtctcctagtgtggagtccagggtccctgccctctgtcatc

SEQ ID NO: 6770468 - DNA, 56 bp, Homo sapiens
gcagctgtcttttctaaatattaagcactcacttggttacatagggcagatggcgc

SEQ ID NO: 6770469 - DNA, 67 bp, Homo sapiens
gtgagcagatagagaagagccctggtgctggccactgtgagcatcagcctctgtcctggaggctcac

SEQ ID NO: 6770470 - DNA, 87 bp, Homo sapiens
agatgggagaagcagtgggacagtagccccagaacatgcaccgttcatagataggagtgctagtctcactcctgctctttctcatct

SEQ ID NO: 6770471 - DNA, 55 bp, Homo sapiens
agctggcttctttaaagcacatacttttgtaaagtgtgcttcagaagccattgct

SEQ ID NO: 6770472 - DNA, 98 bp, Homo sapiens
ccatagctacaggactcaggcctgatgagcttccagctgagcactgggtgtcactcgggctttacctgcttatcttcaggatctctcttctggttagg

SEQ ID NO: 6770473 - DNA, 63 bp, Homo sapiens
tcctctagctttgagatcagtagccagggcctttcggtaatcagcagcttacagttaagggga

SEQ ID NO: 6770474 - DNA, 78 bp, Homo sapiens
tactaagtgaacaaattatctttgagagaccagggtatggttctggactgctttgtaatttaaaagttagccttggtg

SEQ ID NO: 6770475 - DNA, 68 bp, Homo sapiens
caccgtgtgcttgtcgtggagccaggctcggtgcctaccaggcctgagtcaagatgtggcacctggtg

SEQ ID NO: 6770476 - DNA, 80 bp, Homo sapiens
gaatattggctgtttgtttgtgtttgttgcctcatggctgcaaaattgctgctgtggtgtcaagcatctcaaccatattc

SEQ ID NO: 6770477 - DNA, 115 bp, Homo sapiens
tgggaaggaaaagagaaagaaagtgaaattcctggtctttgttgtatgtatccccttgctttttagataaattatcaggggtttaaacacacactctctcccctccctcctccca

SEQ ID NO: 6770478 - DNA, 79 bp, Homo sapiens
ggctttgaatgcatcagggaacaaagtggcaaaaatggtatttgcagattctgtcagtgtttcctagagcatataaact

SEQ ID NO: 6770479 - DNA, 60 bp, Homo sapiens
tcaaaggcaaggttcaccgtgctatgaagcttatcacagggcttagaacttggcctctga

SEQ ID NO: 6770480 - DNA, 60 bp, Homo sapiens
tgtcaccaaatgttttcctggagccagactcatgactggtttctaaggttttggtgcaca

SEQ ID NO: 6770481 - DNA, 70 bp, Homo sapiens
tcaggagcagggggaagctctgtcttcactgattgatttttctgagaagtgagttccccatttctcctgg

SEQ ID NO: 6770482 - DNA, 74 bp, Homo sapiens
tgaatgatagctggattcacatggctgaaaagaggtcacaatttactgaaagtctgtgggtcctcccctcttca

SEQ ID NO: 6770483 - DNA, 55 bp, Homo sapiens
gcctcagggataggatgagcatggcagtgagcacaagtgatgtcccccatgaggt

SEQ ID NO: 6770484 - DNA, 113 bp, Homo sapiens
catgaggttttgtttcacctataattgtgatggaaaatgctgtattgctgacaacaatgaactgtaaccacagttatttactgcataaactatttgtgtactaaccactcatg

SEQ ID NO: 6770485 - DNA, 77 bp, Homo sapiens
caggcacccaccaccatgcctggctaattttttggacggggtttcaccgagttagccaggatggtcttgatctcctg

SEQ ID NO: 6770486 - DNA, 62 bp, Homo sapiens
gagccttcagtgattacccagagttaagagaatgatttagtttctggcacactgagaagctc

SEQ ID NO: 6770487 - DNA, 108 bp, Homo sapiens
ggctcctggttggtggggaccatggtcctttaggaatgctcttcagcagtgcctcacagagaagagcagattcctagtggagcatacacttcagccagcacccgagcc

SEQ ID NO: 6770488 - DNA, 58 bp, Homo sapiens
gcttgaaagatgagtctagtaactgactttggtcagttacagtgaccatttatttagc

SEQ ID NO: 6770489 - DNA, 108 bp, Homo sapiens
aatgtatactttaagttctagggtacatgtgcacaacatgcaggtttgttacatatgcatacatgtgccatgttggtgtgctgcacccgttaacttgtcatttacatt

SEQ ID NO: 6770490 - DNA, 85 bp, Homo sapiens
cctgactgtatcatccaaggaggctttgacgtccatttggtttacccccagatttgcaagggttgccttggaaatctcagttggg

SEQ ID NO: 6770491 - DNA, 82 bp, Homo sapiens
atcgagtgcaagacactggctgtgctggagttgaggaaagttttgctggagacctgcttgcaccatatgtctggtcactgat

SEQ ID NO: 6770492 - DNA, 84 bp, Homo sapiens
gggcagcaagtaccagtggtttcagtcccctgtcaccaggcatcctgcagcaggcacaggacggaagtacatgtcctcactccc

SEQ ID NO: 6770493 - DNA, 72 bp, Homo sapiens
gtatctttgtgtgtgtgtgtgtgtgtgtgtgtgtgtgtgtgtgtgtgtatgtgtatgcatgcactaagatgc

SEQ ID NO: 6770494 - DNA, 55 bp, Homo sapiens
agggcagattgtatattctccactggttggcacattagagtattgaatttgccct

SEQ ID NO: 6770495 - DNA, 86 bp, Homo sapiens
gcaacatactgtgtgattccatttacgtgacactgtggaaaaaggtaaaacaacagatcagcactgaagaacgcatcagtggttgc

SEQ ID NO: 6770496 - DNA, 57 bp, Homo sapiens
tgtggcaattttctagcagatggcagttaagtgccttgctttgacaaaattggtata

SEQ ID NO: 6770497 - DNA, 59 bp, Homo sapiens
cccaggaacagcacagaacagcagggcctggcctctgggtcttctgtgtcctttgtggg

SEQ ID NO: 6770498 - DNA, 59 bp, Homo sapiens
gcctagatgtggtccaattggctatctacgctaatataatcctgcttcacattgaaggc

SEQ ID NO: 6770499 - DNA, 68 bp, Homo sapiens
ggaccagctccggtccctgccctttctggtcttttgcagctggaaatccagatgctggatcttggtcc

SEQ ID NO: 6770500 - DNA, 69 bp, Homo sapiens
ggttttctccccctcttctcaggccactacccagatgcaaaaaatggcctgggcagaagttaggaagcc

SEQ ID NO: 6770501 - DNA, 64 bp, Homo sapiens
tgtggtgtcaatgctcccaccttggcagattgtaagctgccaatatgagatcactgacaacaca

SEQ ID NO: 6770502 - DNA, 67 bp, Homo sapiens
attcacctttccccaaaatgagaaacagcagaagcattataaagctgcccatgggtgacaggtggat

SEQ ID NO: 6770503 - DNA, 67 bp, Homo sapiens
gaggatctgtgtctgtgctgctttggtttctaatcctctcagttgcaagcacagcgcggtgttcctt

SEQ ID NO: 6770504 - DNA, 64 bp, Homo sapiens
tttccatacgtttccactgtttgatctgtgagaaagactaggggacaaggcaggagattggaga

SEQ ID NO: 6770505 - DNA, 71 bp, Homo sapiens
aagagaagtcaggaacaatatctgtcctggttctgacttggacttgattttgttatcttttactttctctt

SEQ ID NO: 6770506 - DNA, 55 bp, Homo sapiens
cttcagtggtcatttgtgataaagctattgtttttgtcattaatcgctatagaag

SEQ ID NO: 6770507 - DNA, 130 bp, Homo sapiens
cagaggctagagaaatgtgaagatatggtcagcactggtggaaaatgtgactattctaaagttgtagttcattatcactttagaagtatgtgttctagttgtgcagatctaatttctgcttgagcccttg

SEQ ID NO: 6770508 - DNA, 60 bp, Homo sapiens
tgggtaaaaaactgaagtaagtggcaactagtgaaagagccatggcttctattttactca

SEQ ID NO: 6770509 - DNA, 58 bp, Homo sapiens
tggaagtggcagaggaagtggtataggaaaattaaatcactttgacggccaacttcta

SEQ ID NO: 6770510 - DNA, 72 bp, Homo sapiens
cgggaccccaggggcgcgcgccccccaggcccggagaacgggcccagggcctgagggcgacgccccttcccg

SEQ ID NO: 6770511 - DNA, 74 bp, Homo sapiens
gggttcaaattcttgctcagatgcttgaaatctaagtgaatttagatacaggctctctgagcctcagtggactc

SEQ ID NO: 6770512 - DNA, 105 bp, Homo sapiens
cttagccctgcatctccaggcaggcaccgccttcccagggtcctgtggctctgggctgtgggcctcaggacctgaagacaggcaggtgcaggatgcaggactggg

SEQ ID NO: 6770513 - DNA, 129 bp, Homo sapiens
ctctgtggtcccttctagcctaaaatttctgtctctgcatcagcttcattctgttcaaaaaagagaatggatggatctgttgcagcacagagtggagagtggccaatatgactggggcccaagacagag

SEQ ID NO: 6770514 - DNA, 72 bp, Homo sapiens
ttccaggatatgctaatgacactctagaaataatgcttctgtttttgagaattgttagcatatatccaggga

SEQ ID NO: 6770515 - DNA, 61 bp, Homo sapiens
ccataccctagagttggacagaattaaacacttggtgaagttggtcctggtctggggttgg

SEQ ID NO: 6770516 - DNA, 86 bp, Homo sapiens
gcgttcctcacctaattgggaggggagaaactatacaagaagaaacacttcccttttgattctcggtgatcacaggtcaaagatgc

SEQ ID NO: 6770517 - DNA, 84 bp, Homo sapiens
gcacttctgcactctcagttcaagagaaatactactgcatgatgtacagttttgaatctcattgaactacatctgttgaagtgc

SEQ ID NO: 6770518 - DNA, 55 bp, Homo sapiens
tgctcctgcttagccgtgttttgcatatgtgcttttgaccatgtgctcaggagca

SEQ ID NO: 6770519 - DNA, 76 bp, Homo sapiens
agacttatatatctttattcatcctcaagtatcatcagatctactttaaagaggtgtaatgaggactcagtgagct

SEQ ID NO: 6770520 - DNA, 89 bp, Homo sapiens
tcaataaaacttcaacaagcattggtggtaaaagcatgaaaatgtgctgcatttatttaaacattaaaaacttgttggagggtatctga

SEQ ID NO: 6770521 - DNA, 68 bp, Homo sapiens
agggcatatgtgtagttaaagtctaacaaatcctacttatatagtactgtgataatactatatgctct

SEQ ID NO: 6770522 - DNA, 74 bp, Homo sapiens
gcacctcagaaagcaagatgcatccgtcaagagtcgcacctccatggaaggcgtgttgctaatgtgaaatgtgc

SEQ ID NO: 6770523 - DNA, 83 bp, Homo sapiens
aagaaacagtttcattttcatgaccagcaaggggttcaggaagcatcctaccacagggtccctggaaatgaaacctgaatctt

SEQ ID NO: 6770524 - DNA, 57 bp, Homo sapiens
aagtatgttgagttttgctttagtatacttgatgctaagccagctgttcagctactt

SEQ ID NO: 6770525 - DNA, 88 bp, Homo sapiens
ttgagatatcttctgttcaaattgattttggtaaagctgtcaatcatagaattctgaatgcagtgtatagagttggaagatgactcag

SEQ ID NO: 6770526 - DNA, 71 bp, Homo sapiens
atctagtttattttgtgtcttttatgaggaaaagaaacattacttttctggaatatttgacacaattaggt

SEQ ID NO: 6770527 - DNA, 70 bp, Homo sapiens
ctattatgcggtaacagttgtgggatgttggtcaacttattacagttactggtactgttaactataatag

SEQ ID NO: 6770528 - DNA, 117 bp, Homo sapiens
cagaagtctgtgggggaaattcatttcttagtttaccaaaatagactttgaggccaagaatgttgaagccttctaactaattggaaatggaacctggattcaaacctaagacttctg

SEQ ID NO: 6770529 - DNA, 64 bp, Homo sapiens
gaatataatatgtatgtttatatgttggtatttttctaacgaatatgtatgcatgttggtattt

SEQ ID NO: 6770530 - DNA, 130 bp, Homo sapiens
catgtggaggaaggaggcccagcccaggaggcaggactctgtgctggggacctcatcacccacgtgaatggggagcctgtgcatggcatggtgcatcctgaggtcgtggagctgatccttaaggtgagtg

SEQ ID NO: 6770531 - DNA, 58 bp, Homo sapiens
ctgactctgagtggtgtcaccaaaaccatggatcaagggggcatcaagacagagttag

SEQ ID NO: 6770532 - DNA, 63 bp, Homo sapiens
gacaggcttcctaagtgccagatgccaactgtgccagtcccggcccttatgggaaggcctgtt

SEQ ID NO: 6770533 - DNA, 55 bp, Homo sapiens
tccagtgtggacccctgcagtcatatcatattcctgagccagggccacacatgga

SEQ ID NO: 6770534 - DNA, 77 bp, Homo sapiens
ccttagaaggtaatgaaacagcagctaattaactctggtaaagccttgataggttctgctttattatcttaattagg

SEQ ID NO: 6770535 - DNA, 55 bp, Homo sapiens
ggcttccagccttttctcctctgtgggtcacctcaagatgacaaggctggaggct

SEQ ID NO: 6770536 - DNA, 77 bp, Homo sapiens
ggtaataattcatgatggcagaaaggattattttagaagtctatcttttcagtttatgtcttgaattaatatttgcc

SEQ ID NO: 6770537 - DNA, 110 bp, Homo sapiens
ctgaacacttgggaggcatgtgggctgggctagggcacagccactctggaccctcctgctgagagccccagctgagacacagacccttggccaaccccaggaatgtccag

SEQ ID NO: 6770538 - DNA, 88 bp, Homo sapiens
gggtgataagagatgctgacgtttacatttctctttcttcttcagtttcacaagataagtgatcaactctgtattctcatatcacact

SEQ ID NO: 6770539 - DNA, 80 bp, Homo sapiens
gcaaagtatgtgacatatctcagtttgaagatttcttacctcttcaggcttccgtaatatgttattctcatcatatttgt

SEQ ID NO: 6770540 - DNA, 88 bp, Homo sapiens
cctcctgagtagctgggactacagaccacaatgcccagctaattttttgctgttgttgatatgtggtctcgttatgttgcccaggctg

SEQ ID NO: 6770541 - DNA, 78 bp, Homo sapiens
ttttggctattgttaacagtgctgttataaatgtacatgtgcatgtatttgtttgagtacttgttttcatttctagaa

SEQ ID NO: 6770542 - DNA, 81 bp, Homo sapiens
atgtccaagttaaccaatacaaatattgttatgcttctagattctgcgatgtatgcagtatttgttagcttttcaggatgt

SEQ ID NO: 6770543 - DNA, 75 bp, Homo sapiens
tttgaactttgttctgcatgcatctgtttcacctatcattagtaggaccaagtggagtgcaggtcaatgtttaga

SEQ ID NO: 6770544 - DNA, 105 bp, Homo sapiens
tctggcttggtttctaagagctttttggcttttatgcagcttaggtggtctatttcatctagattaggtataagagcttcaaaagctaatggcagggctgccagg

SEQ ID NO: 6770545 - DNA, 66 bp, Homo sapiens
gaaggtcagaagtctgctattaatctcatgaggctaaaatcaaggtgttagcagggcttgtccttt

SEQ ID NO: 6770546 - DNA, 80 bp, Homo sapiens
gtttgatgaaggtagaacatttgtagcagctgagtgatctgcttaggacctcagccaggagagtgttcacagcatcaagc

SEQ ID NO: 6770547 - DNA, 55 bp, Homo sapiens
gggagactctcctctgctctcttgggaaaagcctaggagagccacatagtctccc

SEQ ID NO: 6770548 - DNA, 79 bp, Homo sapiens
atttcaatgtcatatatttagttgtgcaacagtgggacaatggggtactatgtgaacagctaactgtgtggaatgagat

SEQ ID NO: 6770549 - DNA, 60 bp, Homo sapiens
tttacaaagatgtcatatgtgctcatgtgtttacaaatgtacattgattatgtttgtaga

SEQ ID NO: 6770550 - DNA, 99 bp, Homo sapiens
ctgccggctcaccccgtctccatgccctctggtttgtgtcatctccaaatatcaaaagcagtcatcagaggttatgtggaggggagggggagctttcag

SEQ ID NO: 6770551 - DNA, 69 bp, Homo sapiens
atgcatgggagaaggcaaggggaggtgacctcatggaacaggtcatccagactttgcctctgccagtgt

SEQ ID NO: 6770552 - DNA, 81 bp, Homo sapiens
gcaggacttctcttcaggaaggagctttggaacttccatagcatttatttcaggtatcaaagttgtcctgtgaagttttgt

SEQ ID NO: 6770553 - DNA, 55 bp, Homo sapiens
ccacaggactgtggaaggatctcttgaggtcaggagtttgagaccagcctgctgg

SEQ ID NO: 6770554 - DNA, 62 bp, Homo sapiens
aggggctgcctggcttggcactctcggggccgaggggaaagtacagcagccagggggcccct

SEQ ID NO: 6770555 - DNA, 57 bp, Homo sapiens
ttaaaatggtacctatagatgtctaggtcttatagaagtgtttggggatcattttaa

SEQ ID NO: 6770556 - DNA, 63 bp, Homo sapiens
catggacagtgggacagtgtgttacatgcctttttctgtgtgacatattgtccatacttcatg

SEQ ID NO: 6770557 - DNA, 72 bp, Homo sapiens
gcctcttatggccctcagagtttggttaagttgcagaacctgtttaagcctgtggtgtcatctgtaaggggc

SEQ ID NO: 6770558 - DNA, 60 bp, Homo sapiens
tgaggcagcctggtttgaatggaaggaaagagcctggaccacagcagataggctgtgtta

SEQ ID NO: 6770559 - DNA, 61 bp, Homo sapiens
gggtgtgtgttgtggtgaggaggagcggaagtcggaagctccagccgtcacagccacattc

SEQ ID NO: 6770560 - DNA, 93 bp, Homo sapiens
tctcaagactcacttgcagggctctggcgagggatgagttgatgtgaaagatcacagacctggccccgcacggtgcccccaggctcttagaga

SEQ ID NO: 6770561 - DNA, 65 bp, Homo sapiens
atgttttcttgggctcttaggtcgtgtccgacttggcatatcactatctgagggtccagatgcat

SEQ ID NO: 6770562 - DNA, 62 bp, Homo sapiens
ggctaggcaggcaaggtagacagaggaagctgaatacattttctcctctcttgcctgcagcc

SEQ ID NO: 6770563 - DNA, 57 bp, Homo sapiens
tgaggatggggagatggtgtctctcaatagatgaatgaagccaactgcccattttta

SEQ ID NO: 6770564 - DNA, 81 bp, Homo sapiens
aagtggcactctttgattctcatgtttgaggttctaattgctacctcatgcaggacttacgagagatcagccatgctgctt

SEQ ID NO: 6770565 - DNA, 59 bp, Homo sapiens
tagcatttgatctcctgaataaacagatagcctttgtttgtgactccagatcaaagcta

SEQ ID NO: 6770566 - DNA, 64 bp, Homo sapiens
cctcacttcatcctcacaaaactagcaagtaaaggccctgcttctctagatgaggtgaagatgg

SEQ ID NO: 6770567 - DNA, 60 bp, Homo sapiens
tatgaggctaagatgttcagtggctgtcgaaacaaatgtcccctgaatttcttacccgta

SEQ ID NO: 6770568 - DNA, 57 bp, Homo sapiens
ggacaaagtgagatgggagtcagaggagcaatgtcctcagcaaacacttcactctcc

SEQ ID NO: 6770569 - DNA, 86 bp, Homo sapiens
tgtgtttgtttacacagaaattaatatgctttatcatgtacaattcaaaagatgaggcaattgtttgtgtaatagggcttaacaca

SEQ ID NO: 6770570 - DNA, 87 bp, Homo sapiens
tatatgaggatgtccattgcagcattcatttggagaataaaatattgaaaaaccactgaaagtccagcatggtacatccttactatg

SEQ ID NO: 6770571 - DNA, 110 bp, Homo sapiens
tctgaggataccatggcacgtttgcccacaggtgcaagttttttgaggaagtgggcaaactcattccccagaggcctgcacagaggcaagctcttcagggggtcctcaga

SEQ ID NO: 6770572 - DNA, 75 bp, Homo sapiens
ggttgtaagcagatctgggtagtgcaagacatgaactctgccagatccaaactatgcatctccccagatacaatc

SEQ ID NO: 6770573 - DNA, 90 bp, Homo sapiens
cttgataatacgtttagtgcaatctcttcctcagcatgattaactgtaatagggctgctgctgaaaaggtgtgcttaatgtattgtaaag

SEQ ID NO: 6770574 - DNA, 78 bp, Homo sapiens
gacaaggtatgaaggctttatgtgaccaaaagaaggttcagggagttctgttgtacacatggggttttcaccttagtt

SEQ ID NO: 6770575 - DNA, 114 bp, Homo sapiens
atggtacaacccgcaaaccttggtagcatttggacattgtcaccttttgattctaggacacaggaggaaaaatgttccaaaatgtttctctgggtcttagagggtgttaatcat

SEQ ID NO: 6770576 - DNA, 80 bp, Homo sapiens
gtttcagagtttgagggaacccaaataggaaaattgatggagtcattttcctctgctggtgttcaagtcagatttgaaac

SEQ ID NO: 6770577 - DNA, 62 bp, Homo sapiens
tagtgtgtatggtaatgatgaatgctggtggggtatgtgtgtgtccttaactgtatatacta

SEQ ID NO: 6770578 - DNA, 108 bp, Homo sapiens
gaaataagcagaaaatgcttttggggtattttttccagtaaatagcagagtgacaacaagcctgttatttgctggaagagtttgtttaagctttttttgttgcttttc

SEQ ID NO: 6770579 - DNA, 79 bp, Homo sapiens
gtggtggtgcatgcctatagtctcagctactgggagggtcacttgagcccaggagttcgaggctgtagtgcactatgat

SEQ ID NO: 6770580 - DNA, 61 bp, Homo sapiens
cttttctctgaatttctagttagtgtctgtggaatttcataaactgagagttcaggaggag

SEQ ID NO: 6770581 - DNA, 130 bp, Homo sapiens
ttacccatgggaaagggcataattagctgttttctaatgcatttgacgtgaagatgcttgaatcagcacataattgaatgtattaatagaagtagcaaattctaattatgagacttagttgttggggtag

SEQ ID NO: 6770582 - DNA, 58 bp, Homo sapiens
ggtgcaatctggttaatacgactcaggagagggactgatctttgatctgattgtcatc

SEQ ID NO: 6770583 - DNA, 88 bp, Homo sapiens
tcatgtctgtcctactagttatagtctcactcatgttgaatccaattcaacatgccgtgacatatagctaataaaagggcatctgtga

SEQ ID NO: 6770584 - DNA, 105 bp, Homo sapiens
gccctcagcgccccggaagggtacggggcagcctccaggaaagctgtcaggagacgcttcctcccgaggtggtcccggcggccaagtggggctcggttgacgggc

SEQ ID NO: 6770585 - DNA, 60 bp, Homo sapiens
gcttgactaggctctggcgacaagaactggacgcttctggaaactcaggcctggacgagc

SEQ ID NO: 6770586 - DNA, 56 bp, Homo sapiens
tcctctttctcaacattagttagcatgggaaagttaacatgatgtgcttcagaggg

SEQ ID NO: 6770587 - DNA, 68 bp, Homo sapiens
ctggagcccaggaggtcgaagctgcagtgagctgtgattgtaccactgcactccagcctgggtgacag

SEQ ID NO: 6770588 - DNA, 73 bp, Homo sapiens
atttccccctcctttgggtgaattcctctcttgattagctcaggaacggaatgtgatccaatctgggcaaaat

SEQ ID NO: 6770589 - DNA, 80 bp, Homo sapiens
gggcttaccttagaggcaggaagaattgcatgttaagaaagctgcatacactctggctttttgctctttgagtttagctc

SEQ ID NO: 6770590 - DNA, 81 bp, Homo sapiens
tctagggcagccttgtcccatggataccaggctatgatgcatgttgcagacgtatctccatggccaaggtgcagcactggg

SEQ ID NO: 6770591 - DNA, 85 bp, Homo sapiens
gatctgttccctggcatgatgtgttcattgaaaaccctgtatagaggagtttcacattagatatgtcatttctttttaacagatc

SEQ ID NO: 6770592 - DNA, 66 bp, Homo sapiens
gtgctgaagtcagtgaaaaggcatcatccaaacacaatccaaggaaaatgcaagctgatacagcac

SEQ ID NO: 6770593 - DNA, 66 bp, Homo sapiens
tgtagtcccagctactcaggaggctaaagtgggaggattgcttgagcccaggagttggaggctgca

SEQ ID NO: 6770594 - DNA, 55 bp, Homo sapiens
actctgtgaccttcagcaagttacttgacctcatttagctggcagttacagatgt

SEQ ID NO: 6770595 - DNA, 55 bp, Homo sapiens
gaggaaggtgtactgggaccctcaaaatgaggcctagacagtgaggcctttcctc

SEQ ID NO: 6770596 - DNA, 82 bp, Homo sapiens
ggcagaacccagggagacagtggtagggcctaagtctggagcggcagacaaggccttgctgtctcctcctttcttctctgcc

SEQ ID NO: 6770597 - DNA, 84 bp, Homo sapiens
gcagagggtgacagtttccattttcatagtacaaggttctcctaaaagactctgggagaggacaaacaaaatgttactctctgt

SEQ ID NO: 6770598 - DNA, 124 bp, Homo sapiens
gttattaggctgacgtgcaggatattctcaggacttggttagtgttttgtacctgtgttgcagtcactggctggagttttcattacatgtctttcagagtcaccatataaaaatgtttaatgat

SEQ ID NO: 6770599 - DNA, 76 bp, Homo sapiens
agtactttcggaaatgtcttcagttctgtattgtgttcacatacacaaacaggctttacaagattgcttcggtact

SEQ ID NO: 6770600 - DNA, 74 bp, Homo sapiens
tggggaagaagagcttgtcaaaattccagatttctgtctctgacaccaatcttctacttgacagttctctcaca

SEQ ID NO: 6770601 - DNA, 74 bp, Homo sapiens
aagtagtaagagaacagggagtacggcacatttagtcaaaggctaggctggctgaaaaacacccttgactactt

SEQ ID NO: 6770602 - DNA, 79 bp, Homo sapiens
ttgtcattctacagtcagagtgcctttctaacttcccttaagatgtaccctgttggaggctgactactgaagaagagaa

SEQ ID NO: 6770603 - DNA, 88 bp, Homo sapiens
agtaacgtagataagtcttccatatttctagatgcaggtggcaaaactgaactatagtaattctggcaagacttatgtatgtctaact

SEQ ID NO: 6770604 - DNA, 84 bp, Homo sapiens
ctgtggctgcagggcaggggtaggggagcacagtccatgctgccagcagcagctcccactgcagccctgagccctcgcccccag

SEQ ID NO: 6770605 - DNA, 91 bp, Homo sapiens
gggaaaggcagaagccagttcaaaggcaggatagcagctgagtctaaaaataaagattagttccgtttatgagtggctttttctgccaccc

SEQ ID NO: 6770606 - DNA, 58 bp, Homo sapiens
caaagagtagtccagtgctgagctgcacagctgcaattctggacatagtctcatcttg

SEQ ID NO: 6770607 - DNA, 55 bp, Homo sapiens
ccaggtgcttgtacctctgagcttctatagccttctgagcatatgcagcacctgg

SEQ ID NO: 6770608 - DNA, 59 bp, Homo sapiens
ctgcgtttgggtagaggcgagtaaaaaaattaaagcgtgtacatttcggcccgatgcag

SEQ ID NO: 6770609 - DNA, 68 bp, Homo sapiens
tgctgcaggccaggtcgttgtcccaccccaccccatcccatcccagtgtccacctacctcctgcagca

SEQ ID NO: 6770610 - DNA, 98 bp, Homo sapiens
tcttctccagggcttcagcagacattattttctggcatcaaataaagggaattggagccttaagaatatagtgttgctgttgtctactgtggactgga

SEQ ID NO: 6770611 - DNA, 70 bp, Homo sapiens
gccagaaggggtggatccaggcctctgacaccaagtccaagtcctctgtctgcgtttccacacctctggt

SEQ ID NO: 6770612 - DNA, 76 bp, Homo sapiens
tctttagaagggaggcagttttatttctttaaagtcataatttctattaggcaaataaaatgtttccataaaaaga

SEQ ID NO: 6770613 - DNA, 69 bp, Homo sapiens
tggggggccgggccatgagggcagtgactgtgggtgggaccgggtggcctcacagggccaggcccctca

SEQ ID NO: 6770614 - DNA, 61 bp, Homo sapiens
agcaaagtggctttccaaaccatagtctactttttctagtttttgtatgagtcattttgtt

SEQ ID NO: 6770615 - DNA, 58 bp, Homo sapiens
cagggccttcgtaagtgtccggccccaagcatcctggggtggacgtctgaggtcactg

SEQ ID NO: 6770616 - DNA, 73 bp, Homo sapiens
cctccggcatcacagagctcccttccactgggggtgaagcactctcccagcagcagcttagtggtccccaagg

SEQ ID NO: 6770617 - DNA, 58 bp, Homo sapiens
gcctaggagtggggatggcggtggcgggatcatgcagcgcgcctcgccaccctgcggc

SEQ ID NO: 6770618 - DNA, 57 bp, Homo sapiens
gtactgcacccagtctcagtaaatatttacaacatggtgagaaggggtcagctgtac

SEQ ID NO: 6770619 - DNA, 107 bp, Homo sapiens
ctgtgtacttcagatgtttcatgctagcatgtgtgtgtgtgtgtgtgtgtgtgtgtgtgtgtgtgtactgtatatatgttccagtgtgtgaaatgtctggtggacag

SEQ ID NO: 6770620 - DNA, 90 bp, Homo sapiens
aacgctaaatttataataactctaatggatacaaaagagaaaacactcctcattacttgtactgcttggtgttgttgtatctttattgtt

SEQ ID NO: 6770621 - DNA, 60 bp, Homo sapiens
gtctgtatttatgcaatgaggggagtgttgctcagagaccttaaggcatgagtgctggac

SEQ ID NO: 6770622 - DNA, 59 bp, Homo sapiens
ggccagcgattggaggacctctcccattttaggagaggagcccctcttcagtcctggcc

SEQ ID NO: 6770623 - DNA, 60 bp, Homo sapiens
agacacttcctagattcttctgccttatgcctgccttggtcagtgtagctaggatgtgct

SEQ ID NO: 6770624 - DNA, 63 bp, Homo sapiens
catccctgattcctagtacagtcaaacctgcgttttaggccatggtgggtacagggagggatg

SEQ ID NO: 6770625 - DNA, 59 bp, Homo sapiens
gcccaggaaggccaaggctgcagtgagccctgatggtgccactgcacttgaccttgggc

SEQ ID NO: 6770626 - DNA, 69 bp, Homo sapiens
gcctgtgcatagcagcggactcccttagacgtgtgtttatttttcactgtagttcgttgcagctcaggc

SEQ ID NO: 6770627 - DNA, 65 bp, Homo sapiens
gttggactaaatcagacttttccaaagtcttctgagatgctcttttggaaaaagattttcccagc

SEQ ID NO: 6770628 - DNA, 77 bp, Homo sapiens
ggctaattttacatgacaatggctgctctatgctctttcatggagcattggaatggctttgcatgtcccatgtggcc

SEQ ID NO: 6770629 - DNA, 60 bp, Homo sapiens
taatttatagttgcagtaggggtagataaagatgtcatgtgtctgctgcagctgttgttg

SEQ ID NO: 6770630 - DNA, 56 bp, Homo sapiens
cgaggtgatggcatttagactcacttaaactcagagttgatgtcactgtaaccttg

SEQ ID NO: 6770631 - DNA, 56 bp, Homo sapiens
gggtcccctcatcatggagactcccctcagaaatagtcttcagcagggttaaaccc

SEQ ID NO: 6770632 - DNA, 77 bp, Homo sapiens
aaggtgtgttactgtggttaccagaagcttctctcattccaggaagaatctgctttctgggctatagaacgggcttt

SEQ ID NO: 6770633 - DNA, 59 bp, Homo sapiens
ccttctggatgggttccgtgggcaaatggcattctggagcacaaaggacccaccggcgg

SEQ ID NO: 6770634 - DNA, 70 bp, Homo sapiens
taccctcagagaactccacaccttagggctagcagagcttgtccagggatgatagttttcctgttgggtg

SEQ ID NO: 6770635 - DNA, 60 bp, Homo sapiens
ccgagtggcaggtatccaggaagcttgattcgacagctcccagggacactggccactagg

SEQ ID NO: 6770636 - DNA, 70 bp, Homo sapiens
ggctgagtccccttcatctggatgtctggttagaagaactctcatccagagtccaaggctgggctctccc

SEQ ID NO: 6770637 - DNA, 130 bp, Homo sapiens
aggtctcagaaataagtggaattgatacatagatagactgtatgagatcctctagagaaactgggtaatgcagaggcatttattgatgtatacaaaataattcacttgaatttaactctggtaatagcct

SEQ ID NO: 6770638 - DNA, 108 bp, Homo sapiens
ggaggctgaggtgggacaagttccttgagcccaggcattggaggctgcagtgtactgtgattgcaccattgtactccagcctgggtgacagagggagactcagtctct

SEQ ID NO: 6770639 - DNA, 77 bp, Homo sapiens
ggggtcagtaggaacctagggtcaaaaaatgggatacagtctccccctttatgcagttgatcttttcttgctgcccc

SEQ ID NO: 6770640 - DNA, 61 bp, Homo sapiens
cctgtgctggaccctggaaggtggtaagcagcttgcctgccctttctgatccagtcagagg

SEQ ID NO: 6770641 - DNA, 66 bp, Homo sapiens
atttaggtagttttcagtcttttgcagtcacaagcaattctgcattgagcaagcttttgcctaagt

SEQ ID NO: 6770642 - DNA, 59 bp, Homo sapiens
agcttcccaaggttggaaggttatgtttttaaattttaagtttgaactttcgggaggct

SEQ ID NO: 6770643 - DNA, 66 bp, Homo sapiens
gagggggagaggtttatttcattaagatccattatctttgacctgaaatcagaacccttacctctc

SEQ ID NO: 6770644 - DNA, 67 bp, Homo sapiens
gcctggtggtgtgctcaagtggctttaggctgaagcagcatgactgatagcacatcctcaaccaggc

SEQ ID NO: 6770645 - DNA, 69 bp, Homo sapiens
gcatggggagtagttagctaggtgccaaggggaggggaaagtattccaggcaaaaggaactgcttgtgc

SEQ ID NO: 6770646 - DNA, 78 bp, Homo sapiens
tcaataaatactagttaaatgaatgaatgagttaataataaacaaatacgttgattgattgattgactggttgattga

SEQ ID NO: 6770647 - DNA, 94 bp, Homo sapiens
aggggaggatacagacttgggagggcagagactcagaaacagaatgttcgcattagggacatggtgttgcggggagctgcctcccccagcccct

SEQ ID NO: 6770648 - DNA, 62 bp, Homo sapiens
ggtgatgccatttgctggaaggaagtgaagttgaccactcttacagagtaaatggccaggcc

SEQ ID NO: 6770649 - DNA, 70 bp, Homo sapiens
tcctctgaagatgcatggaaatctcattacaagtgttcaacacctgttttctaaaaggtatccagaagga

SEQ ID NO: 6770650 - DNA, 55 bp, Homo sapiens
ggtggttcacgcctataatcccagcactctgggaggccgaggcgggcggatcacc

SEQ ID NO: 6770651 - DNA, 67 bp, Homo sapiens
cctaatcacagaaggcagtcttctagtgaattcaattaactggaaaatgccttgtgtgagttaatgg

SEQ ID NO: 6770652 - DNA, 75 bp, Homo sapiens
ggcaccatgagtcccgtgtccaaaggctagccagggaagattgcaggtagccagtgccatgggactgatggcgtc

SEQ ID NO: 6770653 - DNA, 76 bp, Homo sapiens
tagaatagtgttgaccacttagaggggccacttaagtatttgctgaatgagtggattctgagtagaacctagccta

SEQ ID NO: 6770654 - DNA, 67 bp, Homo sapiens
aggattctctgcagactggagagaagacaaagaatattccatcttccagaatctcagagggcttcct

SEQ ID NO: 6770655 - DNA, 60 bp, Homo sapiens
acctgagaattttctagtagtttcatccattttggaagataactaattaaattcctgggt

SEQ ID NO: 6770656 - DNA, 74 bp, Homo sapiens
ttttggtatattcagtaaacatccactattatcattcatttatgaaaattgtgaaggtttctgaaatactagga

SEQ ID NO: 6770657 - DNA, 101 bp, Homo sapiens
gctgagtattatgtggggaccatccctgggcagagtccggaagatgggggtggaatccccgtttagtttgtttgcttcgggggttggcccttcagctcagc

SEQ ID NO: 6770658 - DNA, 73 bp, Homo sapiens
ctcagcgcgagacctggcaggtgggagaggctcgctcatgagagctagaaaacagcctgcctgggtttctgag

SEQ ID NO: 6770659 - DNA, 77 bp, Homo sapiens
gggcctcctgggtccaggcataggaacagaacctactgctcaggtccctgatgccttgatccgtggactgctggccc

SEQ ID NO: 6770660 - DNA, 55 bp, Homo sapiens
tctgttaacctggtcttggctttttttggagtgcctggagtaaaccagtaacaga

SEQ ID NO: 6770661 - DNA, 74 bp, Homo sapiens
tttattggctggctgtcttctgggagctgtgcttagctcttcatggcttctcatgagaaagccttgccaagaaa

SEQ ID NO: 6770662 - DNA, 88 bp, Homo sapiens
aacagtaaaagagacagttacttaagtttgctttgtaaataacttaaattttacaaggaaaatcttgaagtacagaattcttactgtt

SEQ ID NO: 6770663 - DNA, 68 bp, Homo sapiens
gcaagctgagttatggagaataaagtcatgcttttcatacacctgagtttatggccatgattcaaggc

SEQ ID NO: 6770664 - DNA, 83 bp, Homo sapiens
aaagaagttacagttacagaatggagtagttgtttaccatttgctgctctccctttagatattcaaattgccccgacttcttt

SEQ ID NO: 6770665 - DNA, 72 bp, Homo sapiens
gataataggatatgagcaatgaacccttgggtggggttccagggcacttaaattgcctcgtgtcttgagttc

SEQ ID NO: 6770666 - DNA, 60 bp, Homo sapiens
gacagatcattgattttcactcactgtgcataaaacacagttgactctcaagatcctgtt

SEQ ID NO: 6770667 - DNA, 62 bp, Homo sapiens
ttccaggctagaaactgaggcacagttgggaactgatgcaattagattgtaatttcctggaa

SEQ ID NO: 6770668 - DNA, 74 bp, Homo sapiens
tgctgattagatgtgaccttagataaaatgctaaatgagaatgcgttatgatctgaaagtcctgtctacatgca

SEQ ID NO: 6770669 - DNA, 66 bp, Homo sapiens
tattctgacatttgtcaaaatgataagaaagactattcaggattattgtgataggtgtcagtgata

SEQ ID NO: 6770670 - DNA, 55 bp, Homo sapiens
ttggccacaatccaagccttgggtgggatgaagccaggcctggttcactggccaa

SEQ ID NO: 6770671 - DNA, 59 bp, Homo sapiens
ttttagtttggatttctaaagctgctcctctttgaagcagctttaagacacagctaaaa

SEQ ID NO: 6770672 - DNA, 76 bp, Homo sapiens
ggaggaaggcccagcaagaacaatcagggaacaaggacagaatcctggatttgcctatggtgctttatgatcttcc

SEQ ID NO: 6770673 - DNA, 77 bp, Homo sapiens
gctgcttgcacatgttggttcttgaaaccttagctagaagaatttcaggtcataccaacatgtggataggctatagc

SEQ ID NO: 6770674 - DNA, 89 bp, Homo sapiens
gcagggccgcggcctctcccctgtccttgggctgagcctggccagctgcaggcagctctggcgtcagggagcgagggcggtgggtttgt

SEQ ID NO: 6770675 - DNA, 56 bp, Homo sapiens
actcaaggtgtggccctagggacccccgccttgcccctgtgggcctcacttggggt

SEQ ID NO: 6770676 - DNA, 61 bp, Homo sapiens
tgtctgcttcagtgttaagcccttgaccttaattaaaggccttcacaagaaagggcagaca

SEQ ID NO: 6770677 - DNA, 97 bp, Homo sapiens
cactgaggtgtggggcacacagatgcttcagtaagaatgcattcactcatccagcaaatgcgtattgagcatctactatgtgcctaacagttaggtg

SEQ ID NO: 6770678 - DNA, 68 bp, Homo sapiens
caccctagcgtagtgtgctgagactgtaatagtaatgattattacactcatattgcacttaccgggtg

SEQ ID NO: 6770679 - DNA, 57 bp, Homo sapiens
cctcagtcttgaattagccagatgtgcctttcagtccttggctgagctggactgagg

SEQ ID NO: 6770680 - DNA, 55 bp, Homo sapiens
cttctcagcttaggtatggtttctggtggaatagggctggactggacctgagaag

SEQ ID NO: 6770681 - DNA, 71 bp, Homo sapiens
tgtcatatcacagtatcacatcctctaaggcaaaaaccacttttgctgaaaacagtgggtattgataggca

SEQ ID NO: 6770682 - DNA, 100 bp, Homo sapiens
agcaattctcctgtctcagccttccaagtagcagggattacaggtgtgtgccaccatgcacggctaatttttgtatttttagtagagacggggttttgct

SEQ ID NO: 6770683 - DNA, 68 bp, Homo sapiens
tgggcagtcttatcagcattggacatgcataatcttgccttgcaaagtttttgctatgaaattgcaca

SEQ ID NO: 6770684 - DNA, 95 bp, Homo sapiens
catagaatttattcacatttcgcatcagtccgataaacttccattgagtactagtgtgggccagtcactgtgctaggtgctgaatataatctgtg

SEQ ID NO: 6770685 - DNA, 65 bp, Homo sapiens
tctgagttgctcctcctgtctgtgggccctgggggaattaggtacagaaggagtagtcactaaga

SEQ ID NO: 6770686 - DNA, 59 bp, Homo sapiens
gaaactgtttctggctttggtgctttgtgtactcactacagccattttaccatagtttc

SEQ ID NO: 6770687 - DNA, 83 bp, Homo sapiens
gcacataataggcattcaacaaatgtttgtggttgatgatactgctactagcagctactgttgattgaacacctattgtgtgc

SEQ ID NO: 6770688 - DNA, 114 bp, Homo sapiens
aatgacaagaatgtaaacagtgcttagaaagtccccttcttctggtgcctgtggatgagaatcacagtaaaagcatggaagaggcaggagaagacaaggcactagctggtcatt

SEQ ID NO: 6770689 - DNA, 91 bp, Homo sapiens
gctggcacaccgctgacatttagtatcccactgacattagcacaccgctgacattagcaccctgatactagaatgttaaggatgtgccagc

SEQ ID NO: 6770690 - DNA, 115 bp, Homo sapiens
cttccatttagaactattaggttggtgcaaaagtaattgcagttttgccacttttgttggcaatatccacaattacttttgcaccaacctaatactattttgttcaatatagaag

SEQ ID NO: 6770691 - DNA, 56 bp, Homo sapiens
gcttaagatgtttgtggcaatttgacatattagcaaattggagagatgtcttaggt

SEQ ID NO: 6770692 - DNA, 58 bp, Homo sapiens
gttgtacaggactgcccagtgtgttgagactatttggcatcactggcccctgtgagac

SEQ ID NO: 6770693 - DNA, 72 bp, Homo sapiens
tcacattgattacattccatgtatatgtttgtctttgacatttctttaaacagggaaaagtcatcagtgtga

SEQ ID NO: 6770694 - DNA, 128 bp, Homo sapiens
gaaatcctaacacaaccacattagttgagatttatttagctgcattatcaaagttatgtcaattgatgtgtacagtgatttgagttcacatcttaatttctgtgatgttaggtaaataatttcatttc

SEQ ID NO: 6770695 - DNA, 73 bp, Homo sapiens
ttgggattttacttttaagcgtattaactgtgaatgtccaaacagagataccaaataggcagttagatcccag

SEQ ID NO: 6770696 - DNA, 105 bp, Homo sapiens
gtaaatcacagcaggtggattggagaagatgggaatttatgccaccaaaccaaggtgagtctaccattgcttttcctccagtatccccccacctgaatgcaatac

SEQ ID NO: 6770697 - DNA, 92 bp, Homo sapiens
agaaaagcttggtattgagaggtgcataggaaaccaggttaagatttatctcttagggaatgtgaaaacacctctcaggtttcagtttttct

SEQ ID NO: 6770698 - DNA, 67 bp, Homo sapiens
cagaccacaaatgagctggcaggggctcagggactgccaagtcacccagccttggcgggtttgtctg

SEQ ID NO: 6770699 - DNA, 70 bp, Homo sapiens
gcatggattgattgggtatgtgcatgcacttgtgtgtgtgtggatgcgtgcccacattgtgttgctgtgc

SEQ ID NO: 6770700 - DNA, 90 bp, Homo sapiens
gggagtaagtcccattcactaggcccatgatatgtgttctattttaactttttagcacaaggcaattcctggtgaattatttagtttccc

SEQ ID NO: 6770701 - DNA, 68 bp, Homo sapiens
atgtataaattcctcctctgcgccacccactattctaggtacaggggtaacagtggggaataaaacat

SEQ ID NO: 6770702 - DNA, 76 bp, Homo sapiens
gttagttagaaggaaagtagactatagtcctggggaaatccccagcttctgaaagtctgttttcctactaacagac

SEQ ID NO: 6770703 - DNA, 60 bp, Homo sapiens
ggtgttttcattcttggctgctggaaaatagccaggagaccaagaaaggatgaggatctc

SEQ ID NO: 6770704 - DNA, 70 bp, Homo sapiens
aggtctacttctgtggctctaagagacttgtctctcatggcttctctcggagctaccggaagttgggcct

SEQ ID NO: 6770705 - DNA, 115 bp, Homo sapiens
cattaacattattagaacataatccaatgctggtaatacatgtattccagagagttgagatttttaattaatctgagtgacatgtatttggaatgatctgcatgatgtgacaatg

SEQ ID NO: 6770706 - DNA, 89 bp, Homo sapiens
ggagttttgctcttgttgcccaggctggagtacaatggtgcaatcttggctcattgcaacttcaaactcctgggttcaagcgattctcc

SEQ ID NO: 6770707 - DNA, 61 bp, Homo sapiens
gggaatgtttgagtgccatgtgacgtccagagtgacgttctacatgacactcaacattttt

SEQ ID NO: 6770708 - DNA, 57 bp, Homo sapiens
gttgctctctggtttcgcaggaaatagattgttctaatctttgaaatcagggtcaat

SEQ ID NO: 6770709 - DNA, 65 bp, Homo sapiens
tccgggggatttcttagctacctgagtgactgcccaggtctgcaggctggagtccactgcctgga

SEQ ID NO: 6770710 - DNA, 67 bp, Homo sapiens
ttgaaatggttttgtgaaaatgctttgataacttcccactcaaagaagagatttacagagctttcga

SEQ ID NO: 6770711 - DNA, 58 bp, Homo sapiens
ctgtctgcaggatagtaccctcatgaatttcaatgtgtggggaagtcactgcagtcag

SEQ ID NO: 6770712 - DNA, 84 bp, Homo sapiens
ggatttaggtgaggcattttgtaacaagtaaatatcactgaactagtttttcagaaatatcagttgaaagtgctcatcagaact

SEQ ID NO: 6770713 - DNA, 89 bp, Homo sapiens
tgcttgatgacacctacttagtaggcatttaagatggataaggttatgatcctcatgcagttgaatgtttagtaggggattaacaagta

SEQ ID NO: 6770714 - DNA, 76 bp, Homo sapiens
caggcaccaagagaatcactaatttattcaaagatgattttcatttacgaatagataagtgactatttggaaactg

SEQ ID NO: 6770715 - DNA, 91 bp, Homo sapiens
ctacttagagtaaggacagataaatttaagagaataaatttggttgaaatatctaatttatgacagaagatatgctgtctacactgattag

SEQ ID NO: 6770716 - DNA, 62 bp, Homo sapiens
caatggtccccattggcaggaactgaacccttctctcctctcctttctccgggggactgttg

SEQ ID NO: 6770717 - DNA, 68 bp, Homo sapiens
ggctatgggagtgtggggaagggtgggatatcccaaaccaagagccctcatgctaagaccctgtggcc

SEQ ID NO: 6770718 - DNA, 58 bp, Homo sapiens
acagagttaatggataggcaggtaaaatatatgttgaatgccattcatgtaagtctgt

SEQ ID NO: 6770719 - DNA, 95 bp, Homo sapiens
tccgtgttcttttcctcatctggctggctagaatggaaatgtcatccaagatgttgaaactggcagagtcatggtataggaagagaaagcatgga

SEQ ID NO: 6770720 - DNA, 55 bp, Homo sapiens
ctgaccctggaggcatttctctcacgtgtgggagtaaggggcatcagggcatcag

SEQ ID NO: 6770721 - DNA, 59 bp, Homo sapiens
aacaaagatgccaaaaggaagacagattttcatctgtgatttcaaagggtgtctttgtt

SEQ ID NO: 6770722 - DNA, 62 bp, Homo sapiens
gagccagggatgcagaggttgcagtgagcggagatcaagccactgcactccagcctgggctc

SEQ ID NO: 6770723 - DNA, 77 bp, Homo sapiens
gggtttttaagacagtgtaactatgttgtgtgatactgtcatggtagatacaggacattgtgcatttgtcaaaaccc

SEQ ID NO: 6770724 - DNA, 130 bp, Homo sapiens
aactatgtagttatcgctgaaggtcttttccatcaagttattctgacttatttgtccttggtgtccataagccatgttggccacaggaataagtcaaacttcactctgggaaagcgaatgatttatagtt

SEQ ID NO: 6770725 - DNA, 55 bp, Homo sapiens
ggtgtgcatggcacagggcttgttctaacgagtgtgcagtgagcagtgcagcacc

SEQ ID NO: 6770726 - DNA, 60 bp, Homo sapiens
ctatgtaggagaaaattcaagctgtgaaagagaaaaccagtgcaatggctgcctgcatgg

SEQ ID NO: 6770727 - DNA, 55 bp, Homo sapiens
ttgctctggagaatgcctgattctctgagttattgcctagaggttttcagagtaa

SEQ ID NO: 6770728 - DNA, 69 bp, Homo sapiens
tcatttacttggttttaatctttacctttctttgtcaggaacattgttggattagaacacaggtgttga

SEQ ID NO: 6770729 - DNA, 70 bp, Homo sapiens
ttatatctgtcgtgatccattcccatggatttactggcaacaaagaatcttggattggagaaagaagtgg

SEQ ID NO: 6770730 - DNA, 75 bp, Homo sapiens
tgctgagtaaaagaagctttatataaaagagtacatactgtatgattccatttatatgaagttctacaataggca

SEQ ID NO: 6770731 - DNA, 75 bp, Homo sapiens
tgataaacatttgtacattggcatgtctcctctcagaactcacccccatgaaaggcagccaccgtacagatatca

SEQ ID NO: 6770732 - DNA, 64 bp, Homo sapiens
tgacgcacagtgctaagttaatctctctaatgatattaatgctatttacttgtattgtgcttta

SEQ ID NO: 6770733 - DNA, 108 bp, Homo sapiens
taaataattactgtattcatgtattcatatcatgtgtctttgctttcctgttaaaagttagagctcccgagacaatgtatttttcatttgcagttcatttcctattta

SEQ ID NO: 6770734 - DNA, 122 bp, Homo sapiens
tctccactgtcacacgggcccacgggaggacaactgagcccctgcacttgtgagaacacttcaggctcactggggtcgcctgcagtggtttagggacctgcttcccactgtacagatggaga

SEQ ID NO: 6770735 - DNA, 58 bp, Homo sapiens
gttgagaatgatgagattcttccttctaggtgaggaatattttctctttattttctac

SEQ ID NO: 6770736 - DNA, 73 bp, Homo sapiens
cctatgtttgggcacacaaatattttatgacaaattaatgcataccagtacacattgtgtgctacatgatggg

SEQ ID NO: 6770737 - DNA, 81 bp, Homo sapiens
gctgtcactgaccaggtggaggtgtgaggtcctggggcatcatggcaggaccttggacatccactttctcaggtctgcagc

SEQ ID NO: 6770738 - DNA, 57 bp, Homo sapiens
ctcagggagagccaagagttccgtggacagtcttgaagcttgatgggctcttctgag

SEQ ID NO: 6770739 - DNA, 78 bp, Homo sapiens
atgagttttttaatcctcttggtatcttaatttctccatctacccagtaaggctgttaggaggattaaatgtgctcgt

SEQ ID NO: 6770740 - DNA, 59 bp, Homo sapiens
gcacagtattgcacaactctagggggcaacatctacagtgaaaggtatgtgagctgtgc

SEQ ID NO: 6770741 - DNA, 89 bp, Homo sapiens
tttctttgttttctggagctcagttattttgccactcagattttatctcctccccaagggcagcaaactggcttcaggctacagcaaaa

SEQ ID NO: 6770742 - DNA, 73 bp, Homo sapiens
tgctgcattttgcattttgctaggaaatctaactgcctctgcatgagatcatttggcagaagcaacggtagca

SEQ ID NO: 6770743 - DNA, 58 bp, Homo sapiens
tccagcactgaatgtgagtcatggaggagaaacgtggcatgcaatggacagagctgga

SEQ ID NO: 6770744 - DNA, 56 bp, Homo sapiens
ggagtgtgttaaggatagggcttgacacaaacacgaggtcctaacttagatactcc

SEQ ID NO: 6770745 - DNA, 80 bp, Homo sapiens
ggctgcatttctctttcctatttttaaaaatagcgctagaagcttgtttcaaggaagaattaggaaaactcaatgcaacc

SEQ ID NO: 6770746 - DNA, 71 bp, Homo sapiens
cacactgttgtggcaaatgtgtcctgggtcccttctagtccagggttttatactttgctagtatcagtgtg

SEQ ID NO: 6770747 - DNA, 96 bp, Homo sapiens
gtgggcaacgtctgtccatccctggcctcctggccttctcatttcctcttgcagtggccgtgacagtggaaggagggccgaggacagcttgctcac

SEQ ID NO: 6770748 - DNA, 87 bp, Homo sapiens
ggagtctcgcctgttgcccaggctggagtgcagtggcgtgatctcagctcaccacaacctccgcctcccaggttcaagcgattctcc

SEQ ID NO: 6770749 - DNA, 68 bp, Homo sapiens
gaggcaggtggatcacctgaggtcaggaattcaagaccagcctggccaacatggtgaaaccccgtctc

SEQ ID NO: 6770750 - DNA, 55 bp, Homo sapiens
tatacagtcttttgctatattcactaggtgatggtagtttatgaaatactgtgta

SEQ ID NO: 6770751 - DNA, 73 bp, Homo sapiens
tccacatattctggtgtgtttttgccatcaactgaaaaagcagaattggtcaaaagctactatgaatgctgga

SEQ ID NO: 6770752 - DNA, 88 bp, Homo sapiens
ctactttaattcccactttttagagaacaaaactgaggctcagagaagctaactcaaagttttgttcatctagaaagcagaagagtgg

SEQ ID NO: 6770753 - DNA, 75 bp, Homo sapiens
gtctgatatgagtttgatggctctttatggcatataaaatgtatgttaaggagacacatgaaaaattaacagtac

SEQ ID NO: 6770754 - DNA, 76 bp, Homo sapiens
gcagctgcagctgttttctgagtgcatgtgagacttccagaaatagtgtattcctgaataaacaggtgtcagctgt

SEQ ID NO: 6770755 - DNA, 75 bp, Homo sapiens
gtatttgttgaatacccctgtctttgtttgtgctgctataacacagtacctgagactgggtaatttacaaagaac

SEQ ID NO: 6770756 - DNA, 111 bp, Homo sapiens
gtgggggtaggggaggggacaggccagaggagggctctgatgagggtgttggcccctccagaccctgcccctggagacattatctgtccccaaagccccccatgtcctcac

SEQ ID NO: 6770757 - DNA, 63 bp, Homo sapiens
tagtgggtgtggaactgtgagacctgaattcgaatcctggtttcatattttcatagcttgttg

SEQ ID NO: 6770758 - DNA, 70 bp, Homo sapiens
gggtacttttctgaagaattttaataaaggcaaataaatgccttttctaggatgctttatagtagagccc

SEQ ID NO: 6770759 - DNA, 87 bp, Homo sapiens
gaaaactgatgccgaaaggctgttttgaaaaggagttgttccaagatctcccagcagtgaccttcagacctttctgtatcagttatc

SEQ ID NO: 6770760 - DNA, 103 bp, Homo sapiens
tcattattagttcagcaaaagtgggttcatgtggcattatatcaagtagaactccctattaataggcattaacccactcctttgatattgatgttcataatga

SEQ ID NO: 6770761 - DNA, 62 bp, Homo sapiens
tggaataacctgcttgcagctgtcatggggcggccccctccctgcagtgcatggttcttcca

SEQ ID NO: 6770762 - DNA, 72 bp, Homo sapiens
gaatgcatgaatgggtcattatttgatcaatttccagctttgattagaccttggaccagtttgagagcattt

SEQ ID NO: 6770763 - DNA, 66 bp, Homo sapiens
ccagctacacttctgggtgtgtcaatgtccctgtgtttttagatctgggccactcctggtgactgg

SEQ ID NO: 6770764 - DNA, 63 bp, Homo sapiens
catggaaagcactgttaggcaatgggatctgggatacctcactgccagagcaggctttgcctg

SEQ ID NO: 6770765 - DNA, 60 bp, Homo sapiens
tctctacatgtttgaattgtgtgtgaccaagaattgtgtttcattacaaatttgtaggga

SEQ ID NO: 6770766 - DNA, 58 bp, Homo sapiens
tcgctgacggtcgcggtgtcccgttttaatttagagggcgccagcaacacgtcagtga

SEQ ID NO: 6770767 - DNA, 85 bp, Homo sapiens
cccctgctgacttcaggctccctgctgggctctggagatgcatagatcaacaaggtcccccaggagcttgggattctaagagggg

SEQ ID NO: 6770768 - DNA, 65 bp, Homo sapiens
gggagtgagaacatacaaacagagaaagggatattttctttataaagtatgttttatagtttccc

SEQ ID NO: 6770769 - DNA, 122 bp, Homo sapiens
ctgtgactacagtgaccagaccatactattactaggagcaggatagatgcctactagtctgcggcatgtaaggatatcctctcctaagtaaagaataagctgttgcaccttgtatgccacag

SEQ ID NO: 6770770 - DNA, 92 bp, Homo sapiens
tctcacagaaacatccagctctctttcttgttgctgttgtgaccagagaaacatcatggctccaagatggagagccagctgtttctgggaga

SEQ ID NO: 6770771 - DNA, 66 bp, Homo sapiens
gaggcgggtggatcatgaggtcaggagttcgagaccagcctggccaatatggtaacaccctgtctc

SEQ ID NO: 6770772 - DNA, 55 bp, Homo sapiens
cagggattaacttggcaccttctaaactgaagaaggagccaaattttagactctg

SEQ ID NO: 6770773 - DNA, 114 bp, Homo sapiens
ccgctgcccctctcaggcccgggagcccgcgtacctggcagtcagtctttccgcagcgccgaggtgggtgccggagagagacgccgggaccgggactggcgggccggctggcgg

SEQ ID NO: 6770774 - DNA, 81 bp, Homo sapiens
ttgggccagtgacccttggagtaggatgtatagcaactaaagaaactcatacattactgagaagggtgtaaattggctcaa

SEQ ID NO: 6770775 - DNA, 74 bp, Homo sapiens
tgcattctagttttcagtccaccaggtcaccctctgcctctgagaggtaaccctggttgaggacaaggtatgca

SEQ ID NO: 6770776 - DNA, 56 bp, Homo sapiens
gctgctggactcccaccggcagcagggcgccctgctgtcctcctgggcccagcagc

SEQ ID NO: 6770777 - DNA, 63 bp, Homo sapiens
ggctgcctactttcccagagtttgtaccatgtcttttgagaatggtctgtggagagggcagtt

SEQ ID NO: 6770778 - DNA, 65 bp, Homo sapiens
agctgaatacacagttacatgattcttgtgagctgtagggcacattaagaataatgagactagct

SEQ ID NO: 6770779 - DNA, 56 bp, Homo sapiens
tatgtaggtctctgtgtgtgtggtgtgggtgcgcacctgtgtatatggcttgcatg

SEQ ID NO: 6770780 - DNA, 56 bp, Homo sapiens
cccttgagcatctgtggatttgtggaccaacagtcagaaggaagatgcttaaaggg

SEQ ID NO: 6770781 - DNA, 59 bp, Homo sapiens
cccaggaggaggggtttacattggaaccagttcaggttcggtgcatctttcctcttcgg

SEQ ID NO: 6770782 - DNA, 81 bp, Homo sapiens
ggttgcttaacagagagaagtgttgcttaacttcccagaaaccatttgagctgatactactgttctattataaatgcaact

SEQ ID NO: 6770783 - DNA, 116 bp, Homo sapiens
ccattagctcctggtgccagccctatctctgctccatctctcgtggttccagccggtgcattcacagaccttctgccccgggggacgaggaggatttatggggggagaggagaggg

SEQ ID NO: 6770784 - DNA, 78 bp, Homo sapiens
gggaaaggttgcttggccagtattgaggctatatatctctgtggagaaataagaggtgtcagtctgaccccatttccc

SEQ ID NO: 6770785 - DNA, 75 bp, Homo sapiens
cccctcctggagcatggctttggaggatagcaaccccgaacttgcaatcctgactgctatgtgaccttggggggg

SEQ ID NO: 6770786 - DNA, 59 bp, Homo sapiens
gaggtattccaggaagtgtgggaccaagtagactgctcctaaacctcttggaatgtctt

SEQ ID NO: 6770787 - DNA, 90 bp, Homo sapiens
tggcaacttcataatgtcttccgtaatgttacattctcaaatcatggcatcaccttggaatgtattattgggaaaagaaattatttgcta

SEQ ID NO: 6770788 - DNA, 57 bp, Homo sapiens
tgtctgatagactgattcattgacatacaaacttggtgattctctgactgtcggaca

SEQ ID NO: 6770789 - DNA, 68 bp, Homo sapiens
gtgtttggaattggcattctattctatggtcataatttacagagttgtttagtggtagttctaaatgt

SEQ ID NO: 6770790 - DNA, 56 bp, Homo sapiens
gcaggagagtctgtgccaggttccatactccttatcttccacacgtgacctcctgt

SEQ ID NO: 6770791 - DNA, 65 bp, Homo sapiens
agtgcttagtaaattgtcgatgttaatattattaatgaaatttaatcctgacaatgacaagcact

SEQ ID NO: 6770792 - DNA, 83 bp, Homo sapiens
taaatagcttatttttaacatgaggcaagtctcaatctttgaaggtttcaaagtataattgcttttttggaaaaggctatttg

SEQ ID NO: 6770793 - DNA, 73 bp, Homo sapiens
cctgctcgttggaagctccacctaagccttgttgccaggaaatgccacaaggcctgtggggctgctttgtagg

SEQ ID NO: 6770794 - DNA, 66 bp, Homo sapiens
atgcagaagcagaggagcctatgagtagaaatgacactactcagaagcaagcttctacttctgcat

SEQ ID NO: 6770795 - DNA, 66 bp, Homo sapiens
caggggatctgcctgctttcttacatgtttgtttctatggacagatagaaatcagcatgtcctctg

SEQ ID NO: 6770796 - DNA, 59 bp, Homo sapiens
tttcaagttataaaagtcggcagtttgaaagcattcatcctgcatctgtgacttgcaaa

SEQ ID NO: 6770797 - DNA, 70 bp, Homo sapiens
tgaatttcactgacagtatacttacgcttcttattcaaaaggaagcacagcataaagttactggtattca

SEQ ID NO: 6770798 - DNA, 56 bp, Homo sapiens
ggaagctgccagtccaccagctgcagatcacctgagccctggggctggtgcttacc

SEQ ID NO: 6770799 - DNA, 67 bp, Homo sapiens
atcattaacactaaggcgctgattctctgaaagacgttcaactgaagagagccttgaggaagatgat

SEQ ID NO: 6770800 - DNA, 84 bp, Homo sapiens
tattaagttgaaccatttgaaatgaatgtttttataggttaaagatggtgaaagattgacaatttcatatggttccacataata

SEQ ID NO: 6770801 - DNA, 57 bp, Homo sapiens
gcacgagtgcacgctgaatcatggcccctgttcatggagaatgtgtttacttcgtgt

SEQ ID NO: 6770802 - DNA, 80 bp, Homo sapiens
taaatgtgggaaaatacataaaggttgtaccagttaaacactagggctgctactcttgtatgtgtatttccaaatattta

SEQ ID NO: 6770803 - DNA, 73 bp, Homo sapiens
catttaacacatttctggagtttctcaacaggatgatttctctttgttagaaagtttgaggtgtggttaaatg

SEQ ID NO: 6770804 - DNA, 65 bp, Homo sapiens
gagtctagagccatgtttcaaagctgctatatccgcgtgacaggcaaggaacaaggctctgactc

SEQ ID NO: 6770805 - DNA, 96 bp, Homo sapiens
ggcaatatctcatattacagaaatatggtcaaagagacgagaaagacatgaagacctctctgtcctagtctgtagtgtatatttgagaaatctgcc

SEQ ID NO: 6770806 - DNA, 67 bp, Homo sapiens
gggaatgtgtatactggcaattaagattgttagtacttaactgacttcctccagaatacatgttcct

SEQ ID NO: 6770807 - DNA, 77 bp, Homo sapiens
cctctttaaagttttctgccttcattagatattccaaacaggaagttttggaatgagggacggaggggaagaagagg

SEQ ID NO: 6770808 - DNA, 81 bp, Homo sapiens
ttgcaaattggttattctgtcctttttccagttggatagctttaaaagggaaagcagaatgactttcctcaggatttgtag

SEQ ID NO: 6770809 - DNA, 67 bp, Homo sapiens
gggctgaaatgccttgtaaatattattctgtttagaagatagttttaaaatgtggcgttttatgtcc

SEQ ID NO: 6770810 - DNA, 61 bp, Homo sapiens
ggtttgagctgacatccagcagtgacccttaactcctggaggttcctgcatgtgtcagtcc

SEQ ID NO: 6770811 - DNA, 64 bp, Homo sapiens
gtataaagtagaaaaatgggaaattggacatttcaacttcacttcccatttctctgctttagac

SEQ ID NO: 6770812 - DNA, 112 bp, Homo sapiens
gagaaaagagttagtttctgcaaactggcaaacctgtctgtcatagtgtttttattcaagttgacctggtgcactttatagattgctagttttaaaattaacaacggttctc

SEQ ID NO: 6770813 - DNA, 55 bp, Homo sapiens
cattctagaatattatctaatcagccaaaggtagatgtgtgatattctcagattg

SEQ ID NO: 6770814 - DNA, 63 bp, Homo sapiens
gaccacttcatgctttgattttcactgtggggaaggatttctcaaagaggtaggaagtgagtc

SEQ ID NO: 6770815 - DNA, 109 bp, Homo sapiens
ctgcctttgcaaacttccttttgcagcatgttctaatcaagaggtttctgtccagaaaataacctgaatttaattgaaatgaaaagagaggaaacatagcagcgggtag

SEQ ID NO: 6770816 - DNA, 70 bp, Homo sapiens
tgagttaggaatgcagatgcataataaattggttgggatttattaatacatgcacctgcatttctgctta

SEQ ID NO: 6770817 - DNA, 60 bp, Homo sapiens
gaactatatcttcaagaaaatgaatgtcaacagttcaaattcttggaaaggctatggttc

SEQ ID NO: 6770818 - DNA, 117 bp, Homo sapiens
aagtaaaataaaaattgttcaggattgatttgggtggatttttttcaaattataaaaagtacaggtttctatattgaaatgattcagcccttcagtcaaagcaagccaattagactt

SEQ ID NO: 6770819 - DNA, 103 bp, Homo sapiens
cttgtgacctcactgggcattgagtctgaggccttggcagctaagggtggtgttccttagggaactgggaggccatccagacaggaggcacagtacaaacaag

SEQ ID NO: 6770820 - DNA, 69 bp, Homo sapiens
ggtttcctgtgggctctcggcctccaggctcctcatagcctgggagggaatttgacccagcagtgagcc

SEQ ID NO: 6770821 - DNA, 71 bp, Homo sapiens
tccttgaattctcacaagcctggaagcaggccttgctgtttccactttacaaggctcagagagggcaaggg

SEQ ID NO: 6770822 - DNA, 111 bp, Homo sapiens
tgcggtccaagattcaaagagcctgcttcctcagggaacaagcagaacccttggtacaaaagcctgtatttaattgtccctggaaagtatgctctctggtcttcagctgca

SEQ ID NO: 6770823 - DNA, 87 bp, Homo sapiens
gatcaaatgcccagtctggatcttcacaagagagggcgtcccttctggatgcctcactaggactccagctcactgtggcatcgggtc

SEQ ID NO: 6770824 - DNA, 55 bp, Homo sapiens
gtattggtattattttgtcatgcagccaattagctgtaggcatatgaccaattac

SEQ ID NO: 6770825 - DNA, 59 bp, Homo sapiens
gggagggaaggtacctgtgtgaccatgcattgtgctttagccacagtgctttgctttcc

SEQ ID NO: 6770826 - DNA, 59 bp, Homo sapiens
agtgatggatgtaaattgcactgtaggctttcaggctcacaggctcacgatccatttct

SEQ ID NO: 6770827 - DNA, 110 bp, Homo sapiens
tgtaagtgtctgaattgggaaggttgtaccagagagcagcaggaaaccgggagttcctcacgatgttaggccctgctctgttggtcacctgaccagtgtatggcaggaca

SEQ ID NO: 6770828 - DNA, 79 bp, Homo sapiens
atagaaatccaactgtgttctccaactgtagattttgcatggtagaggttcagtaaggaatactgagtaggatttatat

SEQ ID NO: 6770829 - DNA, 93 bp, Homo sapiens
agttcatgcagccagtgagtagtggaggcggggtaagaactcaggcagtttgattcccagagtttcctgtgtcccaaatgctttgtgtgtgct

SEQ ID NO: 6770830 - DNA, 56 bp, Homo sapiens
atcccagacacaggtgtgcctcaatataaaagcagaaggtcctggttctctgggat

SEQ ID NO: 6770831 - DNA, 58 bp, Homo sapiens
ggctagtgggactgtgcaagaagttcccaggaactgcttgatgaagctcccactggcc

SEQ ID NO: 6770832 - DNA, 74 bp, Homo sapiens
cccatcagaggcaggagggcattctctgctgaaatgaagagctgttaaaaatggatctgttttgcctctgaggg

SEQ ID NO: 6770833 - DNA, 130 bp, Homo sapiens
tttaatgagttgttgccttttgagtttgttcagctttttacttagtgttagaaccgagtgacaaatttcaagcttgttatacgcctgtcaggaagctagaactctctagaaagtgaccggagaatgtgag

SEQ ID NO: 6770834 - DNA, 60 bp, Homo sapiens
ccttgactagtgcttaggacttcttaggaaccacagttcctatttcaaagcttatcaagg

SEQ ID NO: 6770835 - DNA, 64 bp, Homo sapiens
tatgattgttctctgggccttgcaagtgctcagagctaactttgcctcctagagcacgttcata

SEQ ID NO: 6770836 - DNA, 55 bp, Homo sapiens
gcagtattcagcacaatttggccaatacgtatgtgttccaagctgctggataagc

SEQ ID NO: 6770837 - DNA, 73 bp, Homo sapiens
taagaaagaaaggctcagaagtttgtatttccttcagtaggaaataggagataatgatgcctctcttggctta

SEQ ID NO: 6770838 - DNA, 85 bp, Homo sapiens
tctaaatttaaatactaaatgattaagcaggaatttacgtcaaaaagcttgaaattcctgttatttatttgggtaaacatttgga

SEQ ID NO: 6770839 - DNA, 96 bp, Homo sapiens
ctggaactctgttcttgacagcaaagcagagccaaggcttctgctgcctaatgagaagatgccctggttctgccttttgtcttcttgagttctcag

SEQ ID NO: 6770840 - DNA, 129 bp, Homo sapiens
tttcctttaatcagggcgattaaagatgcctactcactttccattcaagcacctactgtcttcaagtcggggtggtgatgtgggcgggaaggaaaagcgcatttttccatgcttttgtacttaaggtaa

SEQ ID NO: 6770841 - DNA, 99 bp, Homo sapiens
ctacacatgcacagagctggaaggtctgtccccactgccactccagagtgcgagaaagggagaggcagtgggatggggactctctgcttcgcatgttgg

SEQ ID NO: 6770842 - DNA, 58 bp, Homo sapiens
cagactgcaccatctggagcacctcccctcagggcagcagttacaaatgtgcagactg

SEQ ID NO: 6770843 - DNA, 56 bp, Homo sapiens
tgtctcttggagggtctagtgagtatcagcccctgagtcactcctcccaggggaca

SEQ ID NO: 6770844 - DNA, 67 bp, Homo sapiens
ggagtggcagcgaggatcagatttctccagaatcactcggagtaatatctatcctcagcagccgccc

SEQ ID NO: 6770845 - DNA, 58 bp, Homo sapiens
cagggtagacagtaggtgtctgtgtccagggctcaccctatacctctgtgaacccctg

SEQ ID NO: 6770846 - DNA, 129 bp, Homo sapiens
gtggatgtgtagactacatagtggttttttcaacccaggaacataacagtataatggaggataggaaggcagaagatgtttaaagggttgagaaataatggtatatgtataatggtcagtaagcagaac

SEQ ID NO: 6770847 - DNA, 61 bp, Homo sapiens
cccatttcttgactctgaatttggaatacaacaagactgctttcagaaataaggaatgagg

SEQ ID NO: 6770848 - DNA, 97 bp, Homo sapiens
tatttacatacatgtgtgcacatacatattagtgtcacagatgtgcatgcattcatgtgtatacgagtatgaatatgtgtgcatatgtatgccagtg

SEQ ID NO: 6770849 - DNA, 55 bp, Homo sapiens
cttgactgccaatgtgactgtatttggagacaggtcctttacagaggtaattaag

SEQ ID NO: 6770850 - DNA, 63 bp, Homo sapiens
gaggcggtacagccagtcctccgctgtggccaccatgtccttgggcttggcttgcttggcctt

SEQ ID NO: 6770851 - DNA, 87 bp, Homo sapiens
gggaaaggtgacatctctgaggagcgttggtcacgtgtgtcaaggcctggtgacgcgtgtcttatgtgcctccctgggcatcttctc

SEQ ID NO: 6770852 - DNA, 96 bp, Homo sapiens
acttccggcattcatttactttcaacagctaagcatgttggagatacctcctaggagctacagagctgacttgcggggtagagggaggctggaggt

SEQ ID NO: 6770853 - DNA, 75 bp, Homo sapiens
gccaatttgaattggttttctgttgcttacaactgaaaacgtcctgactactacagaagatcagtctgaagtggc

SEQ ID NO: 6770854 - DNA, 77 bp, Homo sapiens
gacccagaagccctctcagagttccaaggttggctcctgtgggacgctcactgccattctctagatgtttctggctc

SEQ ID NO: 6770855 - DNA, 70 bp, Homo sapiens
gctggctggaatgggagaagaaatgcacacacactttcccatgcagggttctccttttccagttcccagt

SEQ ID NO: 6770856 - DNA, 67 bp, Homo sapiens
tgcgtggcgcagcgtgtgggatgaatgtgcaccgtaagaggtccagtcccactgcggtgccctagca

SEQ ID NO: 6770857 - DNA, 85 bp, Homo sapiens
tccccgtgtgtcactcactcagctgatgaagcacaagtggaaattatttattcttgcattgctgggaaacattgatgtgtgggga

SEQ ID NO: 6770858 - DNA, 67 bp, Homo sapiens
gaaacagcccctgtgtgaagcagctgctggtctccacagtgtctatgctcccaccatggcctgtttc

SEQ ID NO: 6770859 - DNA, 77 bp, Homo sapiens
ctccttctccccatctctccagacagctctccctttcttctgagcctccgcagctgtcctgtgggagggagtgggag

SEQ ID NO: 6770860 - DNA, 78 bp, Homo sapiens
acaccattcccgcagatttgctctttgcaggaccctctctttggtgtttccaaaggcaaaactgtggtgtcgaggtgt

SEQ ID NO: 6770861 - DNA, 77 bp, Homo sapiens
cactgaagcttttagttcacaccagggtagcagaagtcagcttgcttcttgcttcctttaagtgattggctttggtg

SEQ ID NO: 6770862 - DNA, 75 bp, Homo sapiens
gctttctcttccagtctgtaggactaggcctccaacagggccctgggattacaaattgaagactcaacagagagc

SEQ ID NO: 6770863 - DNA, 55 bp, Homo sapiens
taagtaaaacattcaagaagtcagcatcctctgctttagttgagtgctttattta

SEQ ID NO: 6770864 - DNA, 61 bp, Homo sapiens
tattgagtcccatttgagctattctttttcctgaaaaatggcactaagagggagctggatg

SEQ ID NO: 6770865 - DNA, 70 bp, Homo sapiens
atcggcttaaggcgcaccctctaaggtttcagacagacccagggcaccgcggtgatgacctgaagctgat

SEQ ID NO: 6770866 - DNA, 62 bp, Homo sapiens
ccagctctcttcaagcccactctctgttgggtggactccacacttgggtttggggatgctgg

SEQ ID NO: 6770867 - DNA, 108 bp, Homo sapiens
ccccaactaaggtccaacaagatgtgtgagtgaacaagtctttagatctttccagccctagctggaactatctgcctgtatttaccatcattgctgtacctgttgggg

SEQ ID NO: 6770868 - DNA, 88 bp, Homo sapiens
gtggcatgattgagggccctggcttcttgctggctgttggctggagtctactctcagttcctagaggccactctcagctccttgccat

SEQ ID NO: 6770869 - DNA, 90 bp, Homo sapiens
taagcaatggactagacctgccataactgttgcccatagtcgcagattttatttctgggcgatttatactggtatttggcatgttgcttg

SEQ ID NO: 6770870 - DNA, 77 bp, Homo sapiens
ggatgtacagtcatgctttctgttcctcaaactgtaatgtgtttgtaagtgaaaaatgatgagtatgatgtggatcc

SEQ ID NO: 6770871 - DNA, 59 bp, Homo sapiens
tggctccatccaaggccttctaggggaaaccattagcctccagaaggtaggatggaaca

SEQ ID NO: 6770872 - DNA, 75 bp, Homo sapiens
taggccttggtttccttaacagcctaaagggacagggaggtggaccctttgtggcaggagcggagaccgggcctg

SEQ ID NO: 6770873 - DNA, 70 bp, Homo sapiens
caaggacccgtggatggaaggccactgcagagtgtgagctggcagatgcgttttcattttcggttctttg

SEQ ID NO: 6770874 - DNA, 72 bp, Homo sapiens
tagcgaacatatatggagtccttgctgtgtgccatgccttcttcatggcactcgcattgctgtagtttgttg

SEQ ID NO: 6770875 - DNA, 62 bp, Homo sapiens
gctcttttccttccctacagatctcagccagattggtgatggaaatggaaggataaagatgt

SEQ ID NO: 6770876 - DNA, 61 bp, Homo sapiens
atggaggattctagtgacctcagagatcccgttatttttaaagtattctagaattcttcat

SEQ ID NO: 6770877 - DNA, 67 bp, Homo sapiens
accagcagcacaatttccaagtcatgttatttttgttaaaaatgaactagccaggttgtgctgtggt

SEQ ID NO: 6770878 - DNA, 68 bp, Homo sapiens
agtcacatgcagttttccagcagtctgttattgcataaatccagacaggctgctgaagtgtgtgtgct

SEQ ID NO: 6770879 - DNA, 124 bp, Homo sapiens
tggctttgacaatgtactatggtcatataggatattatcatcggaggatgctgggggaagggaacctgagaaccctttgtcctgattttgcaacttcttgtgagtcttcgaccgtttcagacta

SEQ ID NO: 6770880 - DNA, 81 bp, Homo sapiens
agacgcttgccattcctactttgactgggtggagatgtggaaatcttgttattcagaggtgaagtagggagggcaagttct

SEQ ID NO: 6770881 - DNA, 66 bp, Homo sapiens
ctcaggtattctaagctgtgtttactggctttgtgtcaggtaacactacttagtatactaatggag

SEQ ID NO: 6770882 - DNA, 78 bp, Homo sapiens
ttgggaatttgaaactgccactcctccccacttagtgagccccatctgagctggaggacaggagggtaagaggcccag

SEQ ID NO: 6770883 - DNA, 66 bp, Homo sapiens
atattccagcacagaagtatacattgagatgagacattagcagatctaaatgctgtgctggattgt

SEQ ID NO: 6770884 - DNA, 60 bp, Homo sapiens
ccctgatgacaccatattagcctagagactgcctttctctggtcttctattgcatgaggg

SEQ ID NO: 6770885 - DNA, 82 bp, Homo sapiens
attaggttggaccatatgaagttgcccatatttgactgtttcaacctacaaaaaaagtcaagttcatgtggtttaacttaat

SEQ ID NO: 6770886 - DNA, 76 bp, Homo sapiens
ttgagagccacagcagggctggacaggatctcctcgcaggggattctactgatcagcaccacgtttaggtattcaa

SEQ ID NO: 6770887 - DNA, 106 bp, Homo sapiens
cccacctcccccaagccctgcaggcttgggctcagcaccgtgtggacctgacgggagtttcccatgattctgggctcaaaatgctgggtgcctgggagagggtggg

SEQ ID NO: 6770888 - DNA, 65 bp, Homo sapiens
cttgtcaggtaggtgtcatttctgtgcacttgaatccccatccatatatatgacaccactgtagg

SEQ ID NO: 6770889 - DNA, 88 bp, Homo sapiens
ggctgggactgaggtcatgttctgtcaggttccaaagagcgccaggaagactctgagaccacagagcacggcctgctttctcccagcc

SEQ ID NO: 6770890 - DNA, 69 bp, Homo sapiens
ggtgtccggccctcctcgaccccattctcttcccttgaggatgtctctggaccaggatggccggaggcc

SEQ ID NO: 6770891 - DNA, 88 bp, Homo sapiens
tggctggcaccattaggtagactgggatttgttgttgagcgcagtaagacaacaacaaaatcactagtcttccagatggggccagccg

SEQ ID NO: 6770892 - DNA, 75 bp, Homo sapiens
tagttacacttgtggttttagagagtatttgctgctcatttggagtctcaaatgcaaaatataaccctgtagcta

SEQ ID NO: 6770893 - DNA, 64 bp, Homo sapiens
gagaaggcttcttttcctctgataaaattctgtttgtccttcaggggaaaggttatgctttgtt

SEQ ID NO: 6770894 - DNA, 68 bp, Homo sapiens
ctctgagttgaggcaggagagtcatcatgctatttaatgacaaatgctttcagtgtttcaaaatggag

SEQ ID NO: 6770895 - DNA, 74 bp, Homo sapiens
ctgtcactgagccactggaatgttgaggagacaatgagttagcattggaaaacaattcagggtgaaaggtgcgg

SEQ ID NO: 6770896 - DNA, 76 bp, Homo sapiens
gtaggacacccagtcagctgccggacactcaggtaaggaggtactggagccaaactgtctgagtgactgggtctgc

SEQ ID NO: 6770897 - DNA, 85 bp, Homo sapiens
gcaaacacaccaaggatttcactggaaagcctaacatgtcatctgtagcagtggaggtcacatgaagtctttgggaaatatttgc

SEQ ID NO: 6770898 - DNA, 65 bp, Homo sapiens
gaggcctcctctgagacatctgagcccctctcttatcctactgtcagtgtccaaatccaggcctt

SEQ ID NO: 6770899 - DNA, 117 bp, Homo sapiens
ctttttttaaacaaccctcaaattatatgctttgaatgtggcagctgtttcttgcaaggaccctgactgataaaggaaacaagttactcttaaagtatatggcttaagtgaaaaaag

SEQ ID NO: 6770900 - DNA, 95 bp, Homo sapiens
atgtatagtgtgtggccctctatttgcgttctttcccaaacctgcatatgttgagggtgggcctgcaggaagagggatgactgactcatttacat

SEQ ID NO: 6770901 - DNA, 59 bp, Homo sapiens
tagcacagtcttcgccaggctgaggctgcttcccagctcctgtgtgtctgactgggcta

SEQ ID NO: 6770902 - DNA, 84 bp, Homo sapiens
gaagaaatactaaagaatattcatctacatttttcttcaagttcttaagaagtttgtagctggatgtctgtactggatttgttt

SEQ ID NO: 6770903 - DNA, 77 bp, Homo sapiens
tgccatttattagctgggcttcagggtgttactaaacctgtatgctcctgtttcatcagctataaaatgaaggggta

SEQ ID NO: 6770904 - DNA, 129 bp, Homo sapiens
gtgtctagtgtattttattttacctgtctctttttttgtatgggcagaaattagatctttagagattattaaagctacatcaaggagaggcaacataatatagtggtgaagaacactgacgctagatcc

SEQ ID NO: 6770905 - DNA, 86 bp, Homo sapiens
gttctgtatcatacagctgacgccagagtggaattatagcatgaatatcaatttctttggctcagtttctttctgtggttgtttac

SEQ ID NO: 6770906 - DNA, 86 bp, Homo sapiens
aagaggggagacgagatgtgtcaggtcctgggggtgggaagtcacttcctgcgcccgctggccctgcgatctccgccttccctctt

SEQ ID NO: 6770907 - DNA, 69 bp, Homo sapiens
caggcagctgggtcaccgtcccgtgggtcttgttgtcacgctgcgatcttaaagtgaccacgctgcttg

SEQ ID NO: 6770908 - DNA, 58 bp, Homo sapiens
actgaagaataagcatggggttgcatttagccacagaaaccatgtgttctacatcagt

SEQ ID NO: 6770909 - DNA, 129 bp, Homo sapiens
ctttaaaaactattgctgataagaggaaaacaaagttattagtgagtgttctgttctgtgtgtttttccctttagagtcacatgagcactaattagggaaaaatcttttccttgaagcagtattaaatg

SEQ ID NO: 6770910 - DNA, 61 bp, Homo sapiens
ttcaactttaggcaaagaaaacttttaaacaaaaagtattaggtttttgtctgaatttgga

SEQ ID NO: 6770911 - DNA, 59 bp, Homo sapiens
ggagggacccactgcggtgaccggaagttaagaggatacagacgcagttgaggttctcc

SEQ ID NO: 6770912 - DNA, 60 bp, Homo sapiens
cgagggctgtcagtgactcactgcgtgggccacccagggcatgtggtgctgaggctgtcg

SEQ ID NO: 6770913 - DNA, 82 bp, Homo sapiens
tcatttcttcctgtgctttcaggccgctgtgtatttgcagagcctgcaccagcagcctagagcgttcttaggaacttggtga

SEQ ID NO: 6770914 - DNA, 64 bp, Homo sapiens
ctgagacatcagatgaccaaagccaagctcttgactgcaacctttgagcaactctgagtcacag

SEQ ID NO: 6770915 - DNA, 64 bp, Homo sapiens
tgttgccaggctggagtgcaatggggcaattttggctcaatgcaacttccacctcccaggctca

SEQ ID NO: 6770916 - DNA, 88 bp, Homo sapiens
cactatagatttgcaagatgttaacatagggagaaactgagtaaatgtacaaaggatttctctgtattatttcttacaagtacatatg

SEQ ID NO: 6770917 - DNA, 65 bp, Homo sapiens
agtgtaggtgtttagtaaatgtttctcttcccctggaagatgacagatgcttagagtcctctact

SEQ ID NO: 6770918 - DNA, 92 bp, Homo sapiens
ctttcttagttccgactctgtcacctaattacatcagctcttgaaaagcagaggatgttctctgattggtggtagaagtagaagtaagagag

SEQ ID NO: 6770919 - DNA, 62 bp, Homo sapiens
catgttctttgtgattctgagctggcaggtcatcattgccaccagcatttcaaagacacatg

SEQ ID NO: 6770920 - DNA, 101 bp, Homo sapiens
accacagaggcatctgctaaaatctgctgtgtcccctgtgcgggtgttagcgatgcattcagcctagcagcacagccagaaaaagcagcatgaactggagt

SEQ ID NO: 6770921 - DNA, 57 bp, Homo sapiens
gacctactcccaggtcagtggagaatgagcctgcttcaccaacacctgggataggtc

SEQ ID NO: 6770922 - DNA, 76 bp, Homo sapiens
ctgaaacccagtaagaaaagtgagcttgaggtatttgaaccaagacctactcactcttttcatgcttccaactcag

SEQ ID NO: 6770923 - DNA, 124 bp, Homo sapiens
ttcatggcttctcagtgtgccagtatggccgttattaaagtatttgatgttagaatatgactttttaatgtgttgatgcttgaatagagctattctcaagctggaataactgagactgaatgga

SEQ ID NO: 6770924 - DNA, 64 bp, Homo sapiens
cctgacgtgtcctttctctttcatcttgtccctgtgactggaataaatggagggatgagtcagg

SEQ ID NO: 6770925 - DNA, 91 bp, Homo sapiens
gctgtgagggcttctgaagtgggtggtgatatcactgccagatgcagccatcgacggtatagctgccccccaccacagcagtctctacagt

SEQ ID NO: 6770926 - DNA, 58 bp, Homo sapiens
ggttgctacacatcacaacagcaggaatgcaagcatttggctgggctgtgggcacacc

SEQ ID NO: 6770927 - DNA, 59 bp, Homo sapiens
aggtagaggcctccaggcagcaactgaggttatccattgggcagccaggtgctctacct

SEQ ID NO: 6770928 - DNA, 71 bp, Homo sapiens
tttctattcacataatgatacaaagcttctgctgttaagtggcaaagaatcgtaaagttaagtgaatgaaa

SEQ ID NO: 6770929 - DNA, 57 bp, Homo sapiens
ccctcacctcagtctgggcctcatcatgcccctcgcacatgacccagacccagaggg

SEQ ID NO: 6770930 - DNA, 130 bp, Homo sapiens
atggcggttgtcctgttgcaggtgccctgctgcaggaggagaggctggacgcggtgaccctgctttacgccacctcgctgcccagcttctgcctgctggcgggtgcagccctggtgctggaggctggcgt

SEQ ID NO: 6770931 - DNA, 68 bp, Homo sapiens
ccagcccgtgacctctgcctcaattactgacatttgggtaatgaggcatttgagtcacctatgattgg

SEQ ID NO: 6770932 - DNA, 119 bp, Homo sapiens
aagggtgggtctgagatgtttgggtgggttaagcggacattttgacaacatggcttctcctttggcatgtttaattgcgatgtttgacacacatccttgcagtttaagatgacgctttt

SEQ ID NO: 6770933 - DNA, 70 bp, Homo sapiens
ggctcatgaagtcatctggcactcttctaaatttttatttgaggactgaaaactagatgttggggaggcc

SEQ ID NO: 6770934 - DNA, 84 bp, Homo sapiens
ctaatggaaatggggatgctcaagtaaagcagagctggaacaatcagtagtttcatgttaaattgagtttgcaatgtccattag

SEQ ID NO: 6770935 - DNA, 55 bp, Homo sapiens
aaggaagaggcaggttttgctgaccacattttggcaaatctgttggctctttctt

SEQ ID NO: 6770936 - DNA, 70 bp, Homo sapiens
aaagttgaggtggatacattaaataatgctcactttatttgagcaagatttaagagtcagccttgacttt

SEQ ID NO: 6770937 - DNA, 97 bp, Homo sapiens
tcccttcaaagatgagactgggaaaagcgggtggtaagggaattccacggtctgaataccttattgtgtgtattttctagtactcattatcagggga

SEQ ID NO: 6770938 - DNA, 61 bp, Homo sapiens
tcacatggctaaagcaagtctagattcaatggatagagaaataagctttgccttgatgtga

SEQ ID NO: 6770939 - DNA, 77 bp, Homo sapiens
gtgatgagcgtggctggggaggtcagccagcccctggtggggtgggcgtaactagctcctagggccacgcccagcac

SEQ ID NO: 6770940 - DNA, 84 bp, Homo sapiens
tgtggttaagatcatatgctttgggattagatcatcctgggcttgaggattaaatgagacaacgtatataaatgatttagcacg

SEQ ID NO: 6770941 - DNA, 94 bp, Homo sapiens
gaggcccaaagagggtgtgcagggaagggcatgctattggcaaagcgatgaagatggtgatgcttttctgatttgtgcctccctctttgggccc

SEQ ID NO: 6770942 - DNA, 57 bp, Homo sapiens
ctggtatttactgttctccaaaccagctccttggttgatgacagcaaaaaatgctag

SEQ ID NO: 6770943 - DNA, 87 bp, Homo sapiens
aagtaaaaaatcctgttctcatagtggaaaataggtcaaatatcttgttttgaacctgtgccccctatagaatagaggcacatactt

SEQ ID NO: 6770944 - DNA, 73 bp, Homo sapiens
gtggtggtctatagaatgaagctttcatgattaaagtagggcgaatctgaaagcacatactataaatcaccac

SEQ ID NO: 6770945 - DNA, 58 bp, Homo sapiens
ttgatttcagtctgggcctggctctggtgaagctgggtcagtccaggctagaaaacaa

SEQ ID NO: 6770946 - DNA, 81 bp, Homo sapiens
atgaattggaacatgaagcaagaaagatgctagacacttctggtacattctacttgttttacaagaattgcttacattcat

SEQ ID NO: 6770947 - DNA, 70 bp, Homo sapiens
tctgttttcttcttctgttgcactacattagagaattcttttgagtcagtgacagagtgatgaggataga

SEQ ID NO: 6770948 - DNA, 62 bp, Homo sapiens
actgtgaatgggttatttttagggaaagctattaagctgttctctaagccacccattttggt

SEQ ID NO: 6770949 - DNA, 97 bp, Homo sapiens
gagcttattaagacagaagtttctgggccccactgccataattcctgactcaccagttctggagtaggacctgaaaatatgcctttccagtgagctc

SEQ ID NO: 6770950 - DNA, 66 bp, Homo sapiens
accccttgactgtaatggagtagggggaatcccattttgccctacgcctcatacagaccagagggt

SEQ ID NO: 6770951 - DNA, 79 bp, Homo sapiens
atcaaactggctttaaacactgaaattgcatgtaactggaaaatgccagatgtagagcagtctttgggttaggcttgat

SEQ ID NO: 6770952 - DNA, 104 bp, Homo sapiens
tacaattggaatgttaatttttaaagaggtacaagaaagtccagtgggtttttcaaggagaatcatctgtgttttctgtgagcctgagatttacatctgcggta

SEQ ID NO: 6770953 - DNA, 82 bp, Homo sapiens
ggatgaataaggcttctggctgctttcttttcaggataaatatcagagatcagctgatgcagaagatccttgtcacaactcc

SEQ ID NO: 6770954 - DNA, 130 bp, Homo sapiens
ctgagtagttgggattacaggctcccgccaccatgcctggctaatttttggtatttttagtagagacggggtttcaccatcttggccaggctggtcttgtactcctgaccctgtgatccacccacctcag

SEQ ID NO: 6770955 - DNA, 58 bp, Homo sapiens
gtgttgctttctctaatgccacctggtcatccagccaggacatgggaggaagtatggc

SEQ ID NO: 6770956 - DNA, 57 bp, Homo sapiens
atatggtctgtgtcacagctactcaactctgctgttgagctgtgaaagcagccatat

SEQ ID NO: 6770957 - DNA, 55 bp, Homo sapiens
ctagggactgggaccttagttaaggccctttactctctgagcctcagtttcctag

SEQ ID NO: 6770958 - DNA, 67 bp, Homo sapiens
gatttgaaagcaatcagattcagatgtcagttgaagctctagacatcgaagagattgttttatgatt

SEQ ID NO: 6770959 - DNA, 69 bp, Homo sapiens
gggacccaggctggtgttgcttccaccactaggccctgcctagggacaggcccctcgctagcttctccc

SEQ ID NO: 6770960 - DNA, 94 bp, Homo sapiens
gggagagggttacagaaatgggggtaagatggagcaccaaagatgaatttcattgtctttatcattttgcctgccatttgagttctcaagtccc

SEQ ID NO: 6770961 - DNA, 73 bp, Homo sapiens
tctccaggaagtgcagctgggactgtagggtccccagggacttgcaggatcctctgcctgataatcgtggaga

SEQ ID NO: 6770962 - DNA, 88 bp, Homo sapiens
agggcaggaatcaggcacagctctgattagagacattcttcaattttgatggaaatatctttagagcttagttagcaattctggtcct

SEQ ID NO: 6770963 - DNA, 65 bp, Homo sapiens
ttgtcatcatccttgtgtatttatattagacatatcaataatgtctaatgatcaagtgatgacag

SEQ ID NO: 6770964 - DNA, 63 bp, Homo sapiens
ctgtgggagaggtgcctggatttagaggagcgaccactcttcatttgtaggtactctccctag

SEQ ID NO: 6770965 - DNA, 86 bp, Homo sapiens
ggcttcacccaggcggctggctgaggtctagacaccccaggggcagctgtggcccctggtatggacttcggttgcctggggaggcc

SEQ ID NO: 6770966 - DNA, 59 bp, Homo sapiens
ggcgatgctcagatttttgacctgttttccaactctgaggtcaaactactggcagtgcc

SEQ ID NO: 6770967 - DNA, 63 bp, Homo sapiens
agacatggccacatgataatcaagtagaatgcttgttaaagtgcagattacatgggctctgct

SEQ ID NO: 6770968 - DNA, 110 bp, Homo sapiens
gcccatggagcttggtgatgcctcctggtgctggctgaggccatgagaggaggcagaagtgggagaggagagcagcaggagcccttatcaccaggaacacacacgtgggt

SEQ ID NO: 6770969 - DNA, 61 bp, Homo sapiens
cttggtgggatctggcaagatggccaaataggaacagctctggcctgcagctcccagcaag

SEQ ID NO: 6770970 - DNA, 65 bp, Homo sapiens
tggagctctgcgagcctcaaagatgtccaggcagtccttgaaattttaggccttgcaatgtacca

SEQ ID NO: 6770971 - DNA, 79 bp, Homo sapiens
gttgctgttccattacctgtaatgcccttgacagtcctcacccacttccctggtaatactggtgatgggatttagtgac

SEQ ID NO: 6770972 - DNA, 74 bp, Homo sapiens
aggggagaaaaatgccttctgtttctgtttctgtgccgtgcatctaggccaccgggaggttacttttcttctct

SEQ ID NO: 6770973 - DNA, 129 bp, Homo sapiens
gggtggtgctttggtcaggagatgcagagaaagggctggctgtgatgagctgggagtggtgatgagggccccaatctggaggcttcttcacctgcccagcccctttctctttctgatctccctccaccc

SEQ ID NO: 6770974 - DNA, 56 bp, Homo sapiens
agagagtaggtccacagtcatctgaatcccagctctggacagtggcctatggcttt

SEQ ID NO: 6770975 - DNA, 78 bp, Homo sapiens
tgatagagtatcgctttacagcctgcttcctcagtagctgatcaccaggcaaaatgtcagagcagctggtgctcatca

SEQ ID NO: 6770976 - DNA, 115 bp, Homo sapiens
aatatcagtatgggaagtggtttgaagtgtaacagtctacaaagtgatgtgtgggaaaagtattagaactcatatttatttttagctacatagaaaattaaattttactaatatt

SEQ ID NO: 6770977 - DNA, 78 bp, Homo sapiens
agaaataattgtagataaacactgagagaaaggcctctttgggatgtctttcatcttatttgtctacatccgatggct

SEQ ID NO: 6770978 - DNA, 60 bp, Homo sapiens
gtcaagtgctacattggtgctacagattcagactgtgcacacaagcaatgcacttaaggc

SEQ ID NO: 6770979 - DNA, 113 bp, Homo sapiens
tcctgggatgttcctccccctggaattgttttgctgagttaggaggagaggggaattctgctttgaaacctgctctgcagaagccagtttttcaggtttgagggtccccaggg

SEQ ID NO: 6770980 - DNA, 67 bp, Homo sapiens
aatcttttaccagtgtcctgctttgtcccctttagtgggtctgacagtcaggaatttgtaaaacgtt

SEQ ID NO: 6770981 - DNA, 57 bp, Homo sapiens
cagttgccgggagtgtccttatcccccatgcagggcaggatcaggagccgacaactg

SEQ ID NO: 6770982 - DNA, 70 bp, Homo sapiens
tatgacatttctctgatttgtggccaattacggaggttataaaatggctgttaatcagggaaatgccata

SEQ ID NO: 6770983 - DNA, 111 bp, Homo sapiens
tctttaattgaattacatccccctcagcccaaaatgatgaactgaaagttagaaatcatgttggctctgacaaaaatggggcatgtttattttctttgtttaatttgaaga

SEQ ID NO: 6770984 - DNA, 79 bp, Homo sapiens
gctcctgtggcttccacgacctaatcctaactccagggactcgcaggagttaggattaggtcgtggaagccacaggcgc

SEQ ID NO: 6770985 - DNA, 110 bp, Homo sapiens
agggagtaatgtggaatccaaccagggtgtttgagacctaaggggctgtgtctcctgtggctggacagacacaggcctgggctcctcacatctgatttaagatcacccct

SEQ ID NO: 6770986 - DNA, 128 bp, Homo sapiens
tgggtcactgtgaccttaacctgggctggtttaaggcatgagtgggttttagtgatcgcccttctgttgggtgaagtccacaggctgaggcccttctgctgcagcagcctcgttagcatgatggccca

SEQ ID NO: 6770987 - DNA, 85 bp, Homo sapiens
taggaggaagccaataatgttgagaaaagtgtgtgctgtgactaaaggtttctcaacagtgatcgcactcaacagttttctcttg

SEQ ID NO: 6770988 - DNA, 62 bp, Homo sapiens
atatgcactatggaagtagctcatgtaaataaaaactgaataatcatgtccatagtgtatat

SEQ ID NO: 6770989 - DNA, 87 bp, Homo sapiens
gcctttggcatggatttctgatgcagcatcaataaattttctattagcaagatctgcaaagaagcaacatccttgtcttaattaggc

SEQ ID NO: 6770990 - DNA, 78 bp, Homo sapiens
gaacctgataataaccagagagtcttcttcattgaggtcctgacgctacaattgactttctgttatcacttagagttc

SEQ ID NO: 6770991 - DNA, 55 bp, Homo sapiens
gctctggggtccctgggggagaaggcacagcccctgccctggagacacttaaagc

SEQ ID NO: 6770992 - DNA, 69 bp, Homo sapiens
ggagaggggatttggacatctcctgggccctgagacccagctctctgggtgtgtctagatagaactccc

SEQ ID NO: 6770993 - DNA, 129 bp, Homo sapiens
aatgaatgaacaatgggctctcacaattatttgctggagataatgatgctaacccagtccagttagcagaactagactgggttaacatcattatctgcagcaaataattatgagaaccctgtaattctt

SEQ ID NO: 6770994 - DNA, 81 bp, Homo sapiens
aggaccctttcagattgaagagttgaggggctctggagcagggaccccatttgaactccttcaactgccttgcctggtcct

SEQ ID NO: 6770995 - DNA, 75 bp, Homo sapiens
cctttaacttggatcaggtttctctctttagatttttactgagactccagagtgactatttgtcccattcagagg

SEQ ID NO: 6770996 - DNA, 59 bp, Homo sapiens
gggcaagctggctcctgccctcaagggctgtcgagcagggaggaaggcggcggctgccc

SEQ ID NO: 6770997 - DNA, 100 bp, Homo sapiens
gtggcaggtccgggaagtggaggccgagttcacgcagtcagcactcatagctcccagctccctgctcctgagcggtttccatgacaacccggccagccac

SEQ ID NO: 6770998 - DNA, 72 bp, Homo sapiens
tattcttttcagtggcttgcatatgttggcttctgtatgctgctaaatatgtgatcagtgaataaatgaata

SEQ ID NO: 6770999 - DNA, 74 bp, Homo sapiens
ggtataaaataatgtcttaatgtcttatttcttccagtgaggaagttgacatccagagacattctttgtcttcc

SEQ ID NO: 6771000 - DNA, 86 bp, Homo sapiens
gcttccttgtctgtgttcaactcgatgggtggagaaaataattagaattgatttctctgcacccactcaggaatagaataggaggc

SEQ ID NO: 6771001 - DNA, 101 bp, Homo sapiens
cattgtgatttagctgtaagtctgtaaaattagtataattgtacaccataacattgttgtaagaattaaagtgatttagacataaagtgctgaggaaaatg

SEQ ID NO: 6771002 - DNA, 59 bp, Homo sapiens
tcattccctcatgcactcaatgcttacttattgagcacctgctatgtgtcagggatcga

SEQ ID NO: 6771003 - DNA, 66 bp, Homo sapiens
agccacttccttctgtcagctcaaagaagctcctgcagggttcagggcagacagaagagatgggct

SEQ ID NO: 6771004 - DNA, 76 bp, Homo sapiens
aggtatgttttattccccactgttacccctgtacctagaatagtgggtggcgcagaggaggaatttatacatgttt

SEQ ID NO: 6771005 - DNA, 78 bp, Homo sapiens
acagccaatgagctagaaaaccatgtggactcctatgaagccattctaagtcacctggtcctatagctgaaggactgt

SEQ ID NO: 6771006 - DNA, 56 bp, Homo sapiens
tctttgatgggagatctgagaggcatggtggcatggctccatgtctgccacaaaga

SEQ ID NO: 6771007 - DNA, 56 bp, Homo sapiens
gcccggcttgtgattggctgagatagcacagagctccagccaatcagagctgaggc

SEQ ID NO: 6771008 - DNA, 55 bp, Homo sapiens
agttattcatttcttctaatgggatggtttgctatctcagaggaatgtagttact

SEQ ID NO: 6771009 - DNA, 71 bp, Homo sapiens
atcttcaaggcttgtttgctttaaaagtgtgagtttctgattataacagtaaagctaatagtttgtaagat

SEQ ID NO: 6771010 - DNA, 72 bp, Homo sapiens
tataaaaaggagagcaagggtagggacactttttcctccttaaagacttgtcccctttctttccttcgtatg

SEQ ID NO: 6771011 - DNA, 78 bp, Homo sapiens
tatattctggattatcagtccaccaagaaagcagtagcattaagctgtgatagttgaaggactgagtgtctgaatata

SEQ ID NO: 6771012 - DNA, 80 bp, Homo sapiens
gagcctccatttccttctgttacaagtcttgcattgtaaaacagcaaaggcaaacattccacagaaggaaggaaaggttt

SEQ ID NO: 6771013 - DNA, 57 bp, Homo sapiens
gacacagaattcccctccaagtggggcttggtataatttggaaggagttctggtgtt

SEQ ID NO: 6771014 - DNA, 69 bp, Homo sapiens
cttgtcaggtgactcctcagtcaaaaaggagcccagtagagaaatgggctggtgagagcacctgatggg

SEQ ID NO: 6771015 - DNA, 59 bp, Homo sapiens
tgccaactgtcattgagcactttgaacatgtgaagttaagtgcttgatcatagttctca

SEQ ID NO: 6771016 - DNA, 106 bp, Homo sapiens
agacttcaatcttattcaaatcaattctgaagccttcctgtgttttttatcatgtcttagacacctgttacagctgagtatgcattcaagcagagttgtgaagtct

SEQ ID NO: 6771017 - DNA, 65 bp, Homo sapiens
gactggcctctttcttccctttgactgggaatgggtcaaaggcggtgcaggaggaggatctggtc

SEQ ID NO: 6771018 - DNA, 72 bp, Homo sapiens
ttctatttgcctgagttttaatttttttcactgaaataagtagaaggacaggttggggcttcaggagtagga

SEQ ID NO: 6771019 - DNA, 116 bp, Homo sapiens
ggctaggactgggtgcgtgggttccctgcctggagctctgtccttgactgccccaggtcatctgggtttaaggaggacgttcctggtggggacatcttttggtcccggtaaaagcc

SEQ ID NO: 6771020 - DNA, 67 bp, Homo sapiens
ggcagtaggggcagtgttctggttgtcaggacttcagagtcccagcctggaccctgccagtgactcc

SEQ ID NO: 6771021 - DNA, 105 bp, Homo sapiens
aggtttgagacatttgaggtaaacagctttgagcagttctgtatcaactatgcaaatgaaaagctccagcagcagttcaactcggtaggcttggtttctagacct

SEQ ID NO: 6771022 - DNA, 64 bp, Homo sapiens
ttgagaaccactgagttagatatttctgttattgatctccaactcctctctggtggttcgtcag

SEQ ID NO: 6771023 - DNA, 77 bp, Homo sapiens
ccgggggacccgtggcaggctgcctgctcttgctcccagggaagctgctgggcagggcagccttgccgggtcccagg

SEQ ID NO: 6771024 - DNA, 80 bp, Homo sapiens
ggctctggcaagtgagactctcagcagtgctagggttcaccaccaaactggcagctgtggacgtcgtcatttcagaagct

SEQ ID NO: 6771025 - DNA, 98 bp, Homo sapiens
tctgtagctgcctcagcccctgaatggagagagatgctatatgtggctttctccagcatttccggggcctgaaatggctaatctgtaagagctagagg

SEQ ID NO: 6771026 - DNA, 74 bp, Homo sapiens
tcactgagctgatagattctgaatgctagataaaatttataacagtatttctgaatattatcataaggcagtgg

SEQ ID NO: 6771027 - DNA, 72 bp, Homo sapiens
gattcatactgtgagatgaccaactgactggtgctttgactaaccactttcagcattttatagtaaaatgtc

SEQ ID NO: 6771028 - DNA, 58 bp, Homo sapiens
gggagggggttggggtcctgccttagggtcaaccagagagcatctccttcctcctgct

SEQ ID NO: 6771029 - DNA, 92 bp, Homo sapiens
caggaggcataaaatcctattgcagatgtgttgctaattgtaattctcggatacagttaggcttatgtctgtagtttttagttttgcccttg

SEQ ID NO: 6771030 - DNA, 103 bp, Homo sapiens
tatatgtgtatgtatatagatagatatgtagatatctcattatgatcaatttaaaggacataatcagatgtgtacataagagcatttgttacattcatatgta

SEQ ID NO: 6771031 - DNA, 129 bp, Homo sapiens
tatgctttattttatcttaatttttacgtagcttgttgagggtcaaattggaaggtggatatcctagtcacagaatatgtggctgtaccagttttctattttagcctggatagtctaattgagattata

SEQ ID NO: 6771032 - DNA, 56 bp, Homo sapiens
ggagaagacaattctgggtggaggaaactggatgttctaagcctggaatcttgttc

SEQ ID NO: 6771033 - DNA, 61 bp, Homo sapiens
ttctaaacctggagcaccctcatatctgtctcaatagaggaggaaaaatttaggttttgaa

SEQ ID NO: 6771034 - DNA, 57 bp, Homo sapiens
tggatgctcctaggcccaatgtaatagagctactccacaggccttaggggccattca

SEQ ID NO: 6771035 - DNA, 58 bp, Homo sapiens
gggaagtacacatagctggctccttctcatccaggtctcagctcaaatgtcgcttcct

SEQ ID NO: 6771036 - DNA, 112 bp, Homo sapiens
agacagacgcaggaacagcatggccctaaggtatgtgctgggtgttctcttagcctgcggcagacatcctggggagggcaatgcctgggggagctgatgcctgggtgagtct

SEQ ID NO: 6771037 - DNA, 55 bp, Homo sapiens
ggtagaaacttatttgcagaaaagaaacaattatttgcattttaagtttactgct

SEQ ID NO: 6771038 - DNA, 64 bp, Homo sapiens
tatgctcacttatgtaggtgctaattgcctaaaaatatattacttctctgcatatgtgaggata

SEQ ID NO: 6771039 - DNA, 68 bp, Homo sapiens
agctggcctgttagagctgagttgttttgggctgcaatgaggcccttgctcattttctggaggcagct

SEQ ID NO: 6771040 - DNA, 67 bp, Homo sapiens
ggaaaaaggtgtgaagtaaatgcatcgactgatgtaccttgcacacatttcacaccctcctttttct

SEQ ID NO: 6771041 - DNA, 67 bp, Homo sapiens
ggagagagaggaactagcagggatttggagtttattgatccagtggactgctgtgattccctcctcc

SEQ ID NO: 6771042 - DNA, 74 bp, Homo sapiens
gctcaccctcgcaggccgggcactgcgctaggtgctgatgctgcacctcattcaaccctggcctgtggggctgc

SEQ ID NO: 6771043 - DNA, 83 bp, Homo sapiens
tggaatgacagaagtttattttacacatccatggagaatagctgtctccattgggaaaagaaatgcaactaagtacatgccca

SEQ ID NO: 6771044 - DNA, 84 bp, Homo sapiens
cagctgaacctgactcgccaccaatcaatgcagcaaaatggtgaacatttgtccattttattggatggtgggcaaggaagactg

SEQ ID NO: 6771045 - DNA, 71 bp, Homo sapiens
tcctaactcctggctgtatgctggcctcagagctacactgctcagatggagcatgtgagccccttatggga

SEQ ID NO: 6771046 - DNA, 56 bp, Homo sapiens
aggaagaggtagctgtcaaggggaaaggacaaggtccttgaagatacaagtttctt

SEQ ID NO: 6771047 - DNA, 55 bp, Homo sapiens
ggttttagtactagagccttgtactgaagtacaagtgacattcaatactagagcc

SEQ ID NO: 6771048 - DNA, 81 bp, Homo sapiens
atctgtggcttttgcctttcaaattggcaaatgtttttaaatgctcatagccagtgcctgtaaaggtacagagaaacagat

SEQ ID NO: 6771049 - DNA, 60 bp, Homo sapiens
ggcccaggctggagtgcagtggtgtgatcatagctcaccacagcctccatctcctgggct

SEQ ID NO: 6771050 - DNA, 85 bp, Homo sapiens
tttaaatccttgatagctcagtgtcttatttgagttctccaggaagtggaggttgggtcagagattgaatgcatctagatttaag

SEQ ID NO: 6771051 - DNA, 60 bp, Homo sapiens
acagatgaatctgtgattgctggtaaacccgtcctggtgtagcacagtcaaggtcactgt

SEQ ID NO: 6771052 - DNA, 65 bp, Homo sapiens
tgggtctcttttatggtgagttgatctttgagtgagaggacacacttgcagagaggagggactta

SEQ ID NO: 6771053 - DNA, 89 bp, Homo sapiens
gaaggtgcattctgttccataagtggtgctttgttgctgtgtcctcacatggcagaaggggcaaggtatctctctggagctctgccttc

SEQ ID NO: 6771054 - DNA, 69 bp, Homo sapiens
gttctcattgcacaggaagctggtcatttagactgcagtcttcatttgtgtgcctgatgcaataagaac

SEQ ID NO: 6771055 - DNA, 64 bp, Homo sapiens
cattatttcagctgggaaagtcactatatgaattaatagcagatttcccagctgaaaataaatg

SEQ ID NO: 6771056 - DNA, 55 bp, Homo sapiens
agcatggtgataggggagggcgtgtgtactgcctttgacattttctcactgtgtt

SEQ ID NO: 6771057 - DNA, 56 bp, Homo sapiens
gtgaaagcatctgactgtgccagttctgattttggtacataaatggatgttttcat

SEQ ID NO: 6771058 - DNA, 90 bp, Homo sapiens
aggtgggcgaggactgagcctcggtgtttttttgggtggtggctggaaacagcccctctcccacgtggcagaggctcagcctggctccct

SEQ ID NO: 6771059 - DNA, 72 bp, Homo sapiens
cctgcagccccggggccagggctgagcggctggagcagttcagtggggccttgggggacaacaccaggcagg

SEQ ID NO: 6771060 - DNA, 55 bp, Homo sapiens
gccagggccagtcagatctgatcaaagcctaaaagatcatctcacagggcctggc

SEQ ID NO: 6771061 - DNA, 84 bp, Homo sapiens
ttatttataatgcagccctcaggaaccacattgctgcttccattggagtagggctggggctcctgaagctaacatcttgaatga

SEQ ID NO: 6771062 - DNA, 63 bp, Homo sapiens
gggatgggagtgatggtgttcttagaccttcgcacggtttctgagcacgttcatttaaatccc

SEQ ID NO: 6771063 - DNA, 129 bp, Homo sapiens
tggaaggcgggagctgatgagtcactgagtgtgctattgcaccatcataattgttagcatcataaacaatggtatatgacggggtagagcagattaaagagaatgaagtgtcttgtgcagttccctcta

SEQ ID NO: 6771064 - DNA, 83 bp, Homo sapiens
ccaagaggcttcaatgttcagggcagccctgctaccctattttttgggtggtggggtgggaacttggaaagaggtcttgctgg

SEQ ID NO: 6771065 - DNA, 91 bp, Homo sapiens
gcaccttctcatgccaggccccacgctgggcaggggagccagagatgccaccctcgcccacctgtggccccagcctggctggagagtgtgt

SEQ ID NO: 6771066 - DNA, 57 bp, Homo sapiens
tagatggacagcaagctctgttggcaaaaatttcacaacaggccctggacccatctg

SEQ ID NO: 6771067 - DNA, 77 bp, Homo sapiens
aatcttttaatatatttgtgattaactggcaactataataaggagttgcagggaaatagaaataaacagaaaaggtt

SEQ ID NO: 6771068 - DNA, 128 bp, Homo sapiens
gctcgtaggacgcccacagcccatggaatcatgaatgccgaggagctgcccccttcatctttaattcaaatgagcctgaggatgacgatggcaatggcactgatgtgggctgagctcttaccacatgc

SEQ ID NO: 6771069 - DNA, 70 bp, Homo sapiens
ccagggctcctttgccttctggcttgcatttgggttcaaccaatagaaggcacagataggtaatagatgg

SEQ ID NO: 6771070 - DNA, 84 bp, Homo sapiens
ggccttgtgtgagctgggcctgggatcctaagagagttttagcttggacatctggacgagccccagcccctctctcacaagtcc

SEQ ID NO: 6771071 - DNA, 70 bp, Homo sapiens
attagggtgaaaaggaataagaaactaaagtggcttccaaatgtttgtgtcttggtttcttcaccctagt

SEQ ID NO: 6771072 - DNA, 74 bp, Homo sapiens
aatgggctgccaggggcctcacaggccatggtaatgcagaagccctggctagattgagcccttgcatgcttgtt

SEQ ID NO: 6771073 - DNA, 125 bp, Homo sapiens
tctgaatgtcacattcaacatttcacctttaggggattctcagttgggatgatttggatttatttgaataagttcaaatcatcccaacttagaatcccctaaagctgaaaagtaacattaacaga

SEQ ID NO: 6771074 - DNA, 57 bp, Homo sapiens
tactactttgggatttcatgagagctaagtaatacacttaagtctcttagagtagta

SEQ ID NO: 6771075 - DNA, 68 bp, Homo sapiens
gttctgctatgtgaggatgtaaccagaagtcagcagtctgtgacctggaagatggtcctcaccagaac

SEQ ID NO: 6771076 - DNA, 90 bp, Homo sapiens
ggcctctgtaggggcctgtgtctgtgcctgtcctgctcggcacatagaggaaagccagggccggggcaggcaggggtctctggctgggcc

SEQ ID NO: 6771077 - DNA, 129 bp, Homo sapiens
tttgtgaagcagacaaaatacttctcctagtttagctttagattgtaccagcatctttagcagtcagatctcactgctggctcgtattgatcttgaggccaactaaaatctctaggtctatttcacaca

SEQ ID NO: 6771078 - DNA, 82 bp, Homo sapiens
agggcacagctattagattggacttccgcacaatgtctagtacagacttgctcaatgcttgaagccaataattaatgaccct

SEQ ID NO: 6771079 - DNA, 59 bp, Homo sapiens
gtttatctggttggagagagaagaagatacatctctactcttaacacagctaggaaagc

SEQ ID NO: 6771080 - DNA, 79 bp, Homo sapiens
gggtatcctgcttaaacatactatttatataaaaatccttacagatgaagaaatatagttagtatgaggtatattgcct

SEQ ID NO: 6771081 - DNA, 76 bp, Homo sapiens
acatagaggagagatggctctaggttgggcagtttgcgtatcaaaggcacactcccagctgagccctttgctgtgt

SEQ ID NO: 6771082 - DNA, 60 bp, Homo sapiens
agattcagctgctgtatgtaataattacggaagtatgtttgcaaataatagcctgaaact

SEQ ID NO: 6771083 - DNA, 91 bp, Homo sapiens
ccacgatctttgagatattctggattctcaggatagagagctcgctgaaccatgtatctttctgtttgaatacagctctcactgaatgtgg

SEQ ID NO: 6771084 - DNA, 75 bp, Homo sapiens
cctggcatcccttccctaagcactagctctgtgcaaacccttttctcaggctctgctttctggggggatcccagg

SEQ ID NO: 6771085 - DNA, 84 bp, Homo sapiens
ggtgggcccagcggttcctgtggattggagccaggcagtgtgatgttaccagtcaccactccaggtcccagttcctggcccgct

SEQ ID NO: 6771086 - DNA, 90 bp, Homo sapiens
caataatgcaacttcagtgcgattctgcagatttccttccgaagtgagagaagaaatagaatcacattttgataagatattgcattgttg

SEQ ID NO: 6771087 - DNA, 64 bp, Homo sapiens
aaatttggcttctcaaaataactggttttaactttgttgaactagaaaagggaggctcaaattt

SEQ ID NO: 6771088 - DNA, 58 bp, Homo sapiens
gtgcagaacatgcaggtttgttatacaggtatacgcatgccatgttggtttgttgcac

SEQ ID NO: 6771089 - DNA, 58 bp, Homo sapiens
ttagtaaatgcttgcaacatcccaggtgctatattaagcactttgcatgtgtgtctaa

SEQ ID NO: 6771090 - DNA, 79 bp, Homo sapiens
ggtgaaatccctggatagcaaagctcctggttctcaacttcattcatataagaaaggttcttggtgtccagatttcggc

SEQ ID NO: 6771091 - DNA, 80 bp, Homo sapiens
cacttgaggaccttattaaagaccggacacttctttttgctaggaagtttagtcttgtcttagtaaatctgtctccggtg

SEQ ID NO: 6771092 - DNA, 66 bp, Homo sapiens
ggttggatttcctaatggtgccttagtcattcatacacattattctggggccaaagggttccaatc

SEQ ID NO: 6771093 - DNA, 82 bp, Homo sapiens
agttttagggtacatgcgcacaacatgcaggttagttacatatgtatacatgtgccatgttggtgtgctgcacccgtcaact

SEQ ID NO: 6771094 - DNA, 73 bp, Homo sapiens
accagcctggcaggtagcattgaggagtcaaatagttgtttcccagtattaccttcaggaagaatgcaagggt

SEQ ID NO: 6771095 - DNA, 64 bp, Homo sapiens
ctgcaggcgagtgaacagactctcaacagcacgattaagccctgagatttaatcatttgctcag

SEQ ID NO: 6771096 - DNA, 56 bp, Homo sapiens
ctgtgcaaggtacatccttgatgtgttacccacatcgtctcatgaatcttgtcaag

SEQ ID NO: 6771097 - DNA, 65 bp, Homo sapiens
ggggctggtgtttgctgaagctggagccaaggtggccacccatcctcagctcaggactcagcccc

SEQ ID NO: 6771098 - DNA, 63 bp, Homo sapiens
gtgttagtctgagactttttctgtgtgggagagattgtatcctacacacagtctagaagacat

SEQ ID NO: 6771099 - DNA, 70 bp, Homo sapiens
ctattctgtgggtcactctatcctgcttagtcatctggcttggtagtccaggttatccttctaggaatgg

SEQ ID NO: 6771100 - DNA, 59 bp, Homo sapiens
aggctcctggaaacttcagggaataaaagagtatatgttacattttctgaagtgagcct

SEQ ID NO: 6771101 - DNA, 60 bp, Homo sapiens
gcatgcagtgcaattcaatgtagttcttagagagtgacatggagcactgtgcctgcatgt

SEQ ID NO: 6771102 - DNA, 61 bp, Homo sapiens
ttcatcattgccagtctttaaagaaacttaaagtgcatgctctcctggcagtgagactgaa

SEQ ID NO: 6771103 - DNA, 56 bp, Homo sapiens
tctactatgtttcttaaatagaatgtataagtgttctgaaataggagccatgtaga

SEQ ID NO: 6771104 - DNA, 57 bp, Homo sapiens
tccttggaagctggtttttcatatacacgaatatgaccacattccagctgtccagga

SEQ ID NO: 6771105 - DNA, 64 bp, Homo sapiens
gagggccagcctgccaagggcctgagggacaggaacaagaacagcgctctccgggagagccttc

SEQ ID NO: 6771106 - DNA, 85 bp, Homo sapiens
gcaaaggtcatagagtgtgagcctacaggccaaagctgtccacaaacatgttttgctggcttctcagtattttatgactttgagc

SEQ ID NO: 6771107 - DNA, 60 bp, Homo sapiens
ctcatagatgtcaccttgctgtaccctaacatggtaaaaaaggcaaggcagctctctggg

SEQ ID NO: 6771108 - DNA, 77 bp, Homo sapiens
ggcagtaggtgctggggtacccaacagttacagcaacatgaaccagttgtatgtcctccagcaaatcagccactgcc

SEQ ID NO: 6771109 - DNA, 55 bp, Homo sapiens
agagtgtaaaaacttagtgagatgatagtgttagttatcatacatgttacactct

SEQ ID NO: 6771110 - DNA, 70 bp, Homo sapiens
ccaagtttgtggcagagctggaactggtactcagttacttggctccgagtccagagctccctcaactagg

SEQ ID NO: 6771111 - DNA, 61 bp, Homo sapiens
ctggctttcattcattcaggccctcctctcccatccagtctgttctgagtactgtagccag

SEQ ID NO: 6771112 - DNA, 55 bp, Homo sapiens
gtaggtgaagttctggcgagctgtggcactcagcagtttcaggaagttcagctgc

SEQ ID NO: 6771113 - DNA, 95 bp, Homo sapiens
gcatggcctgttctgtttgcacaagctgagtgtgggagacaatagggcactgatgattacaagacagtgtggtaaatattataatagagttgtgt

SEQ ID NO: 6771114 - DNA, 59 bp, Homo sapiens
ctatcacagagggttgttttgagccatgtaacgctctcagaacagttcttggtgcatag

SEQ ID NO: 6771115 - DNA, 61 bp, Homo sapiens
tggcccgctgtgaccacgccttttgctggggcctgctggaggagttggtcaccgtggccca

SEQ ID NO: 6771116 - DNA, 71 bp, Homo sapiens
agtttacctctagctcctacaagtacagcaaagaagaaatttttttatggcatgaaggagagaataaaact

SEQ ID NO: 6771117 - DNA, 56 bp, Homo sapiens
tgcttaaacatccagacagtatgatgttttctaagcatctatctgatgattgagca

SEQ ID NO: 6771118 - DNA, 55 bp, Homo sapiens
tggagccttgggtgcaagggatcagaaaggcaggtcccactggcccagggctcca

SEQ ID NO: 6771119 - DNA, 72 bp, Homo sapiens
gcatttggtgacaccgcaggcagaggggggacgccacagccagctctgcccgcggatgccacgtccatttgc

SEQ ID NO: 6771120 - DNA, 75 bp, Homo sapiens
gtgtagctaagtaacaacctggagagtgggggaaagcttttatttccaacatttatcaaggttgttgacctacac

SEQ ID NO: 6771121 - DNA, 80 bp, Homo sapiens
catttcagatttcttttcaagagggtgcttctaaagtaactattgcgcaaaagtcctctgaaaaaataggtcaagaagtg

SEQ ID NO: 6771122 - DNA, 84 bp, Homo sapiens
cctacctgataagctctatgagtacaaggactctgtctctctttaccagtatgtagcatagggtcctagtacacagttaggagg

SEQ ID NO: 6771123 - DNA, 60 bp, Homo sapiens
atgtaacatatgtgatcgcatttttgtaaaagaaccatgtgtgtttatatgtgtttatat

SEQ ID NO: 6771124 - DNA, 87 bp, Homo sapiens
ggcttttgaatatttaatagtatcactctctctcctctgctcatgcagaaggcagggaatgtggtgctagatgagtatattaacgct

SEQ ID NO: 6771125 - DNA, 62 bp, Homo sapiens
cttcgatagcccaaggggctgggggtggcgagggggcccccatggcttcgaggctggggaag

SEQ ID NO: 6771126 - DNA, 59 bp, Homo sapiens
tttttattcatgatcttcattctagttgaatctgtggagctattggtcatgagtagaga

SEQ ID NO: 6771127 - DNA, 63 bp, Homo sapiens
ggaagattcagcatatatgagtgggcctttggcctcgggttacttatgatctggttgtctttc

SEQ ID NO: 6771128 - DNA, 84 bp, Homo sapiens
ccttggatgtactggcagatgggcagaaggccttgcatgctggcttcctgccatgctgtcttctgttctgtgaggcttcctagg

SEQ ID NO: 6771129 - DNA, 64 bp, Homo sapiens
ttggtttgagtccttacaggctagtctaggatttttcttagaaagcagttgtgggggctcccaa

SEQ ID NO: 6771130 - DNA, 91 bp, Homo sapiens
ccctgtcttgtggaatcagaattactgaatggagcccaggcattttttaaaaaagttcccttggtaattctgttccttagcaagtcttggg

SEQ ID NO: 6771131 - DNA, 73 bp, Homo sapiens
attgatgctgctctgagtattaacggaggccacaaactatgtggcctcatttatatcacttagagttgtcagt

SEQ ID NO: 6771132 - DNA, 72 bp, Homo sapiens
ggtcagtcctggaagtgcttggtgagggcttctagcagctcctgcttcttcagccagtactccaggcaggcc

SEQ ID NO: 6771133 - DNA, 83 bp, Homo sapiens
ggagtgcttgcatgatcaatgacaggttatctatgaaaagcagtgaatatatgatattctaaattgacaccacaagtacctcc

SEQ ID NO: 6771134 - DNA, 66 bp, Homo sapiens
gaggctgtcaaatggctctaaaagttctgatgcatcataggtcctataggtgtctttgccagcttt

SEQ ID NO: 6771135 - DNA, 79 bp, Homo sapiens
tcagagcatctgttccctctcacttaaagcttggaatcaaattagattctgtccagaaagggggcaacaagtattctga

SEQ ID NO: 6771136 - DNA, 58 bp, Homo sapiens
gctgtgccctcagggaccatctgcagaggtagtgtggccaattatgggcattcaaagc

SEQ ID NO: 6771137 - DNA, 77 bp, Homo sapiens
tttaaagatcagtttctaccatgtggaatgcatgataaggtatattgaattgcacgttcttggaaattatctctaaa

SEQ ID NO: 6771138 - DNA, 68 bp, Homo sapiens
tagcagatgttccctggtcccttttcctggattggggtgaggaaaggggaccaggggacacctgtctg

SEQ ID NO: 6771139 - DNA, 64 bp, Homo sapiens
ggattgcaaaagccgaggcactccagctaggacacggcgtcattggagtgccctggtgcgttcc

SEQ ID NO: 6771140 - DNA, 84 bp, Homo sapiens
agatccttgtgagggtgtcttcaggagaattggggcacaaaaatcgacagaaacccccttctctctgaagaccccaaactatct

SEQ ID NO: 6771141 - DNA, 130 bp, Homo sapiens
tgggtagtggagagaaggaagaggagtgacctggttttgattagttaattcagattagggagtaaattctgatttcacagctgctgttcaggttcaatggcactaccaatttttccatttccagttccca

SEQ ID NO: 6771142 - DNA, 102 bp, Homo sapiens
tgagagggagtctcgctctgtcaccaggctggagtgcagtggtgtgttatctgggctcactgcaaactccgcctcccaggttcaagcaattctcctgcctca

SEQ ID NO: 6771143 - DNA, 84 bp, Homo sapiens
aaatagggaaggaatgtgtgtgtgtgtgtgtgtgtgtgtgtgtgtgtatgcatgtatatattacactcacttgcttctatattt

SEQ ID NO: 6771144 - DNA, 78 bp, Homo sapiens
gtgatgtgacggcagaggcagatattggggtgatgtgtgtacaagccaagaaacaccaatgactgctggccacatcac

SEQ ID NO: 6771145 - DNA, 81 bp, Homo sapiens
gcagcaaagacaactgttttctgtaaagggccagaggatcaatactttgtcttttgtgggaaatatggtctttgtcaaagc

SEQ ID NO: 6771146 - DNA, 78 bp, Homo sapiens
acccacagacatttagaagtctaatggccagaacgaaataaccgaggttggttttcggggctgttgagtgttgtgggt

SEQ ID NO: 6771147 - DNA, 77 bp, Homo sapiens
gaagcttaatatcttcttatctgaaagtaatattttgtagttttaatagaatttatgaggaagggagtttgagtttc

SEQ ID NO: 6771148 - DNA, 66 bp, Homo sapiens
acaaagtttttcaggtaacaaacagctcaattgttctggggtgaaagttactgtgataacctttgt

SEQ ID NO: 6771149 - DNA, 70 bp, Homo sapiens
agagagagaagtggttttccagagtggcaagaggacacggtcccagtgccctggtgaagtgctctcctct

SEQ ID NO: 6771150 - DNA, 107 bp, Homo sapiens
ggaatgaagatgaaataagctcccgagatgaggtaggggcagtgttcttatctaagccttagatacagaacaagcctcacctcctgctccagcctccccttctctcc

SEQ ID NO: 6771151 - DNA, 80 bp, Homo sapiens
gagtgcaatgttacatctgagcaacagaacactaggtagtttctatgttgtcttgcctcaggtggcagtaggtagcactc

SEQ ID NO: 6771152 - DNA, 62 bp, Homo sapiens
tgcagtgcagccgagatcaggtgctattaggctacacctgagtacagctggttgctatagca

SEQ ID NO: 6771153 - DNA, 69 bp, Homo sapiens
ttctactatggctcaattctagtggtttttagactcatacttgacctgatagaatgagtcatgaatgaa

SEQ ID NO: 6771154 - DNA, 57 bp, Homo sapiens
aggtagcttatgaaatgtgaggggccaccacacagtgccccacactattgagcactt

SEQ ID NO: 6771155 - DNA, 65 bp, Homo sapiens
ctcaggtgtgaactatttggaaagaaataaacattttctgtaccaaaaatgtgtcagactctgag

SEQ ID NO: 6771156 - DNA, 71 bp, Homo sapiens
ttttcccatttaaacacaagctttcaggatgcaatgctttaacctaaagagtgtctttatggtggagaaga

SEQ ID NO: 6771157 - DNA, 91 bp, Homo sapiens
atattctggaagttactgactttcagaagtatattctggaagttactgactttcggaagtatattctggaagttattgactctgtgagtgt

SEQ ID NO: 6771158 - DNA, 126 bp, Homo sapiens
gttctgtaatgattagggttttatctggactgtctgggtggatgggctaagctggaggggcattttggaatactcctccagtggcccagtccttcaacagccctggcccatatttctttgcagagc

SEQ ID NO: 6771159 - DNA, 77 bp, Homo sapiens
ggctgggacttgggctatgctctggacaaggctggctggtgcaatgatgccctctagaggatggatcaggcccagtc

SEQ ID NO: 6771160 - DNA, 68 bp, Homo sapiens
caccgggatgcaggagggtgttgtcagtgggtttccctccctcttacacagattcctctagctgggtg

SEQ ID NO: 6771161 - DNA, 83 bp, Homo sapiens
gcggaacgccttggcgcactgggcgcacgcgtagggccgctcgcccgtgtgcacgcgccggtgctgggtcaggtgcgtgacgc

SEQ ID NO: 6771162 - DNA, 64 bp, Homo sapiens
gctaaatgaggtcattaatggtgggatcctaatctgataggattggtggcctcagaaaaagagc

SEQ ID NO: 6771163 - DNA, 130 bp, Homo sapiens
ctctggtaatggtcactgactgctctgttgagctgcggtttcagggcacccccagggcagcccacttcccaccctggagtccccgagaggcctgcacagcacctggcccacagttgatgaccgtgcaggg

SEQ ID NO: 6771164 - DNA, 82 bp, Homo sapiens
ggctaacctgtacctggtctccatttgattaaacttcatttgtttggccaaaggaaagactactgttggtaaggtagaagcc

SEQ ID NO: 6771165 - DNA, 80 bp, Homo sapiens
ttatgttttaaaaattgctatatgtgaatgtgaatgttcatgcatttacatgcatatatgtgtgtgtttctgtgatatga

SEQ ID NO: 6771166 - DNA, 56 bp, Homo sapiens
agtatctttacttaaatagtcagtatgccaggatggcatattttgagtgatgtatt

SEQ ID NO: 6771167 - DNA, 112 bp, Homo sapiens
gagtgaaaaaggcaacatgaaacaagcatgtgacatgtgtcatcttttctacaaaattggagggaaagagaaatgtatgcacatatttgcttgaatgtgcagaaaatagctc

SEQ ID NO: 6771168 - DNA, 73 bp, Homo sapiens
gagctcagtgccttacctttgcagggccagggtccccgttctggccagtgttggctagggacacttgcagctc

SEQ ID NO: 6771169 - DNA, 83 bp, Homo sapiens
ctggcttcttcccctaatggcctggccacatccagcaggcttttcacagcctgtggctggtcaggccagcagcatgatgttag

SEQ ID NO: 6771170 - DNA, 67 bp, Homo sapiens
ggcccatgtacactcatgtaactatatgcagatttagtgttctagaatgatatgaggtactcaggcc

SEQ ID NO: 6771171 - DNA, 104 bp, Homo sapiens
gcccagcagcagcttcctcagcagtgttcaggcctctgtgggagggagggaccacgcagcctctccttcctgcagatctgagatgccatggtttgctgttgggc

SEQ ID NO: 6771172 - DNA, 64 bp, Homo sapiens
gtgtcatggcacgttaggtgttaattaggaatcgtctaaagcaaaaatgaactgccatctgcac

SEQ ID NO: 6771173 - DNA, 102 bp, Homo sapiens
atctgttttccttcccatcagtctagctctgcccattggtcattcgacttgatccaggtaatgccaatgggcagaactagactaacgggaaggaaaacagat

SEQ ID NO: 6771174 - DNA, 66 bp, Homo sapiens
tgggttaggcagtgtggtatagcagatatgtggttaacatcattgctgtgtcatttgtttaatctg

SEQ ID NO: 6771175 - DNA, 79 bp, Homo sapiens
gctagggtcagttttgagaaagcgtgcatccaattgtgtcatgcacagaattttctctttacaatgaactggacccagt

SEQ ID NO: 6771176 - DNA, 55 bp, Homo sapiens
ccgaggagtagggtgtctacggggcgggcccgtgtagaccagctgtgctcctcgg

SEQ ID NO: 6771177 - DNA, 72 bp, Homo sapiens
gtggagagggccaggagaatgggattaccctatgaccaaggagacatgggaagaagccctccttccttccac

SEQ ID NO: 6771178 - DNA, 65 bp, Homo sapiens
gtttgattctggccacacactattattctgctctcctctctgcaaatgaaggtggtgctacagac

SEQ ID NO: 6771179 - DNA, 69 bp, Homo sapiens
tatagtgtttttacattatcttgttatctttcaaccttggttgaattaggcaaggtaggtatcattgta

SEQ ID NO: 6771180 - DNA, 82 bp, Homo sapiens
ttggaaggctttctcagtaatgtcctggaattacggttacagcctgcatttcatgttaactgaacagaaaaccagcctccaa

SEQ ID NO: 6771181 - DNA, 67 bp, Homo sapiens
tggcatgagggcatttacagaaatgctggcggaactgctgccagggaggctgtagggtcctctggca

SEQ ID NO: 6771182 - DNA, 86 bp, Homo sapiens
atgggaacactatgaattttattcagggataacatccaggttgttttgacccacagttttgccttgggtttcaggttcattcccat

SEQ ID NO: 6771183 - DNA, 80 bp, Homo sapiens
gcttttattaagcactttctgtgaggtaaagcacagaaatagattcgtatttaagtgtgtattatctcattaatgaaagc

SEQ ID NO: 6771184 - DNA, 55 bp, Homo sapiens
ctcactgctcttcccaagctgccatgttagaggccactggaaagttggcagtgag

SEQ ID NO: 6771185 - DNA, 75 bp, Homo sapiens
ttatagtgtgacattttcatgaatttgagctatttttctttctgttatgtcaaattagtgaagtgttacttgtaa

SEQ ID NO: 6771186 - DNA, 77 bp, Homo sapiens
ttgtttatgtattattcatcagtgggacatttgggttgtttccacttttttactatgaataatggtgctgtaaacga

SEQ ID NO: 6771187 - DNA, 85 bp, Homo sapiens
ggaggagccttcttggggcagcccaggctgagcctctacccctgtgacccgctcctggccgggctgctcttggatgaggtactcc

SEQ ID NO: 6771188 - DNA, 90 bp, Homo sapiens
gggaggggagctgtgcacacggcggaggcgcacggcgtgggcacccagcacccggtacactgtgtcctcccgctgcacccagccccttcc

SEQ ID NO: 6771189 - DNA, 104 bp, Homo sapiens
gtatagtgtgcagatggtacactgaacaactctaggtggtatcattcacgtagttcatgtggtacatctttaaattgttcagtgtacaacctgtacaactgtat

SEQ ID NO: 6771190 - DNA, 58 bp, Homo sapiens
ttgattttactgctgctgaaaactgtctgaagatgagaagcagtttcagtaagaacaa

SEQ ID NO: 6771191 - DNA, 59 bp, Homo sapiens
ggtggacccttggatttctgaagacattaattgtcttaatagtatccaggttccttgcc

SEQ ID NO: 6771192 - DNA, 57 bp, Homo sapiens
cattaacactttggatttagacatatgtagattagctataagtcagaagtgttaatg

SEQ ID NO: 6771193 - DNA, 128 bp, Homo sapiens
gcctctcatcactcctcttgcctctcacctcctgaaaaagcaagttgcctaggttgagaaaggatcggcaacagtcaacttctttgtccatttccctcaggagaggagaaggtatgggaactagtggc

SEQ ID NO: 6771194 - DNA, 77 bp, Homo sapiens
ttctttgcagacttataatctgtcccagactaaaatgttacatttccttttgtgggcaaattatatgtctcattgga

SEQ ID NO: 6771195 - DNA, 101 bp, Homo sapiens
ttcatctcttcttcaaacctttgttgcaatatccatgggattcaactgtgcagctgagtcagtgaatggtgtatgctaatccaggtttactgagatctgaa

SEQ ID NO: 6771196 - DNA, 77 bp, Homo sapiens
gagtggaaattccttggagtcaaacagggagaaaatacgtctcagtgttaaagactttccagagacttcttccattc

SEQ ID NO: 6771197 - DNA, 85 bp, Homo sapiens
acaccttcagctgcgaggagagctgtagtgagacctttgtgtctaatgactgccgtctctcttcaatttcatgtaatgagtgtgt

SEQ ID NO: 6771198 - DNA, 80 bp, Homo sapiens
ttcttaattgatgactgaagcctgagcttttttattatctaatgttccatgaaaggctctattgttttcatatttgagag

SEQ ID NO: 6771199 - DNA, 65 bp, Homo sapiens
ggccgttcatcagaggagtacacaggcctgaaatgacacctgcctgcgtcctctgagggcaggct

SEQ ID NO: 6771200 - DNA, 59 bp, Homo sapiens
actggcaatgttgagcatttcagttgcctacactctcactgacacttgatattgtcagt

SEQ ID NO: 6771201 - DNA, 63 bp, Homo sapiens
acaggcagcaggcctctgttgagggccttctgttggagggcccatgtcgggcgctctgcttgt

SEQ ID NO: 6771202 - DNA, 67 bp, Homo sapiens
gtgacaaaagctttgcagctaagcacagtaatttatgttgataaattgcagctgtcagagtgttcac

SEQ ID NO: 6771203 - DNA, 59 bp, Homo sapiens
tgccataaagaggaggctgaacttcctgcacaatgtccgtttttccttctctacaggca

SEQ ID NO: 6771204 - DNA, 66 bp, Homo sapiens
ggtacatgtgcacaatgtgcaggttagttacatatgtatacatgtgccatgttgatgcgctgcacc

SEQ ID NO: 6771205 - DNA, 74 bp, Homo sapiens
gaaatggttgctggaagagcatttgcatagggcattctcttgttctgagctcttgctcattcctacctcatttc

SEQ ID NO: 6771206 - DNA, 60 bp, Homo sapiens
tgcaaaacaagtgtggcaaactcatgcaaatatccatcagaagccaccttttgttgggca

SEQ ID NO: 6771207 - DNA, 69 bp, Homo sapiens
ttcttttttctgtgcagttcttgtcttgacttatgaaagccaaatatccattctgtatggggagatgaa

SEQ ID NO: 6771208 - DNA, 85 bp, Homo sapiens
acaaatttctttgggggaagaggatagacagtggtcctaaccataggcaagaaacttcaattttctctttcaatataaactttgt

SEQ ID NO: 6771209 - DNA, 55 bp, Homo sapiens
cttgcagccttggtgactgagtctgcctagcccttatgtaaccaaaggttgggag

SEQ ID NO: 6771210 - DNA, 82 bp, Homo sapiens
cacagggagcatcttggccagcgacgaccttcttagtacccctctgaggtggtcgttctgttgtgcttgatgacttccagtg

SEQ ID NO: 6771211 - DNA, 78 bp, Homo sapiens
cttcctataatagaatcagttctctgggcatgaaggtaaattacttctgttctaggcaaaagctgattttccaggagg

SEQ ID NO: 6771212 - DNA, 89 bp, Homo sapiens
gagactctttctattattattcacttgactttgtcatttgtgctgacatacagccaaagatcagtgtgcaagttattaaagagagtttc

SEQ ID NO: 6771213 - DNA, 89 bp, Homo sapiens
ctgttccttctgattttctcatcacttaacatctgcttgtgtcttcagtgatgaggtggtgtggagaagagagaagaggatctgaacag

SEQ ID NO: 6771214 - DNA, 57 bp, Homo sapiens
tctggatccaaagctctttcatggggacgtcctcttcccctcttggcttggtccaga

SEQ ID NO: 6771215 - DNA, 75 bp, Homo sapiens
ttagtcgggaaagctactggtgtcctctgccaagcaggttacaggggacaagggtagcatccattacctgactga

SEQ ID NO: 6771216 - DNA, 58 bp, Homo sapiens
aatggtgttctctgttaggaacaatatcagattctgtttctgctaagaaaacattatt

SEQ ID NO: 6771217 - DNA, 60 bp, Homo sapiens
gggcagctgcaaatctgctctgtaggacttcacttcaacaccagactaatgcagtagcct

SEQ ID NO: 6771218 - DNA, 73 bp, Homo sapiens
ttcagaaacagagtgagtgagtgagtgagagatttactataaaaaactggcttacttgattgtggagtctgag

SEQ ID NO: 6771219 - DNA, 66 bp, Homo sapiens
gagttatgacttgagaattcataattatctaggaatgtcttggctcatgtttctctgtcgtgattt

SEQ ID NO: 6771220 - DNA, 94 bp, Homo sapiens
gaccctctactggtaacttggttgctaaaggattttgtatttatttctgtcaacgtaagataatttctgatttagctacctcccatatggggtt

SEQ ID NO: 6771221 - DNA, 75 bp, Homo sapiens
agatgggatttgtcttaatatgtgcattctgtttgccaaggcatacatagcatgtttggacacatggtctcattt

SEQ ID NO: 6771222 - DNA, 56 bp, Homo sapiens
tcatgcttagtttaatgctctgcagtttctctgtggaaattcttactaagttttga

SEQ ID NO: 6771223 - DNA, 77 bp, Homo sapiens
agaactacccacatttctggactgaaaaggaagtgctagtacccatttttgactgaggccagaggtagggctgttct

SEQ ID NO: 6771224 - DNA, 60 bp, Homo sapiens
atgagcaaatgaaacagaagtgactgttttgaaagcaacagccctgtttcattagtttat

SEQ ID NO: 6771225 - DNA, 55 bp, Homo sapiens
ttctgggtgccatgttgtcttgagttgcccttttcaaagatatgctagcccagag

SEQ ID NO: 6771226 - DNA, 58 bp, Homo sapiens
gagcctggcattttttgcttaaggtctatgaccctagacagaaatttatgtcagtatc

SEQ ID NO: 6771227 - DNA, 60 bp, Homo sapiens
ccagtagttccaggaacctcctagtcctgaacttaatggggtttcatgagaattgactgg

SEQ ID NO: 6771228 - DNA, 124 bp, Homo sapiens
cttccctacacactccagtatttgcatgctaattttttccttcatgacttaagagcctctgaagctcttaatgttctggttgaggatatgtagccacctagaactgaccagacatttggagagg

SEQ ID NO: 6771229 - DNA, 62 bp, Homo sapiens
gggacccggcgctgcaatctttttgtcttccaaatgagacctggtaagcaggttgggctccc

SEQ ID NO: 6771230 - DNA, 65 bp, Homo sapiens
cctgggcgccttgggggacagatccatcaacagctgccctcagatcgtcctctcaacaacccggg

SEQ ID NO: 6771231 - DNA, 90 bp, Homo sapiens
gagttagtagctcatggattgaatataaattagatgattgaaatatgatatttaatgaagcttgattcagtccatgagctacataagctt

SEQ ID NO: 6771232 - DNA, 80 bp, Homo sapiens
cattcagaccactggcactcaggttaatggaggttttactgtcttccagtgaaacatgaggtgtgggtggggaaagagtg

SEQ ID NO: 6771233 - DNA, 57 bp, Homo sapiens
tctctgagctggatttgttcttattattttacagatgaggacagagggtctcagaga

SEQ ID NO: 6771234 - DNA, 130 bp, Homo sapiens
tattgtgcccacttacaaatatgggatcctaaggctcagacaggaaaagtaacgtccacaaaaccatacaatgttcacagatccttgaagccaggataacacaattcactataacaaaatcagtgcaatg

SEQ ID NO: 6771235 - DNA, 84 bp, Homo sapiens
gggcatttttgaatctcaatgcagaggacaatggggagagacctgcaacctatttaattctgttagagaatcagtgaggtgctt

SEQ ID NO: 6771236 - DNA, 68 bp, Homo sapiens
ctcacttctactttaatcagagctccaacatgtcgacaggttggagctctgattaaattggaactgag

SEQ ID NO: 6771237 - DNA, 59 bp, Homo sapiens
ccttttccaagccaaggaagtgttctggctcctggactctgccctgtggaggggaaagg

SEQ ID NO: 6771238 - DNA, 64 bp, Homo sapiens
cacttctgattacacatgggcctctaagtcttcttggccatcaggtaccagttgatcaaaagtg

SEQ ID NO: 6771239 - DNA, 70 bp, Homo sapiens
ggagcagcagagggaacagcagccaggcctgggacaggacttagagctgggcagtgctctgagctgctcc

SEQ ID NO: 6771240 - DNA, 127 bp, Homo sapiens
gggcccagtcttgagcactgagaccatcccaggtgtccagggctttgtttaggtgaccaccttttggttttggaatatgacaaaagctgtggatatggctgcttacattagagagaaataagggccc

SEQ ID NO: 6771241 - DNA, 57 bp, Homo sapiens
caacagggtagcaaaaatgtggaaataatctgggttcttgatgctacctttaagttg

SEQ ID NO: 6771242 - DNA, 59 bp, Homo sapiens
ctatttttttggtgggatatttctggaaaaaactttctagaattttgctaaaagactag

SEQ ID NO: 6771243 - DNA, 64 bp, Homo sapiens
gaagccatttcttcatttctaagatggacatgtctttacattttctgaagttgagatggacttt

SEQ ID NO: 6771244 - DNA, 59 bp, Homo sapiens
cttccttcctggggatttatcatctttatgtttaaagagaaaagtccacagggtggaag

SEQ ID NO: 6771245 - DNA, 69 bp, Homo sapiens
ggggagcctgcagggcccccagctgaatgtgtatgtcaggatggaaggcaggacctgccttgggccccc

SEQ ID NO: 6771246 - DNA, 62 bp, Homo sapiens
gtgtgtgtgtgtgtgtgtgtgtgtgtgttactatacatatacatacatgtacacataaatac

SEQ ID NO: 6771247 - DNA, 57 bp, Homo sapiens
aactgtgggatgcattaattcataatttcacacctgaaatgataagctcccacagtt

SEQ ID NO: 6771248 - DNA, 85 bp, Homo sapiens
gcctgtgtcagctgtggcaggctgcggccgtgtgagcattctgtaatgcaacgccctcggctgtgcctccgaggcttgcacaggc

SEQ ID NO: 6771249 - DNA, 62 bp, Homo sapiens
gttttctggcttggacacaatcttccctgaaacccaatctgggaaaccttccaagcagagac

SEQ ID NO: 6771250 - DNA, 77 bp, Homo sapiens
ctcagtttctgtctacataacagatactctctgtgagggaaagccctcattgaaatttgtttgttgagacagaggag

SEQ ID NO: 6771251 - DNA, 58 bp, Homo sapiens
aacatcaagccataatggcagccagtggctagatatactgggctgttacttgactgtt

SEQ ID NO: 6771252 - DNA, 56 bp, Homo sapiens
gagatgcaggcctggaatggtggatctggggccagtgtcagccaggctctgcactc

SEQ ID NO: 6771253 - DNA, 69 bp, Homo sapiens
gggcattgtcacagaggctttgcgggtcaggcctctggactcgagtccctggcccacatggcttctccc

SEQ ID NO: 6771254 - DNA, 66 bp, Homo sapiens
agtctatccaatgttcagatctgagattcagcaagaaattgccaaataaagctgaccagatggact

SEQ ID NO: 6771255 - DNA, 93 bp, Homo sapiens
gagagtgcctgagggatctattttgggaccgctgtcacttggctcttctgctaataagcttccagtgtggtggccctccttcaggcatgtttc

SEQ ID NO: 6771256 - DNA, 80 bp, Homo sapiens
ttccatgagatgatggtgggtaatgtgtaaaagctgaactgcttcttgctgccatcaccacaccatgttatgttaaagaa

SEQ ID NO: 6771257 - DNA, 66 bp, Homo sapiens
cctgaggaagaaggaatgatgataaatatttccactgggtatcattatcctcctatttgcctcggg

SEQ ID NO: 6771258 - DNA, 77 bp, Homo sapiens
gttgctccgttttgtgggacacggatgagttttcttaggttagaacctctcaccttccccaacgcatggaataaaac

SEQ ID NO: 6771259 - DNA, 64 bp, Homo sapiens
ttccagcagcctctgaccaggaaggccaagtacacggtcagtctctggccagagcctgcgggaa

SEQ ID NO: 6771260 - DNA, 96 bp, Homo sapiens
cagattttgaaattgtatattcctcatattcagtggttgaatgcacctgaatccctgctgttccttgaccactgcataatgagttttcaagagctg

SEQ ID NO: 6771261 - DNA, 80 bp, Homo sapiens
aatgcatggtatcagaagtgttttggatttcagattttttttgggaatctggaatatttgcattgtaccagttcagcatt

SEQ ID NO: 6771262 - DNA, 64 bp, Homo sapiens
aagaaggtggcaagtggcaaatcccatggcagttctttgggaacaacatgcactgccacctctt

SEQ ID NO: 6771263 - DNA, 63 bp, Homo sapiens
gcatgttaggatggttttctattctcactggtgggaatatgaactattcctagccctatgtgc

SEQ ID NO: 6771264 - DNA, 72 bp, Homo sapiens
gctagtcttcacttaccggagcgatcgccgtggggtgtcccaaagccagcaaggtgagtttcaaagactagt

SEQ ID NO: 6771265 - DNA, 68 bp, Homo sapiens
tttgtgccaggcaatgttctaagtgatttacaggttttagctcacttgataaatattgcttttataaa

SEQ ID NO: 6771266 - DNA, 79 bp, Homo sapiens
tagtaatcctatcaagggacaagtgtcttgactcagcccccatccctgattcctaggcactcttctcctggggtctctg

SEQ ID NO: 6771267 - DNA, 83 bp, Homo sapiens
ttcaccttgcttttttcccacatgctattccaccattatcagaaaaagattggcatatttacaaggaagagaggaaaggtgga

SEQ ID NO: 6771268 - DNA, 77 bp, Homo sapiens
actgtgtaagaaggaaaggcctcagcagaaaccagtctcttgatctctaggtctctgtagtctttcctcctcacagt

SEQ ID NO: 6771269 - DNA, 62 bp, Homo sapiens
tctatgtgttcaatatggtttgggggagtgtcctctctgggatcgttttgggctcccataga

SEQ ID NO: 6771270 - DNA, 79 bp, Homo sapiens
tctgtggatcttatgtacagcctggtgactatagttaacaatactctattgtttacttgaaatgtgataagagagcaga

SEQ ID NO: 6771271 - DNA, 89 bp, Homo sapiens
cagttaccacagtttagtccaatgacaccagtcccccaacaacacagttctggtatcagttgctatggtctattaactgtgaataattg

SEQ ID NO: 6771272 - DNA, 70 bp, Homo sapiens
cttctatggctttctatgaactcaaaggcaggcagtggtttgtaggtctgagtgcataggtggcatgagg

SEQ ID NO: 6771273 - DNA, 66 bp, Homo sapiens
gagtcccagattcttctgtgtgggcactttcctgggatatgctaaatgatgggaaatctgggtctc

SEQ ID NO: 6771274 - DNA, 55 bp, Homo sapiens
tttgaagtgggcattagaaccttttccccctttggtgtttaaagctcattttaaa

SEQ ID NO: 6771275 - DNA, 63 bp, Homo sapiens
gaggtcagatttccttgcagtttggaacttccttggaattccatagtactagaaactgacctt

SEQ ID NO: 6771276 - DNA, 91 bp, Homo sapiens
gttattgaggatataaaaagactatttggaagaaatctgaaactaaacagagggcttattagtctagatgtcttgatatgtaccctaaaac

SEQ ID NO: 6771277 - DNA, 56 bp, Homo sapiens
gtgtgtgtgtgtgtgtgtgtgtgagagagatctacaagtgccacccacagatgcat

SEQ ID NO: 6771278 - DNA, 60 bp, Homo sapiens
gtatatattggataaaccagaggtctaacttggagacctttctgagtaaacagtaaatac

SEQ ID NO: 6771279 - DNA, 83 bp, Homo sapiens
aattgctcgtgatggttcccagtgaggaagcaatgcagagtgtgtgcacctgccttcctcctcagagctgccacttggcaatt

SEQ ID NO: 6771280 - DNA, 56 bp, Homo sapiens
tgctgatgctttctgtggttgcccttgggtggggatggtacaggaaaagtgttaca

SEQ ID NO: 6771281 - DNA, 73 bp, Homo sapiens
cagcttgtaagtggtggggttaaggttagaactagaggctagtctgaagattctttccactattcttcagctg

SEQ ID NO: 6771282 - DNA, 59 bp, Homo sapiens
gctagcaagtggcagaacgaggttataaattcatagatcctggctgcacagttgctggt

SEQ ID NO: 6771283 - DNA, 68 bp, Homo sapiens
ttctggctactgggacagagctgtttaatggtctagggagaccagaagctatgttttagataacagaa

SEQ ID NO: 6771284 - DNA, 64 bp, Homo sapiens
tgatttgtctatctcatgtgctgttttctgtgacggcagaaactcatgaggtcagggcaatcca

SEQ ID NO: 6771285 - DNA, 64 bp, Homo sapiens
ttcctttcctaaactaatctcctaaatgaacatgtcatatccagggagttttagggcttgggaa

SEQ ID NO: 6771286 - DNA, 74 bp, Homo sapiens
taataatctatccatgtcatgctgaagctcaaccctccgggggagagttatttcagtaacataatagtagttta

SEQ ID NO: 6771287 - DNA, 62 bp, Homo sapiens
ccagatactccttcccagtcaactcaattatctgcaccaatgaactgggaaaaaggcactgg

SEQ ID NO: 6771288 - DNA, 73 bp, Homo sapiens
ccagggtctgccccaggagcagggtctgcctccctggatggactggtggctccttgggcaggagggtccctgg

SEQ ID NO: 6771289 - DNA, 68 bp, Homo sapiens
gtgtaactggactcgatgctgaagggcttaggaaagccctgaaaggaacaaattggtttagaaggcac

SEQ ID NO: 6771290 - DNA, 59 bp, Homo sapiens
ccttatcagccttttactcctgtgttgtcatataacgcaacagagcaggtttgatgagg

SEQ ID NO: 6771291 - DNA, 71 bp, Homo sapiens
agctgtctgagtaagagaatccttgttttttcatgaacacatccaaaggactcttctcctcaaacaaggct

SEQ ID NO: 6771292 - DNA, 71 bp, Homo sapiens
ggtccctgctcagctgtcctcacgctgcatcatgctggatgatcacagctggggctcagctgctcagggcc

SEQ ID NO: 6771293 - DNA, 69 bp, Homo sapiens
tccactctgtgcttccataaatgtaaacagtgagaaactgtgtttacatgcataagcttaagggatgga

SEQ ID NO: 6771294 - DNA, 83 bp, Homo sapiens
gggtgccgtggaagaggccagcacgtgtggggtggggagggctgccacagcccccaggcactacatgtgaaactccggctcct

SEQ ID NO: 6771295 - DNA, 60 bp, Homo sapiens
attctctagtctcttccataaagtgaaatcaggaagctttgaaagaaggtggtagagaat

SEQ ID NO: 6771296 - DNA, 127 bp, Homo sapiens
acagtctctcatgctcctcccccacccctctctgttataagttatatgtttccctaactgcaggtgttatggaaatgtaacttctgattcaagctgagagaggacttgaggaacttgaggaaattgt

SEQ ID NO: 6771297 - DNA, 81 bp, Homo sapiens
cagggtcccacctttatgcccatcctgcagctgtgctcggatctgtgtcacagtcaaggccatgggcagtgaggaccactg

SEQ ID NO: 6771298 - DNA, 59 bp, Homo sapiens
gggtgactggagggacccaggccttcagtgagggcatttgtccaacctcctagatcccc

SEQ ID NO: 6771299 - DNA, 58 bp, Homo sapiens
cgagtcctgctgacttcctgcccagcaggtagtggtgaccaagggagtcagaggatcg

SEQ ID NO: 6771300 - DNA, 87 bp, Homo sapiens
tcagggaagacataattgtgtcgtttgatttgttcaccaaagagcaggtcagatggaaaggttactgtcctcttaaaaatattctga

SEQ ID NO: 6771301 - DNA, 56 bp, Homo sapiens
ttttgtgtaaatatacatatgtatgtatgaatgtatgtatgtatgtttgtatggaa

SEQ ID NO: 6771302 - DNA, 80 bp, Homo sapiens
gcacgctatagaatttgcactaaatctgctcagcacaatatccaaaagtttgcagagacttggagctaaattgggtgtgc

SEQ ID NO: 6771303 - DNA, 62 bp, Homo sapiens
agaaataggagcttaagcacttctttgtacattgggaagagtgttatttgctctgtatttct

SEQ ID NO: 6771304 - DNA, 65 bp, Homo sapiens
cctaactgacagtggctaaaggaattgctaaatataagtcacttctacagcttcttcagttaagg

SEQ ID NO: 6771305 - DNA, 57 bp, Homo sapiens
tttctgtaagttcaggctttcctagttgaaatggaaagaaaactgaacttggagtga

SEQ ID NO: 6771306 - DNA, 60 bp, Homo sapiens
ttcatttatgtgtgtgtgcatgtgtgcatgttggtgtgtgtgcatacgtatgtatttgga

SEQ ID NO: 6771307 - DNA, 81 bp, Homo sapiens
tgtttctaattggatagcagaatatccctagtagctgtaaatgttggcttctgtggtaaactttgttgtaaatttaagaca

SEQ ID NO: 6771308 - DNA, 62 bp, Homo sapiens
tgaggtgacaattcattctccaggagagctcgttacttcccaagaggcaaattctcacttca

SEQ ID NO: 6771309 - DNA, 71 bp, Homo sapiens
ggtagagagagctgtgtttagtagttacggctgcttacgctggactggaggacatagcttgaccacctacc

SEQ ID NO: 6771310 - DNA, 90 bp, Homo sapiens
actgtcaggtagagtaggtgctttagtaaataatttttgtgtagttgaaatgataaagtgtttacatataaggccctttcccctgacagt

SEQ ID NO: 6771311 - DNA, 64 bp, Homo sapiens
tcccactattatcctatgtgggttcacagatgaaaactcaaggcccaaaaggtaatgagtggga

SEQ ID NO: 6771312 - DNA, 74 bp, Homo sapiens
gtctgcaagccaaggagaatggcctcaggagaaatcacacctgctgctgataccttgatcttggacttccagac

SEQ ID NO: 6771313 - DNA, 62 bp, Homo sapiens
tgcatatcttcaatgctgttgctatgttgtattcttctattgcaatacactgtagatgtgca

SEQ ID NO: 6771314 - DNA, 108 bp, Homo sapiens
gcctcctaactgcccccggctgggagtggcctgcctgggagcagcaggggcaagagggcaaggcctgttggaaggtgtaggcccccagcagggcgctgtgcaggaggc

SEQ ID NO: 6771315 - DNA, 72 bp, Homo sapiens
ctctcagcactgtctgctggctcccttctctctctgttgaggaataaagggagcggggagaccctatgggag

SEQ ID NO: 6771316 - DNA, 70 bp, Homo sapiens
ttatgattaggtggggttgttactgtttatgaaactcatctgtcaaatagggtgcctcatttaatcctga

SEQ ID NO: 6771317 - DNA, 94 bp, Homo sapiens
atttcccgagttagataatgtatttgagttatgaaagagaatattcatgttttttaggaaacatacactcaagtatttagggataaagggggat

SEQ ID NO: 6771318 - DNA, 105 bp, Homo sapiens
tgaatttgaccttgtcaaatcatttacctgcagctgttatgaggtgtacatgcaaatacttgtgattgcctaacacttaggactttggtgctgacggcaaattta

SEQ ID NO: 6771319 - DNA, 55 bp, Homo sapiens
tgccagctggcactttgggctgaatggccagctaccaaagaactgccatttgtca

SEQ ID NO: 6771320 - DNA, 61 bp, Homo sapiens
tcaatgaagagatttaaatcatttggtagtacccaaatgatgttgggatcactttaattga

SEQ ID NO: 6771321 - DNA, 93 bp, Homo sapiens
ttgtatgtaaaggtagctaaacataatctatatgaaaatacaggccacatattttctgtaatataattaatttagctgcctctgtaggtacaa

SEQ ID NO: 6771322 - DNA, 63 bp, Homo sapiens
cgtggctgctgcctgctacgagggaagactgcaggaggtgagcccacagggaggcagtgcccg

SEQ ID NO: 6771323 - DNA, 96 bp, Homo sapiens
cctgtctctcttgtagagtagtcaaactgtagtgtccatttttgtatttactagggtgatgcattggaaaactatggctcaacaaaagagttcagg

SEQ ID NO: 6771324 - DNA, 117 bp, Homo sapiens
tgtaaccactgtccttaacgagtacatagatttgtttccttctctccaggagcatgagatttgttgcctccaggaaaggcaacaaatctacgtattccttaaggacagtggttctca

SEQ ID NO: 6771325 - DNA, 64 bp, Homo sapiens
tgagacatattatactgcttttatctttacttttgaaaggcaatgcagtcatggaatgctctca

SEQ ID NO: 6771326 - DNA, 65 bp, Homo sapiens
ggagccaggctaagaaaggtgtgatgagtcagtggacttcagagcaccaaggtggtttggactcc

SEQ ID NO: 6771327 - DNA, 117 bp, Homo sapiens
tgaagagaccatttgacaacttcaaaaatcactaagttatagtgtggagaacaaaaatcctactctgaattgaagtgatattaagattttggaaatgaaaattcatagggcttttca

SEQ ID NO: 6771328 - DNA, 57 bp, Homo sapiens
ccattgaatcctcagctgctagtacaaaacctggaagcagaggaggatttagttagg

SEQ ID NO: 6771329 - DNA, 65 bp, Homo sapiens
gggagggcaggccagggcccaggaggagatccgctcccctctgcaggctggacctgcccaaaccc

SEQ ID NO: 6771330 - DNA, 66 bp, Homo sapiens
gatacattgagggtggaggaccacctgttagagatgctattaagggtcctctagcttcagagtgtc

SEQ ID NO: 6771331 - DNA, 60 bp, Homo sapiens
catatgtcagctgtgcctatttgaagaaaattcatccccaggcagcatctgatttatatg

SEQ ID NO: 6771332 - DNA, 76 bp, Homo sapiens
gcagggagcagttatcgaagaatcaggtcaagtgggggtttgctggcattacctgtgtttctgtagtggtcattgc

SEQ ID NO: 6771333 - DNA, 60 bp, Homo sapiens
atggaatctgccaacttgttttaattaactgaatgtggcacaagacctggcagcttccat

SEQ ID NO: 6771334 - DNA, 62 bp, Homo sapiens
ctcgtagggagagtgctacactccagaactagcagaagtgggagctgttactctctctggag

SEQ ID NO: 6771335 - DNA, 62 bp, Homo sapiens
gtgtattcccttttctaatgagtctaattttttttcctggctcagcagaatatgaactgcac

SEQ ID NO: 6771336 - DNA, 78 bp, Homo sapiens
cctgaacatcctctacctgcacatgcctgactgcccggtatccctgctccagtggctgttccaggtgaggaccgcagg

SEQ ID NO: 6771337 - DNA, 61 bp, Homo sapiens
ctttttacaaagcctgtcttctctgtgataaaagatagcctatggaaggtgatgtgaaaag

SEQ ID NO: 6771338 - DNA, 93 bp, Homo sapiens
ggcagcagttccctccaccaacacttctttgtcacctgcttcaaggccgataactctgaagaaggtggcccaggggtaggtggaggggctgcc

SEQ ID NO: 6771339 - DNA, 76 bp, Homo sapiens
gaagggattttcagaatcatgaaaagtttgttgtgtgggctcttcaatacattgagttttgatgttctattctttc

SEQ ID NO: 6771340 - DNA, 55 bp, Homo sapiens
gcagaagtgctcctcagaagagttggaagagtttcagctctcctgaagcatctgt

SEQ ID NO: 6771341 - DNA, 63 bp, Homo sapiens
gctcagaggccagctccctgcactgggaagtggatattgttcccaggcagagagctggtgagc

SEQ ID NO: 6771342 - DNA, 65 bp, Homo sapiens
tgcacacacatgcagagggagagtgagatggcctcatgatctagccacttctggtgtgtgtgaca

SEQ ID NO: 6771343 - DNA, 93 bp, Homo sapiens
gaatggcaggggctggtacagtctggaactgctggctatgagtaaatatgacagcagggctttggctggctttcactgggccacttgtcattc

SEQ ID NO: 6771344 - DNA, 77 bp, Homo sapiens
agccccagcggggagcacctgcttctcttgggcaattacccttgagaggccagaaggcgcaccccgcgcaaagggtt

SEQ ID NO: 6771345 - DNA, 75 bp, Homo sapiens
gcttctaaatatttatctggatttctagaactggaatttaagttctacttgaaagtcctagcgatccacagaagc

SEQ ID NO: 6771346 - DNA, 63 bp, Homo sapiens
ctattgctcttaggtgcctagtgcttgatatgtggaagatgatcagcacatgtaagagtaaag

SEQ ID NO: 6771347 - DNA, 84 bp, Homo sapiens
gccccaaccccccttgatggacagggaccactgtcctggcccaactcagggcttcctccttcctgctgtcatttgggttggggt

SEQ ID NO: 6771348 - DNA, 71 bp, Homo sapiens
gaaaggagagggttaaggagctggcagccacacaaacaccttccacattgcactccttgccatttcttttc

SEQ ID NO: 6771349 - DNA, 57 bp, Homo sapiens
taaggtttcttcagatactagtctctgatcccacaggagattctagaagatgccttg

SEQ ID NO: 6771350 - DNA, 104 bp, Homo sapiens
ttagattaacaaggaatatcgtgatcttaactgtgtgttttgctattagtatcccttagtactaggagaaaacttacactgagattaattctttgtctttttga

SEQ ID NO: 6771351 - DNA, 60 bp, Homo sapiens
ccagttgttccctgtcagagattacaaaggatgaatgctttggacccagggagcggatgg

SEQ ID NO: 6771352 - DNA, 64 bp, Homo sapiens
atccctctagcctcttgtctagaagttaagtcctggctgcagcattctggtaaaaggcagggat

SEQ ID NO: 6771353 - DNA, 56 bp, Homo sapiens
cagcctgcagctcatcccgcttaccactgcctttggagggagacagctctgggctg

SEQ ID NO: 6771354 - DNA, 56 bp, Homo sapiens
gcccaggagttcaagtctagtgagctatgattgtgccactgcactttagcctgggc

SEQ ID NO: 6771355 - DNA, 80 bp, Homo sapiens
ccaagtaatatctggcaccaggaacttaactgtacttaacagccatttacaatttcctgcaaagccagatgtcgacttgg

SEQ ID NO: 6771356 - DNA, 58 bp, Homo sapiens
gccctgccatggtagacttccaggggaaacatctctgtggctgttttcctgtgcgggc

SEQ ID NO: 6771357 - DNA, 72 bp, Homo sapiens
tatttttcggtgtgatttggattggaaaagaggtgaaacatttttctactttggaatgcactgataagaata

SEQ ID NO: 6771358 - DNA, 56 bp, Homo sapiens
cacacttagcagcacccaagacacctcttctcggtgctctgcggtctgctagtctg

SEQ ID NO: 6771359 - DNA, 55 bp, Homo sapiens
ctctgttcttctagtccactgacagaacagtctgtctgttgagatgagagcagag

SEQ ID NO: 6771360 - DNA, 64 bp, Homo sapiens
ccgcctttcagtctcgatgcgatgtgcatttgacacaaattgcaagagagtctgaaaaatgtgg

SEQ ID NO: 6771361 - DNA, 67 bp, Homo sapiens
gtgaggagagaacattcctccatattgtctaaccttttttgattttaggagatagtttttacctggc

SEQ ID NO: 6771362 - DNA, 56 bp, Homo sapiens
caaatccatagcttgcattaggatgcacttttagcgttatacattctatggatttg

SEQ ID NO: 6771363 - DNA, 72 bp, Homo sapiens
caggcagagttagagcaactggctcatcgcttcattctagtgtatatcatgttgcatttagttatctgtctg

SEQ ID NO: 6771364 - DNA, 55 bp, Homo sapiens
cagtcatgcctgctggggaccctgttgcaccagggtccagagacaggcatgggtg

SEQ ID NO: 6771365 - DNA, 59 bp, Homo sapiens
gggtgaaccagagctgttttctcctcccagcgtagagctgacagcttggggtgtcacct

SEQ ID NO: 6771366 - DNA, 66 bp, Homo sapiens
gtgggtaaccaggagtaacagtgagtggtagaactcctatttcaaccccttgattcctggacctgt

SEQ ID NO: 6771367 - DNA, 82 bp, Homo sapiens
ctcatgatcttatgtattcttcacactaaccctgtgagatatgattagcttcagtgtacagtgaagggattaaggatcagag

SEQ ID NO: 6771368 - DNA, 74 bp, Homo sapiens
agtgctggaggtggtactggaatccaggcatctggctctagagcctggctcccagctaccgtgtccttaggcct

SEQ ID NO: 6771369 - DNA, 56 bp, Homo sapiens
tcagagagcctcaggcactgccatcctactgatggagaactctgatgctcttctga

SEQ ID NO: 6771370 - DNA, 104 bp, Homo sapiens
gctgtgaagaggggaagcctagcctttggtgaggctggagactgagagtggaggattcagacaggcctctccagcctcagcttgcaggctgactgtccaacagc

SEQ ID NO: 6771371 - DNA, 83 bp, Homo sapiens
aagtctctgagcagatatgaatttagtcagcatccccattcactgcactaggaagtttatattattctgatgtttagagactt

SEQ ID NO: 6771372 - DNA, 84 bp, Homo sapiens
ctgttctggtggacacgatggaattccctcaactataacattattatatgttatgattgaaattccagtttctataagggatag

SEQ ID NO: 6771373 - DNA, 72 bp, Homo sapiens
cacagtgtttggtaagtacccacctgggtccagcactgtactggacattaggtgaagcttatcttcatagtg

SEQ ID NO: 6771374 - DNA, 82 bp, Homo sapiens
gtctgtcctcaggacactttactcttcatatgtgacacaaaatgttctgtcatatagacgaagtgataatgtcaggatagac

SEQ ID NO: 6771375 - DNA, 129 bp, Homo sapiens
gttggtgctaacaaaactgccgtttttgccattatggcaaagataatggagactgacacaaagatactttccaaagtatctttgtatcaatctccattatggcaaaacccgcaattagttcgcaccaac

SEQ ID NO: 6771376 - DNA, 56 bp, Homo sapiens
cagcgtgggatttggaaaccaggggtccaaagccctgcttgaccattttgcagctg

SEQ ID NO: 6771377 - DNA, 106 bp, Homo sapiens
gctttcacgtatttcccaggtcatctggcttttactgaattgctcccacattcctgacagcaaagtcagtggaaccatcctatgcttggaacacatgtttgaaggc

SEQ ID NO: 6771378 - DNA, 55 bp, Homo sapiens
gcagatgctgggactccagagctacctacagcaggagagcctccacggcttctgt

SEQ ID NO: 6771379 - DNA, 67 bp, Homo sapiens
ggcttctgcagcagggcttgcccacctctgagtgggagtgaaaagtaggccctcctgctcccctgcc

SEQ ID NO: 6771380 - DNA, 70 bp, Homo sapiens
gctgcttagaggactgttacagaatcaaaaggattagagaatcctgtcctgtgtgacatcactgggcagc

SEQ ID NO: 6771381 - DNA, 75 bp, Homo sapiens
gtacattgtgctcagaatctgtcgtgtgaacaaatgcctttgctatatatgaaagaatctcagagcacaatatac

SEQ ID NO: 6771382 - DNA, 55 bp, Homo sapiens
agtggctcatgcctgtaaccccagcactttgggaggccaaggcaggcagatcatt

SEQ ID NO: 6771383 - DNA, 63 bp, Homo sapiens
gtttacaaaatgaccaccgctcatgtgatccaagctggtctacagatggaggttattatgaac

SEQ ID NO: 6771384 - DNA, 85 bp, Homo sapiens
agttctttcttaatatttacaaatttatttaacctgcgaaattaggtatgttagtgatagtaaatagtgttttgaaggaagatct

SEQ ID NO: 6771385 - DNA, 58 bp, Homo sapiens
gggcacagtactccaatcaactttatagaaatgtattgttatggtccaaattgtgtcc

SEQ ID NO: 6771386 - DNA, 78 bp, Homo sapiens
tagcgggccttaggcccagttctttctagacacgtagacttcatcaagctgagaaaaatcaggccctatagctcgcta

SEQ ID NO: 6771387 - DNA, 66 bp, Homo sapiens
ctgggtgagctggccagagggtagaagggaggcagtatagtctgctctgataccagctacatctag

SEQ ID NO: 6771388 - DNA, 93 bp, Homo sapiens
ggaagagaaagtataggctgcggagagttgccgtcctggtacctgtgtgcatggtgctctggggatgcttctgccgtgatcatgaactcttcc

SEQ ID NO: 6771389 - DNA, 78 bp, Homo sapiens
gaacacccatggttcaattaaaatgactttttggaaaaattggatttctaagcaatctgtagttggaatcaggtgttc

SEQ ID NO: 6771390 - DNA, 79 bp, Homo sapiens
agccacccttgtgcaggttcatgatgggtgggtctgctcagccagtgggctgctcacatgagatctgtacatccgggct

SEQ ID NO: 6771391 - DNA, 58 bp, Homo sapiens
aggtccctagagtgggatgacttggtacagctgccccaggtcaatattcaggggacct

SEQ ID NO: 6771392 - DNA, 92 bp, Homo sapiens
ggggagcgtggagtgggttagaaaggcaagaagatgagttttggttctggatcacaatctcaactgccttttagactctgtcactgctgtct

SEQ ID NO: 6771393 - DNA, 60 bp, Homo sapiens
ctgatgtttcttgggtaccttccatgtgtcagatgctgaggttggtgctcaggacatgag

SEQ ID NO: 6771394 - DNA, 58 bp, Homo sapiens
tctgtgggtatttcccagggaaacttcttccagctggggccctggagaataccctgga

SEQ ID NO: 6771395 - DNA, 130 bp, Homo sapiens
tattgtagaagggttacagtggccactgtgagtgataagcctgcacatgtgtgcgcctgtatgtatatctgctacatgtgctgtgtgtgcacactctctcacactggtgtctgtgttggtgtctgctatg

SEQ ID NO: 6771396 - DNA, 86 bp, Homo sapiens
ccgtgtcctcggatcccgcgggcccgcattgccaggcgctgcgcccagcgctgggccgacctgggctgcaggtacaggggtcacgg

SEQ ID NO: 6771397 - DNA, 55 bp, Homo sapiens
cagctgaggtcaaagaagcaggtttattttgaagggtcttgtaagcctcgagctg

SEQ ID NO: 6771398 - DNA, 74 bp, Homo sapiens
tcttagcagaatgatgactggggatgaagagaccttttatgggaaaattcagccagtcatcagtcttgtaggga

SEQ ID NO: 6771399 - DNA, 85 bp, Homo sapiens
gaaattaatttgaggtcaagtaaccactggaagcctttatattttccattggtgaaatatttgaaggtcttttaaagttttgttc

SEQ ID NO: 6771400 - DNA, 97 bp, Homo sapiens
ataacattctttcatatctgaaatgaggcttctgttcactcacgctggacccctgcccagcagtgttttagccatttctgtgtgaaatgtatgttgt

SEQ ID NO: 6771401 - DNA, 124 bp, Homo sapiens
tgtatctctaccatttggcttccttctaggcatccgatttgttgcaatgaagatcaattatgtctctattgtcatcttcatcataagtaaaagatgtccagtctactttccagagacaggtata

SEQ ID NO: 6771402 - DNA, 89 bp, Homo sapiens
ctgtatagataaatgagagtgattcctattagtacatgcaaatggtttgctgttttcaatgatttttagggatcatctcaaatttacag

SEQ ID NO: 6771403 - DNA, 68 bp, Homo sapiens
tgagccttagcatcttaaagctgtgattgatcttgattctcacccacatttcttatggatgttggcca

SEQ ID NO: 6771404 - DNA, 65 bp, Homo sapiens
ttttagagtgatgagtgtgtaccagacacaatgctaagtgctttacatacattatctttttaaaa

SEQ ID NO: 6771405 - DNA, 83 bp, Homo sapiens
cgaggcattgccttcatcttctatctgagaattctttaaagttagtctgttcacaggagggtggatgcatgacactggccttg

SEQ ID NO: 6771406 - DNA, 59 bp, Homo sapiens
aaattatatttgaaaggttggaagtcatatttggctgagctttatatcaaatgtaattt

SEQ ID NO: 6771407 - DNA, 71 bp, Homo sapiens
taagatgggctcaaactggaggttgtttgaaaatttaaaatcaaactgctcttaccagatgggtcagcttg

SEQ ID NO: 6771408 - DNA, 79 bp, Homo sapiens
ccctcagcctgcctcagtttccctctgtacttggcatgagcactggagcccaggattgggagggaggaggcaggccggg

SEQ ID NO: 6771409 - DNA, 83 bp, Homo sapiens
gggatgctctctggaggccactgtacagattgtatggatgcaggccacgtaacctgttaagggctgacccaggatttcatccc

SEQ ID NO: 6771410 - DNA, 99 bp, Homo sapiens
ctgccacaggcagcctgccctgcctgccggtgtgggtctgtcatcaggatggtggtggctcacagccggctggcaggggcttgtccttccccgtggcag

SEQ ID NO: 6771411 - DNA, 82 bp, Homo sapiens
ggagtatcacagtaaattggcaatggagactaagtgtgaattcagacacccagagcgccagtgccgagcttttacctgctct

SEQ ID NO: 6771412 - DNA, 84 bp, Homo sapiens
ggttaatgtgtcaaactaaaattaacttctaggtaatatacttttgtaacactggagagttggttgtggcaaacatcatttact

SEQ ID NO: 6771413 - DNA, 59 bp, Homo sapiens
gccctgggctccctgctccacagccacaccgagctgaggcaggggtgaggcccaggtgc

SEQ ID NO: 6771414 - DNA, 105 bp, Homo sapiens
tgttctatcttttaatctggtggtgggtaaatgggtgtacgttattattacttttgaaagtgtgtacataattgtacgccctctttcatatcatgaagatgtgcg

SEQ ID NO: 6771415 - DNA, 83 bp, Homo sapiens
tctcagtttctgccttggatcagatgatatctttgttggtccttttctgacatgaggtgctataggtctacagtttactgaga

SEQ ID NO: 6771416 - DNA, 70 bp, Homo sapiens
agatgagtcaacaaatacttaaagcagagagcttagttcctgttcctatggatatttgtttttctcattt

SEQ ID NO: 6771417 - DNA, 77 bp, Homo sapiens
tgtccccatcatattctattattgggcaaaataaaatgtaaaccatgtgctcaaaacagcaaatattgtgggtgaca

SEQ ID NO: 6771418 - DNA, 91 bp, Homo sapiens
gaattgctctgtaattgaaattgccttgggttttcactacgattactataaattgtataattcaggtattttcgggtttgctgacagattc

SEQ ID NO: 6771419 - DNA, 65 bp, Homo sapiens
ctgggctctctttcctgctgggaaagtaggaggcagctcttaacacagcaggaaaagtgcctcag

SEQ ID NO: 6771420 - DNA, 81 bp, Homo sapiens
agaagtgagatggtgctgccagagtgccgacccccgaatcctcaggggccctggcctctcctggcagcatccacccattct

SEQ ID NO: 6771421 - DNA, 58 bp, Homo sapiens
ctggccccggttcctaaaaaccgcagtcttgctgggattatgtgggagctgggactag

SEQ ID NO: 6771422 - DNA, 57 bp, Homo sapiens
aggccaggaatccttgtcccagcagacatgcactggagcaacggtctcctgtcgcct

SEQ ID NO: 6771423 - DNA, 101 bp, Homo sapiens
ccttcagcatgctgagttttcttattcttttaaacaacgcatttctgttatcaggcatcatgcattagtaaagagaggagggctgatgtcagggctcgggg

SEQ ID NO: 6771424 - DNA, 72 bp, Homo sapiens
agaggatatctagactggattttcactgcttttgcaagtaagctttgcagtgagaattcagtaggtactttt

SEQ ID NO: 6771425 - DNA, 87 bp, Homo sapiens
ctactgtctactcatgaagtttctaattggaactttgaggaatgaaaatttctcaaagtgagaaattgagaaatgaaaattcagtag

SEQ ID NO: 6771426 - DNA, 66 bp, Homo sapiens
gtttcctgccctgtcttatccagacattttcatccccctttttctggcctagaccagtaagggaat

SEQ ID NO: 6771427 - DNA, 95 bp, Homo sapiens
gggcggtaattagctaatgcttctggaatgctgcttccttcccaccagcccctggaggtcagcaggccaggggcgaaggcagctttgtcctgccc

SEQ ID NO: 6771428 - DNA, 79 bp, Homo sapiens
atttcacacatactttttgtgagtagctgtaaatgatgaagcatggaaatttcacagaactcactaaggagtgtgaaat

SEQ ID NO: 6771429 - DNA, 67 bp, Homo sapiens
ccctgctttatattacatagtgtttgagataaacattgtgaatccattctatgtgaaatgtccgggg

SEQ ID NO: 6771430 - DNA, 77 bp, Homo sapiens
ccagctcacagagctccaagaagtcctgcagggccagcttttgctgctgatgggcatctttgagttctttggcctgg

SEQ ID NO: 6771431 - DNA, 81 bp, Homo sapiens
gctgtggattttttcatagtaatggtgcatgtagcatccactgatacacatggtttctatgaaaggataacttctaccagc

SEQ ID NO: 6771432 - DNA, 72 bp, Homo sapiens
gaagccaccaatgagagtgttgtttttccaaccgtggtatctggagacatttctcattaaaaaatggtcttt

SEQ ID NO: 6771433 - DNA, 104 bp, Homo sapiens
ggagccaggctgagagcagtgctgacatctgctgctgaagccagcatgtaggaaagtgggcatgggggtgatggcagaggtgggcctgcctcacagccagggcc

SEQ ID NO: 6771434 - DNA, 70 bp, Homo sapiens
cacaaggccaagtctctgtgaagactgctgatgttagagatatatttatatagagatttgtgcatgtgtg

SEQ ID NO: 6771435 - DNA, 80 bp, Homo sapiens
ccatgtgtgttcctccaagcaagcaggatggtcaaactattgaactttagaacatgagtgtcctcttgtggcaaatatgg

SEQ ID NO: 6771436 - DNA, 127 bp, Homo sapiens
atcagcagcatctggatacttgctagaaatggaaattctctggccctattccaggccttccaagttggaaactttgtgatggggcccagcactctgtgttttaacaagccctctaggtaattctgat

SEQ ID NO: 6771437 - DNA, 129 bp, Homo sapiens
tcagctcgatgacgtcctggcttgcctcccgcatgccgccggtgaacatggccctgaagggcagaaacacaacgtgtggctggcagtggctgaggggtgttttggccagccaggaatgatctggcctgg

SEQ ID NO: 6771438 - DNA, 69 bp, Homo sapiens
gttgcggaaatgcagggctagggtgaggatggttgaaacagctgtacctgtagcactgggtaccacggc

SEQ ID NO: 6771439 - DNA, 74 bp, Homo sapiens
agttagtccctgagcctggcatttccccctaagtaagaggtcgggggaaacagcccaggctcaggggcttctct

SEQ ID NO: 6771440 - DNA, 55 bp, Homo sapiens
ctttcattcttagatattagtgcatgccatatttgtcacatctaagaatgtagag

SEQ ID NO: 6771441 - DNA, 83 bp, Homo sapiens
gagaaggccatagaagtttgattcagctgtaagtcttctgcaaactaattctgatctgcgatcctgcattaaatttccttctc

SEQ ID NO: 6771442 - DNA, 83 bp, Homo sapiens
gtttttgaccaggctccctaggattctccaagttctaaatgagccatgagagggttcccaggggtttcctggagtgcagaagc

SEQ ID NO: 6771443 - DNA, 70 bp, Homo sapiens
gactgccccagcatcaccgccatttctgatgtgaagacaccctccgcagtatgtaggtgctgtttcagtc

SEQ ID NO: 6771444 - DNA, 67 bp, Homo sapiens
taagaaactgtcacagtactatccatagagtggaaaacaatgaagtactcgttgacagttgcactta

SEQ ID NO: 6771445 - DNA, 63 bp, Homo sapiens
catctgtggatatgcacagagcagcaacatatttgagttgctcgatgtgcttgtttgcagctg

SEQ ID NO: 6771446 - DNA, 76 bp, Homo sapiens
taatagttggaaatattgggtaatagttggaaagggaactttccaaaactgatactcatatatttgctggaggttg

SEQ ID NO: 6771447 - DNA, 59 bp, Homo sapiens
ctctggcttggtgtggtaggaactgggcaccaccagctgtgcacactgtgaagtagggg

SEQ ID NO: 6771448 - DNA, 128 bp, Homo sapiens
gctcacagtttaggaggcgttagtagagttggttccttccagaggctctgagggagagtctggtctctatacctctcttgtagctgctggtggttggcaacattttttggtgtttcttattttgtagc

SEQ ID NO: 6771449 - DNA, 115 bp, Homo sapiens
tatatattaagttggtgcaaacgtaattgcagtttttgccattaagagtaatggcaaaaccggattactcttaatggcaacaactgcaattacgtttgcaccaacctaatatata

SEQ ID NO: 6771450 - DNA, 69 bp, Homo sapiens
gcagtatgctcctctgtggtgattcacttctgtcgtgagtctcttacccaagcagaatgtatgaagtgc

SEQ ID NO: 6771451 - DNA, 62 bp, Homo sapiens
tacttctgaagcagagatttgggtccatgatagtggatgtaataggaaaatgtttagaagta

SEQ ID NO: 6771452 - DNA, 64 bp, Homo sapiens
cccgggttctggcttcagcaaactgagtaaatgatagtgctgtttcttgagctaggaacctggg

SEQ ID NO: 6771453 - DNA, 59 bp, Homo sapiens
gaaatgagttaatgggctaatggatgggggcatttacccttttgcctttaattcatgtc

SEQ ID NO: 6771454 - DNA, 71 bp, Homo sapiens
gtctgcctcatgggagtttggccacagccaaggtgctcctcttggattgcagcagctcctgtgggcagcac

SEQ ID NO: 6771455 - DNA, 79 bp, Homo sapiens
gacggttctcagtctattgggtaaatacatagccagcttctcacccccaaagcccagcctgtctttcccaatgaacctc

SEQ ID NO: 6771456 - DNA, 57 bp, Homo sapiens
cagtgaggattactagttaacagggagaaacaatcttgtactatgtctaagtcactg

SEQ ID NO: 6771457 - DNA, 67 bp, Homo sapiens
ctgtcacccaggctggtatgcagtggcacgatctcggctcactgcaacctccacctcccgggttcag

SEQ ID NO: 6771458 - DNA, 79 bp, Homo sapiens
tgtcttttttgaattatttgtttgcaagctagagaaataggctacctttagcaaaataaggtaatttattggaaagata

SEQ ID NO: 6771459 - DNA, 78 bp, Homo sapiens
ttcatgtacgtcctcaccctggcttctttcaagtttggctgactttatctcaagccagggtttgtggatctatgtgga

SEQ ID NO: 6771460 - DNA, 129 bp, Homo sapiens
ccatttttttcaaaattacatagaaagaagatgtagtcttaaggggggtggagggacaaacttccattgagtacctggagacactgcgtgtacatcttcatctccacagtaggcacgtgaggtaaatgg

SEQ ID NO: 6771461 - DNA, 84 bp, Homo sapiens
acaagtgagtggagggaattatgcatttctaatcttctttcaacctttagcttagctgcatgcatgttcttgtcttgtgcttgt

SEQ ID NO: 6771462 - DNA, 77 bp, Homo sapiens
gtaagagacctggactgagttagatggcctgggctccagtcataccttgctatctctttagtactagatttttttac

SEQ ID NO: 6771463 - DNA, 71 bp, Homo sapiens
ggatctggttttggtctggaagcgtcccaaaggtgtcgcatgccagggaaactgcagaccagcccacatcc

SEQ ID NO: 6771464 - DNA, 70 bp, Homo sapiens
gagtttgtcagtggtcatagtagaaaataataaaattttatgttttagcaagattcactgaatcagactt

SEQ ID NO: 6771465 - DNA, 68 bp, Homo sapiens
tctggccatgattagctgatctcagttgagcttattcatatatctgaggtcaattaatcaacaacaga

SEQ ID NO: 6771466 - DNA, 60 bp, Homo sapiens
cctggccagcagccccttcctctgtcctgtttattctgcagctgaagggacctggtcagg

SEQ ID NO: 6771467 - DNA, 130 bp, Homo sapiens
ctatgacatcagaatatttcagaataagtcttcagtttagaaccagggttacgattctttttaaagaggattactttatatgtatttctgtgttgctttgaaggatccctgagtaatttctatgcatgtg

SEQ ID NO: 6771468 - DNA, 79 bp, Homo sapiens
gtacaaaaggcagaagaatggtgtctgagctcaaaatgcaggcagagagtgagttcagccttcctccatctctttgtgc

SEQ ID NO: 6771469 - DNA, 85 bp, Homo sapiens
tcctcctgtttctctgtgcctactacgaggctcatcctcacacctgaggactgtctccttgctggtaggctcaccgcgtggagga

SEQ ID NO: 6771470 - DNA, 73 bp, Homo sapiens
ttccaccaggataaaacctctagatagtaccattcaaaacaacctgttatctagagtgaacatcatgggagaa

SEQ ID NO: 6771471 - DNA, 62 bp, Homo sapiens
gctgcatttcaagtgttcagtagccacatgtggctaatagataccacattggacagtgcagc

SEQ ID NO: 6771472 - DNA, 59 bp, Homo sapiens
aagttacacagagttggaggctgagttcactagaaggagtctccgcttgtgtgttcctt

SEQ ID NO: 6771473 - DNA, 71 bp, Homo sapiens
ggtgggttatgaagggcgaaggacctcttagcaggacactcagctgaggtccagcattcgcctaatccact

SEQ ID NO: 6771474 - DNA, 102 bp, Homo sapiens
tacatttatctgatcttttctcacaatttccattgagcagcagttgctacaaccacctgagcatcaaatgggcaattaattggaacagatttaataaatgta

SEQ ID NO: 6771475 - DNA, 60 bp, Homo sapiens
gttatacgtaacatcacagggacaggcagccccctataacctgggagaattgggtgtggc

SEQ ID NO: 6771476 - DNA, 56 bp, Homo sapiens
ttggagagcagtaaaccacacttgtttaaaacaaacatgctggtgatgccttccga

SEQ ID NO: 6771477 - DNA, 57 bp, Homo sapiens
gaaagagctggcatttatagtctttagagctctaaagattcaggcccatgttttttc

SEQ ID NO: 6771478 - DNA, 102 bp, Homo sapiens
acagtccacgtcccgggaaggggtagacacagctatgagcagcctagcttgccgaagcagcagggcttctgtgcctgtgcacctctgtcatgcctggaatgt

SEQ ID NO: 6771479 - DNA, 72 bp, Homo sapiens
caggcaagggacgtggccttggagttggacagatgtggctctgaattctgctccaccacttccagcagcgtg

SEQ ID NO: 6771480 - DNA, 56 bp, Homo sapiens
gcatcatttgtcctctaggactggacacctcaggcctatgagaggcagcatgttgt

SEQ ID NO: 6771481 - DNA, 76 bp, Homo sapiens
ttgcttgaacccagaaggcggagattgcagtgagccaagattgcgccattgcactccagcctgggcactagagcaa

SEQ ID NO: 6771482 - DNA, 82 bp, Homo sapiens
cagagtggagtgtctcttagctaagaagtttgtgctgctcaagggtttgcacaaatacaaagttgagaaatactccttgctg

SEQ ID NO: 6771483 - DNA, 65 bp, Homo sapiens
cagcatggggtggtgggcaacctcaggtgctggcatctggctctaggaagccattaccctccctg

SEQ ID NO: 6771484 - DNA, 91 bp, Homo sapiens
gctgtgagtgtacctggacacctcagtgtgtggatgttagagaccagtgtttcctcatttggcacatctgagctcagcttggcaccacagt

SEQ ID NO: 6771485 - DNA, 61 bp, Homo sapiens
ggaggcagtccagtgggtaagaaatcccccaacttcccatttccccaccttactaccctcc

SEQ ID NO: 6771486 - DNA, 98 bp, Homo sapiens
ttggctcgactgggtaacttgttctgtttactcttgttttgggcagcaccgattgccctagggctaagcaggactgccaccccagactcgattgccaa

SEQ ID NO: 6771487 - DNA, 65 bp, Homo sapiens
ctggatgcggcccggcttggatgggcccgaacggaggtcgcctcttgaggccgggccggatctag

SEQ ID NO: 6771488 - DNA, 83 bp, Homo sapiens
tattaggttgaactctgtaattctatatgcagttaacaattctgtcttacgtaatcagggagttagagattctgtttctagta

SEQ ID NO: 6771489 - DNA, 71 bp, Homo sapiens
agagaaaaacataaccctaggagataagagagcaccaaggctaatattaaccctgagggtttgtgttcttt

SEQ ID NO: 6771490 - DNA, 60 bp, Homo sapiens
cttggggctttgtgtgtaggatggtttatgtccttgttcaacttgccactgtttcccaag

SEQ ID NO: 6771491 - DNA, 56 bp, Homo sapiens
ttacatattgtccatagttgcttttgcactgcaagggtagagttgaatagttgtga

SEQ ID NO: 6771492 - DNA, 60 bp, Homo sapiens
tcatgcctgagactgttaattggctcagcattcaggcacatttgagacatccaggcatgg

SEQ ID NO: 6771493 - DNA, 62 bp, Homo sapiens
aagtgagtattcaaggctcataataattaatatctgttgctagctttgctttgtactcattt

SEQ ID NO: 6771494 - DNA, 89 bp, Homo sapiens
agcaaacattttacaagtagcttattagggataatagtgaaggaagtcacttaaactagaaaattcctagaaactatgtgttgtttgct

SEQ ID NO: 6771495 - DNA, 61 bp, Homo sapiens
acatgtaagtaaagctgtgaaggaggagattatctttgccttccagttttaattaaattgt

SEQ ID NO: 6771496 - DNA, 113 bp, Homo sapiens
tgtcctcatacgtaaaatagagatgtaattgcataaatttcatagcattgttattaggtacagacaatgctaatatacatgaagtgcatgtctcctggcatattgtgaagaca

SEQ ID NO: 6771497 - DNA, 83 bp, Homo sapiens
taataggtatgtaataattgttgaatagatggataattctttaaccctgtaatgaagtgtcctcattcaacatgcatttatta

SEQ ID NO: 6771498 - DNA, 65 bp, Homo sapiens
ccccttctgaaaccttcagtatgaagccattatgttttaccctttccaggttttaacataagggg

SEQ ID NO: 6771499 - DNA, 60 bp, Homo sapiens
agggaggagctgtgtgtaagggcctttccacagtccctgcacacatatggcttctctcct

SEQ ID NO: 6771500 - DNA, 68 bp, Homo sapiens
tgtggctctggagacctgcatttatatttattcctttagatgccagtccagcaggtcactaggctgca

SEQ ID NO: 6771501 - DNA, 82 bp, Homo sapiens
gcctgttctctctcttgcctgggtggtgcctgctgggaaccacagggtgttggcagccacccatggctccagagaggtgggc

SEQ ID NO: 6771502 - DNA, 69 bp, Homo sapiens
gtttcagtagcccttgagttcatgtagaaattccatttgctctgcagttgctcttgaggcactttggac

SEQ ID NO: 6771503 - DNA, 84 bp, Homo sapiens
gggccagggatgctgtttggtcaatattggtttgtaaagattatgaataaccaacagtccagatgagatggtcattgtttgtcc

SEQ ID NO: 6771504 - DNA, 84 bp, Homo sapiens
cagtggctgtctcctatttcctgctaaggcttgcaacatatatggcacacatccagtatggaggtaggaataaagacatcactg

SEQ ID NO: 6771505 - DNA, 77 bp, Homo sapiens
gcataacaggtttttcaaggattatcttgctagttacgtaaatagcaagagacttatgtggaaacctgtgattttgc

SEQ ID NO: 6771506 - DNA, 77 bp, Homo sapiens
gctggcaaatgtggtgtttgagctgccagggatcatcagggtctctctgcagcccgggacactgcatatattctagc

SEQ ID NO: 6771507 - DNA, 73 bp, Homo sapiens
tccctgaagccagggaaggaagatacaaagcagagtccatcccctgtggctccttgaccctaggcttttggga

SEQ ID NO: 6771508 - DNA, 64 bp, Homo sapiens
cagtcttctcccagggtcgcccaagtccgctgggatggcagagactcctcctgggagggggttg

SEQ ID NO: 6771509 - DNA, 62 bp, Homo sapiens
aggtgacggaagtcttgttccgggggcccacttgttcccattcatcctcgcttccttcacct

SEQ ID NO: 6771510 - DNA, 81 bp, Homo sapiens
cctctttaacatatgctttctcatcttcatgatgcctaggagtggcatacattgaaggagaaaggaagaaatgggaagagg

SEQ ID NO: 6771511 - DNA, 59 bp, Homo sapiens
agtgcaggatcaagaggcccctgactgccacagtaggggttctttaagttgtgagcact

SEQ ID NO: 6771512 - DNA, 104 bp, Homo sapiens
tgtcattcatacttctagtgtagagctgttctgtgattgatctacccttagcttgggataatgctttatttataaaatagcaatttctgcattttctgtaggca

SEQ ID NO: 6771513 - DNA, 60 bp, Homo sapiens
gtcctgcttgttaggcctagtccattgtctatagtgtattagtggccagaaaagcaagat

SEQ ID NO: 6771514 - DNA, 58 bp, Homo sapiens
ctcatgccagtgccttagaaatctatgctctcgtgcttttctaagtgcttggtttggg

SEQ ID NO: 6771515 - DNA, 59 bp, Homo sapiens
gcccgctgcttcagggacgtgccagcggccgcgctggccgagggccggggtcgcgtggc

SEQ ID NO: 6771516 - DNA, 76 bp, Homo sapiens
ttttacataatcctcacagcaacctatggtatgattatcatcatcattttatggctgagaggactaagtcttaaag

SEQ ID NO: 6771517 - DNA, 55 bp, Homo sapiens
gaggttccccattgtactggctgattttctcagactgcacttcagttggagcctc

SEQ ID NO: 6771518 - DNA, 84 bp, Homo sapiens
gttaccgtggcctctggtttcccagttcctccgtggtgtaatgaagtcccaggttttagaagctgaagccaagcctagggtagc

SEQ ID NO: 6771519 - DNA, 60 bp, Homo sapiens
tgatgctcattcttttactccatgcttaattccaggcaaatcgtagtagctatgggctca

SEQ ID NO: 6771520 - DNA, 65 bp, Homo sapiens
aggagatgtgtgctacaggtgtgggaagactgaaaaggttttttaaaattagcactgcatttact

SEQ ID NO: 6771521 - DNA, 61 bp, Homo sapiens
cacacacacagacatttgctcacacgattgtatattgagaatacatttgttattgtgtgtg

SEQ ID NO: 6771522 - DNA, 97 bp, Homo sapiens
gtgcctggcctctaggcttgaaattctaatgaaagtggaccatgggcaggcttataactcagagttcctcatagatccagtcctgaggcacagtcat

SEQ ID NO: 6771523 - DNA, 69 bp, Homo sapiens
gtgctgagattggagtgagcagaactgcatatctcattccagctgcagctcactccaatagtttagtat

SEQ ID NO: 6771524 - DNA, 91 bp, Homo sapiens
ggtggataacagccccctcttctgtcccttgggtcacaactctgaggtgctttctacacagctgctcagaggggacctagcagagtctacc

SEQ ID NO: 6771525 - DNA, 98 bp, Homo sapiens
aaagtatttcagcctttaactggataaagtgttttctcttacttactaaatgacactatcaattttatctagagctgcaggcgattcattaatacttt

SEQ ID NO: 6771526 - DNA, 82 bp, Homo sapiens
aatagtaaaattgtaactacattgagaacatgttaaggaaatggtcatatttctgttcctagaaagatacatagttgctatt

SEQ ID NO: 6771527 - DNA, 67 bp, Homo sapiens
agttttccagtacttttatgtttttattgatgaaacagtaggaacatatgcagtgctttttaatact

SEQ ID NO: 6771528 - DNA, 87 bp, Homo sapiens
tagataggccagtctaagggtgcctgagttagggcagaacttttctcatatgttcttgtaaagctcaggcacaaagaaaactagcta

SEQ ID NO: 6771529 - DNA, 73 bp, Homo sapiens
tagggagctcagagaacttaattgtcacttttctgtgagtctcacaagtggtgctgaggcttctctctcccta

SEQ ID NO: 6771530 - DNA, 82 bp, Homo sapiens
tctctgatgtagaactcttgcagtgaaagcttatctttggaagaaactgggctgtctttctggaagagtcttttctcagaga

SEQ ID NO: 6771531 - DNA, 70 bp, Homo sapiens
ttggagaatacctctttacacagtgcatcaaacacaatagtgtgtacttaaaggttagctattctaccaa

SEQ ID NO: 6771532 - DNA, 65 bp, Homo sapiens
ttttgtgtttaggttcgtgtcagataagtttccattgtttgcaactaaaagaacttgacacaaaa

SEQ ID NO: 6771533 - DNA, 55 bp, Homo sapiens
ctggccactcccgcacaagacgttttcttatctgtctctgtgttcaaggtgccag

SEQ ID NO: 6771534 - DNA, 62 bp, Homo sapiens
aagcgtgcagaaatatgatgcataaagggggcgttccctgtgacattagaatttcattgctt

SEQ ID NO: 6771535 - DNA, 68 bp, Homo sapiens
gggagtcaagatgactttgggggattaaggggcactctgcggcttttccttctgggtcactgaatccc

SEQ ID NO: 6771536 - DNA, 92 bp, Homo sapiens
tctgcctagccatggtctctagtggactactagctgaaagtcactgaattttctgagctagtgatttataagatgctagtttcggtggcaga

SEQ ID NO: 6771537 - DNA, 91 bp, Homo sapiens
tatgagtgaaaaagcaggcaggcagactgagattaagacgcttcctcacagcttctctcgggctgtgcctctagccattcactacctcata

SEQ ID NO: 6771538 - DNA, 85 bp, Homo sapiens
tctgaagacatctgtcatttcaatgatactactaagtcctagaggaagatttggtggtatcattgaaataacagatgtttccaga

SEQ ID NO: 6771539 - DNA, 74 bp, Homo sapiens
gtcttgggcccctcatttctccaatgccagatgcctgggcagcagggctggaaccagagtgaggcaggtgaggc

SEQ ID NO: 6771540 - DNA, 55 bp, Homo sapiens
agagagtgactgaaaggagacattaaaaaatgtctgtctgaataatttactcttt

SEQ ID NO: 6771541 - DNA, 64 bp, Homo sapiens
gagcccagagaagtcttgcctggattttgttctttgcacaagttctttaacctttctgggcatc

SEQ ID NO: 6771542 - DNA, 85 bp, Homo sapiens
ggggaagtccaggtagcattgcttatttcagctaaagttgagaataaatacaattaaatgagctgtggcactgcccttggccccc

SEQ ID NO: 6771543 - DNA, 71 bp, Homo sapiens
cacttttttattaccagtgcctggcagatacccggtgctgcaaaagtacttgtcaggtgggtgggagggtg

SEQ ID NO: 6771544 - DNA, 77 bp, Homo sapiens
gtggctggggagggatgtgggaactgcaggttaaagccatcgcttgagccctcacggtctgggtcccacccagttac

SEQ ID NO: 6771545 - DNA, 100 bp, Homo sapiens
cctgcaattacagatagagtttttctcataaactgtttaattgtttgcttctggaaacaattagactgacggtattatagagggagtgtcgtattgcagg

SEQ ID NO: 6771546 - DNA, 75 bp, Homo sapiens
caaaccttatgtccaggctgcaccccagacccattaaatcaggatctctggggatgggacctggcataagttttg

SEQ ID NO: 6771547 - DNA, 56 bp, Homo sapiens
ccacccagccttccaccctggactacaccctgtgttgtaccagaaaggcctggggg

SEQ ID NO: 6771548 - DNA, 76 bp, Homo sapiens
agacagaaccccgacctcagagaagatggatgaggtaccaccgtgtctgtccatctgtctgggactggttttgtct

SEQ ID NO: 6771549 - DNA, 61 bp, Homo sapiens
gggaaagagaggtggacgcaggtcaaagatatcacatcctctcctctcacctttccttctc

SEQ ID NO: 6771550 - DNA, 108 bp, Homo sapiens
cagccaggagggctgacagtgctggagtggaccagtccgcggagctccgggggtctgaatgctccaggggtgtgtggatggcaatggccaggatggccctcctggttg

SEQ ID NO: 6771551 - DNA, 68 bp, Homo sapiens
ggcaataatttacattggataccaattgcaacacagcaagtggactccgtgaagtaaatctacttgcc

SEQ ID NO: 6771552 - DNA, 71 bp, Homo sapiens
cctggggaaggctcctcaacctctcggggcaggtctcaggtggaatctgaagggcaacgccttcccgcggg

SEQ ID NO: 6771553 - DNA, 99 bp, Homo sapiens
aattttttcctgctatgacaaagactggttggggtgggcagggggaaaccttattatataacaatcttctgcttgacccgtccaagtctggaaggcatt

SEQ ID NO: 6771554 - DNA, 80 bp, Homo sapiens
gagtgaggtgactagcaggtgggggtggtgtaggggagagagagcaatgtccccatctgctgtgtgacctctgtccactc

SEQ ID NO: 6771555 - DNA, 72 bp, Homo sapiens
tatcacagacagaggtgaccctgagctggatggatagataatccagccttccttttcactctctctgtaata

SEQ ID NO: 6771556 - DNA, 60 bp, Homo sapiens
gctgcagcaagccctccaggggattatgatacctgcccctctgagaacttctgctgcagc

SEQ ID NO: 6771557 - DNA, 69 bp, Homo sapiens
gcaaagagttttttcatataatggcagttgctcaacctcctgtccttatatttctatgactctagttgc

SEQ ID NO: 6771558 - DNA, 56 bp, Homo sapiens
aggtgatctgccaccttggcctcccaaagtgttgggattacaggtgtcagtcacct

SEQ ID NO: 6771559 - DNA, 58 bp, Homo sapiens
gatgctccctttgaatgtcagttaccagctgcttatggaagctaagacaagggacatc

SEQ ID NO: 6771560 - DNA, 77 bp, Homo sapiens
gaagaaatgctccttcaaaagtcatagtaaaacagatcatgtagatttttacttttgctgttgaagttgtgggtttc

SEQ ID NO: 6771561 - DNA, 59 bp, Homo sapiens
agtcaacatataacacctggcatctgaaagtaatcatttgcatgggtggtatgttaact

SEQ ID NO: 6771562 - DNA, 80 bp, Homo sapiens
ggccctggccatctcctgccagcggtgctgaaacagggcctcctgcagagactgcatggctggtgactggccctggtgtc

SEQ ID NO: 6771563 - DNA, 59 bp, Homo sapiens
gcctcacagctgcttcaggatccagcattatgctggaaaggtatgggggagctgtgagc

SEQ ID NO: 6771564 - DNA, 89 bp, Homo sapiens
cctttcactgagggtgcactacatgtactcactgtgctagatattgggaatacagggctgagtgagacatgggcagactccctgagagg

SEQ ID NO: 6771565 - DNA, 69 bp, Homo sapiens
ttacagattaaaatgctgaggtctacaaaactaaattcatttatataaggagacctcacagatctgtga

SEQ ID NO: 6771566 - DNA, 60 bp, Homo sapiens
gccttagcctgcacttcctgttttaaagcctcaaggttagcagaggtgagagcttagagc

SEQ ID NO: 6771567 - DNA, 64 bp, Homo sapiens
tgatgattgtgcaggacataaaggacagaaagcccaagcctatttaagacctgcatcatcatta

SEQ ID NO: 6771568 - DNA, 57 bp, Homo sapiens
ttccctctcctactcaggaaaggactggaaactgatcttcctggatgtgagaggcaa

SEQ ID NO: 6771569 - DNA, 95 bp, Homo sapiens
gtcacacctgtcacttctgtttagtacctcttcctagtaaggagaacgtatgctccctttctggaagggtctacttagcagaaacgaggagtggc

SEQ ID NO: 6771570 - DNA, 82 bp, Homo sapiens
gtctttaaaagtgggctggcctggggttgtccttggttaaaccccaaggacacttgagagtccagtcatcttttatcctgat

SEQ ID NO: 6771571 - DNA, 125 bp, Homo sapiens
cagcacagtgcttggcacaagatggacctaccctcagtccacacctgctgcccatccaggccaggcctggagcaggtgccaggtgtgtggtgggggcttggccactatggccgtcatgaatgctg

SEQ ID NO: 6771572 - DNA, 59 bp, Homo sapiens
aggctgtgctcagccaatgggacctgctcctcccttgaaggttgcagaggccacagcct

SEQ ID NO: 6771573 - DNA, 66 bp, Homo sapiens
gaagaacattgacagcctttgttgctttgggaatcgaagtacagtagggtgctgttagtggacgtc

SEQ ID NO: 6771574 - DNA, 110 bp, Homo sapiens
ggtgctgcttatctggtgttggtgtctctgagcttagagaaaggaacctatttgcctatggctagggaacctcttctgaggaagagctactagcaactggtaaaagcatt

SEQ ID NO: 6771575 - DNA, 102 bp, Homo sapiens
gtattcattttgaagctagagtcagagaatcattacagccacaccacttgtgaattagtgtatttgaaatgctctttggaatctagttatataaaatgatgc

SEQ ID NO: 6771576 - DNA, 73 bp, Homo sapiens
tgtagttcaaaggcctgagagatgaagggctgatggtatagatttcagtctgagtctaaaggcttgagaagca

SEQ ID NO: 6771577 - DNA, 65 bp, Homo sapiens
tgtggtcagtagaatgttttgctttcttatagtcacaacagcatagaacagtcttctgagccaca

SEQ ID NO: 6771578 - DNA, 73 bp, Homo sapiens
attgtggttgtgaatgtgggtgtcagcctgtatgtttgtgacaggtgtctgacactatgtgtgcagccagaat

SEQ ID NO: 6771579 - DNA, 67 bp, Homo sapiens
gttccttagagtggttgtgctatgggtgtttgaccaaggatagcatggtttgatgactggaaggagc

SEQ ID NO: 6771580 - DNA, 77 bp, Homo sapiens
cttgttttgatggcagtggagttagtgattgtaaccaccacagtacaatcagctaatgacactgcctacaaaccgag

SEQ ID NO: 6771581 - DNA, 57 bp, Homo sapiens
attctttaaattagcctttgaggattggttttccaagagagggctcatttgaacaat

SEQ ID NO: 6771582 - DNA, 85 bp, Homo sapiens
gaagtattggcttttccagacctggctctctcttggcccattgctgccactctgtgggcctggtctggagcatgccagtggcttc

SEQ ID NO: 6771583 - DNA, 63 bp, Homo sapiens
ataataacctctcggagcctcaccatttttagaataaaattcaggaaaattgagggttgttgt

SEQ ID NO: 6771584 - DNA, 55 bp, Homo sapiens
gaaattcctcatgtgccagtcattttgaagaatggctgcctagacttggaatttc

SEQ ID NO: 6771585 - DNA, 86 bp, Homo sapiens
ttggatgagtgtctcaagcacccttgctgccaagtggatttcaaacaatctattaggggttgcaggtgaggaaaccattcatttga

SEQ ID NO: 6771586 - DNA, 56 bp, Homo sapiens
ggcagctattccaagcagcactggaactgttactgtggtgtttggacaggcatgtc

SEQ ID NO: 6771587 - DNA, 68 bp, Homo sapiens
ggtcaccaggtggctgaggccatgacactcccagaggagacgtgatgaggacccatcacctggtgact

SEQ ID NO: 6771588 - DNA, 76 bp, Homo sapiens
atgagttgacagactcacctcacttgctgaaggactagcccagcaggttctacgggtgagatcactgctagctcat

SEQ ID NO: 6771589 - DNA, 86 bp, Homo sapiens
gagaatcgcttgaacccgggaggcggaggttgcagtgagctgagatcatgccactgcactccagcctaggtgacagagcgagactc

SEQ ID NO: 6771590 - DNA, 67 bp, Homo sapiens
ccccccagcaggaatacaggggtcgaccctcgaattaaagttgacctgctcctaatctggggcttgg

SEQ ID NO: 6771591 - DNA, 56 bp, Homo sapiens
tcaacaataggatatagcaggtgtcagtctttggcctgcaaacaaattattgttgg

SEQ ID NO: 6771592 - DNA, 70 bp, Homo sapiens
tcatggcatcctctccagtgctgtcatcccttccaccaagtgggtttcagggagtcacgctggtgccaga

SEQ ID NO: 6771593 - DNA, 60 bp, Homo sapiens
tcagctgcttgtacatgaccacatccctatttctattggtgtaggtaagcatgcagctga

SEQ ID NO: 6771594 - DNA, 76 bp, Homo sapiens
tggcacacagttctgcaggctgtacaagaagcatggtgccagcatctgcttctggtgaggcctcaggaagtgtcca

SEQ ID NO: 6771595 - DNA, 55 bp, Homo sapiens
catggaggaccctcagggagctcccttctaatacagctccctccgtgtccatatg

SEQ ID NO: 6771596 - DNA, 56 bp, Homo sapiens
catcttgtgaggaccttcttgctgcatcataacatggcagaaggtgtcacatggtg

SEQ ID NO: 6771597 - DNA, 78 bp, Homo sapiens
ctcagtgccatagactacgctcacactagaccccagccttctcctgggccctgtgtgaaggtagctcttggcactggg

SEQ ID NO: 6771598 - DNA, 130 bp, Homo sapiens
aagacagtctagtgggagatgtggctggggctaagaggaagagctgcagtttcctgggccaaagagctgagttggacagggagatggcagcttaccaaggcctgctggttctcagctctagagtctgcct

SEQ ID NO: 6771599 - DNA, 60 bp, Homo sapiens
ctacatggcattcactcccacagggcatctgccactgcctgtgagctgtgtgccagcaag

SEQ ID NO: 6771600 - DNA, 64 bp, Homo sapiens
gagaacagagtgtaccttagcataaaataatctctttgtttctgagattaaaggatgctctctc

SEQ ID NO: 6771601 - DNA, 74 bp, Homo sapiens
gaggctttcttgtccttggggtgagctttgatgttgaggcacccagggtcaccccgtagggttctgcaggtctc

SEQ ID NO: 6771602 - DNA, 67 bp, Homo sapiens
tttcctcaggcacagggctggttgtggtaatggccacacctggtaaggcctctgtcatcctgggaag

SEQ ID NO: 6771603 - DNA, 58 bp, Homo sapiens
gtatagatgaggaacctgatggtatggtctttctaccactctcccaccatatctgtat

SEQ ID NO: 6771604 - DNA, 60 bp, Homo sapiens
agcagtaagacttttttctgtggctctacccctttccagagcagaagctaggcttactct

SEQ ID NO: 6771605 - DNA, 84 bp, Homo sapiens
ttagtggggaggggaggtccagctgatctgcccgctttgatgcaaggaacagtagacgatctcctttaattataccctcactaa

SEQ ID NO: 6771606 - DNA, 64 bp, Homo sapiens
gttattggagaaagtgctggggctctgtccaaatgtcagcccaggtcagctcttctccagtaac

SEQ ID NO: 6771607 - DNA, 109 bp, Homo sapiens
gtataggcgactgtccctctcaaatcctcgcatttgggcaggagatgctccctaagcattgatcacctgcccaaatgtgaggatttgagtttaggatttaggtctctgc

SEQ ID NO: 6771608 - DNA, 94 bp, Homo sapiens
ctgggagggtgcagggctccaggccccagcgttccgcgtacatgacctgccggagcgggacacgggcgcttggtcactctgcccctcgccccag

SEQ ID NO: 6771609 - DNA, 76 bp, Homo sapiens
caggtatctcccacagaccatgagtggaagcgatgagtgtcccttcttttacaggtcttgggttaagaagcaactg

SEQ ID NO: 6771610 - DNA, 87 bp, Homo sapiens
ggcctcatttacgtgccgatgtctagagcaagagatgctggaaaagaagtatctagaattttctgctttgatagtaggagaggggct

SEQ ID NO: 6771611 - DNA, 104 bp, Homo sapiens
gtcattagtgatgcgtttgggcagctttgccctcactgtcctcagtcacaagaaaggatggacatgagcagaggaccctgtagaaaaaggcagacatacatgac

SEQ ID NO: 6771612 - DNA, 56 bp, Homo sapiens
accccagcacatagtaggtattcactaaatgttagtgggtgttgtagtgtgggggt

SEQ ID NO: 6771613 - DNA, 64 bp, Homo sapiens
gttctgtgtgaatagtgaggtctattggttgtaagttcggtgtacacttccttcacacggttac

SEQ ID NO: 6771614 - DNA, 84 bp, Homo sapiens
agtttgtctgtcttaagcaaggcagcctttgtttgattgattttaccctttctgtctaacggggctggcctgacctgactctct

SEQ ID NO: 6771615 - DNA, 68 bp, Homo sapiens
tcctagactgggcccacctggcagtggccatgctggggctatcaccaggggctggtgctgagctgggg

SEQ ID NO: 6771616 - DNA, 65 bp, Homo sapiens
aacatggaggcagacagacgtgggttcaaattccaagtctgttccacgttcgtctgtcccatgtt

SEQ ID NO: 6771617 - DNA, 63 bp, Homo sapiens
ttcatctaaataaaagtgcttaatgtttctcttttggaaattgccagtgtttatttaggtgaa

SEQ ID NO: 6771618 - DNA, 74 bp, Homo sapiens
gaataagtcctatatccatatgtatctgctctacagatatttgtcaggtgcagcttggatgcaagtttttattc

SEQ ID NO: 6771619 - DNA, 64 bp, Homo sapiens
ttggcttagcagcaatggcatcaactagttgctaattagaaatgcccagattctgctagatcaa

SEQ ID NO: 6771620 - DNA, 79 bp, Homo sapiens
agagaaagggcatttaatatagcctttattagtcactttattagtcactggtacctgtcttgaattttccaaaggctct

SEQ ID NO: 6771621 - DNA, 76 bp, Homo sapiens
ggtgtacacattgtctgtttacttcttgtctgaactatcatatttgaagctgtgaagtgtaagataaatgtgcatc

SEQ ID NO: 6771622 - DNA, 61 bp, Homo sapiens
cccaatatcctgctatactcctgccagagctgttcaggtcagagaaaagtagggtgttagg

SEQ ID NO: 6771623 - DNA, 69 bp, Homo sapiens
gtggagcaatcagagggtcagttgaattgtttcctgattctcagagatcactggcctttgttgcttcat

SEQ ID NO: 6771624 - DNA, 78 bp, Homo sapiens
ataattaatcagagacaatgatttctttatggtgagccccactatctcactgggtattatctttgtctctgtagttgt

SEQ ID NO: 6771625 - DNA, 60 bp, Homo sapiens
gagatgcaggctccaagcaagaagtcaggagactggggtgctgggcaggtgtttgatctc

SEQ ID NO: 6771626 - DNA, 108 bp, Homo sapiens
taacataggttaaaatgggtagaggtggctccttcagggaatatggaaattaagaagcagtactttatatgaatgactgacgcttttctgcaattttagtttttgttg

SEQ ID NO: 6771627 - DNA, 71 bp, Homo sapiens
gctggtggggccacctaggagccacagtgacacccagtgtcctgcagagctgcctgtgtggcctgcctagt

SEQ ID NO: 6771628 - DNA, 66 bp, Homo sapiens
gcactctaggcgtattcctgaacctgaaggctcatgtttcagacaggacttcatatgtgtgggagc

SEQ ID NO: 6771629 - DNA, 88 bp, Homo sapiens
gggtcgcgccgcgcaggcgcaacagcgtggcgcccagctgcgtggcgaggcagcggcccagcagcgctttgcccgcgccccgcggccc

SEQ ID NO: 6771630 - DNA, 77 bp, Homo sapiens
ccctgaaccttgttcctgccctcctcccacccctgtcctcctggaggaaggctgcttcaggagctgcaggctcaggg

SEQ ID NO: 6771631 - DNA, 82 bp, Homo sapiens
tgctctagagctattggcttccacaaaagtttgtgatatagttcgtatctgttaagacgagggagctaagttctctatggta

SEQ ID NO: 6771632 - DNA, 76 bp, Homo sapiens
cttccattgccctatccatttcattttggaacccagatactccagttccaaaatgaaatggatagggcaatggaag

SEQ ID NO: 6771633 - DNA, 99 bp, Homo sapiens
ggtgtggtgcatgcctgtaatctcagctactcgggaggctgaggtgggagaatcgcttgaacctgggaggcagaggttacagtcagccaagatcacacc

SEQ ID NO: 6771634 - DNA, 62 bp, Homo sapiens
ggagtctccatgtgcccctcagcttgtgcccacagatgtgaggactcatgtggaggatggcc

SEQ ID NO: 6771635 - DNA, 71 bp, Homo sapiens
tggaaccctcatacgtgctgctggaaatgtaaaatggtgcaactgctttgcagaacagtctgtcggttcta

SEQ ID NO: 6771636 - DNA, 56 bp, Homo sapiens
acaagctggagttcctcagagtggcaaaaatgtacctgaaccaagcccagctctgt

SEQ ID NO: 6771637 - DNA, 65 bp, Homo sapiens
ttcttggatgatatgtgtcctaagcatattgatatcaatatgtgtcctaagcaatcatccaaggg

SEQ ID NO: 6771638 - DNA, 62 bp, Homo sapiens
tccccagttttgataacttctggctggaaagttttccaggctagctgtttcagggctaggga

SEQ ID NO: 6771639 - DNA, 60 bp, Homo sapiens
aactttccatcatttgaagcccagaggcataaaattgcaatttgaatgataaggagagtt

SEQ ID NO: 6771640 - DNA, 59 bp, Homo sapiens
tcctgaaggagcagttgctgggcagtaatgcagtgccacctagcttccctcctgcggga

SEQ ID NO: 6771641 - DNA, 61 bp, Homo sapiens
gcgctggaaattgccgttggctttatacatctctatagagagaggctaaagagtcttgcgt

SEQ ID NO: 6771642 - DNA, 59 bp, Homo sapiens
tggccacagcctctgccagttcaattcttgaaggcctgctctgtgccagggctgggcca

SEQ ID NO: 6771643 - DNA, 92 bp, Homo sapiens
cagagataaattgggtggtctcttggtacacagatgatcacaaaatcagcataatgtggaaatcaattcaaggactattttcttcatctctg

SEQ ID NO: 6771644 - DNA, 58 bp, Homo sapiens
tgcctggctgctggttctgaggatggggatgcttcagtcctggccagggcactaggca

SEQ ID NO: 6771645 - DNA, 75 bp, Homo sapiens
ttgaactgttgcaattctgttgtgttttgctaaaatcttaacgagaggatatttacaaatttgccaatagtttaa

SEQ ID NO: 6771646 - DNA, 63 bp, Homo sapiens
tcccaagagctctgggataaggacaggatcatgaccaaacttctcaatgagctttttaaggga

SEQ ID NO: 6771647 - DNA, 82 bp, Homo sapiens
tctctcactatgggtttagacctgtctaatttctatagggaattatatagaaaattatagatctagtgcctgccctggagga

SEQ ID NO: 6771648 - DNA, 104 bp, Homo sapiens
ttttttttaaagccacatgtaggctgaattcatttaatttgacagaataacactccttactgctaatcctgatcaattttagctttgtgtgtctttgggttgga

SEQ ID NO: 6771649 - DNA, 79 bp, Homo sapiens
atttcacagtctgctttccagaagacccacttgcaatggtggcaggaatggtccaagaaagcacgtgcccatgtgagat

SEQ ID NO: 6771650 - DNA, 61 bp, Homo sapiens
gtatatgaaaggctgtgcaaaaaagtagattgcaaggcagtataccacagccatcaaatat

SEQ ID NO: 6771651 - DNA, 59 bp, Homo sapiens
ggggccgggggactgggcttcatgttattcttcaaaggaaagacaccagcctctgcccc

SEQ ID NO: 6771652 - DNA, 71 bp, Homo sapiens
ttaaaaatgcttgtaaattttccatgtgatgtcttctttgacccatgggttatttggaagcagctttttaa

SEQ ID NO: 6771653 - DNA, 58 bp, Homo sapiens
aagaagtctggagcaatgcaattggaacaatgactaacaagtaagcaccagacctctt

SEQ ID NO: 6771654 - DNA, 62 bp, Homo sapiens
tgaagaatcagattggcctgcgataggtctccccattctgcctgagcaggcactgattttca

SEQ ID NO: 6771655 - DNA, 58 bp, Homo sapiens
tatggtgggggctgggggatgatggcattggagggcttatcctagcacctggcacata

SEQ ID NO: 6771656 - DNA, 68 bp, Homo sapiens
ccatgagaatctgctgcctcccaactaactacttatctacatgggttctacgcagtatgatcctctgg

SEQ ID NO: 6771657 - DNA, 63 bp, Homo sapiens
gagttattgggtggaaaggtagctttctcttccttgtacagctttttgttcctctcattagcc

SEQ ID NO: 6771658 - DNA, 61 bp, Homo sapiens
gagaggctctaataccagcatggtatgttatacagttgatgccattgcttggagtcctttc

SEQ ID NO: 6771659 - DNA, 63 bp, Homo sapiens
ccccaaattatgtcactttcaaggtcagcgggctcatttccttctgcctggacaaatgtgggg

SEQ ID NO: 6771660 - DNA, 79 bp, Homo sapiens
tccatccctttcctggttaaaatggtgctcaatctgcaagttggctatttggccagaagagggtcaaatcaacaaggga

SEQ ID NO: 6771661 - DNA, 92 bp, Homo sapiens
gtccaattgcagccggggctcctccagcctgggatgagtcttggaaaatctgtcatcatcctggagaagctccttcgggcctgcaaaaaggc

SEQ ID NO: 6771662 - DNA, 78 bp, Homo sapiens
ggcagctggaagtgggctggagcaccctgagagtgcaagtaatgtggtcagggctcaccagcctctgccagagaggcc

SEQ ID NO: 6771663 - DNA, 62 bp, Homo sapiens
tggctgtcagaaggtgaagggtaaggagagactcaaattgctctcagtcttctggcttgcta

SEQ ID NO: 6771664 - DNA, 79 bp, Homo sapiens
cccagattcccaggccagagctaagcaccagagaataaacctgacgctgtggacatactaggcctaggctgggtctggg

SEQ ID NO: 6771665 - DNA, 69 bp, Homo sapiens
ttgtctatggctgtgttcatgctacaacagcagcagtatgtagttgttacacagaccatagtcccacaa

SEQ ID NO: 6771666 - DNA, 92 bp, Homo sapiens
gcaccaacatatgtgagctctgtacctgcggagatgagatgttgtcatgtattgatctcaacccagagcagaggctccgcaagtgcctgtgc

SEQ ID NO: 6771667 - DNA, 96 bp, Homo sapiens
gatgtttaacgcctgtcttttcaacttggtctactgagtcttcaatactggtgactgagctgcttgaagtgaactctggacaaggtggagagcatc

SEQ ID NO: 6771668 - DNA, 76 bp, Homo sapiens
ctgaccgcctgttcctgggaggcatgggctgggctggctgcatacctcagccagaacctctggggacagggctcag

SEQ ID NO: 6771669 - DNA, 58 bp, Homo sapiens
ggcagtggtgggaggctcgctctgggtgcacagacgctgccttcagacaccgcatgct

SEQ ID NO: 6771670 - DNA, 116 bp, Homo sapiens
gccctccctgataggagtctgataaggccctcatgcgtcagagccctgcagctgactagtgctgagctcggctcccaggagggcctggaggtcaggctgggtctgcaggagggggt

SEQ ID NO: 6771671 - DNA, 56 bp, Homo sapiens
cacaaggtttacatttatattttcctgattttctaggaaaattagatggacctgtg

SEQ ID NO: 6771672 - DNA, 56 bp, Homo sapiens
gaggaggctccctttaggtccagatcagtggaatttggtcccagggagtcctactc

SEQ ID NO: 6771673 - DNA, 57 bp, Homo sapiens
ctgtcatttactccataccctcaccttaattctggtacagggaaaagagtgtgacag

SEQ ID NO: 6771674 - DNA, 97 bp, Homo sapiens
tgcattgatctgagagctagatgtgtcttccttgacagttcaggcaaccctgattctaattctttggagacaatctgttattaaattgatctgtgta

SEQ ID NO: 6771675 - DNA, 68 bp, Homo sapiens
gacagctgggtgtgtatcagataaagttagtacacaatttggttttatctgccttttattcagctgtc

SEQ ID NO: 6771676 - DNA, 75 bp, Homo sapiens
ggtgttctgtcagctttcatttatggggaacctgctaagaccctgaaatgactccagctgagttacagcaaggcc

SEQ ID NO: 6771677 - DNA, 61 bp, Homo sapiens
tgggaatggtgcttgatgcattcaactaataccttatttgtagacatctgtatcattttca

SEQ ID NO: 6771678 - DNA, 120 bp, Homo sapiens
aagagaaatagattaagcaaagctagaggtattgcacgtgctctctacagacaacatctcactttgtagagaaaaattttactgcaatgcttcccattgcacctgccaactccttctctt

SEQ ID NO: 6771679 - DNA, 56 bp, Homo sapiens
ggtgtgttttagtgacatctctcgttcttgctttagatgttttggagacactaacc

SEQ ID NO: 6771680 - DNA, 73 bp, Homo sapiens
cctgtctcagtaagaaaggctcctgttctagatgttggggtctgagtttacatttttgcttggatgtaaaagg

SEQ ID NO: 6771681 - DNA, 62 bp, Homo sapiens
gcagatgccactaggtgaagtgcgtattttcttttcttgcttttatatactgtggtctctgc

SEQ ID NO: 6771682 - DNA, 63 bp, Homo sapiens
tttaattaggtaggagaaaactaaagctatatttatagatttgactttgtcctacctcaggaa

SEQ ID NO: 6771683 - DNA, 104 bp, Homo sapiens
ggaagtgaaggtttgtgcggaggagggagctggaagctcttcctttcaccgacacagaggaaagtgccctcccgccccctcccaagcacacccctctgcgctcc

SEQ ID NO: 6771684 - DNA, 93 bp, Homo sapiens
gccactatgtaaagcaatattcctgattaacgacctttcaatcaattcaacaattttgagttttagttggtcatgaataattacatggtttgc

SEQ ID NO: 6771685 - DNA, 65 bp, Homo sapiens
ttatgttctaatcatatgggtaatccaatggagggccttggattacccatatgattagaacataa

SEQ ID NO: 6771686 - DNA, 89 bp, Homo sapiens
tttgcagatgaagatacctgcatagaaaataacagagctgagattccaatgcagttctgtctgattctaatgcaattcccatgtgcaaa

SEQ ID NO: 6771687 - DNA, 72 bp, Homo sapiens
ccctttatggtaaggggttggtctcttcataaaacttggagtatccacaataaagccctttgctatgactgg

SEQ ID NO: 6771688 - DNA, 115 bp, Homo sapiens
gggagggagggtaaaagattccagcctcttaatttaatgtcaacatttctgaagagcccttatagctccagagctcttcacaggatggcagaggctgttatgtatcctctctctc

SEQ ID NO: 6771689 - DNA, 77 bp, Homo sapiens
cccactgacaagtctgtcttacttcactgaagttaaccctccaaacacagatgaggacagatgactgggcacgtggg

SEQ ID NO: 6771690 - DNA, 80 bp, Homo sapiens
tgaagccgaggcagccctctcagacgtaccctgtgtccaactctcctgtgacattcttgagaagcggctgtctcagctca

SEQ ID NO: 6771691 - DNA, 91 bp, Homo sapiens
catgagcctgaattgagattgctgtacacttctagatctgagataatcagcctcaggttaatgaggaaatagcagtggcaatttcactttg

SEQ ID NO: 6771692 - DNA, 75 bp, Homo sapiens
ctaagaatcccttgcaagttgttgtaggtctctgataagttgagatatgtacaattctttgtaaggtggtctgag

SEQ ID NO: 6771693 - DNA, 118 bp, Homo sapiens
cgccactacccagcccctgaaggcccagccccagccccaccagggcccctgccaccagcccccaacagtggcactgggcccagtggtgtggctgggggtcggaggttggggaagtgcg

SEQ ID NO: 6771694 - DNA, 99 bp, Homo sapiens
ctgaggcaggggaatcgcttgaacccaggaggcggaggttgtggcgagatcatgccattgcactccagcctgggtaacaagagcgaaactccgtctcag

SEQ ID NO: 6771695 - DNA, 61 bp, Homo sapiens
gtagagatagctgaattcaggcacttaaacgatgttaggatcctttttctgctgtttgtat

SEQ ID NO: 6771696 - DNA, 66 bp, Homo sapiens
gggtaagtgtagttcaagcaaaagcctggatttggaatgtcccagggtagctgagctggcaggcct

SEQ ID NO: 6771697 - DNA, 75 bp, Homo sapiens
tagtgactaataatgctgagctctttttcatgtgcttttctttgtgaagtgtctgttcaagtatttttttcgctg

SEQ ID NO: 6771698 - DNA, 64 bp, Homo sapiens
ttcattcatcccacaaacatgctttgaacatgcacattatgtttcatatggtgtggatgaagaa

SEQ ID NO: 6771699 - DNA, 79 bp, Homo sapiens
ggctgctgatgagtccttctatcgcaggctgcagcagtcctgaaggttgatggagggccatgctattcaaacagcaggc

SEQ ID NO: 6771700 - DNA, 73 bp, Homo sapiens
ttctttcctgccagaaggttcctgctgcagctctcctgctagtttagcttagccttctggtttaagggatgag

SEQ ID NO: 6771701 - DNA, 90 bp, Homo sapiens
tctgacacacaggtcttcctcaggcattagctggacttgctccttcctgcccgtctagctcaatgagcctgatttcctcagtgtatcgga

SEQ ID NO: 6771702 - DNA, 111 bp, Homo sapiens
tctgaaatggaaagtgtctgattggtacattacagtttgattgccagtattttcttgttcttagtggtacatcaaatcaatgttccagtttacaatcaaagtcatcttaga

SEQ ID NO: 6771703 - DNA, 59 bp, Homo sapiens
gttcctttcctatttggataagggagcaagttggttatccagtaaaatggcagagggac

SEQ ID NO: 6771704 - DNA, 60 bp, Homo sapiens
gcagcaggcttttcataccttgagtcttacttaatgttcacatgaaaaagcaactgctgt

SEQ ID NO: 6771705 - DNA, 71 bp, Homo sapiens
gcctttatgtttctgcagccccctcgccgagtctgcccggagaaccagggaaagctgcagataacgctggc

SEQ ID NO: 6771706 - DNA, 129 bp, Homo sapiens
aaagcacgtagacctgtgtcaagagcataataaattcttagaaaatgttggtagttgtaattttatgattagctttaaagcatatttctaaggtactatgtaaatattcatggcacttgtcatttcttt

SEQ ID NO: 6771707 - DNA, 73 bp, Homo sapiens
cccacatctgtaaagttaggcatttggggtgctccatcgtgagcctccttcctgctctaacattcagcgtggg

SEQ ID NO: 6771708 - DNA, 76 bp, Homo sapiens
tgcagcccccaggagaaatcttaaactagagatcttgccaaacctcctggagatttctccctgggggaattttgca

SEQ ID NO: 6771709 - DNA, 55 bp, Homo sapiens
ttactgctaatcatttgatgggtctgtaagagcatttggcaaaaattagcagtag

SEQ ID NO: 6771710 - DNA, 102 bp, Homo sapiens
ctcataggtgaccttggggtgcagggcaggggaccgaggcaggcttaccctggtgcagtcgcagacatggtcccctttcctcccgccaggactgtcctagag

SEQ ID NO: 6771711 - DNA, 59 bp, Homo sapiens
ggagatggccacgtcactcagtgcccagacaggataacactgggagaacgagcctttcc

SEQ ID NO: 6771712 - DNA, 70 bp, Homo sapiens
cacgatcacattcctctcaacatgcctgccggggtctgtggagcctaggggctgatgggagggtggggtg

SEQ ID NO: 6771713 - DNA, 76 bp, Homo sapiens
tgggcgtcaggctcagcagctacaggattcggggtccgtcgtcgtcctccgggccggcttgctcagcactagccca

SEQ ID NO: 6771714 - DNA, 125 bp, Homo sapiens
ggtaaataagtgacttggaaaggaatataaatactatgtacaggctgtctataaaaaccagggtagagaatattttattacactagtagaatagtgtttgctgtgtcatttccttacaatttatc

SEQ ID NO: 6771715 - DNA, 61 bp, Homo sapiens
gtttggaagttaagtgcagcagtttccaaaaaatcataactgtgacatttttattccagat

SEQ ID NO: 6771716 - DNA, 73 bp, Homo sapiens
cattttcgccttgttatcaagcttatctggcatcatttgcaagaactcagaatagggtgcagggcgtgggatg

SEQ ID NO: 6771717 - DNA, 58 bp, Homo sapiens
atgtaggcagaagtaatgtgtaccactgccaggctgggacactacaatctgcctgcat

SEQ ID NO: 6771718 - DNA, 58 bp, Homo sapiens
aggagctgggccttccagagacctttgcatggaggcgtccagggaaggcccagctgct

SEQ ID NO: 6771719 - DNA, 108 bp, Homo sapiens
cctttcatctttgagtcttaaattattttaaaagcattaattcttgcaggattcctgcaaggcacatattttagagtcacagatttatagagacttgaagataaaagg

SEQ ID NO: 6771720 - DNA, 67 bp, Homo sapiens
gacatcaggattttatagtcaggaaaaagactgttctgtttgcccacgtctctgaagatctggtgtc

SEQ ID NO: 6771721 - DNA, 78 bp, Homo sapiens
gtgattgcctgaaaaagtctttgacagaaatcttgtttacttgagataactattctgtcaactcttgcagtaattcac

SEQ ID NO: 6771722 - DNA, 77 bp, Homo sapiens
cccactaatccccatcaaattaatacgttgaaatcttaacccccaatgtggtgatattagatggtggggcctttggg

SEQ ID NO: 6771723 - DNA, 70 bp, Homo sapiens
atggcacgtgtgtggccaggactgcagctcacaacctccgtgtgcagaacagggccatgtcacctgccgt

SEQ ID NO: 6771724 - DNA, 55 bp, Homo sapiens
gcagtgcttgctcaggcttcatagccaagacttgcccaggcctgcccagcactgt

SEQ ID NO: 6771725 - DNA, 63 bp, Homo sapiens
ggaactaactattcaagtgctcattcagaacactctgactgaaagcttaaatggaaaggatcc

SEQ ID NO: 6771726 - DNA, 77 bp, Homo sapiens
aagagaatgtaaaaaaggaaaattgcatatagtgcctctttgctgaggatacaaaggtatctttcctagattctctt

SEQ ID NO: 6771727 - DNA, 60 bp, Homo sapiens
aaggtgtcggcagagccgcttccctcgggggctcggggggagcgtgcactccaggccctt

SEQ ID NO: 6771728 - DNA, 61 bp, Homo sapiens
agctgcctcagcaacacagaccaggtaccaagtcctggtacttccaacactgaggcaggct

SEQ ID NO: 6771729 - DNA, 55 bp, Homo sapiens
tccagaggctgggttcacctcagatacttacttgaatcttatccaagcctccgga

SEQ ID NO: 6771730 - DNA, 66 bp, Homo sapiens
tggcagagtcatcacatctggaatgttgtgtgccgggttcctggagccacgtgtggatgcctgcca

SEQ ID NO: 6771731 - DNA, 55 bp, Homo sapiens
caggaagtggggtcatggagtagggatcccttgccagtccagcccacattttctg

SEQ ID NO: 6771732 - DNA, 75 bp, Homo sapiens
gggagaatgacttgccaagggtgacccagtcggtgatgagagatctggagtcagagggggaagtcaccgactccc

SEQ ID NO: 6771733 - DNA, 56 bp, Homo sapiens
tgtgtcttagtttaggattctgacatttaattcttcagaacctaagttaaaacaca

SEQ ID NO: 6771734 - DNA, 64 bp, Homo sapiens
gccaccagctgcatatgcacgtacttgatggttccatctgcgttgcgctcctgcagcaggaagt

SEQ ID NO: 6771735 - DNA, 77 bp, Homo sapiens
gtattatttacctggtgtttatggtccatctgctctcaaactagaatggtttcagtaagcaccaggtacacccttac

SEQ ID NO: 6771736 - DNA, 69 bp, Homo sapiens
gtctttgaatggtgaggctcctaaattttggtttacaaaggagttgggagccttccgttcccttcagac

SEQ ID NO: 6771737 - DNA, 55 bp, Homo sapiens
aggagagcgtcaggtagggaacaatgaacactgtccccacctacacactgctcct

SEQ ID NO: 6771738 - DNA, 68 bp, Homo sapiens
gtggctgggtagacatggggctggtgttgaacacaactgaagagcgccaggctccggtctgtggccac

SEQ ID NO: 6771739 - DNA, 56 bp, Homo sapiens
agctgtgttaggatgttaataagtagaggaacaccaagcagtttcctaactcagct

SEQ ID NO: 6771740 - DNA, 74 bp, Homo sapiens
gcatgtgtgcgcctcggtgtgtagtgaggggcgtagcttcccacagcgcctggcagcgtgccgagctgcgctgc

SEQ ID NO: 6771741 - DNA, 78 bp, Homo sapiens
gttaccttccctagtactgaacttaaaaatcccctgggaaagttaggatggaaatttacatcagtgggggaaggagac

SEQ ID NO: 6771742 - DNA, 68 bp, Homo sapiens
ggaagcggcgcgggtgctgtccagcttcccggtgctgaaaaccggagggctcgtcatccaccactacc

SEQ ID NO: 6771743 - DNA, 113 bp, Homo sapiens
ggcattcctccttgtggagagtctgtctgcgcgctgctggtaccgaaagcagtttttttggtgtgcaccttgcggtgctcaattagactttctttatttggaaataggaagcc

SEQ ID NO: 6771744 - DNA, 56 bp, Homo sapiens
gacactcttaatcctatccctgaaaccaatatggtaaggataaggttggagtgatc

SEQ ID NO: 6771745 - DNA, 62 bp, Homo sapiens
gtccctctcaaatttatatgctggctctcaaatccgcagtgtggctgtatttggagatggac

SEQ ID NO: 6771746 - DNA, 58 bp, Homo sapiens
acctggcaggtggaggttgcagtgagccgagatcacgccactgcaccctagcctgggt

SEQ ID NO: 6771747 - DNA, 78 bp, Homo sapiens
gggtgtagcgtggtatcctaaggtagttttagtttggatttctccagacttctctaacttgaggaccttttcatattc

SEQ ID NO: 6771748 - DNA, 101 bp, Homo sapiens
tggttgaggaaattgaggctcagagaagtcgtgacattcccgaggtcctgcggctaggaagcaccggaatgatgacttcagcctcgacatctcttgtacta

SEQ ID NO: 6771749 - DNA, 92 bp, Homo sapiens
cttttctgagtagccttccctggatgatttcttaagcaccagattgcccgaaacatacgatttaggagaaagagcactacacaccagaaaag

SEQ ID NO: 6771750 - DNA, 78 bp, Homo sapiens
atcttatatgcaaaggccctgaggcaagagagaacttgtccagttctaggagcttaaaggaggccagtgtgttgagat

SEQ ID NO: 6771751 - DNA, 104 bp, Homo sapiens
cctcacaagattttttagtacgaacattttacaaaagttgctttatagttccacaaaggcatataaatgcacttttgaaatatatcagacagatggttaggagg

SEQ ID NO: 6771752 - DNA, 81 bp, Homo sapiens
ctgggggaagggcagcttaaattggtagcttccgcacataacaagctcaagaccagacaaagcctgccgaacagcccccgg

SEQ ID NO: 6771753 - DNA, 66 bp, Homo sapiens
gtgataagctttggtgactgtgattgcattggttggcagcagatggcagtgatcaaaagcttacat

SEQ ID NO: 6771754 - DNA, 68 bp, Homo sapiens
tgcagcaagcacccaatttacagcagtttcaatcctgaaatttttgtacttctgggtcctatgctgca

SEQ ID NO: 6771755 - DNA, 58 bp, Homo sapiens
ctgggcctgtcagggctttttggagacaagcaacagaaaccaaccctggctggcctag

SEQ ID NO: 6771756 - DNA, 79 bp, Homo sapiens
tcctgggcctcattgcttcagtttgttggggataattgctgttgcacgtccctgccaatgattggagcaagaaccagga

SEQ ID NO: 6771757 - DNA, 77 bp, Homo sapiens
tccatcttttagatgttttaactcttggttagaatgatattatattttacctagaggcaaaatgtgtagcagagaga

SEQ ID NO: 6771758 - DNA, 63 bp, Homo sapiens
tttgaggtactcatgatttagggcttgggagaagggtctggactcgggtgggtgacacttaaa

SEQ ID NO: 6771759 - DNA, 58 bp, Homo sapiens
ccttggtccaaccctgcacagcctctaagtggcaaagggcaatgcgggagggccaggg

SEQ ID NO: 6771760 - DNA, 70 bp, Homo sapiens
ggactgtggaggagaaagcctgtcactggaaattactaacttctcatggacaggaactcccttggcatcc

SEQ ID NO: 6771761 - DNA, 55 bp, Homo sapiens
gaaggccattgcgtcctgggattctattttttgacctgatgttcacttggccttc

SEQ ID NO: 6771762 - DNA, 71 bp, Homo sapiens
gggtgattggaattaatatttgtatacagtcatcactgtgtagttataacagagataaattttaaaagcct

SEQ ID NO: 6771763 - DNA, 63 bp, Homo sapiens
gttccaggctaattttgcattgttttacctccagacccagaataagtaattttgccatggaat

SEQ ID NO: 6771764 - DNA, 80 bp, Homo sapiens
gtgcatgtgtgtgcacacatgcgtgtatatgggtgtgtgtgcacacctgcatgtatatgggtgtgtgtgcacacatgcat

SEQ ID NO: 6771765 - DNA, 63 bp, Homo sapiens
atgaatctgctttctgtctccatgaatctgcctattctagatacatcatgtaagcagaatcat

SEQ ID NO: 6771766 - DNA, 57 bp, Homo sapiens
tttggagaacaaatctacaccttagaggaaggcctctgctgtctgacagttcccaga

SEQ ID NO: 6771767 - DNA, 102 bp, Homo sapiens
aaatatgcagggtgatggttggggatttggcagcatggccccatgaacattagtgggagttagtctgctaaatcccagacactgaacagaatcctcatgttt

SEQ ID NO: 6771768 - DNA, 82 bp, Homo sapiens
agttttagggtacatgtgcacaacgtgcaggtttgttacatatgtatacgtgtgccatgttggtgtgctgcacccgttaact

SEQ ID NO: 6771769 - DNA, 55 bp, Homo sapiens
ttggtgctgataatggcaggatttggagcctcagtccccattttgtcagcaagaa

SEQ ID NO: 6771770 - DNA, 62 bp, Homo sapiens
aatctggaatatgctacatttgatcaatgaagattgaagagtgcattagcatattgtaggtt

SEQ ID NO: 6771771 - DNA, 55 bp, Homo sapiens
gaggcacatatatacagagcccagcatttgaactggggttcagagatgttgcctt

SEQ ID NO: 6771772 - DNA, 61 bp, Homo sapiens
gggcaggagatgcatgtccctggaggctgatccagactctcttccatgcatcaccaggccc

SEQ ID NO: 6771773 - DNA, 60 bp, Homo sapiens
tccagccgccggccctgcaggtgcccagcagctctgacaaagcggggcagggccgctggg

SEQ ID NO: 6771774 - DNA, 59 bp, Homo sapiens
gccattttcttcaggccagaaaagctgagacctcagcactttgcaggaaggaaataggt

SEQ ID NO: 6771775 - DNA, 79 bp, Homo sapiens
agcccactgttactctgagaggatcctgcccgggcctggagttcagggagggctcctctaaggacatgacgttggagct

SEQ ID NO: 6771776 - DNA, 67 bp, Homo sapiens
tgacaattctctgaagagctcagactagttttccttgcagataactttgagtcctttaggcttgtca

SEQ ID NO: 6771777 - DNA, 90 bp, Homo sapiens
gggaggcagagacgttggcacagagggacccagcagccccgggctcctgccctggtgctggctgaggtctagctctttgctctgtttccc

SEQ ID NO: 6771778 - DNA, 64 bp, Homo sapiens
tttgtttatagatggccacaatgacagagttgcatagttgtgtcagaaacatctggtaagcaaa

SEQ ID NO: 6771779 - DNA, 59 bp, Homo sapiens
gggaacttcagaaagtcgctgcattcttgatttcatgccgtgactttcagagcttcacc

SEQ ID NO: 6771780 - DNA, 64 bp, Homo sapiens
tattgaatttcagagtaggtaaaacatagtggatatgcattatcctgcatcctggaactcagta

SEQ ID NO: 6771781 - DNA, 59 bp, Homo sapiens
ctgtatctttggtatttaatatggggatgcgtagagagtattagaagccataggtacag

SEQ ID NO: 6771782 - DNA, 58 bp, Homo sapiens
tctgggagttagaatacatgggtcaaaataataagacccgtgtatggttagctctaga

SEQ ID NO: 6771783 - DNA, 85 bp, Homo sapiens
gtgcaatgtgcattattgaaggccctgtggacagctgggatagcccagtgatgcccaagggcctagtcaaaagtggacaaagcac

SEQ ID NO: 6771784 - DNA, 129 bp, Homo sapiens
gtacgtaatatttgatataatggatttctcttaatgggaaggatacgttacaagataaagacagaattcattgcctttggcttattttttcctacagggaaatagcctctaccttatttagtatgtttc

SEQ ID NO: 6771785 - DNA, 58 bp, Homo sapiens
tgtctcctactgcctgtggatctccttgcaggcttgagaccactggggtggtgggaca

SEQ ID NO: 6771786 - DNA, 63 bp, Homo sapiens
ccagggcagtgggagaaggtgccttcgatcatcagggcacaagcctggctctcactggcctgg

SEQ ID NO: 6771787 - DNA, 61 bp, Homo sapiens
tatggagcatctttgtctgcttggttcacatacatatcccaagatcccagagtgctcagta

SEQ ID NO: 6771788 - DNA, 78 bp, Homo sapiens
tcttctaattttcattttgtgaaaatgttcagtgaaacaaatttttaaatggcattttcccagatcgacattagagga

SEQ ID NO: 6771789 - DNA, 68 bp, Homo sapiens
catcatctctctgaatctgttgtctcattcccaaaattggcaaaagatgcctaactcagaagatgctg

SEQ ID NO: 6771790 - DNA, 99 bp, Homo sapiens
gttttgtagcagactagggctggagtcttgaaagtggactagttctgtgaaggagaaagtgtgggcaggtattgctaaccctggtctcagatacagaac

SEQ ID NO: 6771791 - DNA, 71 bp, Homo sapiens
ccactgttttaaatgctcagtagctggctgacccttgctctccatgggtctgcctgctgtgaagtcagtgg

SEQ ID NO: 6771792 - DNA, 76 bp, Homo sapiens
agcacagtgtagactaataatagataactagtaattgaatagtactctttctgttaatgtgtctgagactgttgct

SEQ ID NO: 6771793 - DNA, 82 bp, Homo sapiens
gagatttcattgaagttaattcttcgtcactattgttggtaaattaagagtttttaggaagcagtttctgtaatgaaatttc

SEQ ID NO: 6771794 - DNA, 76 bp, Homo sapiens
ggagtcctgggcgtcctgggagggagggaaggaggagggcaccttccctccaccaagcagggcgccaggtaacttc

SEQ ID NO: 6771795 - DNA, 71 bp, Homo sapiens
cttaactccgcttctgtgagtcagtgtttctgaggtaacaacacagaacaataaccatagggagagttgag

SEQ ID NO: 6771796 - DNA, 70 bp, Homo sapiens
cagattttgtgcttgaacacatcttttagctgttaaaactcagtttttctttgagtttaatgcaaaactg

SEQ ID NO: 6771797 - DNA, 97 bp, Homo sapiens
cacttggaatttatgacttatttcatcagttctcccttagaccctcctttagaaagatggtcaataagacactggtgaagaaatcaggtcccaggtg

SEQ ID NO: 6771798 - DNA, 68 bp, Homo sapiens
cagagtgacctacttagaactcaagttaatagataaaggtaagatgagcttttgtagtagtcactgtg

SEQ ID NO: 6771799 - DNA, 69 bp, Homo sapiens
gttaagatagaattatggaaagcatcttttacatgtgataaaagatggtttctgtaggtttattgaaat

SEQ ID NO: 6771800 - DNA, 76 bp, Homo sapiens
tgttatagtggcgttgtccaaacttgagtggagcaattgacagttccacatctaggtttgtcaacaacaaataaca

SEQ ID NO: 6771801 - DNA, 108 bp, Homo sapiens
ggatgacacggatgcgacagtttggctttgatcctaggattccacctgagcggaaacatccgcgagccagggagtcctggagagcccgagcgcctctaccatgtctcc

SEQ ID NO: 6771802 - DNA, 97 bp, Homo sapiens
gaggcaggagaattgcttgaactcgggaggaggctgcagggagccaagattgtgccactgtacttccagcctgggtgacagagcaagactccgtctc

SEQ ID NO: 6771803 - DNA, 65 bp, Homo sapiens
gagcagtaatccatcatggcctggcgttggcgggtgctgccagctgaagccctggtggaactgtc

SEQ ID NO: 6771804 - DNA, 64 bp, Homo sapiens
agtgttggggcaatcttgggggggattcttctctaatctttcagaaactttgtctgcgaacact

SEQ ID NO: 6771805 - DNA, 88 bp, Homo sapiens
catggcacagggcaggtctgggtcagcctgaaggggtacaggaacatgtctgtctcttctcagctgttttaatctcccctctgccatg

SEQ ID NO: 6771806 - DNA, 60 bp, Homo sapiens
tgaaattattcttaccaaggtgatatccaggatctctgcccttgttcaggaatagtttca

SEQ ID NO: 6771807 - DNA, 69 bp, Homo sapiens
ccgccatcccgcggggttgagccctcgtggtctgagccccagaactagagaaacgccgtgggaggatgg

SEQ ID NO: 6771808 - DNA, 77 bp, Homo sapiens
ggacctctgattctcaaaacataacttcactgctccgctcacacaattgcagtcaaggaattgaggactagaggttt

SEQ ID NO: 6771809 - DNA, 62 bp, Homo sapiens
ggctcaatatttggccagggtgtggtgagcagacaagggtctcacagactggtcagtgaggc

SEQ ID NO: 6771810 - DNA, 87 bp, Homo sapiens
gcttctgataacagtagcttcagttgaggcctgagaatttgcatttttaagtttccaggtgattctgatgctattggtgcagatagc

SEQ ID NO: 6771811 - DNA, 57 bp, Homo sapiens
tgatgtcctcatgtcaagctccagagccccttggaggcatctgcctgtaggacatca

SEQ ID NO: 6771812 - DNA, 68 bp, Homo sapiens
gaggatgcccaaagggttgtggctactttttgtttctgttaagtgctgtaacaacttatttggtcctc

SEQ ID NO: 6771813 - DNA, 59 bp, Homo sapiens
gccttggcacaactcttcagcattttacaaggataagaatgccttggagcagccaaggt

SEQ ID NO: 6771814 - DNA, 60 bp, Homo sapiens
ttgtgcatgatgcatacatggtcgcccagttaaggtgaccacaatcttatattatcacaa

SEQ ID NO: 6771815 - DNA, 61 bp, Homo sapiens
tgtgtgctgacttggagtggacggacccatcaaagtcatgtctgcccttggctcagccata

SEQ ID NO: 6771816 - DNA, 130 bp, Homo sapiens
tatcctgaagtcgctcattcaatccctttgcacatctatctccttgcctttgaaatgaacaaagtaatcgcactcactttatagggtttctgggagtggggaagggggattaaatgagattttaaaaata

SEQ ID NO: 6771817 - DNA, 57 bp, Homo sapiens
tgtatgttgtatgctggcatcatgtataataactttgtgtctgtatgcagtcatata

SEQ ID NO: 6771818 - DNA, 55 bp, Homo sapiens
gggcctgagactgagggtgagggaaaagtgatgttcctccctttttattgggccc

SEQ ID NO: 6771819 - DNA, 77 bp, Homo sapiens
ggttcatccatgtcagcgtatatagcagtacttcattcctttcattgctgaatcatattcgactccatggatattcc

SEQ ID NO: 6771820 - DNA, 99 bp, Homo sapiens
ggccccctcccttcagcatggcctgcagcggccaccctcgcagctcggcttcccccacgctgctggtggttgcataggccagcagctgggagcacagcc

SEQ ID NO: 6771821 - DNA, 98 bp, Homo sapiens
gcgccgagactccaggcttgcgtgctctccagccccacgtggagccaagctccgcccggccgccgctgaagggctcccgagctcgggtgtctcggtgc

SEQ ID NO: 6771822 - DNA, 68 bp, Homo sapiens
gtgccgacactgggtaaccaactattcaggctttggccacagaagcctggttttgcccagtcttgcac

SEQ ID NO: 6771823 - DNA, 84 bp, Homo sapiens
ctgattcactagcctttacttccacttcctagtttctatgtcataaaataactactatagtgggagggccatatggtgaatgag

SEQ ID NO: 6771824 - DNA, 55 bp, Homo sapiens
ggcaggtcaggtccatgaccaacacgttggcagtggggatatggaaggccatgcc

SEQ ID NO: 6771825 - DNA, 64 bp, Homo sapiens
gtggcctggggacctgtgagaccttgcggctgatcatgggtctctcggcgtttcccacgggcac

SEQ ID NO: 6771826 - DNA, 96 bp, Homo sapiens
ccgctccagggcctcctccagctctgctgtgcgccggttggaatccccgccaggacccaggccattggcaagagtctggagtgagggaaggagggg

SEQ ID NO: 6771827 - DNA, 66 bp, Homo sapiens
actcatatggtgtataccctgaaggacgttactattacatgtatgggttaaacatgctatatgagt

SEQ ID NO: 6771828 - DNA, 57 bp, Homo sapiens
tgctggctcaagctgataagagaaaatatgtaagagtgttggcttcttgagctaaca

SEQ ID NO: 6771829 - DNA, 122 bp, Homo sapiens
gtttgtaatcgtattaaagacaacatattcctatacatcatggagtgattgttatatctttcagggatatttgaaagtagcgcatttcactcattcatgtggagtcttcagtaagtataagc

SEQ ID NO: 6771830 - DNA, 73 bp, Homo sapiens
tggtgacttcttaaattggattgctattggacaagattttcagtatttatcccattgatttaaggagacacca

SEQ ID NO: 6771831 - DNA, 120 bp, Homo sapiens
ggttgatcaaagacatgatttattaaaactgataatgttaaagggagtgcgaatgactaaaacaaatctttaagagtaattattttggagttttagtgctttatgtctatgtaccctccc

SEQ ID NO: 6771832 - DNA, 73 bp, Homo sapiens
actccagcagtcactggttgaggttcactggcaaactcactgcctggtgttgccaatctgtgcctcctggagt

SEQ ID NO: 6771833 - DNA, 72 bp, Homo sapiens
tccaacctaagttagttcagcctagttctgactataacaaacttggttcaaagggattcaatttaggttaga

SEQ ID NO: 6771834 - DNA, 90 bp, Homo sapiens
gatctcagaaccttccaaacatggaacttcaagaagaaagcactaagaatcagtgcttttctctctccttcccctttgaagctttgggtc

SEQ ID NO: 6771835 - DNA, 73 bp, Homo sapiens
gaggccagactagagagccaaccgtcagggagccgagcagcctctggcttggctggcatctctgcccagtctc

SEQ ID NO: 6771836 - DNA, 65 bp, Homo sapiens
cagttttggctctggtgcgggctcctgcgctttcagccgcacctgctccatcagggccatgattg

SEQ ID NO: 6771837 - DNA, 77 bp, Homo sapiens
gttggggcagtgctaaggattctgccttctgggagctcatttcctgagcagaattccctcttggtacctggcctggc

SEQ ID NO: 6771838 - DNA, 70 bp, Homo sapiens
tagtgtacagttctgcaagatatttttttaggctgaagagtaacaaggaagcagggtagagctgatacta

SEQ ID NO: 6771839 - DNA, 92 bp, Homo sapiens
gtgagttcctccgtgtgatagcattacatctctaggctaggaattttttattcttaagcgtatgataatgaaattttcatatggaaagtcac

SEQ ID NO: 6771840 - DNA, 73 bp, Homo sapiens
gggaaggatgacaggcagtggtccaggtaaacaaaggtgggagtctgagctacgatgcctgtcaccccttctc

SEQ ID NO: 6771841 - DNA, 64 bp, Homo sapiens
gggtgaaaaagtgactgggcagaatgattgcccccagcgtaatctaatccctactttatttccc

SEQ ID NO: 6771842 - DNA, 69 bp, Homo sapiens
aatcagataaaggaaaagacaggttaactgtgactctgctggtcagttaagactgcttttcataggatt

SEQ ID NO: 6771843 - DNA, 57 bp, Homo sapiens
ccatttgcataggatggacattttaacaatgttattttttccaatctatgcgcatgg

SEQ ID NO: 6771844 - DNA, 64 bp, Homo sapiens
gttttccctctcttttttccagggaacttacattgttccagggcatggggagagagtggggaac

SEQ ID NO: 6771845 - DNA, 56 bp, Homo sapiens
tctaggacaccatccacaagtgtgctataaagcacaacttcaccagggttcctaga

SEQ ID NO: 6771846 - DNA, 56 bp, Homo sapiens
gacatgtctgtgcttctagctgctatgcatttgagctgcatctcatagaacatgtc

SEQ ID NO: 6771847 - DNA, 72 bp, Homo sapiens
ctgcagcaaccatggctacacaccctgaatttcctgggactctctcaagttcacatgtggtcatgctgtcag

SEQ ID NO: 6771848 - DNA, 55 bp, Homo sapiens
cgagcaccacttcactcttcctcatgacaattccatgaggcaggggctggtcttg

SEQ ID NO: 6771849 - DNA, 60 bp, Homo sapiens
gctgtataaatccctagattggctaagaaggcaggactaacagtctgtggatttgtgggt

SEQ ID NO: 6771850 - DNA, 94 bp, Homo sapiens
gtgtatcaattcaatttttcttaatcctttttattctgtgtgccatctagtcttcatacagagagctgtgattgagttaatttgattgatatgc

SEQ ID NO: 6771851 - DNA, 68 bp, Homo sapiens
tatctgtcttgccttgcatattttcttgaaaagaaacaaatagacaaaaatgtaggtcagggcatata

SEQ ID NO: 6771852 - DNA, 86 bp, Homo sapiens
gaacttaagccatccctcagcagacagcaaaataactaatccctattttgactgacgctaagggtttttaactgtggcttctgttc

SEQ ID NO: 6771853 - DNA, 97 bp, Homo sapiens
catagattgtcctcttggagtttatattctaatatgagagagaaacaataaactcttaagtaaatttataatgtgattttgggaggtaagtgctatg

SEQ ID NO: 6771854 - DNA, 62 bp, Homo sapiens
cggagatggtatttgggtggtagtttgctctccatcagtgctaaagcaaatgcccctctctg

SEQ ID NO: 6771855 - DNA, 71 bp, Homo sapiens
cctgaagtgcacggtgacctgcctgtcagtgggactggcatttggtgatgcaccgtttaatcactcccagg

SEQ ID NO: 6771856 - DNA, 97 bp, Homo sapiens
ggtctgttttgctgcccagtgtatttttgggacctgcagctgtgtcttggatggagtagggctcagtaaatactttggagttaaaatgtataagacc

SEQ ID NO: 6771857 - DNA, 55 bp, Homo sapiens
gcgagaaactaagtgccctttgcgggtgactgcgcaggtacctctgatttcttgc

SEQ ID NO: 6771858 - DNA, 57 bp, Homo sapiens
taggagctgcagtctgacatacgaggacaaatggtcactcttcccagactgcacctg

SEQ ID NO: 6771859 - DNA, 63 bp, Homo sapiens
gcagagtctttagaaggtgtttgtggtacaagaagagaggcaataaattctgagaggctctgc

SEQ ID NO: 6771860 - DNA, 88 bp, Homo sapiens
ggagtctggctctgttgcccaggctggagtgcagtggtgtgatctcggctcactgcaagctccacctcccgggttcatgccattctcc

SEQ ID NO: 6771861 - DNA, 95 bp, Homo sapiens
tggtgttgggcaggaagaagaaaggggcaaggcacctccttatgtgagtgctcatgctgaggttgttgtcctattttaatgttcatccaactcca

SEQ ID NO: 6771862 - DNA, 57 bp, Homo sapiens
atcagaatcttctgaacagtggcctaaaaatacactacagatttcctggattctgat

SEQ ID NO: 6771863 - DNA, 105 bp, Homo sapiens
gaagaagaaagaacagtgctgtgtgaagccactgagacgctggggtcactgtcgccacggcatagcctcgctgtttcacaaattcacatattgtgccttcttctc

SEQ ID NO: 6771864 - DNA, 67 bp, Homo sapiens
gcactgctccaggtgtggcttgtatttttgctgtgttagcatcaccttggagctttattagaagtgt

SEQ ID NO: 6771865 - DNA, 80 bp, Homo sapiens
agtttcatgtttatgttcctcagggaggctagcagtaagcactcggaacgtatattctagtaccctgaaaacctggaact

SEQ ID NO: 6771866 - DNA, 89 bp, Homo sapiens
atattccatagaaagtcttgcattgatcttgaaaggtacagttaaacacattttaaaatttatgtatggctttgtgtgtatgtgagtgt

SEQ ID NO: 6771867 - DNA, 74 bp, Homo sapiens
ctgcttcttagcagctaaggactcttgggaaagttactaaacttcccaaagctttgtctgtgaactggaggcag

SEQ ID NO: 6771868 - DNA, 63 bp, Homo sapiens
ggcgttctgagtcacttggctggcttgggaatgtgagctgggccaggtgcaccttagagagcc

SEQ ID NO: 6771869 - DNA, 78 bp, Homo sapiens
ggcggactggggtcgggcactctccagggctgtcaggccctccccagccctgcacctgccgcgccgccccacctcgcc

SEQ ID NO: 6771870 - DNA, 79 bp, Homo sapiens
aataggcagttttggaagggagaagttaagtgaagtaatataattactagctaacattctcaccaatcacatgcctatt

SEQ ID NO: 6771871 - DNA, 58 bp, Homo sapiens
attgtaaagtactgtgtacaattcagtagcttttactgcgctcacaatgctttgcaat

SEQ ID NO: 6771872 - DNA, 62 bp, Homo sapiens
tgtagaagacactctgcagagttatctccctgaggatgaagtcgctggagtgttcatctaca

SEQ ID NO: 6771873 - DNA, 72 bp, Homo sapiens
cattaaggtaaatgggggaatcaaagtaagaaatcaaatctttcaaactgtactttcccctaggcgttaatg

SEQ ID NO: 6771874 - DNA, 68 bp, Homo sapiens
tcaggagctgggttcctttggtgggaaattggcattttttgaagccactgaaggatttcagcaaatga

SEQ ID NO: 6771875 - DNA, 83 bp, Homo sapiens
tgaacctcttgctattggtttcagcgggggagggagctcactggggtttcctctgtcatgacagctgacaagcaaactcatca

SEQ ID NO: 6771876 - DNA, 81 bp, Homo sapiens
cttgtactgtttactctcagctatctgagaataacccttttgagggttgcatttttagaggctcagcgtcttcagttctag

SEQ ID NO: 6771877 - DNA, 109 bp, Homo sapiens
attctgtgtatagaatgccgagcacagtgctcatgtgacatggtgggaggcaagtaacatttactggctgtctatgatactgttgggccctgcatgagatgcacaggat

SEQ ID NO: 6771878 - DNA, 57 bp, Homo sapiens
taagctgaaagtgctttgaggactagtactctatcttatttgtctattttcagcttg

SEQ ID NO: 6771879 - DNA, 58 bp, Homo sapiens
cagggccgtgttacatgtaacaatctttcaagattcagtgctgtaatacgctaaactg

SEQ ID NO: 6771880 - DNA, 78 bp, Homo sapiens
gggatcagactcgaaggggctatcacgggacatgcccaggtacagggcctgcttctcagtgagcttggtcagcttctc

SEQ ID NO: 6771881 - DNA, 59 bp, Homo sapiens
tttcctctctgcaaccttcaaagcatattttgtgtctttgtgaaagtgttgagaggaga

SEQ ID NO: 6771882 - DNA, 119 bp, Homo sapiens
tcaacatcctccttcttttgagtgcccatgtttcccagatcttggccttggctcttctcactcaacacacaactcttcatctgaacacactactccatttaccatctcctggatgttgg

SEQ ID NO: 6771883 - DNA, 65 bp, Homo sapiens
ggctgtttttgtcataagtgaatcaggcagcataccatgttcattcactcagtgagagggcagcc

SEQ ID NO: 6771884 - DNA, 125 bp, Homo sapiens
taaactgttggtcttctgtttagccattattctcagttctgtgcaggagtgagctgaaacaaagttgtatagcccagagagtgagaagctgcatttcatgtctcccaacagtcagaaagggatta

SEQ ID NO: 6771885 - DNA, 65 bp, Homo sapiens
tgggctcagtgggagaaagggcaaatgctgatcagcccttttctaagtcttccatttcctttcca

SEQ ID NO: 6771886 - DNA, 66 bp, Homo sapiens
aagacttgactccacaatttgacttatatttcctttaaataattttgtcctggtggagtaagtctt

SEQ ID NO: 6771887 - DNA, 69 bp, Homo sapiens
accggttggccccttcggctccacctggctcaacagacagccagtggcatgcggcagggaccaatgggt

SEQ ID NO: 6771888 - DNA, 62 bp, Homo sapiens
cacttatagaatatgggctggtttttaatttttgagaattgagtacctccagattcatagtg

SEQ ID NO: 6771889 - DNA, 78 bp, Homo sapiens
acgtcatcatacaaagagccgctgatgtcagccccgtagatcggggagacaaaggtgaggttcttccagtatttgcgt

SEQ ID NO: 6771890 - DNA, 77 bp, Homo sapiens
tgagagaaaatagcacagcagctgaggcttggtttgaggacttctagcttttatattgtatgtgtttaattttttca

SEQ ID NO: 6771891 - DNA, 55 bp, Homo sapiens
ccattttgtcaatatataagtgagaatcatgctcagttattggtgataaagctgg

SEQ ID NO: 6771892 - DNA, 59 bp, Homo sapiens
acatgcataagcctagccatcaatgcaatgtgtgcgtgtgtgtgtgtgtgtgtgtgtgt

SEQ ID NO: 6771893 - DNA, 93 bp, Homo sapiens
caatgttgctaggctattattttgcttaatgttgattttaaaggtaagcattataatttatctttggatttttatcaggcaatggcaattttg

SEQ ID NO: 6771894 - DNA, 71 bp, Homo sapiens
gcctgcaaggcagggaggtttgctgacctggtgtttgtactggtagctcctgaatatccctctgtgcaggc

SEQ ID NO: 6771895 - DNA, 66 bp, Homo sapiens
tgagtctcaggcatctgtgtggcacagatacttttatgtgttgttgaaagagctggctgagcttca

SEQ ID NO: 6771896 - DNA, 57 bp, Homo sapiens
cgtttaaaaccaaagaaagcctctgccctggcaaggtgtatgctctggttctaaatg

SEQ ID NO: 6771897 - DNA, 55 bp, Homo sapiens
ttctaagagtcattaatggccttgacttcaaggaattaataatgcattgttggaa

SEQ ID NO: 6771898 - DNA, 89 bp, Homo sapiens
ttttgaaataaaagtaagtaaagtttctgttcgctttaataattatcaaaattaaaagggtaagcagcaacttacagcttgttacagga

SEQ ID NO: 6771899 - DNA, 64 bp, Homo sapiens
tcagccccttatctctggctgcctatgaaagaaagcttccaaagcagcttggatgagaggctga

SEQ ID NO: 6771900 - DNA, 58 bp, Homo sapiens
ttgaccctggcagcccgggcatcgtcactctccatgtccaggagctcatccacgtcaa

SEQ ID NO: 6771901 - DNA, 56 bp, Homo sapiens
gaggcttttgctgtgttttccagagtaattatttactctgccttagggggagcctc

SEQ ID NO: 6771902 - DNA, 77 bp, Homo sapiens
gacctgaaagagattaaatgacttcctaagtttacccagctaagctccctggctcttattctagttttctttaggtt

SEQ ID NO: 6771903 - DNA, 60 bp, Homo sapiens
tggtggggattccctccctggcctgacctcaatcccgccagctgcagtctattcccaccg

SEQ ID NO: 6771904 - DNA, 70 bp, Homo sapiens
taacactaaccatgttcccaacagcttagggctgtcagcttagggctgtcaggaacatgccttggtttta

SEQ ID NO: 6771905 - DNA, 130 bp, Homo sapiens
taccagagtagtgctacagggtcataggaaattgtgcagtgcgtgggtgttgaaaaagattccttcttttagcaaaaaagctctgcgtaattatcatgtctttgcttgataattagcactactccaacaa

SEQ ID NO: 6771906 - DNA, 56 bp, Homo sapiens
cccagcaggaggaggttgcagtgggccgagatcgtgccactgcactctagcctggg

SEQ ID NO: 6771907 - DNA, 59 bp, Homo sapiens
ctcggtgcctgttaagtgctttgaccctccaatattggtcactggcaagcagtgcagag

SEQ ID NO: 6771908 - DNA, 61 bp, Homo sapiens
gccagagctttggctagatggttgatccctaagggcaacgaatacccccagagttttgagc

SEQ ID NO: 6771909 - DNA, 82 bp, Homo sapiens
tctgcccggctgccccccagggagcagctcagagccaagaacctgggcagggccctgattcctggggcacagactgggtaga

SEQ ID NO: 6771910 - DNA, 106 bp, Homo sapiens
tgggtgtcaggtagagtttggatgaggcaggattaagctatcaccccccctgctgtgtgttaatttattgcctcagacattttcatatctgattcattttcaccca

SEQ ID NO: 6771911 - DNA, 63 bp, Homo sapiens
atggaagaaagagacaatttgatttgggaatccagggatatttgtacactctttttattccgt

SEQ ID NO: 6771912 - DNA, 59 bp, Homo sapiens
ggcatgtgaggcggggctttgggtgaaaatgtccagttgttagctctcccccacatgcc

SEQ ID NO: 6771913 - DNA, 81 bp, Homo sapiens
gtgatttagagattcagaaatgaggagggcctggtgtctggcccatttgggtggtgccctttggtctggagtgtctgtcac

SEQ ID NO: 6771914 - DNA, 88 bp, Homo sapiens
gtgcctctttgatgatggcaagtggtatgctggcagaggtccccagatcacctctgcccaggacacctgccactccccagggggggac

SEQ ID NO: 6771915 - DNA, 66 bp, Homo sapiens
gctcctgggttactatagcctcattgtctgtctctcctacttacagctccagtgcactcaggtagc

SEQ ID NO: 6771916 - DNA, 85 bp, Homo sapiens
cctgtcactagtgggttcctgctcagagcgtcttgtgtgatgtttcatcttgatgctttgacaggttaacaaccttctcatcagg

SEQ ID NO: 6771917 - DNA, 130 bp, Homo sapiens
tggggcatctccccatgcccaccacactcacaaagctccatgggtactcagacatccgcagcagcatgctggggtctggagttgcccatgagagtgcaaggagtcttgtggagtcatggggttcctccca

SEQ ID NO: 6771918 - DNA, 64 bp, Homo sapiens
acttaatgtgatagctgttaaaatgtctttatgtgacttaatgatagatgtcatggtcttgagt

SEQ ID NO: 6771919 - DNA, 62 bp, Homo sapiens
ccatagtgagaagatgcagctgctatggtaatatgaccacaacattgcatatttcattgagg

SEQ ID NO: 6771920 - DNA, 59 bp, Homo sapiens
cttggctcgtacccggggcaggagcaggggaagtctgcgaaagccgggagcgagccggg

SEQ ID NO: 6771921 - DNA, 71 bp, Homo sapiens
atttttatgacaaaccatcctcccacatccaaccctttatctgggtgtaaagaagggattgtggtaaagat

SEQ ID NO: 6771922 - DNA, 68 bp, Homo sapiens
tcttggaaggacctgattttgagcatcttcattaattgtgaactcagggttcaagtcccttctcttga

SEQ ID NO: 6771923 - DNA, 59 bp, Homo sapiens
tccagtatgactgatgtccttccaaaaaggggaaatttggacaagacagcatgcaagga

SEQ ID NO: 6771924 - DNA, 73 bp, Homo sapiens
ccctccaggagaggccctggcactgcctgggagtggggagacatgttcagtagggtcagggctgagaaagggg

SEQ ID NO: 6771925 - DNA, 57 bp, Homo sapiens
ctccttggagcccaggagtagcaaaaggttaattgctagggtgttgggcccaagcag

SEQ ID NO: 6771926 - DNA, 56 bp, Homo sapiens
ttctttttaccaactctctgatatgcaaatgtatgtctggagtaccataaaaagga

SEQ ID NO: 6771927 - DNA, 73 bp, Homo sapiens
tttacatacatgacactgggctacaggtcctactgtgtgtcttccttttgtcacccggtgttatgttcataaa

SEQ ID NO: 6771928 - DNA, 75 bp, Homo sapiens
tgtactgatctagggcagtatgataagtgtccttagaaccctcagttcttttgtcatagagcatggtatagtaca

SEQ ID NO: 6771929 - DNA, 77 bp, Homo sapiens
tctgtctcatggaagtaatataattgttgttgttgttgttgtcagcttgccagtcatatctgttttcaaatggcaga

SEQ ID NO: 6771930 - DNA, 61 bp, Homo sapiens
gccaggaaagccactggcatactgggacaagttggtcaccccaggccccagtcttcctggc

SEQ ID NO: 6771931 - DNA, 67 bp, Homo sapiens
attattttcaaaacatctgctgtgttggttgttttcccaaaaccaatgtgggatttttgaaaataat

SEQ ID NO: 6771932 - DNA, 81 bp, Homo sapiens
gcaggctgaaggtcaggcaggatgcccccactggtgggtggctgaggagggtcttctggttggcagcactgtcggcctagc

SEQ ID NO: 6771933 - DNA, 87 bp, Homo sapiens
aggggcgaggggagccggggtaattaacacgggggaggcacccctccgtctcccacttccacccacacccccatccctccaccccct

SEQ ID NO: 6771934 - DNA, 66 bp, Homo sapiens
cctgttcttgtctcattggctaaagttgtgtcacatgaccattcctgaaccaatggagggaatggg

SEQ ID NO: 6771935 - DNA, 84 bp, Homo sapiens
ctgtgtgccaggctcttcgtacttggccttctacacacgacacagtgctcaggaggatgagctacgaggagctcccttttacag

SEQ ID NO: 6771936 - DNA, 75 bp, Homo sapiens
ctcgtagggctgcgtagagcaggtggggagggcaactccacagccctagtcacctgtgagctgcgtagacaagag

SEQ ID NO: 6771937 - DNA, 70 bp, Homo sapiens
gtctgtttcagaacaccccatttggggtatataaaatgtatgctgccagcaggagtttctgagacaagat

SEQ ID NO: 6771938 - DNA, 56 bp, Homo sapiens
ccgcgatccctgctggaggggccctggctgcggtaggctccctggcaggggtctgg

SEQ ID NO: 6771939 - DNA, 59 bp, Homo sapiens
aaattaggaagttcagtgtcactaacaacatacagacatgatacagagcttcctaattt

SEQ ID NO: 6771940 - DNA, 88 bp, Homo sapiens
gccttgtgggaaggtggggcagggaggaggctgcccgccacctctgcccccagtcacttcctgcttgacctgactcttcacatgtggc

SEQ ID NO: 6771941 - DNA, 81 bp, Homo sapiens
gcatgagcagctggtacagaaggccaccgagtgccttcccgatctggactccgtgacttctatgcccactggcgctcttgc

SEQ ID NO: 6771942 - DNA, 77 bp, Homo sapiens
tatttgtgtttagacaaggatcaggttagtcatccaagaaaaacttgcaaatagtttgactttgtttagaatggata

SEQ ID NO: 6771943 - DNA, 91 bp, Homo sapiens
gtctggccagacctcagttttaagactactcttttcttagctttgcagatatgctctggagatgccagcttacactgggaactggttaggc

SEQ ID NO: 6771944 - DNA, 64 bp, Homo sapiens
gttcccagctgaggttgaagaaagagatgctctgtcttcttgttttagccctcatactgtaaac

SEQ ID NO: 6771945 - DNA, 79 bp, Homo sapiens
tctttcacacacatacatttggaagtttcaagggaacatgaacatctctttgcattttgaacgtgtttgtcgtgaaagg

SEQ ID NO: 6771946 - DNA, 119 bp, Homo sapiens
agtgtgacatgtgcaggtgggaggggcagagggacaagaccagcagggagggtgctcctggggacagtatcctccccgctggccttcacttcttggccttgccctgggcagccacagct

SEQ ID NO: 6771947 - DNA, 58 bp, Homo sapiens
agctcccgggtagaagccactcatgagacacagcagtgtggccttttggcttggagct

SEQ ID NO: 6771948 - DNA, 80 bp, Homo sapiens
atggcaggaggcccaggccctgctttccagagctcatccaggtgggggtgagagatgtggagcagggccccttgtgctgt

SEQ ID NO: 6771949 - DNA, 55 bp, Homo sapiens
cttggcaaggacccacttagagaagtgttacttagagaaggctccttttgccaag

SEQ ID NO: 6771950 - DNA, 68 bp, Homo sapiens
tgggcagccatggggctcagctgcactaacaaactctgtctagtacagaaaacctcagggtctcccca

SEQ ID NO: 6771951 - DNA, 60 bp, Homo sapiens
ttcctaggatggtgaagcaggatacaggaaagacctgagtttggcttcctgtgctgggga

SEQ ID NO: 6771952 - DNA, 55 bp, Homo sapiens
gtcactttgaagctgtttttagcaggataagaacaaacaatgtttccaaagtggc

SEQ ID NO: 6771953 - DNA, 78 bp, Homo sapiens
gatcaatgccagtgctcaacttcggcttgttaccaccaccgggggtggaagggagaaggttgggtgacggcaatggtc

SEQ ID NO: 6771954 - DNA, 63 bp, Homo sapiens
gtctaagtgggtggcactgacaaagttgacattagctggttttgaaggggccatcacaaaggc

SEQ ID NO: 6771955 - DNA, 74 bp, Homo sapiens
tacacctatgacaaacccaggatgtaacactccttctagatgggtttaatggtgttggcttgggttttattgta

SEQ ID NO: 6771956 - DNA, 57 bp, Homo sapiens
aagtgctcagtatcctcatgtggctgccatattggacagcagagatattgaatattt

SEQ ID NO: 6771957 - DNA, 94 bp, Homo sapiens
gcttcaccgcccccgatcccccactgggagtacaaagaatggggctcgtgtgctgaccgtttgcttcttccagttgggtgggtggccttggagc

SEQ ID NO: 6771958 - DNA, 90 bp, Homo sapiens
ggagaaggctgtaggaacgggtgcagccatgggccctgtgccaagttgggctgagcatgagtgcacctgaacacacccacagtctcctct

SEQ ID NO: 6771959 - DNA, 129 bp, Homo sapiens
cttctgctggtatcctgatagaataatgtgagctccatatggccctgggacctgtacagtctttctttctgtgccttcctagctgaagggccttgtgcacattaaaatacaacaggtgcactgctgagg

SEQ ID NO: 6771960 - DNA, 70 bp, Homo sapiens
tcttctataggagcagaaagtcattcacaatgtaaataaacagttggaagaatgtttgccttataacaga

SEQ ID NO: 6771961 - DNA, 60 bp, Homo sapiens
gagtcagatgaagataaaagggttattccatttttgggtctcttcttcttcatcttcttc

SEQ ID NO: 6771962 - DNA, 55 bp, Homo sapiens
ttgaagagcaccagcattttgatcagtgtgatcaacatgcttaactgtgcttcag

SEQ ID NO: 6771963 - DNA, 59 bp, Homo sapiens
tgggccagctaactcatctaaagaaatcattccgtgtgattctagaagtttgctaccca

SEQ ID NO: 6771964 - DNA, 79 bp, Homo sapiens
ccaacagttctggaggctgggaagtcgaagatgaagaaccagcaggttcagtgtctgaaaggctttttctcacagatgg

SEQ ID NO: 6771965 - DNA, 91 bp, Homo sapiens
gcaaacagaatcagactgacctgagttcaagtccttgctctctggtgcaatagctttgtgatcttagccaagtcatttgaacactctctgc

SEQ ID NO: 6771966 - DNA, 124 bp, Homo sapiens
ccaagtagctgggattacaggtgcgtgccaccatgcctggctaatttttgtgtagagacggggtatcgtcatgttggccaggctggtctcaatctcctgactttaagtgatctgccagccttgg

SEQ ID NO: 6771967 - DNA, 127 bp, Homo sapiens
ctggtgtcttacgggcacatctaaaaggtgacagtccagagactgaataacaagcaaataaagctatcagttttactaattattattcagtcttaactgttgtttcaaggtgtgtaagtgatatcag

SEQ ID NO: 6771968 - DNA, 81 bp, Homo sapiens
gttacccagtcttgggtaatgtctttattagcagcatgagaacagactaatacagacaacttgccaaattagacgggcaac

SEQ ID NO: 6771969 - DNA, 113 bp, Homo sapiens
gtcccctagacctggagtattgtctctcagtcaagagtgacaggaatatttatctgtcctattaaagaggatgtttgtcatcattgtgagagagattctagtagctggggtac

SEQ ID NO: 6771970 - DNA, 62 bp, Homo sapiens
ttgagaatagcttaaatgtttcacagtgggggtaatttggatacattttggcatactctcaa

SEQ ID NO: 6771971 - DNA, 66 bp, Homo sapiens
aggaagccaggcccttgggtggtgccatcacgagccttcactggtgctgcaccagcctggctgcct

SEQ ID NO: 6771972 - DNA, 56 bp, Homo sapiens
atgggtggtctgctggaggctgtgagagaattctctctcctgcagaccagacctgt

SEQ ID NO: 6771973 - DNA, 79 bp, Homo sapiens
tttagggtaaataatctgaagaggtggtatgcctgattctccgggtgaccttggcaatctctcagattcttttcctaga

SEQ ID NO: 6771974 - DNA, 92 bp, Homo sapiens
ttggatttttatgtagtgtgaggtagcagcccagctttactttcttctaattggaaagctgttttttcctcaccacttaactaaataaccaa

SEQ ID NO: 6771975 - DNA, 99 bp, Homo sapiens
gaggcaggagaattgcttgaaccctggaggctgaggttgcagtgagccaagattgtgccactgctttccagcctgggtgacacagcaagactctgtctc

SEQ ID NO: 6771976 - DNA, 57 bp, Homo sapiens
tctttgatacagatgtaagctgtatcttatatagatgtagcttacctatatcaaaga

SEQ ID NO: 6771977 - DNA, 67 bp, Homo sapiens
ggtttaaaatttcatttctgtgggcaggttcttaaagtctctgtatatattaatgaaattctaaacc

SEQ ID NO: 6771978 - DNA, 63 bp, Homo sapiens
ttcttttagcaagtactgaagtctgccagccatatgccactgcatcagtaacttttaagagga

SEQ ID NO: 6771979 - DNA, 98 bp, Homo sapiens
aatctttgaaattctagcagaagcagggcaggggcaaatattggcatgtttcactaatttgtcctaaatgtcctgtatctaccggttttgaaaagatt

SEQ ID NO: 6771980 - DNA, 86 bp, Homo sapiens
ggcagaagggctgcactgattacccattgctgctgaactaatgacccaaaaacttagcagctggaactaatagtggtttctctgtt

SEQ ID NO: 6771981 - DNA, 82 bp, Homo sapiens
taggggaatttgtcgttggtgaaaaaatgtagctgaagattttcagttaacaagttggcaatcaactttaagaaagcctcta

SEQ ID NO: 6771982 - DNA, 72 bp, Homo sapiens
tggtgcagtgcctgagggagtaagagtcctgttgttgtaagatagtgtcttactccctcaggcacatctcca

SEQ ID NO: 6771983 - DNA, 65 bp, Homo sapiens
catagcagcatggagaaaccgttcagatactaagtaattgagtgtgtgtttcttcttggtgcatg

SEQ ID NO: 6771984 - DNA, 86 bp, Homo sapiens
ttggtttttaaagtattaccctcagaacttgatgaagattttaattcttgtccctcttcactaactctgtgggtgatgtctaccaa

SEQ ID NO: 6771985 - DNA, 60 bp, Homo sapiens
cttgttaaaatgcagattcagaaccctggggatggggcctgattctgcatttctaacagg

SEQ ID NO: 6771986 - DNA, 64 bp, Homo sapiens
cttgctgcccaggaatacagtccacctcgaatacaggcaagagcactgctcctgggacaggaag

SEQ ID NO: 6771987 - DNA, 56 bp, Homo sapiens
ccacgtgtggcagcttggtctctgatccctccagaggtgcagctgacaccatgtgg

SEQ ID NO: 6771988 - DNA, 130 bp, Homo sapiens
gagcacagatggttgccagtcccctcttcagatacgtggagcctagagtgctgagtctgggctgaagtgcagtacttgtcctcaggtgttattgtgtgaggctgaggggaaaagctagaaaccatgtctc

SEQ ID NO: 6771989 - DNA, 55 bp, Homo sapiens
tgctgtgttcaccaatatgtgtaccttggcttggggccacactggaggaacagta

SEQ ID NO: 6771990 - DNA, 62 bp, Homo sapiens
ggcaagtcactggcaaaagctgcagttttggaagtggctgacagctgttgcagtgaatggtc

SEQ ID NO: 6771991 - DNA, 80 bp, Homo sapiens
agaaaccaaagacattattattggtgagttaaggaaaggtaactttggaagttatcatataattctggcctatggtttct

SEQ ID NO: 6771992 - DNA, 77 bp, Homo sapiens
gcagagggcatgcttggtggcctgttaagacatcaataagtttagaagcattcagcgtcatcgtgcatgtgatctgc

SEQ ID NO: 6771993 - DNA, 60 bp, Homo sapiens
tgggccgggcactgtactgggcattgggagtaaagactgagctaggctgtgtcctgccca

SEQ ID NO: 6771994 - DNA, 73 bp, Homo sapiens
tgtaaagtatctgtgagctctcaggacatttcaacactccctgacttggagttatatctcatggatacttaca

SEQ ID NO: 6771995 - DNA, 79 bp, Homo sapiens
gccctctcagctctccctggatccatcgggtcccgagtgggattgcccactgggctccaaggacctggaggaagagggc

SEQ ID NO: 6771996 - DNA, 71 bp, Homo sapiens
ggtggcacagcccagagctcttgacgtttattttctcaggcttcagtgaaccttctgtggcaggtgtttcc

SEQ ID NO: 6771997 - DNA, 79 bp, Homo sapiens
ggataacttaaccaaattccagttctaggatctagatcccaattctagaagttggggctagggatatggtcttctttct

SEQ ID NO: 6771998 - DNA, 74 bp, Homo sapiens
gcaggttttgaaggaggattgaggcggtggggcccagtgagaaactggggaaactgtccagttctccccactgt

SEQ ID NO: 6771999 - DNA, 83 bp, Homo sapiens
ctgaagtgatagcattaagctagcataggggtaaattaatgagtatattaatttagaattcgctagctaatgtctcatttcag

SEQ ID NO: 6772000 - DNA, 72 bp, Homo sapiens
tccatctagaatcttaattctgcctttcatgtaacataaaatgttcagaaattaggagaataaagatgtgga

SEQ ID NO: 6772001 - DNA, 56 bp, Homo sapiens
cccaggcaggcctacacaatgggagctgctccctgcagcccccgggccggcctggg

SEQ ID NO: 6772002 - DNA, 94 bp, Homo sapiens
tccttttcagcctctttggtctccgtcatcaatcaccgggaatggtttttacctgaaactgatcttgctggagaattaactgggtttgagggga

SEQ ID NO: 6772003 - DNA, 57 bp, Homo sapiens
caggcagaagaagtggaaggacttgacttgctgagtcttccagccttcatctctctg

SEQ ID NO: 6772004 - DNA, 98 bp, Homo sapiens
tgaggcaggagaatcacttgaaccgggaggcggaggttgcagtgagctgagatcatgccactgcactccagcctaggagagagtgagactccatctca

SEQ ID NO: 6772005 - DNA, 77 bp, Homo sapiens
gaatacaaaagtaatggttaaataattctaggtcattcatggaatagaacagcatttggctattaacaatggtattt

SEQ ID NO: 6772006 - DNA, 61 bp, Homo sapiens
ctttatgtgctgggcattaaggcaggggggatttctgttttgatctgtctgtataatgagg

SEQ ID NO: 6772007 - DNA, 108 bp, Homo sapiens
aatatctttctaattaacctgctccatacttcaacaccatatggtcctgttaaaaagcagataacatatacctgggtgggggtagagggcagtttatacatcattgtt

SEQ ID NO: 6772008 - DNA, 72 bp, Homo sapiens
attttgtgagcccaggttgaggctgcagtgaactatgatcatgccactgtgctctagcctgggcaacagaat

SEQ ID NO: 6772009 - DNA, 55 bp, Homo sapiens
gactttctgagtcaaagaaaggatttgggtcctatcctaaaggcaacaggaagtc

SEQ ID NO: 6772010 - DNA, 110 bp, Homo sapiens
gaaataccctatttgtttgcacaatttagctgatttttgcccaagtatttttttggttaatactaaaactgtggagcagtggctagggataggcaaaaaggaggtatttc

SEQ ID NO: 6772011 - DNA, 56 bp, Homo sapiens
gagtgactgtatcattttacattcccagcagcaatgtctgagtgatccagtttctc

SEQ ID NO: 6772012 - DNA, 79 bp, Homo sapiens
ttgaaattccattgtttcttagcagtgctgagaagaatgaggaaagtattcttcctccacgctgggaatggattttcaa

SEQ ID NO: 6772013 - DNA, 77 bp, Homo sapiens
gccggcttgttcaggaacctggctaactttccgggtccgtttcctagggattcgggcggttccctctggacgggggc

SEQ ID NO: 6772014 - DNA, 68 bp, Homo sapiens
gaaggtcagtagggaaggccaacttcatgtgcaaagagcaatatgtgtgtatttcttactagctattc

SEQ ID NO: 6772015 - DNA, 59 bp, Homo sapiens
tgtttcagtccacttaggcagccataataaattaccatggactaggtggcttgtaaaca

SEQ ID NO: 6772016 - DNA, 91 bp, Homo sapiens
agaggatgagaacacagattctggtatcagtcatacctgggtagaaatctcagctctgtcacttactagctgtgtgaattattcaacctct

SEQ ID NO: 6772017 - DNA, 76 bp, Homo sapiens
gggacgggtagccagctctgtggcatggtatctggaggcaggccagcaacctgatgtgcatgccacggcccgtccc

SEQ ID NO: 6772018 - DNA, 94 bp, Homo sapiens
tcttgtttaccttttaaaaattttgtattttgttagtcattttaagaaacacatgcattgagaagcttgcagatttttctaagggaaaataaga

SEQ ID NO: 6772019 - DNA, 57 bp, Homo sapiens
gcttctgggcacaaaatattgatgaatcacatttcagcatcacgtggtccgagaagc

SEQ ID NO: 6772020 - DNA, 67 bp, Homo sapiens
ctgtgatcacagttatgggccttggtcagtcatttgatttcagcacacccaaattgtccatttacag

SEQ ID NO: 6772021 - DNA, 85 bp, Homo sapiens
cttatgaaccaggaggtgaaacttcaccagacaccagattttccagtgccttgatcttggactttccagcctcctgaactatgag

SEQ ID NO: 6772022 - DNA, 84 bp, Homo sapiens
gcttagctggcagtttgctcacgactgcattcaaaggagtatcttacctattgcagagtaaaagcagatgctactgataaaagc

SEQ ID NO: 6772023 - DNA, 92 bp, Homo sapiens
cagtgaggttgaatacactttgtactggcttgtttcagagaggaaactctaacctctttggcattagcctgtatagaactcaccccttactg

SEQ ID NO: 6772024 - DNA, 82 bp, Homo sapiens
acacaaatgtgttcacctctggtcactggttcaggttctgggcagtctgtccctttggctggaggtagaagaacactttggt

SEQ ID NO: 6772025 - DNA, 73 bp, Homo sapiens
catgcctcagtttctccatcagcgaaatgggcgtaaagccagaagattactgggaggattcattgaggtgatg

SEQ ID NO: 6772026 - DNA, 106 bp, Homo sapiens
ccatagacggattgttgagaaggatattatggccccatctaagcttagagcagggtttctcagctaaggctattgatatttcagactagataattatttgttatgg

SEQ ID NO: 6772027 - DNA, 64 bp, Homo sapiens
cagtggaaggtcaggggacagtgaagtggggtcactcccaggtgctgagctctggcagccactg

SEQ ID NO: 6772028 - DNA, 109 bp, Homo sapiens
gctcaaggcaggccccaggccggcagctggacacttggcttttatcctgaggagttcacaccctcagcattcaatgtccagtccgtctgctcaggagattgcaaagggc

SEQ ID NO: 6772029 - DNA, 62 bp, Homo sapiens
gttcaggagctcatgtggctgcctgtggagcctatccatagattgcctaagactccatgaac

SEQ ID NO: 6772030 - DNA, 87 bp, Homo sapiens
ggaacacaaggtgaatagacaaggcccccttgggctctttatgcaagcacaatgtagggagtgagtggccttgtcactgcttgttcc

SEQ ID NO: 6772031 - DNA, 77 bp, Homo sapiens
ataatggcttgattagttaatgtgaggcacctagtccagagctggcacattgtaagcatattagctgatgtaattat

SEQ ID NO: 6772032 - DNA, 100 bp, Homo sapiens
ctaagattcccaattatttgcagttccaagtataattgtgaaatgccatctttcataacttattagattggagctggagtgagccttccaggaattttgg

SEQ ID NO: 6772033 - DNA, 57 bp, Homo sapiens
atgtgtgtatgagtctgtggagacctggagataggaagatacagattatagatacat

SEQ ID NO: 6772034 - DNA, 72 bp, Homo sapiens
gggtgctggccctgccgccacgacgtctctgcagagctgcccgagccgcgggcggttggggcgaggtgcgcc

SEQ ID NO: 6772035 - DNA, 76 bp, Homo sapiens
tgggtatgttgagagcagtggttcattgagcatacttaaatgtttgagacaccaaactttcctaaagacatactta

SEQ ID NO: 6772036 - DNA, 73 bp, Homo sapiens
attcctactttattgtaaatgctgatggctgtcattatttaagttattatgcataggcaataatggtaggaat

SEQ ID NO: 6772037 - DNA, 80 bp, Homo sapiens
tgaaactgctgccttgagtagccagtgagacccagaaatacacttaactatctcttagtctctggcttaggaaagtttca

SEQ ID NO: 6772038 - DNA, 115 bp, Homo sapiens
gcagtgtggggccagagctactgtcctgggcttttggcctgttccccatcttaccatacatgaattgggacacaaaccagaccaggagtcagggtttcttaaggccttaaagagc

SEQ ID NO: 6772039 - DNA, 63 bp, Homo sapiens
gcagcctggccctgctgaactctgtggtatatgggcctgagcggacctcagcagccatgctgt

SEQ ID NO: 6772040 - DNA, 124 bp, Homo sapiens
aattctttagatttcactttgagaactgaggagcaagagcagtgcaggaacatagcttctttaccctctctcaagaagtatgccagcactggctctacagtaaaacagtgatatcttttctgtt

SEQ ID NO: 6772041 - DNA, 62 bp, Homo sapiens
ttgtgtttgtctgtggcaattgtgggtaagttttcttccttttatttgtccaggctttataa

SEQ ID NO: 6772042 - DNA, 89 bp, Homo sapiens
ctctctgggagtcttctgaattacagcaggtgttaggttcagtagcgcctagctttgcctgaagtaatcagcaaacttcaaacagaaag

SEQ ID NO: 6772043 - DNA, 71 bp, Homo sapiens
cagtggcaaggttagcagcaaagggaggtgagctcattacttctctgacagtctgtttcacctagacactg

SEQ ID NO: 6772044 - DNA, 56 bp, Homo sapiens
agccactttcgagatggctcagttacatggctggagctggcaagttgaaggtggct

SEQ ID NO: 6772045 - DNA, 72 bp, Homo sapiens
aacagataagtatatctatgtatacctactatgcataagccttacaggtgctacatagaggtgatatctgtt

SEQ ID NO: 6772046 - DNA, 121 bp, Homo sapiens
gagtaagacatgctgtctgtgtcacaaacatacattatagatataatctttctgaacacatgaatatctgtatatatgtgtatgtgtgtgagatactagtacaaatacagcttgcagtttc

SEQ ID NO: 6772047 - DNA, 56 bp, Homo sapiens
tattgtgcatgttgaataactaattagcaagtttggttgaataaatatgtataata

SEQ ID NO: 6772048 - DNA, 62 bp, Homo sapiens
ccgtgggtcccaggaaggaccagcagacccgggtcactgccactgtccactgagactgacgg

SEQ ID NO: 6772049 - DNA, 94 bp, Homo sapiens
gaggggccgcttttaaatacaagcctactcctgtcgttggaccagaacaaagacctactggccagaagcacatgagaggtgagagtcgcccttc

SEQ ID NO: 6772050 - DNA, 95 bp, Homo sapiens
ttttggttgcgggggttgctactggcatctcgtgggtaggaggcaggcatgctgctgaacatctacagtgcacaggacagcccctacaaggagaa

SEQ ID NO: 6772051 - DNA, 57 bp, Homo sapiens
ggtcttcattctaccagactttgctgtcggaagagagaaatggtagaatgacaggcc

SEQ ID NO: 6772052 - DNA, 81 bp, Homo sapiens
ttatcctccattggttatagtaattgcatggatttactggtatttcagattcacaatgatacataagcgatagagagatga

SEQ ID NO: 6772053 - DNA, 69 bp, Homo sapiens
gggtggtggatgtctccactgtgggcttctcaaagtctgcaggaggtagtggggaggtccaggccaccc

SEQ ID NO: 6772054 - DNA, 71 bp, Homo sapiens
gccctccatggtgatccaggccagtgcttctcaaaccttagcaagagggggttggaatcacctggagaggt

SEQ ID NO: 6772055 - DNA, 93 bp, Homo sapiens
acacagggaggcagtagctgtggtgacagctgtgatctgaaccagggcttggttgagtactcttctcactacaccagactgcacttcctgtgt

SEQ ID NO: 6772056 - DNA, 61 bp, Homo sapiens
ctcatctctagtggttgatgttcctcctctctaaagaaggcacagtgctgctaagattgag

SEQ ID NO: 6772057 - DNA, 73 bp, Homo sapiens
tgtagttcatacctggtgcaagagggtccttggacattgccaagggaaatcctcagcccaggacttgattgca

SEQ ID NO: 6772058 - DNA, 75 bp, Homo sapiens
agatggcacgaggggctgggtagggcaacccccttcataaagtggaggttgacattcagttccttgccaccattt

SEQ ID NO: 6772059 - DNA, 128 bp, Homo sapiens
agcagtactcaaggagttagaaattggatcattaagaatagctactaaactatattctcaaggtaaattttaatgtgatctagtagctgattttaatgagcccattctttgttctttgcttacctgtt

SEQ ID NO: 6772060 - DNA, 62 bp, Homo sapiens
ggttgcagggttgaccaataggcttaataacatcaaggcccctggacagcagctttgcaatc

SEQ ID NO: 6772061 - DNA, 98 bp, Homo sapiens
aattgttttgttatagttattgttttgttgtgttttgttttagaacaatttgtctgacaaagaccttcaacaagattttgaagtgatgtactgcgatt

SEQ ID NO: 6772062 - DNA, 77 bp, Homo sapiens
gtgcctacagttatgaatggagctctttgttaccttccagatcgacaagacagactgtttggttcatgtctgtgcac

SEQ ID NO: 6772063 - DNA, 85 bp, Homo sapiens
tgagttctgtgtgaccagagaagactatcacattttaaagacacctgtttttgaagcacaatgtcttttatcagtatgaaattca

SEQ ID NO: 6772064 - DNA, 64 bp, Homo sapiens
gcctctccagtcaacttaatctctttatttaaagaatagagtgcatagagatatttgactgggc

SEQ ID NO: 6772065 - DNA, 58 bp, Homo sapiens
tgttgaaagactaaatgaatgagctcacatttgagactccctttttattcttccagca

SEQ ID NO: 6772066 - DNA, 96 bp, Homo sapiens
ctggtccctgtctatgagatgtggctgcacccaccgctcctgtacacagcttgttctgagcgtggctggcagcccatgtttcctgagcacttccag

SEQ ID NO: 6772067 - DNA, 109 bp, Homo sapiens
gatcttctctgccacccaccaccgccatgtccagcgtcttcggggtgtcttccactggcacaaacaccctcctgaagggggcgaggggtggcggctgggcaggcaggtc

SEQ ID NO: 6772068 - DNA, 124 bp, Homo sapiens
cctgtcactacgccaggctatttttttttttttcatggagacgaggtcttgctatgttgcccaggctggtctcaaactcctgggctcaagaagtcttccctcctcagcctcccaaagtgttggg

SEQ ID NO: 6772069 - DNA, 83 bp, Homo sapiens
gggaagccctccctgctgtcagggtgagaaacggaggcgattccccgcgtccaggctcccctgcgtgctccacggggcttccc

SEQ ID NO: 6772070 - DNA, 111 bp, Homo sapiens
cccagaagcagccagggcatggctgggcacgcctgggaaggttgagtcccggagtagtcctggactcagcagccaggagtggccccactgccagctctgcactcctcaggg

SEQ ID NO: 6772071 - DNA, 66 bp, Homo sapiens
caggaatagggcgtgagcatatgtggatccctcattcctagagcatatgtggatccctgtgtcctg

SEQ ID NO: 6772072 - DNA, 84 bp, Homo sapiens
tctctacacactcaggctagggaaaaagtgggcacatttcaaaactcaatgcttaaactatagcttgatgtgaaaaagtagaga

SEQ ID NO: 6772073 - DNA, 65 bp, Homo sapiens
tggacaatcagaccgttctggctgtccagtcattattggatggccaaggagcagtccctgatccg

SEQ ID NO: 6772074 - DNA, 65 bp, Homo sapiens
tagcatgtctatagcctgatttgttggcctcttctgcaaggtcaacactggctacagttatgctg

SEQ ID NO: 6772075 - DNA, 85 bp, Homo sapiens
tctttcagtctgatatcagaaaaagtaaagcagtaaagtgaggttctgttttctcttttaagatacagtaagatctgctgagaga

SEQ ID NO: 6772076 - DNA, 76 bp, Homo sapiens
tgttcctttaaaataatggtgactatattgtatctaaaaataaatatcaaaagatcaaagtcccttagtgggagca

SEQ ID NO: 6772077 - DNA, 79 bp, Homo sapiens
gagagctgtggtcaggaagtggcattggagaataaagagaggcacagattctccctcccaaccttgataaacagagttt

SEQ ID NO: 6772078 - DNA, 60 bp, Homo sapiens
gggcccgcgccgcggccgccgcggccgaccccccgcgctgctggcctcggcgctgggcct

SEQ ID NO: 6772079 - DNA, 59 bp, Homo sapiens
ggcatggaacacattaaccacagggaagagcaacttcccaatgctttcgttttccagcc

SEQ ID NO: 6772080 - DNA, 56 bp, Homo sapiens
ttggcaatgtctaaacacatttttggttgtcacaacatgtggagagtggttgctaa

SEQ ID NO: 6772081 - DNA, 56 bp, Homo sapiens
ccaggaactcaaggtttgtaacaagaacagcaacctttttattactttggtcctgg

SEQ ID NO: 6772082 - DNA, 69 bp, Homo sapiens
atttcctaacagaggcaacagtctatataaacactctgaagtgagagattgaactgtctttgaagaaat

SEQ ID NO: 6772083 - DNA, 56 bp, Homo sapiens
atttgtgctttgggtttctgttggagcttcctccacatgagatcacaaagataaat

SEQ ID NO: 6772084 - DNA, 75 bp, Homo sapiens
tctatgttgctgaggatattttactgcagttcaagttgtaataatagctctgtttaagatccgtcagtcacttga

SEQ ID NO: 6772085 - DNA, 55 bp, Homo sapiens
tgcggtgccagttctcatcatcgggcctgtttccttctgagaactaggcattgca

SEQ ID NO: 6772086 - DNA, 72 bp, Homo sapiens
ttccaaggtcccagtaaatataggaacgtggaatgacagcattttggaatatgtatgcagggcaccagggag

SEQ ID NO: 6772087 - DNA, 57 bp, Homo sapiens
atctcagggcagaggtaggtgaggaaagagcttatatgactgccccttctctgagat

SEQ ID NO: 6772088 - DNA, 56 bp, Homo sapiens
ctggttgattacatcatccctgtgataaagcagtcaagcaaatgtgtagtcaccag

SEQ ID NO: 6772089 - DNA, 65 bp, Homo sapiens
tggggatgactctcaggtactccgagactgggggaggccaagtctcagagtacctgagggaccca

SEQ ID NO: 6772090 - DNA, 65 bp, Homo sapiens
cattggagtttggggtcagacttgagcttggataggcttggctctgaaacccaagctctttcttg

SEQ ID NO: 6772091 - DNA, 78 bp, Homo sapiens
tccccgttaatgaactggacgcccccttcctgcggggctaggtggcaagggcagccagtaacgtcattgcccggagga

SEQ ID NO: 6772092 - DNA, 84 bp, Homo sapiens
tgcattattgacgtgcaattcgccagccaaagacaattattaattcttaccctgtcgggttgtatcacacataaacatgatgca

SEQ ID NO: 6772093 - DNA, 61 bp, Homo sapiens
gctgggattacaagcgtgaaccaccgcacccggccccttgttcacagtttctaatcccagc

SEQ ID NO: 6772094 - DNA, 79 bp, Homo sapiens
acctgctgcggggaagcctgggggatgtccaggggcagcggtccctcgggctgaggctcccaggctcctgcaaagaggt

SEQ ID NO: 6772095 - DNA, 89 bp, Homo sapiens
ctgaaggcggccttgggtccagtctgctttacaagttatttctaaaacccaagtgtgaggaagtctgagagccacaggtagatctttag

SEQ ID NO: 6772096 - DNA, 61 bp, Homo sapiens
ccagctgctcttctggcctgtcagcccattcgtggcagtgagaagccattagagcaggtgg

SEQ ID NO: 6772097 - DNA, 58 bp, Homo sapiens
gagcactgtactcatttgcactgtgttgtgagaagtaagtgaaatgaagtgtatgctc

SEQ ID NO: 6772098 - DNA, 57 bp, Homo sapiens
ctctccggcagctgacatttggggccactaaagtcccagctttcccactgccgagag

SEQ ID NO: 6772099 - DNA, 69 bp, Homo sapiens
gggccttcatcagtgagtcaactgctcttgacgccagcaagtcagtctgatgttcgcaggtgaaacccc

SEQ ID NO: 6772100 - DNA, 100 bp, Homo sapiens
ggtccttgttgaaatccactgtaatagacagtgaactcctagcaagtggtattggttctcggtcatctgtgtatcctcagtgggatatcttgaaagggcc

SEQ ID NO: 6772101 - DNA, 64 bp, Homo sapiens
cctgtccagtcaccacgcccaccaaaatttttcatttttctggtcaaggagcagtgactgaagg

SEQ ID NO: 6772102 - DNA, 77 bp, Homo sapiens
ttcacttaatcaggtactaggttatcatttattgccgtgaagtaatcatttagaaaatgataacccttgttaatgag

SEQ ID NO: 6772103 - DNA, 111 bp, Homo sapiens
tcctttctactcctatactgtatttaaatgacgggactgggttttgttgcaaataaatcatttcactgttgaagaaaatcttgactgtttttagaattgggagagattgga

SEQ ID NO: 6772104 - DNA, 59 bp, Homo sapiens
ttggagaggaggtagggacagcctctctgttcatggaaatctcccatcatcctctccag

SEQ ID NO: 6772105 - DNA, 58 bp, Homo sapiens
ggagtgcaaagtgcatggggaagggtgcatgtcctccatggcaggactttgacaatcc

SEQ ID NO: 6772106 - DNA, 67 bp, Homo sapiens
attccaccagctttggcggtgacaggtaagttgatgatgcatagctgtctcctgggctaggtggaat

SEQ ID NO: 6772107 - DNA, 68 bp, Homo sapiens
gaggcgggtggatcacctgaggccggaagttcgagaccagcctgaccaacatggtgaaaccccgtctc

SEQ ID NO: 6772108 - DNA, 83 bp, Homo sapiens
aagcagaagttctgaatgttttctgactgctaacttggtgctctctctaccacagcatgagagatgaacattcctttctgctt

SEQ ID NO: 6772109 - DNA, 88 bp, Homo sapiens
ttttagtgtgttaagttaatagggatccctggagtgatgtggaaagagccaagtcactggaggaactctactaaatttgtaactggaa

SEQ ID NO: 6772110 - DNA, 104 bp, Homo sapiens
cttctactcctcatgaccaaagctggctttcatggtttactcatgtacttactgatgaaaccctgagacttggggccagtgactgttcagaggtccatgtgaag

SEQ ID NO: 6772111 - DNA, 129 bp, Homo sapiens
gggctatgtgggtttattcttctaggtagatgtttacagagggattatctaagggtacaaaaaatcagacagtacttttaggacaaatctttttctttatatctaggaaatagtagacttactgcattc

SEQ ID NO: 6772112 - DNA, 100 bp, Homo sapiens
ctttgaggctatctcttggcacagccactgaatcgggaagcagtcacaaatgcttagaggagtccagattctgtggatgtgccaagagatagtcccaaag

SEQ ID NO: 6772113 - DNA, 63 bp, Homo sapiens
gatggtttacttcatccaatctagataattattttatgtctattctgggaaaggtatgctatc

SEQ ID NO: 6772114 - DNA, 86 bp, Homo sapiens
catagtacagcaaaatgggataatagaagtagaatgcaacttatagatattctccttgtgttattttatatgtgtgtatatatatg

SEQ ID NO: 6772115 - DNA, 59 bp, Homo sapiens
cacatcaagcatccatgagttttgtcctggttctggccttgctctggattgttgatgtg

SEQ ID NO: 6772116 - DNA, 83 bp, Homo sapiens
gtggagacttacaggcttacaggctgcaagtatctaatcatcttccatgctttcatgtttgttgcctttagcatcacttccat

SEQ ID NO: 6772117 - DNA, 90 bp, Homo sapiens
gaagtttcgctcttgttgcccaggttggagtgcaatggtgtgatctcagctcactgcaatccccgcctcaacaggagagcaggaatcttc

SEQ ID NO: 6772118 - DNA, 93 bp, Homo sapiens
gatgagcaaagtaaagcttagtagtaggaaatacccccttgccttaagggagttggatttttctgctgcatagactttagtttatggctcatt

SEQ ID NO: 6772119 - DNA, 59 bp, Homo sapiens
gatgctatctttgacattgttcacttcaaggagtgagataacatggaagagtagctatc

SEQ ID NO: 6772120 - DNA, 88 bp, Homo sapiens
tttttttccagtaagaatgactaccaaactggaggtttaatctagcaacatgaatctcagtcaatgtgtcagctctcctggaagagaa

SEQ ID NO: 6772121 - DNA, 57 bp, Homo sapiens
tgggagaagagaaattactgccctaactccagggagagattacacattgttctcccg

SEQ ID NO: 6772122 - DNA, 57 bp, Homo sapiens
gttgcttttttgataggtggaaattttatatacaatttcatttagaaaaaaagcaat

SEQ ID NO: 6772123 - DNA, 67 bp, Homo sapiens
tgttatgttcttagaagaggcagcagagagttcattcactctctcttctctgtatgaggacatagtg

SEQ ID NO: 6772124 - DNA, 130 bp, Homo sapiens
ctggcctagccatccacactgaccttggtttcaaggtccctcggcccccccgtggagataaatgcaccatgctgtgggcctctgaggacagccttggcttgggttaaaacgctaatgtggctggcaccag

SEQ ID NO: 6772125 - DNA, 61 bp, Homo sapiens
tttcaaattgcaggttttgactcgttcatgtattgtgaaatcgattcagtggagtttgaaa

SEQ ID NO: 6772126 - DNA, 102 bp, Homo sapiens
gaaatcaatggtcataatcccttggagctgctgggccaaacttattcctcaaggtttcctaggctctagagttctaaattatttccttctttttatgatttc

SEQ ID NO: 6772127 - DNA, 68 bp, Homo sapiens
acagaagccacttagagcgtaatattaacactgtacatcaatgtcgtcccgctctaagtggcgcatgt

SEQ ID NO: 6772128 - DNA, 69 bp, Homo sapiens
ggctctctgcactggggtcccagcgcacgtccaagtggcctgctggcggggacccagtgattcgaggcc

SEQ ID NO: 6772129 - DNA, 91 bp, Homo sapiens
ggcaaacctctttagtgctttagaccttttggggttctgttaacataagtctaggccaagaagtaagtctaaacatcacctgaggtctgcc

SEQ ID NO: 6772130 - DNA, 65 bp, Homo sapiens
tcattaatcccggggtccagggacttaaggactgatcccgattcagtgaccccgggatctgtcga

SEQ ID NO: 6772131 - DNA, 73 bp, Homo sapiens
tattctttcggagcttgtgtagtttccacattaatttaccagaaacaagatacacatctctctttgaggagtg

SEQ ID NO: 6772132 - DNA, 75 bp, Homo sapiens
gctgagacctgtaatgagaaattgaaagtgctatcagtcaacctggtgatgtgatttgctcttgagggtctcagc

SEQ ID NO: 6772133 - DNA, 95 bp, Homo sapiens
tgatgattgtgagaatggaatgagatggttcacagagaaggcttgagggcagtgcctggctcacgcatttcaagtgtttgttctcaccgttatta

SEQ ID NO: 6772134 - DNA, 88 bp, Homo sapiens
gttctccaatgctgcactgcaaagtaatatggtcccagtgatgtatcctaataactgaacagcctaattcttttgcagattggagggc

SEQ ID NO: 6772135 - DNA, 79 bp, Homo sapiens
tagttagtacacctgggacccatccaagaccaactgagttgggtttctaggtgtggggccctggcatctgtgctctctg

SEQ ID NO: 6772136 - DNA, 70 bp, Homo sapiens
ccgccgggctcgggcagcgtgggcgagtggcggggggtcccggccccactgctgcgccgggcgccggcgg

SEQ ID NO: 6772137 - DNA, 80 bp, Homo sapiens
tgttgtgtgggttaattagtgttcctaaaatattgaacattattaaatgtagttagaagcactaattactcacattgaca

SEQ ID NO: 6772138 - DNA, 128 bp, Homo sapiens
tgcacaatttatactcggatttttgagacagtttgggaatagtttatcctgttattatcttcaggagtctatagtcctcctacaggaaattgtatcaaaattaaagaagactgagttaatttattgta

SEQ ID NO: 6772139 - DNA, 102 bp, Homo sapiens
ctaaagatatccagattgtactggtaaagaagtgggaggctgtaacagtagatataggaatgcccaattagcttttttgctatactacttggaagtcattag

SEQ ID NO: 6772140 - DNA, 59 bp, Homo sapiens
tcactatccacttttagtgaggactggctggaggccaagccctgtatgtggatgagtgg

SEQ ID NO: 6772141 - DNA, 56 bp, Homo sapiens
ttcaagactccaagaaattagtgccctctaaaatagcagttgagtggagtcatgag

SEQ ID NO: 6772142 - DNA, 80 bp, Homo sapiens
acatgcctccgtggagctggaagggtctgcttgtggggtaacttcttaccatgccaacaggaccttccaatccatcatgt

SEQ ID NO: 6772143 - DNA, 63 bp, Homo sapiens
gttggggatttgaatcccatgtgtgccaccaaatagccatacagctttagcaaattacctaac

SEQ ID NO: 6772144 - DNA, 58 bp, Homo sapiens
ctgaggagggagataggtcaggggccccctcaggtcaccactttctccttctccttgg

SEQ ID NO: 6772145 - DNA, 72 bp, Homo sapiens
ggggcagacagaggagaggtgtgaggctggggtacccctccccactctccacccactcactctgtcctctcc

SEQ ID NO: 6772146 - DNA, 130 bp, Homo sapiens
cgcaggtcctgggatctggtaggggattgacttcacaaattaacgttcaggtgatggaaaccgtgacagacgcggggctgggattgcttgctgtgaggagttgccccaagggatcaaaggacacctgtag

SEQ ID NO: 6772147 - DNA, 69 bp, Homo sapiens
cttgactactgctgtttatagggaggcccttggggcaggtttgtcctctgtgtaggctgcagacttgag

SEQ ID NO: 6772148 - DNA, 100 bp, Homo sapiens
gactggtactctctgtcatagtaagcagaatgacttcctttttaaaggcatcaggactttcttgtgcatttacctggaggtcattttggggattccagtc

SEQ ID NO: 6772149 - DNA, 79 bp, Homo sapiens
gaggaatatgctttttcttacaagtactttatatattgtttgagtgtacattctgtttgaggtaggcaattttttcctc

SEQ ID NO: 6772150 - DNA, 60 bp, Homo sapiens
gcggaggcaggcaggcagcaggtggcgccatgggccgggcttgtttcctggctgttctgc

SEQ ID NO: 6772151 - DNA, 98 bp, Homo sapiens
gctcatccgggccaggcgtggtttagtggtcttagcctggttgggggaaagctcccgagccaccagagctggctctgagcacccgcttgtccgatggc

SEQ ID NO: 6772152 - DNA, 72 bp, Homo sapiens
ttatcttggcaattctaaggtacatttcccctctcagatcattaatgtgccttttgaaaaagttaagcatga

SEQ ID NO: 6772153 - DNA, 81 bp, Homo sapiens
tcttgggctcagcctcattttctgctctgtcctgcactagaagattcacttagcaaatgagggctgatcaagagcccagga

SEQ ID NO: 6772154 - DNA, 56 bp, Homo sapiens
ggcacacaggcagatggagtgtcctttcccacatcacttcatcatactatgtgacc

SEQ ID NO: 6772155 - DNA, 94 bp, Homo sapiens
gattacatagaaatgttaaagtttacagtgcacatgggttgggccaaagaaagtgcttgacacatgtgcgtagactctttattgactgcggatc

SEQ ID NO: 6772156 - DNA, 74 bp, Homo sapiens
gttcagtgaaataatacatagaacatgtttaatgtcatgactgacatacagcatggtctatgaaagtattggat

SEQ ID NO: 6772157 - DNA, 78 bp, Homo sapiens
actttcctggcagtgtgaccctggacagatgcttaacttctctgtgcctgtcaggtttcccatctgcaaaatgagggt

SEQ ID NO: 6772158 - DNA, 79 bp, Homo sapiens
gaaatctgtcttcttctatacactagaatattttaaataacgtgggggtggtctgtttattgaaggtttgatagaattc

SEQ ID NO: 6772159 - DNA, 66 bp, Homo sapiens
cgaatatgatatctctggtagtcatttataatgatttgaaaggcagttagaggtgtttaggatttg

SEQ ID NO: 6772160 - DNA, 123 bp, Homo sapiens
tctgtgtatgtaggagcatgccgtggtccccagtgacaggtggggagacatggagtaaggaccctgctccacgttgcatcaccagtctagctggggtggcacaggccagcatcctgcagcagg

SEQ ID NO: 6772161 - DNA, 57 bp, Homo sapiens
atgtgagatgcacataattatatatttttcctgatgtatgattatgtaattatacgt

SEQ ID NO: 6772162 - DNA, 59 bp, Homo sapiens
agcatacaggtctgaaacagctactgtacaatagacagaaagctccaggcctggatgct

SEQ ID NO: 6772163 - DNA, 64 bp, Homo sapiens
cagtggtgaagagcaggggctctgggcccagaccatctgggtacaaatcctggctctgccactg

SEQ ID NO: 6772164 - DNA, 76 bp, Homo sapiens
cccacaggtttggctctcattttccccattatttcaatgagtaatgacaccaagggcatgaagccagtcctaccgg

SEQ ID NO: 6772165 - DNA, 61 bp, Homo sapiens
gtagtatacagatatgggcggaaatggttattcagtttctgtgtgtgcctgttaatattac

SEQ ID NO: 6772166 - DNA, 76 bp, Homo sapiens
agtggttttgtgagctgggcccagagtcccttgctgcatgcagcctagggacttggtgccctgtgttgcagccact

SEQ ID NO: 6772167 - DNA, 62 bp, Homo sapiens
cttccaagatgaacagcaagcggatttgtaggggtttctgctgtggttctgtaattggcaag

SEQ ID NO: 6772168 - DNA, 57 bp, Homo sapiens
tatcatgtctctttggtctccagcactctgtaagtttagtttcatagaggcatgatg

SEQ ID NO: 6772169 - DNA, 55 bp, Homo sapiens
tggggatgaaaggaacattgggcagataattctttcctggcccactctatcccca

SEQ ID NO: 6772170 - DNA, 103 bp, Homo sapiens
aggtgcacggtggccgagggcgggaatatgttctggaagttcttgaagcctggcttcttgaagcggtgcaggggcgagttgccatagtccttggtcaggccct

SEQ ID NO: 6772171 - DNA, 63 bp, Homo sapiens
tttttagtttgatgttctactccttgctttccaggtgtaggatgttggacatcatgctaagaa

SEQ ID NO: 6772172 - DNA, 74 bp, Homo sapiens
gctccggcctccagccaagcagagagggcccagcaggaaggggccctgagcactgctgctgggggtcacagagt

SEQ ID NO: 6772173 - DNA, 57 bp, Homo sapiens
gacaggtgtgtgtatattagggcaaatgtgtgtaccctaggaaactttgcacctgtc

SEQ ID NO: 6772174 - DNA, 68 bp, Homo sapiens
tgcatctcatcagtgagagtcagcagccttctgtgtctagctgtggggctggctttcctggatgtgca

SEQ ID NO: 6772175 - DNA, 75 bp, Homo sapiens
ttttttcatccatgtgttttctgtcctgtggacttggccttggcactcaggggagagaacagtgttttgaaggag

SEQ ID NO: 6772176 - DNA, 62 bp, Homo sapiens
caggaactcctgctccaagcagcttagcccaaagtcaagctgcagtggcagcagggcacctg

SEQ ID NO: 6772177 - DNA, 58 bp, Homo sapiens
tcttgggcacgatgggaggcttcagttttctctgaggaacagcttcccagtccacaga

SEQ ID NO: 6772178 - DNA, 80 bp, Homo sapiens
gcctcacacagagtcccagatctacaggagggaggggttgctcctgactgggggatcctggaagacttcatggagggggc

SEQ ID NO: 6772179 - DNA, 82 bp, Homo sapiens
taatagaaagaaatgcaaatattaatggtatgactctgtaaaagggagttatattttgttatttgctttaacatttctgttg

SEQ ID NO: 6772180 - DNA, 80 bp, Homo sapiens
tccccctctctaatccttgctacctgggtgagagtgctttctgaatgcagtgcacccaggcaaggattctgcaaggggga

SEQ ID NO: 6772181 - DNA, 78 bp, Homo sapiens
gaagcctctgtgcctgtaagggcaggtttcttcaaggccccttcagaaacagcatgcagtgtacatcctgagagcttc

SEQ ID NO: 6772182 - DNA, 55 bp, Homo sapiens
ggaaatgcataggagtttagaatcctttccgtgaggcagctcctatgctgtttct

SEQ ID NO: 6772183 - DNA, 66 bp, Homo sapiens
tctttgaggatgtagatgtgagcttcacccaggaggagtgggctttgctggatccttcccagaaga

SEQ ID NO: 6772184 - DNA, 62 bp, Homo sapiens
gggcctgttccggctttgtctgcagacttcctttgccaagtagatccagtgccataaggccc

SEQ ID NO: 6772185 - DNA, 62 bp, Homo sapiens
tgcacttcatctgttagaccaattgacaaccaatcaacatttggcactgcagatgaattgca

SEQ ID NO: 6772186 - DNA, 79 bp, Homo sapiens
ggtgcccactgccatcgggggccccactgccagagtctggggcagttgggcagatggcccccggtagttctggtgcacc

SEQ ID NO: 6772187 - DNA, 85 bp, Homo sapiens
tggctcacacctcctggggctgcaaggcctgtccctggctctggcagcgagatgacagggctgttgccccggcagggtgaggcca

SEQ ID NO: 6772188 - DNA, 68 bp, Homo sapiens
gcctggctcacttcccaggcggtggctccagacaagtcacttggggagcaccgttgggaggtgagggc

SEQ ID NO: 6772189 - DNA, 67 bp, Homo sapiens
ccaggccagtgtttggtccaggttcctcagaaatcacacctggttacacgtgaaccactgggcctgg

SEQ ID NO: 6772190 - DNA, 55 bp, Homo sapiens
gccttttttgttgctctgtcacttagagagactttccattcgagcaacagaaggc

SEQ ID NO: 6772191 - DNA, 58 bp, Homo sapiens
agcctgaaaagagaatccaagtcttggactgacactggttcaagttgggtctctggct

SEQ ID NO: 6772192 - DNA, 67 bp, Homo sapiens
ataaatcctcagttttctagtatggcatttcaccactgatgctgaaattagaacattgagggcttgt

SEQ ID NO: 6772193 - DNA, 61 bp, Homo sapiens
gagtaaatcgtcattgcagcatacactgatttatggcaatttttgttggaatgatgaactc

SEQ ID NO: 6772194 - DNA, 79 bp, Homo sapiens
accgaagctagaagaagaaaagtgaacatagattagtttgtttctgctgacaagccagtttgtagttctctctttaggt

SEQ ID NO: 6772195 - DNA, 129 bp, Homo sapiens
gaactcttgactttggtctgctccctgcctcatttttcagtcagtgactaagcagtttttgagttaataagtaactcttaggtgactgattaaaaattctaggaggtgacttagaaaggagtctaaaac

SEQ ID NO: 6772196 - DNA, 63 bp, Homo sapiens
aatattccagcagctccttagtggtccttcataggttccaacatattgaatgctgagaatttt

SEQ ID NO: 6772197 - DNA, 127 bp, Homo sapiens
agattcaaaatagtgatggcagcatattctgaccaagcattgcatggggattggagcacaggcttgggttctagtcatgattgttccatcgctgagtatccttggagaggtgccatcatgtctatct

SEQ ID NO: 6772198 - DNA, 67 bp, Homo sapiens
ctttgttatcgggccctctcgttcttccaggtaaacatccctgagcgagggaggtctgaggacaggg

SEQ ID NO: 6772199 - DNA, 69 bp, Homo sapiens
cgtcataccagatgtgaccacaggtatcagaagacagatgtctttaattcctttattatttgtatgatg

SEQ ID NO: 6772200 - DNA, 65 bp, Homo sapiens
ggaggacactggctctgccttccctgtttatgcggctcctggggacagacagggccagtgtcccc

SEQ ID NO: 6772201 - DNA, 88 bp, Homo sapiens
ggcccggctcggcaggagtcagagcccccagcggcgcgggcgagcccgggccagcagccgagagggggctctgagcggagccgcggcc

SEQ ID NO: 6772202 - DNA, 79 bp, Homo sapiens
tgtcccttataacagtcaactttttcatagctctgcattatctgtactcacctctgaaatggttgcttatttaagggca

SEQ ID NO: 6772203 - DNA, 72 bp, Homo sapiens
ggttaataagtaaaccacagagaagccacaaaggtgcctacatgtggttgttgtgtagtttatcattagacc

SEQ ID NO: 6772204 - DNA, 59 bp, Homo sapiens
actctgtgcttcttactctggagctgcttacttggagctgccccatgagaggcaggtgt

SEQ ID NO: 6772205 - DNA, 64 bp, Homo sapiens
aggagcaaggaagctacagtttactggaagcctcagccccagtctttgtgggttcattgtttct

SEQ ID NO: 6772206 - DNA, 82 bp, Homo sapiens
cacatagtaattctacttttaaactgttgaaggtgacataactttacctttctccttccagtcaagtaagaatatctgtctg

SEQ ID NO: 6772207 - DNA, 59 bp, Homo sapiens
ttagttcactgctatatcatcagtgcccggaagagtacctgatgcatggtagggactaa

SEQ ID NO: 6772208 - DNA, 67 bp, Homo sapiens
cttgttaaaatgtagattctgattcaggcacctgcagtggggtctgagcttctgcatttccaacaag

SEQ ID NO: 6772209 - DNA, 69 bp, Homo sapiens
ggagggctgggggcaggtggccaggaccccagagatgtgggtcctgcctgctgtccttcaagaccctct

SEQ ID NO: 6772210 - DNA, 74 bp, Homo sapiens
gctccactgcattagcctgttcatggccaggcacaaagcctggaaatgcccaaacagagctgaccagtgagggc

SEQ ID NO: 6772211 - DNA, 58 bp, Homo sapiens
ctgtccagtccatctatcctcattgtgtagctgcagtgcaggttaaggaactggccag

SEQ ID NO: 6772212 - DNA, 116 bp, Homo sapiens
cagccaggctgcaggggctggaagaaattggacaccagcaaggctgtgaggagggatgactctcccatagacctgcgtggtgggccctctcggccagccgctcccagctctggttg

SEQ ID NO: 6772213 - DNA, 74 bp, Homo sapiens
cctggcggtgcgaggttctcgccggggatgcggcggcggcagctgcttcctggtttgaagctcgccgagtgggg

SEQ ID NO: 6772214 - DNA, 102 bp, Homo sapiens
gtgcttgatacatggtgtacattgatgtttattgagtgaatgagcatgaagccacaatttttatgacagttctttagagatgtattttgtacccacaggcac

SEQ ID NO: 6772215 - DNA, 73 bp, Homo sapiens
gctcaggactgtggggaagccttgagctcctctgaggagtctgtctttggcttcaccacaccccaagctgagc

SEQ ID NO: 6772216 - DNA, 78 bp, Homo sapiens
cttctaagggaaagtgaggcaacagcagtattttgaaatcatgttagtgtacacttgcagcctcaagattccaagaag

SEQ ID NO: 6772217 - DNA, 64 bp, Homo sapiens
ttgtgcccagaagaaagtgattaatgcatgggaagcaccaaggtcaaatttattttgggtacaa

SEQ ID NO: 6772218 - DNA, 78 bp, Homo sapiens
aggagctgggaattggatcatctaaaactgggggtaaaagaggaaatactctagacagaggtcttccaatcagctcct

SEQ ID NO: 6772219 - DNA, 75 bp, Homo sapiens
cttcttgcaaatgtgaataattacacctgatatctccaggcactgaaattatatgcatttgaatgatttaggatg

SEQ ID NO: 6772220 - DNA, 94 bp, Homo sapiens
ggtataaacaccatctataattgtattcttgtaactgaagatagatgaccaaatttgtcatcagggtgcaagagttattaactggacttgtgct

SEQ ID NO: 6772221 - DNA, 69 bp, Homo sapiens
gtgctggtggtcccgttgtgccgcagtgtgctgagccaccctgagatgccacagcggggccgctagagc

SEQ ID NO: 6772222 - DNA, 61 bp, Homo sapiens
gaggagtggcagctaggctgtcagtcaactgtgttgatttccgtagctgccacaatacctc

SEQ ID NO: 6772223 - DNA, 59 bp, Homo sapiens
ggaggcatttgaatggcataccaggctcatcccctgagcctgggagatcagctgccttc

SEQ ID NO: 6772224 - DNA, 86 bp, Homo sapiens
gtccatgtattatagagtgtcctatctcccacggtactcacccaagtgttttacatgtagtaggatctcaataagtatatgtggac

SEQ ID NO: 6772225 - DNA, 55 bp, Homo sapiens
agacaggaatttcctaatattcgaagacatttgaggctttgggaaattctctgct

SEQ ID NO: 6772226 - DNA, 58 bp, Homo sapiens
ctgggtgcccctcagtgccgagcacaggtatctggcccagagcactgctgggcaacag

SEQ ID NO: 6772227 - DNA, 57 bp, Homo sapiens
tgcagggagtattgctggccatcacatcatgtgaagactggtctctgtctctttgca

SEQ ID NO: 6772228 - DNA, 92 bp, Homo sapiens
gtttccattttggaatcattgtaaataatgctgccatgaacatttgtgtatgtgtttgtgggtggacatatgttttcaatgctcttggatac

SEQ ID NO: 6772229 - DNA, 59 bp, Homo sapiens
agttcttcataaccttactgtgcatgtccttctgagataagggaggtaatgaagcaact

SEQ ID NO: 6772230 - DNA, 64 bp, Homo sapiens
cgtgccccggtgaggagttcagccggcccctaggttcctggaacccaacctcacttggggtatg

SEQ ID NO: 6772231 - DNA, 77 bp, Homo sapiens
cctgaagcagtacctatgtggtttcactgaagagaagcatgaccttgttctttagcagaccatgttggaaattcagg

SEQ ID NO: 6772232 - DNA, 62 bp, Homo sapiens
gtccaatggtaaatccaaataaactgaacatgggaagtgcatttggataagatcatttggat

SEQ ID NO: 6772233 - DNA, 69 bp, Homo sapiens
ctgctgaattacagaaaaaagcacaacaccatcagaagttacaggtgtagcattttatgtaataagtag

SEQ ID NO: 6772234 - DNA, 69 bp, Homo sapiens
cacatgtttttggccatcatggataatatttattttctaaacttctggatggcttttttaaagcttgtg

SEQ ID NO: 6772235 - DNA, 70 bp, Homo sapiens
agctgcatgtcttttgggcagttatggtttttgatcccgtagagtacacgctcaaagggcttgccatgct

SEQ ID NO: 6772236 - DNA, 114 bp, Homo sapiens
cagtacaagctggcacctcttctcaaagcaacattgacaaatggcaatggctttctatttgagcccacatttgttaatgctgcttttaacaagaagtgccagcatgctatactg

SEQ ID NO: 6772237 - DNA, 55 bp, Homo sapiens
ctcaggcatcaaaaagggctggaagttctcacttccttttttatgaagctttgag

SEQ ID NO: 6772238 - DNA, 65 bp, Homo sapiens
gcctctaaaaatacagtaggtaatagttcataaagattttagaaatagttgacactgttggaggc

SEQ ID NO: 6772239 - DNA, 73 bp, Homo sapiens
tgaatttggcttgaggcagatacaaaggtatggatgttgttctaatgtttctcccccaaaagtgccaagttca

SEQ ID NO: 6772240 - DNA, 63 bp, Homo sapiens
atacatcaatttcttagttatcatgaagtattttatttgctggatacaaagagattgatgtat

SEQ ID NO: 6772241 - DNA, 67 bp, Homo sapiens
ggattttgcgcaaagcgatccaaggagtaggtctcttcactgggcactcttctgtgcaaacacatct

SEQ ID NO: 6772242 - DNA, 130 bp, Homo sapiens
acatgttggttaggggcactccctctctccttccttccagtggcactggagactagagcagctccctgaacaggctctggcatcaggctgccttggatttgaatgcagttctaatgcctcctagctgtgt

SEQ ID NO: 6772243 - DNA, 82 bp, Homo sapiens
caggagccagggtgtcctgggagccattttagaggctgcctattgcagtgtgtctcttggcttcctcatctacagggccctg

SEQ ID NO: 6772244 - DNA, 60 bp, Homo sapiens
agtgggcctgagtcttcccaaaactcctgagtcaggaaacacaaaaaggctgggtccatt

SEQ ID NO: 6772245 - DNA, 67 bp, Homo sapiens
tatttgagtaggcttcctttcactaccctcagtccgtgtggcctggggtggggcaagccaccatgtg

SEQ ID NO: 6772246 - DNA, 56 bp, Homo sapiens
ggctgagacttccactgccatctttccctccagaagcgaggcaatgcagtccagcc

SEQ ID NO: 6772247 - DNA, 79 bp, Homo sapiens
gcactagtaaatctaatatgtatgtgttttctttggatttcttataaatgaattcttcacatacttttggttactgggc

SEQ ID NO: 6772248 - DNA, 70 bp, Homo sapiens
agacgctgacatctgaagacgctttctaatattccatgaatatgtgaaattcaaaatgtcagtatagtct

SEQ ID NO: 6772249 - DNA, 69 bp, Homo sapiens
ccttatcatccactggggatcccatgtggccaagatctccagatggtgtttccccaggtggaccagagg

SEQ ID NO: 6772250 - DNA, 59 bp, Homo sapiens
gcaaaggcttagacacagaactgttgttactgatacttctgcaaatgctaagctttggc

SEQ ID NO: 6772251 - DNA, 56 bp, Homo sapiens
tgacagcaacctcatgagaaacttcgaaccagaggtaccatgcttggcctgctgca

SEQ ID NO: 6772252 - DNA, 56 bp, Homo sapiens
atgttacagggagagaaggccaagccctagagggaaggccatcctgcccttgacat

SEQ ID NO: 6772253 - DNA, 80 bp, Homo sapiens
attcagcagcttccttggttgggagtgtggagggtgggtggaccagctcctgtgcacctccagcggcagccacgcagaat

SEQ ID NO: 6772254 - DNA, 64 bp, Homo sapiens
tttgtctagcccatctaaataacctgactacactttgccaggtcttttcaatggcttagagaaa

SEQ ID NO: 6772255 - DNA, 80 bp, Homo sapiens
ttagtctagtagggacatgccattatctcatttccaattattggatctggattaatgagtgagtatgcccatggggctga

SEQ ID NO: 6772256 - DNA, 59 bp, Homo sapiens
cacaaggtcagaatcagactgagtccagatgatactcctctaataaacttgaccttgtg

SEQ ID NO: 6772257 - DNA, 72 bp, Homo sapiens
ctgatttcaaggactacttttcaatcttgtagatgaagattttagaattggagtctgtgtgcttggtttcag

SEQ ID NO: 6772258 - DNA, 61 bp, Homo sapiens
tagccattggcaggggaggcgcttgagcccttgagtgggtgtgctcccttgcgagtcgctg

SEQ ID NO: 6772259 - DNA, 58 bp, Homo sapiens
tgaaagcactgattctcaactcaaatgtgcctgcacatgggaatggccagtattttca

SEQ ID NO: 6772260 - DNA, 81 bp, Homo sapiens
ggaggtgtggggaggagagagccctttctgattaataactagcagggtaatgttgagggctttttctgcccgattgccttt

SEQ ID NO: 6772261 - DNA, 106 bp, Homo sapiens
gccttccagcccctccacagaatccagaattgctgaggtgccagttaattcttcattctgcacctcccctcaccaatctggttttctgggagggctctggcagggc

SEQ ID NO: 6772262 - DNA, 82 bp, Homo sapiens
tcctttactatggcatgtcacctgctgagcacagcactggtctgccctcagatgtttgatattgttattctacagaaaagga

SEQ ID NO: 6772263 - DNA, 114 bp, Homo sapiens
gtatataactcgttttcccatttagttgcaagacacttggaagcacagaccaaggcttacatttgtgttttaatgtttttcttgtaaatgctttatgcctaaatgtttctgtac

SEQ ID NO: 6772264 - DNA, 55 bp, Homo sapiens
ttcctccagacatcccatgtttcattgacaccaataatgattgtctatggaggaa

SEQ ID NO: 6772265 - DNA, 62 bp, Homo sapiens
tctattcctggatttattctgagtgggtatctctcttgttcttaatgagttccatgaaaaga

SEQ ID NO: 6772266 - DNA, 63 bp, Homo sapiens
ttttctcttagtggaataaacggtcatgttcctattgacataacaagatctatttagaggaaa

SEQ ID NO: 6772267 - DNA, 72 bp, Homo sapiens
tatacattattgatgatacattgttaatgacagctaattttgctgtacagttgatttcattagaatcgtgta

SEQ ID NO: 6772268 - DNA, 57 bp, Homo sapiens
cagacagtatttaactagttcattcgcctcaggcctaatggcctagaagtgctgctg

SEQ ID NO: 6772269 - DNA, 106 bp, Homo sapiens
gctctttgtttacttggttctaagccttaaggattcagccctatggaatgggggtccatctgtgctctgcacccccaaacatcaagggctgacctggctcaaaggc

SEQ ID NO: 6772270 - DNA, 80 bp, Homo sapiens
gttactgttaagatttattatagcatgtgtagataaatatatttcagttttcacatctataacttagataacacggtagc

SEQ ID NO: 6772271 - DNA, 58 bp, Homo sapiens
tgtggtctgctccacggggtgagttctgctattgttctgacccttctagcagaacaca

SEQ ID NO: 6772272 - DNA, 97 bp, Homo sapiens
gctttttatgttcctatagcatttgtacaaaatgcagtaggagtggaatcattattctaaattgcataagtacaaatgaaatggaagagcacaaagc

SEQ ID NO: 6772273 - DNA, 76 bp, Homo sapiens
ggggcagtggggaggtaaggaccaatgtacccaagatccttgttttttgtctttcccctcctcattgtggggcccc

SEQ ID NO: 6772274 - DNA, 63 bp, Homo sapiens
ccaacatcagaattagccagtgaggctctgaagcagagctaatgaaatattttctgatattgg

SEQ ID NO: 6772275 - DNA, 60 bp, Homo sapiens
attcatctgttatgaaatttggttgtgttctcagaacagtgagacaaatagcaggtggat

SEQ ID NO: 6772276 - DNA, 105 bp, Homo sapiens
gagtggagtgccgcgacggtgtggccgcagcctggctgtgccttcacgacgcagctgcaatcagaggagctgtgggacgctgtcccacgtggacacagcccactc

SEQ ID NO: 6772277 - DNA, 79 bp, Homo sapiens
tcttgctgagtaccagctgctgctgaagtcaactaattacaacattccacttgatatcacactggatacacatgcaaga

SEQ ID NO: 6772278 - DNA, 58 bp, Homo sapiens
ttgtcctgaggactgttatcagagaaagaaagatctggaaatagtgccttatggggaa

SEQ ID NO: 6772279 - DNA, 60 bp, Homo sapiens
gatttttcttgccaaagtgtgttcacaaagccagtttgcatagtttggagtgggaaagtc

SEQ ID NO: 6772280 - DNA, 67 bp, Homo sapiens
tagaatatgtcagatgtttatctgattttttaatattagcaaatcagattatttgattggcagtcta

SEQ ID NO: 6772281 - DNA, 61 bp, Homo sapiens
aattcagttggcaaacatgctgattgatcatctgtctgcatgccttctgccagattgagtt

SEQ ID NO: 6772282 - DNA, 57 bp, Homo sapiens
catgcatataaggcacatgtatttccataagtgtgagtgtgtgtgtgtgtgtgtgtg

SEQ ID NO: 6772283 - DNA, 111 bp, Homo sapiens
gacatgggaatgtgtggttgaagggagtatctggttcctttgaggagatgggttttgtacaaactcagcttaggattcctggtctcccatccatcacatggcttccttgtc

SEQ ID NO: 6772284 - DNA, 68 bp, Homo sapiens
ctgccctgagatttgtaatttttgtaggaaaactaagattcctgataaagattcagatctttcttcag

SEQ ID NO: 6772285 - DNA, 71 bp, Homo sapiens
agctattggacacaatgttgccttagggcccacaggcagggcctgtgtgtggagcattgtgtcttcatgct

SEQ ID NO: 6772286 - DNA, 92 bp, Homo sapiens
ccattccactgactctgaaggcaggggaatcccaggagtgccctgaatgtgggaaggacctgggagagcttcatgccttcaggtggaggtgg

SEQ ID NO: 6772287 - DNA, 56 bp, Homo sapiens
ttttcagtttgcactgcagtgccaaccagacaggacgctgctcagtaacctgacag

SEQ ID NO: 6772288 - DNA, 90 bp, Homo sapiens
actggagtcacacacagctctggtcctttagagaggtatagaaatgagcacagcttctctagcaaaaccagctagtagtgaggttcctgt

SEQ ID NO: 6772289 - DNA, 81 bp, Homo sapiens
gtatctacaatgttttatgtgccaggtgtttagtggaaaacaaaactacaaaaccctgctcttatggaacttgtagtttat

SEQ ID NO: 6772290 - DNA, 86 bp, Homo sapiens
gcggctcccagccaatctgcatatttctttatttaaatcatgagagtgggaagtggcaagggaatggtgggttggcagggggctgc

SEQ ID NO: 6772291 - DNA, 96 bp, Homo sapiens
gcccattggaccatgtttgaaaccccaggcctcccttttccagccatccttccctgggtggcagagtctgggcttgggcagaaaggttcaaggggc

SEQ ID NO: 6772292 - DNA, 64 bp, Homo sapiens
cattggctcctcacgcaaatcgacccaccccttattggtgctgtctgtatcagaggagtgaatg

SEQ ID NO: 6772293 - DNA, 57 bp, Homo sapiens
aagctgatattgctgcatcgtgttcatctggatgtattagatgtaaaatagtagctt

SEQ ID NO: 6772294 - DNA, 57 bp, Homo sapiens
atgctggtaagttgcaaatgttctggaaatatagtgatatttatctgctatcagcat

SEQ ID NO: 6772295 - DNA, 129 bp, Homo sapiens
ggactaggtagaagacagaggggaaagtcataaaaacaatgctggtctgcagagttgggagccctggattttagctccagccctgcactgattagataattttgagaagtcactttgccatcctgatcc

SEQ ID NO: 6772296 - DNA, 55 bp, Homo sapiens
ggggtatgcttagtaagtaccagggccagggctccttctagctccgctatatctc

SEQ ID NO: 6772297 - DNA, 76 bp, Homo sapiens
gttggagatgtgcctgagggagtaagacactatcttacaacaacaggactcttactccctcaggcactgcaccagc

SEQ ID NO: 6772298 - DNA, 77 bp, Homo sapiens
gtgttataatctccgctgtatttctgtctgccatgatgattgatctttggctaacaaatcagcttggatggcagcac

SEQ ID NO: 6772299 - DNA, 84 bp, Homo sapiens
ttatatagcatttttcaaggaggcaaagcatcagtagaaatgttctctgggatttttttacctgatgttttaatgctgtgatga

SEQ ID NO: 6772300 - DNA, 58 bp, Homo sapiens
ggagtgggtggtaatgtgtgctcccttcatgacctatgcacccaatccactccattcc

SEQ ID NO: 6772301 - DNA, 93 bp, Homo sapiens
aggggtatcctggtctcagctgcctgacttgtccaaggactgtcctagtttgttagtccaggaaaataagctaggtcagctatcatatcccct

SEQ ID NO: 6772302 - DNA, 74 bp, Homo sapiens
tgcattttgtcagccactttcaaaattgtgatgaattgggcaattctgcaagtgactgaccttcattggatgta

SEQ ID NO: 6772303 - DNA, 117 bp, Homo sapiens
tatcatttctagttgtctaaagttatgttgaagaactgaagacttttactgtacaggataaacaactgacattaaatgtcttagttgcctctgctgaatcacacctagataaggata

SEQ ID NO: 6772304 - DNA, 70 bp, Homo sapiens
tattgcatgttctcattcacatgtgggagctaagaaagttgctctcatggaggtagagaatagaatgata

SEQ ID NO: 6772305 - DNA, 91 bp, Homo sapiens
tggagtaaacttggagctaaatgaatcataaatcaataagtacctcagcctgctgcctcatggtttattgattcagaagctgtttatccca

SEQ ID NO: 6772306 - DNA, 56 bp, Homo sapiens
gggaatgtgcaggatcgtgggccccagccagaggcccgggtaatcctcacgttccc

SEQ ID NO: 6772307 - DNA, 92 bp, Homo sapiens
tgcagagttccttttgggtgattgcttttaagcaccacctaagcccatcccagcttagcccttggaaagcaatgcctagagacatttctgca

SEQ ID NO: 6772308 - DNA, 83 bp, Homo sapiens
tttttcactttgaggaaaatgggacaggctgtagatgacatcaatcttcttggtctttcgtctcttttttgatgagtgaagag

SEQ ID NO: 6772309 - DNA, 80 bp, Homo sapiens
gctatttttgttgtgcaccatggtaggagtgaggccatatctcttcttcttctgctgctgctgcacccaatgcccatggc

SEQ ID NO: 6772310 - DNA, 98 bp, Homo sapiens
tctctgctggctgtcaacaggtgattggtgggctgaggggcagcactgtagcgagtccatacagtccacacggtgcagctgaggacaccaggagtaga

SEQ ID NO: 6772311 - DNA, 101 bp, Homo sapiens
gaaaaatcatgggttaatacaataaacatttatgtcagcatatctgtgggtctgaaattcaggagctgcttaaatggttggttttggctcagagatttttc

SEQ ID NO: 6772312 - DNA, 63 bp, Homo sapiens
gactctgaaggaggagttacttttatactttcaaagttcgtgaagtacactactccttgagtc

SEQ ID NO: 6772313 - DNA, 106 bp, Homo sapiens
gatgattagtttgtttgtttgtttgtttattcattttacaattcttctatgttcagttagtgaaaggttgtaagatggataggaacagcaagactcaatgattatt

SEQ ID NO: 6772314 - DNA, 57 bp, Homo sapiens
acagatactcagctctatgctttaggcaaaaaattagtactggcagctgtagtctgt

SEQ ID NO: 6772315 - DNA, 78 bp, Homo sapiens
gaggccttttagggctgcgtggaatacggtcataatcgctaacatttgtacagtgccatgcagtttgcgaagtgcttt

SEQ ID NO: 6772316 - DNA, 67 bp, Homo sapiens
atgtggtccaggatacatcactttttttgggcccacccaagggagagtttgatgtttcctcttacgt

SEQ ID NO: 6772317 - DNA, 58 bp, Homo sapiens
ctctgcactcttctgatgaagcctctcctaataaggaggcatcggcgcagtgatagag

SEQ ID NO: 6772318 - DNA, 63 bp, Homo sapiens
tctggggatgagtgatgtcgtatggtttgcttctctgccagcactgatagattcttccccaga

SEQ ID NO: 6772319 - DNA, 63 bp, Homo sapiens
tgcaggagcccaggaatactatgcgacacttgatactagccctgagtattggcaggtcctgta

SEQ ID NO: 6772320 - DNA, 62 bp, Homo sapiens
aatctacttctgcatataccaggaaaggctgttaaagactctgaaatgggcaaaagtagatt

SEQ ID NO: 6772321 - DNA, 62 bp, Homo sapiens
tcaaaacttacagaggccggatgtcttttttctcatacatctggctttgctggaagttttga

SEQ ID NO: 6772322 - DNA, 79 bp, Homo sapiens
ccttagagaataagcagaacccttctgtaactagcatgcctgggtcttctttactttgggtcctgcttataatttaggg

SEQ ID NO: 6772323 - DNA, 130 bp, Homo sapiens
tatactccttgaaggatatcctaagtcttattcatatctggatctccagcacttatcacaacgcctagcacagagtgagtacctggtaaatgctgagggagattaatgagaccaccaaattcctttgata

SEQ ID NO: 6772324 - DNA, 78 bp, Homo sapiens
gcagaggttcctgcacagagagtcccgggtgcccctaagtggggccctgaatctctctctgtcagtctttccatctgt

SEQ ID NO: 6772325 - DNA, 90 bp, Homo sapiens
cagtggtggacttcattatccagaatgctcgattctcctgtagcaaaatgaatccattgtgatagttattttggaaaatgagtcatcctg

SEQ ID NO: 6772326 - DNA, 57 bp, Homo sapiens
cagtggaacagggagcctggaatgcctggtgaggcagggctttaatttgttttactg

SEQ ID NO: 6772327 - DNA, 56 bp, Homo sapiens
gcaaaaaagtccatagtatgtgttccttaatagaaggcaacacagtacttttttgc

SEQ ID NO: 6772328 - DNA, 63 bp, Homo sapiens
gctggcattctacagggtacgttggggagaaacaatcttcttagtagtcatgtagaaagccgc

SEQ ID NO: 6772329 - DNA, 66 bp, Homo sapiens
tattggtcagaacaagcaaataataggatgttttacattttattttgttgctggttttggttggta

SEQ ID NO: 6772330 - DNA, 77 bp, Homo sapiens
taaggtgtctggcacacagagaagacacttgaaaattttctgtgtctgaataactctgtgtttgctaagatctttta

SEQ ID NO: 6772331 - DNA, 71 bp, Homo sapiens
ccaaaacttaggctatgtgcctcaaggtcaaggcttggcccttggcccaaggttacatggctagtaagtgg

SEQ ID NO: 6772332 - DNA, 92 bp, Homo sapiens
gtaggaaaatgatgctaaagctgagacacttgagagactattcagtgtggtgctgtggacttttttgtgtctcctttatacctgcatcctgc

SEQ ID NO: 6772333 - DNA, 84 bp, Homo sapiens
ggcatgtatttgaaacttagaaattgagctgagacctcaaagctcagttcagttaagagtttcatgtcctggagcgatgctgcc

SEQ ID NO: 6772334 - DNA, 55 bp, Homo sapiens
ccagctagttgggtattataagcaatcactgacttagaagacatggcatggctgg

SEQ ID NO: 6772335 - DNA, 60 bp, Homo sapiens
ggagaaagcttcagaaatggccttctactttgggagccttgaaccttgaagccttcctcc

SEQ ID NO: 6772336 - DNA, 128 bp, Homo sapiens
gtgcaagagtgcgtttgggtgggtgtagtgtatttgtgtgcatgtgtgtgcatgttcatgtttacatggttcgtgtatgtgcctgcattcacatgtacgtctgtgtgcatgtgtacttgcttttgtgt

SEQ ID NO: 6772337 - DNA, 90 bp, Homo sapiens
cacgatacctctctttgctggaactctgaagtccctgggacatttttatgaagtctcagtggtgttttgagtccagcatagttacaagtg

SEQ ID NO: 6772338 - DNA, 74 bp, Homo sapiens
caaatccacatttaggtctctaaaattattctgtctcctgaggatgtttcagggtcagcctgtatgtgtatttg

SEQ ID NO: 6772339 - DNA, 56 bp, Homo sapiens
gagaggagagaataaagcccaagtggcatctttggggcttctggtcattcctcatc

SEQ ID NO: 6772340 - DNA, 76 bp, Homo sapiens
tctgagtgactgaatttatgtttaaaaacagcttggtgctagccttgtcattgaacataattagccttattcatga

SEQ ID NO: 6772341 - DNA, 62 bp, Homo sapiens
catgcaggaggaaaaagcagcttctctgccacttcggaatggctttctttcctacctcactg

SEQ ID NO: 6772342 - DNA, 70 bp, Homo sapiens
tattcattgcctgttacattccattctatgttttacttgacgaaaacttctggagtctgacagatgggta

SEQ ID NO: 6772343 - DNA, 58 bp, Homo sapiens
tgcttgaacaacatggccttttcctacctcttgggattctgccttgttgcttcaatca

SEQ ID NO: 6772344 - DNA, 80 bp, Homo sapiens
gagaaactctctctttggacaacatgatgtgtggatgtgaggttcacagtatcagtcattttgctaaatgagggtaactt

SEQ ID NO: 6772345 - DNA, 66 bp, Homo sapiens
gggaggcgggggctgagtcagtgggaagaggggaaggttttctgggtgactcacgctcccccaccc

SEQ ID NO: 6772346 - DNA, 101 bp, Homo sapiens
gattagtatggtaaaagtatatatgcactttagaatgaggatttaattctaatactacttcacttcttcctggtagcatattacttacctatgcctcagtc

SEQ ID NO: 6772347 - DNA, 65 bp, Homo sapiens
atgatggtaaattcagtatccgtgggctgtgcccaccaaataacagggactaggtttgccttcat

SEQ ID NO: 6772348 - DNA, 113 bp, Homo sapiens
tagggggatagtgtccaggcagtggggatgtagtgggataagccatgggaaggctcattgtggttcctggtaacaatctcaaagtatgcctcagcttcctataatccacctta

SEQ ID NO: 6772349 - DNA, 68 bp, Homo sapiens
gaagactctcaggtctttaggtcagttcattgcgatgagaatcaagctagcctgaagcctgtgtcttt

SEQ ID NO: 6772350 - DNA, 62 bp, Homo sapiens
gcagctcttctggttctgactctgtgggtgcctttcacctgctggtcctcagcagagcatgc

SEQ ID NO: 6772351 - DNA, 64 bp, Homo sapiens
tttgatcaggtggactgtgttggagttgaccttctggcactccacccagcagtccaggatcaga

SEQ ID NO: 6772352 - DNA, 71 bp, Homo sapiens
ctccctgaggacaggccctgtccccactctgccatattgcaggtgtcaaacactgggcctgactttgggag

SEQ ID NO: 6772353 - DNA, 129 bp, Homo sapiens
ggggcaggttcttcagagaaagtggggatcatggtgctaacagagctgccgggagaactgggacccactcagacctgtgcctgcctgtgagttctgatggtctgatactttcacatacattatttcttt

SEQ ID NO: 6772354 - DNA, 67 bp, Homo sapiens
tagaaataagatgtgcttgagtttggagtcttacaatttcacaaaatatcaagcacttttagaacta

SEQ ID NO: 6772355 - DNA, 85 bp, Homo sapiens
ctgagggaagttagtacctggtatacttagaaatcccagaattatggagagaaggaagctatcagctactatcagcttgcctcag

SEQ ID NO: 6772356 - DNA, 73 bp, Homo sapiens
gcccagagagtgccagaatttgcttccaatgtttacctaccaaggacaaagccagattctggagcacctgggt

SEQ ID NO: 6772357 - DNA, 69 bp, Homo sapiens
aattcacctaattgaagtcaggagtaaatgcactattagctcctgataactttaggtttgggttgaatt

SEQ ID NO: 6772358 - DNA, 94 bp, Homo sapiens
cccacgctgccccctttgttccctgtcgacagcacccactcctgtcctggtcctgacatggtggagctgtggacaggaaggactgtagcctggg

SEQ ID NO: 6772359 - DNA, 74 bp, Homo sapiens
actaagacatggcttctaggaagcttttgaacctcaaccagagaatttagccaagaaaagtcaggtgttttagt

SEQ ID NO: 6772360 - DNA, 63 bp, Homo sapiens
tcctattctttgtcctgttgagagctggcaccagcagcagtggcaatgggacagagcacagga

SEQ ID NO: 6772361 - DNA, 79 bp, Homo sapiens
ggccagcccttgccccaggagggccaatgggaagttccagatggaaagtcacttacagctcttttgtctgagggtggcc

SEQ ID NO: 6772362 - DNA, 57 bp, Homo sapiens
cagcctctgagccttggcagatgctattactccccatagcacaggctcagggagctg

SEQ ID NO: 6772363 - DNA, 58 bp, Homo sapiens
cctgccagcgcttatctctcggcatggtctgatgggccgaatgggagtgggagtcagg

SEQ ID NO: 6772364 - DNA, 61 bp, Homo sapiens
gaccctggaggcttggaactgcactgacagacatctgtgcagcccttccttcctctgggtc

SEQ ID NO: 6772365 - DNA, 68 bp, Homo sapiens
caaagaggggctgcctgccagctcagtggccctgccatctcccctgggctgctcagccccctcgcatg

SEQ ID NO: 6772366 - DNA, 61 bp, Homo sapiens
gctctgcccagtgccctgagacctactgcaggagcatcagaaaggccacatggtgcagagc

SEQ ID NO: 6772367 - DNA, 73 bp, Homo sapiens
gattggttatagctaggcatttgccttatttggatatggttcaatagaaagtccctagttaatataacgaatt

SEQ ID NO: 6772368 - DNA, 91 bp, Homo sapiens
ttcatttattctctcactcatttgttaaatatttattgagtgccttcattgttgtaggcattttgttaagcattgaggatgcaaaaatgaa

SEQ ID NO: 6772369 - DNA, 55 bp, Homo sapiens
gctgctattagtcttctattcaaactataatggatttgaggctacacatggctgc

SEQ ID NO: 6772370 - DNA, 60 bp, Homo sapiens
gaatgtgggctgtgaagaggagggcctctgctctgcccctcttagtagcctgttatgttc

SEQ ID NO: 6772371 - DNA, 77 bp, Homo sapiens
gctgctctgaggccagagctgacctatcaatgaagactagagaggatcgcattggtgggggcttggagaggggcagc

SEQ ID NO: 6772372 - DNA, 65 bp, Homo sapiens
tgagggtctcacgagggccctgggcagctgccgtaggcattgcttacagggtttcgtttctctca

SEQ ID NO: 6772373 - DNA, 78 bp, Homo sapiens
gactccagtacagtgcatggcactgagcaggtatgcaaccatttttgttgcatgagcgaatgtgtcctgtacagagtt

SEQ ID NO: 6772374 - DNA, 56 bp, Homo sapiens
tggttcagagagttgctgaccacctcctcttacctgtggttaagatcttaggacta

SEQ ID NO: 6772375 - DNA, 56 bp, Homo sapiens
ccattagtggacttctggaaggattaaggtggtaccttgcagattctattagttgg

SEQ ID NO: 6772376 - DNA, 79 bp, Homo sapiens
ttttgttccatatatgcatacatgtacataaatgtagcacatgtatgtgctgggtttccatgtagctgtgtggacaaaa

SEQ ID NO: 6772377 - DNA, 65 bp, Homo sapiens
tcttgctgacttcagtggctggcatcaaagtaaaaattacaccagacaaagtgaagcaggcagga

SEQ ID NO: 6772378 - DNA, 73 bp, Homo sapiens
ggagactagaggtgtgcatgatttagcactttagtacactttagtgtacatgtacacattagtatacatttcc

SEQ ID NO: 6772379 - DNA, 115 bp, Homo sapiens
ttagccaggtatggtggtgcaggcctataatctcagctacttgggaggctgaggcacaagaatcgcttgagctgcagtgagctgagatggtgccactgcactccagcctgggtga

SEQ ID NO: 6772380 - DNA, 65 bp, Homo sapiens
cagtttcctatttaaggtgttgttctttttaatggacatcacattatgtagtgaaaagggaactg

SEQ ID NO: 6772381 - DNA, 87 bp, Homo sapiens
ttgaagaacactgtcatttaggtcctacaaattgcagctgactgctgtgtgttaatttggaggtatttagctgtctctgtctttcaa

SEQ ID NO: 6772382 - DNA, 57 bp, Homo sapiens
tcctcagggaagatgagcctcactgaggaaggtgacatttggctaagtcctgaagga

SEQ ID NO: 6772383 - DNA, 79 bp, Homo sapiens
cagagatgatttcagaagcaagaggaggtggccaggagcaccagccaaaccaccagcttcctttgggagctcatctctg

SEQ ID NO: 6772384 - DNA, 56 bp, Homo sapiens
gtctcaccttaaccagtgtttttaccttgtatctaaatgtcattgaatggtgagac

SEQ ID NO: 6772385 - DNA, 97 bp, Homo sapiens
agcaaggtatttagaacaaaggaggtgataggccctctttttcgtgctgagctaaccacatgtggagtattgtagcttccagttcaagtgcctagct

SEQ ID NO: 6772386 - DNA, 129 bp, Homo sapiens
tatcttttttttgagcagtgagattaacattttacagtttaccaagaatattgtatatttatttatttaatatcttggcaaggtgttggtgattttacacaagaggatacagaagttcagaatcagtta

SEQ ID NO: 6772387 - DNA, 79 bp, Homo sapiens
gacatttattatctcacaggtcgagctgtctggaaacaggaagttctaggcttggttaattctgtgtgatgaagttgtc

SEQ ID NO: 6772388 - DNA, 74 bp, Homo sapiens
accagagactcacagctggagtgaggatggagtctcttgcttcagacagattctttttcctcctctgtgctggt

SEQ ID NO: 6772389 - DNA, 63 bp, Homo sapiens
gctactgctcaatttgagatgctacagggacaattgtcaatagtttcacaaattgtcaatagc

SEQ ID NO: 6772390 - DNA, 58 bp, Homo sapiens
ttttgtatcctccctttcactgaacattcagccttagtgtcaggagggaaatgcaagg

SEQ ID NO: 6772391 - DNA, 72 bp, Homo sapiens
tgatacagcttgtgaaatgtcaccactagggttcaaacccaagtgctgtccagtttcacaggtgatctatta

SEQ ID NO: 6772392 - DNA, 64 bp, Homo sapiens
ccatgctctgtccagtgcaccatcattcattaactctgggatgatggtgcattgatagggatgg

SEQ ID NO: 6772393 - DNA, 75 bp, Homo sapiens
aaggctgtgcttgccagcacttggccagctgtgccccaaagtgcagctcagccactgtttggccctagcagcctt

SEQ ID NO: 6772394 - DNA, 102 bp, Homo sapiens
gccccgaggccccagcccatccaggctgcagcagagtgtgcacccgccgactgcggggcgtgctgctgctgaggatgcaggtgggcaggtgggcttggcggc

SEQ ID NO: 6772395 - DNA, 60 bp, Homo sapiens
cttctattgaatttgttggtcaaataagtcactaaggccagctcagtttcaaagtagggg

SEQ ID NO: 6772396 - DNA, 76 bp, Homo sapiens
ggacttgcctctgtttcacttgcctagcccagttcaggagatgttcctgttttttatgtaagtggcagatcagtct

SEQ ID NO: 6772397 - DNA, 67 bp, Homo sapiens
aactgtctttctccctgggttagcctaaaagttccttttctgttcatttccaggagcaaagccagtt

SEQ ID NO: 6772398 - DNA, 67 bp, Homo sapiens
ctgtggtgcccagtgttgcatttttacatctctgtttagcatgttggaagtgtcttgggtattccag

SEQ ID NO: 6772399 - DNA, 59 bp, Homo sapiens
ggtggcttttatgttactgttagtatcacactgtgtacagaggggacatggaagacact

SEQ ID NO: 6772400 - DNA, 81 bp, Homo sapiens
taggattgggttgccaagaaggtggggacatgcagacaccaaaatgtgctgcgtctctctctgtctctctgtatcctccta

SEQ ID NO: 6772401 - DNA, 100 bp, Homo sapiens
gaatcacagggccagaataatttttagttttatttacttggtctagattttgtcatcacaaatctgagaatggagctaaaaatcacagcctgtaggattc

SEQ ID NO: 6772402 - DNA, 60 bp, Homo sapiens
ggggacctttccatttctgagattctgtatattattttcaactgctctgggaaggtcccc

SEQ ID NO: 6772403 - DNA, 103 bp, Homo sapiens
tctgtcttgatgggggaggtagagagcctggtgatcacttcagtggatatgtcttgtgacattgtggactgatcagggctaggtcctctgctagaggacatga

SEQ ID NO: 6772404 - DNA, 65 bp, Homo sapiens
ggaggagctctccctgggggtctgcagattccaactcctagatctgcagaattctgggagccccc

SEQ ID NO: 6772405 - DNA, 79 bp, Homo sapiens
gctaaatcttactctcaggcctgattcctaaagcaaagtgggtgacagggagatgaggctatgaatggggagatttggc

SEQ ID NO: 6772406 - DNA, 63 bp, Homo sapiens
gaatctatgcctcatatagaccagagatggagacgttctaccctaatgtaagtgtatggattc

SEQ ID NO: 6772407 - DNA, 57 bp, Homo sapiens
ggctgtattgtgtcacctatggatctgcccagagcccagtgcataatcaatacagcc

SEQ ID NO: 6772408 - DNA, 95 bp, Homo sapiens
tggtccaggcctggttacaaagtgacaagctctgctgacagagtttgaactggttagcagaaccagcagtcaatttgctaccatgcccacagcca

SEQ ID NO: 6772409 - DNA, 60 bp, Homo sapiens
attgagttgcattttccataattcagcaaagatttgaagacatggaaaattgtactcaat

SEQ ID NO: 6772410 - DNA, 79 bp, Homo sapiens
ggtttgctcattgacatcacagattgtgaataactatgagaaaagggctcatagtattcacctgtggcttaagtagact

SEQ ID NO: 6772411 - DNA, 65 bp, Homo sapiens
gttggctgagggcaatgacatggcccagttttccttactatttacttctttggccttcagccaac

SEQ ID NO: 6772412 - DNA, 95 bp, Homo sapiens
ggagaagagagccaagagaaggggtaaagagtcctggggttgagcccccagaattgtcttatgacccctgattagtcacttcggctctctgagcc

SEQ ID NO: 6772413 - DNA, 82 bp, Homo sapiens
tcacattgatgttcatcagggatattggcctgaagttttctttcttttcttgggtctgttcctggttttggtatcaggatga

SEQ ID NO: 6772414 - DNA, 56 bp, Homo sapiens
tattgatgagatgatgccttggcagcccatgtatgtgccaggcactgttctcaata

SEQ ID NO: 6772415 - DNA, 65 bp, Homo sapiens
gtcacttgagcatttcttcttttttgtagacaactaatccaaggtgagcagtgttgttgggtggc

SEQ ID NO: 6772416 - DNA, 95 bp, Homo sapiens
tcataagctttggaagccctggctcctgtgcaggtctcggttgctgttccagccactggctgtcagcaggactcagaggctcccatggctagtga

SEQ ID NO: 6772417 - DNA, 90 bp, Homo sapiens
tggagttctttagtgtgtcaatttatgtcattcataaattatgcaagcccattacatgggtgagtatgagttgacttctaattcattcta

SEQ ID NO: 6772418 - DNA, 114 bp, Homo sapiens
ctgacttgcagaaaggtatggacatgaggcaatagaatattgaattcctaagaacaagagaggagggaagtcagtgaaggcattgctcaatctatacaatcaaaagaaagttag

SEQ ID NO: 6772419 - DNA, 89 bp, Homo sapiens
caggacagagtgggcccctggcacatgctccctgagtggtaacaatggttctccaccatctctcgtgtctcaaggggccccgctgcctg

SEQ ID NO: 6772420 - DNA, 84 bp, Homo sapiens
ggtaagatcccaggatttagatttggaggaactaacaccttttagtccttgagcctctaagtagtgtggaatctaccttttacc

SEQ ID NO: 6772421 - DNA, 70 bp, Homo sapiens
catgtgatccgttccaccagtctttattcggtatagtttctgaatagatgctgttcaatggagttatatg

SEQ ID NO: 6772422 - DNA, 58 bp, Homo sapiens
gaggcccctctctctgtgcttgggccactggcttttaaataggaaagggaggggcttt

SEQ ID NO: 6772423 - DNA, 77 bp, Homo sapiens
acccagctatcattcatctcttcattagttcctgtcccatgcttgtggcacagggtcatgcagagcaggtgctgggt

SEQ ID NO: 6772424 - DNA, 76 bp, Homo sapiens
ttcggctgactttttctctttttcctattgctggtcttccaggacttcaaagcgtgataaagataaggcagatgag

SEQ ID NO: 6772425 - DNA, 67 bp, Homo sapiens
tcctgctgaagctaggttcatgaggtcggaaatccccaccacatttgcctagactttgggcacagga

SEQ ID NO: 6772426 - DNA, 66 bp, Homo sapiens
gttaagcctaatggggccatttagttcattttcaagaatgcttaaaaggctgcgttagaaaataac

SEQ ID NO: 6772427 - DNA, 129 bp, Homo sapiens
gcaatataagtgaagcacctttttcactgagtgactctttgtaaatgttttatattttgcagcagtttgactttactgagggtaatataaaacatttaatggaagcatttgggaagcttaagtatgtgt

SEQ ID NO: 6772428 - DNA, 77 bp, Homo sapiens
tctatgaatggggatttgtttcttcatttagaagcttctaactgatgcttttccaggagaaatatatgccatgtaga

SEQ ID NO: 6772429 - DNA, 57 bp, Homo sapiens
gcccccaggtgacttatccacacactttaaagtgtgagatgcgcagccctggagggc

SEQ ID NO: 6772430 - DNA, 68 bp, Homo sapiens
aagaagtctgatttttagaggtggcctgctataaaataaacacaatgcttctggcaaacagagttctt

SEQ ID NO: 6772431 - DNA, 67 bp, Homo sapiens
tttctagcatgacacagtcctcatactcaaaaaactgggggctattgctattgttacttgctagaaa

SEQ ID NO: 6772432 - DNA, 64 bp, Homo sapiens
tgtaatcccagctactcgggaggccgaggcaggagactcgcttgaacccgaggcggaggttgca

SEQ ID NO: 6772433 - DNA, 94 bp, Homo sapiens
tgaagtatacatcagtgagatgttttgggattttcacactgctgatatcaatttttgtggaagtgccaatgacaaatttttggtgtgttcttca

SEQ ID NO: 6772434 - DNA, 59 bp, Homo sapiens
ctggaagctgtctgacacaggcccagtccctcaactggactttatcaaagggctactag

SEQ ID NO: 6772435 - DNA, 78 bp, Homo sapiens
acaagatactaggtcccaatccgtggaaactgttaatgttacttcacaggaaaaatgggtcctttaagatgtcattgt

SEQ ID NO: 6772436 - DNA, 80 bp, Homo sapiens
cttcttttagaaatggctttaagtagtctcacattatttaaattaatcgtgaagtcacaataaagtctgctattgagaag

SEQ ID NO: 6772437 - DNA, 67 bp, Homo sapiens
gctattcaaagtgcgaggtcagggctggatgcagaatcacccctgtaatcttagcactttgggaagc

SEQ ID NO: 6772438 - DNA, 80 bp, Homo sapiens
taacaggatgaaaattacagatattttaagattctctccaacaagtatcttcaaatgagtgtggattattcagattgtta

SEQ ID NO: 6772439 - DNA, 68 bp, Homo sapiens
gctggcagttggcagggctgccagaaagccttatttttaacttgatctccaccctgtagcttgccagc

SEQ ID NO: 6772440 - DNA, 59 bp, Homo sapiens
gcttggcttacgcaggcttcgtgattgtaagtaagtgacagaggctgagttagtctggc

SEQ ID NO: 6772441 - DNA, 55 bp, Homo sapiens
atggttatttcatggaaaaattggagaattaccatcctttcatgatattggccat

SEQ ID NO: 6772442 - DNA, 69 bp, Homo sapiens
tgttttgaggagtgtgaagcgttctcatgagtcactagagatgttaaatgctttacagttttccaaaca

SEQ ID NO: 6772443 - DNA, 88 bp, Homo sapiens
catgagtcaaggtaaataaaagttccctggttagaaaagggcaccaaaaaagcctttgaaaagtagttcaacttgactttgacttatg

SEQ ID NO: 6772444 - DNA, 94 bp, Homo sapiens
gagaggatgttatttttccaaggctgtaaaattggttagtggcagaaccagaattaaaactcagcacccttggcagaatattcaatatcctgtc

SEQ ID NO: 6772445 - DNA, 77 bp, Homo sapiens
gggctcttcctgacttgccaggtgtgaccggcttcagaaggcatctgttctcacagtggcatgtcagggtcctgctc

SEQ ID NO: 6772446 - DNA, 55 bp, Homo sapiens
gggtctggagggcagcccttctgtgttactgaatcctcggggccacttcaggctc

SEQ ID NO: 6772447 - DNA, 56 bp, Homo sapiens
gacaataaaatgatcttacagtttcagtagaaggtgtatggttaattttatgtgtc

SEQ ID NO: 6772448 - DNA, 84 bp, Homo sapiens
tagagcataacgtgtctgtaaggagtcctcatgtctgtgcgagctgggctgtgttctaggctgaggagtttgcgatgtgttcta

SEQ ID NO: 6772449 - DNA, 129 bp, Homo sapiens
tgacctccagatgcccgttttaccaggttaccaggcatcctgaggcccaccctctattaaggaagtcagggcgggggtccaggagcctgcatttaacaagactttctggtaatgctaatgctgggggta

SEQ ID NO: 6772450 - DNA, 62 bp, Homo sapiens
atataggtcttctttaatttctcttagcaaagtttgcagattttagtgtagaggacttgtat

SEQ ID NO: 6772451 - DNA, 105 bp, Homo sapiens
aaattttctgggtcagctgagatactcagtgtaattgatgaccaaggctagaaggtccaagttgctgattaacactttgagtgctcagtgcattctagaattttt

SEQ ID NO: 6772452 - DNA, 81 bp, Homo sapiens
ctaggagttaggcttaagacattgcattgctaacaaattacatcatcaggtaatgctgatgctgttaaccctaagacctag

SEQ ID NO: 6772453 - DNA, 81 bp, Homo sapiens
ggtatgatagtattgattacaaatgttggttattcgtggtaacggggatggtggcatttgtaaaaacgttgctgggatatc

SEQ ID NO: 6772454 - DNA, 73 bp, Homo sapiens
aggagggctaggaaaaccaggatgggaatcagaaagaagcgtcctcctggccaaggacgtttcctgccttctt

SEQ ID NO: 6772455 - DNA, 56 bp, Homo sapiens
gctggggccacagcctcctagcttggagcaccaggaaaggtgggctgggccaaagc

SEQ ID NO: 6772456 - DNA, 100 bp, Homo sapiens
ctgtgctgagagagggtgctgctgtgaggacaggatgtactggatggccctgagttcagtgctccagtcccttgcctccacagcccccacaccagctcag

SEQ ID NO: 6772457 - DNA, 55 bp, Homo sapiens
gtgtggcttgcctgaggccactctgtgcatggagatgcctgtggtgagcacacat

SEQ ID NO: 6772458 - DNA, 65 bp, Homo sapiens
gaaactcaagagactgtgacacctgttcaagcaaagctatgcttaacagatacatctgtggtttc

SEQ ID NO: 6772459 - DNA, 65 bp, Homo sapiens
gtcatgttcctggtggctttgccaactgtagcacctagctcatggtggcagaagtagcagatgac

SEQ ID NO: 6772460 - DNA, 77 bp, Homo sapiens
caagggcacctggggaaaggtgggcacagatggagaagtcgggactcgagttctgtccacctttttgggtgaccttg

SEQ ID NO: 6772461 - DNA, 59 bp, Homo sapiens
cccagtagcagggctttggggatctgctgacaggaacccagagtcatctgtagctgtgg

SEQ ID NO: 6772462 - DNA, 84 bp, Homo sapiens
gtgagatgcagcctggattgcagaatgctatatctttattttaatcaccagagcttggttttaataatcacatgctgcactaac

SEQ ID NO: 6772463 - DNA, 71 bp, Homo sapiens
tcaaatggtcttttggttacagggtgaaagagacccaacaatacacctttcccacttccggaggcctttgg

SEQ ID NO: 6772464 - DNA, 128 bp, Homo sapiens
gccccaccactagttgtttttgtgatcttgggcaagttactttacctctttagctctcagtctacctgttagtaaaatggcattaaagtgtctgcctcctaagggttattgtgaggattaagtgaggc

SEQ ID NO: 6772465 - DNA, 64 bp, Homo sapiens
tcacagtgtgaacctgttcactgtcaccaactcactcatcacatttggaacttgttcactgtga

SEQ ID NO: 6772466 - DNA, 58 bp, Homo sapiens
gatcctccagctgacccaggaccccacaacccctccagtcccaagggctgagaggatc

SEQ ID NO: 6772467 - DNA, 55 bp, Homo sapiens
tgagccttcccaagaacccgcacaaacctaccggcaaggtcctgggcctggctca

SEQ ID NO: 6772468 - DNA, 57 bp, Homo sapiens
ccagaatgtttgtgaacagtcttaatgaccactgtgactgttcatttgatgaactgg

SEQ ID NO: 6772469 - DNA, 111 bp, Homo sapiens
aggagcacaaaagttagatttcacttcagagaagtgcattcagtattcataggccttctggaggagcaaggctgtgagaagaatgatattaggtgaaaaatattggctcct

SEQ ID NO: 6772470 - DNA, 63 bp, Homo sapiens
agttatgtaatctaacactcagtttaccaagttagaaactgaggatggataggtcatatgatt

SEQ ID NO: 6772471 - DNA, 76 bp, Homo sapiens
taattgtgagtgagatatgtctcactgtcctttgtggacaaagaacaatgaaagacataaactcagggcacaatta

SEQ ID NO: 6772472 - DNA, 91 bp, Homo sapiens
tttcggcccctgtgggacaatggaggcctctctcccttcgtgtccaggcctgggcctctggagagagacctccatgcccagaggtcagaag

SEQ ID NO: 6772473 - DNA, 75 bp, Homo sapiens
gattgctgcatctcaggagacgggtcttttcaggagcactggatgattaggccaagttacttgggaaagccagtc

SEQ ID NO: 6772474 - DNA, 62 bp, Homo sapiens
ggccaaggttagtgcatcttttgtttgtttataaaggcaaccttggcataatgaccatggtc

SEQ ID NO: 6772475 - DNA, 85 bp, Homo sapiens
tgaggaggtagcatgtgaggtaaaatcggtaagatgtagaaatccatactttgctgatttactattacttagatttttctcctta

SEQ ID NO: 6772476 - DNA, 63 bp, Homo sapiens
tatttttgagcttgtagcattgctattggacctaaggatatagcaatgatcaagacagacata

SEQ ID NO: 6772477 - DNA, 107 bp, Homo sapiens
ggttttgctggggatgcagccaaaaccctctcttattctttgccaggaagtgaaagtctttcatcaccacctgggaggaaaaaggggttcaacggcccagcagaaac

SEQ ID NO: 6772478 - DNA, 99 bp, Homo sapiens
ttgggtctagttgttaaagtgcactttatgttttgttttcaatgtgttacattgtgattagagaatatagagtatgccattttaaaattatagatttga

SEQ ID NO: 6772479 - DNA, 68 bp, Homo sapiens
ggggtgggtcccttcttgctatgctcagaggtctaggctctctggcttggcacggagatgcccagccc

SEQ ID NO: 6772480 - DNA, 69 bp, Homo sapiens
agggtctcaaagcagacctttaccctttagtgtgaattaggggtggggcagtcatgccttgggtaccct

SEQ ID NO: 6772481 - DNA, 71 bp, Homo sapiens
ccgccctcactgctgccagtgccacacgcgcggtttgcagctgcagatctggcactggcgcaggatggcgg

SEQ ID NO: 6772482 - DNA, 74 bp, Homo sapiens
ggtctcatgaaggaggcataattgtgaagaagatatttcttatacctcttcacatcatgttttttaatgccacc

SEQ ID NO: 6772483 - DNA, 130 bp, Homo sapiens
ttagttctattcatagtgccttctcaggcccaggttcagcacaggtgctcagacaatgatggttggttgatatttgcatgtgctaaggctacgaggccatgaaaagaaagtaatcaagaaggaagattag

SEQ ID NO: 6772484 - DNA, 62 bp, Homo sapiens
ccttctttcctttctttaccaagggccttttttggctttggccctggttttagaggagcagg

SEQ ID NO: 6772485 - DNA, 66 bp, Homo sapiens
gggtgttctggtcccaggatttcaggtgaataaactgagattcagggatgcagagcaaatttcccc

SEQ ID NO: 6772486 - DNA, 70 bp, Homo sapiens
tttgttatttcattttggttatgccataaataacacccaattttagcattcctgggatgatttaggcaag

SEQ ID NO: 6772487 - DNA, 71 bp, Homo sapiens
ttaatgtcttcgtcttctttatagcacaatagaagcactaagtgctttaaaaataggagatgaaaagttaa

SEQ ID NO: 6772488 - DNA, 59 bp, Homo sapiens
atgctttgaaatgtcaactgagaatggtgtggtggttgacagatggcacgtcagggcat

SEQ ID NO: 6772489 - DNA, 95 bp, Homo sapiens
tgcgaccatttgcttgttgtgatgaggtggattcaaagcagacatcaaaaagaagcctgtttccaccttcatggctaaagaaccaagtggcagca

SEQ ID NO: 6772490 - DNA, 88 bp, Homo sapiens
tgactggtattcaaggtgtggtgcatactgtaggttggattgagcaataaaagattgacctgcaaaatattatgttcttgaatattca

SEQ ID NO: 6772491 - DNA, 56 bp, Homo sapiens
ttgctctcagaggaggaggccgggtgggaactttcagcgccatttgatgtgagcag

SEQ ID NO: 6772492 - DNA, 55 bp, Homo sapiens
ggaattctcattttgtccctggtttgagaaaaggttagagagatatgggggttcc

SEQ ID NO: 6772493 - DNA, 79 bp, Homo sapiens
tctagattttctttgatatgtagccttggctagctcccttcccttttctgtcagttaccagccgtaagaagcatctaga

SEQ ID NO: 6772494 - DNA, 62 bp, Homo sapiens
gagtgtacagacaatgccctgcagaatgagtgacccgtgaggtcaggagccgtcttacattc

SEQ ID NO: 6772495 - DNA, 70 bp, Homo sapiens
taagcccacatttttctgaagactctacctatgatttttaaatataggcttcttggagagggtggactta

SEQ ID NO: 6772496 - DNA, 83 bp, Homo sapiens
gggatagattccttctccagaacttctaggaatggaattgaatctattatgtctccagaacttctagagatggattctattcc

SEQ ID NO: 6772497 - DNA, 83 bp, Homo sapiens
tgatgggaggtaaaatgagtctccattatatgccacctttattaggcaaagtaatttttagttcattctatcttgtcctgtca

SEQ ID NO: 6772498 - DNA, 59 bp, Homo sapiens
ctgtaactcaacctgtgcttttacatcctactctagaaatgcagggtcgcaggttacag

SEQ ID NO: 6772499 - DNA, 59 bp, Homo sapiens
ggcatctcggaacacgcctccgactctgcttagaggatgaggagtgtgtgtatgaggcc

SEQ ID NO: 6772500 - DNA, 88 bp, Homo sapiens
ttttccctaggattttcttgtattcctctcagagttcttgtttgcttagaagccttcagagatggaaggcagaatgcttagcggaaga

SEQ ID NO: 6772501 - DNA, 80 bp, Homo sapiens
taggattctgtggattgttagagctctgggcagttttgctgcctgtaatcttggctcaggctctggccatccaaggcttg

SEQ ID NO: 6772502 - DNA, 123 bp, Homo sapiens
aactaagttaggattttattttattgtggggaatttatgtgcaaattattgtgcaatttaatgaaaataagccaatgttttatacagaagtacccagaaaattaaataacactatacattgtt

SEQ ID NO: 6772503 - DNA, 64 bp, Homo sapiens
tttcacatttaggcgtgaattgccagttttgatttgctaacaatggcctaccctaagtgagaaa

SEQ ID NO: 6772504 - DNA, 74 bp, Homo sapiens
acaatgaagacttggcttattgttttcctgtttctgtttgaacagtgaactgatttgtaaagaaccttcattgt

SEQ ID NO: 6772505 - DNA, 57 bp, Homo sapiens
gcccccgtctgcctgccacttgatggtattgccatgggctgagtggaatgagggggc

SEQ ID NO: 6772506 - DNA, 56 bp, Homo sapiens
tgtgagacgtaggccatcgaggatggtgaaccaattttcatggtcttagtttcaca

SEQ ID NO: 6772507 - DNA, 60 bp, Homo sapiens
tgatgacttaaggacaaactcacctttcaaccaaagaatcgagtttccctggagacatca

SEQ ID NO: 6772508 - DNA, 59 bp, Homo sapiens
attggaaagtgtctagtgtggtctgagaggcttagaacaatggaatggcactttccaat

SEQ ID NO: 6772509 - DNA, 77 bp, Homo sapiens
gtcaggtgtgtcattgctttacaaaaattgatggtgacatgtgtgtcattatttgtaagagccagtgaatatcttac

SEQ ID NO: 6772510 - DNA, 73 bp, Homo sapiens
tcagtatccttgttctgatttttctgggaactagatgttactgggagatgactcagagcaggccaagccctga

SEQ ID NO: 6772511 - DNA, 86 bp, Homo sapiens
ttcccctaattttcatgttttaatgcctttttcttaatttgttatagatctggaaagtgatgaaactgtgtgagaattaatgggag

SEQ ID NO: 6772512 - DNA, 65 bp, Homo sapiens
gtgtaaataattcaactgtctttagtgcacctgtcaggaaaatgaggaaggcttgaagtttacat

SEQ ID NO: 6772513 - DNA, 102 bp, Homo sapiens
ggagggtgtggggctgcagggctgctccaaggctctggtgctgaggcgtctcactgcctccaccatgtgctttggctttggctatcagctgggacaccctcc

SEQ ID NO: 6772514 - DNA, 59 bp, Homo sapiens
gctggctcccgttcgtcacggccggcggcggcgacaacgtgacctgcgcggggcgcagc

SEQ ID NO: 6772515 - DNA, 58 bp, Homo sapiens
ggcccaaagggctctgtgggctttgaccctacttcctctccagcctcacaccctttcc

SEQ ID NO: 6772516 - DNA, 85 bp, Homo sapiens
gtggaaatcagctctagagttcatatggggggattctgcctggaataagctgtaggtccaccctgagctgggagagcagttcaac

SEQ ID NO: 6772517 - DNA, 97 bp, Homo sapiens
gagggcctgagaagggcatttgtattccctgcacgtgaccataggggattaatattgtgggggggaaaagcaccaagtccacttctaaggctccctc

SEQ ID NO: 6772518 - DNA, 72 bp, Homo sapiens
ttccatatttaaagtctacttgaatacgatggtgatgaaaaccaagactgtcccatttatgtagacatggaa

SEQ ID NO: 6772519 - DNA, 71 bp, Homo sapiens
gggccctgaggaggcgctgaactggcatcagctgtgttgaacagtccccagggtgaccctcccggtggccc

SEQ ID NO: 6772520 - DNA, 65 bp, Homo sapiens
agtaaccagtagtcattcattcaccagtattaatgcctggtacatgcaaaagactatttgttgct

SEQ ID NO: 6772521 - DNA, 58 bp, Homo sapiens
tgtgtacttccccctgacctgtttgaagcaggcctccacaaggtttggtggaaacata

SEQ ID NO: 6772522 - DNA, 87 bp, Homo sapiens
gcagacatttcagttgcagcttcccagctcactcataagtacgtcctctgtccgtgcttggggatgggaagcccagcatctctctgc

SEQ ID NO: 6772523 - DNA, 85 bp, Homo sapiens
gtcactgggaagccagtgctgtcatggaaatccctgcacacgacacacgggtttccttcggtttggcgagacattcccagatgac

SEQ ID NO: 6772524 - DNA, 66 bp, Homo sapiens
agtagctaaagcagctgtttgactttccatttgatgcaagtggaggtgtataaggtagcttctact

SEQ ID NO: 6772525 - DNA, 61 bp, Homo sapiens
tatactattttccacttgtcacgcttttaaccattagaagaggaggaggaaaactagtgta

SEQ ID NO: 6772526 - DNA, 61 bp, Homo sapiens
ggatctcattcactatatgcttaatgtccctcatctattgagtgtgttccctgtgagattt

SEQ ID NO: 6772527 - DNA, 130 bp, Homo sapiens
ccagcataatttaggagagaaataccattatcttgtttagttagctgttgttttagagattcctgttactcacagctgaatctcattctaactagtaggctacgtcaatgttaaatgttttctaaactgg

SEQ ID NO: 6772528 - DNA, 78 bp, Homo sapiens
tctgtatgatagggatgaagatggtatttcttcagaaggtagtgatgaggaataaatatctcattcttggcatgtagg

SEQ ID NO: 6772529 - DNA, 70 bp, Homo sapiens
gtttgtagcttatcaaggctgtttggggtgcaagaaatagaaaaccattcaaactcgcttaagcacaaac

SEQ ID NO: 6772530 - DNA, 84 bp, Homo sapiens
taacaattatagtgtatgttcagcttatatggaacagtccagtttcacctcatcataaagctgaatgtagagggataattgttg

SEQ ID NO: 6772531 - DNA, 71 bp, Homo sapiens
tgccagaatctaggtattttattgttgaaagatacttccggtatcaacttaaagaaaagatacttctggta

SEQ ID NO: 6772532 - DNA, 71 bp, Homo sapiens
gaccagggtcaggctagcccagacttcaggtacgggctgtgatgacgaggagtgggctagtctcccgggtc

SEQ ID NO: 6772533 - DNA, 95 bp, Homo sapiens
tgagttattgctttcactctgtgtttctgcagctctctctgcctgtttttaccactggacaggaagctccatgaaggcagagtcagtttgactta

SEQ ID NO: 6772534 - DNA, 59 bp, Homo sapiens
gaggtggaaggcaggaacaaatggtgaagctaaagaaggccaagtttctcttccatttc

SEQ ID NO: 6772535 - DNA, 78 bp, Homo sapiens
tggctgagttgtcccagttgggtattgaattcatggtatgatttatttgcaggattgggactggataaaactcagtca

SEQ ID NO: 6772536 - DNA, 63 bp, Homo sapiens
cctccttttctcagtgcagtttctacgtctgcttcagatgctgcctgcaatgagagaaaaagg

SEQ ID NO: 6772537 - DNA, 55 bp, Homo sapiens
gtggatctcattcaccatggctttcaaagtcctctggtgataggagagtttccat

SEQ ID NO: 6772538 - DNA, 86 bp, Homo sapiens
agcagagtgataccgtcacatttaatgatcctactgtgaattcaagaattcacgatgaaagttggattgagcggtattttggtgtt

SEQ ID NO: 6772539 - DNA, 85 bp, Homo sapiens
gagggtcgtggagcctgagacctggggaggggccagtgctgctgttcaaatggctcctttccgggtctccagctccatgaccttc

SEQ ID NO: 6772540 - DNA, 110 bp, Homo sapiens
tttaatgtcttgtctgttagtaccaaggccagagggaaaaggggagtaatattttattataaccttttctttatcctccacaaaggccttttagcagaactgaccttaaa

SEQ ID NO: 6772541 - DNA, 88 bp, Homo sapiens
atttttttaactgggcaagtatttgtgtaagttttggaagtaagaacttttgaagaattatgcaaaagccaaaaccatgtaggaaaat

SEQ ID NO: 6772542 - DNA, 60 bp, Homo sapiens
gaaaagggagagcaggtctaccatttctaaaggtacatagtggagacaattgcccttttt

SEQ ID NO: 6772543 - DNA, 59 bp, Homo sapiens
gaggacagttgtggcttatattataggctcaggcagccctaagcacatgaacagtcctc

SEQ ID NO: 6772544 - DNA, 83 bp, Homo sapiens
accaaaagtgaggaatggcttaatgtgggatactcagtggatttgcctaaggtttccaaattgggttaggttttaattttggt

SEQ ID NO: 6772545 - DNA, 92 bp, Homo sapiens
gctctcgatgccattttcatgagtttctgttcacactgtaactaaagaatttcaagtgcatgagcctgaactagtgacaatggaatgatggc

SEQ ID NO: 6772546 - DNA, 68 bp, Homo sapiens
gtccagtctgtttggcaatactctgtagagctgtgcatttaattagagtttggtaaacaattctggat

SEQ ID NO: 6772547 - DNA, 56 bp, Homo sapiens
gagcactcactttttgcctgggggagcactcacttggcaaagcctatgaagtcctc

SEQ ID NO: 6772548 - DNA, 60 bp, Homo sapiens
ccacagtcattacattcatagggtttctcccctgtgtgaactctctgatgtacactgagg

SEQ ID NO: 6772549 - DNA, 60 bp, Homo sapiens
actcccaggtggaggtcctgagccacgcgatctccttctaaagcctccaccatggagggt

SEQ ID NO: 6772550 - DNA, 70 bp, Homo sapiens
gggctaccacctccatcctcctttcagccagcagggacagtttctggaaggagtggtgaggttggagtcc

SEQ ID NO: 6772551 - DNA, 63 bp, Homo sapiens
tgtaaggctgtggatggcaaatgaattccaaaatgaaatcagccagccagctacaggcttaca

SEQ ID NO: 6772552 - DNA, 72 bp, Homo sapiens
gcatactctcattggccctacctgcagtcgctctacgtaaggggcgttccagagtcagccactgggagtcgc

SEQ ID NO: 6772553 - DNA, 66 bp, Homo sapiens
ttcctgtgtgctctcatttagtaggcctgctttattgacttggtccccacaaatgtgtcacaggaa

SEQ ID NO: 6772554 - DNA, 130 bp, Homo sapiens
tctaatggcagttctgttttcttccacataaggatttttagagaggctctgtaaaatgtcccctttcgacagtggttattttaaatgtcttctttgcccttttgtgctggagtcaaggattctcacagga

SEQ ID NO: 6772555 - DNA, 76 bp, Homo sapiens
cctctcctttttcattggctttaggacagaggccattgtaagatgagcaactgagtctgggtggaaataggatagg

SEQ ID NO: 6772556 - DNA, 130 bp, Homo sapiens
gctattatcgtagttaattaaaacatttattgaaagcttgtttgtgcatgatggtgtgtgaagctctgtgcaacatttgtactaaagaagttcactttttactaaaagtttataatgtgacgctataaac

SEQ ID NO: 6772557 - DNA, 92 bp, Homo sapiens
aggtaggtggggcaagagtacctacagatgtaaatgaaacagaaaaagtctgcttcatttctctctgtagaccatctttatctgacctattt

SEQ ID NO: 6772558 - DNA, 61 bp, Homo sapiens
tacactgctgctttgcccgtgaatatggtgctctcactcaattgcaagcctaagcagtgtg

SEQ ID NO: 6772559 - DNA, 60 bp, Homo sapiens
gacagtcatttgttttacaggcagttggtaaatgtctacttgtaattataatgtactgtt

SEQ ID NO: 6772560 - DNA, 55 bp, Homo sapiens
gaggcctagtctgcctgctcacctcatcttcaatgtagagagcagcctgggcctt

SEQ ID NO: 6772561 - DNA, 119 bp, Homo sapiens
agaaatataggtcaaactaggggaatacaagcccaaatgtctctctaaataaacttttctttgacttctctgagaaaagttgatttggagggatattctcctctttgacactgttttct

SEQ ID NO: 6772562 - DNA, 91 bp, Homo sapiens
gcatttgagaaacaggtatttactgagagccactctgttaaaaacacacttgagactagagggctgcctcagtcagctatccatcaatagc

SEQ ID NO: 6772563 - DNA, 79 bp, Homo sapiens
gtcagtgttgcaggtatcaactgtacattattcaaagcaccctaggattctgtgatagttgatccttagaaataccagc

SEQ ID NO: 6772564 - DNA, 67 bp, Homo sapiens
tctgtgtctctaaagatagctgcctcgagatcctgtactcagggaggtgtctgccagagaattcaga

SEQ ID NO: 6772565 - DNA, 76 bp, Homo sapiens
caatttaataaaagttccttttatagacatgactgagaccagagagtctgtctatgttaagagagctgcgaaattg

SEQ ID NO: 6772566 - DNA, 56 bp, Homo sapiens
ccattcgctggctcgtcttttctcctgtgatcaggggtgtttttggccaggagtgg

SEQ ID NO: 6772567 - DNA, 79 bp, Homo sapiens
ctcgctcactgaggtaggtcctgcctcccagacaataaatccctcaaggtcagcccaaagcctgcctcagctagctgag

SEQ ID NO: 6772568 - DNA, 82 bp, Homo sapiens
ccctgcgcggccccgcaagctgactgtcctccacgcctgctctcctgcaagccaggaaggatccagcacgcggccggcaggg

SEQ ID NO: 6772569 - DNA, 128 bp, Homo sapiens
gggattgcttccttcaccagcaaaaggagatcaataagaactggccctaactctaaaattttacctgagtggccagtccctggattgaaagtctctactgtgtcattctcaaggagcttcagaatcct

SEQ ID NO: 6772570 - DNA, 68 bp, Homo sapiens
gtatttagacacaaaagtgccatggagaccaatgatttataaggggaccattcactggtgtcaaatac

SEQ ID NO: 6772571 - DNA, 84 bp, Homo sapiens
cctgaagtcttttgatgatctctggtggtaaagacccttgtttcaaagtcttatttaaagagatcatacttccaagcacttagg

SEQ ID NO: 6772572 - DNA, 56 bp, Homo sapiens
aaggctagaatgaaatctgagttgattacaggtcaacaagatagagctcttgcctt

SEQ ID NO: 6772573 - DNA, 78 bp, Homo sapiens
tgtgaacagtattgtttatgtgattgtgcaggtgaacaaccaaggatctgtacaggtaaatgcaaacagctcttcaca

SEQ ID NO: 6772574 - DNA, 66 bp, Homo sapiens
agacttgccgactggccaaggagtaagtccttttggagctagagccctctggccacgttgctgtct

SEQ ID NO: 6772575 - DNA, 63 bp, Homo sapiens
aaattgtcagaattcagaaagttgctccatgtgcccctgtcaccctgaattctagaccaattt

SEQ ID NO: 6772576 - DNA, 74 bp, Homo sapiens
tctccagaaatctgatatgattcactcattgatccaaatttttaatgtgcttgaagcctcagagaattctgaga

SEQ ID NO: 6772577 - DNA, 60 bp, Homo sapiens
cccggggctgccctctctctgtgggcttgcctcatcatgtcagctctgggcagcctgggg

SEQ ID NO: 6772578 - DNA, 74 bp, Homo sapiens
cagattgatcccatggtctatatagaggcacacacactgcagtgatgtttttgacaagacccatggttgatttg

SEQ ID NO: 6772579 - DNA, 88 bp, Homo sapiens
gctccgcggggcttccccgccggttcgctgagtcccagctccgctcggccgggacctccgtggcaggctcggggagcccgcggggggc

SEQ ID NO: 6772580 - DNA, 71 bp, Homo sapiens
gagaaagcagcagtggtctgtagaaggagtgggaactgtctttcttattagccattgttctttaacttctc

SEQ ID NO: 6772581 - DNA, 74 bp, Homo sapiens
cagagcagtggggttggtcagatgccatatgatgcacacacttaagcagggcaaaggactacacattgactctg

SEQ ID NO: 6772582 - DNA, 65 bp, Homo sapiens
gcctcttggagaattctgaaggcaaaagttatctgctagggctgttagtaattctcagatgaggc

SEQ ID NO: 6772583 - DNA, 68 bp, Homo sapiens
cagaagaccgtccccaggatgtgggcacttctcgccagagggtcctgagcctggggcgcactcttctg

SEQ ID NO: 6772584 - DNA, 56 bp, Homo sapiens
aacagagctggtgactccaggtagccatagcaactgtgaggtaacgctgctctgtt

SEQ ID NO: 6772585 - DNA, 66 bp, Homo sapiens
tcttgcctcttcccctttccatgccttgaggccttttttccagaatggaatgggaagagtgtgtga

SEQ ID NO: 6772586 - DNA, 75 bp, Homo sapiens
ctatctttcgattctagcttaaggtggtttaaactacatgaatgagctgtatttctggctggagttacagggtag

SEQ ID NO: 6772587 - DNA, 68 bp, Homo sapiens
tcccctgtgcccatcctcaaagacagcctcagaagtggacatccgtctttcaggaggggcttagagga

SEQ ID NO: 6772588 - DNA, 55 bp, Homo sapiens
tgtacagtctgcagcttgctgtggcccacatggagaagtaagcaaagactttata

SEQ ID NO: 6772589 - DNA, 63 bp, Homo sapiens
ggggatctttagattagaaactctaattagcgagttcagattagaaagggtctggggatcctt

SEQ ID NO: 6772590 - DNA, 66 bp, Homo sapiens
tccacgtagttgaaattctgggatcaagaaagtatatttaaattgactcccatcataactggtggg

SEQ ID NO: 6772591 - DNA, 117 bp, Homo sapiens
ggaggggaccctggagcccaggtgtctgggctgtgggacccggcactttctcttccctggagagagggatggccccgtaactcagcatcctgcgctttccctagcccggtgccttcc

SEQ ID NO: 6772592 - DNA, 69 bp, Homo sapiens
gtgaatattgcattgggagagctgaaaaagtttatgtactttcagacatctcataatgtattatgtagc

SEQ ID NO: 6772593 - DNA, 74 bp, Homo sapiens
tgaacatttaggaatgttctgcacaaatgcatgtaaatagatttgttttgtgattcctatttctaagtcattca

SEQ ID NO: 6772594 - DNA, 93 bp, Homo sapiens
cacaaaaacagtttcactgctgataacccagcagagtgaacctcaaagttggctctgctaatattgtagtaccagagcatccactgtagtgtg

SEQ ID NO: 6772595 - DNA, 95 bp, Homo sapiens
gggctgatatttacacagttaccagcaggtggcagtatgtatatgaaagtgtgtcgtaaataatgcaacttgcaggttactggctattactaacc

SEQ ID NO: 6772596 - DNA, 89 bp, Homo sapiens
agtcctagggtggtgatcaaggctttagatccacagaatgtagaagctctgatatctggagcttgaagctttggttgcatccactggct

SEQ ID NO: 6772597 - DNA, 58 bp, Homo sapiens
tcttcattctcgcctttgtcgtcagcatttatggagctaggcactgtgtgagtgagga

SEQ ID NO: 6772598 - DNA, 60 bp, Homo sapiens
gaagattacctgagaccacttgtcccccctcaaagaagcaaggtctcagccaaaatcttt

SEQ ID NO: 6772599 - DNA, 69 bp, Homo sapiens
caaaagtgaagtgacatggatctatcagaagttgcaattttgcaaaacttgtcagtgtactttcttttg

SEQ ID NO: 6772600 - DNA, 82 bp, Homo sapiens
gactctttcatgtcaagcctcggagggcttctgggctgcaggagcacaaagggagcccctccaggtacaggagtccagagtt

SEQ ID NO: 6772601 - DNA, 71 bp, Homo sapiens
gcttttaggaaaatgcaaacctacctacatacatacaagtgtgtgtgtttatagtgtatcttccagattgc

SEQ ID NO: 6772602 - DNA, 58 bp, Homo sapiens
acgtgctggagaagagctcgcctggccaccgggccacggccccgcagacccagcacgt

SEQ ID NO: 6772603 - DNA, 129 bp, Homo sapiens
tcatatgtaaagtcagcccagtatccaggaaaggtagaagattcatttcctctgaattagtcgtaggaagtggcatattcaggtcatttggatccctgcctgccctgggctgaattcacagctcttaca

SEQ ID NO: 6772604 - DNA, 65 bp, Homo sapiens
tttggcttgtaaaatgaaaagctatcaagctgaattgccttgaaagttttatattataagctaaa

SEQ ID NO: 6772605 - DNA, 104 bp, Homo sapiens
ggccacaaggacagattcctgggagagctgcccgggtgattgcccttactgtggtcacactgaatggcactgacattcccaggtacctacactcttttctggcc

SEQ ID NO: 6772606 - DNA, 68 bp, Homo sapiens
agctaagaaactattgtctctgaactgtgttggctctccacgttcagtgagacactggttctattgtt

SEQ ID NO: 6772607 - DNA, 59 bp, Homo sapiens
atgctggggcctcagaccagaacagtaatttagaacctctggtagtggggcccaggtat

SEQ ID NO: 6772608 - DNA, 59 bp, Homo sapiens
gctctctgagaccttggctctacaagccttttaaccagagagaggagtctcagatgagc

SEQ ID NO: 6772609 - DNA, 66 bp, Homo sapiens
catttatgtacattttgtctgcggctgcttttgtgctacagtggcagagtcaagtagtcatgagtg

SEQ ID NO: 6772610 - DNA, 111 bp, Homo sapiens
gtaattaaatcttgtcagacctgccttctgatgatgatgtttggcatgcatgcattgagttctgatgcagttttaaatcatttcagaaagccagaggtgcaagtgaattgc

SEQ ID NO: 6772611 - DNA, 66 bp, Homo sapiens
catttaatttgctgttgcttagtttcattatccctgatatgaatcaagtgagaacagcatcaagtg

SEQ ID NO: 6772612 - DNA, 64 bp, Homo sapiens
agggctagaatgcagcttgaaaaatcaggagaacctttctgcatgaacagtttattccagccct

SEQ ID NO: 6772613 - DNA, 73 bp, Homo sapiens
ctgttgttgctgggtgcctgagtttgctagggctgctgtaacagaaccgcacgctgggtggccagaacgacag

SEQ ID NO: 6772614 - DNA, 55 bp, Homo sapiens
agagtcaccaaagtaaaacagtgtttgcatcaccattttacctaaggctggctct

SEQ ID NO: 6772615 - DNA, 60 bp, Homo sapiens
ctatactttcagggatcatttctatagtgtgttactagagaagtttctctgaacgtgtag

SEQ ID NO: 6772616 - DNA, 67 bp, Homo sapiens
tcatctccttccttaggcaatttgggagagtactaagtgtaactcctttgctttgcctagttgatgg

SEQ ID NO: 6772617 - DNA, 65 bp, Homo sapiens
tattttaaaagtcttaattgctttctagtgaacattatatagaagccaatgagacttttggagtg

SEQ ID NO: 6772618 - DNA, 86 bp, Homo sapiens
atcagaatggccattgcagagttttgagagaagaatcatatgttgtgtgatttacaattgtaaaagtttcctctggctactttgat

SEQ ID NO: 6772619 - DNA, 57 bp, Homo sapiens
cccaggcagtgtgtgcatgcgtgcatgtgtgcgtgtgcgtgtgtgtgtgtgttgggg

SEQ ID NO: 6772620 - DNA, 81 bp, Homo sapiens
tctgagccctgcacggtgctgggtattggggttctcctgggaacttagctgagccccaccctagacattctggggctggga

SEQ ID NO: 6772621 - DNA, 70 bp, Homo sapiens
ctgtctgccccagacacacctgtgacttgatgcccacctatgagggcacatgcactgtgggggcaatcag

SEQ ID NO: 6772622 - DNA, 58 bp, Homo sapiens
gagtataagctttttcacttcaaaatgaaacctctgtgaattgaactaggctttactc

SEQ ID NO: 6772623 - DNA, 78 bp, Homo sapiens
ccccaggctggtaaggggcctgcccggaggccgtctggagtttcctcgttctcactgtggctctcgccagcctgcggg

SEQ ID NO: 6772624 - DNA, 60 bp, Homo sapiens
agggcccccagcaacaaaccagggggagctccgcattctttgggcaattgctggccccct

SEQ ID NO: 6772625 - DNA, 86 bp, Homo sapiens
aattagcagcatcctttgatcctaaactcagatgtagagttaatcctttccaactgctgggatggggtagagtgaggctgctggtt

SEQ ID NO: 6772626 - DNA, 60 bp, Homo sapiens
tgagcagactctgcagagccacaaacaatgccgccttatgagctctggtcagtctggtca

SEQ ID NO: 6772627 - DNA, 64 bp, Homo sapiens
gggtgcattcccaaggctgagacatccctggagtaactttaggtgtctgtcctgggctgtgtcc

SEQ ID NO: 6772628 - DNA, 69 bp, Homo sapiens
ggctaaattaggccggagaagagggacaaagcaactttcgccctcattagtattctggccgcgttggcc

SEQ ID NO: 6772629 - DNA, 55 bp, Homo sapiens
ggtagccagcaactagcccaggaccccaagtcataggagatgcttgctgactgct

SEQ ID NO: 6772630 - DNA, 80 bp, Homo sapiens
ggctgggagtgtaaggtgctcacgggctcagggagggcttggaacctccctttgtactcaccagcaccacgctctgagcc

SEQ ID NO: 6772631 - DNA, 75 bp, Homo sapiens
ccttaaaatgtctactcctgtgtttatttatggtttagtgttgagagcatgggctcgggagtcagattgcctggg

SEQ ID NO: 6772632 - DNA, 59 bp, Homo sapiens
tgggacagcttgcctggtaatgcaactggaggacatcattgcatccagagagcttccca

SEQ ID NO: 6772633 - DNA, 59 bp, Homo sapiens
ctcatccaccgcagcccctcagtacccacacggcctggaaaatggatgcgtggatggag

SEQ ID NO: 6772634 - DNA, 56 bp, Homo sapiens
tccgcctggcaaacacctaaggcgcctggaggggcgcaaggtcaggtcccggcggg

SEQ ID NO: 6772635 - DNA, 58 bp, Homo sapiens
atccctgctctgtgcctcttgctggtttatttcttcagtcaactggaagggcagggat

SEQ ID NO: 6772636 - DNA, 58 bp, Homo sapiens
tgcatgttagactgcagagtctggtagggaaaacagactctaaatagataaccatgca

SEQ ID NO: 6772637 - DNA, 68 bp, Homo sapiens
ggctcctctgtccaggctcccttggtgctgccggggcacccactcacaccagagctgggcacaggacc

SEQ ID NO: 6772638 - DNA, 59 bp, Homo sapiens
ttgaagtcctaatctccaggacgtcagaatgggactgaattcagagatagggtctttaa

SEQ ID NO: 6772639 - DNA, 91 bp, Homo sapiens
gtaaattccatgaaggcagtgattttgtttggcttatttacatctatttctctaatacctacaatactgcctgtcacagaatggagtttat

SEQ ID NO: 6772640 - DNA, 68 bp, Homo sapiens
gtgacagccttcagtgtctctgcttatgaccagcagtatcccagtgtagagatctaagatggcttcat

SEQ ID NO: 6772641 - DNA, 111 bp, Homo sapiens
gccgtgtacagggaggttgcttggaatacttttgttaggaaaacgcactttttgtagttggagcctgtttttgtacctggcttaaagtgatgcctcccagtgaatacttgc

SEQ ID NO: 6772642 - DNA, 58 bp, Homo sapiens
ctgagacagacagtgcagacaccctctcctcatagtccctgcactgaacatgtctgag

SEQ ID NO: 6772643 - DNA, 78 bp, Homo sapiens
gtgctggagaagttagaaataagggctctccagaccagcctgaccaacctggagaaaccttgtctctactaaatacac

SEQ ID NO: 6772644 - DNA, 55 bp, Homo sapiens
tgggccacgtgacccttaccctggcaggacagggcagggggttactgttggccca

SEQ ID NO: 6772645 - DNA, 70 bp, Homo sapiens
gttgcttagaactgacgttagggaagaagccctcccggttatcaaataccttctcttgtcagtttgcaat

SEQ ID NO: 6772646 - DNA, 74 bp, Homo sapiens
ggccccagggaagaaggtggtctcttcagatcccacagtatgagccagcttcaaccatctccctgacttgggtc

SEQ ID NO: 6772647 - DNA, 72 bp, Homo sapiens
ctgggcatggtggtgcgtgcctgtagtcccaactacttgggaaactgaggtgaggccatcgcttgaacctag

SEQ ID NO: 6772648 - DNA, 61 bp, Homo sapiens
ttccagtaaaacccataagatttaggcagttcatccctgaagtatgtgtgggatgctggga

SEQ ID NO: 6772649 - DNA, 63 bp, Homo sapiens
atcattaaagacatcacagattacacagtattctgtgtcctgggtctctgattctttttagat

SEQ ID NO: 6772650 - DNA, 59 bp, Homo sapiens
aaggtcacaaagcctggagatactgaaattagaaagaaaatccagggctttatggcttt

SEQ ID NO: 6772651 - DNA, 57 bp, Homo sapiens
ggtgattaataccctgttaacaggatgacagaattgtcttgtgcaatattaaccacc

SEQ ID NO: 6772652 - DNA, 84 bp, Homo sapiens
caaacagcttactccataggcagactctttttggaggtccgtagcttgcctttccagtgatggggtctggctggtatttgtttg

SEQ ID NO: 6772653 - DNA, 58 bp, Homo sapiens
gggcctggcatgcagccccgttccagggagaagaaacggggatgcgaccacaggctcc

SEQ ID NO: 6772654 - DNA, 55 bp, Homo sapiens
ctcaactgggaactgtttgcctttgaaggaatgtcaggcacagttcctagttggg

SEQ ID NO: 6772655 - DNA, 81 bp, Homo sapiens
ttgtggatttaatagtcatagttttgctaattgtaaaccactctttggtacatatttaaattgtgagctatagatctagag

SEQ ID NO: 6772656 - DNA, 94 bp, Homo sapiens
tgtgctcgggcagatggccctgcctggagctccctgtctcccatttctccacctagaagggaagctgctgggtccaccttcccaaaagagcaca

SEQ ID NO: 6772657 - DNA, 63 bp, Homo sapiens
tctgcattacactgataaagacaaaattatgtacatgtttagtcctttaatagttaatgtgga

SEQ ID NO: 6772658 - DNA, 66 bp, Homo sapiens
gtgtctggcttccctctgttctgggccggctccgaaacgcgctcaagagaaatcggaatcagacac

SEQ ID NO: 6772659 - DNA, 95 bp, Homo sapiens
actgagattttactttggtgcttaagcttctgctttatgtgctttaaaccagctggtgcatgccaggtttgagtatcttgataggaacactcagt

SEQ ID NO: 6772660 - DNA, 82 bp, Homo sapiens
ccagtgtaccatttgagaagctctagaggtgtttttgctatacaaaagctagttcaagggcttctttcagaatgggggctgg

SEQ ID NO: 6772661 - DNA, 64 bp, Homo sapiens
gtaatcccagctactcgggaggcttaggcaggagaatcgcttaaacccaggaggcggaggttgc

SEQ ID NO: 6772662 - DNA, 79 bp, Homo sapiens
ttttcacatgtatttggactattgtagaatatagaaaagaatatcatgcaaactctagtcctttaaatatgagtgagga

SEQ ID NO: 6772663 - DNA, 63 bp, Homo sapiens
agcaaaagccaatgtttaacttagtggcaaaggttacgaagctattagttaaggctctttgct

SEQ ID NO: 6772664 - DNA, 56 bp, Homo sapiens
tcagttttctcatctgtgaaatgggtctgtcagcccttccaatgaattaaggctga

SEQ ID NO: 6772665 - DNA, 80 bp, Homo sapiens
cctggagccgtgcagagccatgggaggtttttgagcaggggctcggaggcctcagctcatggtttccatctggttccagg

SEQ ID NO: 6772666 - DNA, 70 bp, Homo sapiens
caatctgctctgttgtgtttttctccagctgcttaaatacaagaagagagacagcacacagtgtgggttg

SEQ ID NO: 6772667 - DNA, 85 bp, Homo sapiens
ggtttactaggccctggggagagttttacacccagctgccaagaggcacaaaggagctgtggaagactgtcagggtcattaaacc

SEQ ID NO: 6772668 - DNA, 68 bp, Homo sapiens
tcactgggccttctcacttcctgctagaattattacaaaatatatctggaagacagtgagcccgctga

SEQ ID NO: 6772669 - DNA, 68 bp, Homo sapiens
ctccctgccgacaggaggcatcctctccccagtaatacccaactgggctggctttctgtgcagcggag

SEQ ID NO: 6772670 - DNA, 55 bp, Homo sapiens
tgccccagaagtttgcacaagagacacaagagtctgaaaaatgagacctggggca

SEQ ID NO: 6772671 - DNA, 68 bp, Homo sapiens
tgaaacagtgactggtacataatacgcctccagtagatgttaggtattagaattacgttactgttgca

SEQ ID NO: 6772672 - DNA, 61 bp, Homo sapiens
aactgagtgcttactctgtcccaggcactgtgccaggtgctttgcacatagaagctcagtt

SEQ ID NO: 6772673 - DNA, 92 bp, Homo sapiens
actgctgtatttatctattgtattgttgatggacaattaggattagttcttctttcttggtcttaacaaacagtgtggatataaacacatgt

SEQ ID NO: 6772674 - DNA, 56 bp, Homo sapiens
gtctgaggaagatgcagggggaattgtctgaagcaccccctggctccttctaaggc

SEQ ID NO: 6772675 - DNA, 101 bp, Homo sapiens
ctgtttttaattgtttggtattttgggaatgcaagttattgtttagaatttatatgaccatttaataagtatttccatagctactttgaagtgttgtgcag

SEQ ID NO: 6772676 - DNA, 66 bp, Homo sapiens
ttttcctggagttcttgttttgcctactttgcggggagtggggaatgaaagaggaagtcctgagaa

SEQ ID NO: 6772677 - DNA, 85 bp, Homo sapiens
aaacatttcagaaattggactttgtgtgaaggaaaatacattatctgtgtgtttagatgcaaagtctcacagtcagatattgttt

SEQ ID NO: 6772678 - DNA, 69 bp, Homo sapiens
accagcctgggagtggtgacagctctcggtggatggtaacctccagggtgctgcaccatccctcatggt

SEQ ID NO: 6772679 - DNA, 62 bp, Homo sapiens
gttcaggtgtggaccgaggtcagatctgttttgacaaggactctggccctgtccacctgggt

SEQ ID NO: 6772680 - DNA, 69 bp, Homo sapiens
cacctttactaacaccatacatgctgcaaaaaatgtgagtgtgtgtatgtatgtatgtgttagtgtgtg

SEQ ID NO: 6772681 - DNA, 64 bp, Homo sapiens
gtcacttgtgcctggcacacagaaggcaagtaagagacttgatttcagttttaggcagagtgac

SEQ ID NO: 6772682 - DNA, 66 bp, Homo sapiens
tatcttctagaggggtagacatattatttgggatacttctccagtctcatctttccctgggagatg

SEQ ID NO: 6772683 - DNA, 56 bp, Homo sapiens
ggcttggccagacagggagctccagtgagctggggcttctcctgtaggctcatgcc

SEQ ID NO: 6772684 - DNA, 58 bp, Homo sapiens
tagttgcaggctgtgtccctgatttcacatgcagaccaggagccagcctgtcagtcta

SEQ ID NO: 6772685 - DNA, 69 bp, Homo sapiens
attcaagctgaatggtgacagatctgtgcagtattaagtacaattttctgtcctttcactcacatgaat

SEQ ID NO: 6772686 - DNA, 77 bp, Homo sapiens
ctggtggtggtttccttctgtcatttgtcagttcactacattttgaaataatggctttaggaatccagtgccatcag

SEQ ID NO: 6772687 - DNA, 84 bp, Homo sapiens
acgacttgtacactgtgatgccatctttccacctataaaatggaaacaatcctatagacttgatggtattaagtgagcagttgt

SEQ ID NO: 6772688 - DNA, 63 bp, Homo sapiens
cagcaagtaaaagtcatgtaatgatatgattgaactttaagaatattctaacatgacttgctg

SEQ ID NO: 6772689 - DNA, 129 bp, Homo sapiens
ctctttttcagttataaataaaattgcactgtaaaacattgcagcttaattgcaggaaacccaatgcattttttgttgttgttctgcaagtggttaatagcttgtttttttctttatatggagttggag

SEQ ID NO: 6772690 - DNA, 68 bp, Homo sapiens
ttttctgtgtgaatgagagaagggagttatgtctttttgtttattctatctctattcccacgaggaaa

SEQ ID NO: 6772691 - DNA, 86 bp, Homo sapiens
tgagatatttgcagtccagaaagtgaacagtgtttggaattctcatgaagacactctttcctcttctggaatccagttatgtctca

SEQ ID NO: 6772692 - DNA, 77 bp, Homo sapiens
tcccatcagctaaacttagtgaaataaagggcaaaaaaatccctgttgatttcgttcataagttcagtctcctggga

SEQ ID NO: 6772693 - DNA, 59 bp, Homo sapiens
tacagaagttggttttagtttactaatttgtttagctggctaatatacccagctctgta

SEQ ID NO: 6772694 - DNA, 82 bp, Homo sapiens
agctgattctgatgtgcagccagggttgagaaccactgccttaatatcaaatctcaactccttaatgcatttcagaggtgct

SEQ ID NO: 6772695 - DNA, 78 bp, Homo sapiens
acagtttttccccttcggagacctttgaagtttgtttattcttacaaagctctggaaggctcgtctgaaagaagctgt

SEQ ID NO: 6772696 - DNA, 76 bp, Homo sapiens
ctaggtggtaggctgtctcttgattcagaaagatttctgttggacatattctgagagagggtcagatgctatggag

SEQ ID NO: 6772697 - DNA, 57 bp, Homo sapiens
ttgctttgatctcatgtcagtctctacccttgactttgacatttggattcatagtaa

SEQ ID NO: 6772698 - DNA, 87 bp, Homo sapiens
ctgggagggctgtagtgggagaggggcggggaggtcaggaactgcccccaccacccagccagcttctccctgccaggcccctcccag

SEQ ID NO: 6772699 - DNA, 104 bp, Homo sapiens
cagcagcatacgtggagatgaggcgagaggcttgggctagtaaggatgccacctatacttctgcccggaccctgctggctatcctgcgcctttccactgctctg

SEQ ID NO: 6772700 - DNA, 71 bp, Homo sapiens
ccgtgcggcctcggggcccggctctcagcgccctccagcagagccccgcggccagcctcgggccgcaatgg

SEQ ID NO: 6772701 - DNA, 61 bp, Homo sapiens
tcccaccaaatagttttggactatcagttctaatctatgtatttcagaaatattggtggga

SEQ ID NO: 6772702 - DNA, 82 bp, Homo sapiens
aaggaggtgttgggaaggcatacctgagggagagactgcgagcctagctcttcttcagaacttgccttttcaatggctcttt

SEQ ID NO: 6772703 - DNA, 57 bp, Homo sapiens
gcaagccccacagccttggtgtcttggctccaaaaggcccaactctgtgagggctgc

SEQ ID NO: 6772704 - DNA, 57 bp, Homo sapiens
actaccattgtaacaagatattgttttcgttgatcgaaggttgtcacaggtggtggt

SEQ ID NO: 6772705 - DNA, 93 bp, Homo sapiens
gataatctccaaggaatctagaaagggagcaaggttgggggagaatggaaaatttatctacctgtatctttctgggattcataggtcatcctc

SEQ ID NO: 6772706 - DNA, 71 bp, Homo sapiens
gtcttaccaaagtgttatgcaaaactctgttttgtttactgaaaagagtttccattgacatttcctaggat

SEQ ID NO: 6772707 - DNA, 83 bp, Homo sapiens
gctatgatagcaaatattttaatgagcactgtttttgtatatacagtaatttttgttctattgaattattttgctgagatagc

SEQ ID NO: 6772708 - DNA, 74 bp, Homo sapiens
tgtttccaggccagccctcacctgtgttctggcctccaagccgagggctgggcttctgggctggcttgtcaata

SEQ ID NO: 6772709 - DNA, 64 bp, Homo sapiens
tggctacagaatgaatgctgcctgaatgagtaatgattagaaagcgtttggaactgtattacca

SEQ ID NO: 6772710 - DNA, 57 bp, Homo sapiens
aaggaaacagaggatgaccttgcttcattatttaagcagctcagcctctgttttttt

SEQ ID NO: 6772711 - DNA, 85 bp, Homo sapiens
cctgggagcttgttaacagtgcagaatctcaggccctacccggacctacagaatcagagtctgcattgtaacaagattcttcagg

SEQ ID NO: 6772712 - DNA, 74 bp, Homo sapiens
cctttatgttcctcctctgaagtgaattttatgcctgtggaaagtgccagaataggaggccaggaaaatgaagg

SEQ ID NO: 6772713 - DNA, 66 bp, Homo sapiens
tcagaagtaggagacattcttggtcctaaggcaagattgcctgtccctgaatatctcaacttctga

SEQ ID NO: 6772714 - DNA, 122 bp, Homo sapiens
agatgaaataaaatgaattcgttacaagacattgtggagatgttgctaagccctttaatttttggaaactcagtataattttcatcagttcttgtgaaacttgatttatgctcgtatcatct

SEQ ID NO: 6772715 - DNA, 56 bp, Homo sapiens
gctggctctttttgccgggctcgcctcctttcaggagccacagtcagaggagccgc

SEQ ID NO: 6772716 - DNA, 59 bp, Homo sapiens
tctccatttcaacatgaccacttgacactaagtgtttgtcccgttagaaatgtcagaga

SEQ ID NO: 6772717 - DNA, 111 bp, Homo sapiens
gttccactaaagaactggtgactctgggactagaatttgtaagatcagtgtagactaggatgggatttacaattctggtgccagctactaatcttcttgttcttttgagac

SEQ ID NO: 6772718 - DNA, 103 bp, Homo sapiens
tgatttcaccgcagtttgtttggatccaggactttattttaacggagattcaacaaatggaaatccttctaaaaagtcagtactatgttctaacgaagaatca

SEQ ID NO: 6772719 - DNA, 75 bp, Homo sapiens
ggttgataacagaagtttgttatgtaaacaaatgctatcaaccatttgttcacctagcaaacttttgttaagacc

SEQ ID NO: 6772720 - DNA, 72 bp, Homo sapiens
tccaaccctgaagaatatttcctgcacttgggattggtgcaaaattccagtagaattttattcaacagtgga

SEQ ID NO: 6772721 - DNA, 86 bp, Homo sapiens
ccttttcctgtgcttaattctcactgaagccagagagtgttaaatgcccatgaggatacagtggagttaaggaatacaggaagagg

SEQ ID NO: 6772722 - DNA, 73 bp, Homo sapiens
gtcatcaagggctctcagcaagcctgcggggagtcagctgccccatcctgcatgctgagatttgcctgattac

SEQ ID NO: 6772723 - DNA, 107 bp, Homo sapiens
agaattgttattggtcttttgccagtctaatgtttgtaaaatcataactcattgttggattagttgttcacacgttcctgactggtagagattttaagcctttttct

SEQ ID NO: 6772724 - DNA, 79 bp, Homo sapiens
atactaagctttttctcaaactaacaatgattatattcctctgagggctatgaatatgtagagtttgaaggttttatgt

SEQ ID NO: 6772725 - DNA, 70 bp, Homo sapiens
gcttttgatggcctgagggattctgcttgccacctgcatggcaggtcagaagtgccagggaattaaaggc

SEQ ID NO: 6772726 - DNA, 84 bp, Homo sapiens
gtgggtgctcgatgagcaattgttaaacttaccaaaattaagcctatctaactttgacaaaattatgctaatattgatccccat

SEQ ID NO: 6772727 - DNA, 64 bp, Homo sapiens
tttgacaggactaacatatggctttggatttctggccaaagactcctccatggttcctatcaga

SEQ ID NO: 6772728 - DNA, 97 bp, Homo sapiens
tgtctctgtggagctggattttgggcatttgaagttagatttttttaagtttaatttgattcagcaaatgttcactgagctcctgccctgagagata

SEQ ID NO: 6772729 - DNA, 55 bp, Homo sapiens
gtaccagggaatgaagggggtgaggcttcccctcagctgttcttttccctgggac

SEQ ID NO: 6772730 - DNA, 107 bp, Homo sapiens
ccaccggctgtctctcttccaggctctgagcccccagaagcagagctttgttttggaggttctgtctgggtgcctcgagtaccggaagctgctgaccgtcgtggtgg

SEQ ID NO: 6772731 - DNA, 63 bp, Homo sapiens
acattgctcaaaggaatgcaattaaaacctaactgctattgcatttaatccatagaggaatgt

SEQ ID NO: 6772732 - DNA, 91 bp, Homo sapiens
tgtaggaagatgtttaagatcttgtcatttctaattctctcccaagtgaggaaggaagtgaccaggatatccctaacatttggatcctgca

SEQ ID NO: 6772733 - DNA, 68 bp, Homo sapiens
cctgactagctgggactacagacgcgtgccaccacacctggctaatttttgtatttttagtagacagg

SEQ ID NO: 6772734 - DNA, 82 bp, Homo sapiens
ttctgtcccactgtttccctgaggctctctggctcacacattccaaagagagttgaagaacctctggatacagtttaaagag

SEQ ID NO: 6772735 - DNA, 64 bp, Homo sapiens
tggcacttgggagtcgtggcgacttggttctttcaggttcacatctctatggtcccaggtgtca

SEQ ID NO: 6772736 - DNA, 83 bp, Homo sapiens
ggatgggaggggcaatgagggaaagagtctggaggaaacatgccccttacaaattccaccactcatgggtgtcccaatcattc

SEQ ID NO: 6772737 - DNA, 55 bp, Homo sapiens
aaagtgctgggattacagacgtgagccaccacgcctggcctatcataagcatttt

SEQ ID NO: 6772738 - DNA, 64 bp, Homo sapiens
tgaggcaggtaagcaagttttgtcatctggaaaatgagggtaatacttgcctatgcctacctca

SEQ ID NO: 6772739 - DNA, 81 bp, Homo sapiens
ttcagccaattactaaaggtattttggtcatttctgtactaatataaggaagtgggtaactggcctttgttatgggttgaa

SEQ ID NO: 6772740 - DNA, 59 bp, Homo sapiens
gtgtcatgaccctgccatatgatctttgccgcccaacagaaggaagcagggtcaggcat

SEQ ID NO: 6772741 - DNA, 101 bp, Homo sapiens
ctctgaacacatggcccgtttttatatatatgtagaggtcacgatgattcatttctaagcattcatttttatatatgtgtagtttttatatgtgtgtagag

SEQ ID NO: 6772742 - DNA, 57 bp, Homo sapiens
tgaatgttatgtatccagtcacatgtaccttggcacatgtaaggattagagcattca

SEQ ID NO: 6772743 - DNA, 71 bp, Homo sapiens
ggcacagcctgtgacattgactatgaaactgtttcctattacctctttcctgtctaaagtcaaggttgtcc

SEQ ID NO: 6772744 - DNA, 62 bp, Homo sapiens
cattcatctatcaaatggtaccaatgggttgagatgaccaaggtgctcgctgatgaggagtg

SEQ ID NO: 6772745 - DNA, 81 bp, Homo sapiens
acaatagaaataatgggagaatgatgtgaggtaatgttacatgtaaaatgttatacacaattcttttactacgtttactgt

SEQ ID NO: 6772746 - DNA, 60 bp, Homo sapiens
ttggctatcactaggcaggtttcccaggatgtcaccctggtctcagcctgtgagagctga

SEQ ID NO: 6772747 - DNA, 62 bp, Homo sapiens
gctgttgggattctgcctttcccctcccaggaagtgagggaggaaggggtcctcccaacagt

SEQ ID NO: 6772748 - DNA, 82 bp, Homo sapiens
gctgacagggttgcgtgctgatgtctcacagctgcctctttctttgaagtgctgctctcagccaccaggaactactgttagc

SEQ ID NO: 6772749 - DNA, 87 bp, Homo sapiens
aaggtggtagtactacagtagagaggatgtagaaatagggcagaagttgttaagtcttgctctgctgttgactacccatgtgacctt

SEQ ID NO: 6772750 - DNA, 78 bp, Homo sapiens
ctcagacaaatgattaaggttaagctcaccaatgatagtgcatgttggtctcaggtacctctaattgattgtcatgag

SEQ ID NO: 6772751 - DNA, 55 bp, Homo sapiens
gattctgatgccagttcaggacagaaaacaactgctctgacctcgcatcataatc

SEQ ID NO: 6772752 - DNA, 76 bp, Homo sapiens
cagcctgcttcagggctttcccttgtagaaatttagtgtaaaccttgagttggggagaacagctctggccaggctg

SEQ ID NO: 6772753 - DNA, 55 bp, Homo sapiens
gtgtactatagcattttctaggagctgaaaggcgtttagcaagagtatagtgcat

SEQ ID NO: 6772754 - DNA, 57 bp, Homo sapiens
aagctttcagagcagaatgtgagcactctgcacccagtcactttgtgctccaggttt

SEQ ID NO: 6772755 - DNA, 58 bp, Homo sapiens
tgcctacaaaatagcgtgtcttttcacggggagaggatttgttgagttttagtgggta

SEQ ID NO: 6772756 - DNA, 78 bp, Homo sapiens
agctgcttccaggtccctggggagattttcttgatgagagaattgctaactctcctcctggatgtgggacccgcagct

SEQ ID NO: 6772757 - DNA, 72 bp, Homo sapiens
taagggaagcattctccctattgaaaaagtagagattatttttctatcaattctatggagaagattccctta

SEQ ID NO: 6772758 - DNA, 64 bp, Homo sapiens
aaaaggcctaattgaatcaagtctcctttccatctggcaggagacattttaataaggacttttt

SEQ ID NO: 6772759 - DNA, 62 bp, Homo sapiens
gtgggcttatgggcagcagcttagcaaccatttcaaggcactcagctgtctcatgggtctgt

SEQ ID NO: 6772760 - DNA, 83 bp, Homo sapiens
tagcatgttcttttagtacccggctgccagcagctgaagtcagcttgctaatcactcggtgtcatctgtcctagaacatgctg

SEQ ID NO: 6772761 - DNA, 61 bp, Homo sapiens
gctgacatgaaatgatatttgggtgggctgtccagtccctcttccctttttttctgtctgt

SEQ ID NO: 6772762 - DNA, 86 bp, Homo sapiens
gagagaagagcgatgctgtgtcagggaccacgtctcctgctctgtcgaatagagcagatgtgtctctgcactgtctgtttcctctc

SEQ ID NO: 6772763 - DNA, 106 bp, Homo sapiens
gccaaagacacggctccaggccctgcctggagcccaggcctggtgtctgtgagcagaagcagaggccaggcagcccaaggtggggcagaggcgccgtggaagtggc

SEQ ID NO: 6772764 - DNA, 64 bp, Homo sapiens
atgtagattcttggttcccattcctgatgtaccaattctgatggcagagacccagaatctacat

SEQ ID NO: 6772765 - DNA, 69 bp, Homo sapiens
gcacagtaggtcagcatgagagctcatctcacttccagttttactccaccatgctgcctccattgatgc

SEQ ID NO: 6772766 - DNA, 79 bp, Homo sapiens
tatatatctgtccattttccattttggcaaaagatacatggagtatttggtaggccaggaaagtgggtcttagtatatg

SEQ ID NO: 6772767 - DNA, 55 bp, Homo sapiens
attcttacaaatgaaactgcaatcactggtgatgtgtgggtgtatgtgtgagagt

SEQ ID NO: 6772768 - DNA, 109 bp, Homo sapiens
acatcccctctccccactgagtgtgcatcttctgctgggataacgcattaatgagcaagccattcattatccaagcagaagctgcacacacaatggggagagggcatgt

SEQ ID NO: 6772769 - DNA, 60 bp, Homo sapiens
attcatctgtacttcaatatctagtttccatagcaactgagatgcagtttgcaggtgggt

SEQ ID NO: 6772770 - DNA, 129 bp, Homo sapiens
attaacagagtttattttctagcagaatgcaatcctatcttagttctagagtctaatctatttagaaatttcttcttgcagggctgatgggaagtgcagtagttggagactaaagtaagaaatgaagat

SEQ ID NO: 6772771 - DNA, 67 bp, Homo sapiens
taccaccttcctctgtgttcctatatatatttaagtgtctttatttcagcacatgggataggttgtg

SEQ ID NO: 6772772 - DNA, 62 bp, Homo sapiens
tactgtatatgcttgtatctgagtctcttgatcaatctcagggaaaaaagcatgctatagta

SEQ ID NO: 6772773 - DNA, 97 bp, Homo sapiens
tggccagaatgatgcagtcactactctgcttaattaaaaccaggcctgtgtacgtggttttaattaagcagagtagtgactgcatcactagaggcca

SEQ ID NO: 6772774 - DNA, 63 bp, Homo sapiens
agggtcatgtccctgctggtcagaaggcaggatgagggccggccttgagcaggggctgacctt

SEQ ID NO: 6772775 - DNA, 75 bp, Homo sapiens
tctgttcatttgggatgagtcagaagtcaacacgccacaataaagacgactttatgctatttctcagtggaaaga

SEQ ID NO: 6772776 - DNA, 66 bp, Homo sapiens
ggttagaggtggagcctggactagaatcctgctctcttgacttccagtccaggagtcacccaagcc

SEQ ID NO: 6772777 - DNA, 57 bp, Homo sapiens
ttttgtgattatttgatcagtgtcctgagatggatacaatggcaagtaatgacaaaa

SEQ ID NO: 6772778 - DNA, 66 bp, Homo sapiens
tggtgactgcttcaatttattttctaggggaaataatggcttctaatatgaattgagcacttacta

SEQ ID NO: 6772779 - DNA, 66 bp, Homo sapiens
ttttgatgtttgctcatttaatgtctgaaatgtacattagtgtaggatgtaaggcaggcatcaaaa

SEQ ID NO: 6772780 - DNA, 130 bp, Homo sapiens
tgagacgtggaggggaaggaaagagctgcctcaaatgtggaaggatttcttctctcccaagaggatctctgtcctcacagggcaggaaggaggggccgaccaggttaggcaacttgcccgccagagctcg

SEQ ID NO: 6772781 - DNA, 92 bp, Homo sapiens
cctggcccccagcccccagcagctcagctactggtcacctgccaccgcctggaatgctgattggcagttggctggggtgggtgggggctggg

SEQ ID NO: 6772782 - DNA, 85 bp, Homo sapiens
cttccattcgaatttgactgactgaggcagcctgagttatttgtaaagaacaacaaggcttttcattcataattttagtaggggg

SEQ ID NO: 6772783 - DNA, 70 bp, Homo sapiens
tatcttcagcagttcacacttaacaagtgctctgtgcatagtaggtgcttagtgaatgctattgaagata

SEQ ID NO: 6772784 - DNA, 56 bp, Homo sapiens
tcttcgttaagctccagtcattccagctctcatgggaatgatcagcatagcaagga

SEQ ID NO: 6772785 - DNA, 62 bp, Homo sapiens
aaggagagggggttggggcagtgggctcagtggggcaggcagccacgattcccttgatcctt

SEQ ID NO: 6772786 - DNA, 57 bp, Homo sapiens
tgttggacactaccatatgggtgtcccaccaaccccacttgctcagcatgtccaaca

SEQ ID NO: 6772787 - DNA, 72 bp, Homo sapiens
ggacctgtgtctttgcctcagggtcttctctggatacttggagaaatgcttggcctgagtataggacaggcc

SEQ ID NO: 6772788 - DNA, 64 bp, Homo sapiens
ggaaatttcaggccaccagatgtctttatgcatctgcataaataacagtgccatgaaattgacc

SEQ ID NO: 6772789 - DNA, 93 bp, Homo sapiens
ggccgggatggtctcgatctcctgacctcgtgatctgccagccttggcctcccaaagtgctgggattacaggcgtgagtcaccacgcccggcc

SEQ ID NO: 6772790 - DNA, 84 bp, Homo sapiens
cagcctcacccagtgacccttgacagggccaagaatggacctccggctctggggtccagtcctgctcaccacttggtgctgctg

SEQ ID NO: 6772791 - DNA, 81 bp, Homo sapiens
gtggtttctcaaacctcttaatggcctgtaatctttcaacagttaagagtattgctaataagagatttgagaacaatttgc

SEQ ID NO: 6772792 - DNA, 93 bp, Homo sapiens
cttcatattttaagttgtggagggtgggatgaaaatgagagggtaattgcttgagatgatttctaatatcacttccagctgtaaaatgtgagg

SEQ ID NO: 6772793 - DNA, 64 bp, Homo sapiens
cgcactgaccctttgaggttgtgtggggtgtggtcagtgccctcctgcctgagggtcaagtgtg

SEQ ID NO: 6772794 - DNA, 58 bp, Homo sapiens
gagtggatgagaggctggactcagagtcagatgagccaatttcagtttctagttcctt

SEQ ID NO: 6772795 - DNA, 90 bp, Homo sapiens
gccctgggagttgccgtctgtcctggctggaccttccggaaaccctgcggtctgaacactggctggtcctcggggacagcagccctgggc

SEQ ID NO: 6772796 - DNA, 88 bp, Homo sapiens
ggtgatgcatcaggacacttagctgagggtgcagatgtgctgagagccacagctggagcttcaagcaggtaaaccctgaaagctcact

SEQ ID NO: 6772797 - DNA, 63 bp, Homo sapiens
ccaggaggttctgggccaggttgagtgtcttcagatgggtcagaggctggaagagcctcctgg

SEQ ID NO: 6772798 - DNA, 103 bp, Homo sapiens
taattagccgaaagatcttgaaggaggaatcaagaaaatggatccaatcaccttgaataatatgcttcgttctccaagatcacaaatttattttggttatttg

SEQ ID NO: 6772799 - DNA, 55 bp, Homo sapiens
ttttctttgcatgacagtgcatgtatatagacatacactgtttttggaaagaaga

SEQ ID NO: 6772800 - DNA, 66 bp, Homo sapiens
ggcttttaatgagcattttagaattgaagagccccaagttcaggatatctcaatgttcagaaagct

SEQ ID NO: 6772801 - DNA, 66 bp, Homo sapiens
gggcatcctgtcattctgtcaaatttcccttatgaatagattaggagtggaaagaaacaggtgtcc

SEQ ID NO: 6772802 - DNA, 69 bp, Homo sapiens
agcagggggagttagactagatgatattttgggttccttttatcttacgatttacctgactttccctct

SEQ ID NO: 6772803 - DNA, 58 bp, Homo sapiens
tgaggaaggttcatgagtttcattgtataaatgcattggcaattctctacctttctca

SEQ ID NO: 6772804 - DNA, 107 bp, Homo sapiens
gtggaatgctaagtaaaaaatgtgatgtagtgtagttgcaaaggcgttagctgtattctaattccagatttgccacttactcgttgaattgactttgggcaatccac

SEQ ID NO: 6772805 - DNA, 64 bp, Homo sapiens
gccatctgtagaacatggtgttatataggcatatggtagactagtatttcactctccagatggc

SEQ ID NO: 6772806 - DNA, 64 bp, Homo sapiens
ggacagagatgagtcaacacagctgctgcccccaggtctgggcaaagctggctcttctttgtct

SEQ ID NO: 6772807 - DNA, 92 bp, Homo sapiens
cctatctgtatggtggcaatgaagtgaagagattaattttactgtgtgatttttcaatcttatcactctatagtcctcacacatacataagg

SEQ ID NO: 6772808 - DNA, 59 bp, Homo sapiens
tagggcagtttcatgttatcttggctcattccttctcccgagatgaagagattgtttta

SEQ ID NO: 6772809 - DNA, 92 bp, Homo sapiens
tgtctggcacatagcaaattctatgtcaatgtttattaaatgaaaataaagttctttcagatgaggcaggagtttgcttgtgtttcaagaca

SEQ ID NO: 6772810 - DNA, 63 bp, Homo sapiens
gctggagagcaatgaggggcaggctgtgaactccaaacgcctcctccatcattgcttcatggc

SEQ ID NO: 6772811 - DNA, 82 bp, Homo sapiens
tatttcccaaaactctatgaaccttctaccaaatcatgcattccatttcacatgtctatctggtggttggtagtgggaagta

SEQ ID NO: 6772812 - DNA, 63 bp, Homo sapiens
tgagaagggttggagaaataatgagaaatgcaaacttgacccagagtttctccttccatctca

SEQ ID NO: 6772813 - DNA, 65 bp, Homo sapiens
ccggctctagccgtctgaagggtctcctgggggacccgccgaaacccatcagcggctggagctgg

SEQ ID NO: 6772814 - DNA, 67 bp, Homo sapiens
cttatcttcctcttctggggtgcatgcaggttggccaccttagccatgccctagaagaggaaggaag

SEQ ID NO: 6772815 - DNA, 83 bp, Homo sapiens
gatgcagctgtgtctctgctctctgcagtcttgggcaggcagcaccgctgtctcctgatacagagggttgaatgcactgcttc

SEQ ID NO: 6772816 - DNA, 58 bp, Homo sapiens
actttgtgttacccagcaaggactaaccaaggtttccttctgaaaaatgcacacgagt

SEQ ID NO: 6772817 - DNA, 78 bp, Homo sapiens
aagggacatggagagtctctgagccagggcaaataaaaagcttgcttggtttctaacttttcatatattttgtttctt

SEQ ID NO: 6772818 - DNA, 64 bp, Homo sapiens
gagcccaggttctgcttccagcaccactcagggtgttaggtcataggtagaacctgcacagttc

SEQ ID NO: 6772819 - DNA, 83 bp, Homo sapiens
gagcagagatgagacatgcattaagacacactgaatctaactagaaatttatcagaaatgttatatatgctttatctctgctt

SEQ ID NO: 6772820 - DNA, 56 bp, Homo sapiens
cctggctccttctctctcttcctcaagtcccaggaagtgaaagggaaggagttagg

SEQ ID NO: 6772821 - DNA, 124 bp, Homo sapiens
ccatggctatgttatttctcatttttagtggagtaaaattatgtggtggtttatttaagaaaaaatttttgacattttcttcagtaacacaaaccattaccactgtgtgggaaaactgaccagg

SEQ ID NO: 6772822 - DNA, 130 bp, Homo sapiens
agtctctagcttgatccaggaggcactggggaggaggttgctgatggcaagattccaggcaggaggtgactcagaaggctgggctgtcaatggccctctgatccccagtatatttttcaggcctgaagct

SEQ ID NO: 6772823 - DNA, 123 bp, Homo sapiens
aaggggctcagagaaggagggggctctggggggacgcagtcgctgcctagaggacagcaacaaaacagtggtctccttcagtgactttgtgcctcccttgcgcctgaaatcaatgagcccctt

SEQ ID NO: 6772824 - DNA, 102 bp, Homo sapiens
ctccctttctggagcactttctaggagaagccatttgtagagaagccctgtgccagggcatccgcctggagggtgctacatacaaaactcccagagaggggg

SEQ ID NO: 6772825 - DNA, 66 bp, Homo sapiens
gctgttgtccctaggagtcctgtgtaggtgctgttgggcctacagaggcctcgtaggtacaacagc

SEQ ID NO: 6772826 - DNA, 56 bp, Homo sapiens
gttaacaaccaaacagaagttcccaatcagtgatgaatggaagcttggtggttaat

SEQ ID NO: 6772827 - DNA, 69 bp, Homo sapiens
ggcagtgggtgacagacacctctctgtgcccatgtgggcgcagggctccactgtggccaagaaactgcc

SEQ ID NO: 6772828 - DNA, 83 bp, Homo sapiens
tgttcaaacctagactgctgggcccacactcagagttcctgattcgggaagtctgggaggggcccaataatttgcatttttca

SEQ ID NO: 6772829 - DNA, 60 bp, Homo sapiens
caggatgccctgagcaggccttcaagctgatggatttaaaggagaggctagggcttcatg

SEQ ID NO: 6772830 - DNA, 62 bp, Homo sapiens
ctgagagccctgcatggctgatgaagttcagttctctcattgtcgctctgcggtgttctcag

SEQ ID NO: 6772831 - DNA, 129 bp, Homo sapiens
gggcatgcatacagagagttctgcgtgtgcatggagggtctgtgtgcacaggagtgtttgaatgtccatgtgttttgttcaggccatgtgcacaggaccccgtgtgagtgcatcagtgagtgtgtgtct

SEQ ID NO: 6772832 - DNA, 57 bp, Homo sapiens
gttacacacaatatatcctaaattcacttggtagttggggtaactatgtgtgttagc

SEQ ID NO: 6772833 - DNA, 74 bp, Homo sapiens
gcttgttctttgcaaagtctttggcaagacatttaactgtctggccagtgaaatgcagaatagtggaatcaggt

SEQ ID NO: 6772834 - DNA, 56 bp, Homo sapiens
atgggggagcgacagacataattcacaccctgtgatcatgccatctgctcccccgt

SEQ ID NO: 6772835 - DNA, 59 bp, Homo sapiens
aggcaacatgggaaaattaacctattagttccattagtagagttgatggtttattgcct

SEQ ID NO: 6772836 - DNA, 60 bp, Homo sapiens
gaggcttgactttaagatgctttttttcagagaagtctcaatctttggctcagaagcctt

SEQ ID NO: 6772837 - DNA, 118 bp, Homo sapiens
tgaggcagtgggttctgcagggtgggatgtgggtgactcctccctgccctgctggtgcgtgtgcaccctggcagggtgtggagttgggacacacacgtgtgtagggctggttgcgtca

SEQ ID NO: 6772838 - DNA, 82 bp, Homo sapiens
cttgttacgtggctcaggctgatctattaatagaattcctgacctcaagcagttctcttgcttcagcctcccacattgcagg

SEQ ID NO: 6772839 - DNA, 78 bp, Homo sapiens
tcttaagcaaaatagggcgtgtctagactcacaattcttaccttgcttaattgaagtgagtcttgcctttgctgtgga

SEQ ID NO: 6772840 - DNA, 74 bp, Homo sapiens
gcaggaccccccgtggccgtgtgcttaactgcatgaacaggtgcagacaagccaggctatggccaggctcctgc

SEQ ID NO: 6772841 - DNA, 99 bp, Homo sapiens
gcggtcctggagggtggacatccaagatcaaggtgccagcagagttggattcccctcaggtctctttccttggcttgcacatggctgctctcctgctgc

SEQ ID NO: 6772842 - DNA, 80 bp, Homo sapiens
ttccctttttgtgttgtacttctgtgcatttgtgccaaagcatgaaatgcaatcaagagtaccagctgcaagctggggag

SEQ ID NO: 6772843 - DNA, 74 bp, Homo sapiens
gttagcagagtccagaaaacagtgtgctccctgatgaaaaggccacggtcactgtcttctgggctctgcctggc

SEQ ID NO: 6772844 - DNA, 67 bp, Homo sapiens
gtcggaggagcaggaggagtatggagggaagactcctgggtggcatgaagctcttgcacctctaggc

SEQ ID NO: 6772845 - DNA, 61 bp, Homo sapiens
cccactaagtaagctcctctacaagctgctactttgtagggcagtttatcttagttgaggg

SEQ ID NO: 6772846 - DNA, 62 bp, Homo sapiens
cgtggggcaggcgggtgtccagatcggcaatgcctgctgggaactgtactgccttgaacatg

SEQ ID NO: 6772847 - DNA, 77 bp, Homo sapiens
gagcagaggcaagcaaaggcaggactgcagcataggcctatgggcttggcctctgtggccctgactctcttctgctt

SEQ ID NO: 6772848 - DNA, 80 bp, Homo sapiens
atgttcatctagccaagattactttcttaattgctgctcatcattagagttgagaaattaattttcatcacagggaacat

SEQ ID NO: 6772849 - DNA, 82 bp, Homo sapiens
ggtaaaaaggtcaagaaactgaacaactgaataaccaaataagtaggcgaaaccatttggttactcagttgtctgaccaacc

SEQ ID NO: 6772850 - DNA, 58 bp, Homo sapiens
ggtggcctgttttcaggtttgcagtgtatgaggcgacaccatctggatactggcctcc

SEQ ID NO: 6772851 - DNA, 55 bp, Homo sapiens
cagcctggccatattctgctcaaaaaaagcaaagaggcagaaagagcccaggctg

SEQ ID NO: 6772852 - DNA, 62 bp, Homo sapiens
agtgctcagtagctgcatgtggttattgatgaccacattgcccagtgcagcttttgagcact

SEQ ID NO: 6772853 - DNA, 77 bp, Homo sapiens
gatttcagcagcctctcctagggccctacctgaccctcaagtttcagggtacatggagcaaatgggactctgaagtc

SEQ ID NO: 6772854 - DNA, 55 bp, Homo sapiens
catcaacctggtatggatgctaccagctgaaacaggtagagtccagggtgaggtg

SEQ ID NO: 6772855 - DNA, 56 bp, Homo sapiens
agtcagagaccctagatctaatttattgtgaggtaaattagggagggattctgact

SEQ ID NO: 6772856 - DNA, 55 bp, Homo sapiens
cagatgtcatttcccatgcagcctatgaacttggttgatggtgggtgatgctctg

SEQ ID NO: 6772857 - DNA, 61 bp, Homo sapiens
ccactgaatgctcgctcagcttccgctgactgttgttgcagaagaatgtaggcataagtgg

SEQ ID NO: 6772858 - DNA, 67 bp, Homo sapiens
ggtggctgtgttctaggagcaaagagtctactagaacaaggcagaaagctaccagaacaaggccatt

SEQ ID NO: 6772859 - DNA, 74 bp, Homo sapiens
ggggcacttaggcattttgctgcaggatttttgatttaaacaatttttcatgctagtatgtgctgttctgtctc

SEQ ID NO: 6772860 - DNA, 120 bp, Homo sapiens
gaaaaggctggatttgggaaggaggtcagatctaccagggtcacagaggcccttggcatggggaatattctgtgattctgtggttatgtagtactgtcattcccagcttgtggctttttt

SEQ ID NO: 6772861 - DNA, 58 bp, Homo sapiens
ccttgccccagtgcactgctttagttgtttgaaaaaggctgccagaaattgggtaagg

SEQ ID NO: 6772862 - DNA, 129 bp, Homo sapiens
cctgtaatacttggtttggttctgtacaactgaagtgaatttttagtgacaagcccatcaacagtgaatttgctcagaggctcactgtctactttagtcctcagttgtcaggatcccatgtggctatgg

SEQ ID NO: 6772863 - DNA, 90 bp, Homo sapiens
ctttgctttgcaaataaaagtagtattagaacatgtatttgccaaaaatatgtgtgtaaacaagtataattttgcaggcataaagcagag

SEQ ID NO: 6772864 - DNA, 70 bp, Homo sapiens
gctcagcactcttgagtggcatgctctaaccaggcccacagctttgttccctgacccctcaaggttgagc

SEQ ID NO: 6772865 - DNA, 76 bp, Homo sapiens
cattaggttagtgcaaaagtaattggagttttaatggcaaaaactgcaattatttttgcaatataagaacttgatg

SEQ ID NO: 6772866 - DNA, 62 bp, Homo sapiens
tatttttctaatattattgttgaaaaatggatgcccatgaaaaaatggtaattagagaaatg

SEQ ID NO: 6772867 - DNA, 78 bp, Homo sapiens
gggacaggcaggtgaaagtgagtagtgagaacaaaatgtgagcaaacaaccttcattactggcaatctgtgtgattcc

SEQ ID NO: 6772868 - DNA, 68 bp, Homo sapiens
atgtaaggcaaaggggaagttatcattctttgacctagattgaattaaccagaattccctctgctcat

SEQ ID NO: 6772869 - DNA, 117 bp, Homo sapiens
tatggtaaaagacagggttattgtgatggaatatagaacatttacaaatccttctgcagaaataaactttgttccaataaggagttgaaattatccatgcggtgccctagtaccata

SEQ ID NO: 6772870 - DNA, 102 bp, Homo sapiens
agaaaggatcatttgatctctctcaggaatagagtggcagcagtttatgctctattctctgaagtgctgcctttaatttatgatagaattagaatgctttct

SEQ ID NO: 6772871 - DNA, 70 bp, Homo sapiens
ttgacactaaacagagatcttaattcctgtatcttcatgcatcagaatttggtcttagtggagatgtcaa

SEQ ID NO: 6772872 - DNA, 79 bp, Homo sapiens
cagcgggcaggaggtacttggggaccctaacttctggtgagacagaagcatccggggctccaggtgccaccccccactg

SEQ ID NO: 6772873 - DNA, 59 bp, Homo sapiens
gttcattctggatgtaggtttgagtttctgttgggggctaatttactcacagaatgaat

SEQ ID NO: 6772874 - DNA, 76 bp, Homo sapiens
tttcagctgctctgttgagctgaaggaagctaggccagtttcagggatacaattcagctcccagggcctgttggaa

SEQ ID NO: 6772875 - DNA, 59 bp, Homo sapiens
ggactgctccagtgtgatttgtcttcatcacccaagtgtgagtctcacccaagcagtct

SEQ ID NO: 6772876 - DNA, 55 bp, Homo sapiens
actttgtttggctattagagtcaagatattcttctctagtgtgctcagtcaaagt

SEQ ID NO: 6772877 - DNA, 69 bp, Homo sapiens
ctgggtatcttcctgggagagtctgtggggatgaaaagttccagagaccagaacatggggatagcccag

SEQ ID NO: 6772878 - DNA, 58 bp, Homo sapiens
gccacaggtggccccgagggagtgggctgatttggcctgagcctccatcccccttggc

SEQ ID NO: 6772879 - DNA, 63 bp, Homo sapiens
aagttgattgcttcaaatttctgctactaacttcaagctatgggagtttggcagtagtcactt

SEQ ID NO: 6772880 - DNA, 82 bp, Homo sapiens
ggggggtacaggaggaggagatccctgagatgggtctggacagattgcccaggtaaggatgctcctcatcccagctcctccc

SEQ ID NO: 6772881 - DNA, 94 bp, Homo sapiens
gccagcattggcccaaaggcatgggatgaacttgatctgcttccttaggagaaggcacactcgagtgtccggtgaaggctatgatgcaaaaggc

SEQ ID NO: 6772882 - DNA, 72 bp, Homo sapiens
aaaataaatgcatgtaggctaaggtgtgtatgtatgcatgcatgcattatttcacactatatcatggatttt

SEQ ID NO: 6772883 - DNA, 55 bp, Homo sapiens
ccacttctccccaccctcccacacctcagttctgcatggttggggagaagcttgg

SEQ ID NO: 6772884 - DNA, 68 bp, Homo sapiens
gaggcgggtggatcacctgaggctgggagttagagaccagcctggccaacatggtgaaaccccgtctc

SEQ ID NO: 6772885 - DNA, 95 bp, Homo sapiens
caacagtagtgggtgagagaagagctttatatctggattcagtttctcataaatgaaataaatgtgtctttttaaggccttccgcatgcctgttg

SEQ ID NO: 6772886 - DNA, 100 bp, Homo sapiens
ggctaattggctgcttccacatgggattctgaaactggagcaagtgaggcaaagcccagggtgcttagaacccattctcagtgagagcagcaggactgcc

SEQ ID NO: 6772887 - DNA, 82 bp, Homo sapiens
cctgaagtcctctattttggtctcattgctcctctttctcagctcctaaagcagtttggacctctgctagatggaccatagg

SEQ ID NO: 6772888 - DNA, 78 bp, Homo sapiens
tcatcttttccaagatttatacagaaattttataatcagagaaaaggtagtgggaagaggggtataaagaagggatga

SEQ ID NO: 6772889 - DNA, 69 bp, Homo sapiens
ctcagtatctccctgtgtgaggtgagataagtattctgtcatcttctattaatagggagaaattctgag

SEQ ID NO: 6772890 - DNA, 77 bp, Homo sapiens
gagatttaagtggaagtgttgtattcgatttctgggaaggctccttaaaatggatagtgcgtcttctcttctgtttc

SEQ ID NO: 6772891 - DNA, 58 bp, Homo sapiens
gtaggctacagaagtcactgggactgagtctgagtttttgacaaactgtagttgttgc

SEQ ID NO: 6772892 - DNA, 82 bp, Homo sapiens
gtggctgatggagagtgtgatttgggcgtaggtcttatttgcaaacctgctcatgttctaagctttcttcaggtagtaccac

SEQ ID NO: 6772893 - DNA, 68 bp, Homo sapiens
atcattgagattttttacaactgctgcactgggtgacagtaacacctgtggtgaaaatttttcaagat

SEQ ID NO: 6772894 - DNA, 66 bp, Homo sapiens
tgttattctggccagcaccgtttggccattgtagaggcctagcacgagcttctggcaggatgcaca

SEQ ID NO: 6772895 - DNA, 68 bp, Homo sapiens
ttgcacgcttgcggttcctgccccttccgtgtgcaaagtaaggaagtcagcaggcggcgagcaagcaa

SEQ ID NO: 6772896 - DNA, 127 bp, Homo sapiens
atgcagtccccttctttttccttggtgactacaggccggcatcagagagtccgatttataacatgggctctacctttgcaatgcagttactttcttttccttggggagagggaaggaaggaagacat

SEQ ID NO: 6772897 - DNA, 84 bp, Homo sapiens
cttggagttgaagttccaggtgcctgttagaatccccatggagccatcaggctggcagttaatacctgaagctccatctccagg

SEQ ID NO: 6772898 - DNA, 65 bp, Homo sapiens
gcactgtgctaggtatcagggataaaccatcaatgtagcaaggtccctgccctcaaggacagtgc

SEQ ID NO: 6772899 - DNA, 126 bp, Homo sapiens
tcacttcttttcttctctctcccttctctcagtgttctcaaatttatacagagttcagagttaattcaccctggattcaacagtagatatgaaatactgagaaggaggataatgtgaaaagattgg

SEQ ID NO: 6772900 - DNA, 85 bp, Homo sapiens
tgtggcttgattatcttaaggaaacatttttccatagtcacaacctagttttatgctggaatgttcttaaagattttctggtcca

SEQ ID NO: 6772901 - DNA, 60 bp, Homo sapiens
gaaacgggccggcggatattggctcggcgacacgccgaggctcctccccgagtctggatc

SEQ ID NO: 6772902 - DNA, 83 bp, Homo sapiens
tcattgacactctacttggggagttttctttattgctttattttggtgagtacagaaagtacccatagaagagaaattaatgg

SEQ ID NO: 6772903 - DNA, 56 bp, Homo sapiens
gagtcaggctagggtgacaggctcagggaagccccacatcctcaatggccttactc

SEQ ID NO: 6772904 - DNA, 80 bp, Homo sapiens
agttaacagagtagcagcactgtgctttaggtcagaggactgaaaaatgaacaatatgcagatgctgcactcaggtaact

SEQ ID NO: 6772905 - DNA, 62 bp, Homo sapiens
gagtttactctttatttcactctgtgctgcacatccttgtgtatgaattaaagattaaagtc

SEQ ID NO: 6772906 - DNA, 74 bp, Homo sapiens
gtctgctgtgggtgtggttcgtttaagacagggtctcactttgtcacccaatgaatgccaccccttaagtaggc

SEQ ID NO: 6772907 - DNA, 69 bp, Homo sapiens
gtggccctgctgacccagtccaggcagggtgtgacaggtctgcccagccctgaggtcacagctgtctgc

SEQ ID NO: 6772908 - DNA, 128 bp, Homo sapiens
agccctgacaggtgccttaccatgtactcttttgttcatttggatgctggcagccgagtgctccatgtgcctggcactggagattcctgtgagtgtgaaaaagacatggcccctgcccttatggggct

SEQ ID NO: 6772909 - DNA, 59 bp, Homo sapiens
ccgaggcggcggccgagcctggctcaccgcaccatggaagctggccggccgccgcccgg

SEQ ID NO: 6772910 - DNA, 68 bp, Homo sapiens
gggtacaagtgcacaacatgcaggtttgttacatatgtatacatgtgccatgttggtgtgctgcaccc

SEQ ID NO: 6772911 - DNA, 100 bp, Homo sapiens
aacatctgctttagaaatgcaccgtttggtttggatttacagctttagtgggttgaaaatttatattaccagaaggtttataaacccctgtgcagaagtt

SEQ ID NO: 6772912 - DNA, 80 bp, Homo sapiens
tctatgtggccaggaaaaggagatggaattagtgggcatctagcccatctctgccacagtccattttactggtcaccaga

SEQ ID NO: 6772913 - DNA, 57 bp, Homo sapiens
ccctaaaagtctcattttccagtagaaaatatacactggtaaaaacggggcatgggg

SEQ ID NO: 6772914 - DNA, 66 bp, Homo sapiens
cctcactgttcctcatcctccaaaacacatactgttattacgggagccagagggatgcagttgagg

SEQ ID NO: 6772915 - DNA, 130 bp, Homo sapiens
gccccaaggacctggggctgcagcgggctcagagtgccaggctgggtgaagccaagggtagcaaggaacccctaggccgtggcttctccagctggctgggttcagagcatctcctccctgttcttggggc

SEQ ID NO: 6772916 - DNA, 59 bp, Homo sapiens
agacaatggagggaaatacttcagctcccttttgctgtcttttgttttcattcattgct

SEQ ID NO: 6772917 - DNA, 72 bp, Homo sapiens
tatcttcattagaaaagtaaaaatgctggagaaccctgggtttgataggcatggagcttcgtggtgaaggta

SEQ ID NO: 6772918 - DNA, 72 bp, Homo sapiens
cactgtccctgcctcaccctaggccaactaatacaaatctcagggcagccagggtggggcaggcccactgtg

SEQ ID NO: 6772919 - DNA, 57 bp, Homo sapiens
tggagtagtgtgtttctctgctatctcggctcagtggatgattttgcactaacttca

SEQ ID NO: 6772920 - DNA, 55 bp, Homo sapiens
gcctgaagttgattgaaggactattaatttgcatggggaggtaacaatttcaggc

SEQ ID NO: 6772921 - DNA, 72 bp, Homo sapiens
cctggaagcggcagattggggttgcaactgacctggctttggctaccctagaccccatctggctgccccagg

SEQ ID NO: 6772922 - DNA, 76 bp, Homo sapiens
gcagagaacataattatcataaactgagaatttttcattttgaagcttatctgtttgtgctaagtatcttgtctgt

SEQ ID NO: 6772923 - DNA, 56 bp, Homo sapiens
gtgacatccgctgacatcgccaccggtctgctttggagggatctagcgagagtcac

SEQ ID NO: 6772924 - DNA, 69 bp, Homo sapiens
tgttggtcttctttgttgctattattttggtccctggaatagtgcccggcacatagggaatgctcaata

SEQ ID NO: 6772925 - DNA, 58 bp, Homo sapiens
tcaagttaggtggttgttaggagtaaatgagttaatgcctgcaaagtgcttagcttgg

SEQ ID NO: 6772926 - DNA, 76 bp, Homo sapiens
cttgcattcaatctctatgttctgtgcagaaatagccagtttttcagaatgtgcaatttagagacttgggagcaag

SEQ ID NO: 6772927 - DNA, 88 bp, Homo sapiens
gaaggaagcagctgttttgacttattcctttgagtttctttaaattaccttagtttcatatgcaaaatagtattaacatgcttttttc

SEQ ID NO: 6772928 - DNA, 80 bp, Homo sapiens
aggcacctcctgcatctaggggcttgcttttgcctggagccaaagccactttgatgatataaaaacgcccaggaggtcct

SEQ ID NO: 6772929 - DNA, 72 bp, Homo sapiens
atcagtagacagcctttgaacttcagaggtttggatccctgcaggcctctgcaactggctgtggctatagat

SEQ ID NO: 6772930 - DNA, 62 bp, Homo sapiens
tcccatttttgactatggtcccgggtttacatggccacggaaacacaggttataagatagga

SEQ ID NO: 6772931 - DNA, 63 bp, Homo sapiens
cacatataaattaccccatttgtgtgcacagacagggcacacactgggcatggtttatgcttg

SEQ ID NO: 6772932 - DNA, 117 bp, Homo sapiens
caggtctctggcttcatcaggtgcactctgagctgcagcaggtggacacactcacctcccagagggtgcaggtgaggaggtggcacctggcttaggttattctggctcaagggcctg

SEQ ID NO: 6772933 - DNA, 79 bp, Homo sapiens
gctaacagtgttcttggcgctgagtgcgatatagaagaaggcacaggatccgcccaaggcacttgcaacctaagttagt

SEQ ID NO: 6772934 - DNA, 68 bp, Homo sapiens
tgataatgtgaatggtttgtgactacctaatggaattcataggtagtcacaaaccattcatatgatca

SEQ ID NO: 6772935 - DNA, 56 bp, Homo sapiens
tggcccgacctctgctcatgcagtattcatctgcacaccaggagccgtctgggcca

SEQ ID NO: 6772936 - DNA, 60 bp, Homo sapiens
gttacccagagaccaggatggcactgtgcaggagacagtactgtccttttgttggaagac

SEQ ID NO: 6772937 - DNA, 65 bp, Homo sapiens
ctctccacagaagaccaagaaagcttccatctctcatggagatctttgttatcttttgataagag

SEQ ID NO: 6772938 - DNA, 81 bp, Homo sapiens
gagtggtgaagccttggctgcttatatgtctgtgggctctggaatcttctacaggaaatgaaagacaagtgtttattactt

SEQ ID NO: 6772939 - DNA, 56 bp, Homo sapiens
aagatcctcagccagtgaggcgccttccctgtgcccagcacattgctgaggacctt

SEQ ID NO: 6772940 - DNA, 119 bp, Homo sapiens
aattggattatgaatataaatagccatgtgctggccccagtggccagtgtgcactcccaggctggtgcttggcagactgggtcctggggaaggcttgggctgtttgtttattttcaatt

SEQ ID NO: 6772941 - DNA, 67 bp, Homo sapiens
agcgaaattttgacagctcgcctttggggtgtatgtcacctcttggctggtcatttaaaatcatgtt

SEQ ID NO: 6772942 - DNA, 55 bp, Homo sapiens
tactccaggactccatttgaaaagacctggttgttcaatgtggagttgtggggtg

SEQ ID NO: 6772943 - DNA, 88 bp, Homo sapiens
tcatgtttactgattacctttgctggtctgctgtgagggcaagggtcttcagaaccagccagaagaggatctagttagatttccatga

SEQ ID NO: 6772944 - DNA, 62 bp, Homo sapiens
cttaacagaagttgttcattgtgggctcagaaggagcccacggatttaatcttcttgttaag

SEQ ID NO: 6772945 - DNA, 56 bp, Homo sapiens
tttagtgtttagaggaggaaagatgaaaaactatctcaaagcttctggacacaaaa

SEQ ID NO: 6772946 - DNA, 89 bp, Homo sapiens
gtgcagttagagggtttcctatgaagagtaggattagatagtactgcttcattattccagttcaccttttcatcattcccttcactcac

SEQ ID NO: 6772947 - DNA, 87 bp, Homo sapiens
ctgggtcttgatcgtcctctctcatgactacttcttttactcccatcaaggtaaagtgtgagtgaaagtagtttgattaaagcccag

SEQ ID NO: 6772948 - DNA, 63 bp, Homo sapiens
tgagagtgcaaattatttacctgatttagattgattaaagtcaggcatgctgtctgcatttca

SEQ ID NO: 6772949 - DNA, 84 bp, Homo sapiens
gtgcatgcactgggccacagtatgaccatgaactccttgaaattatgtacaaagtcatacgtgtgtgtgcctgcatgcatgcac

SEQ ID NO: 6772950 - DNA, 73 bp, Homo sapiens
cgtttttctcttgttcatctgtcttttgttacaaggccttcagccaataacctaagatgggtagaaggaaatg

SEQ ID NO: 6772951 - DNA, 77 bp, Homo sapiens
gcagatttaccatatgtactgagtatctatgatcacctgtaaatacaaggaatgcatatgagtaatgaggagtctgc

SEQ ID NO: 6772952 - DNA, 91 bp, Homo sapiens
actgctggttggatcagggtttctgctgccacctgggcacatgcagcccaccctatctggcagcagacatctgaggtctaacctcagcagt

SEQ ID NO: 6772953 - DNA, 72 bp, Homo sapiens
tgcggtaagtaggaagcataaaagtcagctgtggaacttgactttacagatatgtttcctgagctcattgta

SEQ ID NO: 6772954 - DNA, 59 bp, Homo sapiens
tgtgtgttcccggagatgctgtctggggcccttttcctgaacttctgaggaactgcaca

SEQ ID NO: 6772955 - DNA, 71 bp, Homo sapiens
ttcaactgaaatggccaaatgtgggtgctgatttcggccctgattagttttacatcagccattgttctgga

SEQ ID NO: 6772956 - DNA, 55 bp, Homo sapiens
ccattttccagtgactggtttgctggtacgcaagtaagccagttctagacaatgg

SEQ ID NO: 6772957 - DNA, 86 bp, Homo sapiens
gttcacagccatgctgcttgcatccatgtatgtcagattacctatctttttgctacataccacgatgcagtatcatacttgttaat

SEQ ID NO: 6772958 - DNA, 67 bp, Homo sapiens
tttatagctgtgagaccttgggcaaattacttaacctgtttgtgcctcagatttcaagtcatataaa

SEQ ID NO: 6772959 - DNA, 63 bp, Homo sapiens
ctgcaggggcctcgagcacagggactgcaaccttcctcccgctgcattgtattccccctgctg

SEQ ID NO: 6772960 - DNA, 72 bp, Homo sapiens
gccctaaaaaggccatctttggaatttggagaaccctccagctgtagtggatttgagatggtcacgttgggt

SEQ ID NO: 6772961 - DNA, 85 bp, Homo sapiens
ggatattgaattatatggtacaaaattaggtagtcatataggtcgctgtgatgactttaagctatctgattctaatttaaaatcc

SEQ ID NO: 6772962 - DNA, 58 bp, Homo sapiens
cagcttcattgcctgatgtcttcgggaagtattttgaagtcatcgtggctgtggattg

SEQ ID NO: 6772963 - DNA, 83 bp, Homo sapiens
cttctggcctgcccatcctgcctgccaatgatgcttgtgtggccatagaaaggtctttggcagacaggtgcagatgccagtag

SEQ ID NO: 6772964 - DNA, 57 bp, Homo sapiens
tgtagttgccagcccaagggctgatttcctgtcagttcctgtgtggtttgcactaca

SEQ ID NO: 6772965 - DNA, 72 bp, Homo sapiens
aggggtgctggagccggaccagggacggtggctggatagggtcaccagctggtcagggcttttctaattcct

SEQ ID NO: 6772966 - DNA, 55 bp, Homo sapiens
ttatggctgaataaattatggtatattcgtaccatgaactagtttgcagccatga

SEQ ID NO: 6772967 - DNA, 72 bp, Homo sapiens
gagcagcagacccagagcagagcttggcttcctgcaaggaaatctgcccagtgcactggttggctgctgctt

SEQ ID NO: 6772968 - DNA, 73 bp, Homo sapiens
tgacagacacagagataggcctgtgttttcctgcttccactgctctcggcagggcttgtctctgtgatgtaca

SEQ ID NO: 6772969 - DNA, 87 bp, Homo sapiens
tcctatccaaattaaatgtatatttcttattgagatggcatatattgtgtgtcatattagtattgagagttcattataatcggggga

SEQ ID NO: 6772970 - DNA, 60 bp, Homo sapiens
agggacatgatttcagggaattctcactggggtccattgtgaaatttgaggtcagtgctt

SEQ ID NO: 6772971 - DNA, 71 bp, Homo sapiens
ctctacccctggatgactcaggaaaaacaacgcaaggagtggaggtggcttcctgggtggtcctggtagag

SEQ ID NO: 6772972 - DNA, 74 bp, Homo sapiens
tgataagccatgcctaaataataagtgttgtcaaagtagtcagcactaaatatttgagaggtgtaggctgaaca

SEQ ID NO: 6772973 - DNA, 72 bp, Homo sapiens
atcactgcaaggactagtaaatgaattagaccgaagctgccttattactcaagatactggtccttttatgat

SEQ ID NO: 6772974 - DNA, 61 bp, Homo sapiens
aaggggagtcaggctccctcagagactggaaagtctgggtgagcaactgactcggcccctt

SEQ ID NO: 6772975 - DNA, 87 bp, Homo sapiens
ctgttattattgtcatcagcatccagcatcctatagaaaaagagacacttttttctacaggttgatgggtttggtgacttgtttcag

SEQ ID NO: 6772976 - DNA, 79 bp, Homo sapiens
ggtctgggggcttaggctgggctttggtgggagccaccgctgtgatggcccctggcaccaggctgattcctaccagact

SEQ ID NO: 6772977 - DNA, 71 bp, Homo sapiens
actccctgcaagattttccatgtcaacctccatctaaatgatatctctcggaatatttttcagaagggagt

SEQ ID NO: 6772978 - DNA, 57 bp, Homo sapiens
gggcggtgcctgtctccgaagcgaggagcggattggcttcacggaggccgcgccccc

SEQ ID NO: 6772979 - DNA, 100 bp, Homo sapiens
tgaggcaggagattcacttgaacctgggaggcggaagttgcagtgagccgagatcgcgccattgcactccagcctggtgacagagtgatactccatctca

SEQ ID NO: 6772980 - DNA, 62 bp, Homo sapiens
tagacaaggaggcaggatctggggagttttacagaggctccaggcaatgtttctgaactctg

SEQ ID NO: 6772981 - DNA, 67 bp, Homo sapiens
gagatttcagtgcattgcctcccctgggtgctcttcatcttgggtaagcagttgctttgaatttctt

SEQ ID NO: 6772982 - DNA, 78 bp, Homo sapiens
ggctaattgtacattcagcttagcacttctagatgcaattgcctctacggactcagtcagttgaaggtgaagttagct

SEQ ID NO: 6772983 - DNA, 58 bp, Homo sapiens
ggaataaaaggaggtggcgagaacgttcttgcctaaaccattccccttcctttgttcc

SEQ ID NO: 6772984 - DNA, 56 bp, Homo sapiens
ccttggagagtgtgaggctctgggctctgaatgcccagaccttgtgctgcccttgg

SEQ ID NO: 6772985 - DNA, 57 bp, Homo sapiens
caggcattgttctaggttctcaggatagagtgtcaagcaagacctaaacgatccctg

SEQ ID NO: 6772986 - DNA, 55 bp, Homo sapiens
gcataatcagagttagttcagtgttaattattttgagagatgaactctgatatgt

SEQ ID NO: 6772987 - DNA, 73 bp, Homo sapiens
ggtgcctggggcatgcaaatgtgggtgaccttcgtctcaggtagggaccctcagcttggatgtcatgggtacc

SEQ ID NO: 6772988 - DNA, 87 bp, Homo sapiens
gtaattgttaacactattattttcacagtaaataattgttacagccatttgctggtgaaatagtgacatgttttgttgacttcttac

SEQ ID NO: 6772989 - DNA, 79 bp, Homo sapiens
agatgttatcagggagctggagttggagtacttgcattttgtgtttgtgccagctgtccatgttcctcttcatatattt

SEQ ID NO: 6772990 - DNA, 93 bp, Homo sapiens
tgataaggtggaacaggtgaatgacaaccacaatggtgctggggttaatttcctttaaccagtaggatgtcactttcctttttactgttttca

SEQ ID NO: 6772991 - DNA, 57 bp, Homo sapiens
gttttcatgtctattgggcataaacctaaaagtggcattgctgggtcatatggaaac

SEQ ID NO: 6772992 - DNA, 66 bp, Homo sapiens
ctccctggtctttcccatcattctcttattgacggaggcaactggtggagtggagaggcaggggag

SEQ ID NO: 6772993 - DNA, 74 bp, Homo sapiens
gatgagtaaaggcagggccccttcctcccttgagagaaatcaacaggggatcagattccctgtcccaactcatt

SEQ ID NO: 6772994 - DNA, 85 bp, Homo sapiens
ccttgaagtataatatggcatatagtccagcataaacatacacacccatccttgtgaggttattatgcctattatacagacaagg

SEQ ID NO: 6772995 - DNA, 59 bp, Homo sapiens
cacaaaatctttctcgattattttatgttatgtaatgtgattgtcatgtggattttgtg

SEQ ID NO: 6772996 - DNA, 68 bp, Homo sapiens
cagaatgtgaggttgtatgtgaaaatgacaagttgaattgttgctttcacaatgcaatcctacttctg

SEQ ID NO: 6772997 - DNA, 79 bp, Homo sapiens
tgagaaaatacatcctgtcatacaagactccttcctgaagataattttgtcactgtatgtaaagaaggatattttccca

SEQ ID NO: 6772998 - DNA, 63 bp, Homo sapiens
cctcataccctgaagggagttgccatggtgactgtgggactgtgacctccagggtagctcagg

SEQ ID NO: 6772999 - DNA, 70 bp, Homo sapiens
cagaagccagtgaagagctgttgcagagatttaagtaaagggatccctgaatcagccttgcatgtagttg

SEQ ID NO: 6773000 - DNA, 75 bp, Homo sapiens
ccaccatggccatgctcggagaactgggggctccgggaagatgtcctggggcctgggattttgacagccaggtgg

SEQ ID NO: 6773001 - DNA, 61 bp, Homo sapiens
gggcatgggccagtagtccatgatggaggtgatcttttcttccctcctcctctggcctccc

SEQ ID NO: 6773002 - DNA, 59 bp, Homo sapiens
ctgtcctagagacatcagatgttctatgttagaatgggtttcatgtttctattggatgg

SEQ ID NO: 6773003 - DNA, 104 bp, Homo sapiens
tgattattaaatgataaaataagtgtgggccagtcaaagaggttctgactttttttccccagaatggccattttcaacatatatatttttaatttgaataatca

SEQ ID NO: 6773004 - DNA, 67 bp, Homo sapiens
ttctgctccaagtgcacacacatcctgtgcccaggagctgggcttgggtgggggtgcaccggcagaa

SEQ ID NO: 6773005 - DNA, 76 bp, Homo sapiens
ttccatattgcctcttatggtttgtcagggaaggagcaactaaatcaaaacctgatcaaagaggtcagcattggga

SEQ ID NO: 6773006 - DNA, 93 bp, Homo sapiens
tctatttctttgtctctgtacagtgggtgtagggaccagccccacagggtcggcgggtttttctccccatgtgtggagacaagagattgtaga

SEQ ID NO: 6773007 - DNA, 67 bp, Homo sapiens
tcctttccacttttctctctcatgccttttgctcttccctggaggtggaggagagaagtggagtaga

SEQ ID NO: 6773008 - DNA, 120 bp, Homo sapiens
tgtcctaatatatcttatagtgcttgcaaatttgattttcttaaaccatacatggaatacagttgtttgtcaagggttaaaaagcattgcaagttctgaagtaaacatgtacaaaggtca

SEQ ID NO: 6773009 - DNA, 71 bp, Homo sapiens
gccccctggcaccaccagacaccaggagggcactgctgctcttaattgaaagtcttggtgcaggtgagggc

SEQ ID NO: 6773010 - DNA, 61 bp, Homo sapiens
acagtttcaaattactgcccatggattgttcttgacatcccgaatggtaaatttgagctgt

SEQ ID NO: 6773011 - DNA, 64 bp, Homo sapiens
tctgaatagcttcctggattctggacagcctgggcaatgggcggaatcgggaggcgaaggcaga

SEQ ID NO: 6773012 - DNA, 71 bp, Homo sapiens
tagcagagcagggatcagagcctgggctgtcaggcccgttaactggccatggtcaccaatatgtcgtgcta

SEQ ID NO: 6773013 - DNA, 69 bp, Homo sapiens
tgctcttcgtacagctgcagagctagcaaactgggtgcaactggctctaaagagaatctatgcggagca

SEQ ID NO: 6773014 - DNA, 63 bp, Homo sapiens
caaatagattgttcaatcctgatgaaatgcacaaaaatattgggttagtgagctttttatttg

SEQ ID NO: 6773015 - DNA, 58 bp, Homo sapiens
ggtcactttaccccttggagcctcagctgtggggaggattcatgggagcaaagaggcc

SEQ ID NO: 6773016 - DNA, 65 bp, Homo sapiens
gcctaggaaggggctgggacccaacttggacctgaagagtcaaggtcaaagctcctgtcctcagc

SEQ ID NO: 6773017 - DNA, 86 bp, Homo sapiens
tcccatttcctttgtcgttgattggtttaggtatgggtaatgtgatttaatcctggacaatgagatgtcaggggaaatttgtagga

SEQ ID NO: 6773018 - DNA, 61 bp, Homo sapiens
caactcagaagatataatgactcagacagactttagtctgacttatttcctttttgggctg

SEQ ID NO: 6773019 - DNA, 58 bp, Homo sapiens
gcaattgtgtgtgtatgtgtgtgcacatgtgtgtgtctacaaacgtgtacacatttgt

SEQ ID NO: 6773020 - DNA, 58 bp, Homo sapiens
atggcctccttcagcattacaatgcagtctcctcaattgctttgccaaaagaggccat

SEQ ID NO: 6773021 - DNA, 88 bp, Homo sapiens
gctgaggtgtcctgggaagtcagctccccaggtcccccgcccaagcaggctgaccttcctgacgctaaggattcaccaggaccccagc

SEQ ID NO: 6773022 - DNA, 62 bp, Homo sapiens
gttccaagcagacagtaggcctagaaatgacttccatttctccccatactttcttttgatgc

SEQ ID NO: 6773023 - DNA, 79 bp, Homo sapiens
tctatagaaggcgaattagagatcgcaataacgggccagcttccatgatgaccccaggttgtagtgatgtctatgtaga

SEQ ID NO: 6773024 - DNA, 66 bp, Homo sapiens
ggaatttttctggaagcaattatactagaaactcactatataattttcttgccagagaaacaagcc

SEQ ID NO: 6773025 - DNA, 61 bp, Homo sapiens
ggccttcagcgccttcaccaccagcgccttggccagatgctggccggccaggtgctgagcc

SEQ ID NO: 6773026 - DNA, 56 bp, Homo sapiens
ctgtgagatatgcatatgctctccctttctgcaaaggaggacatcagtacttacag

SEQ ID NO: 6773027 - DNA, 76 bp, Homo sapiens
ccctgtgcactatctgcatttttaatgatttggttacttttgtagttatatttaagaagtccagtgtgtatcaggg

SEQ ID NO: 6773028 - DNA, 99 bp, Homo sapiens
tgagtaggtgtagaatgaattattttttgtaccaggttggggctaggaaggagcagaggttcagctagctctagcactggataatccttctcctgccca

SEQ ID NO: 6773029 - DNA, 66 bp, Homo sapiens
ggtttagtggtctggctcaggagctagccttttgtggttcatctcctggctctgccacttactacc

SEQ ID NO: 6773030 - DNA, 81 bp, Homo sapiens
ctgaggtcatggggagctcgtggcagaaaggaatagaagcttccatctggctggcttctctgttacagccccctgcctcag

SEQ ID NO: 6773031 - DNA, 62 bp, Homo sapiens
ctcttcactggtcctaggttcagtctctgccaacacagagctgccccaggcctcgggaggag

SEQ ID NO: 6773032 - DNA, 72 bp, Homo sapiens
ggaaactcaatctctgggggtcagagtccacttcctggggagcccaatctgtgacccctaggagtggggacc

SEQ ID NO: 6773033 - DNA, 69 bp, Homo sapiens
atttagcagcagtggtgtatttagatacttccccacttgtggaagtctgattagctccatttgctaagt

SEQ ID NO: 6773034 - DNA, 70 bp, Homo sapiens
gctgattctgtcttctgtgaaagcaggtggaaaagacgttctgctgcattccacagaagggaaaacaggc

SEQ ID NO: 6773035 - DNA, 91 bp, Homo sapiens
gtgatgggatatgaaggcttatgtgtgactttcgcgaggctgtgtatgcatgtgacagtacgtgtgtgaggatcttcgtgtgattgtgagc

SEQ ID NO: 6773036 - DNA, 63 bp, Homo sapiens
aggagacataactatgatgagagagtcccttgaggccaagggtaatttcaaggtagagtccct

SEQ ID NO: 6773037 - DNA, 63 bp, Homo sapiens
agaagggcctgggagtcgtattctctgcatcgcctcagcacaggggatcttccaggctctcct

SEQ ID NO: 6773038 - DNA, 65 bp, Homo sapiens
tgtagaaattaggaaagtaacacttatgtgacactcagaggtgccattgcttgccagtttgtata

SEQ ID NO: 6773039 - DNA, 55 bp, Homo sapiens
tttgttttattggggaaaatgatttttgttcatgttctttttctgataaaacaag

SEQ ID NO: 6773040 - DNA, 82 bp, Homo sapiens
accgaggatgtttagcttttgagaatgatttctgtacaaaatggttaaaagaaaacaaagcaataagtcaaaacattttggt

SEQ ID NO: 6773041 - DNA, 64 bp, Homo sapiens
gcttccttctttctttagtcttagagaaatgctttattatagtctttacagaaaggcaggaagc

SEQ ID NO: 6773042 - DNA, 61 bp, Homo sapiens
gggctgccagtgggtgtgcagagacttgatgtcaccagtctagtctgttctactggtgccc

SEQ ID NO: 6773043 - DNA, 127 bp, Homo sapiens
cagcatcacctgggatcctatgagaaatgcagattctcaggctccaccccgccagaccttgtaaatcagggtctctgggagtagggcacagcaatctgtgttttcagaattcatccaggtgattctg

SEQ ID NO: 6773044 - DNA, 61 bp, Homo sapiens
gccctctgcacagctctgagcaggagtgtctgatctggcagcgacctgctgtgcagggggc

SEQ ID NO: 6773045 - DNA, 69 bp, Homo sapiens
ggggagaaagttgttttagccaaacctcctgggggagtccatctggtccaggctgtaacaacttacccc

SEQ ID NO: 6773046 - DNA, 70 bp, Homo sapiens
ccaatgcaaaacctctctataggaatacttgaacaatcttggtgcctaggattcctatggagtgtgatgg

SEQ ID NO: 6773047 - DNA, 126 bp, Homo sapiens
ttgtattttaattccttggccttactctttcaggaaagttgagcaggtaaaagaattcatttatacagttaaataagaactccatttactcgtgctctcctcggctgattttaaaggcagatataa

SEQ ID NO: 6773048 - DNA, 72 bp, Homo sapiens
gggtgcaatgggatgatcacctgagctcaggaagccaagtcttcagtgagccaagatcatgccgttgtgctc

SEQ ID NO: 6773049 - DNA, 60 bp, Homo sapiens
tgattatattctaacttcataaccctttaactggggtttgtgaagataggatgtatatca

SEQ ID NO: 6773050 - DNA, 60 bp, Homo sapiens
ttgaaattcagtgttcttcccgtaacccagttagggatcaagaaaactactgagttgcag

SEQ ID NO: 6773051 - DNA, 63 bp, Homo sapiens
gcctctgcatttccaggagggcttcctgactctggggaaacatgggcttcctgatgcgagggc

SEQ ID NO: 6773052 - DNA, 55 bp, Homo sapiens
tcaatttgcatgtgtctatatgtgtatatgtgctgatataggcatagtaaaatga

SEQ ID NO: 6773053 - DNA, 60 bp, Homo sapiens
agaagggaggtgggaggtgcggaggggatggtcctgtctgtggcttcctatttcttggct

SEQ ID NO: 6773054 - DNA, 63 bp, Homo sapiens
agtataagtttttgagaatttactatgtgccaagcgcttgggatatggctcagagctggtact

SEQ ID NO: 6773055 - DNA, 59 bp, Homo sapiens
cttggcatctcttggtcaaatcaattcccagggcttttataggaccaggagaaaccagg

SEQ ID NO: 6773056 - DNA, 68 bp, Homo sapiens
tggctgctttaagatgacaaagaaggtaggtgctgctcctgccactgttccaccatcttgattagcca

SEQ ID NO: 6773057 - DNA, 63 bp, Homo sapiens
tccctgggtcattctctggcacaacctaaaagtggaagtgcagaaatctcaatgtcccgagga

SEQ ID NO: 6773058 - DNA, 69 bp, Homo sapiens
ccctgttctcagcatcttcaactttggggctgcctgagaaggcaagcgcagaagcggaggaaggaaggg

SEQ ID NO: 6773059 - DNA, 56 bp, Homo sapiens
ggtagggggcaagagttgggtggacttgagagtgggatgcccagagccctcttatt

SEQ ID NO: 6773060 - DNA, 57 bp, Homo sapiens
tgagtgtccttttatgtgactggttttgtaaagccttacactgtgaatggaccgtca

SEQ ID NO: 6773061 - DNA, 81 bp, Homo sapiens
gcaggctatgtggttttaggactgcatcccaccaactcagatgctgatgtgggcagcctgtccggagaccccacagactgc

SEQ ID NO: 6773062 - DNA, 76 bp, Homo sapiens
gcattcttaagaaagcccacccagaagatgttaattaagaaatattgatattttcccagggttttctcattaatgt

SEQ ID NO: 6773063 - DNA, 59 bp, Homo sapiens
ggtggcatctcagttcatgggcacagtgtgattgtttccatttagcatgcgatgtcatt

SEQ ID NO: 6773064 - DNA, 67 bp, Homo sapiens
ggacagatatatttaaggtaataagtttggttgaaatatctaatttatgacagaagatatgctgtct

SEQ ID NO: 6773065 - DNA, 60 bp, Homo sapiens
agatgtgaagtccagagaagtcagggtgggggccctgatccttgctctggttccacttct

SEQ ID NO: 6773066 - DNA, 70 bp, Homo sapiens
caagtcaattattacggttctgagacattgaacccagaaaatcatttcagagtcaggaatgcttgatttg

SEQ ID NO: 6773067 - DNA, 105 bp, Homo sapiens
aatccaaatgattacagatagcacttaaattagttgacctgtttgggagattttattacttccaatcaggataataattagagtttgctaataaaattttggatt

SEQ ID NO: 6773068 - DNA, 73 bp, Homo sapiens
tgttaaagtttggcagacaataacacaaaaaaagcaattttacctgctacagtgtctgtctgcttacttgata

SEQ ID NO: 6773069 - DNA, 59 bp, Homo sapiens
gggctgggctcactcctcacactcactccctggagtgtgcctgagtctcggcccacccc

SEQ ID NO: 6773070 - DNA, 93 bp, Homo sapiens
tagctgggaaaggatgaaacatctattttctgtgaggtatcaaccacaagggaagatacacctttttagaagattttattttgatgccagcta

SEQ ID NO: 6773071 - DNA, 71 bp, Homo sapiens
gatttatcaactgttattattttgcatggttttctgttcagaaaccatggaaaggataaaggcattgagtc

SEQ ID NO: 6773072 - DNA, 77 bp, Homo sapiens
atgaatgtccattctatgttcagcactgtgctaggtgttagggagagggcagtgaacataacacagaaggttttcat

SEQ ID NO: 6773073 - DNA, 85 bp, Homo sapiens
gtggccctaaaaagtagatacacttgttccttccactgttagatgatagaggcacagagtggttgtataacttgcttaaggtcac

SEQ ID NO: 6773074 - DNA, 65 bp, Homo sapiens
ctgcccctggctttacctcactggggctcatcccctggaagagactcagatggagcctggggcag

SEQ ID NO: 6773075 - DNA, 69 bp, Homo sapiens
tttggggttgcttgtctttttgagtcatagaacttctttatgtattctgagtacaagttcttttccaga

SEQ ID NO: 6773076 - DNA, 62 bp, Homo sapiens
agaaccctggaggaggcatagtaagcaaggcagagactgtgagagtttttctaggaggttct

SEQ ID NO: 6773077 - DNA, 101 bp, Homo sapiens
tccatctgtctgtctggtattcctggagcttggtcacgctgcgggagctctggcttgcagctggcagggcccggggttgaagggacagctcccagcatgga

SEQ ID NO: 6773078 - DNA, 58 bp, Homo sapiens
acctaggctggagtgcattggcgtgatctcggctcactgcaacctctgcctcccaggt

SEQ ID NO: 6773079 - DNA, 58 bp, Homo sapiens
cacgcgtgctcctcagtgtcctctgtctccaggcatgggctgctgggagagctgcgtg

SEQ ID NO: 6773080 - DNA, 60 bp, Homo sapiens
gggttgggacatgtaagctggaagtggctgctgtcagttttcttcattctcccacaatcc

SEQ ID NO: 6773081 - DNA, 92 bp, Homo sapiens
ggaactaattttggaatttgttgatagacacaggatagtgttctcttcccactcactgactgtggatggcagcagccagggaattagatacc

SEQ ID NO: 6773082 - DNA, 66 bp, Homo sapiens
gcaggtggagctcagcaaaggtctgtgtggaggctacacatgggctttggtgagggatctccttgt

SEQ ID NO: 6773083 - DNA, 72 bp, Homo sapiens
catagtgttgtgagtcgtaaatgagaccatgcctgtaaggcacctggctgagttcctggcacacggcacttg

SEQ ID NO: 6773084 - DNA, 93 bp, Homo sapiens
aatgtagtataattgttagtaaatgcagtacaaattgttctactgttttaaaaagttttccgcagaacagtgcatttatggcaatgctatgtt

SEQ ID NO: 6773085 - DNA, 84 bp, Homo sapiens
gctgaaataaattgtcaaatatatgcaaaactattcaatataaaaagaaagtaaaatgtaatgtttgaaattgtttgttccagc

SEQ ID NO: 6773086 - DNA, 65 bp, Homo sapiens
ataactggttaaactatctgtgtttgaagttttctttctggaaaatatatagaagtacccgttgt

SEQ ID NO: 6773087 - DNA, 121 bp, Homo sapiens
cattgcagtggtccctacaccttgaagagcatcagaatcatccggggaatgcagtaaaaacacatggactcagccctgttctgttttagtagcttgccagggtttgagaaccactgtgatg

SEQ ID NO: 6773088 - DNA, 63 bp, Homo sapiens
ctggagctgttttttcaggaaatcagtccctactgcctctcttcctggagcacagctatccag

SEQ ID NO: 6773089 - DNA, 79 bp, Homo sapiens
gctaaattttaccaaggtcttttaagtcctttggctgaaacaggtattcaggacagtataggctttaggagaatatggt

SEQ ID NO: 6773090 - DNA, 68 bp, Homo sapiens
ggatctgtctttgagatctcagcctgaatatgtcctctcataaaggccctgagcatccgagggcatcc

SEQ ID NO: 6773091 - DNA, 64 bp, Homo sapiens
gacggtaagaggaaaagctccaagtaaggaataaacctaacttcagcgagttctcttaattatc

SEQ ID NO: 6773092 - DNA, 63 bp, Homo sapiens
gaatacatggcttttttagtctgtctaggaagacccttaacagaatagttggccctgctattt

SEQ ID NO: 6773093 - DNA, 80 bp, Homo sapiens
gctcttggaactcagtcaccatgctgtgaagaagccctggccacatggagaggccacatgcaggtgatctggtcaatagc

SEQ ID NO: 6773094 - DNA, 55 bp, Homo sapiens
gatctcagagtaactgaggggcagagagtgatttcaccccagataatctgatatc

SEQ ID NO: 6773095 - DNA, 63 bp, Homo sapiens
gcggtggacagaataggaattgaataggcatgatgcgcctttgtgtctgtgttctgtcattgc

SEQ ID NO: 6773096 - DNA, 82 bp, Homo sapiens
gaattacactgtaggtggcaggcagcttctaggatggccccaatgatccctgcttcctgatattcatactgttgtgtaattc

SEQ ID NO: 6773097 - DNA, 63 bp, Homo sapiens
gcaatgaaaatgaggactcctgtaagcaagcaaagcgcgcgcggctgtcattatttccgatgc

SEQ ID NO: 6773098 - DNA, 60 bp, Homo sapiens
ggaggctccggtagtagccttgattcaacattttgttcagtaatgtttatgggggcctcc

SEQ ID NO: 6773099 - DNA, 111 bp, Homo sapiens
tatactttaagttctagggtacatgtgcacaatgtgcaggtttgttacatatgtatacacgtgccatgttggtgtgctgtacccattaacttgtcattcatattaggtata

SEQ ID NO: 6773100 - DNA, 59 bp, Homo sapiens
ggcacaatatggcctcttgggaggaaatagagacagactcggagaggcccggctgtgcc

SEQ ID NO: 6773101 - DNA, 60 bp, Homo sapiens
tagaggggaagggagggtggctggcttcaatttttagcacatcatcacccctcctctcta

SEQ ID NO: 6773102 - DNA, 61 bp, Homo sapiens
gttagataagagtaggccgtatgatcctatctagaagacggcatgcctgctggtatctggc

SEQ ID NO: 6773103 - DNA, 58 bp, Homo sapiens
caggtacccaggctctttccaattatgactcttccatccttagagccttggagtcctg

SEQ ID NO: 6773104 - DNA, 56 bp, Homo sapiens
tacaggcaaatatactaacatcccagttaaaacaatgtttagtataactgcctgtg

SEQ ID NO: 6773105 - DNA, 64 bp, Homo sapiens
tgcactatatagtatggtatatatactatatacatgctatgtatacactatgctatatggtgta

SEQ ID NO: 6773106 - DNA, 68 bp, Homo sapiens
tctaagccgcaagcctatctgtcatgatctagcatgcacatgataataacaggcttgccaggctagga

SEQ ID NO: 6773107 - DNA, 55 bp, Homo sapiens
ccaaaggtaaaacgcatgcccagtcatcattatgggtattctgtgtcacctttgg

SEQ ID NO: 6773108 - DNA, 59 bp, Homo sapiens
tcctagagtctcataacaagtcaactgaatgtttattgtgtttgaatgaggctccagga

SEQ ID NO: 6773109 - DNA, 72 bp, Homo sapiens
gccccttaatgttttcgatcatttcacagtatgaacgctttgggcatgcatagatggtggaaagcaaggtgc

SEQ ID NO: 6773110 - DNA, 99 bp, Homo sapiens
gggatggggccaggagctgggcaggagtgtgggtggaggggcctggaacctgcctcagcagctgctccacttgcttaatcccacctggaaccttgtccc

SEQ ID NO: 6773111 - DNA, 67 bp, Homo sapiens
acctcagaaaatgtcatagtggctatttcactctataaagttgaataggcattacatttcctgcagt

SEQ ID NO: 6773112 - DNA, 67 bp, Homo sapiens
ctgggtttcagacacagcgctgggaaatgctttggtatgtagttgtcacaatgtctctgggacctag

SEQ ID NO: 6773113 - DNA, 62 bp, Homo sapiens
cccagagtccttgcccagccccatctgtgaaatgggcagagttgctgcagagtattcttggg

SEQ ID NO: 6773114 - DNA, 58 bp, Homo sapiens
tgaggaagaacaagaatttagagatgggtctgattccagaatctagtgttcttgctca

SEQ ID NO: 6773115 - DNA, 59 bp, Homo sapiens
tcacttccctcttcagctcccacacctccatctggagcccagttggggcagggaagaga

SEQ ID NO: 6773116 - DNA, 72 bp, Homo sapiens
gcagctgctcagcctggccaggggctctgggcccatagggcagtcctggggaccaggctgaggacgggctgc

SEQ ID NO: 6773117 - DNA, 59 bp, Homo sapiens
tgtccatagttcgtttatccgtccatgccaaatggattatggggaaggtgactgggaca

SEQ ID NO: 6773118 - DNA, 100 bp, Homo sapiens
gaggcctggatcttgtccacactaagcgatggctttactgcggggagataatccttctggaaacctcaggtagagtctgcatggggaatgagatggcttc

SEQ ID NO: 6773119 - DNA, 92 bp, Homo sapiens
gctgcctttgctcaggcacacaggctccctgggcggactctacctgcccagtctcttctggccctgtggcctttgatgcacacggttccggc

SEQ ID NO: 6773120 - DNA, 88 bp, Homo sapiens
gctccaattttgcttcagtgactcagagctgagtctgaatgcctcaaagcatgggtaaaaagagctatgatcaaggcagggttggagt

SEQ ID NO: 6773121 - DNA, 65 bp, Homo sapiens
agtcagacagaaggaaggccaacatctgactgagtgcagatgctggctgcttctttctctccact

SEQ ID NO: 6773122 - DNA, 86 bp, Homo sapiens
tgttttctttttcttcttagtacatttgggacaataagagaagacttatttgctttttaatgttccatgtgagatttaagggaaca

SEQ ID NO: 6773123 - DNA, 75 bp, Homo sapiens
gggttcatggcagggagtggctggcagaaagctgggaaagtacgctagtcctggcagccctcctggcctggactt

SEQ ID NO: 6773124 - DNA, 101 bp, Homo sapiens
ttctgggtatttttagagaggtttactgagggtgctggttttctccacccattgagataactggagctaacagtagaagactcagaaagggtcacttagaa

SEQ ID NO: 6773125 - DNA, 79 bp, Homo sapiens
ggtgtatagatctgtgcccgagtgtgtggagctttgagtatagatggtcacaaagctctggggtacacatctgcatacc

SEQ ID NO: 6773126 - DNA, 77 bp, Homo sapiens
cattggtgggcacaggggagaagtttgcatgtgatgagcaaggttaatactacttttccttattcctgcttactgtg

SEQ ID NO: 6773127 - DNA, 65 bp, Homo sapiens
tgttatgctaagtgagaaaagacagtctcgaaaggtacatactgtatggttccacttatatgata

SEQ ID NO: 6773128 - DNA, 59 bp, Homo sapiens
ccaaagtccatagtgtatattagggttcactcttggtgttgtacagtctgtgggtttgg

SEQ ID NO: 6773129 - DNA, 58 bp, Homo sapiens
gcgattaatgagctagatgatcctgtaattgttcaggttcatccagctcattaaaagt

SEQ ID NO: 6773130 - DNA, 65 bp, Homo sapiens
ctttaagcccccaggaaggtgtttgaggatgaggactagcagcaccagcgtgggggccgttgagg

SEQ ID NO: 6773131 - DNA, 64 bp, Homo sapiens
gcaaccaagagactcctgtacacattttagttttgtgatgctggaattttgctcttgcaattgc

SEQ ID NO: 6773132 - DNA, 62 bp, Homo sapiens
acaatttggttacttccttagaattcattttagtggtgtgttttctctggatagccagatgt

SEQ ID NO: 6773133 - DNA, 55 bp, Homo sapiens
gcacatccaatgattgttttgaccaacagtggtcagtgacgtaaactgcatgtgc

SEQ ID NO: 6773134 - DNA, 76 bp, Homo sapiens
acttagctttgtacttgttctgtttccttgaggctagacacagtgccatccaggacttattacagtataactgggt

SEQ ID NO: 6773135 - DNA, 71 bp, Homo sapiens
gctgttacagaacactgaagaccaggtaatttgtaaggaacagaaatctattatttcagagttctggtggc

SEQ ID NO: 6773136 - DNA, 60 bp, Homo sapiens
gcatccttaactctgtagatgcttatggtttggggataattgcaattgggttagggaagc

SEQ ID NO: 6773137 - DNA, 89 bp, Homo sapiens
tctgggttcaagtagagatgggtctcccttagcacctttgccttcttcacacaagggctaatctgccacccatgtctatcgacctcaga

SEQ ID NO: 6773138 - DNA, 63 bp, Homo sapiens
gaatctgctttaaaaccctcagctggtcagtgaattactgccagtttatctttagtgtagatc

SEQ ID NO: 6773139 - DNA, 61 bp, Homo sapiens
cttcacttcacagatgccaagattcctaagtaaagggaaagctgtggcatcttgaaggagg

SEQ ID NO: 6773140 - DNA, 64 bp, Homo sapiens
gtgcttcaactatacatatttacatagacgtaaacatgacctatgttgtttgtgtgggctgcac

SEQ ID NO: 6773141 - DNA, 61 bp, Homo sapiens
tacagtagacaggaccacaggcatgagtgttagactgggctggggttaaactgtcactgtg

SEQ ID NO: 6773142 - DNA, 70 bp, Homo sapiens
cccagagcaattctcacagaactctactaggagctgtcagtttcccatagttctgaatgaggaatctggg

SEQ ID NO: 6773143 - DNA, 103 bp, Homo sapiens
gtccattctgcctactctacctccatcagcactcagccttccttctccttgaggagaatgcagatggctggtgtatgactgagaagggtataggataaggggc

SEQ ID NO: 6773144 - DNA, 55 bp, Homo sapiens
agtgccagtgagacactttcagaaacatgtctgagggttactttattaggcagct

SEQ ID NO: 6773145 - DNA, 72 bp, Homo sapiens
ctgctccagcccctggtgcacagggtgatgagcaattaaacaggtttgctttgtgctactgagttggggtgg

SEQ ID NO: 6773146 - DNA, 84 bp, Homo sapiens
actaaaggattttcagttgtgccggcccctctgtctactagatccccaggcagaacagctgcaaaacttaatctagcttttggt

SEQ ID NO: 6773147 - DNA, 58 bp, Homo sapiens
atctgcatcagactttgcatgagcaagaaatacttttatcatgttagtctgctgagat

SEQ ID NO: 6773148 - DNA, 74 bp, Homo sapiens
agaggtaccgcaaattcattcagttgaagaaaatccagtgagttctataattaaaatgaaggcattgtatctct

SEQ ID NO: 6773149 - DNA, 74 bp, Homo sapiens
ggagatctcagttttataatcacaaggaaatgaacttcgccaaccacttgaatgaataaggacttggaatctct

SEQ ID NO: 6773150 - DNA, 86 bp, Homo sapiens
gtctacttcatccaagcagggctaggctagggctgcaaagatgagtgagtctgcaaagaagccacagtcccagggtgaagttaggc

SEQ ID NO: 6773151 - DNA, 57 bp, Homo sapiens
ttgcctggccaggaggtaaccagatggtgcacctgcaccctccccttggaccagcaa

SEQ ID NO: 6773152 - DNA, 129 bp, Homo sapiens
tgtttcttgtgtttatttgatttgtctaattaaggccattggtatttatgaaagcgtttccatggaaacaatgtctaaggtgcacagctggttccaaatggacttgtttcagacacagaacaggaagca

SEQ ID NO: 6773153 - DNA, 79 bp, Homo sapiens
ggctatggatggttctgggcggcagcaggtgctagagacaaaggcatatgctggggcagaagagccaagatcaggagcc

SEQ ID NO: 6773154 - DNA, 101 bp, Homo sapiens
tgtaccccctcccacccagtttcaactttccagtggaaaaataactcagtgataataagcaaattatttcctggaatggaggtgggtgggtgttgtgtaca

SEQ ID NO: 6773155 - DNA, 55 bp, Homo sapiens
gtgcatttgacgaatactcactggggtaattcactgtgtaattggccaaatgcac

SEQ ID NO: 6773156 - DNA, 78 bp, Homo sapiens
aggtaaatgaaacaaggtccttctgtgacattgaaagaagcaatgaccttcacagagggagcctgtgcgaatttacct

SEQ ID NO: 6773157 - DNA, 100 bp, Homo sapiens
gcggctgctgcttttctccttgcccctcttggattttccggatttttgaaaacccagtggcccaggagcaagaggaggaaggaggaaggggcagatctgc

SEQ ID NO: 6773158 - DNA, 79 bp, Homo sapiens
ggacaaagcacaacaggagaaggcaatgcagcatcagaaaggcagtatctgttggctcctagttgtaccccacttgtcc

SEQ ID NO: 6773159 - DNA, 56 bp, Homo sapiens
ggtctagacgaattcctatcagccctgcatctgggcaacgcggaatctctctgacc

SEQ ID NO: 6773160 - DNA, 117 bp, Homo sapiens
agttccatcatgaatgttattttgcatctatgaccactatgtagaatttagaaccattctgatgtagaaagttcatagatgcgatatagaaagataattgtttatgttgatagaatt

SEQ ID NO: 6773161 - DNA, 73 bp, Homo sapiens
tgtttgtgctgcctggtgggcagagaccttgattttaaacttgcttgtcacatgtccagctacagcacaggca

SEQ ID NO: 6773162 - DNA, 75 bp, Homo sapiens
gggctctcacaacagagggaatggatctcatggttctatatttttcattctgtgacctgctcatttgttgagccc

SEQ ID NO: 6773163 - DNA, 113 bp, Homo sapiens
tagctgtggggcatggccagcattcggtctggctgttatacgctgtggtggtacttagcttgtgaaccaggcctgataggtgagactgggcatgcacttctactcacaggcta

SEQ ID NO: 6773164 - DNA, 57 bp, Homo sapiens
aatgactctatgatcctgccagcagtgaacaatgctgattaaggaccatatgtcatt

SEQ ID NO: 6773165 - DNA, 116 bp, Homo sapiens
gagctgagcaatccttgtagcccctatagttcggttcctccatgttgctgcttcctccctgtaaaggcaggtggtgggggagccgttctgtgcagtggaggggcagatgccagctt

SEQ ID NO: 6773166 - DNA, 65 bp, Homo sapiens
gtggcccagcagctggtggagaagggcgccaaccctgaccacctcagcgtgctggagaagaccgc

SEQ ID NO: 6773167 - DNA, 82 bp, Homo sapiens
tttgcctgttccagggatattagaggtaactgtaccacctaggagttaagtatggttattactgctgttccagggaggtaaa

SEQ ID NO: 6773168 - DNA, 67 bp, Homo sapiens
agagttagagccatagagcacgggttatgtctcccctacttctgtaacccctttagtctctaacttt

SEQ ID NO: 6773169 - DNA, 83 bp, Homo sapiens
cagaacaggtcataaatttatctttgagtgttttaaattatctgattttagtgtctttgacacattcaaaggaatgacttttg

SEQ ID NO: 6773170 - DNA, 76 bp, Homo sapiens
tctgttttagcatttggtgtgcctattatacatcctcatgatgatgttgaataggtagccagatatataaatctga

SEQ ID NO: 6773171 - DNA, 69 bp, Homo sapiens
gttgggatgtctgggtcttcctggcttcacctgtgactagggaagctcagagtagctcagcgtcctcac

SEQ ID NO: 6773172 - DNA, 83 bp, Homo sapiens
tgttctgccccactgtttcctttctgctggctggcctgcacactagcctgcctttgtgaggaagcggctgttaagcagacaca

SEQ ID NO: 6773173 - DNA, 74 bp, Homo sapiens
gcacaatagctcctttcaggaagcagtgtgaagttgtgcctgagcacttgcttaccggagaggtgcatgtgtgc

SEQ ID NO: 6773174 - DNA, 57 bp, Homo sapiens
cacaggaatcagcattaatggctccaatgccacgtgtttttaatcttgttcctagtg

SEQ ID NO: 6773175 - DNA, 55 bp, Homo sapiens
tttctggcagcgggacaggggtggtgaggcagtccctcccaggagtggccagaga

SEQ ID NO: 6773176 - DNA, 61 bp, Homo sapiens
gagctaggatatcatgagggtatctccagtcctcaggagaaatatctttatgttcttgctt

SEQ ID NO: 6773177 - DNA, 67 bp, Homo sapiens
cttgtagagggctactttgtgctaaatttccatacatcttttggcacaaattctccttcctattaag

SEQ ID NO: 6773178 - DNA, 83 bp, Homo sapiens
gggccgggctggtcgcacccgggcgctgctggcggccaagctggatgggtcgccagtgagtttcggtgcggcaccgctggccc

SEQ ID NO: 6773179 - DNA, 87 bp, Homo sapiens
agtcccttctgcctagctgccaggcagggagatggctgggcatgcagcttgtcctccattcctacaagtctggtaggcagtgtgact

SEQ ID NO: 6773180 - DNA, 76 bp, Homo sapiens
ggaggagagttttagttctcccagtcttgattctgtcccttgaagaggttaggaaatagggctgtaaacttcctcc

SEQ ID NO: 6773181 - DNA, 86 bp, Homo sapiens
agggttctagaacggctagcaggggtgtcatgggaaaattgggatacccacatacccggctattgctgcttttgtaaaaggatcct

SEQ ID NO: 6773182 - DNA, 68 bp, Homo sapiens
gagagccgggaggggagtgggcaggcctatttgtcatagtgctttggagctttctcctttcatctttt

SEQ ID NO: 6773183 - DNA, 59 bp, Homo sapiens
gcaggatgtaatcccctttggagggacccctacctttcacagagcatactgcattttgc

SEQ ID NO: 6773184 - DNA, 64 bp, Homo sapiens
gcctcatcatatagtaacttgtgaaccacagggaaaccttcacgttttactgagtgagataggt

SEQ ID NO: 6773185 - DNA, 72 bp, Homo sapiens
gagtccttactgttcctgggactggccatgaggaagaaactcccatcaggaacccaggagcccaagagagtc

SEQ ID NO: 6773186 - DNA, 61 bp, Homo sapiens
aggaagtaaagtggagtccctacaaccagctgggtgactttagccaagggacttgcttctt

SEQ ID NO: 6773187 - DNA, 74 bp, Homo sapiens
gttgtctaactggtgagttggttgagtggaagctggttgagaacttttactgcaaaccatttacagtagaccac

SEQ ID NO: 6773188 - DNA, 64 bp, Homo sapiens
ttttgctctttgtgcaaaccctagaatcacaaacgtagattcttagtttcatagaattgcagga

SEQ ID NO: 6773189 - DNA, 80 bp, Homo sapiens
ttttggatgaggacctggaatccaagagtctgccccacacgcagtctttcgtaatatggatgccacaggaccttccagaa

SEQ ID NO: 6773190 - DNA, 90 bp, Homo sapiens
tgtgggaaaataagtagaaatcaggatttgggaggaggtttcaaaggagactttagtccttccttcctgaaattttagtgttttttttca

SEQ ID NO: 6773191 - DNA, 58 bp, Homo sapiens
gcctggggttctaagcccttgttagatgactgtcccaagagcttctaggacgctgggc

SEQ ID NO: 6773192 - DNA, 64 bp, Homo sapiens
tagtggtagaggggagcatgatctagattggccatccagttctctttgtcaccccctcccacta

SEQ ID NO: 6773193 - DNA, 95 bp, Homo sapiens
ggattacagatagccgcggagtcggtggacccccgctttttcccgccatctggtctcctcagctgggggtcgcgcctctgggcagatctgtggcc

SEQ ID NO: 6773194 - DNA, 90 bp, Homo sapiens
agaagttctggttttgaattcttctgtctttaactgaccccagtggcttccttctggtttcatcaaagtcaaagaatgactactacttct

SEQ ID NO: 6773195 - DNA, 59 bp, Homo sapiens
tcatcctgccgctggtacaaacacggcagaggcctctttgtaaagaagtggtaggtaga

SEQ ID NO: 6773196 - DNA, 57 bp, Homo sapiens
aggccatgaggtcatgggagatgagaaacatgcatcaggccccatgtccttaggcct

SEQ ID NO: 6773197 - DNA, 62 bp, Homo sapiens
tggttcttgggtgcacaagaaaactatgatattataatagtttgtgtccttctaaagggcca

SEQ ID NO: 6773198 - DNA, 77 bp, Homo sapiens
ctacttcataggtcactgtacaggttaaatgagatattttgtgtagggttcttagcactgtaagtggcctatagtag

SEQ ID NO: 6773199 - DNA, 61 bp, Homo sapiens
caggtagtccacagtgagggagtcagaagtctaggctcaatcctaatttcactactatctg

SEQ ID NO: 6773200 - DNA, 56 bp, Homo sapiens
ttgcagggtcctgtggctctccttgcgatgggggaatccacgtgggggccctggag

SEQ ID NO: 6773201 - DNA, 76 bp, Homo sapiens
gggagatattttatacagcagcagcaggctatccacattgtgccatacctcgcttttgtgtgacttaatatctctt

SEQ ID NO: 6773202 - DNA, 93 bp, Homo sapiens
ggaaacattttgcagtagttcgtctgtgttcccttcctcatatcacaccacctagggaattaccttggattactacaaaaatctaatgtatct

SEQ ID NO: 6773203 - DNA, 93 bp, Homo sapiens
ggcaaggactgacatgataagacaggaatacaagtgaggcaataactggctgctatgtcaatatattccatgttttctctcaggtctcctgcc

SEQ ID NO: 6773204 - DNA, 117 bp, Homo sapiens
gattcccatttggctcgacttcctttctttttgctttctgttgaacagagtctgaagaatatagtcaagacctcgtgttcacgcaggacgtttagctaggagagcatcttgggtgtc

SEQ ID NO: 6773205 - DNA, 73 bp, Homo sapiens
caagatgtgcagttcatggcaggatttgcaggtcaccatgttctacctcccatggagctctgtccatttcttg

SEQ ID NO: 6773206 - DNA, 130 bp, Homo sapiens
ctaatatttagatatagtaggtagtttattcatgaaaaggtctatttcttagagtatgcttaagttaagacaaaaaataggatcttttcatgcttattttttatcctttattttttcttctcattgttgg

SEQ ID NO: 6773207 - DNA, 78 bp, Homo sapiens
tgccaaaaagttctgaagtccttcagaccttcgagtctatttgcaattctgagtctggaaactttgacaaaaagggca

SEQ ID NO: 6773208 - DNA, 79 bp, Homo sapiens
ggcttgcctatttcaaaaggacagaagacctaaaaccttttatagttttcggttcaagttttgcctttccttgcaggct

SEQ ID NO: 6773209 - DNA, 101 bp, Homo sapiens
tggcggtaggcaacctgtctagtgaaagttcaaggaggtctcactaaaaacacagtgagttctacctcctggcttatcatggacaggctctgtttattcca

SEQ ID NO: 6773210 - DNA, 82 bp, Homo sapiens
ttcactgaattaaaaagagtataccacccatctgttcataaatgttttacctagctgggaatactcttctttggtcagtgaa

SEQ ID NO: 6773211 - DNA, 64 bp, Homo sapiens
gtccaggctccagctctaacatgctgggccccaagggctgggcaggagagattgcagccaagac

SEQ ID NO: 6773212 - DNA, 58 bp, Homo sapiens
ggacttgctaaggtggctgaactccgaagacgggtgaacgctcagccaaggcaggtct

SEQ ID NO: 6773213 - DNA, 69 bp, Homo sapiens
gcgtggaagtgagggctcaaggaactctctgggcttcttaccagcctctaggccactcactattcatgc

SEQ ID NO: 6773214 - DNA, 78 bp, Homo sapiens
tccacttaagagttgagtgatcctgggaaagctacttcaagtgctgaagctagaagtacctcatagggttattttgga

SEQ ID NO: 6773215 - DNA, 80 bp, Homo sapiens
tgatttccctaaaagcacagggtgctagagagtccctaagaactcctcagacacctctcaagccctgtgctggggaaaca

SEQ ID NO: 6773216 - DNA, 113 bp, Homo sapiens
ttggaccctgaaggcaagaatccacccagttttgctcaccatggaatgctggccagcaccccacagtttccagcacagggcaagctactgtgtgggcataggtatgggtccaa

SEQ ID NO: 6773217 - DNA, 71 bp, Homo sapiens
tccctgttggaagtcttggcaacttttcctcttaaaaacaagaacagcttgcaatggctttcaactctgga

SEQ ID NO: 6773218 - DNA, 84 bp, Homo sapiens
acaaatgtgctgtatactagttaccaaaaaagtaccatttcatacactggtgaggaggccctggttaatgtttagcctatttgt

SEQ ID NO: 6773219 - DNA, 56 bp, Homo sapiens
gcccttcagttactccttgatgtcagagtccccattccctgggagtgaaggagggt

SEQ ID NO: 6773220 - DNA, 88 bp, Homo sapiens
aaatgtgaaaatttctgaaatagaaagctgagtaatacatttctcagttgggaaaatgggtgccagcttctgaaagaggaaaacattt

SEQ ID NO: 6773221 - DNA, 65 bp, Homo sapiens
tgtaggtacctaaatggatatcatttcagggataagttgacccttttcatttgggaaaatctgcg

SEQ ID NO: 6773222 - DNA, 55 bp, Homo sapiens
atgatgccaaatctagagaaagcacaatcaatggcctctcagaattggcaatcat

SEQ ID NO: 6773223 - DNA, 62 bp, Homo sapiens
acataaacatgcttacattctcaacacaagtggagagagatcaacctgtgcatgttctgtgt

SEQ ID NO: 6773224 - DNA, 94 bp, Homo sapiens
ggtattggcaggcttccttggttctgcctggcctggaagtgtatctttccttccaccgtgccatgtgggaccacaaaggagaatgccatgtacc

SEQ ID NO: 6773225 - DNA, 72 bp, Homo sapiens
gacttttgcaatctgattccaatgtaacaaatatgtatgtgtgtatacaaattggaatcagattgtgaagtt

SEQ ID NO: 6773226 - DNA, 80 bp, Homo sapiens
cttgtaagaatatgtagtcaagtggatatatgatcaatacggttaccttttcctcttgtactgttcatttcatttataag

SEQ ID NO: 6773227 - DNA, 72 bp, Homo sapiens
tattttgcctaagaatctctctgattatccgacacttggaggtattctcgagagattcatagcagcaatgta

SEQ ID NO: 6773228 - DNA, 71 bp, Homo sapiens
gcacaggctctaagtaaatagcttaaagaatttatgagcatcactttctgcatttatgtatagcttgttgt

SEQ ID NO: 6773229 - DNA, 100 bp, Homo sapiens
gaggaagaacttgtttttcttgcttaagaggaagaacttgtttctcttgcttaagagaaacaacttgtttctcttgcttaagagaaacaacttgtttctc

SEQ ID NO: 6773230 - DNA, 57 bp, Homo sapiens
gtaattgcagaactttgggaggccgagatgggtggatcacctgaagttttggagttc

SEQ ID NO: 6773231 - DNA, 68 bp, Homo sapiens
ctaatctcatgagatctgaactgcctgagctctctctcccaggagtcctcaggggattttgagattag

SEQ ID NO: 6773232 - DNA, 55 bp, Homo sapiens
cagctgctgcctcactggtctgtgttgaaaacaagacagtgggtggggagcactg

SEQ ID NO: 6773233 - DNA, 79 bp, Homo sapiens
ctttaagtgttttcccagcccaggtatgatgatatgaagcaacccccttccttgtctccactggcctggggccttgagg

SEQ ID NO: 6773234 - DNA, 65 bp, Homo sapiens
caggctgggggaggtgagctgagtctggcaggccacctgccccaccagcaccctctctatccctg

SEQ ID NO: 6773235 - DNA, 97 bp, Homo sapiens
tctgggccaggaagcatcagctcagggccatcggcccttttcctggtgccccttgggagcaaagggccagatgccctagaggtgtacctggcctggg

SEQ ID NO: 6773236 - DNA, 95 bp, Homo sapiens
actgtcattttgtctgggtctaaaaattctcagatggccttattcacatgtctggacaatctgttaggattgttggaatgtccagaatgactagt

SEQ ID NO: 6773237 - DNA, 113 bp, Homo sapiens
gggtcacactttatttgcaagttatctgggaagggctggcaatttatgaataaatttcagatgatggccatgtcctctccctgtttcagacttccagtattaatcagtgatcc

SEQ ID NO: 6773238 - DNA, 96 bp, Homo sapiens
ccaagctcctgccggagggtctttcctgggagccagcccggagtgctcactgccctgctctctccctaggcaagtgagttcccaccaggtgcttgg

SEQ ID NO: 6773239 - DNA, 82 bp, Homo sapiens
ggaactcatcgagtgcctggtatgtaggtagcggagtggaattcaaaccccaggcttctgattccaggcaccatgttcttcc

SEQ ID NO: 6773240 - DNA, 60 bp, Homo sapiens
gaggtgcttacagtcttttagggaactaagcagatggttatctagagtaataagtacttt

SEQ ID NO: 6773241 - DNA, 61 bp, Homo sapiens
gccattcagtatttcatttattcactacataatgagtgcctaccaagtgctggatactggc

SEQ ID NO: 6773242 - DNA, 70 bp, Homo sapiens
tcgctcccagctgaggcagccacacaggagcaggaggcacctgacaggagaagcgcagcatggagagtgg

SEQ ID NO: 6773243 - DNA, 68 bp, Homo sapiens
acagttctatgtcagtgtgctctgtggtactatatttacatacaagtacactacacataacacactgt

SEQ ID NO: 6773244 - DNA, 60 bp, Homo sapiens
ccgtgtgctcagcctcagagccgtaggcgagagcgcctgtctgcatgagtgagcatatgg

SEQ ID NO: 6773245 - DNA, 93 bp, Homo sapiens
tcagtacatatgttgatgttcattagtgaaacagttatcaatctggccagaattgccctgagtactgtgttttacttcagcatatgtttctga

SEQ ID NO: 6773246 - DNA, 68 bp, Homo sapiens
gagctccacttagcaaggccactcaggaaacagatggaccaacttgagttctttttctgtgtgagctc

SEQ ID NO: 6773247 - DNA, 72 bp, Homo sapiens
gtttccatgaaaatgtttctgcttgttccaatgggcaaaaataaagttgcagaaccataaattcaggtaagc

SEQ ID NO: 6773248 - DNA, 129 bp, Homo sapiens
gcctgatactcaacactttaatatgatgatccttaatatggaagagttctctactggttgaggagaaaaaggtaatgatagccttgtagagtttccatttatccaattaaaggtcacttccctcaggtc

SEQ ID NO: 6773249 - DNA, 89 bp, Homo sapiens
cttgggctttacgtaaagaaattgtgccattttttcaagccagatatagcttctgtatcaacaaatggaacacaaatctttagtctagg

SEQ ID NO: 6773250 - DNA, 127 bp, Homo sapiens
cctgggtatccatggcttacccaaaacaccttaaatactgagtctgaagctaatgatttattttctgtcttggacagaattggcacaggcagtgcagtagggtatggggaggttagggaagcgtggg

SEQ ID NO: 6773251 - DNA, 83 bp, Homo sapiens
ctaggagttcagggctgataagagggcaatgagtgtcgtcattagggatctaggcctccatctttctgctctgttatcctcag

SEQ ID NO: 6773252 - DNA, 57 bp, Homo sapiens
agcactcttaattctgagatgcctgattagagcctcaggggtcccaaaagatgtgct

SEQ ID NO: 6773253 - DNA, 57 bp, Homo sapiens
gataattctatggggagtactcaaatcactgagttgttagctccctggatgttactc

SEQ ID NO: 6773254 - DNA, 90 bp, Homo sapiens
ttgttcctgtcgccttttaaagtggtccatttcagaacaggctgttgataaacttgctcattttatggcttttttgaaagataggtttaa

SEQ ID NO: 6773255 - DNA, 76 bp, Homo sapiens
tgtgtttgtcctgatgtgaacatttttggtcattatttaccataatgattactgatcgcataggaaggaagacaca

SEQ ID NO: 6773256 - DNA, 86 bp, Homo sapiens
tcaccagagacttcaaatcatgctaaacctaatgggtcatttttcctctgagtttggccccatggttcccaggttcccattgttga

SEQ ID NO: 6773257 - DNA, 58 bp, Homo sapiens
gtgactcagttagacagtatttgggtcacaatatgtgatttactgtttaattgattac

SEQ ID NO: 6773258 - DNA, 68 bp, Homo sapiens
tgaaatgcaaatactttcctatataaggtgcttggcatagcatctggcccatagtaagtaagctttta

SEQ ID NO: 6773259 - DNA, 62 bp, Homo sapiens
gtaacattattcatgagatacatgagatcagtggttattgttgtctttgtgaatagtgttgc

SEQ ID NO: 6773260 - DNA, 60 bp, Homo sapiens
tctcttaaaagagtaatagagaaggaaatggaagcccacttctattcatcagttaagaga

SEQ ID NO: 6773261 - DNA, 81 bp, Homo sapiens
tccgtctctaccttaaaagaacgttctcgagggagtcaggggaggtgatggactcagaagtgttcttttattttagatggg

SEQ ID NO: 6773262 - DNA, 68 bp, Homo sapiens
taacatctgttcacagtgtttctttgagataggaactataattgtcttaccagctgagaagagggtta

SEQ ID NO: 6773263 - DNA, 73 bp, Homo sapiens
gtccaaagcatagtaagggaagagagcagttatttacatataatttcgttcagtccttactgtgagtatgcac

SEQ ID NO: 6773264 - DNA, 71 bp, Homo sapiens
ggtctcctgctctgctgatcagtgtctcatagggcaagtcctgagggatctgggacaacaggtggtggacc

SEQ ID NO: 6773265 - DNA, 98 bp, Homo sapiens
gagggcctggcctgtctgggggaggctggtgactcctggttccaatgtgctcagctctgagccagaggccagcctgcctcagacggggcatttccttc

SEQ ID NO: 6773266 - DNA, 77 bp, Homo sapiens
ggggttgtgggcagctgggggccccagtaccagcaaccttgaccccccacctggtactgggcagctgctctgacacc

SEQ ID NO: 6773267 - DNA, 82 bp, Homo sapiens
aagctgagtgaaataacttaagaaatttccccactgtcattgcaaacttatcagtggagatgcaaagatattttatgagctt

SEQ ID NO: 6773268 - DNA, 117 bp, Homo sapiens
catatcaaaattgctatgtcaaaatggccactttgataaaattttatagcaaactcctagagaaagcaatagtatttattaaagtagcttccatggcaccctagttcttttggtatg

SEQ ID NO: 6773269 - DNA, 57 bp, Homo sapiens
agtgtctggtctctgaactaaaagaacaacccttttgaattttagagattcaggact

SEQ ID NO: 6773270 - DNA, 57 bp, Homo sapiens
tctagatcctggtgttaactgggaaaacacttaaataacattccatggatctgcaga

SEQ ID NO: 6773271 - DNA, 71 bp, Homo sapiens
ggaaaattgttgccttcaacttctcatcaatgcaaaagagatattgatgaatctgaagggaaccatattcc

SEQ ID NO: 6773272 - DNA, 70 bp, Homo sapiens
tcactgctactcgttgcattccggtgtgccttctggaaaaggaaagccggggtagaatgaaagccagtgg

SEQ ID NO: 6773273 - DNA, 57 bp, Homo sapiens
gcatgtatacagtagaatactattcagcaaagaaaggaatgaagggctgatacatgc

SEQ ID NO: 6773274 - DNA, 72 bp, Homo sapiens
taaaatttaggaaggcacattgttggctaaattaattcacaattgggtttagtcagtgtcctccaaagctta

SEQ ID NO: 6773275 - DNA, 71 bp, Homo sapiens
tccaagcccatgaaatggcctcaatgaacaaatgtttagaaaacagaaagtcattggtgggatcacttgga

SEQ ID NO: 6773276 - DNA, 71 bp, Homo sapiens
ctgagaagaggttgtctgtgatgagttcgcttttattaatgacgaatataacacagatggcctgttttcag

SEQ ID NO: 6773277 - DNA, 62 bp, Homo sapiens
ctttcaatctggcatgtaagcttagaggtcgccactctatcctaacaagttagatttgtcag

SEQ ID NO: 6773278 - DNA, 81 bp, Homo sapiens
gtggggagggggagaaaggccagggggcactgactccattgcatcgtgggaggagcagcctggtctctcgccaatacccac

SEQ ID NO: 6773279 - DNA, 89 bp, Homo sapiens
ctgctacctgcagagatctgagaaggctgcctggaagagtaggcacaatttgggcaggccagagtatcgtacctttaaggcaggagcag

SEQ ID NO: 6773280 - DNA, 55 bp, Homo sapiens
gtccgagccaggctccggagccgcgctgccgcccaatccctggcgcctctcgggc

SEQ ID NO: 6773281 - DNA, 67 bp, Homo sapiens
gaagcccagagttcaaggctgcagtgagctatgatcgtgcccaccactgcacttcagcctgggctac

SEQ ID NO: 6773282 - DNA, 74 bp, Homo sapiens
gtggttttcctctctggacatcacatggctgctttttctgtcatccaaatctcagacatgttgtccatgaccac

SEQ ID NO: 6773283 - DNA, 64 bp, Homo sapiens
gcactggggtccagatggggagaagatgttctgccataagaaaatctcctggtctggtccgtgc

SEQ ID NO: 6773284 - DNA, 94 bp, Homo sapiens
gaggacagcctgtgcttaacagtgacccctggtggccatgagacctgatggctttagtgtaggtttctgttgtttggaaataggactgatcctc

SEQ ID NO: 6773285 - DNA, 86 bp, Homo sapiens
tctagctactatgataagacatcattaaacagcaataagaggaaaaacttatcagcattcccaaatgatgtgcttgtttggctgga

SEQ ID NO: 6773286 - DNA, 59 bp, Homo sapiens
cgctgggggaacagcgagggtgtggagcaggagacacaggccctctgcctccctcagcg

SEQ ID NO: 6773287 - DNA, 60 bp, Homo sapiens
tttctcgcgtttgagctctcagactggtgggcgccatcatccctgagcaaacttgggaga

SEQ ID NO: 6773288 - DNA, 61 bp, Homo sapiens
tattttaccttcttttaactacagtgctaattttatacactgagtaagacagggtgatata

SEQ ID NO: 6773289 - DNA, 57 bp, Homo sapiens
gtgctgagtagaatgaatgcctttggtcccaaaggttttgttactagattcagatgc

SEQ ID NO: 6773290 - DNA, 94 bp, Homo sapiens
ctcataaaagaaactgcccctgccccctgcccatcgtcatttaataaatcaacaggtctgtttcagtggcctgatgtgtaatggcatttatgag

SEQ ID NO: 6773291 - DNA, 71 bp, Homo sapiens
tgtaggaagccttatggggacagttttgctctattgacaacatcagtcctcatgagacaagtgaaactaca

SEQ ID NO: 6773292 - DNA, 63 bp, Homo sapiens
atgcaaatgtcaccacttctaaacgtctgaattcatctagtttgttgaagtgtgactttgcat

SEQ ID NO: 6773293 - DNA, 72 bp, Homo sapiens
ggcggctgtcggcactgcctggcattctctggctgatagaagctccgagttctggcggctgtcggcactgcc

SEQ ID NO: 6773294 - DNA, 62 bp, Homo sapiens
gaggtcagtcagaccagggtttgattggaagcacaatgactttggacaagtggcttgacctc

SEQ ID NO: 6773295 - DNA, 65 bp, Homo sapiens
gtaataatactagtcagccttgttcaccaattcctatgtgccaggtgctgagctagtgttgccac

SEQ ID NO: 6773296 - DNA, 65 bp, Homo sapiens
atggactgaatttcttgaaggcaggatacttctttttagttttgtactctcagaattcagaacat

SEQ ID NO: 6773297 - DNA, 60 bp, Homo sapiens
cactgttttattccaacataggttcccagctggagactatttcatgttggagagatggtg

SEQ ID NO: 6773298 - DNA, 55 bp, Homo sapiens
tgtgactggagtccagcccactggggagcaatccatttggttgtgacctgtcgca

SEQ ID NO: 6773299 - DNA, 76 bp, Homo sapiens
agaggaatcatcacactgtctttcagaatggttgaactagtttacattcccaccaacagtgtaaaggtgttccttt

SEQ ID NO: 6773300 - DNA, 59 bp, Homo sapiens
tttggggattgtgagaagactgtatcatatgtgtgtaacagtctcttggaattttcaga

SEQ ID NO: 6773301 - DNA, 60 bp, Homo sapiens
tacaggcccatagtccctgctttgaaaaccaggggtgatgacaggggccatgggtttcta

SEQ ID NO: 6773302 - DNA, 85 bp, Homo sapiens
gtttgtgttaagatgttgccatgtggggacaatatcataatataacatactattctgtgtgtgtctgcacatgtataatacagat

SEQ ID NO: 6773303 - DNA, 77 bp, Homo sapiens
gaaaacgccacgcactccttctccaagcagggcttgtcgtagggctcaaaggaggtaatgggtgtgagggtcctttc

SEQ ID NO: 6773304 - DNA, 72 bp, Homo sapiens
cagctgcctggccacaacccagggtctctcagggatcctgccgatcattgccctggctgtgctaagctgttg

SEQ ID NO: 6773305 - DNA, 83 bp, Homo sapiens
atatcaaaggcgaaatagatctctgggatgcaagtggctcatggaccacttgtaacctttgatccatttttcatcttctgtgt

SEQ ID NO: 6773306 - DNA, 64 bp, Homo sapiens
ggaagaagcagctgccaggccagttaagagctacacctgggactggcatagcattacttctacc

SEQ ID NO: 6773307 - DNA, 87 bp, Homo sapiens
gagaattgcttgaacccgggaggtggaggttgcagtgagatgagatcatgctactgtactccagctctgggtgacagagcaagactt

SEQ ID NO: 6773308 - DNA, 69 bp, Homo sapiens
ctttttgtgtgagattttgccaggcagtaatataaaagtgtcttggtaaattgtcttataaataattag

SEQ ID NO: 6773309 - DNA, 79 bp, Homo sapiens
tttctttgctgtttgtgaaatgaagaaagatcaagtcagtgaaaaacaggctttctggaagttggaaatagcagagaaa

SEQ ID NO: 6773310 - DNA, 92 bp, Homo sapiens
ttcaaagatttggggagttaatgccaaagatatgttagcaggtaagaatcccacatcctctagacgtttgcgttggtcctcaagactatgga

SEQ ID NO: 6773311 - DNA, 81 bp, Homo sapiens
ccaagggatggcattaaagttctttctcttatttggtagctctaactaccaaataagccaagggctttggatattccttgg

SEQ ID NO: 6773312 - DNA, 81 bp, Homo sapiens
ttgtctataagttacagagagataagtgtaaaagtctcccataatacgcatgacttttgtatttctctgtagtaccatcag

SEQ ID NO: 6773313 - DNA, 73 bp, Homo sapiens
tagcctttggtggtgaccattagtccatggcatcccttgacctgcagtggcagtggcatcaccccaatatcta

SEQ ID NO: 6773314 - DNA, 86 bp, Homo sapiens
tccaagtctttgctattgtgaatagtgctgcaataaacatacgtgtgcatgtgtctttatagtagcatgatttatagtcgcttggg

SEQ ID NO: 6773315 - DNA, 98 bp, Homo sapiens
ctctccaaggccatgtgggaggttttcgatgagccctgaagctctgtggagtttctggcatctgggggaggcctctgtttacatccaagccttgggag

SEQ ID NO: 6773316 - DNA, 59 bp, Homo sapiens
gcctgtggcccaactgtctgtctgtcctaccacctcaggctacagggcctggccaaggt

SEQ ID NO: 6773317 - DNA, 93 bp, Homo sapiens
gatgcctggctctagggtgtgcggcagggctacaggactgagagtgtccaactctcttggccctgccgcactatcctcaggttaactggtgtt

SEQ ID NO: 6773318 - DNA, 80 bp, Homo sapiens
gtcctgctgtctctgctgcaccttctgggtcctgctatcccccaggagacccaagatggtgagtagggaaagcaaaggat

SEQ ID NO: 6773319 - DNA, 92 bp, Homo sapiens
aatgataatctttaattatagaatgaggacatagctttttgtttcatttatttaaaaggctgtgtcctcattttatatcatgatttgccatt

SEQ ID NO: 6773320 - DNA, 61 bp, Homo sapiens
caattattgtgcacctactgtgtgcaggccctgcctggacactggggatgcgcagtggatg

SEQ ID NO: 6773321 - DNA, 76 bp, Homo sapiens
gatctattgtatagctttgggacataagttgcttttcttaggtaacatcaaacatgttttaaagttattcattgtc

SEQ ID NO: 6773322 - DNA, 73 bp, Homo sapiens
caaagagaaaagtcaacgtacagtaagcaaatgtatagcttaatgtggaatcatggactttattatttctttg

SEQ ID NO: 6773323 - DNA, 69 bp, Homo sapiens
tgtggtgagtaacatctggaaccgacactgaattcttttagctgatgtttagttgatgttacccacgca

SEQ ID NO: 6773324 - DNA, 57 bp, Homo sapiens
ctttctgtgctgagctctgagatgtggggagatgcccgacaccctcagcccagaaag

SEQ ID NO: 6773325 - DNA, 84 bp, Homo sapiens
aaatgtttattgttttaggtttctaatcacagtggttataaataagcacagattctgaagagtccttatatgcggtacacattt

SEQ ID NO: 6773326 - DNA, 76 bp, Homo sapiens
attagaaccattgtaatacttgttgcagggaatgccaaacaagcttcctttgttgtacaattattttggcgctaat

SEQ ID NO: 6773327 - DNA, 74 bp, Homo sapiens
gtaattcagagtcctgagttattgtcaagaagccagagacttccctggcttccagaatgactaggatgttttac

SEQ ID NO: 6773328 - DNA, 80 bp, Homo sapiens
agcgtcagacgtgaggacacggccttttggaaaatgtgtcttgcgtttttagcattagactgttatcctgattgaatgtt

SEQ ID NO: 6773329 - DNA, 71 bp, Homo sapiens
ccttctaccaccagcttacagtctcacccctggcctgggttagtggggggagctgcaagctggaaaggggg

SEQ ID NO: 6773330 - DNA, 67 bp, Homo sapiens
accagcttttctcaccagatggtgttgctatcaagcatagccttcctctgcctgagactttgctggt

SEQ ID NO: 6773331 - DNA, 65 bp, Homo sapiens
cccaggccttgacataatgaaggagcttaataaatagacaagagccaagttgtcaaggcactggg

SEQ ID NO: 6773332 - DNA, 78 bp, Homo sapiens
ccccattcagcagaaagaagttagtacagttgttggccaacctccccaacagcacttgggttttcctgttgagagggg

SEQ ID NO: 6773333 - DNA, 82 bp, Homo sapiens
gtcaaacccaggggcttctcttcagtatctgaggctcctttataaaacctcagggccaaagcaagcccaactgtgtcttgac

SEQ ID NO: 6773334 - DNA, 58 bp, Homo sapiens
ggagaaatcacttagaggaagtgaccagggctggtcggctttttatggtggttccttt

SEQ ID NO: 6773335 - DNA, 79 bp, Homo sapiens
tctatctatctatgatgaatgctactgaatcattttttaatgatggtaaacaaagacatttatttgtgaaagtgataga

SEQ ID NO: 6773336 - DNA, 93 bp, Homo sapiens
tcatcctatttgggtcttctgttacttgcaaccacaggatgctagttaataaacccacttgtagttttaaagcatgagccccaaattatttga

SEQ ID NO: 6773337 - DNA, 66 bp, Homo sapiens
ctgctgacggaaggctgtttctggtagtgatggtgaaatctggccaaggatgccgtctggaggcag

SEQ ID NO: 6773338 - DNA, 85 bp, Homo sapiens
gggccaagtacttggtctgggcagggggttcctggcaggggctcacacctcctcagccccctcctcagccaaggtggcttgggcc

SEQ ID NO: 6773339 - DNA, 67 bp, Homo sapiens
tacaggtgtctgggctttggagtcaagtatagttgatactactgagtcacagtctagtcacttagta

SEQ ID NO: 6773340 - DNA, 111 bp, Homo sapiens
tccctcagcctgctgcttgaacagttgcgaatgaatgaagatcaccgcagccttcccccctgctgttgctcatttgcccattagcatctgcttaagcagcaggctggggga

SEQ ID NO: 6773341 - DNA, 87 bp, Homo sapiens
cctacccccactagaagcacaggaacctatggggaaacaccttgacaaacccaccaggcacctggaggtttactggatggctttagg

SEQ ID NO: 6773342 - DNA, 57 bp, Homo sapiens
cttggcatcatgtagtgggctcttactgagccatttttcacacccatgcttgccaag

SEQ ID NO: 6773343 - DNA, 55 bp, Homo sapiens
tctccttgctcttaaccactatgcatattatttatagcaaatggagagtaagaga

SEQ ID NO: 6773344 - DNA, 63 bp, Homo sapiens
gcaatgtcttctatagttactcatttacactgaaacgtgatgggtaacttttagggcgtttgc

SEQ ID NO: 6773345 - DNA, 77 bp, Homo sapiens
aatcctaaacagtaagttctagtattatctgcattttatatatgatgaaaatgagccttaggaacttacccaggatt

SEQ ID NO: 6773346 - DNA, 68 bp, Homo sapiens
cctgggtgccaggcttggtctgccttctccaggggtgataggtgcagctgcccaagcctgagcccagg

SEQ ID NO: 6773347 - DNA, 72 bp, Homo sapiens
tggcatttggcttacttatgttttcttacagtcaatgtagtaagctggctgaaagcatggaagctggtgcca

SEQ ID NO: 6773348 - DNA, 55 bp, Homo sapiens
ggctgctttgaaagaggagctttacacattgtaaacttttcccccagggcaagtc

SEQ ID NO: 6773349 - DNA, 59 bp, Homo sapiens
ccgagctggccacgctgagccctgtgccctctccagggctggtgcccttggccagtcgg

SEQ ID NO: 6773350 - DNA, 127 bp, Homo sapiens
ggctgcctgctgagacccagggctggagcatggctctgtgcgggccatggtcaggaacctggggcttccacgaccttgctcaggcctaagccagaatgccagctccacatcttctctgccggcagtc

SEQ ID NO: 6773351 - DNA, 78 bp, Homo sapiens
ctgcaaaatgtgataaggattaaataagaatatttaataatttaataagttcttaggatagtgcccagcatattgtag

SEQ ID NO: 6773352 - DNA, 84 bp, Homo sapiens
agtaacatctttgggcaatgatgagggagggggacggaaaaaacaagccctattttatgttccctcaacaatctaaatgttact

SEQ ID NO: 6773353 - DNA, 55 bp, Homo sapiens
agggtaaagtacatccttctcagaatgttgcagaaggtcttcatgagctcaccct

SEQ ID NO: 6773354 - DNA, 68 bp, Homo sapiens
tgttaacatgtggctggtagttgacaacttcactgttgaggagttcccagtccccagccacagagaca

SEQ ID NO: 6773355 - DNA, 58 bp, Homo sapiens
gtggccctggagttgtgacactgcaaaatggcagtgtcaggagccttccatgggctgc

SEQ ID NO: 6773356 - DNA, 68 bp, Homo sapiens
cctcgatggcctgaccacccttggacaaggtcatttgcagtgacctggtgggtgggcagacattgggg

SEQ ID NO: 6773357 - DNA, 116 bp, Homo sapiens
tgtcttttcttccagagtaagtgggtagcttcttcctactttttttctcttttcttctataaatgggaggaaaagtgtgaagtatggagactgctctttcatttgaaggaaattca

SEQ ID NO: 6773358 - DNA, 76 bp, Homo sapiens
ggccagacctgctctgtgagtgagatggccacaggccaaacttgagcctgccatttgaccaggaactcaactggcc

SEQ ID NO: 6773359 - DNA, 58 bp, Homo sapiens
aggggtggcctgccttactccctgaggagctaccatgggctgggcaggacccacccct

SEQ ID NO: 6773360 - DNA, 80 bp, Homo sapiens
tggttatgtaaaattaagatgttcccatttaatttttaacaatcaaaacagttaatgagcattttggaatgtacaagcca

SEQ ID NO: 6773361 - DNA, 56 bp, Homo sapiens
ttcagaaatgtcagccatcagagaacaacacatctgtggtaaacaacatttctgga

SEQ ID NO: 6773362 - DNA, 55 bp, Homo sapiens
gattgagtctgaggatgctgcagatttcatttggcggtaccatcacttttcagtt

SEQ ID NO: 6773363 - DNA, 69 bp, Homo sapiens
gtcactgtcccggcccccagccctgccccaggccccgggggcttgggctcagacttgaggacagaggac

SEQ ID NO: 6773364 - DNA, 87 bp, Homo sapiens
ctgcttaacattacctagtttttcagcaaatacaaaagttttataagttcaaaagttatgtgtattctgaggtaggtatattaacag

SEQ ID NO: 6773365 - DNA, 86 bp, Homo sapiens
tacttatgtgatgtgattgatatgttaattaccttgagttgggtaacatttcacaatgtgtttgcatattaaaatattacattgta

SEQ ID NO: 6773366 - DNA, 63 bp, Homo sapiens
ggaagtagcagagctgggattgaatctgggctgcctgactctaaaccccactctgctggttcc

SEQ ID NO: 6773367 - DNA, 92 bp, Homo sapiens
cggagtttgtgttttgctaacagagtttgtaaggctcagagggtgttgaaatgtttctgaggttactgctttgtagaacacataggattttg

SEQ ID NO: 6773368 - DNA, 112 bp, Homo sapiens
tggtttatttgttttggtttgcttatcttgtcagtacttttgctctgctatatttctgaagttttttgatgctagaagtaaaccaagctctattccatgacaggttttacca

SEQ ID NO: 6773369 - DNA, 80 bp, Homo sapiens
ggcattttctgctcagagaaatgaagtagggattcagtgatatagacaaatcctagaaatttatttgaagtagaatggcc

SEQ ID NO: 6773370 - DNA, 67 bp, Homo sapiens
cggtggcctggcggtcccagggtaccccacaggccctactagttggggactgacagccaggcctccg

SEQ ID NO: 6773371 - DNA, 73 bp, Homo sapiens
ggggaagttatttgaaggctaaaggggcagaggttaactagaattaacgtgtctactttttagtctcttctcc

SEQ ID NO: 6773372 - DNA, 112 bp, Homo sapiens
gtgccatataaaaggcttgataagagatgagctgtctagctgttggaatcaagcattctgacagcttcagtagtttttatcttgttttatttgcctcatttctgtttggcac

SEQ ID NO: 6773373 - DNA, 57 bp, Homo sapiens
agccctctgcaaacacctgataatgctgaagagtgtgttagtcattgtagaggagct

SEQ ID NO: 6773374 - DNA, 73 bp, Homo sapiens
ccttcaagatctgggttttcagctttctgcagcctttgttttcactgaaatgttgaaactactcgtctgaggg

SEQ ID NO: 6773375 - DNA, 57 bp, Homo sapiens
gttttcaattataagatggctttactaatattttgaggctatcactgaaatgaaaac

SEQ ID NO: 6773376 - DNA, 81 bp, Homo sapiens
atgacaaatgatgcagctgctcttcctctattggacacatgtacaaaacaggaagagaggagcagttgctacatatgccat

SEQ ID NO: 6773377 - DNA, 93 bp, Homo sapiens
ggccggcatggctgcagtagctgttgcaataaacagttccagacattgtcattctgggaccctgggcagctggctgctgtctccatgccaccc

SEQ ID NO: 6773378 - DNA, 66 bp, Homo sapiens
tgcttatgtgaatgcatgtatgcgtatgtgtatatatacatatgcatgcattgtttatcatgggta

SEQ ID NO: 6773379 - DNA, 65 bp, Homo sapiens
tgtctttgctattgtgagtagtgctgcaatgaacatacgcatgcatgtgtctttatggtagaaca

SEQ ID NO: 6773380 - DNA, 89 bp, Homo sapiens
ctttggaatgatgaatcaggcagtgggtgataagaccaaggaggacattttcacctggtcctgttaaccctactatttgggttctaaag

SEQ ID NO: 6773381 - DNA, 95 bp, Homo sapiens
tgaggcaggagaatcgcttgaatccgggaggtggaggttggctgagaccatgccactgcgctccagcctgggcaacagagtgagacttcgtctca

SEQ ID NO: 6773382 - DNA, 87 bp, Homo sapiens
gtgagctctctgcagtgcactggggtgggcctggtagagcagctgcagtgctgcttggcactgtacccagtggagtgtggagctcat

SEQ ID NO: 6773383 - DNA, 87 bp, Homo sapiens
gtgtgaagatcctgggagtgtcagacttgcttctgcgcatcatcaaatccataccataagcaaaatagtgacacctcctacttgcat

SEQ ID NO: 6773384 - DNA, 80 bp, Homo sapiens
gcatttgctttgactccgggccctgcctggggatgagcctcttaggccttagaggaccaggattcagcaacagcatatgc

SEQ ID NO: 6773385 - DNA, 57 bp, Homo sapiens
cagaggaggcttgggctgcaaggatgccaaactagcgctgcccccagcacctccctg

SEQ ID NO: 6773386 - DNA, 56 bp, Homo sapiens
gctgccccgagccatccttcagtgaatctttaactgagggctgacaggaggacagc

SEQ ID NO: 6773387 - DNA, 83 bp, Homo sapiens
tcagtaattttgttgccacatatagcagttacaaaacaatgtactgtgtgttaattgtcatgtttggtagataaaagatctgg

SEQ ID NO: 6773388 - DNA, 86 bp, Homo sapiens
gcaatgggcagggtgtgtcctgggaactcacagtccagggctgggcagggctgggctggattccctggagccccttgtgcccttgc

SEQ ID NO: 6773389 - DNA, 63 bp, Homo sapiens
gctgaaaggggtgacattcttttctcagaagcaagactgtctaaaggaagctccccctacagt

SEQ ID NO: 6773390 - DNA, 77 bp, Homo sapiens
gatgtggtttataggctattatagttcatctgactttcacaataagtacgtgttaatggctatgaactgattacatc

SEQ ID NO: 6773391 - DNA, 83 bp, Homo sapiens
aagagaagccttcttactctactcctcaaactacaggcccagcttctaaacaggcctgagctagggaaggaagaccttgtctt

SEQ ID NO: 6773392 - DNA, 78 bp, Homo sapiens
tgttgatctgcccaggtgagcctaagccaatcttgagagcagctgtctcaggccaggctgccctgggagcagaccaca

SEQ ID NO: 6773393 - DNA, 67 bp, Homo sapiens
tgccgcaagacctatctagttgctgtgaattatgccagggcgacaatggagagcgtttttaatggta

SEQ ID NO: 6773394 - DNA, 67 bp, Homo sapiens
tgtcaggtcattgccatggaaaggggtggtaacttctggatgttgccatggcaatggtaaactgaca

SEQ ID NO: 6773395 - DNA, 102 bp, Homo sapiens
gtctctatcctggccctttgcaactgcctgcctctgattctgcacaccacagtgctgcagtatctatgggcatgccatatgtataagatgttatttagggac

SEQ ID NO: 6773396 - DNA, 97 bp, Homo sapiens
ctagccaggagggaggaagacctgcatgcggactaacagaaaccattttggaagacaatgtacatgcagtttaacctctttaaagtgaccttgttag

SEQ ID NO: 6773397 - DNA, 76 bp, Homo sapiens
atgctttgccacagaactcttccaaatgcagctaaagcttcctgaggctaagatgcatgaggatctggggaagtgt

SEQ ID NO: 6773398 - DNA, 58 bp, Homo sapiens
attctcaatggctactttcataccataatggcacagttgagtagttgccacagagaat

SEQ ID NO: 6773399 - DNA, 100 bp, Homo sapiens
gcttgttacaggaacagccaggaggcctcagccctgtccacagcctctgtccaggtccgtccacagctctgaggtctccctgctgtgacccttggcaggc

SEQ ID NO: 6773400 - DNA, 82 bp, Homo sapiens
gtgactgggcccaggcctcttccggctccagtaccccccggggcgattctggcaactcagccagaggaagcctggccctcgc

SEQ ID NO: 6773401 - DNA, 88 bp, Homo sapiens
ctgctcaagtggccttctctaaggctgcctctgccagaggagccacgtaaggccacctctgccagaggagccgtgggccacagagaag

SEQ ID NO: 6773402 - DNA, 80 bp, Homo sapiens
ttccatcccagaacaccattcaccatcagtacctggtgcccagagcaggaaaggctgaggggaggtgagatggagaggaa

SEQ ID NO: 6773403 - DNA, 109 bp, Homo sapiens
tttcatcctcattctttccacatttgataaacctatgctaagctgtggctcattaataatggtccaggctggaaatgtcaaactctgcagaaggcaagagagggaggaa

SEQ ID NO: 6773404 - DNA, 60 bp, Homo sapiens
ctgaatattagtcatgtctgatctcccttccctggttattagaggtctggctgaattcag

SEQ ID NO: 6773405 - DNA, 62 bp, Homo sapiens
tttggtacccttggaacagttgatgattgtccaaacacaaaaattctcaggggcatactaag

SEQ ID NO: 6773406 - DNA, 55 bp, Homo sapiens
cttttctggaatcatctctaactcagagctcctagaaagagagtatctagaaaag

SEQ ID NO: 6773407 - DNA, 55 bp, Homo sapiens
atttgtgttttcccatactattgagacatttcagtagctaatggaaaccataagt

SEQ ID NO: 6773408 - DNA, 82 bp, Homo sapiens
tccagagggttttgtgaggctcaaactgacttctagcgtagtaatagatttgaaaccccttacattaatcagatactctgga

SEQ ID NO: 6773409 - DNA, 124 bp, Homo sapiens
attgctttggttcctcaggatcttttgtgtttccacatgaattttaagactgttttttctatttctatgaagaatgtcgttggtattttaattggaaatgcattgaatctgtagcttgagtaat

SEQ ID NO: 6773410 - DNA, 104 bp, Homo sapiens
gtatagcgtggttccgtaaattaaggttgatatgtatctagggattttatttattgatgttctgacatgtgagattttgtttgttgctgaatcaaaacctatat

SEQ ID NO: 6773411 - DNA, 68 bp, Homo sapiens
tgatgccacattcaaatattatgtgagttcctgtgaaacgagatgatatttgcaatgtgcttgcatca

SEQ ID NO: 6773412 - DNA, 60 bp, Homo sapiens
gtgtgttgggagtgaaatgggtggatttggatcatgccctcagaattgctccctgcacac

SEQ ID NO: 6773413 - DNA, 129 bp, Homo sapiens
ggactaggctgggctgagctggactgagctgagctagactgagctgagctgggtgagcttaggtggactgagctgggctgggctgagctgagctggactgggctgggccgaactgagctagactgggct

SEQ ID NO: 6773414 - DNA, 122 bp, Homo sapiens
ttttgttataatagggctcagcacattctagcgtgattgttagtttcagacacttgccacctgtgtgcagttggtgaaagtaagaggaatgctactttgcctgacctcgtttaagaacaaga

SEQ ID NO: 6773415 - DNA, 79 bp, Homo sapiens
acagcgaggtgacagagattaatagcttggtattgactgagcaacttcgagttccttatctctgtcaagtcaaggctgt

SEQ ID NO: 6773416 - DNA, 67 bp, Homo sapiens
ctatcgacattctctgattggtgcctccctgaactcacggacaaaaatcagggtaatgatgaggtag

SEQ ID NO: 6773417 - DNA, 69 bp, Homo sapiens
tctgtaaatgtgtttagttaatgagttgctatgaagcatagtgaacttatatttagatatattagaaga

SEQ ID NO: 6773418 - DNA, 76 bp, Homo sapiens
aggtcatcagtgttgttgattggatagaaagacaaaagtcaattacctgctaatcaataaaggtcatttctgatct

SEQ ID NO: 6773419 - DNA, 95 bp, Homo sapiens
ggggcaggctgacaggcagggtcagcagggctgtggtgtggctgtgtgaccttggacaagtgacttgagctctctgagcctgcctcgcttcaccc

SEQ ID NO: 6773420 - DNA, 63 bp, Homo sapiens
ggccctgcctggcaccttcacagactactgcttcagtgtgtcgagggagggtccagaagggtc

SEQ ID NO: 6773421 - DNA, 93 bp, Homo sapiens
tcctcccaggatttctttcttgtgggtgccctttttgcagcgtaaaaaccccaggggaagaggtagcagtcacaaaagaaatcctagggagga

SEQ ID NO: 6773422 - DNA, 66 bp, Homo sapiens
ggccttggctgccaagctgctgagtctggccttgattcagtagaccctggggagcctttgaaggtt

SEQ ID NO: 6773423 - DNA, 69 bp, Homo sapiens
ttgatttctacagaataaatgtttacagatcatagaaggagactatgtgaacagtatttgtggaagcaa

SEQ ID NO: 6773424 - DNA, 96 bp, Homo sapiens
gggcttgcgaaaacccagattcctgggctacaccccagaaattctgatttaccaggtctgggatggtgcctaagaattttcatttctgacaagctc

SEQ ID NO: 6773425 - DNA, 129 bp, Homo sapiens
ctgagtctttagggtaaatctgcgatgttcataaatccaagatccaggaacttggagcagtgaggagctcagttaccaaagcttggatttggttagtgtctttcatggattttaaagaaactgaagcag

SEQ ID NO: 6773426 - DNA, 122 bp, Homo sapiens
acagaggacatttcccagagacaggttcagggtgccaggtctcgggtctgctcgtggccttgtgttttctggccaggggactggagaacctcacagccagggactttggggaaatcctctgt

SEQ ID NO: 6773427 - DNA, 83 bp, Homo sapiens
tgacacgtgttctgggggagcctggctggggacctgaccgggtgtggtgggggcagccaggctgtcaaggcagggctgtgtca

SEQ ID NO: 6773428 - DNA, 59 bp, Homo sapiens
tcctcttcaaacccagattaaatgcatgtagatacaggctacatgcatggtttacagga

SEQ ID NO: 6773429 - DNA, 70 bp, Homo sapiens
tggggtaacatcttttactctggttcgggtttaaaagaatccaggtgacagagacaggatacctgcccta

SEQ ID NO: 6773430 - DNA, 80 bp, Homo sapiens
agggactgtgtcttgatgttgacaatttctgattgccttacctattatctgttttctcctcatcaggaccctcagttttt

SEQ ID NO: 6773431 - DNA, 64 bp, Homo sapiens
ctagccatgggcattaaaggtatggatgtccttcctcagggcacctttgatacccttggtatgg

SEQ ID NO: 6773432 - DNA, 68 bp, Homo sapiens
agaggtgtgagagtcagtacaacactttgccatcggcagaggtctttgggctggctctcgatgcctct

SEQ ID NO: 6773433 - DNA, 83 bp, Homo sapiens
tttgccttgttattcaactctctggaatgtttacatgccctgtttcctcaaacagattgtaagttcatagagggccaggcaaa

SEQ ID NO: 6773434 - DNA, 59 bp, Homo sapiens
atcagattgtcagcatggttgggttctagtgagggctcttttcatggcttgcagatggt

SEQ ID NO: 6773435 - DNA, 103 bp, Homo sapiens
tctgttagcaccatgaatcttggctgagagctgctctgcagatctgagaattctgtcttcttttccaagcactctgggctgagtttttcaggggattaatgga

SEQ ID NO: 6773436 - DNA, 74 bp, Homo sapiens
ggattcagaatggttattcagggttatgttttttaacaaagttattcataacacctgatggcaatgatgaattt

SEQ ID NO: 6773437 - DNA, 73 bp, Homo sapiens
gaagagggattagtagttaagacataggcatgttaaaatgttattccttttgattctagaatcttccctcttt

SEQ ID NO: 6773438 - DNA, 69 bp, Homo sapiens
gagagcccatcttagcatagaccctctgcccatgtggtcgggagggtgctgtgccaagatgacctagtc

SEQ ID NO: 6773439 - DNA, 105 bp, Homo sapiens
cgttatttatatcgttggagagtcaagaaaaggatgagtgtatagacctaaacagaatctgaatgcttgcctttggctaagttgaagttaatgatcacaataatg

SEQ ID NO: 6773440 - DNA, 57 bp, Homo sapiens
ccatctgcatacacaaacaggaagactaccatagctggcctggaaaaatgcagatgg

SEQ ID NO: 6773441 - DNA, 74 bp, Homo sapiens
gtgccctgccagtgcctcccactggtcacatccaacatgaagccagccacaagggaggcttgtgcaggctgcac

SEQ ID NO: 6773442 - DNA, 75 bp, Homo sapiens
atggtggtgtggtcataagctggcccagtgcttggcgatgctgctattgcaggttaccttatcccacagcagcat

SEQ ID NO: 6773443 - DNA, 60 bp, Homo sapiens
tgctgaccctgagagtggtgcaaccatctgcctgcccctggccaccacctctcaccagca

SEQ ID NO: 6773444 - DNA, 80 bp, Homo sapiens
gctggctctgaagagagcagcagatcttccagcacagcactcgagctctgctaagggataggctgcctcctcaagtgggt

SEQ ID NO: 6773445 - DNA, 77 bp, Homo sapiens
actttacaatgcacatattgcataaatatatgttgataaataaacttgctagctggtgtatgcattgcatgtaaagt

SEQ ID NO: 6773446 - DNA, 74 bp, Homo sapiens
gggggatccgggcgcagccaatcctggccctaggattgtgttggggggcttggcaggcggtgtcccgacccccc

SEQ ID NO: 6773447 - DNA, 57 bp, Homo sapiens
gagtttgatggcttaatagtagatgtatttatgtcttagttgtttgctgtctaactc

SEQ ID NO: 6773448 - DNA, 129 bp, Homo sapiens
tctggggctggtggacggtgttcctctcccagtgctgctctctgtaagagagaactcttagattcaatcctttcctccagagggcccattcgcaagggaacaaaaggtccctgccaactttcccataga

SEQ ID NO: 6773449 - DNA, 63 bp, Homo sapiens
tgggatgagctgcatctgggaagggttttctatggaagccaaaggtgcaggcctcaagcccca

SEQ ID NO: 6773450 - DNA, 55 bp, Homo sapiens
gggggacaggctaaccaggccgtgtgtgagagcagcctttggtttcttgtcctgc

SEQ ID NO: 6773451 - DNA, 63 bp, Homo sapiens
tctgtcatttgtacctaaaagagttctgatgaaaacaagatctcatggccagcaagtggcaga

SEQ ID NO: 6773452 - DNA, 60 bp, Homo sapiens
acactggtcaagagctagcagagctagggtctggcttcatttctgtccttgattagctgt

SEQ ID NO: 6773453 - DNA, 56 bp, Homo sapiens
cctgggttggagagcaatggtgtgatctcagctcactgtagcctccacctcccagg

SEQ ID NO: 6773454 - DNA, 56 bp, Homo sapiens
ctagtttggaactgaagtttcaggatcagtcagtcactacttaagatccatgctag

SEQ ID NO: 6773455 - DNA, 102 bp, Homo sapiens
gagacctctgcaagcatcatgatttggagttggagtggtttctagagtttcggtcttgctctgggttgtcatgggtccaacccactttgtgatgcaggtctt

SEQ ID NO: 6773456 - DNA, 77 bp, Homo sapiens
taccacagactaggtggcttaaacaacagaaatgtgttttcttacagtttgaagtttagaagtctaagattgaggta

SEQ ID NO: 6773457 - DNA, 79 bp, Homo sapiens
ctgtctcacagttctggaggatagaagtctgagattaaggtgttggcagagttggttcctcctgagggctgtgagggag

SEQ ID NO: 6773458 - DNA, 73 bp, Homo sapiens
gtactgctgcggtacctgctactaccgcttctgctgcaagaagcgccacgagaagctggaccagcgccagtgc

SEQ ID NO: 6773459 - DNA, 85 bp, Homo sapiens
cattattacaaaagaagggagaaggtaccatttagcccctaagccatggaagttaacagactctttccatcttttggtaatgatg

SEQ ID NO: 6773460 - DNA, 55 bp, Homo sapiens
agcttctcaagtgtttgcggggttgcagtaggcagcgcagagatgggaagaagtt

SEQ ID NO: 6773461 - DNA, 72 bp, Homo sapiens
tcattctcagaaatgctcggaaatggattcctgttacttcataagaaacctttccaagcatttctgttgtga

SEQ ID NO: 6773462 - DNA, 67 bp, Homo sapiens
taacttagcctaagatattttcattaaaggtttcccttttaaggaaaaaatgtacttagcctggtta

SEQ ID NO: 6773463 - DNA, 105 bp, Homo sapiens
gtgtggttttctagcaccttgaggaaatttagtgtctttcaaaaggtttattctactaataagctcttttggttgagggactttgcaaggtagagaaaatgtcat

SEQ ID NO: 6773464 - DNA, 98 bp, Homo sapiens
cattgcgtagaactgaggttagcaggttaccattgatttcctctacttatgctttaagaggttggcattggtaagccgctacactttcttggtcaatg

SEQ ID NO: 6773465 - DNA, 119 bp, Homo sapiens
gccgggtgtggtggtgcgtgcttgtaatcccagctactcaggagggtgaggcaggagaatcacttgaacctgggaagtggaggttacagtgagcgaagatcgcgccattgtactccagc

SEQ ID NO: 6773466 - DNA, 56 bp, Homo sapiens
tctacgttttgaaataaggtggcaaataaatatgccaccttatagataaaattaga

SEQ ID NO: 6773467 - DNA, 91 bp, Homo sapiens
cagctattcctgtggtaggctttttctctccaggatcattctaacatgattttataggaatggtcataagaggagggcccatcacttgctg

SEQ ID NO: 6773468 - DNA, 57 bp, Homo sapiens
gctcagtgggtggctgaaggggtctggggtcagctccgctccaccccacccactggc

SEQ ID NO: 6773469 - DNA, 80 bp, Homo sapiens
tatggttgcagaacttaaagacagagtgcttactccacctccatctgtgagagcttaacaagtcatgacttctgtccatg

SEQ ID NO: 6773470 - DNA, 63 bp, Homo sapiens
gaggcagctggccctgacacgcagacttcctgaagggtctcttgtttatgccaagctttcctc

SEQ ID NO: 6773471 - DNA, 117 bp, Homo sapiens
gtccttttagccttggcagggcacctaagtaaacttgccaagagctttgctagccgtgggcaggccgagctcattggaggaggtgctaggaacgccctgctctctggctttcaggac

SEQ ID NO: 6773472 - DNA, 83 bp, Homo sapiens
aagaagttacagtcaggagatattttgttccctatagaaactgaatataacatcttaaaatttgtccctgagtgttgtttctt

SEQ ID NO: 6773473 - DNA, 129 bp, Homo sapiens
tcggacatcatgccttcacctgtgcgcttctgagcctcaagggcttgtggcatgttttgatgctgtgtttatgccatgcacacgtaccctacaaggcacgccagtgtacatatggcatgcataattgga

SEQ ID NO: 6773474 - DNA, 77 bp, Homo sapiens
aattgggacgtttatctttattagtgaatcaaagtgggactcagttaatggtaagggtgaaagagattgtcttaatt

SEQ ID NO: 6773475 - DNA, 70 bp, Homo sapiens
gtgtcattcacttattgtcctgactcatggcctggtcttaggtcacagtcaaggagaatgtcactgatac

SEQ ID NO: 6773476 - DNA, 60 bp, Homo sapiens
ttccctgatggccccaaggatactcacaaaaacaaacatctgggcagccatagaggcgaa

SEQ ID NO: 6773477 - DNA, 129 bp, Homo sapiens
taaattttatgtcttattttcagaagtagcagctctgtggtaataagaaacagcaattattttagggctaaaatagaagctctctggttctcagactgtcacttgagctgaaagacattaaaggacctg

SEQ ID NO: 6773478 - DNA, 94 bp, Homo sapiens
tcccatttccaggagggagatgcctttggctcggaggtgacatattggttgagttacccagtgaagccgaggcagaactccctgtgagatggga

SEQ ID NO: 6773479 - DNA, 112 bp, Homo sapiens
caggggaggcggcactgtgggggctgccggcagccggggctggggagagacatgtggacacgtggcctctatggctcccgcctgccagatcctccgctgggccctcgccctg

SEQ ID NO: 6773480 - DNA, 101 bp, Homo sapiens
gtcctaggaatttcgcactttgtacttggctagagccaggaggctgctaaattctcagcagtagcctcagttccagtcttgcagtggtgagaagaaaggac

SEQ ID NO: 6773481 - DNA, 75 bp, Homo sapiens
atgcaagaagaagcagtatttctcttaatcacttgttatggggactaaatgagatactgtcttcaaagcttgtat

SEQ ID NO: 6773482 - DNA, 69 bp, Homo sapiens
atgagtcctcagatagaaagtgcgtttccaacagcaaacagcataaaataaatctacatgaggacacat

SEQ ID NO: 6773483 - DNA, 59 bp, Homo sapiens
tgtctgtggtataaatgacatccttgtgcagtgcacaatgggtgcaactatccatgaca

SEQ ID NO: 6773484 - DNA, 69 bp, Homo sapiens
ggctgccaggggtgggtgtggtcagtgccaagagctgtccttaccccatcacatctcaccactgcaacc

SEQ ID NO: 6773485 - DNA, 113 bp, Homo sapiens
ccagagtggagaatgcaagtttggtacgtatcagagagatgcagtaacttctattgaaaaacttaagtcacatgagtttctctttatggtaggagaccatattctccatacgg

SEQ ID NO: 6773486 - DNA, 72 bp, Homo sapiens
tggccattgcgatggctctgatgggaggtattggtttcattcaccacaactgcaccccagagttccaggcca

SEQ ID NO: 6773487 - DNA, 90 bp, Homo sapiens
agagctatttcagggatgtgatgagctgagccagctgctggagagggactccatgggaaaatgggctcggccgtcagcttcatgagctct

SEQ ID NO: 6773488 - DNA, 58 bp, Homo sapiens
ttgacataggatttggcatttgggatgtgattccaaatcaccagcagccaatgtgcag

SEQ ID NO: 6773489 - DNA, 106 bp, Homo sapiens
cctcacccatcaacactattgcccacttaagctgattaagccccttctagcagagaggttggaggaatcagggcttaggctggtcaagggaatgggaaaagtgagg

SEQ ID NO: 6773490 - DNA, 74 bp, Homo sapiens
gcctggacaagcactgtgcctcatatctgatggtaagattcatagtttgtaagagcacagggttggagccaggc

SEQ ID NO: 6773491 - DNA, 72 bp, Homo sapiens
atcctgtgaggataagcccttgggaggctccactttgtcctccagtaacaagtggactagtctttacaggat

SEQ ID NO: 6773492 - DNA, 60 bp, Homo sapiens
gttccggtgctgaaggcccaggtgagggccctcctctctgacccaccctggcactgggac

SEQ ID NO: 6773493 - DNA, 61 bp, Homo sapiens
ctgagtaacgacctcatctctgacgtatctatctaccgtcaaaggaggcatcgttctgcag

SEQ ID NO: 6773494 - DNA, 63 bp, Homo sapiens
gtaagcaaacagcaaatgattttttataaccaaatagagattttagttttgctatttgcttgc

SEQ ID NO: 6773495 - DNA, 85 bp, Homo sapiens
aaaatttaagtagattactactctaatggggataaagggagattttccttgagtattttgccatggagtgggtcaactatgtttt

SEQ ID NO: 6773496 - DNA, 90 bp, Homo sapiens
gacatcttctcagcacaggaatatggtggacaagagcaatatggactccgtccttgtggcacttacatcctagtttgggagtgtgatgtt

SEQ ID NO: 6773497 - DNA, 57 bp, Homo sapiens
tcctcccctcagggcaacggatggctgcagtcttgcctatttggcctgtggggaggg

SEQ ID NO: 6773498 - DNA, 57 bp, Homo sapiens
aggagcagttgttgagcaagccaccaccaccgaggtgaatgagctctgactgcttct

SEQ ID NO: 6773499 - DNA, 64 bp, Homo sapiens
cgtggagggctcctgcatgctgccagccttgggttgtcccctggcctggcaggggacctctatg

SEQ ID NO: 6773500 - DNA, 67 bp, Homo sapiens
gctggcgtattcttcctagagttgcctccttatatatgtagttgcaagttaggatgaatgccttagc

SEQ ID NO: 6773501 - DNA, 87 bp, Homo sapiens
tgggctgtcagtctctttcaggttccgtttctgacttcatgtgattttgtaaggcagatatattcgtgaaataggctgatggtgcta

SEQ ID NO: 6773502 - DNA, 83 bp, Homo sapiens
ggtgatgtaatacatatggaattccatgttggttcagtacaagtgggaaaggaaagaacattattccatctgtagcatcttcc

SEQ ID NO: 6773503 - DNA, 55 bp, Homo sapiens
gctgaactctggacttagcaggcttccctatggtcagtgtgcatttagagtctgc

SEQ ID NO: 6773504 - DNA, 63 bp, Homo sapiens
cacagacccagtacttacaaacctatgggatcagcgagaccagtctgtgatcttactgctgtg

SEQ ID NO: 6773505 - DNA, 82 bp, Homo sapiens
ggcccagagtgggcgtgcccggcagtcacacacccaggggttgtcgttgagcctcaggtactgcagggcacgcaggggggcc

SEQ ID NO: 6773506 - DNA, 59 bp, Homo sapiens
gtgctgagtcatctttatctgtagatcccttctgagatacagtggagtgtgttcagtac

SEQ ID NO: 6773507 - DNA, 65 bp, Homo sapiens
atgagtggggcttagggaggctcagaaggtccactctttctcagagcctaactaacctaacgcat

SEQ ID NO: 6773508 - DNA, 79 bp, Homo sapiens
gaccagggcacttgcgatgctcacgggactgcataggaaacttggtgcaatagactgtggtattaaagagcttttggtc

SEQ ID NO: 6773509 - DNA, 71 bp, Homo sapiens
actcccagcatcccagtgggcagcaggtagggacctgctgccatgctgcccccaacagggaagttgtgagt

SEQ ID NO: 6773510 - DNA, 97 bp, Homo sapiens
ctggcaatttggggttgtctgccacctacagtgcttgtcagtcaccctcactcggtgccaggccacaaggctgttggtcacaaaccaccccagccag

SEQ ID NO: 6773511 - DNA, 61 bp, Homo sapiens
gagagtagcagcaggaagccctggcttgcagacctaagctggggctccagctgtgattctt

SEQ ID NO: 6773512 - DNA, 80 bp, Homo sapiens
ttgcctttggaataatcagatcctagtcctttgtggatgcaagtcctttgtggactaggatctggtcattctaaaggcaa

SEQ ID NO: 6773513 - DNA, 65 bp, Homo sapiens
tgcctggcaccccagtctgcacagccccgcacgccctgggggagtgtaggatgggggtggaggca

SEQ ID NO: 6773514 - DNA, 124 bp, Homo sapiens
cccacaggctctgccttccatcccccagccccagtccagtgccatgcatggctgtgctcagccgagctggcatccctggccttctgctagggctgaaagtgccaaggactccactacctttggg

SEQ ID NO: 6773515 - DNA, 75 bp, Homo sapiens
ttctaggcagaaattggcagagaagacctagcgttcaagggttctagacttctcttggctatattattgtttgaa

SEQ ID NO: 6773516 - DNA, 57 bp, Homo sapiens
gggggcggcttcccacggacacgtttgagttctgtgttctcagggataacttccccc

SEQ ID NO: 6773517 - DNA, 57 bp, Homo sapiens
tcataaaatgctcctgatattgcaggaaactcagtagtctggcagggtctttagtga

SEQ ID NO: 6773518 - DNA, 60 bp, Homo sapiens
ctccagtgcacccagaggattttgaaggcttatgccaacaattctttggggcagttggag

SEQ ID NO: 6773519 - DNA, 60 bp, Homo sapiens
gcccagcactcctctctgacatttgatctaaatctcctgaagtcataggggaggctgggc

SEQ ID NO: 6773520 - DNA, 121 bp, Homo sapiens
gtgtcagtcagggttctttgttgcaagcatcagacactgactcttgttaacttcagcaaaagagagatctgctggcagaatatcaggaagctcagttgtttgcggagaagcctgaagacgc

SEQ ID NO: 6773521 - DNA, 57 bp, Homo sapiens
gggaggtcataattggtttgtagtaattgtttttactttcccatagcatggcttcct

SEQ ID NO: 6773522 - DNA, 69 bp, Homo sapiens
ataagtctcatgagagctgatgactttacaaggggcttcccctttcactcagctctcattgtctcttgt

SEQ ID NO: 6773523 - DNA, 65 bp, Homo sapiens
agctttacacttggacccacacttgatagtacaccaggaaagggttcatggtgtaggatgtagct

SEQ ID NO: 6773524 - DNA, 70 bp, Homo sapiens
tttgtataaattttgaggtgagtagtatttaatcttgtacttcaatttgaacctcaaaaagttgtataaa

SEQ ID NO: 6773525 - DNA, 58 bp, Homo sapiens
tgggcagcagaaccaggccgaccacagggacagacgtggtccaggcgtgagctgccca

SEQ ID NO: 6773526 - DNA, 56 bp, Homo sapiens
caaaagcctccaaaagcccatgaggcatgacgttccaggagcttaggaggttattg

SEQ ID NO: 6773527 - DNA, 59 bp, Homo sapiens
agagacctgcccagagcccctttcactctgagttatggagtatttggtctggcagctct

SEQ ID NO: 6773528 - DNA, 103 bp, Homo sapiens
ggtaggtactattgtttccactatagagatgagaaaattgaggcccatagatgttaaattacttgactagggtcacaatttcttaagtggcaaggttcttgcc

SEQ ID NO: 6773529 - DNA, 71 bp, Homo sapiens
gtcttgacctagattttgcctgattcatgatattaggaatgataggcattttaagtagtttagggtcaaac

SEQ ID NO: 6773530 - DNA, 62 bp, Homo sapiens
ccaaaactgtaagagaataaactaccactaagcttgtggtaatttgttactggtgcagtagg

SEQ ID NO: 6773531 - DNA, 75 bp, Homo sapiens
ctgtagcccatggcttttagccctacatgagtttgggacagcaatcacataggaatgaaaagccataggccacag

SEQ ID NO: 6773532 - DNA, 62 bp, Homo sapiens
gagctacaactcagagttcctgtgcatagtggttccattgaattcacagatctgagaagttt

SEQ ID NO: 6773533 - DNA, 89 bp, Homo sapiens
gcctttgagcacctgtggccagaaccaggagaatgatatactttccattcacagttatcttctccttttctgtcccaaggctcaatagt

SEQ ID NO: 6773534 - DNA, 55 bp, Homo sapiens
tgttttggtctggctttatatctatcattgaggttataggccacactccagaaca

SEQ ID NO: 6773535 - DNA, 79 bp, Homo sapiens
cagcctttgacttttagaaccttcagattaggaggtggtcttggggccccttaggagtgcgggtgaaagtgtagagctg

SEQ ID NO: 6773536 - DNA, 113 bp, Homo sapiens
ggtagttcaaaggctggaatgggagcttggcagtgtcactagggagccacacttcctctgcctgtgagcttccatccttactgtgtgggctcctcatcttcagcctcactgct

SEQ ID NO: 6773537 - DNA, 85 bp, Homo sapiens
ttgggggtggctttttcaggacacttggcacaaggtcacagatatttgtggctttggaatggagttctgccctcggcacccccag

SEQ ID NO: 6773538 - DNA, 62 bp, Homo sapiens
gcatcccttcccccgagcatggcagaggcctggctttgcaaggccaaggccataagggatgc

SEQ ID NO: 6773539 - DNA, 63 bp, Homo sapiens
ttcacattgtggttcatgtgaaaggcattctctagagttgtgcaaggcacgaccatatgtgga

SEQ ID NO: 6773540 - DNA, 84 bp, Homo sapiens
agagatggtaaaccttgcatatttttgaaagcatttgaagacctcaaatcaactgtttatgtaagtatgcagcttttattctct

SEQ ID NO: 6773541 - DNA, 68 bp, Homo sapiens
ccgggggcaatagagttggaactgaaacccagtacaaccactatcagaagtccaattttcgcacctgg

SEQ ID NO: 6773542 - DNA, 58 bp, Homo sapiens
ttgatgctgttattgtccaagatgttctctcttagaatagctggtaatgatagcacaa

SEQ ID NO: 6773543 - DNA, 62 bp, Homo sapiens
gactaggagcacacatccaaatgcccgcagcatacctggggcagtgtggtcgtgcctttgtc

SEQ ID NO: 6773544 - DNA, 67 bp, Homo sapiens
ctgagccctcggggctgtattccccagggactatgtcccgaaaaggaggtcagtgcctgagggtgag

SEQ ID NO: 6773545 - DNA, 60 bp, Homo sapiens
gcagatggagagaggggaggaggccccaacgtggggcagtggctcccctgttttccctgc

SEQ ID NO: 6773546 - DNA, 58 bp, Homo sapiens
cctgctggtttttacaaagatgtgggtctctctttccccgagtgtcagagcttgcagg

SEQ ID NO: 6773547 - DNA, 89 bp, Homo sapiens
gaagagagaggtctcagggatggttgagaattggtactgtagcaagaaaggataccaattccgatcacccaataaatatccctgtcttc

SEQ ID NO: 6773548 - DNA, 56 bp, Homo sapiens
tgctaagatatgggtagtcaagaggttgataaaacctagcttctcatttctaagca

SEQ ID NO: 6773549 - DNA, 79 bp, Homo sapiens
gctgccaggagaggtctcccttccccagtcacctcatgccccacggtcatactggggtggatgggcctgtcctgactgt

SEQ ID NO: 6773550 - DNA, 74 bp, Homo sapiens
atcttttctattattatctttgagtgggactcattattgtctgagctatttattaaaatggtgaaggaaaagat

SEQ ID NO: 6773551 - DNA, 65 bp, Homo sapiens
tgcagaagtggctccaaaaacaaatgacataaagcaggaacactttagtaatggagctacttgca

SEQ ID NO: 6773552 - DNA, 66 bp, Homo sapiens
ctcctggatgcacggtcatgtcttttcatcctgcttgtacttgaacttgactgtagacccttggag

SEQ ID NO: 6773553 - DNA, 123 bp, Homo sapiens
ggccctggccactcaccggaagcagtggcgatggtacagcctgccgtcagccaggtagcgctgcaccaagtgcacatgctgctggcaggctgcgcacgtgctgctgggggtctggccggtgcc

SEQ ID NO: 6773554 - DNA, 78 bp, Homo sapiens
ggatagggcccaagtaacttgattaaggtaagatgaaatgagaaatgtttgctccttgaaaattgctaacatctgtcc

SEQ ID NO: 6773555 - DNA, 75 bp, Homo sapiens
ggtataatgaaagaatgaaacagcccacagacaagctcaattttgggtctttggatgctttttgttctgttcacc

SEQ ID NO: 6773556 - DNA, 76 bp, Homo sapiens
tttcatcagtgccaggctagcccagaccacaggaagtttatgaaagcctttgtgatggctggcaggctgggtgaga

SEQ ID NO: 6773557 - DNA, 76 bp, Homo sapiens
attgggcagatcaatcaacttcttagtgcctcagctttttcctctgtaaattagaagatagtgatttctgcttgat

SEQ ID NO: 6773558 - DNA, 111 bp, Homo sapiens
gcacctgagcctgcacgacctggggaaggcctctccccttctccagcctccagttctctggctggagaagggaacgggcctggctgatcccagggtcctgaggtttgatgc

SEQ ID NO: 6773559 - DNA, 68 bp, Homo sapiens
tgagttgtagtcttttatgtgcatctcaggccattgttggtaactggtcacatgtgagattaaacttg

SEQ ID NO: 6773560 - DNA, 79 bp, Homo sapiens
tttgctagacttcagctttgtgatctttgggtcagacaccatgatgagagatgcagatcgcaactgagcgtcatttaaa

SEQ ID NO: 6773561 - DNA, 81 bp, Homo sapiens
ttttcaaagaaatttacagccagtagtgataaggttgtgaacactgaaagctgcctggctgatgaaaattctgtttgaaaa

SEQ ID NO: 6773562 - DNA, 73 bp, Homo sapiens
tcaataagcgattggctgttgttggccatcagctgtaggaatagtcagcaatagttagtttacaactttttga

SEQ ID NO: 6773563 - DNA, 84 bp, Homo sapiens
tcattgagtatggaaagtgagacatatttatagccaggagaacatggttatgaagctgataatcactgataatccatgccagga

SEQ ID NO: 6773564 - DNA, 63 bp, Homo sapiens
ggtgcgaggcactgcgcccggcagtaatcagacttttaatacaccaatgcagtatctcgttcc

SEQ ID NO: 6773565 - DNA, 60 bp, Homo sapiens
gcagagatccttgctggatgacagttgatttggtggctgttgctaggatagaatttctgc

SEQ ID NO: 6773566 - DNA, 130 bp, Homo sapiens
tgaaccatctggcaaaggggcaaatggggtgccatttctaggagagatggaaattgatgaggcacagtgagttgtttggtcctttaagtctttctctggtctctagtctgcccctcctgtttcagtgtca

SEQ ID NO: 6773567 - DNA, 67 bp, Homo sapiens
gtatgtggaagaaggtggtgttggtaggtcacagaagggtgggcccagccagcctcttcccatatgc

SEQ ID NO: 6773568 - DNA, 69 bp, Homo sapiens
gttgaggccaatggagtcaaaggtacttgcccaaggccacagggcaaaactcggacatctaatctcgat

SEQ ID NO: 6773569 - DNA, 70 bp, Homo sapiens
tgcttcatttccttatattgtaaaaatgtcaactgtagtgagacaccaaatgctgtgaggaatgacagca

SEQ ID NO: 6773570 - DNA, 58 bp, Homo sapiens
cagagtcaggattacccaatctgtacaagctttgtgtaaaggaaggaacctgagtctg

SEQ ID NO: 6773571 - DNA, 60 bp, Homo sapiens
gcaaatcctcctgcctgaagaagtgcatctcagcatcacttcagctgtcggggcatttgt

SEQ ID NO: 6773572 - DNA, 75 bp, Homo sapiens
attgcctctgttccatgttttgttccatataaacatccagacacaggtctcatgggagaaacatcatgaggcagt

SEQ ID NO: 6773573 - DNA, 62 bp, Homo sapiens
gaggttaggtgacttgttcagagttccatagcatcttcccattcaacatacaacctagcctc

SEQ ID NO: 6773574 - DNA, 58 bp, Homo sapiens
gctcttaggaggtgttccttacctgtcactcccaggtaagtaacaccactcctggagt

SEQ ID NO: 6773575 - DNA, 59 bp, Homo sapiens
acttttacttctggaatgtgaagctgtatttcactgaaagcacatttggggagttaagt

SEQ ID NO: 6773576 - DNA, 57 bp, Homo sapiens
aactcagctcaggagctggctggggacagagttgcccagagagcagtgagtggagtt

SEQ ID NO: 6773577 - DNA, 56 bp, Homo sapiens
ggtcatcaggaaaagctccactgagaaggtgatttctgagctgccttttgaagacc

SEQ ID NO: 6773578 - DNA, 64 bp, Homo sapiens
gcattgggcggggacctcggctgcagccctccagctccccacagtcgactgtgccctcccgagc

SEQ ID NO: 6773579 - DNA, 81 bp, Homo sapiens
ggcttggctgtcataactcaagttgttgggggacacatgactatttaagcagcaattatggagttgttgacgggcaggacc

SEQ ID NO: 6773580 - DNA, 62 bp, Homo sapiens
cagagactctttatggtaagccgaccagacagattctgcttgtgcctgtagagaagttcctg

SEQ ID NO: 6773581 - DNA, 57 bp, Homo sapiens
catcactgggcttctaatcactgggacgatcttgtggacaatgaggccccggtaatg

SEQ ID NO: 6773582 - DNA, 60 bp, Homo sapiens
aagtcacacagttaacatgaggaagatttatggggaattgaacttatatttgtgtgattt

SEQ ID NO: 6773583 - DNA, 80 bp, Homo sapiens
aggcaaaactctttttctgcacacgtgtcccattcctcctccctgtagtttggagagggcattttagaaaaagagtccct

SEQ ID NO: 6773584 - DNA, 82 bp, Homo sapiens
tctccatatggactattttcattttattattttgctgccttgggagaatctagatgaatgtgaggatatcctgggctggaga

SEQ ID NO: 6773585 - DNA, 84 bp, Homo sapiens
tgaggtcttctggcagggtgtgtatttacagtttttcacagtccccatcactccttatttatcataccttgtccaatttgccca

SEQ ID NO: 6773586 - DNA, 58 bp, Homo sapiens
tggagatgcacgagcaggtggagcagctgaagcagagcatccaccgcgtgcacctcta

SEQ ID NO: 6773587 - DNA, 56 bp, Homo sapiens
cacctgagcaaccctgtgcgggggagaaactcagttttgcattggatgtgcaggtg

SEQ ID NO: 6773588 - DNA, 69 bp, Homo sapiens
gcccatcatcactgtggaggctccaagttccagggccttgaccacatgctccacggtcctatgatgggc

SEQ ID NO: 6773589 - DNA, 90 bp, Homo sapiens
tcttccaggatattttgagggcttggcactgggaatatggagcaatacccaacacagtcccagcctgtaggattgggttcatatgggaga

SEQ ID NO: 6773590 - DNA, 67 bp, Homo sapiens
gtgtcctttggctctggagctcctgggcccgggttccgcatccgggaggagaaaggagcgagcgcgc

SEQ ID NO: 6773591 - DNA, 77 bp, Homo sapiens
gttgtggcaatgactagttaataagtgctcggtaaatgctcattgaaatgagactaattgattgataggtgcctaat

SEQ ID NO: 6773592 - DNA, 79 bp, Homo sapiens
tagttagtttttctgagatggagtctttttctgtcacccaggctctggagtgcagtggcgccatctcagctcatagcta

SEQ ID NO: 6773593 - DNA, 76 bp, Homo sapiens
ggcactgggcaccggctgagggacttgtgctccaggaactgttggtcttgccactcctccgcctgggcccagtgcc

SEQ ID NO: 6773594 - DNA, 101 bp, Homo sapiens
ttcaatggttttaagcttttacgaaagacaagagtatctttgactttaggctgcttctgccttgaaaaatatgccttgcttctttaaagctggccatagag

SEQ ID NO: 6773595 - DNA, 71 bp, Homo sapiens
aagtgcaatattgccatgttcttgctgctcaaaataattgggagcagcaaggagatgataatattgcactt

SEQ ID NO: 6773596 - DNA, 62 bp, Homo sapiens
gtctggcttgggtaggtagttcaatgattcaacaaacactgagcacctacctggagccaagc

SEQ ID NO: 6773597 - DNA, 63 bp, Homo sapiens
gtgacaaggaaaggattttgtaagacattagtgtacaagttgagcaatgttggttcctgtcac

SEQ ID NO: 6773598 - DNA, 55 bp, Homo sapiens
agtgtggccaatgaggatgggcgaagggttgctgccatcttgaaccatgcccact

SEQ ID NO: 6773599 - DNA, 70 bp, Homo sapiens
tctcaagacttagagcatcttgaaaatagggatcatgtcttacttatttctttggtctccaagtctaaga

SEQ ID NO: 6773600 - DNA, 59 bp, Homo sapiens
gttatgtttccttgtgtccatttgcccagcgctggaatctgtggagcaggaagcctggc

SEQ ID NO: 6773601 - DNA, 65 bp, Homo sapiens
agaaagggccatcccagaacagaaagggatgtctttaatcctttctcttggaaaaggccaattct

SEQ ID NO: 6773602 - DNA, 61 bp, Homo sapiens
ctgtctctagaggtactcaagtgtatttttaataatgattgactggagtaccctagagaag

SEQ ID NO: 6773603 - DNA, 82 bp, Homo sapiens
gtataatatttctagaatttttaatgcagtataaaatgtggtatttaccatcaaggtgctttattaagagagaaatttgagc

SEQ ID NO: 6773604 - DNA, 103 bp, Homo sapiens
gtttctttgaatatatggtttcctcacagaacaccaaagaaccttcctcaacaggaaacctcagtggcttgttccctctgtgtgaggatgtgttgaaaagaac

SEQ ID NO: 6773605 - DNA, 73 bp, Homo sapiens
gctcctgcccttggatctccagttcccctcagcctccaggtgggccaacaggaggtctaggaatagtaggagc

SEQ ID NO: 6773606 - DNA, 65 bp, Homo sapiens
ttggggctaaagatgtgttctttggagtcaatgatgatgacattcgatggtatttatagccttaa

SEQ ID NO: 6773607 - DNA, 108 bp, Homo sapiens
tctctctgccgcccaggctggagtgcagtggcgcgatctcggctcactgcaagctctgcgtcccgggttcacgccattcttctgcttcagcctcccgagtagctgaga

SEQ ID NO: 6773608 - DNA, 103 bp, Homo sapiens
atgtctcttgagtagttttcatgtgttttgaggatagttagtgtttattgagctcttccatgtgccatctactgtcccaagcacgtcacatacttcatctcat

SEQ ID NO: 6773609 - DNA, 87 bp, Homo sapiens
tggtatatttagtgtaggtggatcataattattttgcgaaaattttcccaggtgattctaaagtctagcctgtactgaacatcacta

SEQ ID NO: 6773610 - DNA, 60 bp, Homo sapiens
ccacatctccctattgctctttcatttgtaattctgaaaggagtagaagaatgatgtagg

SEQ ID NO: 6773611 - DNA, 92 bp, Homo sapiens
gtgatgaagtgccaagcccagagggcatgagagccacaagaccagcctgcctttccaggctctctctgcccctgggactctgcctcactcac

SEQ ID NO: 6773612 - DNA, 68 bp, Homo sapiens
ctttcactgactgatgatcagaaatatttgcctggatggcacagtacagctaatgtcattagtgaaag

SEQ ID NO: 6773613 - DNA, 130 bp, Homo sapiens
gcatctgatgaatgctgactctgcacgacactgttttgtgtgcaagagattctggcataaaaggactcagatcctatgttcaaactttttacacaccagagcagggaagcagacaacagtccataagagc

SEQ ID NO: 6773614 - DNA, 72 bp, Homo sapiens
ggcttagtgagtttgctcagtgcctacagaaatcagaaatgtgtttaccaaggcatagtaatctctgaggcc

SEQ ID NO: 6773615 - DNA, 61 bp, Homo sapiens
tccactggagtccagacccaagaggccatctgcagaaagagaagccctggctctaggtgga

SEQ ID NO: 6773616 - DNA, 74 bp, Homo sapiens
ctctgggtgtcatggcctcagctgacggaaccacctgctaaaacacgttcatggcagaggcacggcaccaaggg

SEQ ID NO: 6773617 - DNA, 82 bp, Homo sapiens
ggaagctggggaaatcagttagggtgttaatgaggctttctttggtggcaactttaactgagcactctcattctccatctcc

SEQ ID NO: 6773618 - DNA, 77 bp, Homo sapiens
tgagtgcctctgcaggtccgagttcatctacctggggaacagcgtcttcatcgactgggacgtgcagatgtactaca

SEQ ID NO: 6773619 - DNA, 56 bp, Homo sapiens
gacctggattcaaattcagactctgccacttagttgcttttgaatttgggccagtc

SEQ ID NO: 6773620 - DNA, 92 bp, Homo sapiens
ctgaaaggcctgatttgcctctgtttcctatgtagagtagacatctgtctggcctgcatcagtggatatgatggtggatggaggttctgtag

SEQ ID NO: 6773621 - DNA, 65 bp, Homo sapiens
ggcagagcagaggtgcaggttggagccaggttactagcaatctaatcccagctctgccatctgcc

SEQ ID NO: 6773622 - DNA, 69 bp, Homo sapiens
tgcccagcacatagtgttttgagagacagctgactggctgtctcatacaaggccctgctctgttgggca

SEQ ID NO: 6773623 - DNA, 65 bp, Homo sapiens
gcaaggcataggagggtgtcaggcctctgagctcaaactaggccatcatatcccctgtgacctgc

SEQ ID NO: 6773624 - DNA, 62 bp, Homo sapiens
tttgcatttctcgtaaggaaacacatagcaacttgtctccttgaatgaagagaggtgacaaa

SEQ ID NO: 6773625 - DNA, 60 bp, Homo sapiens
gtgtataaggtgggttctctggctgtttaaaaacaggcaggagaattctgcctgatatat

SEQ ID NO: 6773626 - DNA, 55 bp, Homo sapiens
tagtagctagcatattgggcagtgtggtcatagaccttcagtgtgctggctcctg

SEQ ID NO: 6773627 - DNA, 129 bp, Homo sapiens
aggctgggctccaagcctgctcctggacctgccctgctttttctggccacacccagctcttaggacctcagctggcaggaagacgtggggcaccatctgagggcaggacactcctttggtcccctccct

SEQ ID NO: 6773628 - DNA, 99 bp, Homo sapiens
attgagcaggggctgtggatagaaatttcctgtaggggcttgcgaaggcatcttcactggtcctttataggaaccctctatgcatttccctttgccagt

SEQ ID NO: 6773629 - DNA, 55 bp, Homo sapiens
caggggcaggtgtgagatcatcttgtaagaaaacaagcttctcccttgtcacctg

SEQ ID NO: 6773630 - DNA, 56 bp, Homo sapiens
actgagggtcaaccatttgctctgtaaccccagcttaaatgtgtctgagcctcagt

SEQ ID NO: 6773631 - DNA, 55 bp, Homo sapiens
caggtggttgagagctgtaggcctgacaccagaaagtctgatctcaaccattctg

SEQ ID NO: 6773632 - DNA, 120 bp, Homo sapiens
ctggatgtgttgttgagggaaggctagcctgggtagctgtaggtcatttaatcacctagtgaagctagaattagtgtgtttagatctcagttgggaagctttctttggagataagtctgg

SEQ ID NO: 6773633 - DNA, 63 bp, Homo sapiens
gagagtccctgggtctgttccatctaaacactgttgaagcaagagacagatctgagggacctc

SEQ ID NO: 6773634 - DNA, 87 bp, Homo sapiens
agatgagaagagtggggtgggcttccatgaggacatggcatgctttttgagtcttgtcttcatgataccctaagccactctctgtct

SEQ ID NO: 6773635 - DNA, 57 bp, Homo sapiens
tctcctgggtgctttatcagaacaggctttcaccagctttatgaggctctcaggaga

SEQ ID NO: 6773636 - DNA, 76 bp, Homo sapiens
cctggcccagggagttcatggtgtgtcctaagccacatcagtcacacctagaaccttatccctgaccaaggcctgg

SEQ ID NO: 6773637 - DNA, 67 bp, Homo sapiens
cgcacactctgggctttgccaagttaagcaaaataggataattgcatgcaaggctccaaggggtgtg

SEQ ID NO: 6773638 - DNA, 101 bp, Homo sapiens
cccaatttttcaggtggtcaaaatatccacttgttgaaaccagcctaggcgaacttaaggacattggttttgagtaatgtaaaacacctggggataatggg

SEQ ID NO: 6773639 - DNA, 92 bp, Homo sapiens
tttcagaaaactagagaaggcttattttctttgtaaaaatgttgctttgctttgcttcacagaatgatccttctcccaaagtgtttctgaga

SEQ ID NO: 6773640 - DNA, 75 bp, Homo sapiens
tttgttactaagcctttaaatagctcatctgacttctcctctgtcaatcatctattcaggaggcttggtaccaag

SEQ ID NO: 6773641 - DNA, 64 bp, Homo sapiens
tgaaaacctcccctctgcttctcaaaacacacctgtccaaagcagacagggggcgtaagtttca

SEQ ID NO: 6773642 - DNA, 79 bp, Homo sapiens
ctgagtagacttgatttgcggtttcgttattgatgttgggcaaaaaaagatgacaaaagagtaagtaatgtgctgccgg

SEQ ID NO: 6773643 - DNA, 98 bp, Homo sapiens
gaggcaggagaatcacatgaacctggcaggcggaggttgcagtgagccgagattgtgccactgcactccagcctggccacagagcgagactccgtctc

SEQ ID NO: 6773644 - DNA, 64 bp, Homo sapiens
ttgtctctgctcaaaggctggggaggcatcctctgtgtgtgctcccttgccagaggggaagcgg

SEQ ID NO: 6773645 - DNA, 67 bp, Homo sapiens
ctcttctgcttccctcctttctaagatggagtcttctttccttcttgagcatgggtagtactcaggg

SEQ ID NO: 6773646 - DNA, 112 bp, Homo sapiens
cagatgctgtcctcattctggagattaagttctcagccacaaagtagattagagtatttatccactgtcttggtagtgggaacttctccctgagctgagacgagagtgtttg

SEQ ID NO: 6773647 - DNA, 65 bp, Homo sapiens
ctttacagttaaggaaatggaggttcagagagattctgagctcttccccatcttacatctggaag

SEQ ID NO: 6773648 - DNA, 59 bp, Homo sapiens
ctgagtactgtgcctgccgaaggcctggccaggggaggggctgtgcaggccgggctgag

SEQ ID NO: 6773649 - DNA, 64 bp, Homo sapiens
ggaaatgttttcaggattttaagaatatggaggaaaatgctcccctttcctgaagaatattttt

SEQ ID NO: 6773650 - DNA, 94 bp, Homo sapiens
gtgtgcccagacagctgagccaggggatggtggggagacttgagcggctttgtctgtccaggcaccccaagtgggcccaggctgctggggacat

SEQ ID NO: 6773651 - DNA, 100 bp, Homo sapiens
ctcttcttcagggtcattcaggagctcaggctgatggaaattctgccatgtcacacagtggcttccacagtcatcctgggaattgacctctggctaggag

SEQ ID NO: 6773652 - DNA, 115 bp, Homo sapiens
tcccctctccccggagctgggacagcctgactttccattctcacacagtaattagataccagctgtcagtgcaggggggacggctccgcggctgcagcccggctgggagtggggg

SEQ ID NO: 6773653 - DNA, 62 bp, Homo sapiens
gttttctttgaatgcttctagaaccacaaaatatcagggcagaaaggcatctcagagaaaac

SEQ ID NO: 6773654 - DNA, 55 bp, Homo sapiens
tatatgtgaacacatgttcatgaacttatgactgtcatgcatgagtttatatata

SEQ ID NO: 6773655 - DNA, 76 bp, Homo sapiens
gttgggggttcagcccaggcatagggcaaaggcagaccctgggtgccctgggccatgggaaacctgccctcccagc

SEQ ID NO: 6773656 - DNA, 58 bp, Homo sapiens
ttagtatgacatgctgtcttgctgcacatccgtattttggcacagtttgtcattctaa

SEQ ID NO: 6773657 - DNA, 62 bp, Homo sapiens
ccacgttcccgatggtgcactggttttctttcctgtctgaccaacaagcctctggagagtgg

SEQ ID NO: 6773658 - DNA, 89 bp, Homo sapiens
cttgtggcacagtacaataactagtcttatagtacataaagggaagggtaccctcccaggaattatgagattggtgtatttcacacaag

SEQ ID NO: 6773659 - DNA, 66 bp, Homo sapiens
gtgtccaagtggaagtataagaatgatagctgccccatattatcagatatagcattcactggatgc

SEQ ID NO: 6773660 - DNA, 62 bp, Homo sapiens
cctgtggagttcccatctgaatgtgaaaatctgtagcagctagagttatgtggctccacagg

SEQ ID NO: 6773661 - DNA, 85 bp, Homo sapiens
gaggagtcatcgtacccaaacactgatgaccaggcctttacaaagcattttggcctttatttacattctgggtacaagatttttc

SEQ ID NO: 6773662 - DNA, 55 bp, Homo sapiens
gtggccaagggactctaaggcaggggtgtccaatcttttggcttccctgggccac

SEQ ID NO: 6773663 - DNA, 72 bp, Homo sapiens
gctgagaacaaagagttaatatttacctgtcaagaaagccagcattttaggacagtgagctattatcttggc

SEQ ID NO: 6773664 - DNA, 105 bp, Homo sapiens
ctcgcggcccctcagaccccacgcggaggaggtcaggaggtgacacaggttcgcggaagaaagcgggactcatcttcctcatttctccagggatttaggtgtggg

SEQ ID NO: 6773665 - DNA, 62 bp, Homo sapiens
tgtagcactagatgtttctcttctgaggcaatggaatgcttgaggaaatgctctggtgttca

SEQ ID NO: 6773666 - DNA, 58 bp, Homo sapiens
ctgatcactttctctcaccacgtgggtcatttgtggtggcaaagtacaaagtgaccag

SEQ ID NO: 6773667 - DNA, 56 bp, Homo sapiens
aagccttttccacctaatagagatccaagtacatcactaagaggaggactaggttt

SEQ ID NO: 6773668 - DNA, 75 bp, Homo sapiens
agaaaggttagggatatcacatatcctaagctagccccttaggtactggaataatgtgatattcctgtcctttct

SEQ ID NO: 6773669 - DNA, 87 bp, Homo sapiens
taggagtttcctctatagggaatgggacccactggtggtgagcgctccacccagctggtgggtctttctctgaaaccagagctctta

SEQ ID NO: 6773670 - DNA, 75 bp, Homo sapiens
tccataccgatttgtatcaaaacctcagcgtcagaaacaaactctgcagaatgggtatttagattcaagtatgga

SEQ ID NO: 6773671 - DNA, 73 bp, Homo sapiens
cacaggttggcagggtctctgctctacatggcttttcagcgagccaggctagcagagactccactgtcttgtg

SEQ ID NO: 6773672 - DNA, 67 bp, Homo sapiens
aggacattcatttcaaggaggacagtaaaaccttccatgttccaggctccatgaagatgaattttct

SEQ ID NO: 6773673 - DNA, 101 bp, Homo sapiens
tgagatggagtctcgctctgttgcctaggctggaatgcagtggtgccatctcggctcactgtaaactccacctcccaggttcaaacgattctcctgcctca

SEQ ID NO: 6773674 - DNA, 55 bp, Homo sapiens
tgcactatttcgccatggttgtttcacttcaggatcacagtggtaaaatgatgca

SEQ ID NO: 6773675 - DNA, 57 bp, Homo sapiens
ttcaaggctatacaaaatcctggcaacttctactgccaggaaactgtatatcttggg

SEQ ID NO: 6773676 - DNA, 87 bp, Homo sapiens
ggtttctgccctcatgttgtgtttatttagcctgaactgaggcacacgttgcattttctaagtaaacacagcatacagcagcactcc

SEQ ID NO: 6773677 - DNA, 78 bp, Homo sapiens
agtgctctaggcacaggccaataccctctctctcgaaagctcctgaaagcagagatcatggcttgtatctgtgagact

SEQ ID NO: 6773678 - DNA, 86 bp, Homo sapiens
tgaaagagtcaaaagttctcgtaccctgagtttttctccccattaaccacaggaaatctctggtcacagaacttaaatgaaagtca

SEQ ID NO: 6773679 - DNA, 66 bp, Homo sapiens
tggtagagtagaaagacatgggccagcagctgggcaacccagtttcccttctgttctattctgtca

SEQ ID NO: 6773680 - DNA, 70 bp, Homo sapiens
gctatttctgtttgctactataagtaatctaagtggttgtattcatgctctgtagtatttagtaaatagc

SEQ ID NO: 6773681 - DNA, 87 bp, Homo sapiens
gcaatgagaatgaagctgctcacagggattcatgctgtagaagacaggccaggaccctggagggcatctgagatcatcactcattgc

SEQ ID NO: 6773682 - DNA, 67 bp, Homo sapiens
cacagcatagctgggaagggtttgccatgcttccatggctgcatcatcctggttgagaattgctttg

SEQ ID NO: 6773683 - DNA, 82 bp, Homo sapiens
tctgttacatagagcattggatatgggatatagtttcttaaggaaattaagggatttcctatcaaatctctattacaacaga

SEQ ID NO: 6773684 - DNA, 65 bp, Homo sapiens
ttccccagtttaccaggcaggaaaatgaagcttagcaaataacttggccaaggtcactgggtgag

SEQ ID NO: 6773685 - DNA, 62 bp, Homo sapiens
agatcacagaaacatgtgttgggagctgcctgtcagcaaatgctgctagaaattctgtgact

SEQ ID NO: 6773686 - DNA, 67 bp, Homo sapiens
tagctattcacaagttgatggatatttgggtcatttccagttttttcaactattgtggataaagttg

SEQ ID NO: 6773687 - DNA, 127 bp, Homo sapiens
aggtccgtggtgctctcagtgccccgaggagggtgggggtcggcctgacccgcttccgcccgtgcttctcaggtggcagggcagtgtctggcccccaggctgctctaggtctgggttcctcgctcct

SEQ ID NO: 6773688 - DNA, 108 bp, Homo sapiens
gctttggaaatgtgaaaatgctgtgtaaatgttaagaaatactaagtatagggccagaagctatacagtgtttcacttaaccgtttgccattctgtatttaccaaggt

SEQ ID NO: 6773689 - DNA, 119 bp, Homo sapiens
tatctttttcgacaataatgaactacttgactgacagattcatgtcttgaaagaagaaaattaattgaaaatggatttgttcatgtctgcagtacttcattgttttatgatctgagata

SEQ ID NO: 6773690 - DNA, 55 bp, Homo sapiens
atggctttgtgttcagagctgagagatcgatcaaagcatgaactcattgagctgt

SEQ ID NO: 6773691 - DNA, 65 bp, Homo sapiens
gcagggctgtgtgagctcttactgttcccggcactgaggagtcagcagtgaaagcacagccaagc

SEQ ID NO: 6773692 - DNA, 72 bp, Homo sapiens
catttaggttttgatgatagtggaattaaatgtagcacatttaattgaactaacatgcaaacatcttttatg

SEQ ID NO: 6773693 - DNA, 62 bp, Homo sapiens
agttatcagagctagtacttgcaggtgagtctctctttacttcaggagcagtctctggaact

SEQ ID NO: 6773694 - DNA, 86 bp, Homo sapiens
gagcccagtgtggatggcctttccgtgttctgtgaaggcgctggcaactccacagagctggaaaggctgggccatgaacagggctc

SEQ ID NO: 6773695 - DNA, 130 bp, Homo sapiens
tccggtttcctagggagctctgctgaagcagcccagcctccgtgggtccatctgtcagggaggctgttccgccccatcgattgctgttcccagggggctgtgctgctcgagggacccaatgtggccgcca

SEQ ID NO: 6773696 - DNA, 79 bp, Homo sapiens
gaatgcttagagccttataatttgtaaagatgcttcccattctcataatgagagtgtgaacatttacagctttgcattc

SEQ ID NO: 6773697 - DNA, 59 bp, Homo sapiens
gcctctcctctgaagtggtgacccagatctcagtgtgtggctacctcagaggagcaggt

SEQ ID NO: 6773698 - DNA, 61 bp, Homo sapiens
tccaaattcctcagttagtgcctgaggcctggaggctgaaggcagtaactgggggcaagga

SEQ ID NO: 6773699 - DNA, 63 bp, Homo sapiens
ggccccagcagtgcttgtttattaattaccctaatgataacaacagcagtgctggcagcagcc

SEQ ID NO: 6773700 - DNA, 116 bp, Homo sapiens
gtgtacaggacaataggaatgttcatattcattttcctggaatttctttacagcttttctcttaggcatgtaatcactctaggaaggatatgagatttttcagttattcaattcac

SEQ ID NO: 6773701 - DNA, 60 bp, Homo sapiens
ccaatactgtaaatggagcagccaatcccagattcttgctgctgtccacacagtaagagg

SEQ ID NO: 6773702 - DNA, 85 bp, Homo sapiens
ggctggccaggccgcaggagctctgctgtctttgggatgagaaatgccactctcactgcttggctcctgccagccctgggcagct

SEQ ID NO: 6773703 - DNA, 65 bp, Homo sapiens
gataattgatgaaagatagattctccttacaatgagagggagtccaaattttttgaatcagtttc

SEQ ID NO: 6773704 - DNA, 58 bp, Homo sapiens
tgagatggagtctcactctgttgcccaggctagagggcagcagagcagtctccgctca

SEQ ID NO: 6773705 - DNA, 100 bp, Homo sapiens
caggggtttcgtgcactccgaccgtgccatctcctgccacgacatgtttgattttctgcatttgacaggaggtggctactcaaaggtctgcaaacccttg

SEQ ID NO: 6773706 - DNA, 80 bp, Homo sapiens
cagctgaaacaaatattgacttttaaagtgatatatttgacattcaagtgtgtactcaattgagccatttatttcagttg

SEQ ID NO: 6773707 - DNA, 73 bp, Homo sapiens
tgttactgtcgggacttgaaaaatctatggaaaatctaattttcctgaattgccttagtttctgattttaaca

SEQ ID NO: 6773708 - DNA, 64 bp, Homo sapiens
ggaagtcaggacaacaagacttgtttaaagctacctttaggtaggaagtgttgtttttactttc

SEQ ID NO: 6773709 - DNA, 70 bp, Homo sapiens
acagatgattttctgtgttagaagatgctatcggctcacctggcctcttagtgacagagaaatcctttgt

SEQ ID NO: 6773710 - DNA, 70 bp, Homo sapiens
cattcctagatggattatgtaagatttgacagtttctttcttgaagtcttgcacttttatctgcagaatg

SEQ ID NO: 6773711 - DNA, 66 bp, Homo sapiens
gacatgttgaagaatatttggaaagaaaacagtttgactttgtatccaaatgttttatgacatgtt

SEQ ID NO: 6773712 - DNA, 130 bp, Homo sapiens
caaatagatgccagtacagtagcccctcggatcacaggaggtatttttggtgctggaagccagccacactttggcaggctttcagcatcaagtctgttccctttagaggcggggggtggcaagctatcag

SEQ ID NO: 6773713 - DNA, 62 bp, Homo sapiens
tcttgtttctgagcatattaggcatatataaaaatgaaggccaaatacttagaaacttaaga

SEQ ID NO: 6773714 - DNA, 69 bp, Homo sapiens
ttggaaatatgctccattcttttccctttgactccagatttaagaaaattaaatggggcagctttctga

SEQ ID NO: 6773715 - DNA, 58 bp, Homo sapiens
taattgtagtagctgtttaatatttgcacagccttcattagaaagctcactacagtta

SEQ ID NO: 6773716 - DNA, 80 bp, Homo sapiens
agaagcatgcctactagaacacgtctcggaatgagagatgtttaattctgtcacctcccagaaagttttgcagggtttct

SEQ ID NO: 6773717 - DNA, 67 bp, Homo sapiens
ctctacttattcatctgcaccagttctgactctcccagtgagcagccaattggaggatgaagtggag

SEQ ID NO: 6773718 - DNA, 76 bp, Homo sapiens
cccattggaagaggcccatgactgccttattgatctgagatttacgaaagcagcaattatgtgttatttgagtggg

SEQ ID NO: 6773719 - DNA, 126 bp, Homo sapiens
atcatggaatgtcaataaccattacatatgatttctggtgaggcagcaataaaaagaatttttaattgcctgtgtaggttcaaattgttgcagtttctaagttgtcaggtaggattcaaacatgat

SEQ ID NO: 6773720 - DNA, 57 bp, Homo sapiens
agacacagtctgtctggaggagtccccaaagactgttccaattggtgatgtgtgtct

SEQ ID NO: 6773721 - DNA, 71 bp, Homo sapiens
gctttctacatcctaaatgaaggctagttatagaacttttttgactatcagtcatattgatgtagagcagc

SEQ ID NO: 6773722 - DNA, 75 bp, Homo sapiens
ttactgagggcataaaagtactgtgttgtcacacttcatttaccaatttgcagtatttttttgtgtccccagtaa

SEQ ID NO: 6773723 - DNA, 73 bp, Homo sapiens
ctgtgggttaaaatgataccttgcaaggttaattaaatttactggtttaaaatgcgggtatctgactccacag

SEQ ID NO: 6773724 - DNA, 72 bp, Homo sapiens
gcatcttttctatattgttaaaaaaaatctatgtcttttgacatttgatgcttttccagtatgagagtatgt

SEQ ID NO: 6773725 - DNA, 75 bp, Homo sapiens
tgggagtggggttactctatgaacatcctcttacagccatgatggcttgggcaggcacatagagtttaattccta

SEQ ID NO: 6773726 - DNA, 66 bp, Homo sapiens
gctgcagaggtcttgctgatggtgtgtgcatatcctctgattggaaccacagcatgacacctgggc

SEQ ID NO: 6773727 - DNA, 73 bp, Homo sapiens
taaagagtgagagtttctgcaactgtattctgaaagtattgacagagctgttgttaattaactcatttcttta

SEQ ID NO: 6773728 - DNA, 82 bp, Homo sapiens
gtttcacagttctattactccctgcttcttcatgtgagttgcctcatgaagacgaactagtagggtggtaaagagaaagaac

SEQ ID NO: 6773729 - DNA, 67 bp, Homo sapiens
tttgcaagagaaaagcccctttgttccaacttcaagcctctgttggtccacgagttctcttagcaaa

SEQ ID NO: 6773730 - DNA, 82 bp, Homo sapiens
atgtttttcatggttttgcatgactcttgggatcacgatttgcatcttaaaaaaaggagtcatggaaaatattgcaagatat

SEQ ID NO: 6773731 - DNA, 103 bp, Homo sapiens
ttttaaatggtatattgaagtttatccctctcacagttactggggaacagtctaaccctattgacagagatggaatgaatctttattgtaaatcactttaaag

SEQ ID NO: 6773732 - DNA, 59 bp, Homo sapiens
tctttggaaggagcagtttttgtggtttcagatgagccagaggactgcccctccaaaga

SEQ ID NO: 6773733 - DNA, 58 bp, Homo sapiens
gcactatatttaaacctgtggatgggaatattccccattcttggttacgctgtagtgc

SEQ ID NO: 6773734 - DNA, 81 bp, Homo sapiens
atctgtgtatgataagccatgtcgtggtcatggtgtactgcggtagactacaaattctatggtttttattataagcaagat

SEQ ID NO: 6773735 - DNA, 77 bp, Homo sapiens
ttttcctcaggagaaacaatcatcatgtgatttgaatcaaactatttaaaatatgtattgttttaaaccagggagag

SEQ ID NO: 6773736 - DNA, 71 bp, Homo sapiens
ggacaggcccggggagcctggatggcaaggggtgcaggaaggcgcccattccgggactgcctgggcctgcc

SEQ ID NO: 6773737 - DNA, 62 bp, Homo sapiens
ccatttgtgtgtctgaaaaggaggctacgatgtgctttctcaagtactgcacatgaaagtgg

SEQ ID NO: 6773738 - DNA, 70 bp, Homo sapiens
tttggaagcttctctgccagcctgtaaaaggaacttctcaggcaatcagtgtagagtaacagttttcaaa

SEQ ID NO: 6773739 - DNA, 80 bp, Homo sapiens
ggtattgtttaattaatgaggtgatttgtatatgagtaagaacagggcttacactaaagttcctcaaataaaacatgacc

SEQ ID NO: 6773740 - DNA, 88 bp, Homo sapiens
tttggaattctgattttcattgctctcttgctggtctcaattttgacagcagaataatgagtaatagaaaagtttcattaattctgaa

SEQ ID NO: 6773741 - DNA, 55 bp, Homo sapiens
atgtgtgtgtttaatcctcaaagcattcctgcagtttgtagattatgccacatat

SEQ ID NO: 6773742 - DNA, 66 bp, Homo sapiens
acgttttcagccttaatgtagatagtttttctaagccgtctcgagaaacacatggggtataaacgt

SEQ ID NO: 6773743 - DNA, 82 bp, Homo sapiens
agttttattagaaggtccatgactcggcatagtaagactaataccctgctccagaattatgaccatacgtctttgtgaaact

SEQ ID NO: 6773744 - DNA, 130 bp, Homo sapiens
gactccatagtaaagcagggtgatcttctgcccttcagcactatagttgggtgtgagatctgttgggcttttgaatactcagccatgcaacatgctgggggcagctgtcacattggctctttgtgggatc

SEQ ID NO: 6773745 - DNA, 74 bp, Homo sapiens
gtgtgtgtgtgtgtgtgtgtgtgtgtgtgtgtgtgtgtgtatatgtgtatgtgtatacacacaggcatgcagat

SEQ ID NO: 6773746 - DNA, 113 bp, Homo sapiens
gaccagctcaagtaaaggcttcagtgtctttgatctgggtctgacttgaatgcctggagtcagaacagaagaaggaacacggttatctttgaagctcacactggttgctggtt

SEQ ID NO: 6773747 - DNA, 67 bp, Homo sapiens
tgcagaaaaggaagagctatgtaaccattagccatgtgcttacaaggggctatttctgcttctgaca

SEQ ID NO: 6773748 - DNA, 66 bp, Homo sapiens
gttcataaagatttctttttctctacttaatatgctaaggagtaggggaaagagagattttttaac

SEQ ID NO: 6773749 - DNA, 61 bp, Homo sapiens
gtcccattgttctgggcttggcttacgatggcacaggggccaagggccagtgagatgggat

SEQ ID NO: 6773750 - DNA, 72 bp, Homo sapiens
gaattttcttatgtgtagtaagggttgaaaacttgttaaaagctttgccacattctatacatttgaaaggtc

SEQ ID NO: 6773751 - DNA, 81 bp, Homo sapiens
gggtattgatagttaattgtctgtgagtacctgacagcaacgggttatggctattgatgacaattggtaccttcagtgccc

SEQ ID NO: 6773752 - DNA, 70 bp, Homo sapiens
gaggtcaggcaggagctctcatcgtcagggcctgctggggcccttccttgaagagttctaaccctgcctc

SEQ ID NO: 6773753 - DNA, 84 bp, Homo sapiens
gagaatgataggcactgaccttctcagattgctctgaaatctcaagaagtgcactttgaaaagacagtagctctagcgtctctc

SEQ ID NO: 6773754 - DNA, 63 bp, Homo sapiens
caacatttggcagtgacccagggagatggctcttgacataaacctcaggatactgcaaagttg

SEQ ID NO: 6773755 - DNA, 63 bp, Homo sapiens
gggtccaagcaagtcagggcttctgagggaggctgctgccaagggctctgacttgcctgcccc

SEQ ID NO: 6773756 - DNA, 76 bp, Homo sapiens
ggagtttctctgaggtacatgattccccataaaaagaaaggccttcttgttgatggtgtcaggtaactgaagctct

SEQ ID NO: 6773757 - DNA, 74 bp, Homo sapiens
tcagttaatatgggtaaagcatttagtacttctgtcatattcgacaccatgtatgtgtttttttcaataactga

SEQ ID NO: 6773758 - DNA, 55 bp, Homo sapiens
tgaattacatccatggacacaccctttattttggggtatgctctaggataattca

SEQ ID NO: 6773759 - DNA, 118 bp, Homo sapiens
gaaaaggatgagtaatgttagaatatttgcacaatatttgtagttggctagctataggcatatttaactgttccaaatgctgtagcggtcattcattactgtggattcaattcttttc

SEQ ID NO: 6773760 - DNA, 55 bp, Homo sapiens
gccactctgatttcaagggagataattgaagatttccagtgcaatcctgagaggt

SEQ ID NO: 6773761 - DNA, 64 bp, Homo sapiens
agttacataaaagttcacgtaggctggaaaaagggggaaccagcctacctgaactttatggatt

SEQ ID NO: 6773762 - DNA, 78 bp, Homo sapiens
ttcctcagaataaacctctttaaaagggatattgatggaaatgtacaattaccagtaattgaggttttatctgagggg

SEQ ID NO: 6773763 - DNA, 60 bp, Homo sapiens
ggcctgaaggtgcagtggctggaggctgttgccagttctcagaattgcacctcaactgcc

SEQ ID NO: 6773764 - DNA, 57 bp, Homo sapiens
gtgtagggtcctctgctgtgacagcagtggtgcctgctccagcgtgtgactctgcgc

SEQ ID NO: 6773765 - DNA, 56 bp, Homo sapiens
tcttcatgtatttgacaaccatttaatcactttatctggtatgtttggcctgaaga

SEQ ID NO: 6773766 - DNA, 87 bp, Homo sapiens
gcccatggactttggtctgtccatcctgccttccctttcccaagagacaggccaggccacaggtggaagccagagaatccagaccgc

SEQ ID NO: 6773767 - DNA, 56 bp, Homo sapiens
aggtctggtgggctttagattggggtcacagggagacccaaagcccactagcgcct

SEQ ID NO: 6773768 - DNA, 70 bp, Homo sapiens
ggagagccggtccgtttctcaggcagactaggccattaggtgcctcggagaaaggacccaaggctgctcc

SEQ ID NO: 6773769 - DNA, 61 bp, Homo sapiens
ctttcacataattgaccttgaaactttgcctctgggggaatcacaggtcaatgtgtgaagg

SEQ ID NO: 6773770 - DNA, 83 bp, Homo sapiens
aacaagcacctgcttcttgggccaccatgtggcagccagcctgctgagcattgctgtgacgcctcaggaatccaatgcgtgtt

SEQ ID NO: 6773771 - DNA, 88 bp, Homo sapiens
agagagcaaaggcaagaatgttagagattcttaggttttagtagaaagagcatagtttgaagccagatgaccttgcgtttaaatctct

SEQ ID NO: 6773772 - DNA, 58 bp, Homo sapiens
tgggggctgaggggtatctcatgggagaatgccatccctgctgtcatctcagctctca

SEQ ID NO: 6773773 - DNA, 87 bp, Homo sapiens
tgttaaaacacaaattgttgggactcagccccaaagttcctgatgcagtaggtctgggctggggctcaataatttgtatttatcaca

SEQ ID NO: 6773774 - DNA, 55 bp, Homo sapiens
tttcaggagattgtactgtcatcacttaatagtggagaaaaatagttttctgaga

SEQ ID NO: 6773775 - DNA, 61 bp, Homo sapiens
tgtctctcatttagttttgcaccggcttgtttcagtcttgcaaagatttaatgcaggggca

SEQ ID NO: 6773776 - DNA, 62 bp, Homo sapiens
cacctgattactttctctagtataattggcttcatttagatgcagccagagggaagcaggtg

SEQ ID NO: 6773777 - DNA, 57 bp, Homo sapiens
agtaggcattttattgaacgtaacacgtgcgcgtgtacttttatgagatgatcttct

SEQ ID NO: 6773778 - DNA, 56 bp, Homo sapiens
gctctgataagctcccaaagatcagtccttatctgaaaatttgatagaatcagagt

SEQ ID NO: 6773779 - DNA, 93 bp, Homo sapiens
tcagtgaaacaaggctttgggagtaagaagtcctgggttcaagtgctatggatgctgtggatgccttgccccattgcccctgggcccacctga

SEQ ID NO: 6773780 - DNA, 65 bp, Homo sapiens
gaatttggttgcggtgtactctcctccgataaaaggcaagagagggcaaacttgtagctaacttt

SEQ ID NO: 6773781 - DNA, 60 bp, Homo sapiens
gctgagctcccagcagtatctggctttatcatcagtagcttcactgctgtctggctaagc

SEQ ID NO: 6773782 - DNA, 55 bp, Homo sapiens
tgttcaagtggatgtggcttttcttgtttgagaagagctcactaaggcttgaaca

SEQ ID NO: 6773783 - DNA, 73 bp, Homo sapiens
ggatctggtgggacagggacactatcagaactgaggctctgtcttggtggctgctccctgccttgaccttgcc

SEQ ID NO: 6773784 - DNA, 80 bp, Homo sapiens
gaggcagagtcccaggggcagagagagcctggaaaggcaggctggtcttgtggctctcatgccctctgggcttggcactt

SEQ ID NO: 6773785 - DNA, 71 bp, Homo sapiens
taacagtcatgtgctactgctaatgagcctgacccaaattgcatatttgtgagcaaagcaaatgtctgtta

SEQ ID NO: 6773786 - DNA, 129 bp, Homo sapiens
ccagagtaaaccattccccattgaggtattcagggaacgccaggatgaagccttgtccatcagcaagtgatgacagcagtcctggagttcccaggcagcttttatattcagaggaaaggcttgctaagg

SEQ ID NO: 6773787 - DNA, 79 bp, Homo sapiens
tcaaatctgctccagcgggccagtctagccccaaagggataaaggagttgagggtaggctgctcctggggccctcctga

SEQ ID NO: 6773788 - DNA, 55 bp, Homo sapiens
gcggccgcggctgccctgagccagcagcagagcctgcaggagcggctgcggctgc

SEQ ID NO: 6773789 - DNA, 59 bp, Homo sapiens
agaatagctagaacaaaagaattgatggcatggtcaattccagttaaggaagctattct

SEQ ID NO: 6773790 - DNA, 86 bp, Homo sapiens
gttgggcgatggaggtcgttctgtggcgctcagcctgcagcacagctggcctggaggtccagaacgtgcctactctcatacccggc

SEQ ID NO: 6773791 - DNA, 60 bp, Homo sapiens
ctgattcgctatcattccagctcatgtcagagccgcctggaatcttcgatattgattcag

SEQ ID NO: 6773792 - DNA, 64 bp, Homo sapiens
gatcagggagtggatatgtttagcaaagttgcctgctgttgctaggattcattctatactaatc

SEQ ID NO: 6773793 - DNA, 75 bp, Homo sapiens
cctcatattgattaccttattaccttatctggttgatgataacaggtaaggcaatagtaaggagtccctcagagg

SEQ ID NO: 6773794 - DNA, 64 bp, Homo sapiens
cagagctgcaaatgcccctccgctcattagagcaggagttagtctcggcattgtacagtctctg

SEQ ID NO: 6773795 - DNA, 73 bp, Homo sapiens
tgtccctgttttaaagattaggcaaattgcttcccttctaactcttagtatcccagtctgtaaaatggggaca

SEQ ID NO: 6773796 - DNA, 57 bp, Homo sapiens
gattctgagtgacagtgtttgttcagtggatctcttctgtactgatttttcagagtc

SEQ ID NO: 6773797 - DNA, 62 bp, Homo sapiens
ctattgggtcagccttctggctggattcaatcatagtttccagcctgggcttgattcggtag

SEQ ID NO: 6773798 - DNA, 59 bp, Homo sapiens
gacagtttaggttcaaatctcatatctgtcacttggtgactgtttggcctagaactgtc

SEQ ID NO: 6773799 - DNA, 71 bp, Homo sapiens
ttctacaacatacatatttcagtgtccataaactccagccatgtggatatgtttatatgttgtctatggga

SEQ ID NO: 6773800 - DNA, 77 bp, Homo sapiens
tttgaatttagaggtgccaaagcctgcgggtgtcaggcaccagcaacacccgtctgagttggcatcattttgtcaaa

SEQ ID NO: 6773801 - DNA, 62 bp, Homo sapiens
atcttttcttcttctccacacacaacaatccttcagccctgtgtgctggagttaggaaaggt

SEQ ID NO: 6773802 - DNA, 57 bp, Homo sapiens
tcagaacattacattttgagctgctgatgtagaagtgctcaaaaactagtgttttga

SEQ ID NO: 6773803 - DNA, 70 bp, Homo sapiens
gtgacagggtgattatgagagctaagctggctctctcaggccaaatgtgggttttcattattattgttac

SEQ ID NO: 6773804 - DNA, 78 bp, Homo sapiens
ccagtgggcccttaccctgtgcctgtcccagtgtgacccagcacaaagggggactgcagagggtctcctgcccactgg

SEQ ID NO: 6773805 - DNA, 77 bp, Homo sapiens
cagttgagagtgtcagaaaacttccctttgagttctcaagtttcatggctcaaggcgaattttctgtttcttttctg

SEQ ID NO: 6773806 - DNA, 77 bp, Homo sapiens
gggtttgccagcggttcccctacccctgacgtggtcttctcagctccatagtgcagaggaggagcctctgcaggccc

SEQ ID NO: 6773807 - DNA, 57 bp, Homo sapiens
gtggcccttgagctatagtttggtgaccgctgccctagactgccatctttgggccac

SEQ ID NO: 6773808 - DNA, 55 bp, Homo sapiens
ggcagagctctggactgagaactaaagtcctggattccagctcagtttttttgtc

SEQ ID NO: 6773809 - DNA, 60 bp, Homo sapiens
ggcatgatggctgaggcttctgcagctattttgtgatcttgaggcttcaggccacatgct

SEQ ID NO: 6773810 - DNA, 85 bp, Homo sapiens
ttagcacatggatatagttggaattataaagggatttattttctaaatttaaaaatgctttttatagctatgtcctatgtcctaa

SEQ ID NO: 6773811 - DNA, 71 bp, Homo sapiens
cagagaacgaatagatgtattaggaatacattatccttgcattcctgagacttatctgtttcccccatctg

SEQ ID NO: 6773812 - DNA, 55 bp, Homo sapiens
gcattgaactaaataagcagtcatggacgaagtggccagaggatttgttcagtgt

SEQ ID NO: 6773813 - DNA, 91 bp, Homo sapiens
ccttcattcattcattcattcagcaactgttatttgaaggtctactatgtgccagtattaggagtgggatgaagagtagagtaagagaagg

SEQ ID NO: 6773814 - DNA, 65 bp, Homo sapiens
ctgcctccatggggtctggcccaggctgcacactgtaggtgctctggggccagctcctgaggcag

SEQ ID NO: 6773815 - DNA, 78 bp, Homo sapiens
tgagcaatgtcacccatttttaaatataacttggagaatagctaagtagtatgtttaacaagggcttgagaatgttta

SEQ ID NO: 6773816 - DNA, 96 bp, Homo sapiens
aaccagcatctatttaacctcaaggatgattctgaaagagctgaagaaaataagtcctcctttagaatcatccttggggttaaacagatcctggtt

SEQ ID NO: 6773817 - DNA, 64 bp, Homo sapiens
ctctttctgattcgctgggacctgcctgggagagttgggcaatacccagtgaagcatggaagag

SEQ ID NO: 6773818 - DNA, 71 bp, Homo sapiens
caggtggtaaatggcagatccacagtttgaagcccaatggcttggctgggaactgtgattcaaactgtttg

SEQ ID NO: 6773819 - DNA, 106 bp, Homo sapiens
gagacaggatctcactctgtcactcaggatggggtgcagtggtgtgatcatagctcacagctcactgcagcctcaaattcctgggctcaggtgatcctcctgcctc

SEQ ID NO: 6773820 - DNA, 94 bp, Homo sapiens
atatttatctagcaattaggtttataaggctgcccagtatctgcatttcaatgtgcttttgtgattgccttataattatctttgcagaaaatat

SEQ ID NO: 6773821 - DNA, 58 bp, Homo sapiens
gggacaggtgctaagggacctggcaggcagggctggcaggccccatggcgcctgttcc

SEQ ID NO: 6773822 - DNA, 123 bp, Homo sapiens
ggtaccgctggcactgggctagcagcgaccacaggggccggctgcgctgtcctgaggatgccctaccgggctggccacagtgacacgggctggcccacggccgcaggggtcggcagcggtgcc

SEQ ID NO: 6773823 - DNA, 75 bp, Homo sapiens
tcagataatcgggtcccaggtctggaaaagcagccttttccccacgtttctttccccacctaggacctcctctga

SEQ ID NO: 6773824 - DNA, 58 bp, Homo sapiens
gaagctaggctggggttcaggatgccggggtctccagcttgcctccagctataccttc

SEQ ID NO: 6773825 - DNA, 84 bp, Homo sapiens
ggctcttttgggaaccagagactctttctagtcctgaatgtgtggttgggggcaggaggtgttctctttttccttctctgggtc

SEQ ID NO: 6773826 - DNA, 60 bp, Homo sapiens
gcccatcctggctccagcaagctgtttcaggaaatgtgtacagctgcctgccatgggggt

SEQ ID NO: 6773827 - DNA, 77 bp, Homo sapiens
tgagggtagaatcacagatttaggactgtagcgatcccatttggggttctggggctctggattttaggactccttca

SEQ ID NO: 6773828 - DNA, 57 bp, Homo sapiens
ttttctttgtctttatatgctgggcatttggtgcctagcaggaccatgacaagaaaa

SEQ ID NO: 6773829 - DNA, 67 bp, Homo sapiens
gaggcaggcagattgcttgaggccaggagttcgagactagcttgggcaacatgcgagagcccgtctc

SEQ ID NO: 6773830 - DNA, 69 bp, Homo sapiens
ccttcatgaggccggctttatccagtacttggattctggaatctggcatctggctttttataatgatgg

SEQ ID NO: 6773831 - DNA, 93 bp, Homo sapiens
ctgggtgataatggaatactatgcagccataaaaaggaatgagatcatctcctttgcggggatgtggatggagctggaagccattatcctcag

SEQ ID NO: 6773832 - DNA, 129 bp, Homo sapiens
ttaatatgagtgagatgcttgtttctataatgaatttgcaaatatgtgtttctatttcaaaaagtagtgtattcatgtgtgcaggtgtcagctggataaatatatataacagctttttaagtattatag

SEQ ID NO: 6773833 - DNA, 67 bp, Homo sapiens
gcttgtaaattggaaatcaatcaagacagcttttattttagttcctgatggctgtccaattacaagc

SEQ ID NO: 6773834 - DNA, 110 bp, Homo sapiens
ggtgggaagacagggtgcagccattgcccagttgggccccagaggtccaggccctccccagggttagccttggcctggggtccaggcttgatggggtccctgtccccacc

SEQ ID NO: 6773835 - DNA, 71 bp, Homo sapiens
tggagaataggggccactggtgaggcttcacttccttccatgcttggccagggccctgctcaatttctcca

SEQ ID NO: 6773836 - DNA, 117 bp, Homo sapiens
ttatcgctaatggaatcagattatttgggaaatattaatctatgcatattcagactcagatactgagctaaggaattcaaatagttagtattcctacatggatttggttagtgataa

SEQ ID NO: 6773837 - DNA, 81 bp, Homo sapiens
tgtgctgatagactggatggaaggaggatagtattagagcaggttctgtgcatctttctattctctagtctttggggcaca

SEQ ID NO: 6773838 - DNA, 55 bp, Homo sapiens
ggctgagcgtggctgccgtggggacacacctgccaacacagccacgttcctggct

SEQ ID NO: 6773839 - DNA, 79 bp, Homo sapiens
tctccaatgccttttccatctcaggcagccaagtctctgcttctgactccactgaagagactggagggggcatcaaaga

SEQ ID NO: 6773840 - DNA, 55 bp, Homo sapiens
attactcttaagggatcagcaaccaacatggtaagttcttcctgactagagtagt

SEQ ID NO: 6773841 - DNA, 55 bp, Homo sapiens
gagtgccatgtgttacctctgggaagaagctttggaagtcagtgcatggcgtctc

SEQ ID NO: 6773842 - DNA, 77 bp, Homo sapiens
tctttcattctcctcctgccccctgtatgacaaaataggcaaaatgagtacatcagagggtgagatggagaaaaaga

SEQ ID NO: 6773843 - DNA, 71 bp, Homo sapiens
gaagcaagctggtgaatcgtaatgaggcatgtgctgccaatatgcactgtacattccacaagcattgcttt

SEQ ID NO: 6773844 - DNA, 56 bp, Homo sapiens
ccatcagcatgggagcatgggctctaggctagagggtgctgcccccctgcttatgg

SEQ ID NO: 6773845 - DNA, 72 bp, Homo sapiens
acaggtctctgctctagagtctgtgattgtctcccgagatggaccgtgaacttctcaagggcagagacttgt

SEQ ID NO: 6773846 - DNA, 60 bp, Homo sapiens
tctgcaaactggctcttactgctttccagagcccaaggtcaaaggtagccagcctgcaga

SEQ ID NO: 6773847 - DNA, 108 bp, Homo sapiens
gctgcaaaaattgatgaaagtaaagaacttagcagagatatgggcatagatcgtgtcaaaaacatccccaataattttgttttctttgcattaaaaagaacatgcagc

SEQ ID NO: 6773848 - DNA, 58 bp, Homo sapiens
atctgggcctgttccctcacctagttagaacacagcaaatgaggccaaggtcacagat

SEQ ID NO: 6773849 - DNA, 75 bp, Homo sapiens
gtaaagtcttcagttatgataattactgttacatcgattatagatgagcaaggctgggtctaatggggaaattac

SEQ ID NO: 6773850 - DNA, 67 bp, Homo sapiens
ggttccgtctttgaagatttgatgctgtgaatttggacctggcctggcagcagatcttaaagtgacc

SEQ ID NO: 6773851 - DNA, 106 bp, Homo sapiens
ttcttcccaaggttagtttgaggactaattatgatggagcgtaaaatgtacctgtgtatgttaagtgtaccatatatcagttcttcttcaccttccccctgaagaa

SEQ ID NO: 6773852 - DNA, 77 bp, Homo sapiens
gtgagcaatgaccatcatgccctgcagtgagtgcgtctgccgggagcagagctcagagcagggcactcttgactcgc

SEQ ID NO: 6773853 - DNA, 71 bp, Homo sapiens
ggttagacattgggtgtacaattggcaatgtctgccaaagatactgccagtaatagctctttgtacttgcc

SEQ ID NO: 6773854 - DNA, 70 bp, Homo sapiens
gcattctgtcattacaaaaggcagtgatagagtaatgaaagaccattgcccaaggggaatgaaagagtgc

SEQ ID NO: 6773855 - DNA, 59 bp, Homo sapiens
tgaggtaaatgttagggctattattaatatctttatatggcacagcctgaaatgcctca

SEQ ID NO: 6773856 - DNA, 61 bp, Homo sapiens
gccacctcttcccactgcccatgggcaggccaaccagtcctgggtgcagcaggaaaatggc

SEQ ID NO: 6773857 - DNA, 73 bp, Homo sapiens
gcctatttattctgagcctgctgtagcaagggagtccaccactatcacttgcgttttggcagagactcaaggc

SEQ ID NO: 6773858 - DNA, 64 bp, Homo sapiens
ctctgatctagaccagaagctgttgtaagaatatcttgacaacatctctcactggaagccagag

SEQ ID NO: 6773859 - DNA, 83 bp, Homo sapiens
cttccaggtctcactcttctctttcttcgcttgttggatgatagatctcaagaatctagggaggattctgagacttaagggag

SEQ ID NO: 6773860 - DNA, 62 bp, Homo sapiens
aggcagggaccagttgttttctttaagaatggtgaaaacatgatcatggctagtccttgctt

SEQ ID NO: 6773861 - DNA, 82 bp, Homo sapiens
cgttgacataaatactaaaggcttgagcatttgttgaatgagtttaagattatacaacatgtaaagtggtttaatgtcaatg

SEQ ID NO: 6773862 - DNA, 79 bp, Homo sapiens
gcgtggcaatgtgtgagctaagcaaatatgagccatcatactggctctgctgcacccttggctcctcacacatgtctgc

SEQ ID NO: 6773863 - DNA, 74 bp, Homo sapiens
aactacaaagtcttttacaacagtcattcttggtgtatagctagtggaggtgaaatgggaagattattgtagtt

SEQ ID NO: 6773864 - DNA, 82 bp, Homo sapiens
gctctacagagaaaatctcagtgaggacacccacactatcacatgttagcaggctgtcctttactgattgcttctggagagc

SEQ ID NO: 6773865 - DNA, 81 bp, Homo sapiens
gcttgaggagcccttcagcccgcagctgcaccgtgggagcccctctctgtgctggctgaggcctgagcgggctccctctgc

SEQ ID NO: 6773866 - DNA, 72 bp, Homo sapiens
ggtcacacaacaaagacgggataaggtttggattccaatccatgccttaaccttgctcttaaccactgtacc

SEQ ID NO: 6773867 - DNA, 61 bp, Homo sapiens
gagtgttgctgtgttagaattacatgaactaattaagtaaacttacacatagtaaatactc

SEQ ID NO: 6773868 - DNA, 115 bp, Homo sapiens
catggccctattgaagccctttctctaggttttagatgaagaaattaccaagccctactcttaaactttctatgtcttccttgtagaatttagagcagtgtaatcaatttctgtg

SEQ ID NO: 6773869 - DNA, 56 bp, Homo sapiens
aagcaccaagttcaacattcccattttacagatgagcaggttgaggcatggtgttt

SEQ ID NO: 6773870 - DNA, 60 bp, Homo sapiens
tagtttatattcaacggagtatctaattgaaagattatgaacgcgtggaaatgtagacta

SEQ ID NO: 6773871 - DNA, 69 bp, Homo sapiens
gtcaagggcatcagtgttgcgtggcacatgataactcctacaaatgcctgctgtcctgattcccatgac

SEQ ID NO: 6773872 - DNA, 68 bp, Homo sapiens
cggagcagtaattagattctccagaaaacattggacttcagtttcctggaagtgcttttatagctttg

SEQ ID NO: 6773873 - DNA, 60 bp, Homo sapiens
agttattgtcctcctcaccttacacccgaggaaactgaggctcaaggaggatacgtagct

SEQ ID NO: 6773874 - DNA, 93 bp, Homo sapiens
gagccgtcccttctgcaggtagaggctgccatcagctgccatggagacccggtagtggcagaccttggcctgggcccggactaggaagggttc

SEQ ID NO: 6773875 - DNA, 121 bp, Homo sapiens
tggattgatgataagaagaagagcagaagcaggaggagcattaactgagcatctcctgattgccagacacagctcagagcttgaagttccacttatatttgctctgatcctcacaacgcca

SEQ ID NO: 6773876 - DNA, 87 bp, Homo sapiens
attgtggttgtctcctctctttgttattgtaggttaaaaacattcttttagtgtcatttcagtggagttttgggagatagccagggt

SEQ ID NO: 6773877 - DNA, 76 bp, Homo sapiens
gaggggctgggccactccagatgcccacttgatcatctttgctggtgcagtatatggagggctcacccacaagctc

SEQ ID NO: 6773878 - DNA, 58 bp, Homo sapiens
ctaggccagttaggaagagaaggcagagcccctgtttctaaatcagaatatggcctgg

SEQ ID NO: 6773879 - DNA, 86 bp, Homo sapiens
ccaatatactgtaacttacagtggaagttaaccccattttgaaaaattagattgttttaattccattgtgaagttgaaaaaattgg

SEQ ID NO: 6773880 - DNA, 80 bp, Homo sapiens
aagctttcttagcagccctcttggtcactaggcacactacctaggagtcaagctgtgacaagaggctgcttcttaaactt

SEQ ID NO: 6773881 - DNA, 58 bp, Homo sapiens
taggagcagagttgggatttgagcaggttcacctgacttctcctccaagttgctcctg

SEQ ID NO: 6773882 - DNA, 56 bp, Homo sapiens
gggaggtagacttcttggaagtagaccctccagtcccagctcttcaagtcaccccc

SEQ ID NO: 6773883 - DNA, 72 bp, Homo sapiens
tagcttggtgcacaagttattgcagttcattgaaaataatgggaaaactgcaattatttgttcaccaaccta

SEQ ID NO: 6773884 - DNA, 62 bp, Homo sapiens
gctatggcttgttgaagtgacttgctatgtggtttgcttaagtccttcagcaagttagtggc

SEQ ID NO: 6773885 - DNA, 125 bp, Homo sapiens
gaaatgtgaagcagaaaaatctcgacaatgctgttgagacattctttttcttgggaaggcctcatgtcaaagcagcaaatattaatccatttgtcataacagatgtttttctgttgaaacccttc

SEQ ID NO: 6773886 - DNA, 79 bp, Homo sapiens
aactgaaggaaagagggaaagtactgagttaaattctaatgtgagctttgtgcacattgcttttctatgacctgcagtt

SEQ ID NO: 6773887 - DNA, 69 bp, Homo sapiens
ccagagaggatgtgttaaagcgtgcatcatgcacatgtgcagccctgccatcgctttgaacatcactgg

SEQ ID NO: 6773888 - DNA, 65 bp, Homo sapiens
ctttggtcaaatattatcctgagtgcatccgggaggatgtttctggataacatttgaatcagtag

SEQ ID NO: 6773889 - DNA, 64 bp, Homo sapiens
ctatggtatttccttgcctctgcctagcttcaagtttggtgaaggttgggaaattttaacatag

SEQ ID NO: 6773890 - DNA, 77 bp, Homo sapiens
gaggagatgaatggatggatgcctccacctgtctcaccaccaatgagcccactgaagcattcgccttcaccctcctc

SEQ ID NO: 6773891 - DNA, 62 bp, Homo sapiens
tggcagctggagggcaatggcccccaacccctggcacggccatcccacccgccagccagcca

SEQ ID NO: 6773892 - DNA, 76 bp, Homo sapiens
gtggtggaccttttaaaggctgtatgaccaagatataattttggttcaggttgtctttattgatatgttcactcac

SEQ ID NO: 6773893 - DNA, 68 bp, Homo sapiens
ccctgtgctaattcaaggaaacaaggcagccaaggagtctaacttgaggtcttcattcttgggcaggg

SEQ ID NO: 6773894 - DNA, 57 bp, Homo sapiens
ataaggcttaaaccttgttgccacagctggctttcaaatttggctttaagccattat

SEQ ID NO: 6773895 - DNA, 62 bp, Homo sapiens
agaggagcttttggaaaaggccactctccctgggggctcgctcatcatccacaagcttctct

SEQ ID NO: 6773896 - DNA, 56 bp, Homo sapiens
gagaggagtagacactttggtttccattctaaaaccaaagctacagattccatttc

SEQ ID NO: 6773897 - DNA, 62 bp, Homo sapiens
tcagagggtagaagacagggttgctcgtcttaaccgggcagtgtctacatttattactttga

SEQ ID NO: 6773898 - DNA, 56 bp, Homo sapiens
acaagtggccgagagtcatctctactttggagttagtcaagatgctggccacatgt

SEQ ID NO: 6773899 - DNA, 72 bp, Homo sapiens
ggtctgggcccaggtgctcttgccagggctgctttctagggtagaatggaggaagagccttgggcaagggcc

SEQ ID NO: 6773900 - DNA, 63 bp, Homo sapiens
aaggagaatgagtgctaggtatcaaaccatttagataaaaccaccttagcatttatcttcctt

SEQ ID NO: 6773901 - DNA, 60 bp, Homo sapiens
tgctgcagaaattctgtgaggatggatgcctcctaatccttgccttcagctctgccagta

SEQ ID NO: 6773902 - DNA, 71 bp, Homo sapiens
tagctctacttattgtgattcctgcctctttccacaagttgggatgatggtgggttattacactgatgcta

SEQ ID NO: 6773903 - DNA, 129 bp, Homo sapiens
gaaaaaatacttaataaactgataccaagggtctgttgtaggggaagtcattgcttaggtatccatttgttgagacttctgaattcagtatggtctttctctctctctttttctgtttatgtatgtatc

SEQ ID NO: 6773904 - DNA, 82 bp, Homo sapiens
cccgcgtcggcgccttcaggccctttttgttgttaatagtttttctgtgttaattgcagggagcctgggggcgtcgcttggg

SEQ ID NO: 6773905 - DNA, 81 bp, Homo sapiens
gtttctttaactcatggctgaaacagtaacacagaagacataaacctcaaatctgtgtctgggtctgtaacatggggaaac

SEQ ID NO: 6773906 - DNA, 86 bp, Homo sapiens
ctgtactaactgtgcaacttttctgtgaatttaagtattccgaaacagtatttattttaaaacatagggtagaggttgcacaacag

SEQ ID NO: 6773907 - DNA, 62 bp, Homo sapiens
gtggcatccagataccctgagggcgtgtaacactccaactttccccatatgtctggagctat

SEQ ID NO: 6773908 - DNA, 107 bp, Homo sapiens
agtgattatttttgctgtacagcagtatgaggcaaggatcatcactgatctgggtggtgtttccagaggtatgttcacttccctttctgtatggttaaaaagttact

SEQ ID NO: 6773909 - DNA, 61 bp, Homo sapiens
gccccaggtggtaaacctaagaatgacttcaatttttaaacatcttgttgccttaaggggc

SEQ ID NO: 6773910 - DNA, 62 bp, Homo sapiens
gaattaatttgccaaggttatcttgttattgaacaacaatgtgaggccttggtagttatctc

SEQ ID NO: 6773911 - DNA, 72 bp, Homo sapiens
ctcattcactagctgtaagagggatgtggctcaaacttcaactgagaagcatcagcaatggctggaaatgag

SEQ ID NO: 6773912 - DNA, 65 bp, Homo sapiens
gtgatgtgagcctctagaccctggcctgcagggactgagggcagctctagggggttagttattat

SEQ ID NO: 6773913 - DNA, 55 bp, Homo sapiens
tggtaaatgtctaacaatcactggacaaaagagccattatttgtgatatttaccg

SEQ ID NO: 6773914 - DNA, 74 bp, Homo sapiens
cacagaaagaggcactggcaaagcaaagtctggtacctaggtctcctgactcccaagctagtgctctttctttg

SEQ ID NO: 6773915 - DNA, 56 bp, Homo sapiens
gcctggctcgggcactcgccaggatggagatttctcaggcggctcgaaggtcaggc

SEQ ID NO: 6773916 - DNA, 63 bp, Homo sapiens
ggagacccccgactgtgagaccaggaggagcctggcttccacttacagttgatggagtattcc

SEQ ID NO: 6773917 - DNA, 61 bp, Homo sapiens
ggcctaggaatccttttagagttggtaaaagacatggacctgacacaaaaggattcttgct

SEQ ID NO: 6773918 - DNA, 119 bp, Homo sapiens
gccacagctgctttgctcattatttctgatgaatggacatcacctggcgtctccggtgatggcgccagctcaggacccaggtgtgacctgcacaacaaagaaaagcaagatagctttgc

SEQ ID NO: 6773919 - DNA, 63 bp, Homo sapiens
agtccgtggcatcgtctgaggtggggtcctgctcaggttactccataactgatgccctgccct

SEQ ID NO: 6773920 - DNA, 96 bp, Homo sapiens
gaggctccgacgcgcaggcgctctccggctcccgtgtaggaacctgcagagatcctggactgagcgtttgtcacctagctctgtggacggaccctc

SEQ ID NO: 6773921 - DNA, 77 bp, Homo sapiens
ttaatatttatggaatacttatgctgcagtaggcactgtggaaaatgctttacatatagtgtttcattaatgcttaa

SEQ ID NO: 6773922 - DNA, 109 bp, Homo sapiens
gggagggttcagtccgtccttgagtctgtgccctatgctgtccaatctcaggttgacaccggcagctcaagggttagattccagctcaatacggaaacttaaaactccc

SEQ ID NO: 6773923 - DNA, 95 bp, Homo sapiens
ctttatgagggtccctgtcatcaaggatttagctgtttcatttacagattcctgtaaatgttcaccagatccatgaccagtaattttcactggag

SEQ ID NO: 6773924 - DNA, 69 bp, Homo sapiens
ggtgagcagaggcagaggaaggtggtctctcggggacagtgtctgaggactccgttctgtctgcttgtc

SEQ ID NO: 6773925 - DNA, 69 bp, Homo sapiens
acctggaataggcagcaggatgctcctcttgaggtttcagagggagcacagccttgccagtacctcggt

SEQ ID NO: 6773926 - DNA, 71 bp, Homo sapiens
ctctccagtcctcatctcaaaacccaaggggcagtttaatctgtctctgtagtttgagagagcagggagag

SEQ ID NO: 6773927 - DNA, 72 bp, Homo sapiens
tcaatatgtgaaagcaagtgttgctgtcatggttacaaagagccatgcagccacgtctagctaacatcttga

SEQ ID NO: 6773928 - DNA, 62 bp, Homo sapiens
gagggcccagccacatacagtcaaccattatgaatatgtactggctggtggcagggcttctc

SEQ ID NO: 6773929 - DNA, 67 bp, Homo sapiens
ctttgcaccattgctgggctagttccctcatggtcctggggaaggaagcctagtaatggagtcagag

SEQ ID NO: 6773930 - DNA, 87 bp, Homo sapiens
aactctgagaagcactgccataattcagacctttcattttctctgtgtgtatgtgtgttttaattgtggggtgctcatagtggagtt

SEQ ID NO: 6773931 - DNA, 61 bp, Homo sapiens
catcatcacttctgtcatattctattggtcgtgcagaccaaccatgatgcagggtgggatg

SEQ ID NO: 6773932 - DNA, 61 bp, Homo sapiens
gtccgtagtggctgatgctttgagcccatggctgctctggaggcatgagccctgcatggac

SEQ ID NO: 6773933 - DNA, 61 bp, Homo sapiens
ctgtgagctgggtggccaggactactcccggagcgtgattcatggtgcatccacctcacag

SEQ ID NO: 6773934 - DNA, 62 bp, Homo sapiens
attaattgaatatggtcaatgaataccaatacatgggaatcattgtacatgttccagtggat

SEQ ID NO: 6773935 - DNA, 62 bp, Homo sapiens
gtctgaaagtgggtcataaaaaattgcatagtaccacgtgcaagttggtcctattttcttgc

SEQ ID NO: 6773936 - DNA, 76 bp, Homo sapiens
agtttctgggaaaatggaggcagtgatttgctgaaggccacacagcaaatatttctgtagctatgttctttccact

SEQ ID NO: 6773937 - DNA, 57 bp, Homo sapiens
ggctgtgattggtggatgtgaattccttctgctgaatcatgccaccactctgcagcc

SEQ ID NO: 6773938 - DNA, 103 bp, Homo sapiens
ttgagacggagtctcactctgttgcctaggctggagtgtagtggcgctatttcggctcactataacctctgcctcccgggttcaagcgattctcctgtctcag

SEQ ID NO: 6773939 - DNA, 77 bp, Homo sapiens
tttcttgttcgctgaatgtaatagtcagtagaacagtaatctggaagcactactttaatgcatgtgtatataagaag

SEQ ID NO: 6773940 - DNA, 83 bp, Homo sapiens
ccaaattaaaagttgaagcatgaaccaaggtcaaaggttaagggttaggatgtgggattttggtgttcatgctccaggtttgg

SEQ ID NO: 6773941 - DNA, 92 bp, Homo sapiens
tgctctccagcccaaatgggaggcctctgtcccaccagggagctttaggttccccgggtgcttctcggaggctgacaagggcgtggagagca

SEQ ID NO: 6773942 - DNA, 70 bp, Homo sapiens
gctctgacacatttgttctacctccttcatctcggggagacagcgtgaaggataaatgaaagtcaggagc

SEQ ID NO: 6773943 - DNA, 60 bp, Homo sapiens
caacaaatttctatttggttttgtgtgatttcacatctaactgtttcagaaatattgttg

SEQ ID NO: 6773944 - DNA, 84 bp, Homo sapiens
aggaagcggtatctgaatggctgagagagagactggagcaaggacaaagtggcatttctctgcctcagcttctgccgcagacct

SEQ ID NO: 6773945 - DNA, 74 bp, Homo sapiens
ttcccctgtgctatagaaggtaccatattcacatgcttcaagaattagaatatattgtatctttcatgggggag

SEQ ID NO: 6773946 - DNA, 95 bp, Homo sapiens
gctaacaaattattggagaaaatcttgcattaacaacttgtgatttataggtaatttcttgtcagtgacagatttatgatctcttaatttttagc

SEQ ID NO: 6773947 - DNA, 86 bp, Homo sapiens
agccttcaagagtcttcagtgatgagaatgatttgcctaggagccaaagccttagtcattctccttacaaagcctatgtgacagct

SEQ ID NO: 6773948 - DNA, 55 bp, Homo sapiens
ggctgccacatgccatgtcctcttaacaagataagaaaacagtggctatggagcc

SEQ ID NO: 6773949 - DNA, 55 bp, Homo sapiens
taccaagtagctgggactacaggtgcccgccaccacgcccggctaatttttggta

SEQ ID NO: 6773950 - DNA, 82 bp, Homo sapiens
gtgtgtgtgctggcacaagcccatgcactgtgtgtgcagacgcatggcgcctgcacccacaggcatggccgagcacatgtgt

SEQ ID NO: 6773951 - DNA, 82 bp, Homo sapiens
ccaagccaaaccctcctgaactggccactgggtgacaatcatctgcctgttccagaggcccagtgagagggctgtagcttgg

SEQ ID NO: 6773952 - DNA, 94 bp, Homo sapiens
ctataacaagttaggcatattctgaatcctcgaaacatagcagttaaactttgctgactaaattcctgttcgcgatgagcttaatttcttgtgg

SEQ ID NO: 6773953 - DNA, 66 bp, Homo sapiens
tcttgcttgagctaatagaatgcagcagaagcaatgttgtacaagttttgagcttaagtttcaaga

SEQ ID NO: 6773954 - DNA, 68 bp, Homo sapiens
ggtaggtgagaaggactgttgcatttctgttgttcactcatcaaatagcaattacccttcaactctcc

SEQ ID NO: 6773955 - DNA, 91 bp, Homo sapiens
tggttggtttttggatcattagtaactcatggatataagtatatttgttttgttttaatccatggcagttattaaatttaaaaatgttcca

SEQ ID NO: 6773956 - DNA, 68 bp, Homo sapiens
atcaggccatgggcaaaaacttgctagcacccaggctgccagcagggcagtgccctggactccctggt

SEQ ID NO: 6773957 - DNA, 60 bp, Homo sapiens
tatcactgagttttgacaacttttatataattgactgtaaagtgttttgatttagtggta

SEQ ID NO: 6773958 - DNA, 58 bp, Homo sapiens
tttagtttaggtggggtagacagagaaggcctctctgaaaagatcattttaagctgag

SEQ ID NO: 6773959 - DNA, 56 bp, Homo sapiens
gcttgctgctctggagtcatgcccttccagcaatagggcaggacccggtagggagc

SEQ ID NO: 6773960 - DNA, 108 bp, Homo sapiens
gtacacgctcgccttgggggctctggggtgccctggcatgctgacccacccttcaccagtcatcacgtttgcccccagatgccttctgaagtcctagcatatgtgtac

SEQ ID NO: 6773961 - DNA, 63 bp, Homo sapiens
aaaataatctagtctaagaggagctgggaaatttttctctttatgtaagactgggcttgtttt

SEQ ID NO: 6773962 - DNA, 75 bp, Homo sapiens
actgtttcaggcaaggcaggcctcagtaagcataaacaataggaacttctggctgaccttaccctgacccacagt

SEQ ID NO: 6773963 - DNA, 84 bp, Homo sapiens
ggtctccctaaccgctcccctacctcccttcaagttaatgttggagcttctccagggctgacttgggagaggagccggcagacc

SEQ ID NO: 6773964 - DNA, 61 bp, Homo sapiens
gggtgcagctggacagagaagcccacaagagagtttaagtgtggcctctgcaggccgcccc

SEQ ID NO: 6773965 - DNA, 122 bp, Homo sapiens
cccagctcctgcctaggaaagccttagtgttgggagggaccctgatgactgaggagcctggtagctccaggtcgcccacactttcaggtctcttgcaccagaaggtggcaggatccattggg

SEQ ID NO: 6773966 - DNA, 76 bp, Homo sapiens
agttttatggatgttgctaagaccaagactgggcatggacttgtccagggtcttcgaggcagcaatgacaaagact

SEQ ID NO: 6773967 - DNA, 74 bp, Homo sapiens
gccacagccatgtgggcagtgatgggtgagtgtgtcctgcaactggacgtttaaccagcacgcttggccgtggc

SEQ ID NO: 6773968 - DNA, 56 bp, Homo sapiens
ttcatgaatacaatgagacaatatttgtattattgttttaacctagtgtttatgag

SEQ ID NO: 6773969 - DNA, 107 bp, Homo sapiens
tgtatttgtttaatttcctcatctgagtctctgacagcatgttttgcctgaattcacaaaggaaacacagttcaagacatcagtatgatctctattttatatgtaca

SEQ ID NO: 6773970 - DNA, 78 bp, Homo sapiens
ggatacaataaatatttagtgcttcatgtttctcatgtatatttggggtatcatgaatatttagtatttacttggttc

SEQ ID NO: 6773971 - DNA, 62 bp, Homo sapiens
gcctggaagtcattcctcgttcccttgtctgagtggcctggagccgagctgtgtttctgggt

SEQ ID NO: 6773972 - DNA, 86 bp, Homo sapiens
tggaagacaatgtaaagtagcttttatgatttactgcaaagaatcctgcttgtttaaagtcctggctgtcttatgttgaactttca

SEQ ID NO: 6773973 - DNA, 72 bp, Homo sapiens
atggctgtggttatggaactggctatggctgtggatgtggctctggctctggctactgtggctaccggccat

SEQ ID NO: 6773974 - DNA, 67 bp, Homo sapiens
ttccaacatgaatttttctgtgggttaatggataggtttgattaaacacactgagatttatgtggag

SEQ ID NO: 6773975 - DNA, 127 bp, Homo sapiens
cattagaattgcctaaaagacttgttaaagcacaaattgctaggtcacagcaccagagtttgtgattcaataggtctggtgttgggcctgaaaattaaagtttttaacaagtttgcaggtgttaatg

SEQ ID NO: 6773976 - DNA, 90 bp, Homo sapiens
gggaagaaactgataggagaggtgagtgatactggacttacagatatatatcataaattatctatttggctattatttatgtttcttccc

SEQ ID NO: 6773977 - DNA, 64 bp, Homo sapiens
tgcctgggatctgtgccctttgctctggaaactctccaaattaaagtggctagaattttaggta

SEQ ID NO: 6773978 - DNA, 72 bp, Homo sapiens
gcaggattcattctggaggcttgagcaaagaatctgtcttcttagcttttccagcttctagaggccacctgc

SEQ ID NO: 6773979 - DNA, 87 bp, Homo sapiens
ggtagcttgcatcactttacagtgctgctaatggctcatcatggggagccagataaaagcatttaaagaggaaacaatgcaggctcc

SEQ ID NO: 6773980 - DNA, 64 bp, Homo sapiens
tctttaggatgaatttgttttattctcattggccattgatcatggaatgaatatgttttaagga

SEQ ID NO: 6773981 - DNA, 71 bp, Homo sapiens
gtccttctgatatattttccatggtctgcagtattcaactcactgagactgagggaaatattctgccagac

SEQ ID NO: 6773982 - DNA, 81 bp, Homo sapiens
gggtagacaagagacagagagtaaatggtgatgttagagtaataggatgttaacacaggactctctgccttagttttgcct

SEQ ID NO: 6773983 - DNA, 58 bp, Homo sapiens
gcagcagatgtgggcccagagcagaaaatgttctggcttaagtcatcccatctgcagc

SEQ ID NO: 6773984 - DNA, 62 bp, Homo sapiens
atgctgcaggttgagtcttagagccagtactgtctgggaaagaagattctgatttgtagcgt

SEQ ID NO: 6773985 - DNA, 78 bp, Homo sapiens
cccccaaagctggctaagcccaggctgggccctcatcagccacgcggaatcagggctgggcttgtggccagctggggg

SEQ ID NO: 6773986 - DNA, 63 bp, Homo sapiens
aatgtgaatcttcctttttgatcttgcagtaatcaaggtttaaaaagtattagggttcagatt

SEQ ID NO: 6773987 - DNA, 88 bp, Homo sapiens
cttagaaggatgagacaaatttttatagtgagaattatgcccagtcagggcagcattttccatagaaagaagttataaaatttctaag

SEQ ID NO: 6773988 - DNA, 55 bp, Homo sapiens
actgagttatagaggtttatatctttgaaaaatgagataactacattggctcagt

SEQ ID NO: 6773989 - DNA, 68 bp, Homo sapiens
atcttcactgttatgaagctctgggagttatttaaatctctcagcatgcttcctctgacggtgctggt

SEQ ID NO: 6773990 - DNA, 74 bp, Homo sapiens
ctatatttcatttacattgttgagcctcttgttcagcctactaatgtggttggtgcttaacaaatgttgtatgg

SEQ ID NO: 6773991 - DNA, 58 bp, Homo sapiens
ttggctgctaatggctgacagctgcccctttctcctgaacattgcccttggcggccag

SEQ ID NO: 6773992 - DNA, 112 bp, Homo sapiens
aaggatatgcttataggtacaaaatgaactgttgacagtagttgcttctggaaaatgagacaaagtggctaatgaaaaatagattataggttgactttctatttttgtcttt

SEQ ID NO: 6773993 - DNA, 55 bp, Homo sapiens
gggggcaggtgcggcgccgccggtgacggtggccctcagtcttgctcctgctctc

SEQ ID NO: 6773994 - DNA, 68 bp, Homo sapiens
tcatatctttcacagagaatattgccttgaaatggtagtcaaagctataagctctttgagattagtga

SEQ ID NO: 6773995 - DNA, 81 bp, Homo sapiens
catgggaggactggggagtgagggtgaggaagatagcctaactctctgcttcattttgacttagccagtgcttttcccatg

SEQ ID NO: 6773996 - DNA, 62 bp, Homo sapiens
agggggcttggagattgtcatggacagaagtccatttagactctcacctccacctgtcccct

SEQ ID NO: 6773997 - DNA, 73 bp, Homo sapiens
cccgggaaaaagattcaagcggcaaagtccggaggaaacgaggagcaggctttcaagagtcttcttccagagg

SEQ ID NO: 6773998 - DNA, 56 bp, Homo sapiens
gtatgtgcaattcactgtgagaggtaaacaagaccttaactgtgtcttacacatac

SEQ ID NO: 6773999 - DNA, 65 bp, Homo sapiens
ggctgatgggcatgagctgtcaggccactctttctcccaaaggcagccatgttcccgtctcagct

SEQ ID NO: 6774000 - DNA, 65 bp, Homo sapiens
tctcaggtggcttcatcaactgtgcttatgtagacatagtatttactttgtgtggagcctggaga

SEQ ID NO: 6774001 - DNA, 76 bp, Homo sapiens
gccccgcggcccgcagagtcaggcgtgagcttcgccctttctgaaagggcctccgcctgggcaggcgccggggggc

SEQ ID NO: 6774002 - DNA, 114 bp, Homo sapiens
gtgggatgataaattgagggagttgaattttcttcatattttgaaaatagggcccaactgaaaatacctcaaacattgatgggaagtttaatatttcatttttatctttcccac

SEQ ID NO: 6774003 - DNA, 93 bp, Homo sapiens
tcttatgtgtggacattcaggaaaaatgccaggagtcagctactttgacagcagcatgacccatttttcttgctgtgtctaccaaacctaaga

SEQ ID NO: 6774004 - DNA, 61 bp, Homo sapiens
gcctgtttactttgccgcaggaggagaaggtcctctggaggtgctggacagggtggcgggt

SEQ ID NO: 6774005 - DNA, 84 bp, Homo sapiens
ctggggatttatttgttcatgggttgttatgcaatcctaaggttgagtgcaatacagaagagtggcaagggagaatcactccag

SEQ ID NO: 6774006 - DNA, 83 bp, Homo sapiens
ggacaggagaggacacagctgctctgcagaggcacacagcttgtacccaaaacctgcaggagggcaggtggtcctcagcctcc

SEQ ID NO: 6774007 - DNA, 60 bp, Homo sapiens
gaggtgggctgggggcagtcaaagagggaggggcctcgtggtgctgcttccagctcactc

SEQ ID NO: 6774008 - DNA, 95 bp, Homo sapiens
ttctccatctgctaaatggagagtattgtaatagcacctgcctcatcaaattgttatgatgattacatgtgttaatatacattaagcatggagaa

SEQ ID NO: 6774009 - DNA, 76 bp, Homo sapiens
ttgatcgcctggtggaccagcctccccagcccctctggcagctgtctgggaggcctccacttactgaggcggacaa

SEQ ID NO: 6774010 - DNA, 72 bp, Homo sapiens
catttgctgtattttcagattcacttacctatatagcagagtttagtacttatctggaagaactggtaagtg

SEQ ID NO: 6774011 - DNA, 104 bp, Homo sapiens
gtggggctggaccctggcctcactcttcctggaggggcagactgaggagatcacagggttctgcagaattcgaggaagaaaaggccctggcctttcagtgctac

SEQ ID NO: 6774012 - DNA, 58 bp, Homo sapiens
tggtaaaagtgggacttgtgtttatcatttctcaatgagcacagtcctatgtttatca

SEQ ID NO: 6774013 - DNA, 87 bp, Homo sapiens
atctggtacatgttaatgaatttttgcagttcctttggatataatctctttcctccactgtcaggttcagcatgtttctagccaggt

SEQ ID NO: 6774014 - DNA, 79 bp, Homo sapiens
ggtctaatagctggtaagtggagtctttgggactagaacccagtcctgacccaaaggctgtacttgtaaccactatgcc

SEQ ID NO: 6774015 - DNA, 59 bp, Homo sapiens
gtgccaggagaggccctggcctgggaaggcccctttctcccagggctggctcctgggat

SEQ ID NO: 6774016 - DNA, 84 bp, Homo sapiens
ggttccagcagctcaggctccttcccattggttctcacaaagtgtgcctctctgggtggagcaggctggcgctttagttgaacc

SEQ ID NO: 6774017 - DNA, 83 bp, Homo sapiens
acagggctctccaccctgagtcactgtctgtctgccctgattaccccagggccaggtaccagacaactcaggacagcccttgt

SEQ ID NO: 6774018 - DNA, 65 bp, Homo sapiens
cagaaccacattgaagagagagagtggctgctctcagcacgttgttttcattgtggttaaacctg

SEQ ID NO: 6774019 - DNA, 59 bp, Homo sapiens
ctggcagtgacattgcaggtgctcaccccctttgcaaacttccctgcagtgcctgtcgg

SEQ ID NO: 6774020 - DNA, 73 bp, Homo sapiens
tttgtaatgaagtagagtaaggttttaagctaggacttcctgactctaaagtctttgttctttccattgcaaa

SEQ ID NO: 6774021 - DNA, 60 bp, Homo sapiens
gggttctgttatggaagtttccttttttggagggaaagggttactttcttaacataatcc

SEQ ID NO: 6774022 - DNA, 130 bp, Homo sapiens
cacgtgcagcaaggaacagggaaccgcttaatgattaatcactgtcaacctttgttctcgttaaagacttgattgttggacaaggcttgtaatgagggactgttttggtgtctgttgctatgagattgtg

SEQ ID NO: 6774023 - DNA, 60 bp, Homo sapiens
ttctctctgagttcctgtggattttatgaggttgaacccacccctgagctccagggtgag

SEQ ID NO: 6774024 - DNA, 79 bp, Homo sapiens
gccccgcggcatttaggagaagagggtcagagttcaaggagtgaatttgtgaatctgtctcttgaaaatgcccctgggc

SEQ ID NO: 6774025 - DNA, 57 bp, Homo sapiens
tgagagtatattatatgcagagtagtaagtcaaatgctttgcatctatatgttctca

SEQ ID NO: 6774026 - DNA, 57 bp, Homo sapiens
cagctcagtctggagagatgcaggatcatcctctccttgcattccaatctgagactg

SEQ ID NO: 6774027 - DNA, 80 bp, Homo sapiens
gcttctgtgggactgttgcctggggaagctctgatgacagacaccaagctcccacagggcaaccctgtcctagttgaagc

SEQ ID NO: 6774028 - DNA, 72 bp, Homo sapiens
ggggtttgcagagccccagattggagagtggaaggctggacaccactctccaaatatgggcctgtgtgtcct

SEQ ID NO: 6774029 - DNA, 82 bp, Homo sapiens
gaggtcagtcaggtaaatgacattcttaagtcttgggcactgaccatcaagaaagataagaaacattctccctggtgccctc

SEQ ID NO: 6774030 - DNA, 65 bp, Homo sapiens
tccaagaagagcattttagtctcccttttcttactgaaaacaggagataaaagctcctttgtgga

SEQ ID NO: 6774031 - DNA, 130 bp, Homo sapiens
gtcaggggggccagtacacagggataagtatacaatggatgagattttggctttgaatccaagagagatgggaagctatgggggagtttcaaccataatcttatttgcctgttaactggcttactctggc

SEQ ID NO: 6774032 - DNA, 87 bp, Homo sapiens
tggcagcctaatagaggtgacccacctgcctcaccctggtttgttcttatagatgtaacggtaggtggcatttcaaatgggtttcca

SEQ ID NO: 6774033 - DNA, 68 bp, Homo sapiens
cttcacattcactagaatggctgtaattaaaaagagaaataatagcaagtgttggtgaagatgtgcag

SEQ ID NO: 6774034 - DNA, 56 bp, Homo sapiens
ctaatgtgcttaaaatactgaactgatgagttcagggggtattcaagctatattag

SEQ ID NO: 6774035 - DNA, 71 bp, Homo sapiens
tgtgtgtttttcagggaacatctgactacattcagaagcacgtcaggagttcctatgtgggcagagacaca

SEQ ID NO: 6774036 - DNA, 90 bp, Homo sapiens
aatgcctgaactgttattaaataattctctctttacctacttacaatatagatgaaggtgcaggatttgaaatatttagtaaaaggtatt

SEQ ID NO: 6774037 - DNA, 62 bp, Homo sapiens
gggggtggtggctgcttcctcaagaggagggtggatctgctctcctgccagcacacaccccc

SEQ ID NO: 6774038 - DNA, 77 bp, Homo sapiens
ggtggcttagggttggtggcgttggacctgggcagagatctccctccaggcaggcagctgtcaccactcggtgcccc

SEQ ID NO: 6774039 - DNA, 78 bp, Homo sapiens
ttcatgagagttcctgaaatcactactgctatgcctaagtaaaacatgtgtcaagtggaatttcagggtatgtatgaa

SEQ ID NO: 6774040 - DNA, 81 bp, Homo sapiens
tgtgtgtgtgtgtgtgtgtgtgtgtgtgtgtgtgtgtgtgatggtacacatgtatggcacttacattttcactgagcagca

SEQ ID NO: 6774041 - DNA, 101 bp, Homo sapiens
tgaggcagggggatcccttgagcccagaaggtcgaggctgcagtgagctgtgatcatgtcactgcactcctgcctgggtaacagattgagaccctgcctca

SEQ ID NO: 6774042 - DNA, 90 bp, Homo sapiens
cctggtctataaaggcatgaaatgctgagaggtgcttcttagctattttttgtggggcacttttaagtatttaaagagcttttccccagg

SEQ ID NO: 6774043 - DNA, 55 bp, Homo sapiens
ctgggagtctggcctctggtcctcactgagctgatgaccagctaggtgaccttag

SEQ ID NO: 6774044 - DNA, 65 bp, Homo sapiens
gataggacacacttctgaggtctttcatgtcaaagtatctaacatgagaccctgtgtgccttgtc

SEQ ID NO: 6774045 - DNA, 76 bp, Homo sapiens
attaacagggtgggaggaaatcagtctcttctggtggaaacaagttcctattggtcacctccctcagctctttaat

SEQ ID NO: 6774046 - DNA, 129 bp, Homo sapiens
ggttttgacagagtcccaagtgcacctgcaaagcagacaggctgccacagtgctgggcggagaaaggtcaccctgcccttgcctgttcagcatggctctgcagaaagggcctaatgactaattaaaacc

SEQ ID NO: 6774047 - DNA, 67 bp, Homo sapiens
aaagtagtctctttcatctttttgtcatcccttcctaagtagagaagaaattggaacagacagcttt

SEQ ID NO: 6774048 - DNA, 58 bp, Homo sapiens
gtcaccccgcccgccatctgtttacaggctgaaagacagctggctgcggtgaggggac

SEQ ID NO: 6774049 - DNA, 61 bp, Homo sapiens
ttttgttggttcctgtaaacattagaattctgttttaaggtttctagggggagccacaaag

SEQ ID NO: 6774050 - DNA, 119 bp, Homo sapiens
gaaaaatgcatacaaaaaagcaaagtaagaacattaaggtagtagtagcaaagtattaacagtagtcttatggtgtgattacattggtaatgtttatttgtatactttatgtatttttt

SEQ ID NO: 6774051 - DNA, 57 bp, Homo sapiens
ggcgggtgcacagacccttccccaaaggcctcaggtctgaggtcctggctgcccgcc

SEQ ID NO: 6774052 - DNA, 104 bp, Homo sapiens
atctttctttcaaatacttaatgatattggcattatattctgtgtacaaaatacttagttgacacaaacaagatatttgcccagtaagagttagaatggatgat

SEQ ID NO: 6774053 - DNA, 77 bp, Homo sapiens
ttcctgcagcgaggccaggtgttcctgggccgacggactgagttgtctggacagcagcacctcggcccctggagggg

SEQ ID NO: 6774054 - DNA, 76 bp, Homo sapiens
gcttattgtgcagcagtggtacctggaaccccgcagaaaggcatgggggatcaggcacggctgaatgcacattggc

SEQ ID NO: 6774055 - DNA, 130 bp, Homo sapiens
atgaagtcagggagaaaatatgtgtcacgatgtttaggctttccaatgtcactatgaatcctttactctgagagatacggggaaccattggagggttttaagcaaataagtcatgtgacctgactttcat

SEQ ID NO: 6774056 - DNA, 55 bp, Homo sapiens
ccatttgtcacctctgcactccatttgtcacagagtcccagtggtgggctgatgg

SEQ ID NO: 6774057 - DNA, 63 bp, Homo sapiens
gacttgtggccacgcagacccaggttccatgcccagctctgccactgtggccatgggagagtc

SEQ ID NO: 6774058 - DNA, 96 bp, Homo sapiens
ggtgttgtaaggattaactagtgtgtataatgctttgaagattaaaagtgctgagcattattagtgagtattacataactaattgtctataatact

SEQ ID NO: 6774059 - DNA, 101 bp, Homo sapiens
gcacttgctagaaatattccaaggtcagggagccctgtgattctgttgtgtgacacagtaaagctgtgctagacagtccggggctggcagtgggagagtgt

SEQ ID NO: 6774060 - DNA, 61 bp, Homo sapiens
cctggagaccaggtcttggtgcacacaacttgctttatcactcttcacacttgtctccagg

SEQ ID NO: 6774061 - DNA, 94 bp, Homo sapiens
ttcaaaaattcacttgatgtaattagagaagagtgaccagtcctgggcatatagcatggactccactgcttttttaagtcaggagaatattgaa

SEQ ID NO: 6774062 - DNA, 60 bp, Homo sapiens
gatattagtctgtaaattgatgcttgagacatacttcctagctcactctagactggtatc

SEQ ID NO: 6774063 - DNA, 65 bp, Homo sapiens
atcagtttcacttgcttgcaaagatctgaattgatacagatattggtacaaaaatgagaactgat

SEQ ID NO: 6774064 - DNA, 81 bp, Homo sapiens
cctgaactctgagctcttatattgacatcatgctgcagatggtgtacatgtgtctaagaatgaaagatacagattttcagg

SEQ ID NO: 6774065 - DNA, 73 bp, Homo sapiens
ccctttttaccttttatggataataggcaagctatcttctatgagcctgggtttcatcattggtaaaaagtgg

SEQ ID NO: 6774066 - DNA, 67 bp, Homo sapiens
ggctcccacttgccctggcgctgtctctatggagctcaatgtactgtaacagctgtcagagcaggcc

SEQ ID NO: 6774067 - DNA, 57 bp, Homo sapiens
tgcactgcagttccccagtgcgcaatcattccatgtgtgttgacggactgcagggca

SEQ ID NO: 6774068 - DNA, 64 bp, Homo sapiens
ttacacattaaaatcctaacttccaatgtaatactattaggaagtgggaccttttgagaggtga

SEQ ID NO: 6774069 - DNA, 79 bp, Homo sapiens
tagggacattgtgtatcacagagcagctggttggctaaataaggctgtcagctgtccctgataccaaccaaccccccta

SEQ ID NO: 6774070 - DNA, 64 bp, Homo sapiens
cccacgggctgcacgggcttccgtggcctggctgctggccaccagcctcctagctgctcctggg

SEQ ID NO: 6774071 - DNA, 60 bp, Homo sapiens
gagtagagtgcggtgattaagactttgcatactggagtcagaccgactgggctcatattc

SEQ ID NO: 6774072 - DNA, 86 bp, Homo sapiens
accaatattgttataatatggagattgacaactagaacaggagcctctttcttagatgttagctctgtgtgggatgcagtgagggt

SEQ ID NO: 6774073 - DNA, 65 bp, Homo sapiens
tgattaaaatgcatgtattatctagatgagctagctgcaccaatctggatggtacagcagagtca

SEQ ID NO: 6774074 - DNA, 67 bp, Homo sapiens
aaggtggcagcagggctgtgctccttccgatcatttggaacaatcacatccttgcttcttccacctt

SEQ ID NO: 6774075 - DNA, 75 bp, Homo sapiens
agaagctaggaagaagcaaggaaagattcagagggagcatggcccaccctgctgatgccttgattttggacttct

SEQ ID NO: 6774076 - DNA, 57 bp, Homo sapiens
tttaagacttagatttattgggggaaccagatatcctaatgactgtcaagttttaaa

SEQ ID NO: 6774077 - DNA, 77 bp, Homo sapiens
acttcaagattttcctcgctctgctctgcaggtctctcctttttctgggggttaagtgaggacaagttctttgaggt

SEQ ID NO: 6774078 - DNA, 93 bp, Homo sapiens
ccagtgaaattaaatggcaattaagatgtgggaaaatttaatctatttaaaatttgatctaaatgtatcacatctggatagaccttaaactgg

SEQ ID NO: 6774079 - DNA, 67 bp, Homo sapiens
tcttcattacccacagcctctcttcaaaatattatcaatatttgtgggtatgctgggagtaagagga

SEQ ID NO: 6774080 - DNA, 80 bp, Homo sapiens
atcaatcttaaccagagaagaattatattgtttggtactttcatagataataaaattcattctctaggtacagggctgat

SEQ ID NO: 6774081 - DNA, 129 bp, Homo sapiens
ctttctactgctccagtgtggtgcttcgcgctgtcaatagagctgttaaaacacaatggaaagtgggtaattgtgcattacatggcttttgttttctgtgatgaaatatcgacatctgagcagagagag

SEQ ID NO: 6774082 - DNA, 80 bp, Homo sapiens
gggattgaaatgtaagtctttgtttcttaaaataactttttaaggttacaaaggacttcatagtaaatcttccaaatccc

SEQ ID NO: 6774083 - DNA, 126 bp, Homo sapiens
aggaaaaaaagtgcatgttttcttttccctttttcagttcagtttattatatcttgacattctgtcttgtaattgaatagtaattctggatttagagtggagaagaaagaaatttaagtcagtcct

SEQ ID NO: 6774084 - DNA, 130 bp, Homo sapiens
gattcttctaggctcagacaaacattaaatgggggagcagaagagggagtgtggacataagccatgctggcagtgggcaggtgccagctccctgtctcagttcccttgtctgtaaaatagaaattgaatc

SEQ ID NO: 6774085 - DNA, 66 bp, Homo sapiens
agtagttgagagagagctttggattgtaacttagaaggaataaattccaaacctgtctctggctct

SEQ ID NO: 6774086 - DNA, 59 bp, Homo sapiens
actgtggaatagattttcaacaaataaattttgggagacacaaacatttattccacagt

SEQ ID NO: 6774087 - DNA, 77 bp, Homo sapiens
taagatggagactgtctctagttgctggcattcatcaaaggtgttagttgcaagcaatggacggtgactttgactta

SEQ ID NO: 6774088 - DNA, 65 bp, Homo sapiens
gcagtgattttgctcagataaacgtagtgttaagtaagactttttacattgtctgatcacattgc

SEQ ID NO: 6774089 - DNA, 75 bp, Homo sapiens
ggtttagttttaagttaatgtcatctcagggctaaagtttgtccaattgagattcccattaattttatataaacc

SEQ ID NO: 6774090 - DNA, 55 bp, Homo sapiens
gtggagtgcaacggttggagtttgggtatgaattcaaatactagctctactccat

SEQ ID NO: 6774091 - DNA, 94 bp, Homo sapiens
ctgtgttttaaattgcagatctaaacagagtgctagttcacgggaaattacattctcagattaaagtagcattttgttgtgcagaaagcagcag

SEQ ID NO: 6774092 - DNA, 56 bp, Homo sapiens
tgttcctgtttaatgtgctcatcataatgcagtgaatgacactccagcggagaaca

SEQ ID NO: 6774093 - DNA, 86 bp, Homo sapiens
ctaggaggcactttcaggaatacacacacatctgtgataatacaaggcatcacatgctgagtggctttttggatacttctccctag

SEQ ID NO: 6774094 - DNA, 67 bp, Homo sapiens
ggggaccgggcatgagagctggcccgtgaggctgggccaggaaaagaagctggtgctcaggtaccct

SEQ ID NO: 6774095 - DNA, 56 bp, Homo sapiens
gagagcctggaggttctgctgaagcaagtcgttgctttctagaatgactggttctt

SEQ ID NO: 6774096 - DNA, 58 bp, Homo sapiens
tgtctttacttagaagttcagggtacagggctgactttgttcactcctgggaaagaca

SEQ ID NO: 6774097 - DNA, 56 bp, Homo sapiens
tgaggatggtcccgaggacacttgtaataaaccaagattcctccaagcactcctca

SEQ ID NO: 6774098 - DNA, 69 bp, Homo sapiens
gaggagaggccatcgttgttattaaaaataagaatataaattgttaccaaacactgagggctactcttc

SEQ ID NO: 6774099 - DNA, 101 bp, Homo sapiens
tactctctccttgtctaaaactttaattggaatttttgtaagggaactaaaatctgtgtttacctgaagtaacaatgaatatttttgataaggataaagta

SEQ ID NO: 6774100 - DNA, 59 bp, Homo sapiens
agatcctaggcagcagggctatattttgtaacagatttcctggctcctgcctgccttct

SEQ ID NO: 6774101 - DNA, 62 bp, Homo sapiens
ggtggtggggagccctgggaaagctgagaggggatacagttggcagggcctaccccaatatc

SEQ ID NO: 6774102 - DNA, 72 bp, Homo sapiens
gatagatagataagatagatagatagcctggtgtgggtggcctatggctgtattctatgttacttgtcggtc

SEQ ID NO: 6774103 - DNA, 82 bp, Homo sapiens
gtgtttaatatagtgtctggcatattgttggaacatacttatgacatatgcaaacaatagacccatgacacatacctaacac

SEQ ID NO: 6774104 - DNA, 106 bp, Homo sapiens
actagggcaagtaatttcagctcacatgtcctgggaaaataactggacttggatctagttcctgccctgaccatgtggccttgaaaaccactcacctgctctgagt

SEQ ID NO: 6774105 - DNA, 59 bp, Homo sapiens
agaccatagggacctcaggttgagcataaataacacatgccacctttccctggtggtct

SEQ ID NO: 6774106 - DNA, 68 bp, Homo sapiens
cccaggaaggccatgaccacttgctgtgaatcttaataggacacatgagctggtttggccctcctagg

SEQ ID NO: 6774107 - DNA, 122 bp, Homo sapiens
tgctgttttgttgcatcatcatgtcaaagtgctgttgttcatcatctgtcattcaacattgaatgccagagctcctgagtaacccccaaagcactcatcatgaagtatacacagaaatagca

SEQ ID NO: 6774108 - DNA, 70 bp, Homo sapiens
cacttggaaatgcaaatatattgaatctgattttattttagaagttcaaagtgcatgttcctcagaagtg

SEQ ID NO: 6774109 - DNA, 80 bp, Homo sapiens
ctcagtcaatctgagacttgacttgttggggttcctagatgagggttgtgtctgacaagtcaagtcttgactcttctgag

SEQ ID NO: 6774110 - DNA, 61 bp, Homo sapiens
ccatctcactcatgtttctagaagccttatgggccactgtgcagagcatagagtgtggtgg

SEQ ID NO: 6774111 - DNA, 64 bp, Homo sapiens
cccgcagggcctgcctggttcctggaagtcttcccagtcttcccagccagcccgggccctgggg

SEQ ID NO: 6774112 - DNA, 67 bp, Homo sapiens
ctgaaggtatctttcctactttgctgatcatgtagctaaagtcaggctgtgtacctaactaaatcgg

SEQ ID NO: 6774113 - DNA, 81 bp, Homo sapiens
gcctcatctaagagattccttccctgacctctctcatctcttcacacctaggtttccactctaggaatttctcagggaggc

SEQ ID NO: 6774114 - DNA, 76 bp, Homo sapiens
aggatgaatgatgatgaccgccaacgtttaggtgtccgcagattttacagaagcctttggccatttgacttctcct

SEQ ID NO: 6774115 - DNA, 129 bp, Homo sapiens
gatttatgtgtgttatttagaaagccaaaagtaaatgtgttgtggatgaagttcaagatccagcattctgtaggaagatgcaatttcattctgtgacaacatgttttaataggaactaacacgtagatt

SEQ ID NO: 6774116 - DNA, 63 bp, Homo sapiens
tgagcaaaacagcatcaccccataacattgtcctagtgttgcctggtatgttgtcaatgctca

SEQ ID NO: 6774117 - DNA, 112 bp, Homo sapiens
cacgtatatgaagaagtactggtttagaccaaggcaattggcttgtataagaggcctaccctcataccaaaagccagtttccttggtctaggccagtgtttactggtatgtg

SEQ ID NO: 6774118 - DNA, 101 bp, Homo sapiens
tgagacagagtcttgctccatcacccaggctggagtgcagtagtgcgatctcagctcactgcaacccccacctcccgggttcaagcgattctcctgtctca

SEQ ID NO: 6774119 - DNA, 88 bp, Homo sapiens
gcaggcaggaagaaaatgtgtcccttatttcacaggtgacgaaaatgcattgtcaggagccttgctagggtcacacatctctgcctgt

SEQ ID NO: 6774120 - DNA, 55 bp, Homo sapiens
ttcactgccaactaacatggaatttgttttgttgcatggcctcgtttgcggtgga

SEQ ID NO: 6774121 - DNA, 55 bp, Homo sapiens
atgagatgaggaatggccctccaggagagccagaggctatttccactcttctcat

SEQ ID NO: 6774122 - DNA, 81 bp, Homo sapiens
ggtgggtctgtggttggcagctcaatgaaacaggagtctgaggatgaagcctggtgtctgggcagcttctgcatgcccacc

SEQ ID NO: 6774123 - DNA, 57 bp, Homo sapiens
ttttgtaactcagacaggaggcaaacagcacatggcattgctgactgagctgcaaaa

SEQ ID NO: 6774124 - DNA, 59 bp, Homo sapiens
gaaaagcttactgccacttggctctgtccatgatacgtcatttgggagagagtttattc

SEQ ID NO: 6774125 - DNA, 58 bp, Homo sapiens
ttctcagatgattcagataaacttcaggatcccacactccttctgaatcatctgggaa

SEQ ID NO: 6774126 - DNA, 67 bp, Homo sapiens
aggatgattgactgatggaggctctggttggagaggcctcagccaggtctaagcatcagccacacct

SEQ ID NO: 6774127 - DNA, 76 bp, Homo sapiens
ctggttataatgtttaggtatgtgtattgtgtgtacatgtatgtatacatatgtgtaatcaaacacatgctaccag

SEQ ID NO: 6774128 - DNA, 124 bp, Homo sapiens
gatagtcacacatagttctaaaatgtactcattcatttacatagttcttctacatgccggctactgactagatgctgggaagaccactgtgaaatgccatggttcctgctaacaagtgcctgtc

SEQ ID NO: 6774129 - DNA, 65 bp, Homo sapiens
ggcatcattatgtccacctgttggatcacttgtgagaaaaataacagttggtgtaatttcttgcc

SEQ ID NO: 6774130 - DNA, 83 bp, Homo sapiens
aagatccacccaggacttgacttagtgtctaggtcagcctgtgacctacatggctttaagtaagtttcctgagggtggatttt

SEQ ID NO: 6774131 - DNA, 79 bp, Homo sapiens
gccgaggcctcagctccagccctcagcagctctggacacaagagccgtctgctctgacaactgggctgaggcagtcggt

SEQ ID NO: 6774132 - DNA, 71 bp, Homo sapiens
ttcgcattaaaaaatgagcaaggttttcaaccaaacagttgagcaactgggctcattttttaaacaccgaa

SEQ ID NO: 6774133 - DNA, 68 bp, Homo sapiens
gcacattgtcttcagacatccttgaccttgggaaatcagcatctgggtcactgtaaggcaataagtgt

SEQ ID NO: 6774134 - DNA, 107 bp, Homo sapiens
ttgggttggttccaagtctttgctattgtgaatagtgccgcaataaacatatgtgtgcatgtgtctttatagcagcatgatttatagtcctttgggtatatacccag

SEQ ID NO: 6774135 - DNA, 71 bp, Homo sapiens
caggaaatggtggtggtgtccaatctgatgttaagacttgacacattgcagacatctcattagtaattctg

SEQ ID NO: 6774136 - DNA, 60 bp, Homo sapiens
tctttgccctgaataatagagtggggaaggcttttgagccattctcagttcaggagaaga

SEQ ID NO: 6774137 - DNA, 68 bp, Homo sapiens
ggggcttttattgtctttacgacgacctgaatttaaaacctcctccaggtgacaataactatggccct

SEQ ID NO: 6774138 - DNA, 61 bp, Homo sapiens
ggtgttactcagcactgctctgctcggtggatggagcagggttctcagttggtgcttcacc

SEQ ID NO: 6774139 - DNA, 66 bp, Homo sapiens
tctgcctttgttgaagaatccacaggtggcaggaatcacctgacaaagaggaacagcaggggcaga

SEQ ID NO: 6774140 - DNA, 67 bp, Homo sapiens
ctgtgtggaggtgggtgatgtcttcctgtgctaaaaggtgaataaataagctcctcacctctcgcgg

SEQ ID NO: 6774141 - DNA, 59 bp, Homo sapiens
ggaactgtgggacctttatcaggggacctctgctagacaaggctctgttctgcagtttc

SEQ ID NO: 6774142 - DNA, 64 bp, Homo sapiens
ttagagggaggaagggaatatatgtatttatacaaagatacattgagtttcctcctgattttaa

SEQ ID NO: 6774143 - DNA, 79 bp, Homo sapiens
gaacttttgagcccttttaagggagactagagatctgtaagatctagtccctgcccttgaagagcttacaatctagttt

SEQ ID NO: 6774144 - DNA, 56 bp, Homo sapiens
aaaggcatctagccaagttgagaataggcccttcattgacttgcttctttgctttt

SEQ ID NO: 6774145 - DNA, 74 bp, Homo sapiens
gccctggatgtttttggcttcaagtttctccacaatggggagaatgtatttttagctcagaaatccagcagggt

SEQ ID NO: 6774146 - DNA, 75 bp, Homo sapiens
ggttacccaactgttataaatcaacagagaggcacggggagagcattctgtagagcagtgacagtgctggtaacc

SEQ ID NO: 6774147 - DNA, 73 bp, Homo sapiens
cttgcctggcatctagccctgggattattaaggcagagaaaatattgcctcccggggtaagggccagataaag

SEQ ID NO: 6774148 - DNA, 62 bp, Homo sapiens
acacagggtctagagttaggccaaagttcaaatctcagtcctgcctcttagtatctatgtgt

SEQ ID NO: 6774149 - DNA, 59 bp, Homo sapiens
ccatttgtacatgttgtcttcttttatctacacatttaaagaggtcaaattataaatgg

SEQ ID NO: 6774150 - DNA, 62 bp, Homo sapiens
gaggaggaatgaagccttaggcatacaaataataaactggaagcctggagttagttttcctt

SEQ ID NO: 6774151 - DNA, 69 bp, Homo sapiens
cagcaagtattaatttaatctccatggtatttctaatgccagtaacctggggatgttaagattttgctg

SEQ ID NO: 6774152 - DNA, 58 bp, Homo sapiens
ttactgttcctctctcaaagaggctttctctggaagcctctctgcttatgaatagtga

SEQ ID NO: 6774153 - DNA, 61 bp, Homo sapiens
gtccacagaggtactcttttgggctttttatgtcttaaagccaaatcttaacttctgttac

SEQ ID NO: 6774154 - DNA, 88 bp, Homo sapiens
gtgtctgaggcagcatggtaccttggagaacacatgaaagctatagataaattgtgaggcttcaagttccagtgttgtccatagggac

SEQ ID NO: 6774155 - DNA, 77 bp, Homo sapiens
tataaggaaccacaagtttcagcacccagagaagatgtcaaatttttctggcctttcatgaaatttgattcattgtg

SEQ ID NO: 6774156 - DNA, 99 bp, Homo sapiens
actgggcggcccacccactgtccgtgcagtggagggtgtggctgtgcctggttcacccgcaggtgggcccttcattgatggagagcaggtgccccgagt

SEQ ID NO: 6774157 - DNA, 59 bp, Homo sapiens
actcctcccagcattgtacagatgaaagaaagatcatttcacaggctcagggagagagt

SEQ ID NO: 6774158 - DNA, 79 bp, Homo sapiens
acagaagggatggagacgaaaaggacataatattttaaaataaaataatgtttatttgtattctccctacaatctttgt

SEQ ID NO: 6774159 - DNA, 74 bp, Homo sapiens
ctgatatgttatcagagtagcctttaatcttctagaaccaagacattgttagagaaattctggtaatgtaaaag

SEQ ID NO: 6774160 - DNA, 56 bp, Homo sapiens
gagccctcattgaatctgcattttatagcatgtactgtgcaagtttcgggggtatc

SEQ ID NO: 6774161 - DNA, 77 bp, Homo sapiens
ggcatcattctggaaatggtaaacattttaatggtcagaccctgtccacttatgcattactatttccagtattatcc

SEQ ID NO: 6774162 - DNA, 58 bp, Homo sapiens
aaatgcaaggccatgtgaaggaaaataccagttttctgagcagctttgttttgtgttt

SEQ ID NO: 6774163 - DNA, 64 bp, Homo sapiens
tttgtttacatctcttgactcttttaggagtatagccaaggaaggagtcataaatgtgaacaaa

SEQ ID NO: 6774164 - DNA, 57 bp, Homo sapiens
ctcagtccgtcccgctaggtgcaaagcagcctcttatccaccagagggcggactaag

SEQ ID NO: 6774165 - DNA, 108 bp, Homo sapiens
gcatcaacatcaccttcaagcttgttacaaatgcggagtttgtggtatcattccaaactactgacccaaagtctgcattttaacatgattcgaaggtgacgtatatgc

SEQ ID NO: 6774166 - DNA, 108 bp, Homo sapiens
ttcatttctttgtatctctgccattaatgtgaaggaaggaaacagagatccctactctaattccctctgattttatcattaatgtagctctggaagacatttaatgga

SEQ ID NO: 6774167 - DNA, 130 bp, Homo sapiens
aaacacaggattcctttgcaccttggaaattctgattaggtagctctggggtggagcccaggaatctgtattcctaaagggctctccagattattttgatgaggaccatgctgtgagaaatgctgtgttt

SEQ ID NO: 6774168 - DNA, 68 bp, Homo sapiens
catccccatgtgctgggattacaggcaccttgtaatctgccagtttgtccccatggccatgtgagatg

SEQ ID NO: 6774169 - DNA, 64 bp, Homo sapiens
ggctgggttaccatgaggaaatgaaaaacgtgaaattcgggtacatcatttctgacaggcagcc

SEQ ID NO: 6774170 - DNA, 61 bp, Homo sapiens
agtgcccatgtacctggggtggctggagcccctgagccagcccctcccagtcaggagcact

SEQ ID NO: 6774171 - DNA, 55 bp, Homo sapiens
gacaaagggagttggggtggcctgccaggtcactgggctccagctcctcattgtt

SEQ ID NO: 6774172 - DNA, 68 bp, Homo sapiens
ttcatcctgtcctgagataaagatgaggaaagtctagcccttctcatagtttattttaggatgatgaa

SEQ ID NO: 6774173 - DNA, 110 bp, Homo sapiens
agcattgaaacaggtggactcaagccattcctctgtctcttttctggcactgtagttatagatgtaagcagaagaacagcttgtttgaagtaatggcatgtttgaatgtt

SEQ ID NO: 6774174 - DNA, 60 bp, Homo sapiens
gctagaatcttcagtctaattcctaggagatgcagtctgggagaagagacagatgcttgc

SEQ ID NO: 6774175 - DNA, 59 bp, Homo sapiens
gagggtcctggctaagtctgacaagtgctggcatactttggattctgttaggcaccttc

SEQ ID NO: 6774176 - DNA, 60 bp, Homo sapiens
ctgcaggcagctgaaaggtgccttagactgctggggagacaagaagtagcctgcttgcag

SEQ ID NO: 6774177 - DNA, 86 bp, Homo sapiens
tttttgtgtgttttctgaatccattcatgcaagatatttgatcagccctactctgtgccttgcactaaggattcactagccaaaaa

SEQ ID NO: 6774178 - DNA, 99 bp, Homo sapiens
atctattgcgtttatatggcagcctgagcagaggaatgtaagcatgtataccgctgtctccatactgtgctgagagctccatgagagcagtgatcagat

SEQ ID NO: 6774179 - DNA, 100 bp, Homo sapiens
tcttcaagtacttcagtgagtccaggcctcctcttttcctgctcatccattgatatctgtgtatgggaaagggggctggacagaggggggtatctgagga

SEQ ID NO: 6774180 - DNA, 83 bp, Homo sapiens
tctgctattctgtgtatttactggctggacgttcacctgttcctcttggtgtagtaaagctataaataggaagaagaagcaga

SEQ ID NO: 6774181 - DNA, 73 bp, Homo sapiens
ggggcttatggagaccatgagattagtgacgttttgcccaaatccacttcaaatatggcttcatgagatcccc

SEQ ID NO: 6774182 - DNA, 78 bp, Homo sapiens
gagcaaattcacattttatttcactggatgactagaaatcataagctgtagtttccagcattagatgtgaaattgctt

SEQ ID NO: 6774183 - DNA, 78 bp, Homo sapiens
gggaatggaagggggaaaatgacaacagaaaactagcagtgttttgttatttcgtttaccttccttaggataattttc

SEQ ID NO: 6774184 - DNA, 74 bp, Homo sapiens
tctgaagactttagggccatggtaggtaataatcgttggaaacatactacccaaggttttaataggcttctaga

SEQ ID NO: 6774185 - DNA, 76 bp, Homo sapiens
gggtgaagcagggctgctatgttgattcagaccatggtactccagagttgtgcagaatacagccttgtgaccacct

SEQ ID NO: 6774186 - DNA, 65 bp, Homo sapiens
gctgctgtgcaggtgcctatgatcagtggatggaatcagggaccacacctgtgtactcagcatgc

SEQ ID NO: 6774187 - DNA, 92 bp, Homo sapiens
gtaaacaccattgtccaggctttcattccagagggagatgtctactttgctgtttttctttgtgtgaagacaatgacagtggttgaaattac

SEQ ID NO: 6774188 - DNA, 63 bp, Homo sapiens
tcctgagtggtccttaagctgctgggtctctccctgaccccagaatccaaggcccgctgagga

SEQ ID NO: 6774189 - DNA, 69 bp, Homo sapiens
cattctagctctgactagaagcctctctctgctgccaggtgttcccagctgtttcttgtgagttgagtg

SEQ ID NO: 6774190 - DNA, 64 bp, Homo sapiens
ttaatacagtctccagaagtaattgagccattaactggtttatacactgattagattgtgttaa

SEQ ID NO: 6774191 - DNA, 57 bp, Homo sapiens
tctagtatcatctaagggagttactgaaacacactactaatgcctcatgatactaga

SEQ ID NO: 6774192 - DNA, 61 bp, Homo sapiens
taaaggccagggcctgagtgcttgtgtttttgtgttttggtagccaggccttgagccttta

SEQ ID NO: 6774193 - DNA, 55 bp, Homo sapiens
tgctctctggcttccagctggcccagtggaggtaccagctggagattggagggca

SEQ ID NO: 6774194 - DNA, 66 bp, Homo sapiens
gtggtagagtcccagctggtgactgtttttcaggcatttacggtagccacctcaatcttctagcgc

SEQ ID NO: 6774195 - DNA, 57 bp, Homo sapiens
gcgggttgaagggcgcatcgaagtcgtcttcgaagtcaccggtgaccctcggctcgc

SEQ ID NO: 6774196 - DNA, 94 bp, Homo sapiens
cacacatatgctcatctagttttcgttttaagtcattctaaagatcaaatgtctttacactcctggaaatgatattgtgttgtgtgtgtgtgtg

SEQ ID NO: 6774197 - DNA, 58 bp, Homo sapiens
gtgttacatatatacccacacctggatgatgactggggagaaggtattgtgtatatac

SEQ ID NO: 6774198 - DNA, 88 bp, Homo sapiens
ggagtcttgctctgtcacccaggctggagtgcagtggcgtgatctcagctcactgcaacctccgcctcccgggttcaagccattctcc

SEQ ID NO: 6774199 - DNA, 74 bp, Homo sapiens
caaattagcagcatgtgccttaaatcattctattgtttgattatagattgtagaagttcactgctgctgttttg

SEQ ID NO: 6774200 - DNA, 60 bp, Homo sapiens
tgtgaatagtgccgcaataaacatacgtgtgcatgtgtctttatagcagcatgatttata

SEQ ID NO: 6774201 - DNA, 61 bp, Homo sapiens
tacacaggggagcatggttgactgggctctgttaaatatctgtttcccataactctgtgta

SEQ ID NO: 6774202 - DNA, 56 bp, Homo sapiens
catttatcttgggtgcacagcgtgtcaggcgtcaggctaagcactttgataaactg

SEQ ID NO: 6774203 - DNA, 66 bp, Homo sapiens
tattcttcatccatatgcagagagcttcctttatacagtgaactttgctgaatggagtggagaata

SEQ ID NO: 6774204 - DNA, 90 bp, Homo sapiens
ggcctgttctctgggcagcccacgttctgtccacgctggcagctttgagatgcccacaggagctgggtcttgggccaggagacacaggcc

SEQ ID NO: 6774205 - DNA, 80 bp, Homo sapiens
gcattagctgggaacttactagaaatgctagcaataatcagaatctgcattttaataagattcccaagtaattatgatgc

SEQ ID NO: 6774206 - DNA, 55 bp, Homo sapiens
cgtgctgctgtggcccttgtctgccagcagctagtgcgggggttcccagcagccg

SEQ ID NO: 6774207 - DNA, 63 bp, Homo sapiens
tgccaggtatgcaacaacctctaggaccaaaaacaccgaacgaggcttgtaatatctcaggca

SEQ ID NO: 6774208 - DNA, 130 bp, Homo sapiens
ggaatcctatgtgcggtaaaaacactcagaacccagcagcagtgctttggaatcctgtgtgagcgacaaggactcaggaattcatagcattgttctggaattccatgtaagaggcacacactgagaaccc

SEQ ID NO: 6774209 - DNA, 66 bp, Homo sapiens
ctttttaacctaactcatggaaaacaggaacttttttccttttttatggatattggagttaaagag

SEQ ID NO: 6774210 - DNA, 71 bp, Homo sapiens
cagaaggcagcagaggaaaggtgcttagtgcaagcctaaggatcttgtaagcctttgtagcccggactctg

SEQ ID NO: 6774211 - DNA, 63 bp, Homo sapiens
attaggcttgcagtgaatatgaccagtgacatattattagtttggaattctgtgtagcctggt

SEQ ID NO: 6774212 - DNA, 78 bp, Homo sapiens
aggtgttttctcttctccaaactcagactaagtatccttccattggcaaatgcttggtttgttgggtcctttacactt

SEQ ID NO: 6774213 - DNA, 65 bp, Homo sapiens
ggggtcggggcatagccacttactgacgactccccacccagcaagtggttttgaacccggaccct

SEQ ID NO: 6774214 - DNA, 58 bp, Homo sapiens
gagcaaggcagcgttcctttctggaccctctagaggagaatccaggcgttgctttctc

SEQ ID NO: 6774215 - DNA, 89 bp, Homo sapiens
gtaaaagaagaactgctaggctgaatatggtgcttaactttattattgatgtactgagcaccttctgccactttagccaattcatttac

SEQ ID NO: 6774216 - DNA, 73 bp, Homo sapiens
cagggtgcagcccaggtggagtaatctatgggaagcgtgggtgaggattctgcctgggcctcgcttagccctg

SEQ ID NO: 6774217 - DNA, 69 bp, Homo sapiens
gtggttatggtaattttaaaatgtctattggtttgtacctaacagataataggatgtaccctgttccac

SEQ ID NO: 6774218 - DNA, 82 bp, Homo sapiens
gcttggagtgctggtctgtgctctggagcctctgaggaactgggacagcagagagccatgcagagcagatgggtgcccaggt

SEQ ID NO: 6774219 - DNA, 74 bp, Homo sapiens
ggtgccctcaggcagggagtctttcaccctctgtcatttgataggagaaagtttgcctctctcttgagccagcc

SEQ ID NO: 6774220 - DNA, 58 bp, Homo sapiens
tgcagggccttgggatgtgtcctgtacacaaataactgatacctcctgaaaccttgca

SEQ ID NO: 6774221 - DNA, 93 bp, Homo sapiens
ttgaggcataattgatatagaaaaattgcacgtgtttatgctttttgatgagcttgaacatatgcatgtttgttttgttttattttgttttaa

SEQ ID NO: 6774222 - DNA, 67 bp, Homo sapiens
tcaggaataaacttagaatgtctactcttaccatgcctattaacatggtacaagatgttctaactga

SEQ ID NO: 6774223 - DNA, 91 bp, Homo sapiens
tggcccagggagtgtctggtgctgtgcaggacaaagggtcaatccacaaatttgtcccttacctgattgctggcatccaacactcatgcca

SEQ ID NO: 6774224 - DNA, 102 bp, Homo sapiens
atcttaacctccgagctaattggcaagcagatttccactaaatttatccatctctcaacaatttatggaggtagttttgtatgctaaggcctggattaagat

SEQ ID NO: 6774225 - DNA, 80 bp, Homo sapiens
tggccctgttctacttcattccttccctaagcaactagcatgaagaagctatgattacaagggcaatgaacaaagggcca

SEQ ID NO: 6774226 - DNA, 55 bp, Homo sapiens
ggtatcaaagaagggggtgccagagaaagccaagggcgcccccttctttgatgcc

SEQ ID NO: 6774227 - DNA, 70 bp, Homo sapiens
ctgactgaaggtgatgtcatctgtgtagcctctcaataaggggagatatattaacattaatcttgtacag

SEQ ID NO: 6774228 - DNA, 90 bp, Homo sapiens
ggacagagtctcatctgtctgggctggttttgggtgtggctccgactggaggcaagaggatagactagaatagatgaccgcacactgtcc

SEQ ID NO: 6774229 - DNA, 69 bp, Homo sapiens
ttaagacatttttggagattatgaaacaaaattttctgatggtcaatataatcttcgaaaatgtattag

SEQ ID NO: 6774230 - DNA, 62 bp, Homo sapiens
ttctcatccttcagtgcagttaatcgctacacaagatgacgctgcctgtcccaggatgagga

SEQ ID NO: 6774231 - DNA, 60 bp, Homo sapiens
accatctagaagtccctgagggctcaaaactgccccaccagtgagaccttctaaggtggt

SEQ ID NO: 6774232 - DNA, 62 bp, Homo sapiens
tccattccttgtatatctacatgcaggatcccaactgcattcaatgtgccagggaaaaggga

SEQ ID NO: 6774233 - DNA, 61 bp, Homo sapiens
tcatttcatgtctcaggcactgtaaaatgctgagtcacagtacacctgagcgctgcagtga

SEQ ID NO: 6774234 - DNA, 60 bp, Homo sapiens
cagtgcttaacccagagcgaacgttagcgactattaatacttctgcctagggttagcctg

SEQ ID NO: 6774235 - DNA, 110 bp, Homo sapiens
ctcgccatgaggacactggaacctcggagcctgtagctgggcctcggcagtgcagccacggtgtatggcactgcagagtgtttgctaggctcaaagccggaatctgcgag

SEQ ID NO: 6774236 - DNA, 76 bp, Homo sapiens
atgagatatgttaaaagttaaaaatacagctgttggtaatgtgttgtaatgaaactaacttttgtgcctatcttgt

SEQ ID NO: 6774237 - DNA, 69 bp, Homo sapiens
ggcgttgggtttggtgttgtaacaactggtgacatttcagttcatgtgactactatgacctaatcactc

SEQ ID NO: 6774238 - DNA, 65 bp, Homo sapiens
gagcagccctttctgggcaggggaatacatacatacacataactctcacagccctggggctgttt

SEQ ID NO: 6774239 - DNA, 97 bp, Homo sapiens
cagtgtgaaggtttttatacttctgccagaggacaacgtaatatgaaacaccgagttttatttgtctctacagagagtagtagtgtctttcaggctg

SEQ ID NO: 6774240 - DNA, 76 bp, Homo sapiens
gttttgttatctagatgaccaaaataactgaacactatcatttcaaaattcagcaattttggtcttcagacaaggc

SEQ ID NO: 6774241 - DNA, 71 bp, Homo sapiens
tggagtgctgcttgggatagtgaggaaggagcttgatttccccttcaccctgtgaggcattggcaactcca

SEQ ID NO: 6774242 - DNA, 61 bp, Homo sapiens
ggtggcatcacctggtatcaagccgcagggggacacttcccaggctcagggcgctgccgcc

SEQ ID NO: 6774243 - DNA, 61 bp, Homo sapiens
gagagcacatgaacatggaggagagatgaacagcttcctccaaaagaagagcgtggctctc

SEQ ID NO: 6774244 - DNA, 62 bp, Homo sapiens
cttcctgcccacttcctgctggaggattccaactggaagcaggccagagttggggagaggag

SEQ ID NO: 6774245 - DNA, 61 bp, Homo sapiens
ggaaggaagtaaatgatgctattttaggatggctcaacatccctcatcacttggtcctttc

SEQ ID NO: 6774246 - DNA, 74 bp, Homo sapiens
ctcagagcctccacttcctctcaataagatgagaataatgaggttctcagaattgactgggagcaggcttcaag

SEQ ID NO: 6774247 - DNA, 74 bp, Homo sapiens
gggaagtcctcctatcttgctcttcctcatattactgagaaggaaacaggctgagagaggaaaagggacttgcc

SEQ ID NO: 6774248 - DNA, 75 bp, Homo sapiens
tctcagcttcccctttgtaagatggaaacgcagtactaatatgtgcactgtttaatttcacaaagttgactgaga

SEQ ID NO: 6774249 - DNA, 96 bp, Homo sapiens
gatttattttgtccatttgcaatttcagtattttagctctatctcatatcattttttggtaggtgctgttaacatatgaggttaaagtggtaagtc

SEQ ID NO: 6774250 - DNA, 120 bp, Homo sapiens
gttgttatgaactgaatgtatgtgtctcctaaaactcatatattgaagccttgacccctaaggtgacagtgttgggggtaaattttttgggaagtaattaggtttagattagatcacaac

SEQ ID NO: 6774251 - DNA, 65 bp, Homo sapiens
agacatctgtcaggggttcttaactaggggcaattttgcccctcaggggatacctggcagtgtct

SEQ ID NO: 6774252 - DNA, 90 bp, Homo sapiens
gttcattaaagactgttccttctctacaaatccaggcacttaaaacaatcttcttggtttgtgtttgatttggaaaacagctttgagaat

SEQ ID NO: 6774253 - DNA, 58 bp, Homo sapiens
tcacagttcaaaccccatatctgtctaacctccagaatacgggttatgggaactgtgg

SEQ ID NO: 6774254 - DNA, 57 bp, Homo sapiens
tgccttgagagaatgactcgggagccctcagactcaacggactttcttctcagggca

SEQ ID NO: 6774255 - DNA, 81 bp, Homo sapiens
gcagccgagcatccatggcgtctgagggcgttgtacagggaagtcctcctgaagaacctcacgggcactagagctggcagc

SEQ ID NO: 6774256 - DNA, 55 bp, Homo sapiens
tgctgtttcttgcatgcccacaaacatgtctgctcaatgggcacaatgaacagca

SEQ ID NO: 6774257 - DNA, 89 bp, Homo sapiens
agcagtgtcgtggtaggttggcaagtgccggctgcaaaaccctcctcctttgctgcaggtggatattgctacttgatcacagcactgtt

SEQ ID NO: 6774258 - DNA, 58 bp, Homo sapiens
tttgtgttcttgggggtcatcgaggtaacagttataccctccttccccccagcacaga

SEQ ID NO: 6774259 - DNA, 73 bp, Homo sapiens
atttcatttaatcctcatggtgacccctgatggaggactgttatctacccttcacagatgaggaaaatgaagt

SEQ ID NO: 6774260 - DNA, 69 bp, Homo sapiens
attagctttgtcctcactgcaagtttattgttcgttgaggtaagcaagtggtagaaggacaacgttaat

SEQ ID NO: 6774261 - DNA, 81 bp, Homo sapiens
gatttaagttgcctggagcaaaaatctaaggagcagagttgcagctggtttttctgatgattgtaatttaggtaaatagtc

SEQ ID NO: 6774262 - DNA, 67 bp, Homo sapiens
acccaatttctcggttttgatattgtgctatcgctatgcagaatgttaccacgggagaaaactgggt

SEQ ID NO: 6774263 - DNA, 120 bp, Homo sapiens
taaggtgccccgggcggggaccctgcccctgaggtcctctcggaacccctttgaagaagtttcagggctggaggaagaagaggccggggagctggggtccctccccaatggaacatcttg

SEQ ID NO: 6774264 - DNA, 73 bp, Homo sapiens
cttgttgtctaggagactttctgatctcactcatgtctggaacaaaggagagaagagtcttccccatcccaag

SEQ ID NO: 6774265 - DNA, 80 bp, Homo sapiens
gcttctggagctgggggcttagtattagcatcaaacttttactaatggatgcccgacactctgctctgagcttcaggtgc

SEQ ID NO: 6774266 - DNA, 85 bp, Homo sapiens
ccatttgcaagtaaagaatcacatttcttgcggctaggaagcacttggttagacaagagaggtgatttatttacttcttctatgg

SEQ ID NO: 6774267 - DNA, 78 bp, Homo sapiens
gatgtttggctcatcctcattggggtccttcagctcctggagcttcagccagaggtggatgagtcacaccacggcatc

SEQ ID NO: 6774268 - DNA, 65 bp, Homo sapiens
agctacctggcttatcactgtcttgacttcgatcacctggccaacgtagtgggtgccaggttgct

SEQ ID NO: 6774269 - DNA, 62 bp, Homo sapiens
atctctggcaatgcagcatcgtctgccctgcttggctctcacattggtgttgctgcctggat

SEQ ID NO: 6774270 - DNA, 81 bp, Homo sapiens
agtctggagactgtggtgaagagcctgtttcttggagtcagactgcttggcttcaagtctaggttctaccactaactagct

SEQ ID NO: 6774271 - DNA, 57 bp, Homo sapiens
ctgaccttgtgatctgcccaccttggcctcccaaagtgctgggattacaagcgtcag

SEQ ID NO: 6774272 - DNA, 72 bp, Homo sapiens
tgggaataacactgagaacaatacagagtccacatcctcaaggaactcaatagtctactgcagtggttctca

SEQ ID NO: 6774273 - DNA, 72 bp, Homo sapiens
ctgtctcaggatgagaagattggaatcttcatttgcaaagagaagaaataagacttctctgtccttagccgg

SEQ ID NO: 6774274 - DNA, 61 bp, Homo sapiens
gataagagctagtcttttccttgcacaaaaatctgcacgaggaaaggcgatggctctcgtt

SEQ ID NO: 6774275 - DNA, 75 bp, Homo sapiens
tcaagtggtgtgagggcaacacagcaaacttaccctttttaggccgtttcctttttctgccctcaatctctgtga

SEQ ID NO: 6774276 - DNA, 103 bp, Homo sapiens
tgtacctagaatcttttcaagggcttgaggtccctctgtcttagtaattagacaaattctgtagccagtttggcctcaccctgacaaagattttctatctata

SEQ ID NO: 6774277 - DNA, 92 bp, Homo sapiens
agtcattttattcagtgatctttggtagtacgataatcaatggaatttatggtgtcgtagaaaaccaaaaatccatgttgaatatagtgact

SEQ ID NO: 6774278 - DNA, 83 bp, Homo sapiens
tatgcaaaaattatttaaatgcaggctcatgaatctgttttagaagaaaatggatgctaatggcctgtaaaatatttagcata

SEQ ID NO: 6774279 - DNA, 116 bp, Homo sapiens
gtgctgggaggtttatcttgaggccactgctgctctggtggagtgattgggaactatgtatatatattttctctccagggaagcagtgtacttttgaagggcttaataacagacac

SEQ ID NO: 6774280 - DNA, 71 bp, Homo sapiens
aatggtgtagtcactttgaaaaaacgtttggcggttcctcacaaaggtaaaactagagttactacatgatt

SEQ ID NO: 6774281 - DNA, 55 bp, Homo sapiens
tacatgagtcctgaaggcactataaagtagtttctcctttagaaactcatatgta

SEQ ID NO: 6774282 - DNA, 74 bp, Homo sapiens
agttgaaccatatgaaattgcttttgggtggatcaagaacagctgaatattggccatttcatttggttcaaact

SEQ ID NO: 6774283 - DNA, 55 bp, Homo sapiens
gggtctcagtttcctcctctgtaaaatggaggcaaatgaggatggaaggagatgc

SEQ ID NO: 6774284 - DNA, 96 bp, Homo sapiens
tgaggcagaggaaatgctaatttctcagaccagagaggtgtgcttctctacagcacgcttttactattttgagctctctgtatagcttttttttta

SEQ ID NO: 6774285 - DNA, 56 bp, Homo sapiens
gaatgccagaggagtggtgccaagaaatctgtgtgtaatacaagctccctgggttc

SEQ ID NO: 6774286 - DNA, 80 bp, Homo sapiens
ctgccagagtagttggtcccccagccatgtccggcctggacacaggactcatggtggggccagacttcagctctgggcag

SEQ ID NO: 6774287 - DNA, 68 bp, Homo sapiens
ggccctgctgggccctgggtgccctagctccagtggggctcggcggctcccagtgccgcagcggggcc

SEQ ID NO: 6774288 - DNA, 55 bp, Homo sapiens
gaagggaactgtctggcaaagcataagtggatgcatccagagctcagtccccttt

SEQ ID NO: 6774289 - DNA, 72 bp, Homo sapiens
agacccacagggactcggttgagtgcccctggtatctgcgaccagggcaccctctctgcagtaccccggtct

SEQ ID NO: 6774290 - DNA, 56 bp, Homo sapiens
tccttataacaacaggagtggaatgcatctaccacctttgttggatttgtaggtga

SEQ ID NO: 6774291 - DNA, 55 bp, Homo sapiens
gaaatgtagagtatctgaggatttcgtctacttccttgatactgtattatatttc

SEQ ID NO: 6774292 - DNA, 63 bp, Homo sapiens
gcctgtcctggatgctctgcaaccaggtgccctgcactgccaacatgcatgccaggacagcgc

SEQ ID NO: 6774293 - DNA, 80 bp, Homo sapiens
ggcagactgggagaggccaagtagccgctgtcctagaactgttagagtaagtaggtggcgggatttgagcccagtcggct

SEQ ID NO: 6774294 - DNA, 85 bp, Homo sapiens
cactttcaatttgtttccttacttataaaatggggataataataggttcttcataagattgttgtgaggattaaacaagatagtg

SEQ ID NO: 6774295 - DNA, 71 bp, Homo sapiens
ggctcatgtttcagaaagtggaggaaatataaaaacaccttaactctgtgctttcgagatgtgatcttgcc

SEQ ID NO: 6774296 - DNA, 61 bp, Homo sapiens
acttaggagaatatctggttatgtgtatacacacacatacacacatactttctccttgtgt

SEQ ID NO: 6774297 - DNA, 126 bp, Homo sapiens
ccatcttggcctctgcatcccctttcctcacatccctgccacctccttcttttccaccctgggaaaatctggctgagagatggagagcactggggctgaggagagggcttgggaggctggaggtgg

SEQ ID NO: 6774298 - DNA, 62 bp, Homo sapiens
agcagcagtgttctggaattctatgtgagtgacaaacactcagaacccagcagcactgttct

SEQ ID NO: 6774299 - DNA, 81 bp, Homo sapiens
gtttaggtcaggcctggctgggttgaagcggggacccttgagggactttgctgtgtcagcttcagcttcccggtctttaac

SEQ ID NO: 6774300 - DNA, 74 bp, Homo sapiens
cctatatgcatatggcttcatttaattcttgcaacagctcttgatagggttagataaggttatggatatctagg

SEQ ID NO: 6774301 - DNA, 58 bp, Homo sapiens
atggctacagatttgctgacaatctctgggcctatggagagaagcccctgttagccat

SEQ ID NO: 6774302 - DNA, 65 bp, Homo sapiens
tgtctttcattgttatgttttgctgtctgctttgcagatatatgaaatgtaataaagatacagca

SEQ ID NO: 6774303 - DNA, 62 bp, Homo sapiens
tcccaaatggatacaggcaaacatttccttaacaaagtcaatgtgctgtattcatttctgga

SEQ ID NO: 6774304 - DNA, 73 bp, Homo sapiens
tcaatcctctcaggcccttctcccaggactccctcttgagtctgagttctggtcagcagggcagccgggttga

SEQ ID NO: 6774305 - DNA, 102 bp, Homo sapiens
tgcaaactcctttccagttgcaacttgatcagcatatgagtaagaagcaagttaattgctttccgtcatgtgctaatgatgcatcttgtaaaggactcagca

SEQ ID NO: 6774306 - DNA, 75 bp, Homo sapiens
aggcttgctgagcctgcccagccctgtccacttcacacagcaagttagtgttcgctgggacaggcttcaaggtct

SEQ ID NO: 6774307 - DNA, 58 bp, Homo sapiens
gcccaggctagagagcagtggcatgattacagctccctgcaacctctgcctcccgggt

SEQ ID NO: 6774308 - DNA, 78 bp, Homo sapiens
ggggctccactaaggcagcagcggctcggcaggccatgtcttttggcctctgcaccaacctgtcaagagttaagcctc

SEQ ID NO: 6774309 - DNA, 76 bp, Homo sapiens
tactgtctttccatccttgcctggtctggaattgagaacagaagacctatgggggcatcaaggagggaaagtagta

SEQ ID NO: 6774310 - DNA, 68 bp, Homo sapiens
ggaagtggtttgagcacagtgctgagctaagcaagttttagaagcactgaatcagaccacgtgcagcc

SEQ ID NO: 6774311 - DNA, 71 bp, Homo sapiens
ggggaggtacaagcttttagtgatattgtttgagtcttggataaagattcacttgaagctagaatctgccc

SEQ ID NO: 6774312 - DNA, 76 bp, Homo sapiens
agcaggaacagatttcatcagcaccttgatcttggacttcccagacttttagaatggtgaggaataaatttctgtt

SEQ ID NO: 6774313 - DNA, 68 bp, Homo sapiens
ggtgactatgttagaggcagaggctattttgctgttccctgtccctctgcccatgagcagaagtcacc

SEQ ID NO: 6774314 - DNA, 70 bp, Homo sapiens
ctctctctctctctgccagccccagggatgacctagagtctaaccctgacagatggcaggggagcaagag

SEQ ID NO: 6774315 - DNA, 66 bp, Homo sapiens
caggagagatccttcaatctagttttgtggctaaaagcagtaaggagaagttgaggaatctacttg

SEQ ID NO: 6774316 - DNA, 84 bp, Homo sapiens
aggctctgagagacgagacagaagtttcaagtaagaagtgattattcgctgtactatttgagactactgaaacgctcatcgcct

SEQ ID NO: 6774317 - DNA, 88 bp, Homo sapiens
gccccctccgctctggccaagctgcagcgcctgcgccgggagcggaagcggccggcgggcactggcggcctcggcctgggcggcgggc

SEQ ID NO: 6774318 - DNA, 94 bp, Homo sapiens
ggcgccctggcagacacagtctccttccgggagcaggcaggtgcaaggcaggcaccggggctttggaaggggctggtggagatgcttgggtgcc

SEQ ID NO: 6774319 - DNA, 76 bp, Homo sapiens
tcctttttcatctttggactttttatattctgcttttttaagatgggttttggaagtataaagatgtctgaatgga

SEQ ID NO: 6774320 - DNA, 58 bp, Homo sapiens
tcatgcatgtgcagaaaggggttgtggttctccagcagccagttttgggcatttatga

SEQ ID NO: 6774321 - DNA, 97 bp, Homo sapiens
gtctcttgtgatcttgctgtaacttcactggactcagcagctcttaaaacagagtacgcttgtaaggtggggtgggatggacagagatccaggagat

SEQ ID NO: 6774322 - DNA, 76 bp, Homo sapiens
agagcagtaaacatcaccctggggtgaggctctgactgagtacgactgttcatcccaggtgactggaagctgcttt

SEQ ID NO: 6774323 - DNA, 86 bp, Homo sapiens
ggtgtgggatggcagcagcgggtgtgggcagcaactatggtgccagcacctgggctcagtctgcacctgcgggttctaattgcacc

SEQ ID NO: 6774324 - DNA, 101 bp, Homo sapiens
tgaggcaggagagtcgtttgaacccatgaggtggaggttgcagtgagccaagattgtgccactgcactccagcttgggtgacagagtgagactccgtctca

SEQ ID NO: 6774325 - DNA, 56 bp, Homo sapiens
ttctggagtattcctggcacctcccatctcccaaggctgccaggaatactccagaa

SEQ ID NO: 6774326 - DNA, 81 bp, Homo sapiens
ggctctattgcactgacagcccacctcacaggatttgggaactacccacatcaatctcatgagggggccgttaaaagagcc

SEQ ID NO: 6774327 - DNA, 91 bp, Homo sapiens
ctggattaaaatactttgctgaagtattgtgaatcctagctcttaagagctgggagcatttattttccgttagttgttttagattatccag

SEQ ID NO: 6774328 - DNA, 91 bp, Homo sapiens
tggatgtaaaaagtcattgcagaacatgaggtcttctagattttctcttatgttatcttcaggagttttatggttttgtgttttacattta

SEQ ID NO: 6774329 - DNA, 121 bp, Homo sapiens
tagttattgaaacgaggatgaatattatgtgtatatgtgtttatgtatgcattatgctgtattagccactgtatacatagatgatgaacaagaatgaagtagtccttgccctcattaattg

SEQ ID NO: 6774330 - DNA, 61 bp, Homo sapiens
gggtgatccaaattggtctggggtcaggatttggcccacagtctatcagtttgcgtcatct

SEQ ID NO: 6774331 - DNA, 125 bp, Homo sapiens
ggggttagaaatgatgcttcagaggtgaggtcaaggatgaggaatgggagatggaggcacgaaaaccttactctgcctgtacctcttttttgcagaaggcagctgagggcatggtaatgagcccc

SEQ ID NO: 6774332 - DNA, 72 bp, Homo sapiens
gttttcaggtacattgtttgagatagtttgttatagcagctataggaaactgagaaacattgtatgtgtaac

SEQ ID NO: 6774333 - DNA, 58 bp, Homo sapiens
cctctggtgggcatggtgtgtgtgtgtgtgcgcgcacacgcgtgtgactcatctgggg

SEQ ID NO: 6774334 - DNA, 99 bp, Homo sapiens
ccctatccttactctccctgtaccccttacatcagctccttcacccaactccaggataccagagctgatgtaaggggtgcagggagagtaatgataggg

SEQ ID NO: 6774335 - DNA, 72 bp, Homo sapiens
gtcccagagagcactagtccatctgcatgttaaacagataggacacagtggttctgtgagtaagtttgggac

SEQ ID NO: 6774336 - DNA, 65 bp, Homo sapiens
ctgttagaagggctgcaatccaaaacactgacaagacaaatgccggtgaggatgtggagcaacag

SEQ ID NO: 6774337 - DNA, 60 bp, Homo sapiens
agaggggcaagtaaagagtctttctatagtttgaattttaagatctcgtacttgctttct

SEQ ID NO: 6774338 - DNA, 58 bp, Homo sapiens
tggatgaagcaagacctgcctaactagtgaggacacaagtgcacgcctagcttctcca

SEQ ID NO: 6774339 - DNA, 86 bp, Homo sapiens
gaactttgtgagggtgcagggtgcctctgctcccaccagctctgaggggctccctgggaccggcagctcacatctcacacaaagtc

SEQ ID NO: 6774340 - DNA, 69 bp, Homo sapiens
tctgctctaggtattgaggctaaagcataagataggatgtggtctttgacctctagtactgggagcagg

SEQ ID NO: 6774341 - DNA, 102 bp, Homo sapiens
tatccctttaaatcccgcgaggggtgtggctggggagccccgactcccgggttccggcccgcggagctccagcccgccccgccgcgcaagggttaaccgata

SEQ ID NO: 6774342 - DNA, 126 bp, Homo sapiens
actcctgcttgattttactgtcaactttatctccagcgtccagccctgtctatgactgatgatctataaatatcttagagtaaatggctaatgcatgagaaagtggcagacaaaaagaaaaggagt

SEQ ID NO: 6774343 - DNA, 96 bp, Homo sapiens
ttcttagaggattgcctttgtctggctgcttgttttgatgggtgtaaaacaaataagattagaccgagcagcccaactgaaagcgatagctgggag

SEQ ID NO: 6774344 - DNA, 58 bp, Homo sapiens
atgagcaaggctttgtgatagttgcataattatttcaggctgtttgagcatagctcat

SEQ ID NO: 6774345 - DNA, 55 bp, Homo sapiens
ctcccctttcccagaagcccgagcaaagctggctctgtacgcaggatgaggggag

SEQ ID NO: 6774346 - DNA, 69 bp, Homo sapiens
aacaacctaggtctcccgtattagtgctcatttcattgcataatacttgggctgagatttttggttgtt

SEQ ID NO: 6774347 - DNA, 119 bp, Homo sapiens
tttctgaccagttccaggtgacatggatcctggtgagctctagggtatgctttgagtaacagagaatattagagttagtttataatgataaccatagcacctgaagctaaattagcaaa

SEQ ID NO: 6774348 - DNA, 90 bp, Homo sapiens
tcgaattaaggcttctgtagttcttacaagtcacccgctttctttcaggaggaatgttaaagattaagagcggcaagaagtcagagtcgg

SEQ ID NO: 6774349 - DNA, 65 bp, Homo sapiens
tgatgaatgtttgatatgttggcttcctccagaatatatggaagtttctattattacattcgtta

SEQ ID NO: 6774350 - DNA, 67 bp, Homo sapiens
tgctgggcaccggagagaccccagcagcaacatgattgggccggtgggggattccggttccccagta

SEQ ID NO: 6774351 - DNA, 70 bp, Homo sapiens
accaggcacaggaatgtcatccagtgccattcgcaagaacagaggactggggatcgttccaagtgtccgt

SEQ ID NO: 6774352 - DNA, 114 bp, Homo sapiens
gtttatatgatttgtaaagtacaaatgctatgtcaagtgtacataccacataaagtctatataacatgtagggtgtatatgatatgtaaagagtatgtaatatgtcaagtaaac

SEQ ID NO: 6774353 - DNA, 62 bp, Homo sapiens
tcttgccttccccttgataatgcagtaagggacccccattttacgacatagggcaggcaaga

SEQ ID NO: 6774354 - DNA, 80 bp, Homo sapiens
tgtttccagttatcttgatttgtcagctggggataatcacgaattatcggtaagatggaaatcagggtcatgagaataca

SEQ ID NO: 6774355 - DNA, 88 bp, Homo sapiens
cattttggatttgggtggactctggcagagcctgccccagggcttctgcactaggctctgcagattcatcccttcacccagcaaaatg

SEQ ID NO: 6774356 - DNA, 90 bp, Homo sapiens
ttatttaatcctcacaacaatctcgtgaaatggctttgatcattactactttacagatgacagaactgggggcacagataggataagtaa

SEQ ID NO: 6774357 - DNA, 88 bp, Homo sapiens
ggcagagggagcggagggcgagcccgcggagccaaaatcttccctcggttccggttgctgagctcgccgcctctccccttcccctgcc

SEQ ID NO: 6774358 - DNA, 122 bp, Homo sapiens
tgggagatggggaccaggcctccccatatggctggtgaggggatccagcgtcacacagtttgaagcatgtgccccgggtcccttggttggtaggtggaggagcagtttgaccccagagccta

SEQ ID NO: 6774359 - DNA, 68 bp, Homo sapiens
ctgagaatggacagcagggcaggaagcattgtccccaatgcccataagcctttgttttcttttcttag

SEQ ID NO: 6774360 - DNA, 91 bp, Homo sapiens
ttgattttgatacatgatgtatattcactgagcaagggggttgatccattatgtggaccccttctgggaatatgtggactgtgtctatcaa

SEQ ID NO: 6774361 - DNA, 64 bp, Homo sapiens
cactcaatcatttcctgtcacaggtgcagcctctatgcattatcctgccatgattgatagagtg

SEQ ID NO: 6774362 - DNA, 77 bp, Homo sapiens
tgtttagtgattactacatagatgaccatgttgggtaataattgaatttatcggtgtctgtgttgtaaaactgaata

SEQ ID NO: 6774363 - DNA, 56 bp, Homo sapiens
cctggagcttctggtgctagagcagtttctttccatcctgcccaaggagctccagg

SEQ ID NO: 6774364 - DNA, 56 bp, Homo sapiens
gatactggcttaaatcttagacttttctaaaagtttagattgctggggctagtttc

SEQ ID NO: 6774365 - DNA, 87 bp, Homo sapiens
gttatagtttattcagccttaagaagccacctttttggctacaaaaatacccagaaagactttttaggtacgtagggaaactgtaac

SEQ ID NO: 6774366 - DNA, 82 bp, Homo sapiens
ggttctctccaccggtaaactcatgccattaatccttttgatgtgtacaacaaaggccatggcatgtttatctggcaattcc

SEQ ID NO: 6774367 - DNA, 71 bp, Homo sapiens
gaggcatatgtgactgttgaaagtaggggttttgaactcgacctccctaggtcctagtcacagtagtcctc

SEQ ID NO: 6774368 - DNA, 78 bp, Homo sapiens
tccagccgctcttggaggtctctcacactcacagggcgtccccccaacgcctagggtgctcagggacgagcgactgga

SEQ ID NO: 6774369 - DNA, 69 bp, Homo sapiens
gttgtagttgaagcacattagatgtgtcttcgtgttctgcactctgaagacatcgtgtggactaacagc

SEQ ID NO: 6774370 - DNA, 92 bp, Homo sapiens
gactttcctccaatgtcatatttgagaatgtcatattgccacaattgttatcttggcaataatgacattttaaaaacaggaatgggaaggtt

SEQ ID NO: 6774371 - DNA, 59 bp, Homo sapiens
gaagggaagtttgcatcctcactgtattccacagtgtcttttccagtaagcttcttttc

SEQ ID NO: 6774372 - DNA, 101 bp, Homo sapiens
ttcttattataattattaggttcttgcagtactggagttgattacataaaactgattacttgggtttaattaattaattccacagcaagagataataagaa

SEQ ID NO: 6774373 - DNA, 129 bp, Homo sapiens
gacaaacagaatctggaaagagttatttgcaaatgtatttgggcatgaagaaggaagtgggtcacaaaattatgacccctgcatatttagtctaatacacatcctcattccagacaactaactgtgagc

SEQ ID NO: 6774374 - DNA, 78 bp, Homo sapiens
tccctcttgctgatgggatggtaacttctttgaatgtattatatgacacagaccatcttagcagactgcagtgaggga

SEQ ID NO: 6774375 - DNA, 78 bp, Homo sapiens
gccccttatccctaaggcagtagtgtctgtagggcctcaggcacctacattctcatttccttcatgtatgcagagggc

SEQ ID NO: 6774376 - DNA, 97 bp, Homo sapiens
tagggccgctgtgttgtataattccagggttcactgattacgtagaatataacatgaatggcacccagtggagctgtgctccaacacagtggccctg

SEQ ID NO: 6774377 - DNA, 71 bp, Homo sapiens
ggatggctcgtggttggtgctccgcaccgccgagaaggcgaccttggagttggccgcccggaccgatatcc

SEQ ID NO: 6774378 - DNA, 55 bp, Homo sapiens
gtcacagcctcaatcccatctgtctcccagatgtggagggtagggcatgactgac

SEQ ID NO: 6774379 - DNA, 118 bp, Homo sapiens
cactcatgtatggagtaggttggcacaaccctattagccctgttatccagatgaggatcatcctcttgatcatcctcttgacagggagttgaatgccaatgccaccttatacctggtg

SEQ ID NO: 6774380 - DNA, 90 bp, Homo sapiens
gggcatctgacatacacagtgtggcaaatttcaacttttcttaaagtttaacattattgtcactctgtaggtcttaaatgtcagctgttt

SEQ ID NO: 6774381 - DNA, 70 bp, Homo sapiens
ggtgtgaggactggggctggcacggcagcaggcatgccagggcaccatgggctggctgccttatcacacc

SEQ ID NO: 6774382 - DNA, 73 bp, Homo sapiens
cttgggcactagcggattctcgacagaaccacaaagtggagttggctgcagatgagtctgttcatggccccag

SEQ ID NO: 6774383 - DNA, 71 bp, Homo sapiens
tggttctcaggccttcagacctagacaggaatctatactactagatctctgaatctgaagccttcgaacta

SEQ ID NO: 6774384 - DNA, 64 bp, Homo sapiens
agagcctgtaacatctttcttagggtaactatgaactcctggttcagattttggcaaggcatct

SEQ ID NO: 6774385 - DNA, 72 bp, Homo sapiens
tagtttattacagcatttggtggttcagtaaacaaacatgctctaaaaaacctaaatagctgtgttgaagta

SEQ ID NO: 6774386 - DNA, 99 bp, Homo sapiens
tctttccaacactctcctccatccctgaccacaaggtgttgctccagcagatgtgggagataattcattgtgttcaagggggtggtgctgtggtagaga

SEQ ID NO: 6774387 - DNA, 69 bp, Homo sapiens
agcatgctgtagctgtgacccaagtaccacttctgagaagtgccacagggccacatgtaaacagatgct

SEQ ID NO: 6774388 - DNA, 90 bp, Homo sapiens
tccagaagccaaagcaagggctgaagactccctggtctctttctctccatggcccaaggagaacagtcaggtctttggttagcttcagga

SEQ ID NO: 6774389 - DNA, 55 bp, Homo sapiens
gcctagggcagagtgactcacactctggacagagtccagacagcacctgcctggt

SEQ ID NO: 6774390 - DNA, 63 bp, Homo sapiens
ctacagagttagttaagttagagtgacaatgttgagattgtagatcttcatctaattctgtag

SEQ ID NO: 6774391 - DNA, 62 bp, Homo sapiens
taggtaggtggaaaagtaattgcggtaatggcaaaaaccgcaattacttttgcaccaaccta

SEQ ID NO: 6774392 - DNA, 62 bp, Homo sapiens
gcagtacctatctcaccgagtcgttggagggttcagtgacttccgtgaagatcaggtgaagt

SEQ ID NO: 6774393 - DNA, 61 bp, Homo sapiens
attttctctggcttctcaggacccatattaagaaaggcaccctgcagcaccagaaggagat

SEQ ID NO: 6774394 - DNA, 89 bp, Homo sapiens
ggagaaaggatatttgtggtaacggagaaatttgccacccagcgctgttgctttggtgtcatgtttctgcggtcacaagttattcatcc

SEQ ID NO: 6774395 - DNA, 88 bp, Homo sapiens
gaaattatcaccccaacgactgttcacagattagtcgatgcaaatgttaaaaacgtgttggcaagctggatgagcaggtttgtatttt

SEQ ID NO: 6774396 - DNA, 113 bp, Homo sapiens
atctattaaataatacagtggttgagcttggctctgagttcaccaacaagtgtgcttaaataaggtgaattacactgtgagctgaagggctgctcggtgtattttgtaaagat

SEQ ID NO: 6774397 - DNA, 88 bp, Homo sapiens
ggttatgatatcttcacagataacacaggcaaattatcattaaaatgatttgtgttttgttgttatttgttaacattgaattataatc

SEQ ID NO: 6774398 - DNA, 68 bp, Homo sapiens
ggctaatggctaaatattcggaggagctgtaagtgcagaccctgactctaatgcttggctttatagcc

SEQ ID NO: 6774399 - DNA, 81 bp, Homo sapiens
caggggtgcagcaccacacctggctaattttttgcagagctgaggtttcactatgttggctaggctggtctcgaactcctg

SEQ ID NO: 6774400 - DNA, 89 bp, Homo sapiens
atgttcacttgctaattaaccacccattcagaaacactgagaattctttattgttatcatgggtgagtgaatattagcagtgtgttcat

SEQ ID NO: 6774401 - DNA, 55 bp, Homo sapiens
ccctcttgagtgtctgttttccagtagtgcttggtttataaccatttagtgaggg

SEQ ID NO: 6774402 - DNA, 129 bp, Homo sapiens
gctgacaggggatgacacaaggtgggcagaggtatgggcatggtgctgtggtgttccctgtgaacagtgtctcaacaatggccctatcacctttgcttctggctggcctgcgccacttcctctgtttcc

SEQ ID NO: 6774403 - DNA, 63 bp, Homo sapiens
gccactatacctagggtgcctttcagctctaactttatacaaggtgaatttctaggaagtggc

SEQ ID NO: 6774404 - DNA, 124 bp, Homo sapiens
ggcagggcttgctagtctgacataatataaagagtcttggaacatgccggggtccagggcctaaaaccccttgtggtctttggaacacccagctctgtgccaaagggtggaaggctgccctgcc

SEQ ID NO: 6774405 - DNA, 64 bp, Homo sapiens
taatcactgtgagtctgttttcttacccacaaaatggaaagataactccttcatcacaggattg

SEQ ID NO: 6774406 - DNA, 85 bp, Homo sapiens
ctggacaaaagatctctgagaaatttctttgtgatgtgcgcattcatctcacagagttgaactttcttttgattgagcagtccgg

SEQ ID NO: 6774407 - DNA, 67 bp, Homo sapiens
ctctggagtcacacacaccaaggtctctagcctagctctgccacttactggttgtgtgaccccaggg

SEQ ID NO: 6774408 - DNA, 79 bp, Homo sapiens
atcccaatgccaggaagtggggcagaggccggcctggtgcccagagcccagggcctacgtcccaccaccctgccggggt

SEQ ID NO: 6774409 - DNA, 81 bp, Homo sapiens
aaagatgggtttgtttgttataacaataaaaagtctgggaaatagactgtttggggttattacaacttggagaccgttttt

SEQ ID NO: 6774410 - DNA, 55 bp, Homo sapiens
gtagcatacactgccaagtctggtcaattgtttgacaaggcagctgtgtgcatgc

SEQ ID NO: 6774411 - DNA, 67 bp, Homo sapiens
tgtatatgcaagaaggcaataaactctttctatataataaagacatagtaagagcttcgcatataca

SEQ ID NO: 6774412 - DNA, 80 bp, Homo sapiens
gtacttgattacaaaactcatctatgacgaatgtaaaagaatatccacctgttgtactgaagagttttgcaaccaagtat

SEQ ID NO: 6774413 - DNA, 72 bp, Homo sapiens
gggacttggagagagcctcagctgttggatgaaagagcgaaaacagatgcagtagttttcaaaccaagttcc

SEQ ID NO: 6774414 - DNA, 57 bp, Homo sapiens
agtgttttgttgttaccagtgccttgactgaatggcttaggaacagtgtaagacact

SEQ ID NO: 6774415 - DNA, 55 bp, Homo sapiens
gaccatctttgagtgataatgtcagtgggatagaatgtgtcactggataatggtc

SEQ ID NO: 6774416 - DNA, 67 bp, Homo sapiens
ctgggctggggcagctgcccagtggccacagtgagctacaggcagctgagccctgatacagacccag

SEQ ID NO: 6774417 - DNA, 59 bp, Homo sapiens
aacattgagctggtggagaggagtataaacatcatcccttccatcactttgcttatgtt

SEQ ID NO: 6774418 - DNA, 120 bp, Homo sapiens
gaaaacagtgctttagaagaattaatctagtaaagacaaatgggattatagggaacagaaactgttaaagaaaaatatatccatttgtctgctaatttttttttatcagtgcctgatttc

SEQ ID NO: 6774419 - DNA, 56 bp, Homo sapiens
aagccctgtccggggggaagaaagacaacctcccgagtccctcaaggcaggtgctt

SEQ ID NO: 6774420 - DNA, 79 bp, Homo sapiens
ctattgtatcttaaagctgctggtgactgggctgatctcctgattgtttagcgaattaccagtgcattattctcattgg

SEQ ID NO: 6774421 - DNA, 80 bp, Homo sapiens
gttatcaaatggtaccatgagatgccactaatgtcgagtaaacaattggaaatggatctcatgctgtgcccttgtgggac

SEQ ID NO: 6774422 - DNA, 59 bp, Homo sapiens
aggtatacaggagctcattatagttttctttctagaaaactgttgcttcaatgtatcct

SEQ ID NO: 6774423 - DNA, 60 bp, Homo sapiens
tcagtggcatttggttagaatgtctggctgactgaggacaagataatgaagtgcaattga

SEQ ID NO: 6774424 - DNA, 80 bp, Homo sapiens
agggagtgggctccctgtctggaactggactccaatggttggaggtggatttaaaatcagatgggagttggctgctccct

SEQ ID NO: 6774425 - DNA, 61 bp, Homo sapiens
gctttgtgtgtgtgtgtgtgtgtgtctgtgtgtgttcctgctcatgtgcacatgtgaatgc

SEQ ID NO: 6774426 - DNA, 67 bp, Homo sapiens
gcccagcgggggacacatctcttgcaggaaggactgatgattgcaaggctaggttcacccactgggc

SEQ ID NO: 6774427 - DNA, 65 bp, Homo sapiens
ctgtcagaggctctctgttgccaccagctgcctggccatgacatcgcagagagaccatcttgcag

SEQ ID NO: 6774428 - DNA, 63 bp, Homo sapiens
cagaccccagcggccagcaggcttcaccacctctgccttccctgggctggcttgctgggtttg

SEQ ID NO: 6774429 - DNA, 62 bp, Homo sapiens
gcatatataaacaatttccacctctcctgagaagttcctcgttttaggtggacattgtgtgc

SEQ ID NO: 6774430 - DNA, 80 bp, Homo sapiens
gtgcagattctgattttacacctcttgtttctcctttgcagaggcatgtaagaatcagtctttaatgtcaacatctgcac

SEQ ID NO: 6774431 - DNA, 66 bp, Homo sapiens
ggcactgtttttgtattcagttggttaatgagtgtactttttcaatgctgaagcaggaatagtgcc

SEQ ID NO: 6774432 - DNA, 73 bp, Homo sapiens
gcctcactgcctgtagccctgagatgtgggacccagaccaagaagaaccacagccaggagccatgggcagggc

SEQ ID NO: 6774433 - DNA, 103 bp, Homo sapiens
acgttctaaaatctccttcaggtgacagatttgctgcgcatggtgtgtttaactgaggattcagcgtacctagcagagtttctggaggaaattttgagattgt

SEQ ID NO: 6774434 - DNA, 86 bp, Homo sapiens
gagtagaattcagggaggctcttatttgttcaacatcccccagatggtatgtgatggagtgagggtttctacttaagtctgatctc

SEQ ID NO: 6774435 - DNA, 92 bp, Homo sapiens
tcctactcctacctctactccctgccactgcacctgtatcagttttagttttgctgaggtttcaggagtggcaggggagagtaggtacagga

SEQ ID NO: 6774436 - DNA, 113 bp, Homo sapiens
caacacatgtctgaacagggaaagaaaatacaaagatggaaggttatgttaagttcaaaaacaaacaaacaaacaaacattttgtcatctttctggcctggtagtttgtgttg

SEQ ID NO: 6774437 - DNA, 64 bp, Homo sapiens
agccacaggctgtctgaatggaggcccccagcacgggggccccctgttgagtcagccttgggct

SEQ ID NO: 6774438 - DNA, 76 bp, Homo sapiens
ggacactgcaccgggccctgaggtttggctctgcaggcagatgtgcagcaaacaggccttcagggcgacagggtcc

SEQ ID NO: 6774439 - DNA, 73 bp, Homo sapiens
ggtaactctgtaaagcataacgtttgttataaaacagaaggaaaacaacaagtgggtactttacagggatgct

SEQ ID NO: 6774440 - DNA, 65 bp, Homo sapiens
ccatcattctctggggaaagaaatttggtgtctgtaccaccacaatttctgatcagtgaatttgg

SEQ ID NO: 6774441 - DNA, 108 bp, Homo sapiens
gggcacagattttcttcttagcatagaaatgaagatgctcttttcaggtaaaggacacattgctaagagcttcttcatttcaacttgctgtgcttgaaattggtgttc

SEQ ID NO: 6774442 - DNA, 58 bp, Homo sapiens
aggggttcatatgtactcagttctgtcctagggactgtattagtccatttgagctgct

SEQ ID NO: 6774443 - DNA, 66 bp, Homo sapiens
ggagaacacgaggaggcccagcgatgtggcagccgtctgcgctggccatagcctcctgtgttgacc

SEQ ID NO: 6774444 - DNA, 87 bp, Homo sapiens
agctaccactgtgcagttggttctgtcaaagtctcatgttacagctgattaactggctgcttctgacagggccaaacatgacaagct

SEQ ID NO: 6774445 - DNA, 56 bp, Homo sapiens
cctgttccattggttggaagcaagtcacaggtgctatccacactcaaggggagggg

SEQ ID NO: 6774446 - DNA, 61 bp, Homo sapiens
gacaagtgcatgatttctatctgattcaataagaggaaagaaaatgaagcgagcactggtc

SEQ ID NO: 6774447 - DNA, 61 bp, Homo sapiens
tttcttgacagaggacagtgtttatcaagtagaatttggaacactagaatctgtactgagg

SEQ ID NO: 6774448 - DNA, 61 bp, Homo sapiens
ccttccggccctgatttgcactacacagtcctagatgtagaaaagaagtctggccgggagg

SEQ ID NO: 6774449 - DNA, 77 bp, Homo sapiens
gggaattgaggtagggacttaaaactgttttcactaatggctctttagtgcatcatagtgaggtttttattcttccc

SEQ ID NO: 6774450 - DNA, 67 bp, Homo sapiens
accctggcatagagacctgagtcatgcaggccctggactgttgtaacaggcactctgtgccaggagt

SEQ ID NO: 6774451 - DNA, 73 bp, Homo sapiens
ttgctgtaaggctactgtcagcttcagggcagaactgtttctgagactgcagtgagccgcttagccacagcag

SEQ ID NO: 6774452 - DNA, 61 bp, Homo sapiens
agaagctgttgcattcctggcgctctgtctttgagctggagcttacctgcggcagctctct

SEQ ID NO: 6774453 - DNA, 91 bp, Homo sapiens
gaatattgtattcggtgctgcacaggagaccccatttagagacaggaaacttgtgcttgaagggcactctttgtgcagctacagacgattc

SEQ ID NO: 6774454 - DNA, 65 bp, Homo sapiens
ggaaaaggcttaaagaattaacagagatgtcagacctgacatagttaagtcattgagccaactcc

SEQ ID NO: 6774455 - DNA, 73 bp, Homo sapiens
tctgaaactgtcttcctagccatattccagtttagcacctttgggcacgtggattaaggaagggggttccaga

SEQ ID NO: 6774456 - DNA, 67 bp, Homo sapiens
cctgctcttgtatccaaaagtgatcatgggttgcctgtgtcccgatcattaacagtgcaggggtagg

SEQ ID NO: 6774457 - DNA, 81 bp, Homo sapiens
ttcttggccaggcgaggtggtcatgcctgtaatcccagcactttgggaggccaaggtgggcggatcacttgaggtaaagag

SEQ ID NO: 6774458 - DNA, 71 bp, Homo sapiens
gatagcatggccaggaagctggggactgggattccaacccaggcagtctggctcctgagtccatgctcttc

SEQ ID NO: 6774459 - DNA, 72 bp, Homo sapiens
ttaggttgctacaaaagtaattgtggtttttgtcattaaaggtcatggcaaattacttttgtacctacttaa

SEQ ID NO: 6774460 - DNA, 57 bp, Homo sapiens
accaaatgcttggctgctgtgataactgctggagccacagatcttcaagacattggt

SEQ ID NO: 6774461 - DNA, 61 bp, Homo sapiens
aaggcaccataggcaaatccaggatgctctccttatgccctgattgttcttgctgggcctt

SEQ ID NO: 6774462 - DNA, 59 bp, Homo sapiens
tgtcagtgagggaggcagaatgtgtggtgtgaagtggattctgcctccaggagctggca

SEQ ID NO: 6774463 - DNA, 67 bp, Homo sapiens
cttcctctgtgtcctgggcttctagcacagagggtcagaatgaaacaagcccaggacacagaggaag

SEQ ID NO: 6774464 - DNA, 84 bp, Homo sapiens
tgccagtttgagaagcacagggcctgtgctttcagttttctcacatttgaatattatgttgtatgggttttgtttcttctggta

SEQ ID NO: 6774465 - DNA, 67 bp, Homo sapiens
gaggagggcaggggaccttcctcagctcagcaccaacagccgccctgcagagagccctgccttcctc

SEQ ID NO: 6774466 - DNA, 76 bp, Homo sapiens
atgctcttaccattagaagagctggaagaaggctgagggagatgccttcttccagcccttctaatggtaggagcat

SEQ ID NO: 6774467 - DNA, 100 bp, Homo sapiens
aatacatgcttgctatgacataattgtgatgattgaaatactgtgtgtgacatgactagcacagtgcttggcacacagtaataacatagctgccagtatt

SEQ ID NO: 6774468 - DNA, 80 bp, Homo sapiens
ggtgtcagtagtgccattgccaggaagggccatgaggaaaacaagggtcctctccctggctggtacattcccctggcatt

SEQ ID NO: 6774469 - DNA, 74 bp, Homo sapiens
tggaagctcgtattaaaatgcaggctctgattcataggtttggaatgagattctgcatttctaataagagccca

SEQ ID NO: 6774470 - DNA, 70 bp, Homo sapiens
gtcaggatgtttattctccagttcacaccctgtagagataccaccaggggttggcagtgtacgtcctggc

SEQ ID NO: 6774471 - DNA, 62 bp, Homo sapiens
ccttctgaatttaaaatgtttaaaaaggtttaaaagccttttaaactgcagaatttagaagg

SEQ ID NO: 6774472 - DNA, 100 bp, Homo sapiens
ctgaagattcctgctctcctgctgaggtggagattgcagtgagctgagatcgcaccattgcactccagcctgggcaacaagagcaaaactcagtctccag

SEQ ID NO: 6774473 - DNA, 71 bp, Homo sapiens
ttctcctgagcaggcagcctaggaagtgaagaaccaaagcctctgtatagcctgagctgcttgccagggaa

SEQ ID NO: 6774474 - DNA, 78 bp, Homo sapiens
gaggtgatgggcaagaaggatgacactggatgattaaaatccaccaaaaatctccagcctcctatttaccctaacttt

SEQ ID NO: 6774475 - DNA, 75 bp, Homo sapiens
gcatgcagtgatttgaggattattgctcacggtaagaaaaacatgagtaatatattgtcttcaaagaacctatgc

SEQ ID NO: 6774476 - DNA, 57 bp, Homo sapiens
tcttgcctttgtcttcaaaggctctgccaatgtgaagtacaggagagagaggcaaga

SEQ ID NO: 6774477 - DNA, 61 bp, Homo sapiens
actcagaaaaccagcgtcaaaccccaccctgcccaggatgtggaccttgcctggtgagagt

SEQ ID NO: 6774478 - DNA, 76 bp, Homo sapiens
tggccccttctctgaggaacctgccctggttccctggtccacctcccagctagtagagttccctgggaaggggtta

SEQ ID NO: 6774479 - DNA, 65 bp, Homo sapiens
tggcatttagagaaatgaaggatttaatttccagcaaacgattcttgtttcctcccaaaatgcca

SEQ ID NO: 6774480 - DNA, 57 bp, Homo sapiens
ttttaagacacctctctgcccttcatgtaatatggggagtttagcggtttctcggga

SEQ ID NO: 6774481 - DNA, 93 bp, Homo sapiens
tgaacttcctactataaacatagcaagatcacattctgtattgttttatttataattttacattttatgattttgcagtgtagagggagctta

SEQ ID NO: 6774482 - DNA, 77 bp, Homo sapiens
tcaggctgtggctgtgtggctgctctggacctggagtggatggtgtggtgtcagggctggacacagctgcagcctgg

SEQ ID NO: 6774483 - DNA, 58 bp, Homo sapiens
attcatctatgactctaatgtgctatggaaacaccacagcaacattcatgtggtgaat

SEQ ID NO: 6774484 - DNA, 55 bp, Homo sapiens
ctgtgggatgagtggtgagggaggtgaagtctctcccaggccataaaactcagag

SEQ ID NO: 6774485 - DNA, 83 bp, Homo sapiens
ggagagttttgttggttgtgggtcattgttaaatggaaaaagaaatttcagaaacactgaaacattgattgacagaactctcc

SEQ ID NO: 6774486 - DNA, 65 bp, Homo sapiens
ctcccatgaggccatggctgtcactaaatactttctgtctttgggaacagcagttggctctggag

SEQ ID NO: 6774487 - DNA, 58 bp, Homo sapiens
accatgacacatgacaagctcatgaactcttaaatgagttttaaatgatggtggtggt

SEQ ID NO: 6774488 - DNA, 58 bp, Homo sapiens
ggaggccatctggctggaggctgcaaagtgagacatgaacctcccccaggaggcctcc

SEQ ID NO: 6774489 - DNA, 72 bp, Homo sapiens
ggtcgagggtatttgtagtttactcaagctttcactgctatgaagttcaagggctacatttgcacttaggtc

SEQ ID NO: 6774490 - DNA, 102 bp, Homo sapiens
tcacattctgcgttgactcctttaagaggtctgaaacggtgggagcaaacttactctgcccgttcaaatccttgttgtcaatgttaatcgcaaagagtatgg

SEQ ID NO: 6774491 - DNA, 69 bp, Homo sapiens
acatgcttcagagacatcctactcaagggtggaggagccattgtttggaggctgctctcaggggcatgt

SEQ ID NO: 6774492 - DNA, 91 bp, Homo sapiens
ccagtactattattatctctcctttatcaaggagccttagagaggttaagtaatttttctgaagtcacatgattggaaagagtagagctgg

SEQ ID NO: 6774493 - DNA, 55 bp, Homo sapiens
agcggcccggaccctcctggggtactaggcctgagcctctggagggaccgccgtt

SEQ ID NO: 6774494 - DNA, 58 bp, Homo sapiens
tctgccacttagccagaagtcctcagacaatttattagagtgctcagttaagtggaga

SEQ ID NO: 6774495 - DNA, 66 bp, Homo sapiens
tttgtgggaaagtttgctataaaatgcatttatttaaaatgttgcagagcatagacttctcaggaa

SEQ ID NO: 6774496 - DNA, 103 bp, Homo sapiens
tacaggggttgagggaccaggcctggccggggctgatggacagtggggactttccttctctccatgatggctttgcaggggctccatggtccttctctctgtg

SEQ ID NO: 6774497 - DNA, 55 bp, Homo sapiens
cgcgcgtcctcagctctgcgagccccctctggagcggcggggaggtaggtgggcg

SEQ ID NO: 6774498 - DNA, 56 bp, Homo sapiens
gcctggccaacgtggtgaaaccccgcctcaactaaaaatacaaaaattggccaggc

SEQ ID NO: 6774499 - DNA, 99 bp, Homo sapiens
tctactttggcctgattgtcttaaaagctggctctgatattaacggacggatgttcacatctttaatttggatcagggccactgacacaatagagtaga

SEQ ID NO: 6774500 - DNA, 69 bp, Homo sapiens
ccaagtgatcaataggcttttaaaaatctctgagtaatctcagaagtgacagtgtatttgactatatgg

SEQ ID NO: 6774501 - DNA, 94 bp, Homo sapiens
tttggtggtgagtggggagctggaaggagccaggttcttgaggactttatagggtaagagctgccctgccagttctaagctatatacctccaga

SEQ ID NO: 6774502 - DNA, 56 bp, Homo sapiens
ggtcatggctattaggcagtcacacaagtcataaatggctactgaggcccaggacc

SEQ ID NO: 6774503 - DNA, 89 bp, Homo sapiens
acaagagacatcaactgggactgtgtaaatataagaaagtatctcctcagttaagtcaatatcaatctcagccactgggtgttttttgt

SEQ ID NO: 6774504 - DNA, 72 bp, Homo sapiens
tcttgctggctgtgctgtgtttgggccaggccctctttcgggcctgcctgaaggtcagccaccctgtccaga

SEQ ID NO: 6774505 - DNA, 59 bp, Homo sapiens
agcagacatatctcatgtcacatctttttagaccaggctgagcttatatatgtgctgct

SEQ ID NO: 6774506 - DNA, 90 bp, Homo sapiens
ttcaggcccagagacacaatttccccatcctaccatttgaagcacaggatgcctactgggattaggggaattgatttttgtgctactgaa

SEQ ID NO: 6774507 - DNA, 57 bp, Homo sapiens
taggtcttagaacacaggatcagaactatctgttgcctgagcaacttcaagggcctg

SEQ ID NO: 6774508 - DNA, 60 bp, Homo sapiens
cagcctcctgggacactcaccgctcacaggagactgagggagtgctccgcgagagggatg

SEQ ID NO: 6774509 - DNA, 55 bp, Homo sapiens
actgctgactaaacagctccattttgtatctgatggctgtctcaatgttagcagt

SEQ ID NO: 6774510 - DNA, 69 bp, Homo sapiens
gcttgagcccaggttgaggctgcagtgagctatgatcacatcactgcactccagcctgggtcacagagt

SEQ ID NO: 6774511 - DNA, 75 bp, Homo sapiens
gctgggagctggtgttggtgacttcgggaagttagctctcccttgcttccaagtcaatcaatgctggctttcagt

SEQ ID NO: 6774512 - DNA, 70 bp, Homo sapiens
gtggaagagtccaggtgggctggaggcatggcctgtgtgtcttgcctccagtccctgggctgagattggc

SEQ ID NO: 6774513 - DNA, 80 bp, Homo sapiens
aaggagtccgtgttcttcttgggtaaagctgagccaggggcacacagactggctggatggctggggaagagcaggccctt

SEQ ID NO: 6774514 - DNA, 70 bp, Homo sapiens
gcctcggtccaagtcttccttcccaaacctttgtcatttagggattgagaagctgagttgggtgaaaggt

SEQ ID NO: 6774515 - DNA, 57 bp, Homo sapiens
cggcaggtgtgctcactctgcccgggagcgtctccccgccgaggagcgcccatgctg

SEQ ID NO: 6774516 - DNA, 70 bp, Homo sapiens
tgtagctggtcctgcagaagagtccagctcatttgaaagaatgatctggggacattctctgcctagttca

SEQ ID NO: 6774517 - DNA, 112 bp, Homo sapiens
tcttgtgttggaggcccggaacatctggagcacttccagacctgggctcaccatgccttggatctgagtcctggcagggtctaggtctaggctcctgggactcccagcagga

SEQ ID NO: 6774518 - DNA, 75 bp, Homo sapiens
tgacacaggaggagagggagcacccagggaagttgtgtctgggaaagtgtgctcccctccagacctttagtgcca

SEQ ID NO: 6774519 - DNA, 90 bp, Homo sapiens
cagctgcttgtagagagctcaggagatgacagaaggtatcctgtgtccccaaggatgtacctctgcattcctgcctctatcagcaggctg

SEQ ID NO: 6774520 - DNA, 55 bp, Homo sapiens
ggtccagagaggtgcaagaggctggtggccagagactcctgtgcctctctgggcc

SEQ ID NO: 6774521 - DNA, 79 bp, Homo sapiens
gttgattgaaatctactagtgatataatcaaagatgaatcattgaacataaatcactggtcagtagtttccccaccagc

SEQ ID NO: 6774522 - DNA, 80 bp, Homo sapiens
cccagcatgctcacctgtgtttttgtttgactccttcacatgcctgcgggaagatacataaaggtagagtctatgttggg

SEQ ID NO: 6774523 - DNA, 84 bp, Homo sapiens
gcagccttggagccccatgtgctcttattaccctgtcgcacagaagtgatgcacagagagatgagacacgtggcttccggttgc

SEQ ID NO: 6774524 - DNA, 70 bp, Homo sapiens
gcaaggtcagggctgcagaagaggcaggtggggtagccctgccttctctcccagtcagccctcatctagc

SEQ ID NO: 6774525 - DNA, 89 bp, Homo sapiens
ctgtgattctccactgaaggattcaaaatggcaggtctgctgcagagcttgccttgaggctgagtcagatttcattgtgtggatggcag

SEQ ID NO: 6774526 - DNA, 88 bp, Homo sapiens
gttctgtggtggcatcttccaaatgtctgtctttagcccaggtcccttccctgaggtcatggctgatatttccagttgccagctgaac

SEQ ID NO: 6774527 - DNA, 84 bp, Homo sapiens
gaggtgcaggcacttgctgaggtcacggcggccagactggagcccagaactctgtctgcacctaagcacagtgtcccttacctc

SEQ ID NO: 6774528 - DNA, 84 bp, Homo sapiens
gaggctgccagcacctttgtggggatgcctcgtgcagcaaaaaaaaccacgcacagagtctgcgagcagaggggctggtgcctt

SEQ ID NO: 6774529 - DNA, 60 bp, Homo sapiens
ctcatagaagcaccagaagatatcacccagacatggttctttaaactgctgctctgtgag

SEQ ID NO: 6774530 - DNA, 62 bp, Homo sapiens
gccctggagttcgactgagttgaatgctgactctgctatttacaaactctgtgactttgggc

SEQ ID NO: 6774531 - DNA, 83 bp, Homo sapiens
tggctctcaggaaccaaatagagactggccttgtggaaatattaaacttctatttgctggttgcttctgttttcctgaagtta

SEQ ID NO: 6774532 - DNA, 91 bp, Homo sapiens
cacatttctcctgtctttctaggcttggacttgctctctgccaaagcagatgactcccagagcagccacagtctgggacagggcaaatgtg

SEQ ID NO: 6774533 - DNA, 60 bp, Homo sapiens
ctgattttagatatgaggaaactgagatatggagagttttagtaacttgcctaaggtcag

SEQ ID NO: 6774534 - DNA, 101 bp, Homo sapiens
gttgggctagctgctccagttcctgctccatatgctcctgcagctcactgggcctcagcaggacctggcagatggggcaaattggggcctggctgtcgaac

SEQ ID NO: 6774535 - DNA, 82 bp, Homo sapiens
gcaaattgttatgaagactgaaatagtgcacaccaagtgctttaggaatgtgcttggtatatttttagtcctcaataattgc

SEQ ID NO: 6774536 - DNA, 85 bp, Homo sapiens
ggaactaagtgatgaaatcttttccaattgtttagggaaagtgtctcattcccataaacgtggaagaatttgcacacttgctgcc

SEQ ID NO: 6774537 - DNA, 103 bp, Homo sapiens
cagattgtaagtctttagtaaatgtctttgtcacgttgggctgccataactaaatatcacagatggtggcgtgaacaacagacatttatttcttatagttctg

SEQ ID NO: 6774538 - DNA, 70 bp, Homo sapiens
ccgctgtcaccagctgctgacatgggcaggtcccttgtggggctgcctgtgcgggtcgctagggcggtgg

SEQ ID NO: 6774539 - DNA, 114 bp, Homo sapiens
ggctgctatgtgtatgtatgcatgttattgatgcctgaggcttgtggaactcatctgcctggtctattccttgagagcaacacgcagtagtatacgagcgtaacaagaacagct

SEQ ID NO: 6774540 - DNA, 60 bp, Homo sapiens
cagtaagtagtcaggggtccagggcaggccctgcctcctggtgtcctggtctgctagctg

SEQ ID NO: 6774541 - DNA, 55 bp, Homo sapiens
ggcaacttgtgtctcgacagctcccctagggactttatgtagagccaggtttgcc

SEQ ID NO: 6774542 - DNA, 62 bp, Homo sapiens
gtctctagattgggagagagaatcctgccaagctttttccttcatttcccacttcaggagac

SEQ ID NO: 6774543 - DNA, 55 bp, Homo sapiens
taaagagcgatatgctttaaagtccatcattgagatgaaaagcaaaagcttttta

SEQ ID NO: 6774544 - DNA, 118 bp, Homo sapiens
gggtcgtctagtcctggtgttccagttctctaccttctccagtgtggttggcaggtgggcgtcctggctgatgggggtgtacactggacaggagtaggaagaggaaggggctattccc

SEQ ID NO: 6774545 - DNA, 84 bp, Homo sapiens
cttctatttaagagaacgtggaatgtggctccttggtcccattcagcctgtaaggggatacttccactttctttgggaaaggag

SEQ ID NO: 6774546 - DNA, 82 bp, Homo sapiens
gggggtggctgtgctgtgcattgtaggaggtttagcaggatccctggcttctacccacgagatgcaaatagcatcctccccc

SEQ ID NO: 6774547 - DNA, 69 bp, Homo sapiens
gagtttagtgctgggcaaaatgcatttcctgccttttaaaggaatatggatttgctcagctgaggactc

SEQ ID NO: 6774548 - DNA, 59 bp, Homo sapiens
gtggtcagaggaccaaactagtgcctggctaaggagcactgggcagctccctgactcac

SEQ ID NO: 6774549 - DNA, 56 bp, Homo sapiens
acatgcaagcccctgaacacatgtttaggctagatatgacccagggctggcagtgt

SEQ ID NO: 6774550 - DNA, 62 bp, Homo sapiens
tcacaaggcagcctgcttccgcagaattaaaagtgggagtgtctaaactggcttcctggtga

SEQ ID NO: 6774551 - DNA, 70 bp, Homo sapiens
gctttttcagttctaaataggacttgctaagcaagaaggttctagggaggagaacttgtgaagagaaagc

SEQ ID NO: 6774552 - DNA, 59 bp, Homo sapiens
gggccagtctgactctgctggtcagtgtccagtgtgtttcccagcagacacagctgccc

SEQ ID NO: 6774553 - DNA, 61 bp, Homo sapiens
cagtggaaactttaagacagtcctcaagagctagcagcagtcttgggggtagagatcactg

SEQ ID NO: 6774554 - DNA, 130 bp, Homo sapiens
cgagagcaaggctagggaagtcggcgttgccgttttctctctgtttgctctgcctgttcccgcttccttggaacattagataactcagaaaggaaagacccgtctctcgtttctggcccttgtcctctcg

SEQ ID NO: 6774555 - DNA, 59 bp, Homo sapiens
ctgataattgtaacttcctaaagagtggttgtgaggttcttaggaagtcacaatttcag

SEQ ID NO: 6774556 - DNA, 55 bp, Homo sapiens
cagcaggcgttgggagaaagacagaatgcctattgaactctctgagatgctgctg

SEQ ID NO: 6774557 - DNA, 103 bp, Homo sapiens
gagatgcaaattaatggttgtgagcatttaaaaatgtaaggcattactttagttggggcattcactgggtgttcatgggaaaagtggctttgaattgtatctc

SEQ ID NO: 6774558 - DNA, 91 bp, Homo sapiens
tcctctgggtgaagggatttggggtctctgaagctgaggtactttgggggtttcatgctgaggggattttaaatccctcaaggtggcagga

SEQ ID NO: 6774559 - DNA, 80 bp, Homo sapiens
aagggcatatggagggatctttttgaaggatgaggcaccttttacattaccctctcaactgaagtcctgttatatccttt

SEQ ID NO: 6774560 - DNA, 63 bp, Homo sapiens
ttttctccctctattggcttctgtttagaatacagtggtgagctctgaaatagggaaagagga

SEQ ID NO: 6774561 - DNA, 60 bp, Homo sapiens
agggccctgcatgagattaaggttggtaagaaggaacgccagctgtctaaggcaggccct

SEQ ID NO: 6774562 - DNA, 95 bp, Homo sapiens
ttccatttgctctctttcctgctccacttgggcaccccccaggcccagtttccttgggtgggatcagctggtggaaaggagggaggtgctgagaa

SEQ ID NO: 6774563 - DNA, 76 bp, Homo sapiens
tttcagaaagacatatttctaagtttatttctagctttgaagaaagcatatctgcctagtaatgtgtcgattgaag

SEQ ID NO: 6774564 - DNA, 63 bp, Homo sapiens
tttgagcaaaaacagtttaaattcttcttagaaggattcacagacagctgcttttggcttaaa

SEQ ID NO: 6774565 - DNA, 111 bp, Homo sapiens
tcttgtgaggggagtggcaggggttcattcagaggaatgagaatctttgaccgaagaggtaatagtgaagatacctcaattctttgaaattattgtccctttttttaatga

SEQ ID NO: 6774566 - DNA, 61 bp, Homo sapiens
gtcatctttgccctgtgcaggactttggagaggatgattccctgtacatcaccaaggtgac

SEQ ID NO: 6774567 - DNA, 68 bp, Homo sapiens
gaaaactgcccagaagagatgaaagtcttcagcatgaaaagcacttcatctctctctggagtaacttc

SEQ ID NO: 6774568 - DNA, 61 bp, Homo sapiens
cccgagtgcacctgcgttcctgctggtccgggagctgatcaggtggattcactaatttggg

SEQ ID NO: 6774569 - DNA, 65 bp, Homo sapiens
acatatttcagctttacttaggaaaggcatctgcttcgagtattttctgggaaaagccaatatgt

SEQ ID NO: 6774570 - DNA, 70 bp, Homo sapiens
gctagaacaaatggtcatttctcttttgtgactgaacaagtcacagaatgggatttgaatatttcttggc

SEQ ID NO: 6774571 - DNA, 55 bp, Homo sapiens
gtgtgaggcagagatgccaaaactgtcctgggaaatagtgcctctgcgcctccac

SEQ ID NO: 6774572 - DNA, 96 bp, Homo sapiens
ggagaattgcctgaacccgggaggcggaggttgcagtgagctgagatcgcaccactgcactccagcactccagcctgggtgacagagcaagactct

SEQ ID NO: 6774573 - DNA, 55 bp, Homo sapiens
ctttcagggcagacaacgagcatgcctgttcagtttgggttttttgctctgaaag

SEQ ID NO: 6774574 - DNA, 85 bp, Homo sapiens
tatgggtccatccatttaggttccactagttagtcaacatactaaaataaccagttcaactaataatcctaaatggtggcaaata

SEQ ID NO: 6774575 - DNA, 97 bp, Homo sapiens
catgaaatgaaaacaagtagaagaagggagtgacaaatgcacactttggatgtgtgtattgatagctgtgtatttcctttatatgcatttttacatg

SEQ ID NO: 6774576 - DNA, 62 bp, Homo sapiens
ttatgctttgtgggcctactttgcggatgatccatagtcagtgaatctattacaaggcatga

SEQ ID NO: 6774577 - DNA, 66 bp, Homo sapiens
ggcctggcctcccttcctagcgtacagaccgaaaccccaaaccgaaattaagcggagggccgggcc

SEQ ID NO: 6774578 - DNA, 62 bp, Homo sapiens
ccagcagcccctcaatgatctgttgtgttccgtctggcttccgttgtccgcgggcttgctgg

SEQ ID NO: 6774579 - DNA, 62 bp, Homo sapiens
gatgtcacttaacctttctgagcttgagtattctgagctactcattcttgttaagtgtcatc

SEQ ID NO: 6774580 - DNA, 63 bp, Homo sapiens
gagaggggctcagtgggcaggggctggcccagtgacagcgctctgtccaacaagccccttctc

SEQ ID NO: 6774581 - DNA, 63 bp, Homo sapiens
tggacgtaattctctctagtacccctcgccggcacctgaggataggtactgttgttattccca

SEQ ID NO: 6774582 - DNA, 107 bp, Homo sapiens
gccttgtcaaactgcttggctctgatcagatgtccagtgtgatccttgattctgaacaccaactggtgactgattctgggagccagattaaggcaggcggtaagagc

SEQ ID NO: 6774583 - DNA, 64 bp, Homo sapiens
agcctctcaggtgccactcggagggaagcgctggctgcttcctcctggaggtcactcaaaggct

SEQ ID NO: 6774584 - DNA, 67 bp, Homo sapiens
gcagaccaggatagtggtttctaagcatgagctctgcagtcagcttggcttcacattctgtatctgc

SEQ ID NO: 6774585 - DNA, 83 bp, Homo sapiens
aataaagtgtcagcatcagaagactgtcttttccatgttaacatcaacatgggtaagactcttttgcccaagacaatcatatt

SEQ ID NO: 6774586 - DNA, 76 bp, Homo sapiens
ctcctctgtgctgttgtctgctctttgagctccagttgaggcaagggctctgaggcagatcgatgggcagactgag

SEQ ID NO: 6774587 - DNA, 66 bp, Homo sapiens
tgtcagtattttcaaccatagcctgggaggcatctacgcctcctagggttattagaaagtaacaca

SEQ ID NO: 6774588 - DNA, 63 bp, Homo sapiens
ccctgttttgtgaggcacccacaggtagagtcttcgacacctagggggcttcccagagaaggg

SEQ ID NO: 6774589 - DNA, 55 bp, Homo sapiens
catcaggaaaggacgtctagccagctgtgttgtcggcccactccccttcctgatg

SEQ ID NO: 6774590 - DNA, 82 bp, Homo sapiens
gaaatagaaactttgtcttttatgcttacagactgtttagtttttctgtttccaaatggtataaagacagggaaaatgtttt

SEQ ID NO: 6774591 - DNA, 67 bp, Homo sapiens
catagaatgaagaataagatagatggagcccccttgggctttcattgcatttatacttatagctatg

SEQ ID NO: 6774592 - DNA, 129 bp, Homo sapiens
tgttacccaccacgttgacatttgagtcagtgtactcaagagccaggtaagcacagggaaacaatcatttcctgtagcatgagtggtcttaagacatctagcttcctgttgagcaaggtaagaatgaca

SEQ ID NO: 6774593 - DNA, 105 bp, Homo sapiens
gccacatgccaggcagtcttacatgctagggcctcaggccttgctctgtgagagttttctcatagtttaatgcctgggctagcaaatggattgattggaagtggc

SEQ ID NO: 6774594 - DNA, 57 bp, Homo sapiens
acggcaggctcagagctggaattagaacactggcaaccaaactctagagcctgttgt

SEQ ID NO: 6774595 - DNA, 86 bp, Homo sapiens
agagcaaggtctgtgtcatctgctatcgtgctctcagcatcttctaaagtgctgggcatagagtgcttagtagtgacatgggttct

SEQ ID NO: 6774596 - DNA, 106 bp, Homo sapiens
tggaaaataaattgatttaattaagtgcctgaatactaatctgaatttcaattcattcaacaaatattgattgagaatatgatttagtataaggcactattggcca

SEQ ID NO: 6774597 - DNA, 66 bp, Homo sapiens
ttaggttttggacatactttgtttaatgtgcctttgagacatgctaatggagatgccaagaagtga

SEQ ID NO: 6774598 - DNA, 57 bp, Homo sapiens
gctctgtatgagggtgagagatgaagccaataaacatttcttgattatctacagggc

SEQ ID NO: 6774599 - DNA, 85 bp, Homo sapiens
ccaggcgtttccaactctgagtttacagtatgttttgatttgatcattacagattataaatttgagctggttttaaaatttctgg

SEQ ID NO: 6774600 - DNA, 57 bp, Homo sapiens
tcaatgtgctttaggtttgtttacaacctgttgtgaatctatctaaaggtattatga

SEQ ID NO: 6774601 - DNA, 63 bp, Homo sapiens
ctgctgtaagactaaggagaggtcacatattgattttggacctatgtacagttttactagtag

SEQ ID NO: 6774602 - DNA, 68 bp, Homo sapiens
taaagcgtggtctgttactgcagcaccttttttaccagagttcctatgtgagtccagattttgcttta

SEQ ID NO: 6774603 - DNA, 71 bp, Homo sapiens
tggagccacctttaatgagcaccagccgaagcaatattgtctttgcagggcatctttgaagtgtggcttca

SEQ ID NO: 6774604 - DNA, 55 bp, Homo sapiens
tcccacttcagagaagaattagactgttcccaatgtcttcacatctgtgagggga

SEQ ID NO: 6774605 - DNA, 77 bp, Homo sapiens
gggaatatagcagttggttagaacaaacaattttcttaaataggaaatgtactttaaagccatcctgctgtgatcct

SEQ ID NO: 6774606 - DNA, 55 bp, Homo sapiens
tccctgcaggtggggtggccaggtgtcctcagaccgggtggctctccctcaggga

SEQ ID NO: 6774607 - DNA, 67 bp, Homo sapiens
agaaagattaaaggggagacaagctcagttatttgagtctttccagctgccccaatttcatccttct

SEQ ID NO: 6774608 - DNA, 58 bp, Homo sapiens
tccttctctggtttttactgtaatccacagtagacagacagaacacagcccagaggga

SEQ ID NO: 6774609 - DNA, 107 bp, Homo sapiens
tatattccatatgtcaaagatgctgtgctatgtctacagagttctgagcttaataatacatagttcttgtctgtggacatgtatattgttggtacagtgggaatata

SEQ ID NO: 6774610 - DNA, 60 bp, Homo sapiens
acagaaatccaatttaaacacttattgcttttttgagccagaattaaattggatttgtgt

SEQ ID NO: 6774611 - DNA, 77 bp, Homo sapiens
tgtctttcatgatccaggaatctggggcctctgcaaacaccacgcaacagaagggctccacttgaatcacacagaca

SEQ ID NO: 6774612 - DNA, 63 bp, Homo sapiens
gcgagcccagcccgggctgcgctttccttccggggaaagagaaaaagatcccggctcggccgc

SEQ ID NO: 6774613 - DNA, 86 bp, Homo sapiens
gtctcagcttctcacaggaagtaggacttttcttttctcagtcatccccaaagaaacagaactgttgttctggaggagtctgagat

SEQ ID NO: 6774614 - DNA, 81 bp, Homo sapiens
ttctttgtacttcacttcacaagaggctggagatattccaatctcaacatcagaatggaatctctaggttctaacaaggaa

SEQ ID NO: 6774615 - DNA, 56 bp, Homo sapiens
ccagaggtggctttcaatatagttgctttatgtagacaacatgacagccactctgg

SEQ ID NO: 6774616 - DNA, 96 bp, Homo sapiens
ggaagccactggctctagggtgcaggccccaggacactaggccacccactacaggtcctggattctgccctgaaggcacccggtggcccaccttcc

SEQ ID NO: 6774617 - DNA, 68 bp, Homo sapiens
tgcttaacagagtgcctggcatgtagcgccacgctgcggactgtcggccactgctgttcctacccgca

SEQ ID NO: 6774618 - DNA, 63 bp, Homo sapiens
cagatgggggaagcgtggcattcaatatttagacagatgccacctccttattccacctgtctg

SEQ ID NO: 6774619 - DNA, 74 bp, Homo sapiens
cattctaggcacatctccatcctagctcaccatctgggcttctgggaggatgggaaatcatttgtgtcagagtg

SEQ ID NO: 6774620 - DNA, 61 bp, Homo sapiens
gttaaggaactagtactcaggctctcatccaagtggctgagggacttgctagttctctgac

SEQ ID NO: 6774621 - DNA, 73 bp, Homo sapiens
gcagctttccttattcaatgctggaaatgttgttcttattgaacaggcacttgcattgatgaggtcttgttgc

SEQ ID NO: 6774622 - DNA, 62 bp, Homo sapiens
ggcttcgccatcgccagcttcagcaccctggaggccctggagaaggatatggccctgaagcc

SEQ ID NO: 6774623 - DNA, 56 bp, Homo sapiens
gggacagccatgtgcagatgcccccgattagggacatgttctgaccacggctgccc

SEQ ID NO: 6774624 - DNA, 79 bp, Homo sapiens
tgtattttcttcattgacaaggaaaaatcattaatgaattttttttcctaagcagtggagctggcatattaaaggtaca

SEQ ID NO: 6774625 - DNA, 75 bp, Homo sapiens
gctctcagccagtatctgcctacagcctgatctgctactttctgagccaggctgtggtttagatagagtgggagt

SEQ ID NO: 6774626 - DNA, 75 bp, Homo sapiens
tttatgacatgttagggaaatgtgatatgccatttaattgatgaacaatccatcctctttgactcatgttatgaa

SEQ ID NO: 6774627 - DNA, 80 bp, Homo sapiens
gtggagggcccagtccagggagcccaggctttggggagcagtttcaagcctgtgcaggcccctggctcgggtgcccccgc

SEQ ID NO: 6774628 - DNA, 59 bp, Homo sapiens
ggccctctgcctgtgctggcgagtccctccatctcccttatcagacaagcagcagggcc

SEQ ID NO: 6774629 - DNA, 129 bp, Homo sapiens
cattagaattgcctggagaggaatgcaaagcccagatgtctgagccacactccccagtcatttgcagaaactggtctggagtgagggccaggcattggtgtttacagtgtttctcagctgattctaatg

SEQ ID NO: 6774630 - DNA, 73 bp, Homo sapiens
gaaatctatgatgtacagaaagttggcggctagtcctaaaagcttccccacactctttacattcataggtttt

SEQ ID NO: 6774631 - DNA, 68 bp, Homo sapiens
gtgccctgaggtcttcactttgcgatacaaagcccagaggagttcacagggagaggggcctggggcac

SEQ ID NO: 6774632 - DNA, 58 bp, Homo sapiens
cagacttcaactctaaacaacgggctattctggcatcgatgttggaggctggggtctg

SEQ ID NO: 6774633 - DNA, 69 bp, Homo sapiens
ccaaagtcaatacagctcgttagtttttagtgatagggtcagtaaataactcagatgctctgactcagg

SEQ ID NO: 6774634 - DNA, 60 bp, Homo sapiens
tcttgggagctggaggtgacaactgtctgagttgacagcatctcctggcagctgttagga

SEQ ID NO: 6774635 - DNA, 84 bp, Homo sapiens
tattaggttggtgcaaaagtcattgcagcttttgccattgaaaataatggcaaaagctgcaatgacttttgcaccaacctaata

SEQ ID NO: 6774636 - DNA, 58 bp, Homo sapiens
cagctgggtccttttgtcccccacctacagcttcaggtaggggctggggctccagctg

SEQ ID NO: 6774637 - DNA, 63 bp, Homo sapiens
tcacatttctagacttagaactcttaggaaaatgatccataaaaggtctagtttggaaattga

SEQ ID NO: 6774638 - DNA, 106 bp, Homo sapiens
tagcacacacttacagtgtagtccatgcctgagcaggattttgaagtgcaagtagaatcattggttgccaagagtcttctcagttataaacactgcaggattgcta

SEQ ID NO: 6774639 - DNA, 89 bp, Homo sapiens
tgagcttggcaaagccattgcttgttctggcggccagtattcatttgtgggcctgtcctatacaggcggctgctgtgccctgaggttca

SEQ ID NO: 6774640 - DNA, 57 bp, Homo sapiens
gaagctgctggaaggaaatgctttcttctatcatatgtcacctaaaccagcagtttc

SEQ ID NO: 6774641 - DNA, 83 bp, Homo sapiens
caccctgcagacagctccagaggcagtgatgaagtttctgctataggttagccttttattctcttctggagtcttcatgggtg

SEQ ID NO: 6774642 - DNA, 56 bp, Homo sapiens
gtttcctctccggggcctccagggttcccgactcctgccggacctggtggggagac

SEQ ID NO: 6774643 - DNA, 90 bp, Homo sapiens
ggatccaaaggggaatgttttagcttgacttttctaaaataaattccagcaggaaaaaagttaacatgaaatattaagcccagaagattc

SEQ ID NO: 6774644 - DNA, 64 bp, Homo sapiens
gaagcaaatgaaccagaggtaatactaagagatggccttggtattgatccattttatttgtttt

SEQ ID NO: 6774645 - DNA, 68 bp, Homo sapiens
gtatgtgaccttctgaatgagtatcggagttaatctaaagtacatcctactcacctgaaggaatatat

SEQ ID NO: 6774646 - DNA, 104 bp, Homo sapiens
ggcagtgtggtttggcaggccagagaggcagcgtggggtttagggtgtcagagatcccaccactagcccatatggtgcctttgtgagaattcgaaaaaggtgcc

SEQ ID NO: 6774647 - DNA, 98 bp, Homo sapiens
gaggctgcgccgtggaggggaggaggctaagtgggctctggaatcagccagaccccaggtccaggcccaccttggccacttacgaactgtgcagcctc

SEQ ID NO: 6774648 - DNA, 69 bp, Homo sapiens
aggggggagctaggagggaggtctcttctgtctccctatgacctcttcatctctcctggccacccctct

SEQ ID NO: 6774649 - DNA, 99 bp, Homo sapiens
tgcaaagaagagttgtagattgaatgatcactgcagttgatgaggcatttctcattgcctactgcagaaatgattttcctatctaccattgtccatgta

SEQ ID NO: 6774650 - DNA, 77 bp, Homo sapiens
gaatttaaagaggcactcctttttaaggctgaccctgtatttacgggaccctgagagcgagtggcctcatgaaattt

SEQ ID NO: 6774651 - DNA, 67 bp, Homo sapiens
gggctgtctccagggcaggtgcaggtgctgctgagggctggcttcctgtcatggcctggggcggcct

SEQ ID NO: 6774652 - DNA, 57 bp, Homo sapiens
gggtgctgatgttggggtagggccatgctgcaaacgccctctccagctccagtagct

SEQ ID NO: 6774653 - DNA, 71 bp, Homo sapiens
agcctgagcacatccaggacatgggacatttctacctgcccgtcctgttgctacctggagtgtgttaggct

SEQ ID NO: 6774654 - DNA, 73 bp, Homo sapiens
atgaggatttctctgagcctgggacatgcttttgtagtctacaaaggtggaccatgtggctttttatcttcat

SEQ ID NO: 6774655 - DNA, 81 bp, Homo sapiens
tgtggagccctttaagtgactcctgtatgtatgggcagaatatcgatccttgctctgggaccgtcattaaaatttttcaca

SEQ ID NO: 6774656 - DNA, 78 bp, Homo sapiens
caagtagaaggcagagtttgtgtggcgcttggtttgttttgactttaagagttgctaaattcaggtctttgatatttg

SEQ ID NO: 6774657 - DNA, 77 bp, Homo sapiens
tttaactggtctcctgctgcttcccttgtccccacttgctctgttctcaacatggcagccagggtgatccatttaaa

SEQ ID NO: 6774658 - DNA, 62 bp, Homo sapiens
ttctagtaggggtcagatgcatatgaaatagaatagaaaaatgctttcagactcttacagaa

SEQ ID NO: 6774659 - DNA, 60 bp, Homo sapiens
cagcccacgtcagggccactcaaccatgcgctctgggaggagtgggctgagatggggctg

SEQ ID NO: 6774660 - DNA, 71 bp, Homo sapiens
gcttgctcagggcctggcagcctccaaccttcacctatttgaagcctggggtccgtgggtagggggtaggc

SEQ ID NO: 6774661 - DNA, 63 bp, Homo sapiens
attctcttcaaaaactgcaccttgctggcagagttgctacagaatgtggattttgaaaagaat

SEQ ID NO: 6774662 - DNA, 70 bp, Homo sapiens
cacacaaatataataatccttactgaatgagaaaaatgccttttttcttgaaggaagggttctttgtgtg

SEQ ID NO: 6774663 - DNA, 55 bp, Homo sapiens
tcaggtggagacctccttggcctccctagcagccaaggttagagtcttcccctgg

SEQ ID NO: 6774664 - DNA, 69 bp, Homo sapiens
gaagactgtttttcggtgtgaggcatgaggcacgtaagctgtaaagtgctcttcagtggtgagctcttc

SEQ ID NO: 6774665 - DNA, 96 bp, Homo sapiens
gccatctaagacatatctgctggtgcatgtggccttgctctgttgctttataccttcagcttagagaagggaacacatcatctggagtctgatggc

SEQ ID NO: 6774666 - DNA, 58 bp, Homo sapiens
ccagggacagatcacctgttagccaaaaacagatatgttagctaccttgatcccctgg

SEQ ID NO: 6774667 - DNA, 55 bp, Homo sapiens
gaagtccgggaggatcatgttcatggctgcagtgaacaggtcccccacgggcttt

SEQ ID NO: 6774668 - DNA, 58 bp, Homo sapiens
atagatatatgggtttagttctgtactctcaagtcagtgccattgaccctatgtctat

SEQ ID NO: 6774669 - DNA, 86 bp, Homo sapiens
ggcacctgcagctgacagtgaggtgggggctttgcagcaggtgctggggcctccccaaagtgctgacagctacaggaaaaggtgcc

SEQ ID NO: 6774670 - DNA, 65 bp, Homo sapiens
tttttgaaggtacagatattttgtaatgaccatgtgtttttgtgaaacttaatgtatctcagaaa

SEQ ID NO: 6774671 - DNA, 55 bp, Homo sapiens
gggtggcatggagaaggaggcagtgtccgtgactgtgctgctctccgcagccccc

SEQ ID NO: 6774672 - DNA, 67 bp, Homo sapiens
ggaagggcaggcacccaccctcacctgtaaattcaggtctgggggtccgggtgcctgctccgatgcc

SEQ ID NO: 6774673 - DNA, 70 bp, Homo sapiens
gctcccactgtggggtttggctggaacctcaactgcaggtttgggtacaggcttcaggtgcctggggagc

SEQ ID NO: 6774674 - DNA, 84 bp, Homo sapiens
cacttgcaacaaagagaaggcaagctttggatatgagtaaagacaattacatatatttattttcttcttattgagtagcaagtg

SEQ ID NO: 6774675 - DNA, 57 bp, Homo sapiens
ccatcctccctgctccctacctgggccagctgtcagagtcaggatgcaaggggatgg

SEQ ID NO: 6774676 - DNA, 65 bp, Homo sapiens
aggaagaacagataatggacgctggaagccctttcttgcctggcaccggttaatctgttttttct

SEQ ID NO: 6774677 - DNA, 91 bp, Homo sapiens
ccttcttatcctacctataggtacaattacaagacctaaactaatccattatggttcttctcaagagtgctgtaggtggtgactattgagg

SEQ ID NO: 6774678 - DNA, 63 bp, Homo sapiens
ggttcctgtctggggactccctgggtaaccctgtcctgcccatggcttccctaggcacatttc

SEQ ID NO: 6774679 - DNA, 89 bp, Homo sapiens
gcacactgtggagaaccagcactgctctcagactgagaggattccaaacagcttctctggacagcaggtgctgtggctgaatagtgagt

SEQ ID NO: 6774680 - DNA, 55 bp, Homo sapiens
gagccaggagcagagagccctgcatcttgcctggggccccttgtatctctggctc

SEQ ID NO: 6774681 - DNA, 63 bp, Homo sapiens
tttagagcccatgtgagtgtgatcgagtgaaagctctgtgttaatgctccatgggttattaaa

SEQ ID NO: 6774682 - DNA, 68 bp, Homo sapiens
ctcaggttattatgagagctccgatagtggtcaccatgctgaactgtcagggatcatgaaagcttgag

SEQ ID NO: 6774683 - DNA, 62 bp, Homo sapiens
tgtactgtatgccaggcactattttagtattccatgagaaagtaaagcagagttgcagtaca

SEQ ID NO: 6774684 - DNA, 68 bp, Homo sapiens
ccagattaagtcttgtgaactgtttgatctttcatttttcattctgttcagttccacactttatctgg

SEQ ID NO: 6774685 - DNA, 76 bp, Homo sapiens
accccagatcctgtggccaaactaaccttcaaaaatattaccttgtacgtttactttggtcataagcttttggggt

SEQ ID NO: 6774686 - DNA, 66 bp, Homo sapiens
gaaagtaaaggctcactggcttggggtggcactccacgccacctctggtcctgctgcctggctttt

SEQ ID NO: 6774687 - DNA, 66 bp, Homo sapiens
ctgcacagagcggcagttcttatcttcagacttcagtcaagtttcattactgtggtttatgtgtag

SEQ ID NO: 6774688 - DNA, 79 bp, Homo sapiens
atctgctgctcctgaggttggagatccatcaagttgatcttaccttttgttgcgattttctcctctggatgttttagat

SEQ ID NO: 6774689 - DNA, 90 bp, Homo sapiens
ccagcctctgtcgcaacggggtgagagtgttttaaagcaggcgctgcttacgagctattttcactttctggaaacttgtgcaatggttgg

SEQ ID NO: 6774690 - DNA, 64 bp, Homo sapiens
atatacaagtgagaagaagagttctgaagtctaggtttgaatgagctctgcattctcagtatgt

SEQ ID NO: 6774691 - DNA, 70 bp, Homo sapiens
tgggttctcacaggttgggggagttgataagaaacgggattctcagtcatttccctcacctgcaattcca

SEQ ID NO: 6774692 - DNA, 58 bp, Homo sapiens
tcctcccctagactttgtgcaaatgggtcaattggtttgcatgaggccaaggggtgga

SEQ ID NO: 6774693 - DNA, 130 bp, Homo sapiens
ggagagaggtcctttcccctgtactcgcaatttccaggttttgtttggcaacttggtaaagtgaccatttgcttagccagatgtgcctgaacattttggaactctgagtcaagagggcggttcctgcttc

SEQ ID NO: 6774694 - DNA, 70 bp, Homo sapiens
ttgtgtgtttgttcgtgactccaaagactaaatgcagtcttgaatgtcctgtggcaaagtttacacataa

SEQ ID NO: 6774695 - DNA, 60 bp, Homo sapiens
gccatacattttgcctgggcttaaatttaggctaccgtaagccaggagggtgtgatgagc

SEQ ID NO: 6774696 - DNA, 67 bp, Homo sapiens
gatgaaggccactttgtgttgagaactgtagggaaacttgattttcttacccaaagggtattttatc

SEQ ID NO: 6774697 - DNA, 84 bp, Homo sapiens
gagggccagggctctgtcttcagcacacagtaggcacctgtaaatgtttgctcagttgcggcgaagacaagcagtcaggttctt

SEQ ID NO: 6774698 - DNA, 88 bp, Homo sapiens
gcggaatgctcctggtgaaacacaatgatttgtaaaacaactgtggcggggttctcagagattttgtttcccttaggagacatttggc

SEQ ID NO: 6774699 - DNA, 92 bp, Homo sapiens
aggatgtccgagaatggctgtgatgccaggcttctggcaggttccagactccatcacaagcccagcatccctgcaccagatctgacatcgct

SEQ ID NO: 6774700 - DNA, 67 bp, Homo sapiens
tctctcaacattctggttctaaaaacctccagtgactcaggggagctataattagaatgttgtctga

SEQ ID NO: 6774701 - DNA, 60 bp, Homo sapiens
gcactctgcgctgggcgccagcgccctcagccggtcgctcacgtccacgcagcagggcgc

SEQ ID NO: 6774702 - DNA, 63 bp, Homo sapiens
ggtcacacaccaggacctgcagacaacctgggctcctacagcacctgagctcctgtgtggacc

SEQ ID NO: 6774703 - DNA, 118 bp, Homo sapiens
aatactccattcaaacacctcaccctgatgtattgcattaatagatcatcagaagcagttgtcattccagtgatatattagtgcaatacatgagaatgagactcactgatgatgtatt

SEQ ID NO: 6774704 - DNA, 91 bp, Homo sapiens
cacaggccacactttgagcagccagtggttgaagatgcagtctcctcataggatctctcctctgcctctgagcaggcaggtgtggctaatg

SEQ ID NO: 6774705 - DNA, 86 bp, Homo sapiens
acctaggtcacactgtgggaggaacacagccagaacccaaacattctgggtccttcttcactgctttttccagggttgggctaggt

SEQ ID NO: 6774706 - DNA, 66 bp, Homo sapiens
ttctggcagagactggtattagggctcctttaactgaaagcaaattctatttccagtccttcagag

SEQ ID NO: 6774707 - DNA, 61 bp, Homo sapiens
ccctctctgacttctgaacttggcttgccttcctgacaagtacaagagtgaccggggcggg

SEQ ID NO: 6774708 - DNA, 58 bp, Homo sapiens
ccacagaatcatattgtcagtttctggttgacagatgactagatgaacagattctggg

SEQ ID NO: 6774709 - DNA, 78 bp, Homo sapiens
cctctgtcctgggtggtgtttggtgatcagaggcttgccagggatggcagggacgccagggacagcaaggacggcagg

SEQ ID NO: 6774710 - DNA, 67 bp, Homo sapiens
agcgcagctttgtcacggagtgtcggctgacaccgtttctgtttggcactctgctgtgatctgtgct

SEQ ID NO: 6774711 - DNA, 76 bp, Homo sapiens
gctgcttcttgaggttggtatcagtgagatgttttgggattctcacattgctgatatcaatttttgtggaggtggt

SEQ ID NO: 6774712 - DNA, 57 bp, Homo sapiens
gaatatgcaagcttccaggtagatttgagaagttttctatctttagtttgtatactc

SEQ ID NO: 6774713 - DNA, 85 bp, Homo sapiens
ggagtttcactcttgttgcccaggctggagtgtaatggtgtgatctccgctcaccgcaacctctgccgggttcaagtgattctcc

SEQ ID NO: 6774714 - DNA, 66 bp, Homo sapiens
gaggacaggggtggagtggggacatgtgcccgagccaccggggcagctgccactccgcttgccctc

SEQ ID NO: 6774715 - DNA, 62 bp, Homo sapiens
gcagagcaaggatggccggggccgtggcgcctgccagcccgcagccaccctccttctcctgc

SEQ ID NO: 6774716 - DNA, 115 bp, Homo sapiens
gattgtctggtcacttaggcaggtcagtgctgttatttgctcatgtcatgagggctgggtgttcttgaatagatggtgacagtatgaccataattcctaacgtgtccagtcaatt

SEQ ID NO: 6774717 - DNA, 60 bp, Homo sapiens
cctcggagccgcttccgccgctcattggctgaaacacaggagctgggcgaggctccgggg

SEQ ID NO: 6774718 - DNA, 105 bp, Homo sapiens
ctttcagacaataatgctggtcacattaaggaatggttggaatggattttagttttctgtgctagtccatctcttattgatcctaagtgtcacaaagtctgggag

SEQ ID NO: 6774719 - DNA, 57 bp, Homo sapiens
cactgtgaaaaatggagtggtcattctacattgacactttcctgttttttcactgtg

SEQ ID NO: 6774720 - DNA, 66 bp, Homo sapiens
gctgtgattgtcagtcttcaatctcttgtcaaaaagctttcggaatgaactgagaatctgtacagt

SEQ ID NO: 6774721 - DNA, 63 bp, Homo sapiens
ggtccccagtgcctcctaatttgtcaataatcaagaagcgatggaaaaaggcactgtgggacc

SEQ ID NO: 6774722 - DNA, 84 bp, Homo sapiens
aaatgtggaggaaaaatgtatacatgtgtgtctgggaagcatatacacttgtacattttttaatactctgattctgtaacattt

SEQ ID NO: 6774723 - DNA, 119 bp, Homo sapiens
cacaaaaaaagtgtatgagtcctctgttgcttctcagggcctgatgcagtcttagatcatgagtgcccagcctgagaaaggagtttggaggggaaaataacttatttggagaacatgtg

SEQ ID NO: 6774724 - DNA, 122 bp, Homo sapiens
agaaaacaaatcaaagtgatggttattttcttttccaagctgtcttggcccacattgttaccatggtgactcagtgactgccatgacatttggtacagaatgagcatttgtttatgtttttt

SEQ ID NO: 6774725 - DNA, 61 bp, Homo sapiens
gtgctggtggagaaagtggaggtgcctagcagaaatttagggtagcagcacccaccagggc

SEQ ID NO: 6774726 - DNA, 83 bp, Homo sapiens
ctattcaggttctcagtgcagcaaggaatttagaccagtgcttctcaaatttcaatatgcgtatagattacctgaggaactag

SEQ ID NO: 6774727 - DNA, 78 bp, Homo sapiens
ggacatttgtttacggtttgagagctggaacaaggcggcagagcatcgtcctatacagcctcagctgagattttgcac

SEQ ID NO: 6774728 - DNA, 58 bp, Homo sapiens
gcaggtgtgacctgttagcagcctccatttgcagtggctaggtgacaggtgcacttgc

SEQ ID NO: 6774729 - DNA, 62 bp, Homo sapiens
acagggtttggagatcatcagaggttgattccaaatttacctctgccactttctaactctgt

SEQ ID NO: 6774730 - DNA, 57 bp, Homo sapiens
tgagacgaagtcttgctctgttgccaagctggagtgcagtggcacgatttcggctca

SEQ ID NO: 6774731 - DNA, 55 bp, Homo sapiens
acagacaattttactgagccatttgtttatttaggatggcctgctagaagtctgt

SEQ ID NO: 6774732 - DNA, 70 bp, Homo sapiens
aggaaatggctctgggaatctgttgcttggctcctcgtccgtcacccagcaggaacccaggccagatctt

SEQ ID NO: 6774733 - DNA, 101 bp, Homo sapiens
tgaggcaggagacttgcttgaacccagaaggtgcaggctgcagtgagctgagattgtgctactgcacttcaccctgggtgacagagtgagactccatctca

SEQ ID NO: 6774734 - DNA, 72 bp, Homo sapiens
gctcatagggacctggaatctggagttggaatccctgactgggctttccaacctgtgattccaattgtgagc

SEQ ID NO: 6774735 - DNA, 63 bp, Homo sapiens
tatgtaccatgttttgtgcttaatttcaaagctaatgtaactactaggcacagagcatacata

SEQ ID NO: 6774736 - DNA, 58 bp, Homo sapiens
tctgaggacagtgctgtgcctggcctttccccttcaacacgccagctgctccctcaga

SEQ ID NO: 6774737 - DNA, 55 bp, Homo sapiens
acaccagggatatgaggaaggaggcggctgaggccccagactcagaccctggtgt

SEQ ID NO: 6774738 - DNA, 74 bp, Homo sapiens
cctgttgatgagaaagagttgtatctagaacattttctaacgaagcttctgacaatttctttgttctcagctgg

SEQ ID NO: 6774739 - DNA, 59 bp, Homo sapiens
gcattcttcactaggtgagagccaagggtattggcagcaatcaccgcatgaaatgaagc

SEQ ID NO: 6774740 - DNA, 79 bp, Homo sapiens
atctctttcagataagcagcgtggtttggtgcagacacaaacagtagcactgaatcacatgctgctcttttgaagagat

SEQ ID NO: 6774741 - DNA, 80 bp, Homo sapiens
ttgaaggctctttagtcctgtactcatttagattgactctcacttctggtccctttttgtggtgcagactaaagcctcaa

SEQ ID NO: 6774742 - DNA, 63 bp, Homo sapiens
gggcatggcagagtatgagatgtttaattttctggaatagcatcctgtatctcttccacctcc

SEQ ID NO: 6774743 - DNA, 58 bp, Homo sapiens
tatgtatatggtagaagtatgtgtctatgggtacatatatatcttacacatatatgtg

SEQ ID NO: 6774744 - DNA, 60 bp, Homo sapiens
tcacagtgtggcaactcacagaagaagaaaattcatgtagggtgctctggcacattctga

SEQ ID NO: 6774745 - DNA, 122 bp, Homo sapiens
aacgtaactttcactctgtatttatgttggtggtgctctattgtatttttcttgtcattatagctgatgtgtaccattaagatttaagtcagagaattcgcaacaaactgaaagaccctgtt

SEQ ID NO: 6774746 - DNA, 75 bp, Homo sapiens
tattgtgacttttactgagtaaatacagttgattttaattattcagcgcagttacgtttccgtaaaatcacagtg

SEQ ID NO: 6774747 - DNA, 77 bp, Homo sapiens
tttttgtaatttttcatggtatcactgcagataaaacttaaaagatctttatgcggtgtatctgttaagtataaaaa

SEQ ID NO: 6774748 - DNA, 64 bp, Homo sapiens
actctgtactctagaggaagtggtcagtagagatcagttgagagttacatttctaagacagagt

SEQ ID NO: 6774749 - DNA, 108 bp, Homo sapiens
ggagaacacttgatttatctggtacagagtggagttcagtaaatatttgttaaatgaatgactgatttattttgcatttaggaaaagagaagaatcaggcatacctct

SEQ ID NO: 6774750 - DNA, 129 bp, Homo sapiens
agcatcagcattgttggaaatgttagagaggaaatcttaggccccaacctggacttatcaaatcagaaactgtggggtgggtctgatgtatctagcctttaacaaacctttcagatgattctgatgctt

SEQ ID NO: 6774751 - DNA, 55 bp, Homo sapiens
ggatggaaggcatttcacacaggatgagcaattatttgtgttgtgttttaccacc

SEQ ID NO: 6774752 - DNA, 109 bp, Homo sapiens
attcctgcatttctctggagttttgaccatttgaaatgagaaacctgtcagatgatgctgagtattctgaatttcaaactctattagatttccaggggagtgcagtaat

SEQ ID NO: 6774753 - DNA, 58 bp, Homo sapiens
gctgccaggccctggggctatggcactgcgtgaccctgcaagtcctacctggcgaagc

SEQ ID NO: 6774754 - DNA, 60 bp, Homo sapiens
gaattgggagaagtagctggtttacttgtatgcttatttaacttgtatttctccttattc

SEQ ID NO: 6774755 - DNA, 57 bp, Homo sapiens
tgtgagatcagtgcatcagtcaaagcaactcagtggcttcctaaactgatttccaca

SEQ ID NO: 6774756 - DNA, 67 bp, Homo sapiens
gggcgctcacctgcctgcaaatgccgaaggccaggcggctaggctcggaagcagcagggagccgccc

SEQ ID NO: 6774757 - DNA, 61 bp, Homo sapiens
tttgtaagttctatggaagtctatatggcaaactgtgtagtccagaaactgagcttataag

SEQ ID NO: 6774758 - DNA, 61 bp, Homo sapiens
gaacttagtttttctctgaccctgttgaatcacagttcaacaatagagataaagtgagatc

SEQ ID NO: 6774759 - DNA, 75 bp, Homo sapiens
cctttcaatatacagagactttatggcacaaaatatagtttgttttggtaatatctctgtgcgcacttgaaaagg

SEQ ID NO: 6774760 - DNA, 129 bp, Homo sapiens
tagtagatttgcataggaattaaaaacaattggtgttctttccatttgctccctgatggcaattttatccttggtcataattgtacagatgaggtaagtgagaatccaaatatccctatgatcctgtta

SEQ ID NO: 6774761 - DNA, 67 bp, Homo sapiens
gggcggccacctgccaacttgctggaagttaagaaagggcatttctgagggaggcaggaggcggctc

SEQ ID NO: 6774762 - DNA, 55 bp, Homo sapiens
ctgtgccctctttgctggccttacagctccaggtaaggtcacagtggtgggccag

SEQ ID NO: 6774763 - DNA, 56 bp, Homo sapiens
tcaacactctttggcacagttacacggccaaagtgattaggtgctaagagtgtgga

SEQ ID NO: 6774764 - DNA, 88 bp, Homo sapiens
cttatttttctctctgtagtcctcatgcctgctacagtagctgccccacagcagacaccttgtaggtgtgtacagaatggagaacgag

SEQ ID NO: 6774765 - DNA, 99 bp, Homo sapiens
ggctgaatgtcagaagccctggggatatcaaacccactgttctggggtgagagctctgcagcagcagacatttgatcttccctgtttccttggccagcc

SEQ ID NO: 6774766 - DNA, 76 bp, Homo sapiens
gcttaagataacacccatttacatgtcacacctctgtaggtcagaagtgtgggcaaagggtagctgggttcttagc

SEQ ID NO: 6774767 - DNA, 92 bp, Homo sapiens
ggccagagtatgagcacagggacaatcttacttttgaaaagtgaaaggcaagcttttacttaagattattcctgatgaaataccctagggcc

SEQ ID NO: 6774768 - DNA, 64 bp, Homo sapiens
tagagagatgtatgcatttgtcacaaatcagctcctgcatgtgttagatttgtgcatttcactg

SEQ ID NO: 6774769 - DNA, 79 bp, Homo sapiens
gtgcttaatgtgcttctgcttttctctgtctgagtggtcctttgacagctttgatggtcaaggcagaggcagaaggtac

SEQ ID NO: 6774770 - DNA, 88 bp, Homo sapiens
gcaagtcaagcttctctccatctgcttcctccttagggaaaatctaatgctaaaatgactttctaaggggaggaagcacagctgctgt

SEQ ID NO: 6774771 - DNA, 107 bp, Homo sapiens
ctgggttggttccaagtctttgctattgtgaatagtgccgcaataaacatatgtgtgcatgtgtctttatagcagcatgatttatagtccattgggtatatacccag

SEQ ID NO: 6774772 - DNA, 76 bp, Homo sapiens
acacaggaattagaagaacatgtcaaactataaactgcttgtgattgtgaatggctttgttctttgcttcttgtgt

SEQ ID NO: 6774773 - DNA, 85 bp, Homo sapiens
aggacagatttcagagattgaagttctgatattttcttggcaataagatcaaagttatgaactacatgatcctgaaattcttcct

SEQ ID NO: 6774774 - DNA, 58 bp, Homo sapiens
cacattcatggagtttgcctgtcagcaatgtgatgtcaacaggtaaatatgaatagtg

SEQ ID NO: 6774775 - DNA, 70 bp, Homo sapiens
caggcagtggaaactatgctgctggattgtcatactgcaccactgtccagcaggcatgtttccttgcatg

SEQ ID NO: 6774776 - DNA, 76 bp, Homo sapiens
agtattgagggcagtgatgtcaaacagtgaataaagttatatatctatgtggtgatcttattttaacctcaatatt

SEQ ID NO: 6774777 - DNA, 91 bp, Homo sapiens
tattcactatgatttgggcatctaatttggcttcatttgttctgcttcaggtaatgccaatttaatgatccatttatgtaaccgtagaata

SEQ ID NO: 6774778 - DNA, 60 bp, Homo sapiens
gcatgcagggagggtctggctgttctctagcctcaccgaggcctttcactgcatctcagc

SEQ ID NO: 6774779 - DNA, 89 bp, Homo sapiens
tgcctggtgtttagcaaggggaggtggagtgtggtcctcccccaggagaggcagcaggcgacttccctattgaaaacacagctgtggca

SEQ ID NO: 6774780 - DNA, 102 bp, Homo sapiens
gtatctccctccagatatttgttaattatgaggcatacccccatattgattaattgcaaatggaaaaatagtagctttatagtgaataaacctggcagatac

SEQ ID NO: 6774781 - DNA, 62 bp, Homo sapiens
aaggaagaatcatcacgttgggacacaaatccgagtcctgtctgtcctttgcattcttcctt

SEQ ID NO: 6774782 - DNA, 72 bp, Homo sapiens
tacaggggaagagtactgggcttggagacagactgtctgagttcaagtcctgagccacatactatccatgtg

SEQ ID NO: 6774783 - DNA, 67 bp, Homo sapiens
aggaagtgcggaaggtcagaggccgggctcagctgaccgcctggtccctggacctccctggacccct

SEQ ID NO: 6774784 - DNA, 81 bp, Homo sapiens
tggttgtatattactaccatctgctactattagtaacagtaccagtactagcagtagtgatagtagtagtaagaataatca

SEQ ID NO: 6774785 - DNA, 68 bp, Homo sapiens
tggcgacatctcagccaaaagacccggcagacaccatcttggccaagggatcgaggttggcatcgcca

SEQ ID NO: 6774786 - DNA, 90 bp, Homo sapiens
gttatgaagagagacatattggcttgctttaatttacttatttatgaaattaaagcatgaataatatgtataatttgaattttttgtgac

SEQ ID NO: 6774787 - DNA, 60 bp, Homo sapiens
cccgtagctctttgccatttcttagctagaaggccagctttcagttacaggcactgtggg

SEQ ID NO: 6774788 - DNA, 67 bp, Homo sapiens
agaagctataacaacaattatagacacattattatcaacgtggtatgtaatatttgttaaggtttct

SEQ ID NO: 6774789 - DNA, 64 bp, Homo sapiens
cctggctgcattttgctggatgtattggagtagaatgaggatggattcaaggacagcagtgagg

SEQ ID NO: 6774790 - DNA, 76 bp, Homo sapiens
aagcctaattgtgactatttctgaaggcagagaacacagaatcagttctcttaattttggaatagtgttaaggttt

SEQ ID NO: 6774791 - DNA, 93 bp, Homo sapiens
gagaggaagggggagaaccaggaatgccaaccagtgcatggtttaagttaactctaatgccacttagcttcaacgttttccacccttcctttt

SEQ ID NO: 6774792 - DNA, 69 bp, Homo sapiens
ttttgtaacactgtcttatacttcaatgtagtacaatctatttggggctagaggtacatgtttacaaaa

SEQ ID NO: 6774793 - DNA, 55 bp, Homo sapiens
agctctccatctatctgtgatgacagactcattaaagaataagatggagttggct

SEQ ID NO: 6774794 - DNA, 55 bp, Homo sapiens
ccagaggctgatggctgtagccatgctgagctgatggctggagcagaggctctgg

SEQ ID NO: 6774795 - DNA, 67 bp, Homo sapiens
tgtaacctgcaggtccccggatgcgcaccccaacggcgcctgcgcctacgggggcctcagccttgca

SEQ ID NO: 6774796 - DNA, 79 bp, Homo sapiens
tgtgttcaggctgacttggagagagaggccgatgctttaagacctaaagttctcatgaggtagtctgaaatgaaacaca

SEQ ID NO: 6774797 - DNA, 58 bp, Homo sapiens
gacccagaggcctgacagtgtggttgtgtaaaattgtcggtgtcggtgtcttgggctc

SEQ ID NO: 6774798 - DNA, 57 bp, Homo sapiens
gcctcttctgaaaaatatcagccaatctggtcacactgggctgaaatttttcatggc

SEQ ID NO: 6774799 - DNA, 75 bp, Homo sapiens
tgaatagcatgacctgactttagcatgaagtgagtttaaaactgtgatgctgaccaagcaggacatggttattta

SEQ ID NO: 6774800 - DNA, 77 bp, Homo sapiens
tttggagtccttttagtctcctctaagtagaagacacttatttgaggaagatcggagggaaactgcataactttgaa

SEQ ID NO: 6774801 - DNA, 69 bp, Homo sapiens
gctacctctcggcaggaacccagacaaccagggtgcctgcatcactctgtgtggttttctgtaggaagc

SEQ ID NO: 6774802 - DNA, 56 bp, Homo sapiens
gcacagttttatcttatactgatgcagacagcatggttgcctgagataagactggc

SEQ ID NO: 6774803 - DNA, 57 bp, Homo sapiens
cacatgctgtgaaaagaatttcaacactaaacagtgcctgtgcctctatagcatgtg

SEQ ID NO: 6774804 - DNA, 62 bp, Homo sapiens
ggggtaaggagctcggcagggccttcagggataagctgctggctttgatgctgccttgctcc

SEQ ID NO: 6774805 - DNA, 74 bp, Homo sapiens
gcaggtgaaatcagttaagatgaggccatactagagtagggtgggccctaaatctaatgactgattgtacttgt

SEQ ID NO: 6774806 - DNA, 99 bp, Homo sapiens
cagtgcagggaggctgggggtcctggaggccagctggagcaggtatcgcccagtcaccccctcctacttccttccactccccacgcctgagcctcgctg

SEQ ID NO: 6774807 - DNA, 61 bp, Homo sapiens
tgggggctttatagggtagaggatcagttcatataacttggctataccctgtgggtcctta

SEQ ID NO: 6774808 - DNA, 70 bp, Homo sapiens
agacaaatggactgtgatatttacatgtacacagtacagggaaacatgtaactatctgagccatgggtct

SEQ ID NO: 6774809 - DNA, 119 bp, Homo sapiens
ggccctcaagcaggttcatgatgcagtgatatttttgcagacacctgggccatgcttcagctataatgcaccatttccagatgtttgaagaataccattggcagcatcctttgagagtc

SEQ ID NO: 6774810 - DNA, 55 bp, Homo sapiens
gctgagttgaaagcagaggataaagattttgtttatcgctttgtgctcaactagc

SEQ ID NO: 6774811 - DNA, 69 bp, Homo sapiens
acacccactggcccataaaggcctgggagccacgccagcacccaaggccttcaagccagctcagggtgt

SEQ ID NO: 6774812 - DNA, 55 bp, Homo sapiens
ggaggtgctgatcccagtcaacgaaaaactttcaacacggcgaagaagcatctcc

SEQ ID NO: 6774813 - DNA, 57 bp, Homo sapiens
taggagtattctaggactgcctgagggctgcctgagcacctactagaatgctaacta

SEQ ID NO: 6774814 - DNA, 62 bp, Homo sapiens
attgtgtaattttcagctcatacgtggtgagccatatttctgggcttttaaattttcacagt

SEQ ID NO: 6774815 - DNA, 57 bp, Homo sapiens
gcaaaagtacagccggatttctgtttccctacagaaattggaaagccatatttttgc

SEQ ID NO: 6774816 - DNA, 84 bp, Homo sapiens
gcaatgaaggaaggactggcacagccactgcaggcagggagcttatctgccattgcccgcggcagtgccagaatcctacaatgc

SEQ ID NO: 6774817 - DNA, 84 bp, Homo sapiens
aattcccacttagaactacaagcattaaaagtcacagtatctaagacaagtgagcttttagctcctggttgcaataggggaatt

SEQ ID NO: 6774818 - DNA, 59 bp, Homo sapiens
tggcaaagtgactcttgagcatgggtgggggaagcccccacatgtctgagtcagtgcca

SEQ ID NO: 6774819 - DNA, 70 bp, Homo sapiens
tccttttgctggtgatttctcatgacccccatgctttgagctgagagtttgagcaaatcatacaaaggga

SEQ ID NO: 6774820 - DNA, 64 bp, Homo sapiens
gatgaagtggaccctggacagaccccggcaggaagtggaaggtttttctctgggtcccttcatc

SEQ ID NO: 6774821 - DNA, 98 bp, Homo sapiens
ctatttagtatttacagagcagctttattaatgattgtcttgcagaaagtcaaggcaggaaggtcttttaataaagcacacatgaaaataacgggaag

SEQ ID NO: 6774822 - DNA, 61 bp, Homo sapiens
ccaggcccccgagcagaagacaaacaacaggaacagagtttggcttttgtactgggcctgg

SEQ ID NO: 6774823 - DNA, 78 bp, Homo sapiens
gcttactctgtgctaggcaatgtggtagatatttgaaatacaaacgtgaaccaggcacatttcctacacatggcaagc

SEQ ID NO: 6774824 - DNA, 55 bp, Homo sapiens
gatggccacatacatggctggggtgttgaaggtctcaaacatgatctgggtcatc

SEQ ID NO: 6774825 - DNA, 92 bp, Homo sapiens
gcctctctgcatctgcgtgtccagcctctcctgcgtgccagaagttcccaggcaggagtgtggtgggacatccggctggggtaaggacaggc

SEQ ID NO: 6774826 - DNA, 61 bp, Homo sapiens
attccacatgaaaggagctgaagctaatagcccatctccagtctctcttagtttgtggaat

SEQ ID NO: 6774827 - DNA, 120 bp, Homo sapiens
ttgctaaacgaaaaggtgaggtgctgtaatgagtgtcacatgtggagtcagtctagtgagcgactgtttccagctttctgatgcttggggaagcagtactgttcctgaacttcccagcag

SEQ ID NO: 6774828 - DNA, 55 bp, Homo sapiens
ctgaatgaactaaatcatagttctgctgaatagaactgaaaatagttcagttcag

SEQ ID NO: 6774829 - DNA, 76 bp, Homo sapiens
tacctggccagcggtcggtcacacctgagtgcccagagtgagcgggcggcagaggcatttctgacgctgccaggta

SEQ ID NO: 6774830 - DNA, 87 bp, Homo sapiens
gcagttttaaagtctactaattttattctatgtgtttaaaaaaattgatatgtgaatggcagttggatagcactctaaaaagctagc

SEQ ID NO: 6774831 - DNA, 59 bp, Homo sapiens
tgtatttgtgataacgacctgaatttttgtaggtacaggttacttaagtcagaaataca

SEQ ID NO: 6774832 - DNA, 76 bp, Homo sapiens
cactgagaaggcaggagaggagaaattcagagggaggagtcctccagcagcctgacttccctcttgactctcagtg

SEQ ID NO: 6774833 - DNA, 75 bp, Homo sapiens
tgggggtcaggctatgccatgtgagccctgctgcattctacatgcctcccagccactggcaaagcctgttcctta

SEQ ID NO: 6774834 - DNA, 63 bp, Homo sapiens
gcaagattttgttattctcatggcacatgtagtgtggcatgtaccatgtgactggagtcttgc

SEQ ID NO: 6774835 - DNA, 58 bp, Homo sapiens
agggtcagctttatttcacgtgtttgttgctacgagggcctctggttaaggtgatcct

SEQ ID NO: 6774836 - DNA, 67 bp, Homo sapiens
cactgtgagcagctcctttgaatgctgggaagttcttggcaagtttccaaggggatgtctccaagtg

SEQ ID NO: 6774837 - DNA, 61 bp, Homo sapiens
ccccacctgcggaaccagccagctgcccctggggcctttgcagctggcccacaggtgtggg

SEQ ID NO: 6774838 - DNA, 57 bp, Homo sapiens
cctcttccctccctttgtccttcagtcacatgtcttacttaaaggaagtgggagagg

SEQ ID NO: 6774839 - DNA, 88 bp, Homo sapiens
cagagcaactacatgaagttgtctaaactggcctgttttaacctaatattccctcaagccagacctaaccagcttttgtacaagcctg

SEQ ID NO: 6774840 - DNA, 85 bp, Homo sapiens
ggtaatcttgaatatagcgtgccttgaaaaattatagaaacaagctgtataaattttcgagggccttaagtattccataataacc

SEQ ID NO: 6774841 - DNA, 57 bp, Homo sapiens
cccatctccaaatacagtcatcttgggagtaaggcctcaacatatgactttggtggg

SEQ ID NO: 6774842 - DNA, 55 bp, Homo sapiens
acgtagcccatggctcagtattttctgctcaaatgctggctcctcgaggcttcgt

SEQ ID NO: 6774843 - DNA, 124 bp, Homo sapiens
tatagtagtaggttcagaaactcaggctaaggaaagcatccagaaaacattgtctgcctctgcaacagtttgtggatagcttgtaattgtagttctgatcttgtcaatctgtcttataactcta

SEQ ID NO: 6774844 - DNA, 65 bp, Homo sapiens
ttgtatgagctccaggaactcaagcctcaatttctgtatctgtgcatttgttcccagctctgcaa

SEQ ID NO: 6774845 - DNA, 59 bp, Homo sapiens
gctggctcttcagtggagataggtttgttacctgactcatatttgttgagcttatcagt

SEQ ID NO: 6774846 - DNA, 65 bp, Homo sapiens
gttattacatttctgagcagggagctgttcattagaatgaacactgaatcagaaattgttggaac

SEQ ID NO: 6774847 - DNA, 74 bp, Homo sapiens
gggctttgcaacctgtggccatgcctccccacagtctccttgcgctcagggaggcagagccaaggtcaaaaccc

SEQ ID NO: 6774848 - DNA, 62 bp, Homo sapiens
gcaggctgagttgggaaaccaagcaaatcccatgcttcctggcttgcccaaatcctgcctgc

SEQ ID NO: 6774849 - DNA, 56 bp, Homo sapiens
ggtgggcagagccagttcatgaaggatttaccatttctgagctgctgctgcccatc

SEQ ID NO: 6774850 - DNA, 91 bp, Homo sapiens
gcagacgctctgggaaggcagccagttcaggtttctttttcttcagggaaaccagacctgtctttggctgaaagtctctctggtgtgctgc

SEQ ID NO: 6774851 - DNA, 89 bp, Homo sapiens
ctccaggataaagtgccacagctggatctgcctcgagccaggggatgactctggcttgtaggcccaatccgggaaggcaaaccctgggg

SEQ ID NO: 6774852 - DNA, 61 bp, Homo sapiens
gacagcagcttgcgtgtctggtctttcctccttaaaaggctcagaaactaaaggcgctgtt

SEQ ID NO: 6774853 - DNA, 65 bp, Homo sapiens
cctgaactctaaatagagcagtgaactcaaagtcaaagcattcaggttttattcgtaggttcagg

SEQ ID NO: 6774854 - DNA, 77 bp, Homo sapiens
gctgtagagggccgaggcttataggtgcttccagggggacacggaccctggaatgagcagggcttatggtagacagc

SEQ ID NO: 6774855 - DNA, 84 bp, Homo sapiens
gggggagtgggtggtagggtgggccgaagctcaagacagataatggccttgtagatctgcaaccctcagatcacccacacctct

SEQ ID NO: 6774856 - DNA, 69 bp, Homo sapiens
atggtcccaggaagacaactgggggcaagctatcatggaaaagctccacctgttttcaagtgggattat

SEQ ID NO: 6774857 - DNA, 65 bp, Homo sapiens
gcagtaactgtcatgtgatatgaaaacatctttgattctgttagagacaaaatcatatgtactgc

SEQ ID NO: 6774858 - DNA, 65 bp, Homo sapiens
ccagtggccatgcacgagcagcaacttcttgagatgcttaaagcgggtgatggcaaagtcgctgg

SEQ ID NO: 6774859 - DNA, 77 bp, Homo sapiens
ggatttgtcttcttgtgttgcctgtcttggtcatcactgttcatccacttgcccaagctgagatcaagaagacctcc

SEQ ID NO: 6774860 - DNA, 56 bp, Homo sapiens
gctcctcaccagcagcctcaccttcctctggtggaaatgagaaggcagtggggagc

SEQ ID NO: 6774861 - DNA, 58 bp, Homo sapiens
ctcatgcattcatggtttctgtttctccaatttgattcaaggagccttgagcagtgag

SEQ ID NO: 6774862 - DNA, 75 bp, Homo sapiens
gcacagtgagttactctggttctcatttagacacactaaattctaaataccacatgcatagctcattttatgtgc

SEQ ID NO: 6774863 - DNA, 91 bp, Homo sapiens
gttgttctgtttctagtttaggatccaatctaagatcccacgtttagtttttatatctctagtctcctttaacctgaaacagtttctcagc

SEQ ID NO: 6774864 - DNA, 88 bp, Homo sapiens
ccctgctctgagctctataaagctgcgtcttcagagtcccctggttctgctaagtccaagggctccaagaggtagctgggcagcaggg

SEQ ID NO: 6774865 - DNA, 56 bp, Homo sapiens
gtgagatgtttgtgctttgttaatgccgtgttaaacgacagctacaggcatcccac

SEQ ID NO: 6774866 - DNA, 72 bp, Homo sapiens
gtctaaatgtggttgatatctctgtttaagagctcatcttgctttaggaaaatgagcctcagctacattgat

SEQ ID NO: 6774867 - DNA, 85 bp, Homo sapiens
tggagagatttggattccagaataccggcaagatgtatttttttagagcttttgtttcactctattttggaactcatttctgcca

SEQ ID NO: 6774868 - DNA, 74 bp, Homo sapiens
ggacttggcactggcccttgaatctatttatctttcaaaaaaccggaagatagtttaaggaactatgcgattcc

SEQ ID NO: 6774869 - DNA, 69 bp, Homo sapiens
agtaatacaagttgtgataatgtaaaatatatgtctaatttatgccttttaattgtcacatttgttgct

SEQ ID NO: 6774870 - DNA, 82 bp, Homo sapiens
acaatcagatttttatttcaaatggatccctcagcctgtaatctggtgggaagacagggacagaccattgagatgtgattgt

SEQ ID NO: 6774871 - DNA, 115 bp, Homo sapiens
ttcatagagcagggttatctgcattttggtgtcttctggcatggatttgagtgtctttaccttttggtcaggcacgtctatgcttaggtctctgcctgcctttctgctggatgaa

SEQ ID NO: 6774872 - DNA, 70 bp, Homo sapiens
tagctgtaacacagctaataacactctccaagctgtaacacagcacagtctcctagctgtgtttcagcta

SEQ ID NO: 6774873 - DNA, 59 bp, Homo sapiens
ttaagcatcacagatggcactttatagacagctatttttgtgtacgtgtgggtgtttaa

SEQ ID NO: 6774874 - DNA, 82 bp, Homo sapiens
tcatagttatttagtaatatgaattattgttacaagtcattgtcttgtacgagtaacatgaattcatgaagatgatgcttgg

SEQ ID NO: 6774875 - DNA, 97 bp, Homo sapiens
tttttgaaacagaattggtcagtagagaggaagaggatttgcaaggggtatttacaagtcacttcctttctaaatgttggatctcagaattcagaga

SEQ ID NO: 6774876 - DNA, 59 bp, Homo sapiens
catgtgtctggttattgacatgctgttggccagagagacaggagttcccaggccacatg

SEQ ID NO: 6774877 - DNA, 77 bp, Homo sapiens
acaccagtgttggccttctgtactctggctgcagactgaccttgctcaggtgagactttagaagagccagcctgggt

SEQ ID NO: 6774878 - DNA, 92 bp, Homo sapiens
tttctgagtgtgtccaaaactgttgataataccccctttcccatggctctcaggaggtcttactggaatttttaggacattcgactcagaaa

SEQ ID NO: 6774879 - DNA, 91 bp, Homo sapiens
gtttaccctgaggactcttgctgggccagaagacatttaggatgctctgacttagctcttaaggagtctggttgggaagagttatttaagc

SEQ ID NO: 6774880 - DNA, 68 bp, Homo sapiens
ctggagggggtgtttagggaggggttataactgcccagtagtagccattttcccaataatctttccag

SEQ ID NO: 6774881 - DNA, 63 bp, Homo sapiens
agctttggagctgggtgaaagagctggtcttaaccatggaatctggagcccgtctcttaagct

SEQ ID NO: 6774882 - DNA, 58 bp, Homo sapiens
tcatagatgtgctgtgcacaaacgagagatgcttggtataaagcacacacatcaatga

SEQ ID NO: 6774883 - DNA, 69 bp, Homo sapiens
actgttgttgatcagacagcacttctttatctctttaagttttaagtgctgtttctgatgaatgccagt

SEQ ID NO: 6774884 - DNA, 62 bp, Homo sapiens
cctctgcataatggatgatttcacaagcggtgtgcttgagatcagcatctgttgtcaccagg

SEQ ID NO: 6774885 - DNA, 58 bp, Homo sapiens
tgttggtttgcttggattgagtcactgctctatgtgactttgtgcaagtgaattatta

SEQ ID NO: 6774886 - DNA, 60 bp, Homo sapiens
cgtgccgggcgtctcccaggctcagggtcttgctcagggccaggctgatggcctggcatg

SEQ ID NO: 6774887 - DNA, 78 bp, Homo sapiens
cagttcttttgagtatatacccagaagtggaattgctggatcatatgctaattctatttttaaatgtttgaggaactg

SEQ ID NO: 6774888 - DNA, 55 bp, Homo sapiens
gcggaggttttcttgctcacttttgttgttagtgagctcttaagctgatctctgt

SEQ ID NO: 6774889 - DNA, 82 bp, Homo sapiens
tactcatgcctggagacttagctgagattaagtgaacttctccaagtggaaattctcttctcagtggtctctcagccttgta

SEQ ID NO: 6774890 - DNA, 81 bp, Homo sapiens
agggaggtgttttgggcgaccgggggcaggaccctggctctctcagcccctggagccagctgcggtctcccaaagttccct

SEQ ID NO: 6774891 - DNA, 57 bp, Homo sapiens
agcagaaacagccagtctggactcttctccgtccccgagccagatggccagtctgct

SEQ ID NO: 6774892 - DNA, 102 bp, Homo sapiens
gggcggagcgccagcggcgcccggggctacgcgccgcactgcaccgagcggcggcagcggcaagcttgggtgtgagcccgggagccgctttgcttaccgtcc

SEQ ID NO: 6774893 - DNA, 70 bp, Homo sapiens
ggcaaatgaatctagggagaggaagcatgagttatttaatgtcagttactcctttccttaggtttttgcc

SEQ ID NO: 6774894 - DNA, 61 bp, Homo sapiens
tggctaagctgaggagaggatgccctcattttgcaaagagacgcttctcccatcttggcca

SEQ ID NO: 6774895 - DNA, 87 bp, Homo sapiens
gagatagaggctgccttgtgagccagcacccaccgtagtttgctgactcagaatctaggcagggtgctgtgccatggtttctgtctc

SEQ ID NO: 6774896 - DNA, 98 bp, Homo sapiens
cccaatcatactgggtgtttaaaccatttcctgacaatctttaaatttgcaaattagaaatgtcaatgctggtcttgaatgagcccgataaggatggg

SEQ ID NO: 6774897 - DNA, 59 bp, Homo sapiens
atatcacaggtgtttacctgatcttgcctacatcatttcattgtaattatctgtggtat

SEQ ID NO: 6774898 - DNA, 55 bp, Homo sapiens
gtgatcctcctgcctcagcctcccaaagtgctggcattacaggagagaacctcac

SEQ ID NO: 6774899 - DNA, 77 bp, Homo sapiens
gttgataatactgaaggccctggagtttctggacaatagtgtcattgtctgggagggacagggctacaattatctac

SEQ ID NO: 6774900 - DNA, 75 bp, Homo sapiens
atgccctgctttcaggagaggattataacatctctggttgagaactctgtgatgtgactctccttgctggtgcat

SEQ ID NO: 6774901 - DNA, 74 bp, Homo sapiens
ggaattgacagcagcagtgtctgaatctcccacactctttagaggttaggagaagagactgtcactgcagtacc

SEQ ID NO: 6774902 - DNA, 74 bp, Homo sapiens
gaggaagggtcagggtctgtaggggaaggtctggatttgggtcctggctctctacaaaccagacataaaacctt

SEQ ID NO: 6774903 - DNA, 77 bp, Homo sapiens
tgaacttcctgtatttacatcttagtctacccagtgattcccactggaatgtaaactctgtgagggtggggagctca

SEQ ID NO: 6774904 - DNA, 88 bp, Homo sapiens
ctgcctccctgctcctggctgcgtctgctctgacagttctcctccttgagcctctgcacagagcagggcagacactaaagggtggtgg

SEQ ID NO: 6774905 - DNA, 77 bp, Homo sapiens
atattttgggatgagtgaaactatgctataaaatatcagaatttgcacgggcataggtcactaaatcagcaaaatat

SEQ ID NO: 6774906 - DNA, 101 bp, Homo sapiens
gcccacctcggcctcccaaagtgctggaattacaggtgtgagccaccacgcctggcctccttccacttctgttctttgggtttaggctggtggtaaagggc

SEQ ID NO: 6774907 - DNA, 55 bp, Homo sapiens
acttggaatattgcgtttttgctattcttatgggaaaatgctttaaattctaagt

SEQ ID NO: 6774908 - DNA, 62 bp, Homo sapiens
gaaggaattctgagcttagattgcttgcttcttttagcttgaatacagtgaagaatttcttt

SEQ ID NO: 6774909 - DNA, 67 bp, Homo sapiens
gtggtactctaagagccaagactgtcactcaggtttcctgactcccatcttgcagctcctgtaccat

SEQ ID NO: 6774910 - DNA, 76 bp, Homo sapiens
tcctgaaaatcccaggtgtcctggagttggtactgtcagcatcttcaaacatccccaccagggactttctataggg

SEQ ID NO: 6774911 - DNA, 69 bp, Homo sapiens
aaaacatgctggatttagaatataaccaacaacctaactaggtcatgagatgttctgagtcaatgtttt

SEQ ID NO: 6774912 - DNA, 70 bp, Homo sapiens
cccagaatctcagggctctgggagcactcaggctgcattggccagaactatccctgccctggtgactggg

SEQ ID NO: 6774913 - DNA, 66 bp, Homo sapiens
tggagtgatgctggggacacagtggtggccaagacagccctaggccctgcccttagcacactcaca

SEQ ID NO: 6774914 - DNA, 86 bp, Homo sapiens
ggttccttttagtggaatccagagtttaattgctggaatctgggtaaggtttagtgtttcaagactctttccctaagactagagcc

SEQ ID NO: 6774915 - DNA, 61 bp, Homo sapiens
aggcagctcttcacagggcggcaggagggagagtgatactgagcaaagggggaagctgctt

SEQ ID NO: 6774916 - DNA, 100 bp, Homo sapiens
ttttatttacaggtgtcatccaacaggacagggttgatgacctgttcaacagcttgaaacgttgattccctgtcacaatggatgacatttgtaagtaaag

SEQ ID NO: 6774917 - DNA, 71 bp, Homo sapiens
ggaactggggttatatcaggacgctatgttgcaaccttataatgacatggcctcccctaacagcctcttcc

SEQ ID NO: 6774918 - DNA, 69 bp, Homo sapiens
aagacaacatgacatagtagaaaagcccttgtttgtcaatcaggaagcctgggctctactctcagtctt

SEQ ID NO: 6774919 - DNA, 70 bp, Homo sapiens
cccccattttctcacctctcagatgggtgtcataaaccatcggtttgtcttgaggctggggaagtggggg

SEQ ID NO: 6774920 - DNA, 74 bp, Homo sapiens
cactaagtctcttagatgtggacctgcagctccggctgtttactcaatcaagggttcatactgagagacaagtg

SEQ ID NO: 6774921 - DNA, 65 bp, Homo sapiens
gtcttgactttgatgaagctggatctaaattacaaatttgagaatcagctgcacagaggtaagat

SEQ ID NO: 6774922 - DNA, 74 bp, Homo sapiens
aagacatccctcagggtgcagttgcttttgatgaaggatagcatcgttagggcggcatcactcgggggctgctt

SEQ ID NO: 6774923 - DNA, 63 bp, Homo sapiens
gtggcttcggcattgctacacccattgtgcatttttatgtgggaagtggggatttgaagtcat

SEQ ID NO: 6774924 - DNA, 109 bp, Homo sapiens
ctgcaacatgccctctgtcataaattcgtgaatatattaaaaagggttgggcagagcagcaatttcactaataatatttactgctttggggatggagaggagattgtag

SEQ ID NO: 6774925 - DNA, 70 bp, Homo sapiens
gcctcagaaaggttagaaaccacccggctagtatgtggtggggccagggctccaacctctcctatgtggc

SEQ ID NO: 6774926 - DNA, 70 bp, Homo sapiens
gtctaacatgctcctctattccccacatttttgataaattgaaagtggggtctagagggcctgataagat

SEQ ID NO: 6774927 - DNA, 79 bp, Homo sapiens
accgtgcatggggtatcagagaaattgatgtgttcagttgaaagtagtttctctttgacaccaaaatcataagcacggt

SEQ ID NO: 6774928 - DNA, 94 bp, Homo sapiens
ggagatctgatcatggctgggctcatttgtgtgtctgggaatctgccagggatcagaccatctaggctgggctcagcagggttggttcatctct

SEQ ID NO: 6774929 - DNA, 71 bp, Homo sapiens
ctcctcacttcccagacggggtggcagccgggcagaggctgcaatctcggcactttgggaggccaaggcag

SEQ ID NO: 6774930 - DNA, 62 bp, Homo sapiens
ttggccagtgtcggaggccaggagggctggaaggaagagttctggaagaggacattggccag

SEQ ID NO: 6774931 - DNA, 80 bp, Homo sapiens
gtatgcagggcagctgtgctagaagccacgaacgctattctctgtctggggttctatgccagccaccttctactgcctac

SEQ ID NO: 6774932 - DNA, 90 bp, Homo sapiens
gtctccatgtggctggctccagagtcctccctgataagagaaacaaaccgttctgcagacactggggtctggaggctccacgtggtagac

SEQ ID NO: 6774933 - DNA, 58 bp, Homo sapiens
gaagttctggcagcatggagcctgtgctcccactggggctggaccatgctgccccttc

SEQ ID NO: 6774934 - DNA, 57 bp, Homo sapiens
ggctgaggcggcgatgcccttgtcttctccggaggctacggcggcgacgctctcgcc

SEQ ID NO: 6774935 - DNA, 63 bp, Homo sapiens
acttctgcagaattaattcactagtacttgataatactgtggctacagtaatactgtagaagt

SEQ ID NO: 6774936 - DNA, 66 bp, Homo sapiens
tgacaacatcttaagatagaaggggaagctgtgtaagacagtaagtctctttccttgagatggtca

SEQ ID NO: 6774937 - DNA, 65 bp, Homo sapiens
ggcgtcgtggctcacgtctgtcatctcagcactttgggaggctgaggcaggcggatcacgaggtc

SEQ ID NO: 6774938 - DNA, 56 bp, Homo sapiens
ccctgcaggaagccttaccaagcccaaggaaatgtgggccccagtttcttcagagg

SEQ ID NO: 6774939 - DNA, 81 bp, Homo sapiens
tgtgtggagctgcagagtgaagaaaacaaacattgtattctttatattgtttacactaacttcataaaagcatttcacaca

SEQ ID NO: 6774940 - DNA, 55 bp, Homo sapiens
ggcctgtgccctcagcctggctctcttctggggaggggcaggtgagggggcagcc

SEQ ID NO: 6774941 - DNA, 69 bp, Homo sapiens
gcaaattccagtttaaagaaggatgggagttgggagtccactaattcaagcatcctcttcaaattttgc

SEQ ID NO: 6774942 - DNA, 56 bp, Homo sapiens
tcagaagtcccagaattcacatctccaggactgaagtgggtcatgtgactttctga

SEQ ID NO: 6774943 - DNA, 130 bp, Homo sapiens
cctgaatagataattacatagagaaatccactggagaatttgagtgatgtcaaggggttgccgagattggaggaccagcattttcagagtgagctctggtgtttctctggaagttctctatgcattcagg

SEQ ID NO: 6774944 - DNA, 55 bp, Homo sapiens
tctgtgtcctgctagctgtcttcacacagacaagcagctcccatcagggcacaga

SEQ ID NO: 6774945 - DNA, 67 bp, Homo sapiens
tcaccccatgtccttttcttgaactcagccaagccatggtctctgtcttggaagggttgtgggatga

SEQ ID NO: 6774946 - DNA, 81 bp, Homo sapiens
cccatgagtcaaatgcatgagctttgtgatcctgactgaggtttgactagggcttaggaactagactcatgactcagtggg

SEQ ID NO: 6774947 - DNA, 78 bp, Homo sapiens
gagaagttattggattggtcacacaatagtatatatacttaaattatatgcactatgatgagctagtcttaatttctt

SEQ ID NO: 6774948 - DNA, 78 bp, Homo sapiens
ggaaagttatatcatgattttaggagactgtgaacataaaatgtgtgagtggaaaattaagatttcatatggcttttt

SEQ ID NO: 6774949 - DNA, 93 bp, Homo sapiens
ctgaaagtgtgggcttctgagtgctctgctgttccagacatgtgatcccttgagcagctgatcaaagcacttattttgagaccttatacacag

SEQ ID NO: 6774950 - DNA, 72 bp, Homo sapiens
gcagatgctaaagatttaagaataatttgtggcagaaactttaaattatagttaatgtctgtttttatctgc

SEQ ID NO: 6774951 - DNA, 76 bp, Homo sapiens
ttccaaagcctggctctgccgtaaccaccagtggggaactgctccagctcggccagcccagaaccgggccttggag

SEQ ID NO: 6774952 - DNA, 89 bp, Homo sapiens
cctgttcagcggcctgcgcctgagcctgctgtcgctggacccggtggagttacgggtgctgcggaacagcggctcggccgccgagcagg

SEQ ID NO: 6774953 - DNA, 57 bp, Homo sapiens
agaaaaggatcagttattttcttttcttcaataggaaagaatcaagtgatcctgtct

SEQ ID NO: 6774954 - DNA, 56 bp, Homo sapiens
ggaaggtgctccctggacagaggttcttctcaccctcagcctggcctggcccttcc

SEQ ID NO: 6774955 - DNA, 95 bp, Homo sapiens
cctggccctggcccgccctgctggggcacagcaagaaagcaaagcaggctttccactgtggggaccagcctgagggcagaggagagggacccagg

SEQ ID NO: 6774956 - DNA, 67 bp, Homo sapiens
aggattgcttgaagcggggaggctcagagctacagtgagctgtgatcgtaccacttcactcaagcct

SEQ ID NO: 6774957 - DNA, 72 bp, Homo sapiens
gtctaaagtctatacttttgtgattttgagaatgtcatatggatggaatcatacaagaggtaacctttgggc

SEQ ID NO: 6774958 - DNA, 87 bp, Homo sapiens
ggattaagtgagataattatgaaattaagctcagtgcatgacgtatttgctaaataagtgattaagtcttgttctccaccttgatcc

SEQ ID NO: 6774959 - DNA, 57 bp, Homo sapiens
atcaggatgaagctgtagcgaagattttaacaagtcacattactgtcatatcctgat

SEQ ID NO: 6774960 - DNA, 59 bp, Homo sapiens
ccagggaagtcacattgtctagtaacaattgtatggacactggggtgtgactgccttgg

SEQ ID NO: 6774961 - DNA, 64 bp, Homo sapiens
gggacagagcagcacccagcccctcacaggatgatggagtgaggaggaggttgctctctgttct

SEQ ID NO: 6774962 - DNA, 55 bp, Homo sapiens
aggcaggctgctatggagtagatcccttatctcctacctagaaggcatcttgcct

SEQ ID NO: 6774963 - DNA, 68 bp, Homo sapiens
ggcacatggataatttacgattcccattgtcccctctgcagggattaattctgaattatttatgtacc

SEQ ID NO: 6774964 - DNA, 85 bp, Homo sapiens
accccacttactttctatatagcttatttatccactgaacattagagttcttaggactagtatagcatgaggtaattgtggtggt

SEQ ID NO: 6774965 - DNA, 68 bp, Homo sapiens
tgcactgtctttggaataaaattagttgttcttgtacagaacaattgtcaatttagggctacactgca

SEQ ID NO: 6774966 - DNA, 58 bp, Homo sapiens
tgagataaggatgttatactcgtgccacatgtaatggcatgtctgacactgtgtctca

SEQ ID NO: 6774967 - DNA, 65 bp, Homo sapiens
ggaggggagatgagggtagcctgattgcctctctggctctttcctgcatccttctcttccactcc

SEQ ID NO: 6774968 - DNA, 57 bp, Homo sapiens
gggtctaggagacatgggcaaggttcttaacctggagcagcccagaggtctgggccc

SEQ ID NO: 6774969 - DNA, 92 bp, Homo sapiens
ctgtgttcagattcagatactgtcttcacattgttgcctagccatgagtggggccacttagtgctggtgaacagtgggcagcttggagccag

SEQ ID NO: 6774970 - DNA, 69 bp, Homo sapiens
ggtaagaaagatggggcagaatggagccatccatctgggtagcctctcttcccgcattcccttttaacc

SEQ ID NO: 6774971 - DNA, 58 bp, Homo sapiens
aggcatggatggatccagggctcaaatgatgttttgaagctccactttctctccacct

SEQ ID NO: 6774972 - DNA, 60 bp, Homo sapiens
gttagaaatgcagaaacttgaccccaccccaaatggctgagtcaaaatctgcattttaac

SEQ ID NO: 6774973 - DNA, 55 bp, Homo sapiens
ttgttctactctacagtggagggcttcttaaaagtttccacccagggtagaaggg

SEQ ID NO: 6774974 - DNA, 89 bp, Homo sapiens
cttgtgccacaatttcttcatagataaatgcaggtattgaaaatagctgcatcatataatgtctatggaagtagatgcaatagtataag

SEQ ID NO: 6774975 - DNA, 65 bp, Homo sapiens
tgtggtagttaaagaaaatcgaactaaaattatgtcctgttcaagattttaaagagactgccaca

SEQ ID NO: 6774976 - DNA, 94 bp, Homo sapiens
tgacttctcgtgagggctcttgctactgaagtcctggtttctgtccttatcactatagtattccagggcagccaggttcaagtccttatagtca

SEQ ID NO: 6774977 - DNA, 115 bp, Homo sapiens
tcgtgtagtgctaagaagatagtatgtgcccaggaaataaaagtgggcttgtcaagcctggaagccatgctcagttcctggagcatcctcagtacctgttttgttatctatgtga

SEQ ID NO: 6774978 - DNA, 62 bp, Homo sapiens
ttctcatctaaggagggaggtgtctccaagaaaccaagccattccctcctgcagatagagaa

SEQ ID NO: 6774979 - DNA, 68 bp, Homo sapiens
gagaggacaccatttgccactgtcacaactggccctgtatactgtcgggttcagtggcagatcttctc

SEQ ID NO: 6774980 - DNA, 75 bp, Homo sapiens
tctctgtgtcttgattttatcttgcctaaagtggagataacattcagcccacaaggttctgtaaaatcaaagaga

SEQ ID NO: 6774981 - DNA, 84 bp, Homo sapiens
ggaggaccagaaactgaagcaattctgcttactaaagaaataattttcaagtgaggtaattagagctgctgctacagttcctcc

SEQ ID NO: 6774982 - DNA, 61 bp, Homo sapiens
tatgccaggaccataggttttaacaactgtatagttagaacctgaactagggtcttgcata

SEQ ID NO: 6774983 - DNA, 77 bp, Homo sapiens
ggctggacagtcagaggttattgatcccgatttaagccaaatgttgctaaaacttgatctgtgaccttgcttaagcc

SEQ ID NO: 6774984 - DNA, 56 bp, Homo sapiens
gacacagtcatactggcatagggcccactctgagggccttgttttaagactctgtc

SEQ ID NO: 6774985 - DNA, 65 bp, Homo sapiens
agctctggctacagaattggccctgtttatgggttggagcaggttccaggcactgtggctgggct

SEQ ID NO: 6774986 - DNA, 56 bp, Homo sapiens
gagccacagaaggaaattggggataggaaaggtctaaaattttgttagtgtggttc

SEQ ID NO: 6774987 - DNA, 115 bp, Homo sapiens
gtcaattaccttagtgttgtgctttaatatttttttcagattctttagcctcatagcaaaaactttggtctattagtttgaaagtattgacagaagtagcattaaggaagttttc

SEQ ID NO: 6774988 - DNA, 70 bp, Homo sapiens
tgtagggagagggagttgcacctcagacctaaaactccagtggctccttgggcacccctccctccccaca

SEQ ID NO: 6774989 - DNA, 76 bp, Homo sapiens
ggcctgccagaggaggccggccttgaagcttcttttaggaaaaaggccctgaagtcggcccctcaccccggaagcc

SEQ ID NO: 6774990 - DNA, 64 bp, Homo sapiens
catagagctctcagttccaaagggtccttcttagaagcaagaattggaatttgggagctatgtg

SEQ ID NO: 6774991 - DNA, 57 bp, Homo sapiens
gcacacaggcagtttccagccaggtgtgtgccagttgctgggtatatgcttgtttgc

SEQ ID NO: 6774992 - DNA, 66 bp, Homo sapiens
tcagtgggaacagcaaaagtgggctctccagtaaatgctttatagttcactgaggttgaccactgg

SEQ ID NO: 6774993 - DNA, 56 bp, Homo sapiens
gtgtcttttgaggctgaccagttgtacggtaggactactgggcctaggggaggcat

SEQ ID NO: 6774994 - DNA, 55 bp, Homo sapiens
tgaaagcagaactgagagagctggggtttacctccactggttttattctctttca

SEQ ID NO: 6774995 - DNA, 75 bp, Homo sapiens
gattacttagtttagtctcacttggaattttgcagattgggaagtggaggccaagaggcagaatgcagagaagtc

SEQ ID NO: 6774996 - DNA, 57 bp, Homo sapiens
tgttacagtactacaattctgccacaactttaagcctcatttgtggagactgtagca

SEQ ID NO: 6774997 - DNA, 89 bp, Homo sapiens
acatctcagtgacattgacccaactgggggaactccctgaggttaagaaaacctccctccaaggctgagttaatgaactacctagatgt

SEQ ID NO: 6774998 - DNA, 58 bp, Homo sapiens
aagatatgagaagtgatggcctctgcttttggtgggtgggcagtcttcctcatttctt

SEQ ID NO: 6774999 - DNA, 60 bp, Homo sapiens
cctcggtgtctttgtctgaaaatggaaatcatatggaagtttctagaaggaggcatgagg

SEQ ID NO: 6775000 - DNA, 77 bp, Homo sapiens
gactcttttactgaaagtatacatttctgcacttacatttcaagatgtagttatgtctctttcagaagattgtggtc

SEQ ID NO: 6775001 - DNA, 63 bp, Homo sapiens
tttgggaaagcctttcacagggtgatagaatctattttattcagctctctagaggcactcaga

SEQ ID NO: 6775002 - DNA, 91 bp, Homo sapiens
ccaccaaaccaaccagggacttggctccccctaaggcaccaaggaagccctggggaaccagcccactggtgttctcatgtggtttgtttgg

SEQ ID NO: 6775003 - DNA, 68 bp, Homo sapiens
ttaatttcagactgcttttataaaggacataactagtagcatggtaaaagtgcagtccatgaaattaa

SEQ ID NO: 6775004 - DNA, 98 bp, Homo sapiens
tatttacctgggtcttccccgagctcagctgagctccagctcatagtgaatcacatgttgggaatcagctgagagctggccctgaagatccctgaata

SEQ ID NO: 6775005 - DNA, 62 bp, Homo sapiens
tgacatgtaagatggaaaagcgcaacttgatgtgattagtgttcccttcttagactatgtca

SEQ ID NO: 6775006 - DNA, 86 bp, Homo sapiens
gcaatatggaggtcattgctgacttcaacccctcttccctttctgccatgagtggaaggaagcagccagagaccctcaccagatgc

SEQ ID NO: 6775007 - DNA, 80 bp, Homo sapiens
tgggatataactagatgtgagaatattcacgcagcaagagtctgctagccaaactgaaaattttcactctggcccaccca

SEQ ID NO: 6775008 - DNA, 88 bp, Homo sapiens
gtttttaaaaatatcttaattggttttctaggtttaatggaagtcttatccatttgctcaggggcaccaaatactcaggtataaaaac

SEQ ID NO: 6775009 - DNA, 63 bp, Homo sapiens
agaggggctgttgaagttagttgagcttttgaagttggggaaacttcagctagcctcatttct

SEQ ID NO: 6775010 - DNA, 63 bp, Homo sapiens
gggatccgcagaggaggagttgctgtcagctggtgctcacggggtgcctctctctacggaccc

SEQ ID NO: 6775011 - DNA, 75 bp, Homo sapiens
acgagtgtctggtagttatggtaaagaatcaacaattcaaaatgttcatcattcatcttattgccagtcccttgt

SEQ ID NO: 6775012 - DNA, 129 bp, Homo sapiens
agatccacttttctctctgtaatggcatcttagcttgaaatccaggaagcagtggtgtatggtgtccatatccacgatttcctgcattggagaaaaagtgtggaaagcatctggggaaaaggaggctct

SEQ ID NO: 6775013 - DNA, 59 bp, Homo sapiens
tgcacatgctctccgggcacacacccagcctgtctgccactgcccagagtgtatgcgca

SEQ ID NO: 6775014 - DNA, 97 bp, Homo sapiens
ctctgggcctcagtttcaccaacagtatagtgaaggggtggacaaattggcccaagatcctttctgtgctgtcaggtcctccactactgggcctgag

SEQ ID NO: 6775015 - DNA, 59 bp, Homo sapiens
ctcccttcaggagaggctcacaaaatgctgatgggcttcttccatgaagaatgcaggag

SEQ ID NO: 6775016 - DNA, 106 bp, Homo sapiens
atgtactgtcgtgttactgagctcggtggaaggtgctagaacaaggactgctctccagggctctctgtgtttctcaccttacctcgaggtcatgcctgcagtttgt

SEQ ID NO: 6775017 - DNA, 58 bp, Homo sapiens
gaggaggctatcagcaatcaggtacacatcaaccatatggctgtcatgtagtctcttc

SEQ ID NO: 6775018 - DNA, 96 bp, Homo sapiens
aggtactggacacagtggaaaaacacttcctgtaacatgacagtggtctgacttaacccttccaagttcccaggagatgtacacgtgtatgtatct

SEQ ID NO: 6775019 - DNA, 64 bp, Homo sapiens
cctcacagccagtaatctacccctgtcccccttatcccaggcctgcatagttattggctggagg

SEQ ID NO: 6775020 - DNA, 80 bp, Homo sapiens
gagaccctagaaatgattggttgagctctgatttattgattaggaaagtgcttgaacagtttacaactttactagggctt

SEQ ID NO: 6775021 - DNA, 58 bp, Homo sapiens
gctgagggccctgagtctagctgctcttcccaacggatctagaaagccaggggcctgc

SEQ ID NO: 6775022 - DNA, 130 bp, Homo sapiens
gctgttaaggaagatttaatgagataaatgtgcatggagtccttaatacactggtggacgcagagaaatctgatatttacctgttattacagtgtttgttgtaactctggattgtctttaaattatgtgc

SEQ ID NO: 6775023 - DNA, 68 bp, Homo sapiens
gtagatctgttcatttggcccttttgtatgatctatttagctacagtggacaagtgaactggtcctac

SEQ ID NO: 6775024 - DNA, 57 bp, Homo sapiens
tagcccctgaatctaaaagcatctctctctcttgctcatgggtgctccaggtggctg

SEQ ID NO: 6775025 - DNA, 67 bp, Homo sapiens
ggctggatggggctgggctgggcaaggctgagcaaagccagcccattaacccctgtcctctcctgcc

SEQ ID NO: 6775026 - DNA, 89 bp, Homo sapiens
tgaaaatgctgaatagacttggttagtaaatttgatgagtgaaattttattatgaaaatacctgccaagtgttctgtcatgcatttcca

SEQ ID NO: 6775027 - DNA, 60 bp, Homo sapiens
tttctagttgttcatgaaaggagaccaatctgatattaggtccttcatcatggctaggag

SEQ ID NO: 6775028 - DNA, 58 bp, Homo sapiens
gtggaatgtgagaataccgttttgagcacctaccatgtgccaggactcactacttcac

SEQ ID NO: 6775029 - DNA, 102 bp, Homo sapiens
ccagattttaggatttccataattcagctcattctatttgtccaatcgacatatacccagagtgggtagagttagaatagaaaatcattttttaaaatctgg

SEQ ID NO: 6775030 - DNA, 62 bp, Homo sapiens
atagattaggcttagaagtctgtagtgaaagttacattacattctttcgatgtctgatttgt

SEQ ID NO: 6775031 - DNA, 87 bp, Homo sapiens
gcccaaggcttgggttgtgcagtcagactgcctgggctcaaactctgagactgaggcctgcttgctgtgtaaccttgagccaagggc

SEQ ID NO: 6775032 - DNA, 57 bp, Homo sapiens
cagcagagaccaagtgatttgagtgtcattaaattcattatgtggctttttctgttg

SEQ ID NO: 6775033 - DNA, 91 bp, Homo sapiens
tcagtgaacagaatacatctagtgctgcatgagggagcttcttttttagtgaaggaggacattagacacagatgtataaatgagtcattga

SEQ ID NO: 6775034 - DNA, 76 bp, Homo sapiens
gcattctgacatacatagtatttttagtgtaagtggagtacaacttatctatacacacaaagaatgcttcagaggc

SEQ ID NO: 6775035 - DNA, 60 bp, Homo sapiens
gccttgtggtaagttgggccctggcaggatgttcccagggtccagagaagccattagggc

SEQ ID NO: 6775036 - DNA, 88 bp, Homo sapiens
gagaaacctattaacatgcattactataacggcatagattattgtcattaatgagtatcctatatggtgtaagttccttgaaggtctc

SEQ ID NO: 6775037 - DNA, 77 bp, Homo sapiens
gcaggagacaactggctttctctgtggtgttcagtgagccaccgctgatgcctcattagaacgcgagacactcctgc

SEQ ID NO: 6775038 - DNA, 66 bp, Homo sapiens
acgagtcactgggagtcgtaagacacggccctgccgttctgcccctctgtggctcccagccctcgt

SEQ ID NO: 6775039 - DNA, 58 bp, Homo sapiens
actgtgccccacagagctccacactgagaggccggttgtcggatgctggggggacagt

SEQ ID NO: 6775040 - DNA, 87 bp, Homo sapiens
gtatatatttgtttggaacaagacaaaacattagatcatcttcgaagataagtaatggaaaatgtcctgttctcaggcctataatat

SEQ ID NO: 6775041 - DNA, 57 bp, Homo sapiens
tagccaaagtagctgttatagctatatgctatggtaaaacactgcagcttttggttg

SEQ ID NO: 6775042 - DNA, 57 bp, Homo sapiens
aggtggctcacgcctgtaatcccagcactttgggaggccaacgcaggcaggtcacct

SEQ ID NO: 6775043 - DNA, 58 bp, Homo sapiens
acccaggctggagtgcagtggcgcgatctcagctcactgcaacctctgcatcctgggt

SEQ ID NO: 6775044 - DNA, 122 bp, Homo sapiens
caaaacgttatgtaccaacctcatcctctttggagtctgcatcctgtgcaaccgtcttgggcaatccagatgtcgaaggatgtgaccgagagcatggtctgtggatgctaaccctaagtttg

SEQ ID NO: 6775045 - DNA, 94 bp, Homo sapiens
gtccccataaacattccaggtctaatttgtccttgaacatccttagaataacggtagacttaaagacaatattatgcctggcagtatttaggac

SEQ ID NO: 6775046 - DNA, 121 bp, Homo sapiens
tcttgtgagtctgatttatgctttcaggaaatcatagtgtgctaagatgaagacttgtgtcccaaatcaacaggaattatagtagtatttgtcttttcaagaggcatcattcaaccaagga

SEQ ID NO: 6775047 - DNA, 69 bp, Homo sapiens
gagggcaccaaggctccagtgaagtagcacctgagcaccttgctccttgtcttggagctctttgtcctc

SEQ ID NO: 6775048 - DNA, 70 bp, Homo sapiens
tccggtgcctggtttggggaatgttcgtgggatatgttccaaaggactgacggacctatcaggtactgga

SEQ ID NO: 6775049 - DNA, 56 bp, Homo sapiens
tgctccaggaaaatagggaatgagagaaacagctttttttcattgttcctggagca

SEQ ID NO: 6775050 - DNA, 58 bp, Homo sapiens
ctgcttcatagccctggtctctcctaggatcctgagacctttggggctgagaacgtag

SEQ ID NO: 6775051 - DNA, 57 bp, Homo sapiens
tcttcagagcatttctgaggtagagagttctctgcttttcacatcctgccctgagga

SEQ ID NO: 6775052 - DNA, 74 bp, Homo sapiens
ttactaagtagtcagtggaccaggtcaattttccttcaaaggaaatgtatttgacagtccttgctaaaaagtga

SEQ ID NO: 6775053 - DNA, 59 bp, Homo sapiens
cattctttacaggttctttggggattcaagatagagtcccaaaggataaggtaagaatg

SEQ ID NO: 6775054 - DNA, 61 bp, Homo sapiens
ggccaagtctctagagaaatgctttattattgcagacaatacattctctggtttgctggct

SEQ ID NO: 6775055 - DNA, 124 bp, Homo sapiens
cattacggaatttccagttatagaaactgtggggctttggttgataataattagttcttggactcatttgcatgccacgggagagaattattgccagacccttgtatttatagcttcccaggtg

SEQ ID NO: 6775056 - DNA, 100 bp, Homo sapiens
aaggaaaatatactcaatttatttaaattactgttttgttctccacgcattctaaaggagaatatgacatagaattgagatgagggtcttttagttcctt

SEQ ID NO: 6775057 - DNA, 56 bp, Homo sapiens
gtttttgtagtaatgtttttggctgttagaggcctgaagcacatttctacaataat

SEQ ID NO: 6775058 - DNA, 73 bp, Homo sapiens
aggcagtgtttaatgccttttccagctgctggtttgaggagactgggtagagaggacaagtaaacagaggcct

SEQ ID NO: 6775059 - DNA, 62 bp, Homo sapiens
ccctcccactcggatccacgcatcaaaggggtcctcggatgcagggaacttagtgggctggg

SEQ ID NO: 6775060 - DNA, 102 bp, Homo sapiens
agtgtttggaaggtggtgcttaatctggagccttgttgatataaatttatctgaacttcagggcttggttggaaccacccaaataagaaactccttagcact

SEQ ID NO: 6775061 - DNA, 79 bp, Homo sapiens
gtcatgaatttggctttagatttctagaacctgacccaaagagggaaatcagttctgaaatttacactgcttttatgat

SEQ ID NO: 6775062 - DNA, 79 bp, Homo sapiens
agggccatatggctgagatgggctccaggctagggttgggtgagggttgatgcttggtccactcagtccagatgcccct

SEQ ID NO: 6775063 - DNA, 61 bp, Homo sapiens
gccttcctcccagatgtgcccaatggagtctgaactctggttctaatttgtggaggtgggt

SEQ ID NO: 6775064 - DNA, 60 bp, Homo sapiens
ggctggcaagtaggttttggctgtctgatgggataccagctgaagctcttgtcaaaggtc

SEQ ID NO: 6775065 - DNA, 71 bp, Homo sapiens
cctcaaacagtttatgataaattcttagggtctcttgatttcttaagtctctcgtttgattcattttgagg

SEQ ID NO: 6775066 - DNA, 92 bp, Homo sapiens
aaggttaaggtcagtagtcataagtcataagtcatgatgttatgtatccttaatataacatgataagtatgatactttgcctgtgtagtctt

SEQ ID NO: 6775067 - DNA, 76 bp, Homo sapiens
tctgaattacagcagtggattagaggatggctagaggtagtcattctttttaaaacattttaaactgtggtttaga

SEQ ID NO: 6775068 - DNA, 59 bp, Homo sapiens
catgtgggtgagtgagagatagaccatatagtaagtctgtgttccctcaacaccacatg

SEQ ID NO: 6775069 - DNA, 99 bp, Homo sapiens
tatgtgtcgccactggttctaagagctgtgcttataccaattcattgggtcctggcaactctatgaaatgtacaagtgcttttttctatgtgacacatg

SEQ ID NO: 6775070 - DNA, 61 bp, Homo sapiens
tgtgtgaggatgtattttatcagagtctcatcatgacctgggtgaaatagtcctcaagaca

SEQ ID NO: 6775071 - DNA, 79 bp, Homo sapiens
gaatacattttcatgaagtactcgttgtgttattgttgtttgcattgaagttgatatctactctcatgaattggtattt

SEQ ID NO: 6775072 - DNA, 88 bp, Homo sapiens
gagttgagggttgtttatgtgagactaagtcctgttcacaaatgagaaatcttttcttatgtggacgtacctgtgtacagttcagctc

SEQ ID NO: 6775073 - DNA, 80 bp, Homo sapiens
aggagctctgaggacagggtccaaaggcaggggaggcagattctccaccgtctccctggccttgccttcaggggcctcct

SEQ ID NO: 6775074 - DNA, 123 bp, Homo sapiens
ttgtagtagcccagataggctgaattgaaaccttatgttattttgttttgttctattctggctttggtctgaaagggcaggcagagatcatatagtgtttttctattgcactagtttttacaa

SEQ ID NO: 6775075 - DNA, 94 bp, Homo sapiens
ccagtttaaagattaaacatgcaaagcgttttgaccagccaggaagcactgctgttgtcttttgttttgccaagtttgatccttagtaagctgg

SEQ ID NO: 6775076 - DNA, 119 bp, Homo sapiens
gtgtgcctgctctgtgccaggcactgtcaggtgccgggaatgcagcaatgaacaaaatgtagatcaattcctgccctcttgggccttactacctggcagaagatataaaaaagggccac

SEQ ID NO: 6775077 - DNA, 78 bp, Homo sapiens
ctatatatgcattttgtaagatatgagtacatgtaagtgggtctgtatatgtgtatattttaaaaagtgttcctttag

SEQ ID NO: 6775078 - DNA, 72 bp, Homo sapiens
tggctgtgcattctctgattttcacaaataagaacttttacatcattagtgaaatgagaatgtatgacacca

SEQ ID NO: 6775079 - DNA, 100 bp, Homo sapiens
ctgcaaggttgttatgctgaataggggtcccaaagatatccatgtactaatctttggaatctttgaatgttaccttatacggcaaaaagggacttggcag

SEQ ID NO: 6775080 - DNA, 78 bp, Homo sapiens
ggacaatggaacatactctggcagcctggaatctctcagccttcccaggatgggttctcggttgcctgctccactgcc

SEQ ID NO: 6775081 - DNA, 62 bp, Homo sapiens
cgcctatgagaataaaggtgatttcgaggtgactgtgttctcagagtttatttttaaaggtg

SEQ ID NO: 6775082 - DNA, 81 bp, Homo sapiens
cttccctgtgttaagccaaaccttgtggtcccaggtcatgatccaccaaagaccacaactgttggaggaacacagggccag

SEQ ID NO: 6775083 - DNA, 70 bp, Homo sapiens
atggaaagtacagggttgtggggtgaggggtggaaccacttaccattcatcttcctgtattgatattcat

SEQ ID NO: 6775084 - DNA, 77 bp, Homo sapiens
aaaatgcaaattattgggccccaacttctgatctactgaatcagaaactctgagttgagcccagaaatttgtgtttt

SEQ ID NO: 6775085 - DNA, 109 bp, Homo sapiens
ggcactgtgccaatttcaagtttagactagaagcttccacttttctgctttctggggaagccagcggctataaagaagcataggctagacttctgaggggtcagatgcc

SEQ ID NO: 6775086 - DNA, 70 bp, Homo sapiens
gggaacggtctgtttcttccagggctgtgtccccacatccggacctcaccttcccagagacgatcttctc

SEQ ID NO: 6775087 - DNA, 76 bp, Homo sapiens
ggagaagccgaagcgcaaggtgtcagcaggtttcgtctcttctgaggcctctctccttggcttgcagatggcctcc

SEQ ID NO: 6775088 - DNA, 59 bp, Homo sapiens
acctcccagtatttcagcggtgttgtttacaagggtgtcccggtggcttgcagggaggt

SEQ ID NO: 6775089 - DNA, 62 bp, Homo sapiens
ccccaagtggggagatcaattagtgcaacaactctggcctgtctccatctcattacttgggg

SEQ ID NO: 6775090 - DNA, 76 bp, Homo sapiens
ttgcagccaggggaaggagccttgaaactctccagccccgacgccccagtctcattggctccctcccccgctgcag

SEQ ID NO: 6775091 - DNA, 81 bp, Homo sapiens
atccattcagtaattcagtcagttaacaactatttattgagcacctgttatgtgctaagtgttgatctgagtgctaaggat

SEQ ID NO: 6775092 - DNA, 88 bp, Homo sapiens
tgaacaatgccaaagcccaagttcatcagttaaaccagttaatctccattggcccttggtgtcaacttgttctttggacaaagtgtca

SEQ ID NO: 6775093 - DNA, 69 bp, Homo sapiens
tgctgctccatctgaccattccccactgctgatccatggcaaaaaaaacgaacggcaatggagctggca

SEQ ID NO: 6775094 - DNA, 67 bp, Homo sapiens
ttgtttgattattgttttaatagtagagatggggacattttatgtgtcaaagcagtggtccaaatga

SEQ ID NO: 6775095 - DNA, 65 bp, Homo sapiens
ctctcacctattcattgtagaactaacaagaagtaataagatttctggaatgtagtcggtgagag

SEQ ID NO: 6775096 - DNA, 63 bp, Homo sapiens
ctgggttttggagcagcttgcctaccacgatcgtggtagattctagctggcactagaatccag

SEQ ID NO: 6775097 - DNA, 68 bp, Homo sapiens
tctattccaaaccccttcccctctctgtgtctcctttctcactgttgaaagaagggctttgaagtaga

SEQ ID NO: 6775098 - DNA, 59 bp, Homo sapiens
gggctggaggtggctcacacaagctcatgagagccagttgtgtaatctcttccctgccc

SEQ ID NO: 6775099 - DNA, 69 bp, Homo sapiens
gggaatatggaagtggacacttggatgtcttagtacttcttccaatgcagtgccgtctctaccattcct

SEQ ID NO: 6775100 - DNA, 70 bp, Homo sapiens
ctggattcctggagttgtctgtactcatctggaaccagagaaacagagaaatcagcttcagcctccccgg

SEQ ID NO: 6775101 - DNA, 59 bp, Homo sapiens
aaagaaagtgggcttctgtcccaaactggctgccaacaggacaattgttcattttcttt

SEQ ID NO: 6775102 - DNA, 79 bp, Homo sapiens
gcgtgctcatgccaaggcagcctccaagctagcccagcctggcaacatggacaggtctgccttaggacctgagcattgc

SEQ ID NO: 6775103 - DNA, 70 bp, Homo sapiens
tagtatgggttggggatttgattggcattagtcttcacaaggggtacaagtaagaaaattgcccatgcta

SEQ ID NO: 6775104 - DNA, 73 bp, Homo sapiens
gcgtggtgtggtgaaacaatgataaaatttggaatcagaaaaccaaattcaagtccagcttctctacactggc

SEQ ID NO: 6775105 - DNA, 61 bp, Homo sapiens
ggacagtcagagccttggccgctttccagctgaaggccttggccagtggccttgactttcc

SEQ ID NO: 6775106 - DNA, 66 bp, Homo sapiens
gctaaaaatggaggtgattaatatgctaagtaggaaaaccttggctgtcagtcgcctgcattcagc

SEQ ID NO: 6775107 - DNA, 91 bp, Homo sapiens
tttcccttgtgtgactctatggaagttaactttttcttatggccatagtgtgaatcgaaggccacaagagaagttaagggttatattgaaa

SEQ ID NO: 6775108 - DNA, 70 bp, Homo sapiens
atcttgaaatcagtatgtctttctcaatggcagagagcatttgaactgggaattagtgttgattcaggat

SEQ ID NO: 6775109 - DNA, 68 bp, Homo sapiens
tcttggtttgctttggttacttccacatgttgatcaaacatctgtaaaaggaaatcaaagcactaaga

SEQ ID NO: 6775110 - DNA, 65 bp, Homo sapiens
ctgtttcacagtagaaatcattatgtcatcaaattggcttaatttcaaactgctagtgataacag

SEQ ID NO: 6775111 - DNA, 63 bp, Homo sapiens
gggaaatacctattggctatctgagagactgatccccatctctcagactccccatggtttccc

SEQ ID NO: 6775112 - DNA, 87 bp, Homo sapiens
agagagtagtgcctgtgtatatgtgtgcatccatatgtgtgtttacgcatgttgggcatgcatatgtgtgtgggtgtgtatatttct

SEQ ID NO: 6775113 - DNA, 56 bp, Homo sapiens
gtctttgtcaatgcaaagctgtgtgaacccagacgcagttacagccaggacaaggc

SEQ ID NO: 6775114 - DNA, 65 bp, Homo sapiens
gttcagatggagaaggaaaactttgggttatgcattttttcccctcttttccttctcctcttaat

SEQ ID NO: 6775115 - DNA, 106 bp, Homo sapiens
gatgtaggttttggcagtagatgtaggttggcataaaactcttcaaaatttccttaaataacactgattaaaggtttatatgccaacctctgctcttgactgcatc

SEQ ID NO: 6775116 - DNA, 62 bp, Homo sapiens
ttgccattgcaaagtactatgaaacaaagaaatcatgctgtcatggaatagagcagtggcaa

SEQ ID NO: 6775117 - DNA, 55 bp, Homo sapiens
cctacagacaaaccagtgactagatacattagctctttctggagttgtctgaagg

SEQ ID NO: 6775118 - DNA, 82 bp, Homo sapiens
acaaattacctgtcatacatcaagccgtcacatgtttaacttgtgccatttgtgcttgggtgttggatgactgtgtctttgt

SEQ ID NO: 6775119 - DNA, 55 bp, Homo sapiens
gacaaatgggcagaaaaaggactgtggatggtagagttctgctagaccatttgtt

SEQ ID NO: 6775120 - DNA, 63 bp, Homo sapiens
actttgaaagccttggccccggcttatcattttttccattcttaggccaaggctatttgtagt

SEQ ID NO: 6775121 - DNA, 64 bp, Homo sapiens
gttctgggctctgggaattagggatgagccagccatgttcctctttcttcccagaactcagagc

SEQ ID NO: 6775122 - DNA, 116 bp, Homo sapiens
gcatataacattctcgaggaactgaggaagaactagaaactaatggattattaaggaaattgatgggatgagggtttcttgttctttcccttatcctttcttatgtttaaatatgt

SEQ ID NO: 6775123 - DNA, 121 bp, Homo sapiens
taccacattctgaatttataagaatttattttagtcctgggctttggaacagtacttgcttataagaagtattagctttaaaacccagacatgtaaattaataagaaaaagagatggggta

SEQ ID NO: 6775124 - DNA, 85 bp, Homo sapiens
ggctggtaaaggccaactttgacaggtatagggccaggcagccctgggcctggagtttgtccagagtggtggaaagcagccagtc

SEQ ID NO: 6775125 - DNA, 82 bp, Homo sapiens
atgctcttggtaccaattcttaagtattcctgataggccactgccttcagcctagaacttgagaggacccagttcttagcat

SEQ ID NO: 6775126 - DNA, 57 bp, Homo sapiens
cctttggctgacttttatgcacactaaagttttagtactgatagggtcaatcaaggg

SEQ ID NO: 6775127 - DNA, 60 bp, Homo sapiens
agggagttcctgttgctctagggtgccacctgcaatacctgggctctaggaaccattcct

SEQ ID NO: 6775128 - DNA, 75 bp, Homo sapiens
catggttgtgtgtgagcacagctaactgagatgaagatcacatctgaccctgggctttgccacatattgaccatg

SEQ ID NO: 6775129 - DNA, 56 bp, Homo sapiens
gtcagagtggaaggccagtggctctgtgaaagtgcctgctggtcacctaatctgcc

SEQ ID NO: 6775130 - DNA, 73 bp, Homo sapiens
ggaacaagattttgtctggtagggttgatctttgaaaggctacaaatcatcctactagccaggatttttcacc

SEQ ID NO: 6775131 - DNA, 61 bp, Homo sapiens
tgtctccagatctcacagaggcccaccaggaactgaagttctgccactgtgataggaaaca

SEQ ID NO: 6775132 - DNA, 77 bp, Homo sapiens
tcaattgttctctcttcatccatttcagtgtatcactatttgtggcagatgaataaactatgaggaggaatagttga

SEQ ID NO: 6775133 - DNA, 87 bp, Homo sapiens
gcctgaacatctatgaattcattcagtattcttgaaaggttcctgcagccaggccctcccggtgctgggtgctgtatggaaacaggc

SEQ ID NO: 6775134 - DNA, 65 bp, Homo sapiens
ccaccagaagtggctttctcagggacactgccatttgttttcctgttcctgttcgctcctgctgg

SEQ ID NO: 6775135 - DNA, 58 bp, Homo sapiens
tttatttctccagaatgctgtctgtggcattctccaaggcagatttaggagaaaagaa

SEQ ID NO: 6775136 - DNA, 110 bp, Homo sapiens
caggtagcagcagtgatgagaacaagcagagaagtctctaggctaaaatcaatctccttagcttagcatatgaggcctcatttgtcttggttattcccaaagcactcctg

SEQ ID NO: 6775137 - DNA, 129 bp, Homo sapiens
cccctcattctgtgttgaacccaaacatgcctagaatatttagagtatccctgatttagctgctgggtaatttgaggatagttgggtactctgggatgaaaaggcttgatacaatatgggaaaaaaagg

SEQ ID NO: 6775138 - DNA, 57 bp, Homo sapiens
ggatcaggtgggagctgcggaggcctgggcacccccagcatcggctccctctgaccc

SEQ ID NO: 6775139 - DNA, 94 bp, Homo sapiens
gttctcagggtcacttaaaaatgaatgtgagttacctggattgaacagaattctatttagtgtattctaatatgtggtgataaaacttgggaac

SEQ ID NO: 6775140 - DNA, 76 bp, Homo sapiens
atgccagacacacaagcaatctaagttcctgggtaaatattaaccaagtgcttaggtcttgttgcaatctaggtgt

SEQ ID NO: 6775141 - DNA, 62 bp, Homo sapiens
ggagaggctcctgaagccagccttgcagatacatagttacaggctgagcaaagggccttacc

SEQ ID NO: 6775142 - DNA, 64 bp, Homo sapiens
ctctctgaggcaggcctgtgggttctggtgtaagtggagattgggcctggaaagccttagagag

SEQ ID NO: 6775143 - DNA, 58 bp, Homo sapiens
ctttggaacacatgggcatggttcttaacctagaccaggcagggaagtgatttcaggg

SEQ ID NO: 6775144 - DNA, 83 bp, Homo sapiens
caggacctgggatggttctcatgtgttcgtccccttccacactaagccaaagaaggagctgaaacaagggaccgtcctttctg

SEQ ID NO: 6775145 - DNA, 123 bp, Homo sapiens
gagctaatctggtgtggatcttcctcttccatcctaaatcccctgtgagtcgctcacctctgtatcttgagcaactctccagggatttaggatggaagaggaagatccacaccagattagctt

SEQ ID NO: 6775146 - DNA, 62 bp, Homo sapiens
catccatttctatcttgctgaggacgaagtactgtgtctcagctagaatagacaatggcttg

SEQ ID NO: 6775147 - DNA, 56 bp, Homo sapiens
agaattttatctaaagggagtacaaaggccatgatgccttttccaggtaaaattct

SEQ ID NO: 6775148 - DNA, 90 bp, Homo sapiens
gcaacatgtcactgtcagcccacatgtacagaagcaggctgggacactcccagccccagatctctcgtacatgtgggtgcacacagttgc

SEQ ID NO: 6775149 - DNA, 55 bp, Homo sapiens
tggtcagttgtgactagaacacagaatcttaatgttacactgtcacagatggcca

SEQ ID NO: 6775150 - DNA, 64 bp, Homo sapiens
gtaggtgtatatgaaaatttttgtcctttgcagctgtcttagacacatattcatatgtacttac

SEQ ID NO: 6775151 - DNA, 113 bp, Homo sapiens
acgatacactgtgttctctgctcaaagctatttattcttgagagtgagaagaaacgttgcatgtttcttttgtgccaagtaatgaataatcaacagtagacactgagtgttgt

SEQ ID NO: 6775152 - DNA, 72 bp, Homo sapiens
ggttgtagatttagatagaaatgtaatagtccaaaaatacactacacagcttcaaagtctaattctacaatt

SEQ ID NO: 6775153 - DNA, 110 bp, Homo sapiens
gaggcagtgcggggggtaatggaagcacgctcagttggatatcagtctgcatgttccctgatttgtaactggaagtccttactattgcctttgagctctggaactgtttt

SEQ ID NO: 6775154 - DNA, 64 bp, Homo sapiens
tcagaggattggacttttatgtttaaaaataaatttaatgtaagatgaaattcctgttttctga

SEQ ID NO: 6775155 - DNA, 113 bp, Homo sapiens
acagaggacattaaaagccatgctaagaagtttggcatttattctaaggtcaaagggaagccaattgaaatttagtatgaagccattttaagcacgggtgtagtgttttttgt

SEQ ID NO: 6775156 - DNA, 58 bp, Homo sapiens
cttggactttagtctctctccatcacttgacagctatggagacatgggcgaatctaag

SEQ ID NO: 6775157 - DNA, 69 bp, Homo sapiens
aggacagaaggctgtggttctatacagaagacaagaacactgctttggtattgcacactgtcttctcct

SEQ ID NO: 6775158 - DNA, 58 bp, Homo sapiens
gctggagtccagtggtatgatcttggctcactgtatcctcgatctatctggctcaagc

SEQ ID NO: 6775159 - DNA, 74 bp, Homo sapiens
gtggggtggtacaggtgggcaccgtgctgcatgtcacaggatgtcaggcagcatcccggcctccactgtcccgc

SEQ ID NO: 6775160 - DNA, 90 bp, Homo sapiens
gttaccaacatctaccttccttgaaaacgaatggcaaggtatatattctgtaagttgccattcatttttaaggaaggtagagttaataac

SEQ ID NO: 6775161 - DNA, 58 bp, Homo sapiens
tgggcaggataatatctcatgtttacaactaacaagttagatatccctgtcctgccca

SEQ ID NO: 6775162 - DNA, 60 bp, Homo sapiens
ttgtgcaatcccctcattttatagatcagaaaacaagtctagagaggttaagttgcacaa

SEQ ID NO: 6775163 - DNA, 63 bp, Homo sapiens
ggccaggccaagagggttggaagccaaggaacgggttaaggatccagtcaacttggcttggct

SEQ ID NO: 6775164 - DNA, 61 bp, Homo sapiens
ctgctgttgtgcttggaaaggggcccggggtgccggaggcctctcccaggcgcggcggcag

SEQ ID NO: 6775165 - DNA, 129 bp, Homo sapiens
ccaatcaggagccggcctgaccccgccccctcttctcacgttattggctgagaggcccccagatgggcggggccggccgtggggttggggagggcagggggcggggaggaggaggaaggcgctggcggg

SEQ ID NO: 6775166 - DNA, 92 bp, Homo sapiens
gcatttaacaactaggaagtcttaactgacagtttaatgggtgctaaaggtgtaagacccatttctgtaagttgagtactatgttattatgc

SEQ ID NO: 6775167 - DNA, 88 bp, Homo sapiens
atgggctggtgaccagcttggtgtgatataatagaacactccagagacccgagttctagtcacaaccttcaagttgtcactgccacat

SEQ ID NO: 6775168 - DNA, 65 bp, Homo sapiens
gtgacccaggctggagtgcagtggtgcgatctccgctcactgcaagctctgccttccgggttcac

SEQ ID NO: 6775169 - DNA, 99 bp, Homo sapiens
tgaataagacatacagcttgctctgggtggcatggcaaagaaatagctaggactactggctttccctgccctcagaaggaagggctgtagttgctatca

SEQ ID NO: 6775170 - DNA, 103 bp, Homo sapiens
ttagggcattttcatatattcttgtgattataaagtagtatgttcaagttttagtaaattaatattacgttatcaggtatgcaagaggagtgagaaccactaa

SEQ ID NO: 6775171 - DNA, 95 bp, Homo sapiens
gaaggaatactcacggcagtggtgataacctctatcatagctaccattaaattacttgttgtgactggttgtcccgctttcctcaggttttcttc

SEQ ID NO: 6775172 - DNA, 66 bp, Homo sapiens
attgcacaggactgtgatccagtaaccaagataaaggcctcttgtgttcatcccagtctgtgcaat

SEQ ID NO: 6775173 - DNA, 74 bp, Homo sapiens
tgtgcagtagttatcatcatactccagaccaatacttctcatctgtgtctgggttattatgatggctaccaata

SEQ ID NO: 6775174 - DNA, 119 bp, Homo sapiens
gacaacttgtcatgtgtaatcagcatcacattagtctcaagagaataagctctcctttaatcagctgcttttctttaatctggtggggtgaggcatatggtaaccatgacatttttgtc

SEQ ID NO: 6775175 - DNA, 66 bp, Homo sapiens
gtgacaatattagctcaggggccttctgggatcaataattggttgtctttgagttaaaattctcac

SEQ ID NO: 6775176 - DNA, 67 bp, Homo sapiens
gctgctccaagtgctgcctgctgccctgcccatggctggagggattttggtgcactgggaatgcagc

SEQ ID NO: 6775177 - DNA, 56 bp, Homo sapiens
ggaggaggtcccccgacatgcctgaggcaaaaccaggtggcgccaggaccccctcc

SEQ ID NO: 6775178 - DNA, 60 bp, Homo sapiens
gaatgtctatgtaaccgaggggtcccctcctccttttaaaactgtggttatttagcattt

SEQ ID NO: 6775179 - DNA, 83 bp, Homo sapiens
gagcttggtatttgctgtggggtagatctttctcaggaatgtcactttctgtgaataagattctcccactgaactccattctc

SEQ ID NO: 6775180 - DNA, 87 bp, Homo sapiens
cttgcactgaatggacagagatcaaaagtttgttaggtaaaaaatatttaggccaaatgacttgatgtttgaaaaatacattgcagg

SEQ ID NO: 6775181 - DNA, 107 bp, Homo sapiens
gatagattgcatttataaacttagggcacatgttagcttgtgtgaaaatgcttaaaaaaatgagcatttgcacacatttaacaaatactaagtctgccaaatctgtc

SEQ ID NO: 6775182 - DNA, 75 bp, Homo sapiens
tttctttcaaaaggctgttttctgtgtcattacaaagtgtattagttaacaagagaacagtcgtggtgagagaaa

SEQ ID NO: 6775183 - DNA, 110 bp, Homo sapiens
cgggagattctcctctctccctgctttggcaggcagctcctggagaggtgcagctcccggagaggtgcaggtcagtggcagtgggtacagacaagctggagagtttcttg

SEQ ID NO: 6775184 - DNA, 83 bp, Homo sapiens
gtgctgtttctattcatattggatatggtattctatggtattggctatagatacatacattttaaaatgttatttaacagcat

SEQ ID NO: 6775185 - DNA, 67 bp, Homo sapiens
caggtagggatatgatggtgatccaatatctattggtcttcttgtccatccattttgtcccttcctg

SEQ ID NO: 6775186 - DNA, 79 bp, Homo sapiens
gcaagttgtgaagttttactaggtgaatttgcaaacttacatgcaaatatcctcccagaactcctttctccaactctgc

SEQ ID NO: 6775187 - DNA, 60 bp, Homo sapiens
gacagcaatgagtaactccttgggccactcaacacccagactgacgttatcattgcagtc

SEQ ID NO: 6775188 - DNA, 62 bp, Homo sapiens
gttggagggcagaacagagaggggagggagcccagaacctctggatctgccctgacgccaac

SEQ ID NO: 6775189 - DNA, 57 bp, Homo sapiens
gctgttattttacaagacttatgctgtaagaagaatttgttttagtaaaataagagt

SEQ ID NO: 6775190 - DNA, 63 bp, Homo sapiens
gcactgagggccagcccataatgccaaaggctttgcagagtccttgctgtgccctcgggatgc

SEQ ID NO: 6775191 - DNA, 65 bp, Homo sapiens
tttcaacagatctgtcttcaggtttgctcattctttcttctgccagcttgaaactactgttgaga

SEQ ID NO: 6775192 - DNA, 61 bp, Homo sapiens
tcagattttattttcctgttaccaaagttaaactttgtcctgcaaaggaaatatgatctgg

SEQ ID NO: 6775193 - DNA, 61 bp, Homo sapiens
ggcctggcattccagagatggtcttggaattctaaaaatgcctctgatggaggccagcgct

SEQ ID NO: 6775194 - DNA, 57 bp, Homo sapiens
tgcctgcttgtgtacctggtgatggtattgtacttcagaaaacaggtgagggaggta

SEQ ID NO: 6775195 - DNA, 69 bp, Homo sapiens
agggaagcagaatttaatagaaaggtctggctaacaatgtgctacatttggaccagattctgctaccct

SEQ ID NO: 6775196 - DNA, 73 bp, Homo sapiens
gagacccagtaacttgcctaagttgccatccataaagtggtggacccaggcatcagaggcaggttcctgactc

SEQ ID NO: 6775197 - DNA, 68 bp, Homo sapiens
ttctcagggcatctcatgacccttagagcagtgtttgcagtctgggtgcacattggagtcactgggga

SEQ ID NO: 6775198 - DNA, 78 bp, Homo sapiens
caaaccatcagcttaaattctaggcctgggctgcttgcggaaaacttcccagaggagcatggccttgagaatggtttg

SEQ ID NO: 6775199 - DNA, 92 bp, Homo sapiens
ttgccttcattattcctggggatgaaatagaattaatttaggccatggaatcttcgactgcctgttctttcacccaggagttgtggggggag

SEQ ID NO: 6775200 - DNA, 71 bp, Homo sapiens
ggttctatggtaatatgatttgttgtaatacagcaattcctgtatcacatcttgtgatgttttcatgaacc

SEQ ID NO: 6775201 - DNA, 95 bp, Homo sapiens
atggcagtgttttagttttctccaactcaaaggaaaggtcaacttttagtgacctttcctttattttggaagataatttggtcaagcattaccat

SEQ ID NO: 6775202 - DNA, 56 bp, Homo sapiens
gccacaccttcctctagcctaggaattgataacccaggcgaggaagtcactgtggt

SEQ ID NO: 6775203 - DNA, 121 bp, Homo sapiens
gcacacctggaggctggggggctggtccaggttgagcaagtgtacgagcaggccctgcagctggccttggagatcactgctcatgttgggcagcagtctcagtagcacctgcaggatgtgc

SEQ ID NO: 6775204 - DNA, 72 bp, Homo sapiens
gtaggccatggtggttgtctctggcatcagtctgaaatgccagctacatccaagcaactctcacctggctgc

SEQ ID NO: 6775205 - DNA, 68 bp, Homo sapiens
gattctttctctgcacatgtagtaaatattaaacattgatcagacagttatgtgcatgagaaaatatc

SEQ ID NO: 6775206 - DNA, 106 bp, Homo sapiens
tttgaaacatttcaagcatttgaacgttttatgtgattccagtggcattttctgtgaaagttgtcatgccatttaaaatgttttcaaatatgaatcatgttacaaa

SEQ ID NO: 6775207 - DNA, 89 bp, Homo sapiens
tttggaaaaacaccatttatctctgtagtgctacttctgtgacactatcactgaagcgtctaggtagaaatttaggtggaatttccaaa

SEQ ID NO: 6775208 - DNA, 72 bp, Homo sapiens
aagactctggcagcagaaccagtgtttgaatccacatttcttgttctttacactctcgctgctataagtgtt

SEQ ID NO: 6775209 - DNA, 85 bp, Homo sapiens
acaatggtttgacttatggtttttcaactttataatggggcaaaagcaatacacattcagttaaaaactgtacttcaaattttgt

SEQ ID NO: 6775210 - DNA, 79 bp, Homo sapiens
tgaaaagaaggttgaaggggcatgcttttgccaggacctgttttcgtggcacccatgacctcttaggcctttggtgtca

SEQ ID NO: 6775211 - DNA, 90 bp, Homo sapiens
cctgccaaggatattatagacagagtcttctgtttttgtgggctgccatctcagaagctttgtctagtcttgatatattgcctggttagg

SEQ ID NO: 6775212 - DNA, 72 bp, Homo sapiens
gatgagacaacatgatggggaagaacaagaaaaatttcccatggatctcgtttatttttatcatgggacatc

SEQ ID NO: 6775213 - DNA, 76 bp, Homo sapiens
acttgcattcactcagttgcacttttcattcatgagagcgataggagaattgatgggtgccaatggagtggcaggt

SEQ ID NO: 6775214 - DNA, 55 bp, Homo sapiens
ctgggcacctttgcagcaggctcggccacgaggcctgctgtcacagcgggcccag

SEQ ID NO: 6775215 - DNA, 79 bp, Homo sapiens
tgttctgaatcatttcttctgaaaggtaagccatgtggctctaaaaggcatactcttcagagagaaatgattaagaata

SEQ ID NO: 6775216 - DNA, 67 bp, Homo sapiens
tttcttttgacccgagctgaagaaattcaccacacaccaaatcttcaataactcgggttaaaataga

SEQ ID NO: 6775217 - DNA, 66 bp, Homo sapiens
cttacgcctgccacctaagactgattgctttgtgttcacggtcctcagtccataggtgggcctgag

SEQ ID NO: 6775218 - DNA, 62 bp, Homo sapiens
gagtcaagctgccctacccgaggcactctccaaggggagagaaactcctaggccagcgactc

SEQ ID NO: 6775219 - DNA, 56 bp, Homo sapiens
ctgacttcttgctcatactagctgttctattcagatcagctagtggtaggagtcgg

SEQ ID NO: 6775220 - DNA, 60 bp, Homo sapiens
gaatactgatgctcagcccccttgcagttctctaggtatggattggagccatcagtgttt

SEQ ID NO: 6775221 - DNA, 68 bp, Homo sapiens
gcatcttggccccctgtttgtggcctgaccaccctgagaggtcccacaccttgaggggtcttgggtgc

SEQ ID NO: 6775222 - DNA, 60 bp, Homo sapiens
tggacttctcatgaggggaggtcagagtcaatgtaagtgacttcctaatttggggggcta

SEQ ID NO: 6775223 - DNA, 64 bp, Homo sapiens
tcaggtcttttgtctcctagaaataaatagtttttaaaaatcaataaaggggacagaaatctga

SEQ ID NO: 6775224 - DNA, 61 bp, Homo sapiens
gcccatgcactttctgtgatggctgataattgctgatacaagatgacaggtgcatgatggt

SEQ ID NO: 6775225 - DNA, 72 bp, Homo sapiens
gtcaccagtaggacatttggttaagagataagaggaggaatcatttgtctctcctgatgatctggtggagat

SEQ ID NO: 6775226 - DNA, 69 bp, Homo sapiens
tccctttctccttgttcccttcaattgttaaaaaacttgggtcaaacaacatgaaaggagaggagagga

SEQ ID NO: 6775227 - DNA, 56 bp, Homo sapiens
gggactggatagatgtgggtgacccaaccataactacctactctccctcagctccc

SEQ ID NO: 6775228 - DNA, 59 bp, Homo sapiens
gagtcagtcttgagccatgctggagaggaacaagtattctttagcaaaagggactgctc

SEQ ID NO: 6775229 - DNA, 130 bp, Homo sapiens
attgtgagaaataataatggctgttttaagtcactaaactttggggtggtttgttagtttcccaggactactgtaacaaactaccacaaactggatagcgtaaaacaaaagaaatttattttctcagagt

SEQ ID NO: 6775230 - DNA, 59 bp, Homo sapiens
ttggcgtcttttccatggaaagcctgctgtctttctctgggcttgggagaagaggccag

SEQ ID NO: 6775231 - DNA, 69 bp, Homo sapiens
tggacgtgggaaagatttgaaggatagaacagtaagctgtgctgtcatcttaaatcattcccactgcta

SEQ ID NO: 6775232 - DNA, 59 bp, Homo sapiens
gatcatgcagacaagaagaaccaaggaactttgttcctggcttccactcctctgttatc

SEQ ID NO: 6775233 - DNA, 96 bp, Homo sapiens
ttacggccttgcctagctggcagggacagctgcgtgtgatgctggtggagatgccagatgccgcctgccctgtgaggacggctggcggggccgtgg

SEQ ID NO: 6775234 - DNA, 71 bp, Homo sapiens
ggggacaggaagtgcctgtggtggaaggtgtgcagactttgctcccgtattataagtttttccttctcccc

SEQ ID NO: 6775235 - DNA, 67 bp, Homo sapiens
tggacaggaaaagattagagatttatgtgaatcaggacagcttaagtcttgaaatatttcctatcta

SEQ ID NO: 6775236 - DNA, 62 bp, Homo sapiens
gacatccaggctgatccatgaagaatgaatgtcttcagcctctgtgtctcaacctggctgtc

SEQ ID NO: 6775237 - DNA, 76 bp, Homo sapiens
catgttcagctcagaagccggaagtgctcctcaactagaggccagatactctcttctgcaactcacagccaacatg

SEQ ID NO: 6775238 - DNA, 87 bp, Homo sapiens
agatcttggcctctctcgatacagtgccaactctccagcacatggctcctttctgggtggcactgataatgagacgtgtcaaattct

SEQ ID NO: 6775239 - DNA, 74 bp, Homo sapiens
caatttggtatgtcatgagttatttcataggacaaagtttgttaaatgaacactcactggcagtgtcattagtg

SEQ ID NO: 6775240 - DNA, 58 bp, Homo sapiens
gctgaattttgttctagggttttgtgaaagttagaacttgcatgtgatgaaattcagt

SEQ ID NO: 6775241 - DNA, 68 bp, Homo sapiens
taagatggcaggtagtggtctcatcaggcagacccctatagaggtgggtactacatctgtcactctta

SEQ ID NO: 6775242 - DNA, 87 bp, Homo sapiens
acttggaatgccagaaaagagttccaagtcattttatgcaatgagaatgtatggaagatttttgagctcattctctacttcctcagt

SEQ ID NO: 6775243 - DNA, 114 bp, Homo sapiens
ggaagtaccaagttgctctgctttttgatcagtggatgaacgaaattaaattgttggttaaagaccaggctaatagttatggttggttctcatggcaagtagcttttcactttt

SEQ ID NO: 6775244 - DNA, 91 bp, Homo sapiens
tagaggtccactgtgggcctggaatcatgcaggggttacaagacgggggactcccatgaccaagcgtgattctccagcaaggggatttctg

SEQ ID NO: 6775245 - DNA, 87 bp, Homo sapiens
gggagttctcaccctgctggccatgcctggtctggcaccatgagttcttatcctgccaggagtgctggccctgctgggtgacctctt

SEQ ID NO: 6775246 - DNA, 56 bp, Homo sapiens
cattgctctagagacaagcctgaaattggatcccagatgtgcaactctaggcaatg

SEQ ID NO: 6775247 - DNA, 86 bp, Homo sapiens
gtggacctgccttgtctagctctgcttatcatggctcccaccatccttggagctgagaagagagctcagatcactgtgaattccac

SEQ ID NO: 6775248 - DNA, 59 bp, Homo sapiens
gcttttatgtcttcagagaatgtaagtgcagaagcgcagatttctccagaaaacatagc

SEQ ID NO: 6775249 - DNA, 98 bp, Homo sapiens
caagtagcctttaaagataagctgtacaatgtggccagtgttaatatgacaatttgttaatggactaggcagttgtaatcagtgttaaaaattacttg

SEQ ID NO: 6775250 - DNA, 75 bp, Homo sapiens
gccaatatcagaatcatttcatccctatcacgtgcctttcttgttgtatggattttcaatgaacttctgcctggc

SEQ ID NO: 6775251 - DNA, 96 bp, Homo sapiens
gtctgcacatcagcacggacttcatctctcagcaaggggtctctgcccttcagtgcgtgagaatgaggcccgtcaactgctaaggctgtggcaaac

SEQ ID NO: 6775252 - DNA, 87 bp, Homo sapiens
ggccccagtgctgtgggctgactcaggctgagctaagtttctattcagggatttaattttcctggtaggcctggcatgtcaagggcc

SEQ ID NO: 6775253 - DNA, 72 bp, Homo sapiens
gataaggtggcttaagatttgcgatacctaatgccagctaggtattaggtatctcaaatcttaagccccatc

SEQ ID NO: 6775254 - DNA, 82 bp, Homo sapiens
atctctaaaattagcatgataatagcaggtaaactgatactaagattatctgtttattgttactgtcagaattaaatgagat

SEQ ID NO: 6775255 - DNA, 92 bp, Homo sapiens
tatattttctgtcaggtgctttcagattcattttagatcaagtaactgaatcagagctgcattttagagccctatttgagtcagattatata

SEQ ID NO: 6775256 - DNA, 84 bp, Homo sapiens
tggactggctgatatggctaggaaggattggcccttacacatatgcagcttctacttccttgtctatatgcaatgccacgtcca

SEQ ID NO: 6775257 - DNA, 113 bp, Homo sapiens
gaaaacagtcaaatttaaccatttggagtttatttgaattcttggaaagagcaatattcaaaaccttttcaaaaataagatattctggactactggatggatgttttgttttc

SEQ ID NO: 6775258 - DNA, 83 bp, Homo sapiens
agaacagagaggttcagtcacgtgcccaagttcacccaggctggttgtgaacttcagcagcgtggctccaaagtccatgttct

SEQ ID NO: 6775259 - DNA, 81 bp, Homo sapiens
aggacacagaagcccaaaaggggcatggccacacactgagttaacagcagagttggagccagcccagggctctgatgtcct

SEQ ID NO: 6775260 - DNA, 70 bp, Homo sapiens
gggtttggaaggagtcaaccagctgaaggtgccaatatgactgtcagtaatgttgccttctttagggctt

SEQ ID NO: 6775261 - DNA, 59 bp, Homo sapiens
gagttttaacctcagctctctgattggtctgtcagaagacagcttgagagttcaggctc

SEQ ID NO: 6775262 - DNA, 63 bp, Homo sapiens
acacactggcaggagctataaaatccagctatggggtttgtcatgtttcctcctcagtgttgt

SEQ ID NO: 6775263 - DNA, 76 bp, Homo sapiens
gatgggtacctccgtgctgactgctgctcagctgctggcctcctttccagaagagcagtcagggtggtaagccatc

SEQ ID NO: 6775264 - DNA, 64 bp, Homo sapiens
caatatattcagtggaaaatgtgttgaagagaggatgtagttcttcaaaaacactgaatatatg

SEQ ID NO: 6775265 - DNA, 58 bp, Homo sapiens
tgcacttcgcgcacaggtgccagctgttacctcgccgggcagctgaccgcgcggtgca

SEQ ID NO: 6775266 - DNA, 76 bp, Homo sapiens
ggcacttggtagcagaaaataaacatttgtggaatgaataaacaaagttctacttttcacatttttttaccatgcc

SEQ ID NO: 6775267 - DNA, 78 bp, Homo sapiens
ggcgtcctgcagggcgcgtttgagcgggctctgcaggtatcagtagaagtccgttggagagcgcccgggcagggcgcc

SEQ ID NO: 6775268 - DNA, 93 bp, Homo sapiens
ccatactgtgttcaaaatattccattggtttcccttctcactcataataaaacctgaaagttagtaaaatgggatatattttgttcagtctgg

SEQ ID NO: 6775269 - DNA, 55 bp, Homo sapiens
aggtccagatcccagcttcagcctatctttaggagctgcatggatacctggttct

SEQ ID NO: 6775270 - DNA, 129 bp, Homo sapiens
aaaaaaacaaagaagaagaaacaggacatggatggcctggaagcagtcacttcctagttttataaagcctggagcctaggagagtaattagcatcaaggccagatcaattttcctcatcacagtatttt

SEQ ID NO: 6775271 - DNA, 63 bp, Homo sapiens
cccgtggcacagacagatcaggagtctctgggtccctatgacctctgccctctgtgccaaggg

SEQ ID NO: 6775272 - DNA, 63 bp, Homo sapiens
gctgctttggtatgaattcactacttccaaacaaactagggtttggatcatgtcaaagtcagt

SEQ ID NO: 6775273 - DNA, 58 bp, Homo sapiens
tgaaggggcattcccttagacaggaatgagttatcaccatgattggaatgtcttttca

SEQ ID NO: 6775274 - DNA, 78 bp, Homo sapiens
tggagataataaaagtatctatttcacatatggttctttcgaagattcaatgatggagtagatataaaattgtatcca

SEQ ID NO: 6775275 - DNA, 62 bp, Homo sapiens
ttgcaggtgaaatgggcctggcattgttaatccgtgtttggctgacctggtttaccatgcaa

SEQ ID NO: 6775276 - DNA, 64 bp, Homo sapiens
gcgttctggctcccgttgtccttgaagttgcatctcaggcttctgggcatggcagagcctgcgt

SEQ ID NO: 6775277 - DNA, 71 bp, Homo sapiens
tggcgttgtctatacataaaaggtagtcagagtaaaaagaattctagcaacatgtgttagacaatagacca

SEQ ID NO: 6775278 - DNA, 61 bp, Homo sapiens
ctttttttatcctttagtttcctgcctataggaggtgggcaggcaatgaggatgggaagag

SEQ ID NO: 6775279 - DNA, 72 bp, Homo sapiens
cagcctctggaaggttggctcccagttccatctcctgtctagaagaactgggtgcctgcctgctgtgggctg

SEQ ID NO: 6775280 - DNA, 57 bp, Homo sapiens
gtttctttctattgactgaacaccccctctggtgttgtgtttataaatagtggagac

SEQ ID NO: 6775281 - DNA, 70 bp, Homo sapiens
gatattccagtgtcatgctctcaggcaagcaggtctgttggcattggggagcaatggcattggctttttc

SEQ ID NO: 6775282 - DNA, 127 bp, Homo sapiens
gcttagaaaaaagaagccttatgcactacatttttagttttatgaattggtataatgagggatatgattgattgatcttcatattcactgagcataaagccagaagaaatgggcttaaaagtcaggc

SEQ ID NO: 6775283 - DNA, 67 bp, Homo sapiens
tttcagtcaccaacatggttcccaggggtctaggctgtggcctctgctggagcaagtggtgaggaga

SEQ ID NO: 6775284 - DNA, 57 bp, Homo sapiens
gtgttgtggagcttgtcaggggcatttcaatgtcacctgtgaagggctcacagctac

SEQ ID NO: 6775285 - DNA, 69 bp, Homo sapiens
caggtagcgacagccagctttgctgtggttgaggagactcatgcaacggctcgctgagccgcaggcctg

SEQ ID NO: 6775286 - DNA, 62 bp, Homo sapiens
caatcacttcagactaaggaagctcctggaaaagagagcaaatattttgttgaagtgcattg

SEQ ID NO: 6775287 - DNA, 59 bp, Homo sapiens
attgttttgtttcccagtgacttgttgctgccacaactccaatgaggagataggacagt

SEQ ID NO: 6775288 - DNA, 83 bp, Homo sapiens
taataatgtacataaagcacctagcacagtagattagctcataggagtcaccaaatgatttgctgttctgggtactattatta

SEQ ID NO: 6775289 - DNA, 74 bp, Homo sapiens
gttcaattaagttacaaatttatctgagacttcagctcagcttcagacccatgatatgtgtcttggtcatgaac

SEQ ID NO: 6775290 - DNA, 70 bp, Homo sapiens
aggggatccttgggctggcagaggtggtctttggatatgcaacggctacgtgctggcctacagagcccct

SEQ ID NO: 6775291 - DNA, 58 bp, Homo sapiens
ctgtttatctaggagttgcagggccattcgggatggctgcatgctcataggaaaatag

SEQ ID NO: 6775292 - DNA, 58 bp, Homo sapiens
cagccccaggaaaggaaatgaatgggtcagaacagcccaatacatttttttggagctg

SEQ ID NO: 6775293 - DNA, 66 bp, Homo sapiens
ggcatgctcaggcttcttgctgcctaggaaatgtgcccactgggggcttagaggcctgagtgtgcc

SEQ ID NO: 6775294 - DNA, 74 bp, Homo sapiens
tggactccagatggatttaagacctaactatgaaaagtgtatttctacaattgtgtctggaatgcgtggagcca

SEQ ID NO: 6775295 - DNA, 63 bp, Homo sapiens
tggtcctgatcaccgctgggcacagaggcaatggatcctgagcctagctgagcatcagaacca

SEQ ID NO: 6775296 - DNA, 61 bp, Homo sapiens
gatgcaagaacgaatcctacttgcttacatcaaggtgttagcagacttttgtatttgtatt

SEQ ID NO: 6775297 - DNA, 56 bp, Homo sapiens
ggaaaagaaagggactgattggaaaggatagttctgtctccacaccctttccttcc

SEQ ID NO: 6775298 - DNA, 79 bp, Homo sapiens
gggctttgggctgcagctggagcatcttctcatcttgcatttgagcgtggtggggtcctccagtgcgggatccatgtcc

SEQ ID NO: 6775299 - DNA, 63 bp, Homo sapiens
ttcacttaattgtcttctgtgccatatgacaggcagatcactttaggagcaatgagagtagaa

SEQ ID NO: 6775300 - DNA, 78 bp, Homo sapiens
ttttcataggccagtgtcctttcttaaaataactagtaaccaaaaaactttcaggattatttcagtggcttttgagaa

SEQ ID NO: 6775301 - DNA, 75 bp, Homo sapiens
gaggtggtatttatagtggtgcttagtgtaggctctggaactaggctgctggctatgaatcccattatgccactc

SEQ ID NO: 6775302 - DNA, 68 bp, Homo sapiens
agataagagttttgatgtttctatttcttattacttcctgttagaagagaatcatggaaactctttct

SEQ ID NO: 6775303 - DNA, 83 bp, Homo sapiens
ggagttctggtcgtgtcacccaggctggagtgcagtggcgtaatcttgcgcagcctccaccttctgggttcaagcgattctcc

SEQ ID NO: 6775304 - DNA, 99 bp, Homo sapiens
gcaaaaccctatcgataaagcaatggtaatgatttatgtaaattgacattcttttttatgaggtttacaaagttattttattctactccagggttttgt

SEQ ID NO: 6775305 - DNA, 74 bp, Homo sapiens
gattgtgccctgaaggatgtgtggtgggagtgggtaagctgggctcccaccttaaccttcacatgagcattttc

SEQ ID NO: 6775306 - DNA, 57 bp, Homo sapiens
gctgctactgagccagagggggtaaagcaacagcgttttctcagttgtgtgagcagc

SEQ ID NO: 6775307 - DNA, 69 bp, Homo sapiens
atgcatgagaatatcccatgctctctgatttgcagcagcagttgagcgaaaagggctatttatatgtgt

SEQ ID NO: 6775308 - DNA, 94 bp, Homo sapiens
agtgctttaggatgtggataaaaattatgtagtcactgtggtcttgattgcatctgtaatttagattgataacattttatacattctaactact

SEQ ID NO: 6775309 - DNA, 74 bp, Homo sapiens
agacattatgctgagtgaaagaagctagtcacaaaaggctacatattatataatttcattcatatgaaatgtct

SEQ ID NO: 6775310 - DNA, 80 bp, Homo sapiens
gggcacttttggcaatgtttactggggacccagacctcactcttggtctcccacagtgctaagacaggggcaaaaggctc

SEQ ID NO: 6775311 - DNA, 75 bp, Homo sapiens
tggtattaaaatataccttcttttatgaaacaactgtaaaagttgatggtcatatttgggggtgtgtgtttatta

SEQ ID NO: 6775312 - DNA, 80 bp, Homo sapiens
aaccaagcatttaccaagatagcatctggtttcatggctacctacccaaatgaaccagctatctttgtaaagaaagggtt

SEQ ID NO: 6775313 - DNA, 55 bp, Homo sapiens
cagctcttggagcctccagtaagtgttttgctggccaacaaggctccaagaggtg

SEQ ID NO: 6775314 - DNA, 89 bp, Homo sapiens
gatcacctttaaatgaatcctgactaatggtattagaggagagatggtgagaattggttggatttacaacatagtttgaaggtagaatc

SEQ ID NO: 6775315 - DNA, 73 bp, Homo sapiens
cagcctgaggtagatgtggggtgaggttgctaacagtctagtggatttttcccacatgtgaatcctcaggttg

SEQ ID NO: 6775316 - DNA, 55 bp, Homo sapiens
ggacagtttcctggatgtgggctccttaggatctggctcattcagggaacggtct

SEQ ID NO: 6775317 - DNA, 59 bp, Homo sapiens
agaggcactaagggaagagcagaggaatctacacctgtgtttggttccagagggcctct

SEQ ID NO: 6775318 - DNA, 93 bp, Homo sapiens
tttgatgcaactagtaacatcaacatgaatttctctgaagataaataatatgtgtttcaggatttttctatgtgaatcagctagttgatgaaa

SEQ ID NO: 6775319 - DNA, 69 bp, Homo sapiens
tttgatctgcacacaccgtgcttcactgatggaatcaccatgtggcctgggaaatgagtgttgatcaaa

SEQ ID NO: 6775320 - DNA, 92 bp, Homo sapiens
ttctcttcagaccctcctcagggattaaggtcaaaggtgggaggaagaaggcttccattggccttttatcctagaggttctaatggagggga

SEQ ID NO: 6775321 - DNA, 68 bp, Homo sapiens
ggaagattaagttgctaaagttttctgttcaaataatatgttcaataaacattagtaatttgactttt

SEQ ID NO: 6775322 - DNA, 57 bp, Homo sapiens
agccattgaaggcacttgagcagaggagtgacctgatctgacttatccttcaaggct

SEQ ID NO: 6775323 - DNA, 65 bp, Homo sapiens
ccaggacagtgcatttcctggcatgggagctcactcttatgcccagacaatgccactgagcctgg

SEQ ID NO: 6775324 - DNA, 68 bp, Homo sapiens
gacttggtgccattgctcctttgcccaccgctccctgatgcccagcagaggtgtcagtgcccagtgtc

SEQ ID NO: 6775325 - DNA, 76 bp, Homo sapiens
ggtgaagggcgactccggggacttggcctgagtcgtcatctccaccacgtctgtctcctgggtgcgcaccgtcacc

SEQ ID NO: 6775326 - DNA, 86 bp, Homo sapiens
ggttgaatagaatgagggagatgatgtagaaagctgttttgatatgtaactcttcatgctcccatttcctacattcttattagtcc

SEQ ID NO: 6775327 - DNA, 89 bp, Homo sapiens
caatagaatttctcaatgaaagagcatgcattttaaaatttaattatgtgcatttgaaatgccttatcattgagacagaaatttttttg

SEQ ID NO: 6775328 - DNA, 66 bp, Homo sapiens
gaaaaggaagggttctttctgtttataggcagcctatcctcatatccaaaagactctctcctagtc

SEQ ID NO: 6775329 - DNA, 59 bp, Homo sapiens
cagtggtagaagccaagtagatcattattccacaaacatttacaattggctttccattg

SEQ ID NO: 6775330 - DNA, 93 bp, Homo sapiens
atttaaagctaatttgcacttggcttcaaggttaaggtccacagcataagctgaagacctttaaatcagaagtcagactgaaaagccttaggt

SEQ ID NO: 6775331 - DNA, 58 bp, Homo sapiens
gcatgatattccaaggtgtgaagttttggtttgagaactttactattttgaataatgc

SEQ ID NO: 6775332 - DNA, 80 bp, Homo sapiens
cagagtctggagaggagcaccatggccatgaacactgactctggaaagaaccagatggcctgggctcgattccaactctg

SEQ ID NO: 6775333 - DNA, 63 bp, Homo sapiens
taatatctatactggggattgcggagtctgaatctttgtgtctgccccaaagtttagatgttg

SEQ ID NO: 6775334 - DNA, 68 bp, Homo sapiens
gtcgtgagggttgggagggcccaaatcttactaaatccagcatacattgggctctttaacccaggcac

SEQ ID NO: 6775335 - DNA, 71 bp, Homo sapiens
ccttcatttcctcacccatgaaatgcaggaagtaaggtctactttgcagagtggttgtgaggattagatgg

SEQ ID NO: 6775336 - DNA, 56 bp, Homo sapiens
tttttctttctgcttgccctttgaactttgaggtctgagcagtgcaggaagaagag

SEQ ID NO: 6775337 - DNA, 73 bp, Homo sapiens
atagtctctcctattcaatgggaggaatattgagctcacattgtataaagaccattgagataggagagattgt

SEQ ID NO: 6775338 - DNA, 55 bp, Homo sapiens
tgagtcaccttggtattggcaggggctgctttgttctgcattgagggctgtctca

SEQ ID NO: 6775339 - DNA, 63 bp, Homo sapiens
agtgcaaagccgaggtttcttgggcctctcacatcagcacctcccagacctcggttctgtatt

SEQ ID NO: 6775340 - DNA, 105 bp, Homo sapiens
catgccagctgctgtgggtgtgtggggccttcgggtcctgtgggatggcgagtgtgtgtgctgagcaggacctgtagggcctgcatcccaggtgagtgggccatg

SEQ ID NO: 6775341 - DNA, 57 bp, Homo sapiens
gggagaaagtggcccttgggcgagctgggccaggctcacattgcccctccacctcct

SEQ ID NO: 6775342 - DNA, 60 bp, Homo sapiens
acaaatgtcaggtggtggatggcttgagttccaagctaatgaacttagacctgacactgt

SEQ ID NO: 6775343 - DNA, 59 bp, Homo sapiens
agtcactggctttgggttgccgcagagccctcctggtttttgtagcaagaggcgtgact

SEQ ID NO: 6775344 - DNA, 122 bp, Homo sapiens
gctgaatgaatatatgaatgaatgaatggaatttgtttgcctttgtcaggtcagacttggtttttaagaccttgcagaactggaagtttgcctgaagtccatctttcatataaacgttgggt

SEQ ID NO: 6775345 - DNA, 64 bp, Homo sapiens
aagtgcaggagtggggaaagtagctgccaacctggaagtttttaatcccccttcctgaacactt

SEQ ID NO: 6775346 - DNA, 64 bp, Homo sapiens
ggtagcaatgcatatgtgggtagcatggaatttgaacagcacctgcttaatgtgcagtgagact

SEQ ID NO: 6775347 - DNA, 55 bp, Homo sapiens
tcagagtgaggcgtcaacatgagctgatgcacaggaccagatggccttaatctga

SEQ ID NO: 6775348 - DNA, 65 bp, Homo sapiens
gtggtcctttcttgctaagagtttatgttttgtacctcattcatgcgcatgagtaagaaaatcac

SEQ ID NO: 6775349 - DNA, 83 bp, Homo sapiens
acggcttcaactgcgcagaggccatcaactttgccactccacgatggattgattatggtaaagtggcttcacagtgtagctgt

SEQ ID NO: 6775350 - DNA, 124 bp, Homo sapiens
ggcccctgagatcagaggtggtgcctcctctgtgtgctggtggggtcctgggctctagccacagaagcacctgtcagctacatgttggtgagatggttttatggcacctggctcagcgcgggcc

SEQ ID NO: 6775351 - DNA, 58 bp, Homo sapiens
ctgtctcatgtagatggactatgagcaatgtaggccattgcttcattatgtgagatag

SEQ ID NO: 6775352 - DNA, 78 bp, Homo sapiens
tggtggtaatatatgccagataaaattcgccactttaatcaatttaagtgtatatttcagtggcatcgattaccctca

SEQ ID NO: 6775353 - DNA, 55 bp, Homo sapiens
aagtgccagtttctggcttcctctccctctgacctgaagtcagaagctagtattt

SEQ ID NO: 6775354 - DNA, 55 bp, Homo sapiens
aagaactgtaataggaggtcaaaggaaagggcttattgaaatccattacgttctt

SEQ ID NO: 6775355 - DNA, 59 bp, Homo sapiens
gtcacttgtccccagtagcctgtttccaacaagaaccaacaggagtggggattggggat

SEQ ID NO: 6775356 - DNA, 57 bp, Homo sapiens
ttctgaggatgcagccaccttcctatggtgagtggagatggctggttgtcctctgaa

SEQ ID NO: 6775357 - DNA, 61 bp, Homo sapiens
gtaaagtttgtctttctcagggcaagtacattccttcatgccagagaagtgcatacattat

SEQ ID NO: 6775358 - DNA, 65 bp, Homo sapiens
ggctttttattgatctgcactgatgtcctcgtttgctgaggtgcttacagaatccatgggaagtc

SEQ ID NO: 6775359 - DNA, 86 bp, Homo sapiens
ccttgaaaaagtagagaccttaggaaagttttctgctgcagttgtcctgagttgaataattttccagagatttgtgcttgccaggg

SEQ ID NO: 6775360 - DNA, 83 bp, Homo sapiens
gggagactgatgtactgtccgcatgtgtgccacctggagccctcaaagacatggggcattgatgtggacaagaatgtctgccc

SEQ ID NO: 6775361 - DNA, 63 bp, Homo sapiens
gttcttagtgttcaagtagcgctggttcaggtccaaaccttcagtctattttgatctaggagc

SEQ ID NO: 6775362 - DNA, 58 bp, Homo sapiens
tcctggtgtttatgtcacatagcatcctgaatggaatctgtgggaccaagcactggga

SEQ ID NO: 6775363 - DNA, 74 bp, Homo sapiens
ctggaacagggaaccacagcacagcttcctagttgagaatcttcaggaagggctcagtctgtgccctgtcccag

SEQ ID NO: 6775364 - DNA, 83 bp, Homo sapiens
gacgttagcgctccgccttcgcctggcaaaccctgcgcgggctccgctgccaggtcaccaggggtagcgccgggcgcgacgtc

SEQ ID NO: 6775365 - DNA, 58 bp, Homo sapiens
ttaagagggtgatgctagcatttcctgtgtgcagatttggcagccgtcatctatttgg

SEQ ID NO: 6775366 - DNA, 124 bp, Homo sapiens
ttatttgactgtagaggttaatccttaactgtaggtttgtggttgggggccttcttagaaaagctgtattttggcaggaaccttaaccacaaatatttagggggttttctttgtagttcaatga

SEQ ID NO: 6775367 - DNA, 63 bp, Homo sapiens
ggttaggattatatatcccatgatgccctacagtggggatcagaggatagaaatacttattcc

SEQ ID NO: 6775368 - DNA, 60 bp, Homo sapiens
aggtccacagttcagctgcccaagaggagctcaatcctgccagcagcaacatgtgagcct

SEQ ID NO: 6775369 - DNA, 60 bp, Homo sapiens
ggaggatggcggccacgccccctattctgcgctgtagtaggccctggttacgcctcctct

SEQ ID NO: 6775370 - DNA, 129 bp, Homo sapiens
ttgtgatgaggtgaattcggatctgatccaggccagtagctcctgcaaaactgggatagttccatgcccacagttaatgggggctcttctgggatggatataacatggttcctgggttcctgtatcaaa

SEQ ID NO: 6775371 - DNA, 77 bp, Homo sapiens
cgtggaccttccctgtggcctgtacccgtccctcaacagagacaggcaattaccagcgcccaggctgttgtccgacg

SEQ ID NO: 6775372 - DNA, 75 bp, Homo sapiens
aagagtgtgtgtgtgtgtgtgtgtgtgtgtgtgcgtgcatgcacgtgcacacatgtgtacaagtgcatttctttt

SEQ ID NO: 6775373 - DNA, 84 bp, Homo sapiens
gagctacattaagctgccagccttcattatcaatccatgcacttctcattaggataaacagaggcatggcatggatggtggctc

SEQ ID NO: 6775374 - DNA, 70 bp, Homo sapiens
ggatgagcgagtcgggtcggcccgggagtgttccgaacggagctggctccgccacgcccactcctacccc

SEQ ID NO: 6775375 - DNA, 122 bp, Homo sapiens
ctccatccaaatagagcttgtggacttcatcagcctagaccaaagagttcacggaggccaaagggagccactctggtgggctcagtgggctctactgaaaagtttagacttcatttggggag

SEQ ID NO: 6775376 - DNA, 56 bp, Homo sapiens
gccatcctgtgctgggccggccagctcccagcaattacaggcccaggacgggaggc

SEQ ID NO: 6775377 - DNA, 69 bp, Homo sapiens
catgccgcctgtgttctaatccatctcagccaggggcccaatgtcattgccagatggatagagggtatg

SEQ ID NO: 6775378 - DNA, 55 bp, Homo sapiens
caggagaagtctctagggggtgcctctcaactggccctatggagaccctttcctg

SEQ ID NO: 6775379 - DNA, 68 bp, Homo sapiens
gcagatggctcagcccatggaagaaaactttctcaagatgcttttcttccaggcctgggctcaggagc

SEQ ID NO: 6775380 - DNA, 78 bp, Homo sapiens
ttctgcaaacaatatggcttatgctgaacacctgctctttttctgggagtctggaatttttgtatatgctaagcagaa

SEQ ID NO: 6775381 - DNA, 77 bp, Homo sapiens
ctgtggctcagtgaagggtgccaagtacacctgtgccctccgctggtagctgctctaacacccttctgagcccgcag

SEQ ID NO: 6775382 - DNA, 92 bp, Homo sapiens
gaagcttgttacggtattttcaatataaacatttttatcatgaaaaattttaaacagacataaaaagtagtgagaatggcgcaacgaacttc

SEQ ID NO: 6775383 - DNA, 109 bp, Homo sapiens
gggggtacctgatgttccccaaggagatctctgaatctcctgactcttggttgtttgtgataaaagagcattccgttctgattcttctgggaggatttcaggtatcctt

SEQ ID NO: 6775384 - DNA, 121 bp, Homo sapiens
agctaatctggtgtggatcttcctcttccatcctaaatccctggagagttgctcaagatacagaggtgagcgactcacaggggatttaggatggaagaggaagatccacaccagattagct

SEQ ID NO: 6775385 - DNA, 55 bp, Homo sapiens
ccctgctactcaggaggctgagtcatgagaatcacttgaacctgggaggcagagg

SEQ ID NO: 6775386 - DNA, 61 bp, Homo sapiens
gaccaactcgtctgcccctgtgagcaatgtttattattcaacagggcatgatgagacggtt

SEQ ID NO: 6775387 - DNA, 64 bp, Homo sapiens
aggttttggaatattaaaatgtctcactgcatcggcactgttactttgattggtattctaacct

SEQ ID NO: 6775388 - DNA, 60 bp, Homo sapiens
gctgtccctaatttgattttaaatagccacatatagccagtggctactgatttggacagc

SEQ ID NO: 6775389 - DNA, 70 bp, Homo sapiens
gagaggacgagctcgctgggttgtaaaaagagacgagttttcatctttgagcatcgagattcgttctttt

SEQ ID NO: 6775390 - DNA, 95 bp, Homo sapiens
cagctcgtattgtagcatgcgcggctcagtcatctccaggggctgcccgttcaccttgatgagaccattgccgcgtctgcagtgcgccacagctg

SEQ ID NO: 6775391 - DNA, 63 bp, Homo sapiens
tccttctttcacctcatagtcagtttggccttaaaactcttccttagtgatgtgatagatgga

SEQ ID NO: 6775392 - DNA, 75 bp, Homo sapiens
gaagttgctgctgaggagtaagcaggggggactctgggcccctcatctcatcctgcacctgagcagcctgacttt

SEQ ID NO: 6775393 - DNA, 66 bp, Homo sapiens
cccagttcaaaattttgaagaaggcagttaattttctttgtgtctatcacctcattttgagttggg

SEQ ID NO: 6775394 - DNA, 77 bp, Homo sapiens
caggatattagtgaaagtaatacaaagtagagacataaaatgtgcttgtgcatttgggttgctctcctaacctcctg

SEQ ID NO: 6775395 - DNA, 71 bp, Homo sapiens
gggcaggagaaggaaaagctatgccagaatcccaggcttatttatttgcatagttctccttcctcctcctc

SEQ ID NO: 6775396 - DNA, 85 bp, Homo sapiens
tgtaaattttcagatgcttacatagcccaagtgtggaagactgaattctgtgttcaactatttggctgttgttagcaatgatgca

SEQ ID NO: 6775397 - DNA, 78 bp, Homo sapiens
gtagttgtctcttggtctacatttgtgtcttttggtgcacaaatgaaaagacacaaatgtagaccaaaagacaactac

SEQ ID NO: 6775398 - DNA, 63 bp, Homo sapiens
gtacataattttcagccagtttttgattattcaaagaccttctgatctttggattttgtgtac

SEQ ID NO: 6775399 - DNA, 81 bp, Homo sapiens
cttcagggctctgccgtgtgctcacatggacacacgtggagaacaggtgcaacgtggaggcatagcagatgcaacgtggag

SEQ ID NO: 6775400 - DNA, 62 bp, Homo sapiens
tttcactccctcgtttttcctctcagagagaaaaaaattagggaggaaccactgggaggaga

SEQ ID NO: 6775401 - DNA, 67 bp, Homo sapiens
tgagttaagaagtcccaggctgctgtgaagaagtaaacaacacagggccaggggccattttaactca

SEQ ID NO: 6775402 - DNA, 86 bp, Homo sapiens
gcccaggcagcctcctagttctctgccagtcgctgaaggacacccaggacagttattgagtgcagagcagggctgctgctggaagc

SEQ ID NO: 6775403 - DNA, 75 bp, Homo sapiens
cctaattatctcccaaagatcccacctcctaataccctcacactgggggttaggatttcaacagataaatttggg

SEQ ID NO: 6775404 - DNA, 82 bp, Homo sapiens
tgcacagcagggagctcaggaagaaagaagggagtgtgttcataacaatttctttccttcttgaaaacctgttatctgtgca

SEQ ID NO: 6775405 - DNA, 62 bp, Homo sapiens
tctgagaggcatctgcacttctgagttgtaacgcaggttaggaagaggcaatttctcttaga

SEQ ID NO: 6775406 - DNA, 130 bp, Homo sapiens
agtccaggactgttttcctacagcgtgcctcaaaagtgttgtagagggcaggattctacattcacagcctgttccatctacgagattttccagatgctacttgtggtagacattcctaactcatggtact

SEQ ID NO: 6775407 - DNA, 83 bp, Homo sapiens
cctagaggtttcatggtacatagtacatgtatgtgtatgtgtgtgcatgtgcaaatacatatgctgtggaggtgggacaaggg

SEQ ID NO: 6775408 - DNA, 106 bp, Homo sapiens
cagagaagcaccgttgaagataaagcacattctttgttgtaagtagcaaaagactgatacattcagcaaaagaatggttcatagaatttttaaagggtttcatttg

SEQ ID NO: 6775409 - DNA, 71 bp, Homo sapiens
tagtaatctctagtatgtctgtcttctagtcttcctctagtatattagagagagcatattactggttatta

SEQ ID NO: 6775410 - DNA, 61 bp, Homo sapiens
gctattctcagtgggaagggcacagttcaggatactcaattatctcttgccactgttaagt

SEQ ID NO: 6775411 - DNA, 58 bp, Homo sapiens
ccctgcctccctgaaggcacagcttttcctaaccctgagccgccaggaaggccatggg

SEQ ID NO: 6775412 - DNA, 56 bp, Homo sapiens
gggtagtaactacacagcgaagggagtgaagtccacacgcgtgaggtttgctgctc

SEQ ID NO: 6775413 - DNA, 73 bp, Homo sapiens
gaatagtcccctgaagttgagaaaaccacatgaccttacagtgtgaaatctaccctattcagggtggctattc

SEQ ID NO: 6775414 - DNA, 55 bp, Homo sapiens
ggagaggcatacatatacccagattctcatcccatgggtatatgtatgcctctcc

SEQ ID NO: 6775415 - DNA, 55 bp, Homo sapiens
aggcacagagaatgccctccatacatatttattgaatgaagggattaatgtgtct

SEQ ID NO: 6775416 - DNA, 56 bp, Homo sapiens
atgtggctcagcaggctcccgtttcacttttttgccatgggatttctgaggcacat

SEQ ID NO: 6775417 - DNA, 88 bp, Homo sapiens
atcagaagaaaggcactagatttgaaagtcttcaggacttgcacatgtaagattcatgggaaagctttaggtgtgtgttgattttggt

SEQ ID NO: 6775418 - DNA, 89 bp, Homo sapiens
tggtcagccttccaggacctgtctggaatgaaaagggaggaataaaaacttattttcgtttatttgacatgtaaggaaaagaatgatta

SEQ ID NO: 6775419 - DNA, 97 bp, Homo sapiens
ggtgagacagtcccaaagtcttagtatggttttaggttacttaaagtatttaaagcttgacgctgtacaaagacttctgggatatcctatgttaacc

SEQ ID NO: 6775420 - DNA, 69 bp, Homo sapiens
cgcaggcaagagagtacagttaatatctgaagaccctaaaagatatgccctgtggaattttaccatgcg

SEQ ID NO: 6775421 - DNA, 74 bp, Homo sapiens
agtcaactaaaacatgacagtgactttataagagctttccttttaaaaggttgctgttataaaaaagtatgact

SEQ ID NO: 6775422 - DNA, 69 bp, Homo sapiens
gggaatggagacgcaagggacctaggagtctcagctcctacgttcagccctagcgagatactcagtccc

SEQ ID NO: 6775423 - DNA, 104 bp, Homo sapiens
tcaccaagtcatctcgccaagctgagaaagctgcccttgtgaaacaaggatggtagaattcatgaaacgaggcagctttgaatactgtgagataattcaggtga

SEQ ID NO: 6775424 - DNA, 89 bp, Homo sapiens
agcttctcatggtttgtcctgagacattgttctttcaaagctctctgcctggatacaactgctctcagataagtagtcatggaaaagct

SEQ ID NO: 6775425 - DNA, 61 bp, Homo sapiens
gagcggaaggcctggctgatccggagccccaaaaggaattctgacaacatgccttttgctt

SEQ ID NO: 6775426 - DNA, 68 bp, Homo sapiens
ccctccaggaaagtcaggcttagatatcccttgctgtgtttctgccttatctttgctgagacgatggg

SEQ ID NO: 6775427 - DNA, 94 bp, Homo sapiens
tctaaggatctttctgcacagttgacaatgattaagatctggtatgataaatgtagatatttgatactcaacagtggaagactgatcactcaga

SEQ ID NO: 6775428 - DNA, 70 bp, Homo sapiens
gaacaggcaaagggtgaaggctcatacatttagattagccttttaaagtggttgctgtcagcctctgttc

SEQ ID NO: 6775429 - DNA, 66 bp, Homo sapiens
acatttcccaacaaggaaacgtgtaagatgtaaacagtttacaaagtttcactgttccttagatgt

SEQ ID NO: 6775430 - DNA, 106 bp, Homo sapiens
tgcatattaaaaagagatttactgaagttcttatgaaaacttgagctgatatttcatttcaatgtggttataataactagtatatttttcttgagcaaataatgca

SEQ ID NO: 6775431 - DNA, 76 bp, Homo sapiens
gggtgctaactggggctcccactgcagaacatgaggatctcagttagtgagctcttgggacctcagttccccaccc

SEQ ID NO: 6775432 - DNA, 83 bp, Homo sapiens
gagtcaaaggttgcatggtatatgaccatgttatttgcagtgtatgttaataatgtacatacatatttcgtgcaacctggctc

SEQ ID NO: 6775433 - DNA, 127 bp, Homo sapiens
tatcagaacctccatggctactcagccaggactgagaatgggagcaaacccaggccagaaagctatggactcctactgttcttatctcagttttagcagtttagcagttataaaggtgtctctgata

SEQ ID NO: 6775434 - DNA, 100 bp, Homo sapiens
gggacactcatgaactttttcccaggtgatatgttcctcaaactgctgcaactgcagaatgctgagagctgtccacctgtgggaatggtcagagggtctt

SEQ ID NO: 6775435 - DNA, 61 bp, Homo sapiens
tttagcacatttctcaaagaattgtcaccagtgaggtaggctacccttagaaagtgctgga

SEQ ID NO: 6775436 - DNA, 60 bp, Homo sapiens
tatccagtgaggatgataattaaggtggctttacctaaggcagttattttcatcttgata

SEQ ID NO: 6775437 - DNA, 126 bp, Homo sapiens
acttgtaaggccggagcccaagccgccatcttttctgcaggtgctgtttgggagaaggttctaggacatcttggaatcgttaggtaagcagggagcctcgggaatgagggtgggccctggacaggt

SEQ ID NO: 6775438 - DNA, 96 bp, Homo sapiens
ctctgaggctcatagtttagttagtatgattgtatcaatgttaatttcctggttttgacaattgtgctatgattatgaaagatgctaacattagag

SEQ ID NO: 6775439 - DNA, 79 bp, Homo sapiens
atggcttaaagtaactgccacattcattttgctcactaatctgcagtttggaagagctggaaagaaggtggcagcccat

SEQ ID NO: 6775440 - DNA, 68 bp, Homo sapiens
gcagtgggagccaaagcacctcggacgttcagattcaaccagaacaagcccaggtctggccccccagc

SEQ ID NO: 6775441 - DNA, 62 bp, Homo sapiens
tctccctttttttccttcacaaggaggtttgataggacttttttataaggaagaagataaga

SEQ ID NO: 6775442 - DNA, 81 bp, Homo sapiens
ctgtttttatccagtaccatgatgtttgagttactatagctttgtagtatcttttgaaatcaggtattgtgatgcctccag

SEQ ID NO: 6775443 - DNA, 72 bp, Homo sapiens
ccggcaactacaggcagattaagggtaggcatttcagactcgaaatactgctcttgttttttgttgttatgg

SEQ ID NO: 6775444 - DNA, 102 bp, Homo sapiens
tgagacagagtcttgctcttgttgcccaggctggagtgcaatggtgtgatctcagctcactgtgacttctgcctcccgggttcaagcaattctcctgcctca

SEQ ID NO: 6775445 - DNA, 110 bp, Homo sapiens
gtgagtgttggagatgctgttgaactttaagcttaattggtcacctgctgtcctttgttctttgaaataattgacattgatccttgctgttcagccacattgacacttat

SEQ ID NO: 6775446 - DNA, 56 bp, Homo sapiens
ggtggtcatcacggaaggaagatgggcacttccatcttaattgctctgtgaccact

SEQ ID NO: 6775447 - DNA, 102 bp, Homo sapiens
tgtgagggtgtgacatttatttaagggatttggagaccaaggcttcatacacatgcaatcagaggcttctggtgtcagtattctttgaattatcccctggca

SEQ ID NO: 6775448 - DNA, 56 bp, Homo sapiens
gtagtgtgtaggcactgtgctctgatgtgtgtcaggtgtcagtgagagcacagtac

SEQ ID NO: 6775449 - DNA, 78 bp, Homo sapiens
gagatttacaatgtgtaattatataaagatctacagctaacactgtgtggaactgccaattgtcactttgtggatttt

SEQ ID NO: 6775450 - DNA, 69 bp, Homo sapiens
ccctcagacctcctgagatctcgtttccagattggctcctctgagaatactgacactcaggtgggaggg

SEQ ID NO: 6775451 - DNA, 70 bp, Homo sapiens
ggctggcctgagctggagctttcggccaccgggcctccaggctccgtccagtctcaggcctcccccagcc

SEQ ID NO: 6775452 - DNA, 74 bp, Homo sapiens
tcatcaatgaaaactttagcctcattagtatggatatcttaatgcattttaatggtatgaagtccttcaagtga

SEQ ID NO: 6775453 - DNA, 124 bp, Homo sapiens
gattgtgtaggaagagagttaatggtagcttgttggatttttaaagtcagatctattaatgtctatttcactccgagactctatgaatcaatatgctgcattacactgaatctgagataccatc

SEQ ID NO: 6775454 - DNA, 64 bp, Homo sapiens
gtacggtggaaatgcccccaaatagtgtatgaatacattttggggagtttccatgacaacgtat

SEQ ID NO: 6775455 - DNA, 105 bp, Homo sapiens
gggggtcctcccaccccatcctcccctcagacagagactgggtgttgtgtgggtttctactgggtcctctgagagggcagcgcttggggtgaagaagtagccccc

SEQ ID NO: 6775456 - DNA, 61 bp, Homo sapiens
gagggccacgttcagggctctctgcaaccaaattgaacgcacagccctgttcgtggctctc

SEQ ID NO: 6775457 - DNA, 85 bp, Homo sapiens
ctgcctgctgaaagagcctcctgtagccctcacccaggtgctgctctctggggcagagctggagggggttccacagtcccaccag

SEQ ID NO: 6775458 - DNA, 87 bp, Homo sapiens
tgaataccttccgcacggtggctcacgtctgtaatcccagcactttgggaggccaaggcagatggatcacctgaggtcgggagttca

SEQ ID NO: 6775459 - DNA, 129 bp, Homo sapiens
tcattcccaagagttggtagtcatggggttgtctcccatgaaacctattaagaaacttaagaaacctatgcaagatacataataggtttcatgggagacaactcaatgactaccaactcttgggaatga

SEQ ID NO: 6775460 - DNA, 71 bp, Homo sapiens
ggctttgctgcctctcccagctccctggagacagtggagagagataagcctggtcgagagcacagccggcc

SEQ ID NO: 6775461 - DNA, 80 bp, Homo sapiens
gagccttttaaagtttcagaaacttggtctatgggcctttgttctcttctgattaagtaactgaacactttgtatagctt

SEQ ID NO: 6775462 - DNA, 66 bp, Homo sapiens
cttcacacccactaaaatgatgtttaaaaaaaatggaaaataacaagtgttagcaagggtgtggag

SEQ ID NO: 6775463 - DNA, 63 bp, Homo sapiens
gctaaacatctgtcatgtgtttatcgcagtgccaagctcagagcaaacattcagcagattggc

SEQ ID NO: 6775464 - DNA, 55 bp, Homo sapiens
ggagactacgttgtgagtagcaatgcctgtaaatggttactcacatttagattcc

SEQ ID NO: 6775465 - DNA, 58 bp, Homo sapiens
ccttacttggaggcctgttaccagacttccccccagctctggttgccttcaagtgagg

SEQ ID NO: 6775466 - DNA, 83 bp, Homo sapiens
tgttttccctatgtccagtacttctaaatggtcaatagactatggttggccatttggcaaaactgacttctcaagaggaaaca

SEQ ID NO: 6775467 - DNA, 71 bp, Homo sapiens
gtggaccaggcctggcccaggagcttgtcggcaaggcagagccgcatccaggctcccggaccaggatccgc

SEQ ID NO: 6775468 - DNA, 78 bp, Homo sapiens
tactattgtgaatagtgccgcaataaacatatgtgtgcatgtgtctttatagcagcatgatttacaatcctttcagta

SEQ ID NO: 6775469 - DNA, 71 bp, Homo sapiens
agagtcaagtagggcatgggctttccatggctcccttcagcccttctggctccaggctcctatttcacttt

SEQ ID NO: 6775470 - DNA, 85 bp, Homo sapiens
gctatggggctatctcttagaattctgaattgtgttcatcacttgtcaaaggagagagcatggcacagaggggtgcccctgtagc

SEQ ID NO: 6775471 - DNA, 63 bp, Homo sapiens
gagaagggcttagatttagaacatgctgataaacaggccagttctaaacataaagctaatttt

SEQ ID NO: 6775472 - DNA, 69 bp, Homo sapiens
ccctctccctgctgcatggcctccacgaccctggactgggtgtggctctgcctggcagtattcagaggg

SEQ ID NO: 6775473 - DNA, 75 bp, Homo sapiens
ggcagggacactgaggcatgcagagccgggatacagaccaagcaagtcctggctcctcttctgggtgtcccagcc

SEQ ID NO: 6775474 - DNA, 61 bp, Homo sapiens
gggcaaagagatgatctttgcaattgcttcaagtcctattgccctttgattctctttgtcc

SEQ ID NO: 6775475 - DNA, 63 bp, Homo sapiens
gcattatgccttagatattgaatggctagatttactagtagcaatggctctgagctatcttgc

SEQ ID NO: 6775476 - DNA, 62 bp, Homo sapiens
gggcaggtgtttccaaggtgagccttggcacaggtctcacctcatttgaggagtctctgccc

SEQ ID NO: 6775477 - DNA, 64 bp, Homo sapiens
ggctctggtttcctgttcactcaaagtctccacagagatctgagtttagctgaggctttgagcc

SEQ ID NO: 6775478 - DNA, 73 bp, Homo sapiens
ttgctttaggccaatcaggaaaactcagaaaaatcccacatctttctgacgtctgcctgttgtcctaagggaa

SEQ ID NO: 6775479 - DNA, 79 bp, Homo sapiens
acatcagcagcgggaagtctgttcagccgtcccttgatccccttcgtggagatgatatacaggcttttggctccggtgt

SEQ ID NO: 6775480 - DNA, 55 bp, Homo sapiens
ctgcctatcaaatggggagggcagtgtctcacaagtttccccaagtcgtaggtag

SEQ ID NO: 6775481 - DNA, 112 bp, Homo sapiens
ggtcttctcactctgtcacgccctggctggagtgcaggtgagtgatcagcaatgagctgtgaccacacatgtgcactccagcctgggtgtgaaactgtgacacatggagatc

SEQ ID NO: 6775482 - DNA, 60 bp, Homo sapiens
aaggcccagggattggaggtcacccctcagtcatgggcagaacttgatcccgtgggcctt

SEQ ID NO: 6775483 - DNA, 87 bp, Homo sapiens
tcctgtttctactaaaaatacaaaaattagccgggagtagtggctcatgcccgtaatcctagctacttctcctaggctgaggcggga

SEQ ID NO: 6775484 - DNA, 62 bp, Homo sapiens
cccccagggagaaatctccaggaggtttggcaagatctctagtttaagatttctcctggggg

SEQ ID NO: 6775485 - DNA, 62 bp, Homo sapiens
tagaagccagaagagtaatcctagttcctctctctcacaaagagttgctctgtggtctttta

SEQ ID NO: 6775486 - DNA, 62 bp, Homo sapiens
gtctggtccctgctcacttcttgttcagaatccctgtcctgaggacctctcaggggccaggc

SEQ ID NO: 6775487 - DNA, 60 bp, Homo sapiens
gtattagttatctactgctgtgtaacaaactatcccaaacctagtagtagaaaacaatac

SEQ ID NO: 6775488 - DNA, 76 bp, Homo sapiens
ccaggctctctgtggcgccgctgagagcagagggctgtcttggggtcttcgagctctggagccaaggatggcctgg

SEQ ID NO: 6775489 - DNA, 64 bp, Homo sapiens
cctggctgtctacttcatgtactcttccttgtatggggacggtggcatggcagttgatgtaagg

SEQ ID NO: 6775490 - DNA, 71 bp, Homo sapiens
ggatcattaacacatccatcacctcgcgtagctgccattctttttgcgggtagtgagaacttttaagatct

SEQ ID NO: 6775491 - DNA, 67 bp, Homo sapiens
acattttagaagttcatgtgggattttttttagtttatgtagaattcctttggatcttctggagtgt

SEQ ID NO: 6775492 - DNA, 77 bp, Homo sapiens
atcccctgggtacctactgtatactactgctgttctagagtttggagccacagagaatcagagatacagaggtggat

SEQ ID NO: 6775493 - DNA, 78 bp, Homo sapiens
gcttgaataggcaagggatacaatataccgtttcttaaattgagtggtattattaagtgtatttgacctatatcaggt

SEQ ID NO: 6775494 - DNA, 82 bp, Homo sapiens
ttgacttgggaaagatgtctcaaagacatctcctgcttgtaaaggcaggtgttttaagacattgaacccatccttaggttaa

SEQ ID NO: 6775495 - DNA, 72 bp, Homo sapiens
cataatggggcattctgtggagctcagacaatgcatgtccagagctctgtacacagagggtgtccaataatg

SEQ ID NO: 6775496 - DNA, 73 bp, Homo sapiens
agctaaatgtcctcagaggtgtgtagaagggcctgataaattctgttctgggtgctctgaggtcattcgtgct

SEQ ID NO: 6775497 - DNA, 68 bp, Homo sapiens
ggtgtgaaatctgatgaattgacctcagattccccagttcaggacatcaaattgtcagattttatccc

SEQ ID NO: 6775498 - DNA, 67 bp, Homo sapiens
gggagtaagtcagttggcctagactctgactccaggtcctgtctaggccatcacaggcgccactctt

SEQ ID NO: 6775499 - DNA, 78 bp, Homo sapiens
gctgcgcagagccaagggatggaagctcgtctgcaaggtcagcctcagtcgccccttgtctgtccggctctgtctagc

SEQ ID NO: 6775500 - DNA, 95 bp, Homo sapiens
cttgactaaagtggccctgcaaggggtaggcttagtgttcacagttaaggcaagagcttggcacaagggctattccttagctgaatggcctcaag

SEQ ID NO: 6775501 - DNA, 77 bp, Homo sapiens
ctggtggtcccggcgcactttgcagatgtttctcccacacagtggaaacattccctaatgtgtccgtagacttccag

SEQ ID NO: 6775502 - DNA, 64 bp, Homo sapiens
ctagggaagtctgtattttgtgtgaaacctttcaagcacagtgcaccactttgaaaaaccctag

SEQ ID NO: 6775503 - DNA, 68 bp, Homo sapiens
gggcagtggccactgctctcaagctcaggaaaagcccaagtcctggcctggcgcagtggctcacgcct

SEQ ID NO: 6775504 - DNA, 127 bp, Homo sapiens
ctctgtggaaagcacttctgttccccttgctttgaaactggcaggagataggctcagtgctggtgggaagtagctagcctctcttatcccttcaaagaagcaagaacaggactgaattttattagag

SEQ ID NO: 6775505 - DNA, 94 bp, Homo sapiens
ttcaaaggacttggactggcagataaacatgtgataaacagataaaacacctcactgtccgtccatctttttatcgttggcaggtgctcttgaa

SEQ ID NO: 6775506 - DNA, 65 bp, Homo sapiens
gcaacatctaagcaagaatgagtgcaacatttaagtaatcgttgcatgcttgtttggttgtcagc

SEQ ID NO: 6775507 - DNA, 56 bp, Homo sapiens
tttcaaaatgtatggggaaaatatgtgaataaaatattgtgaccatcattttggaa

SEQ ID NO: 6775508 - DNA, 75 bp, Homo sapiens
ttgacagcaaagattgtgcctagccccctaaaagacagtacagggtaatgcaaaggtcacaggctttgaaatcaa

SEQ ID NO: 6775509 - DNA, 79 bp, Homo sapiens
ggcctgaaggatgatggttttgtcctctttggttctcacctgcttgagaagtaaaacagtaactttgttcttctgggcc

SEQ ID NO: 6775510 - DNA, 72 bp, Homo sapiens
gctgagcttctccaactgtcctccccacatgtgcccaatatgcagcgggaaggcagtgggaggaactgcagc

SEQ ID NO: 6775511 - DNA, 102 bp, Homo sapiens
acacctcagttccttctacatgagtcatgggcttgaggttacccagaaatggactgtgaacctataaaccccagcatgcatgtggtattgcgtcgagcatgt

SEQ ID NO: 6775512 - DNA, 77 bp, Homo sapiens
tgacaagcatgtacattctgtttccccaaagagagcaggaacttttcagtggaaaaagagtgatttctgctttgtca

SEQ ID NO: 6775513 - DNA, 92 bp, Homo sapiens
caggcccaccatctcccagacatgtgcctccttgctctgcttctctggcctctcgcatggccgggctgcatgtttggggttggcaatgcctg

SEQ ID NO: 6775514 - DNA, 75 bp, Homo sapiens
cttcagcaggccaggccctgactggatgctggcgagtcgagaaaaacacaatcgggcctccggccttgtctgagg

SEQ ID NO: 6775515 - DNA, 56 bp, Homo sapiens
gtgacaggcccttcacccaaatcctgccatggggacaggggcgtggggattgttac

SEQ ID NO: 6775516 - DNA, 119 bp, Homo sapiens
gggggctccagtgtgctccaccccttcctttctgtcagcctgagtgctcccgccccctttgggcctcagtctcccacagagagggagagctgggtggcccagcaatctctggagcccct

SEQ ID NO: 6775517 - DNA, 66 bp, Homo sapiens
ggttcccggaaacaggtgacaatctcattttctttcttgagaggatcctttgttctgggtggtgcc

SEQ ID NO: 6775518 - DNA, 64 bp, Homo sapiens
aagttcttgtatttgcctttctcttttctaacttcttgagatttggctttgtgttcaagaattt

SEQ ID NO: 6775519 - DNA, 119 bp, Homo sapiens
tgaatcggctcaaagccaaatttaggttaatgtcaaatgagaggggagaacaatgaacgcatcattctttatgcttctgtttaggcttctgatctaaagaccaattgttgagttattta

SEQ ID NO: 6775520 - DNA, 60 bp, Homo sapiens
tcaattcccatattttatatgatttactttatagtagtaaatgtgaaatgtggggactga

SEQ ID NO: 6775521 - DNA, 84 bp, Homo sapiens
ctctattggaccatgatcttgcccttcctctctgtctgcttatggctcagcagagaaatggggtaatctttcaggaaggtggag

SEQ ID NO: 6775522 - DNA, 100 bp, Homo sapiens
ggctatttcaggagctgcttgcctgtggctagttggctctgttggatggagcagtgagttaatgaggccaagggcaggaggctgactttctgcaaaagcc

SEQ ID NO: 6775523 - DNA, 97 bp, Homo sapiens
ggggaaagaagaattaacttcacaatggaaaattttaacatggtctgcctcgtctagctagtgcatgtcaagcttatctctgtggtcttccttcccc

SEQ ID NO: 6775524 - DNA, 111 bp, Homo sapiens
ctattatgtcatctaagtgctgaaacattagccatatagaaaaagagctcttataggtagtctcttaattttttctaagtgtgtttatatttctatttagtgaccacatag

SEQ ID NO: 6775525 - DNA, 63 bp, Homo sapiens
gggatgtggcagctggaggtggagaagacttttttctcccttcctcctccacctgtctttccc

SEQ ID NO: 6775526 - DNA, 77 bp, Homo sapiens
acctgatggtcaatcactccccagcagtgagagacatgccctgaagcatcattgcagtagggagagacccatcaggt

SEQ ID NO: 6775527 - DNA, 78 bp, Homo sapiens
cctggcgctctgtgggtggctgtgccccaggatgcatccgtgtgttccctgccagcctgccatcccacagaggcaagg

SEQ ID NO: 6775528 - DNA, 61 bp, Homo sapiens
caggaagttcagaggttaatttatttgcctcaatggcacaatgaatttttttggaggactg

SEQ ID NO: 6775529 - DNA, 80 bp, Homo sapiens
gtggagggccagtgagtcgggagagctgctaatctttttcttgacttcagggacagttccttgtcctcatttccctccat

SEQ ID NO: 6775530 - DNA, 78 bp, Homo sapiens
gctctacaggccttaattgcagagcaatatagggaccaactcacttatgcttaatgcaatctaattctgccttggagc

SEQ ID NO: 6775531 - DNA, 88 bp, Homo sapiens
actattaggttggtacaaaagtaattgcagtttctgccattactttcaatggcataaaccgcagttacctttgcaccactctaatagt

SEQ ID NO: 6775532 - DNA, 56 bp, Homo sapiens
tagtgacagaacagaaagaactcaagtgtactctgaaatctaatgctctgtggcta

SEQ ID NO: 6775533 - DNA, 71 bp, Homo sapiens
tttgtttctttgaagtttctagaggtggaataaaacagacacatttctgtggactacattaaagaaggaaa

SEQ ID NO: 6775534 - DNA, 73 bp, Homo sapiens
cttacaaattcctatagggtaggtcttgctactgtcatttcatgtatgaagaaacctatcctctagtggtaag

SEQ ID NO: 6775535 - DNA, 75 bp, Homo sapiens
atgaaacctctgaatactgttggcagagctgtgaattgggaagagtcattatggaaaacagtacagaggttccat

SEQ ID NO: 6775536 - DNA, 78 bp, Homo sapiens
agggccaagatgtaatgattgcaatgctgctacctccaccatttggtaaagcagatttcagtcaactagtttggtttt

SEQ ID NO: 6775537 - DNA, 83 bp, Homo sapiens
gagccactctagtatattctcattttggcccagaggcataaaatcgcaagggcagcatcgtgtggaaagtggtagaaaggctc

SEQ ID NO: 6775538 - DNA, 60 bp, Homo sapiens
gagggaagactgtatattgagaaaagagaatctactctcttttcgggcctcagtttcttc

SEQ ID NO: 6775539 - DNA, 62 bp, Homo sapiens
gaagcatgtgtctgtgaagtgagtagatgagtgcataaaatatctttgtcagaacatgcttc

SEQ ID NO: 6775540 - DNA, 64 bp, Homo sapiens
cccatgcaacaaatgctacgaatcgctcgctgtcgatttagaagcatttgtggtggacgatggg

SEQ ID NO: 6775541 - DNA, 126 bp, Homo sapiens
ttaattttctgcctttttgagtttctccagttatcctggaagcatagcagcgtgtgtgtccttgggtaggacccacttgctgtgcattccactttgcacattgagaaaccaggcccagagaattga

SEQ ID NO: 6775542 - DNA, 56 bp, Homo sapiens
cacctgtcagaggatctcccgctgcccaaccagtggcatttctatactggcaagtg

SEQ ID NO: 6775543 - DNA, 130 bp, Homo sapiens
agtgtttcacaatgctcgatgtagacacacccctaatgtccttgttttctccactgcatcttatttcctaatgaggtctaggcaggaaactctggatgtggaggtccatcgcttggtggttgagaatact

SEQ ID NO: 6775544 - DNA, 57 bp, Homo sapiens
gctgcatgtggatggagctaaataatcatgttgttcacttcaaatccatatttcagc

SEQ ID NO: 6775545 - DNA, 56 bp, Homo sapiens
aggcctctgctggaaagagttgaaatactgccagcaactcaaatcactagaggctt

SEQ ID NO: 6775546 - DNA, 58 bp, Homo sapiens
gcttccttttgcttctctacctttacaaaaattaattttgggtgagggagctggaagc

SEQ ID NO: 6775547 - DNA, 80 bp, Homo sapiens
tgtaatcgaattcttgaaagacagaatctgtcaatctaaaattttgtgaaaagataagctgtttttcaagaatgaggaca

SEQ ID NO: 6775548 - DNA, 88 bp, Homo sapiens
gtttgggagcatggtaaagtagcaagtttagactgagcaatcaggagccttttttttggatgtgttaactttgaaatgccttttagac

SEQ ID NO: 6775549 - DNA, 58 bp, Homo sapiens
gccagggctgtgcaggtttgttcaggttccctcctgggccttctcggttggccctggc

SEQ ID NO: 6775550 - DNA, 60 bp, Homo sapiens
ttctcttgcagttttgcatgaccacgtaactgagttctggacaatgcacatgtaagagga

SEQ ID NO: 6775551 - DNA, 73 bp, Homo sapiens
tacttgtttaattttgtgctttctggacttcaatccatttacaatactttagaaagtactaaatttaactgtg

SEQ ID NO: 6775552 - DNA, 64 bp, Homo sapiens
acaaaagtgtcctgctttcacatttagattataacatgaacaggtggaggccaggatactttgt

SEQ ID NO: 6775553 - DNA, 62 bp, Homo sapiens
taaaggttgaaaactgactgcctgatggctggatctggctctcagatttgttttaatcttta

SEQ ID NO: 6775554 - DNA, 55 bp, Homo sapiens
tcctgccctttgaaagaacgtctttgaaagaacgtctttctttcaaagggcagga

SEQ ID NO: 6775555 - DNA, 87 bp, Homo sapiens
ccttgccccttgcccctttccatggctctcctagggtgcgggttgcggggctttgggcagcttggactggggagactaggtgcaagg

SEQ ID NO: 6775556 - DNA, 62 bp, Homo sapiens
gcagggcagagctgtctaaatggccagatgactgtggttcatggcccacggccctgctctgc

SEQ ID NO: 6775557 - DNA, 71 bp, Homo sapiens
ttgcttttatcagttgtgtgtatacacgcacacatacgcatggccatgcatacacacaatggttctggcaa

SEQ ID NO: 6775558 - DNA, 57 bp, Homo sapiens
ggtcattttagctcctgaagctcctattgtcatctgagcgcaggagccgaggtgacc

SEQ ID NO: 6775559 - DNA, 62 bp, Homo sapiens
tggctcatgactgtaatcccagcactttgggatgctggcagggggcagatcacttgaagcca

SEQ ID NO: 6775560 - DNA, 61 bp, Homo sapiens
tccctgctgcccactgcagtgactcttgcttagtgccttgtgtgtgggcagccctcaggga

SEQ ID NO: 6775561 - DNA, 58 bp, Homo sapiens
tcaaaggcggtccaggaataaagggagcccttcccagggattctaggatggcctgtgg

SEQ ID NO: 6775562 - DNA, 79 bp, Homo sapiens
tgtaaagtaagcacacattcaccatgactgaaaaccaaagttctttactctcacaaagtggatgtgggttggctagaca

SEQ ID NO: 6775563 - DNA, 65 bp, Homo sapiens
tccgtagctcccaaagtaattaattgctatgcaaatagtaatgccctctgctttggagagaagga

SEQ ID NO: 6775564 - DNA, 72 bp, Homo sapiens
gaggctttgggagtcagatttgcgctttgtttgtggtacattgttgcgttgagactggctccaaaaaggctc

SEQ ID NO: 6775565 - DNA, 75 bp, Homo sapiens
ttctggctggccggaggcatccctgttgttccagcacaaggctcttcagaggggaccctccacagccagcctgag

SEQ ID NO: 6775566 - DNA, 62 bp, Homo sapiens
ggataataagcacagcaggatgtccctcaaggtgcttcagactccggctgtgtttattatcc

SEQ ID NO: 6775567 - DNA, 81 bp, Homo sapiens
caagccccttgctgtggggctctctgttactgtgttccttgaatcacaccctttcagtcagagagctctcagcatagtttg

SEQ ID NO: 6775568 - DNA, 57 bp, Homo sapiens
tgctattgacactttttgtgtagccttgagagaagagtatgaattgtgttagtagca

SEQ ID NO: 6775569 - DNA, 70 bp, Homo sapiens
ggctaccagcgctgggtgtaaaggagaggaagaaaaaatcttccttttctatccttctaggttcttggct

SEQ ID NO: 6775570 - DNA, 78 bp, Homo sapiens
gctgagctgatggtaactgaaggaagtgactgagacctgaattaatgtcatttctattgctactgtctgaggcttggc

SEQ ID NO: 6775571 - DNA, 67 bp, Homo sapiens
gagaaaactgggaagaaggagtggtttactcttcaggcagagtgcaagttcttccttcttctttctc

SEQ ID NO: 6775572 - DNA, 57 bp, Homo sapiens
atgtgttagtggaaaccaaaatgtctgtggaccagcacagattctccactaacatat

SEQ ID NO: 6775573 - DNA, 127 bp, Homo sapiens
gttgcagtgatggattctttatcccttcattaacaatgactgcttgactgtactaggttacagtacttaattgtgagcagtaactgttggccagagtgatgttatttaagaaaccaacactaacaac

SEQ ID NO: 6775574 - DNA, 106 bp, Homo sapiens
ttggaatatttattgagttactgttatgcatcaggcactaggaatagaaagaaaaatattctgtctctgtactgggtgttcagaatttagtgaggaaaatagccaa

SEQ ID NO: 6775575 - DNA, 59 bp, Homo sapiens
acagttagaaagtggcagaaccaggattcaatgccagatggtttagctccattgactgt

SEQ ID NO: 6775576 - DNA, 58 bp, Homo sapiens
gatggcctcatggctgcaggcccacttctagtcggcttagcaactcctgaggctcgtc

SEQ ID NO: 6775577 - DNA, 93 bp, Homo sapiens
atagggaaacaggcagagaaagacttgcccttagtctggttggggacagtgctggaactagaatgcaggattggtctctggcctctcacctgt

SEQ ID NO: 6775578 - DNA, 91 bp, Homo sapiens
ttactagaaagaacactgctgagatgccaggagctctaaagacctgggtgcgaagagccccgaggctcctggctctaagtctttctggtag

SEQ ID NO: 6775579 - DNA, 57 bp, Homo sapiens
cagacagggttttggtctttggtttctgtgatcccagttgttcccatgaccctgctg

SEQ ID NO: 6775580 - DNA, 87 bp, Homo sapiens
tcagaggggacatacccagctgtcacagagagttctaggttgctctaatctcacatttcattgacagctggggcattttacctctga

SEQ ID NO: 6775581 - DNA, 65 bp, Homo sapiens
cctggctggttgtctgattctaacatagctgctatccctgattctagaaatcagaaaaccacagg

SEQ ID NO: 6775582 - DNA, 80 bp, Homo sapiens
gatcatttcttcacagggtattgggtgcaacgcaagtatacaatttgaaaacgtctttggtattcacttgtgaagagatc

SEQ ID NO: 6775583 - DNA, 130 bp, Homo sapiens
ctgacttcaagcctcccattcccaggatgagatggacaaatagcatgacacttgtattccaagcacaatcttgaggcaaccatgtttttgtccatggccttgccctgtaattgtgggatgtatacgcgtg

SEQ ID NO: 6775584 - DNA, 94 bp, Homo sapiens
catttattgagtgcccattatacatgttagagacagatgatgagtacaaagtacttagcctgatttctagtacatagtaagtgctcaataagtg

SEQ ID NO: 6775585 - DNA, 80 bp, Homo sapiens
agaagcagctgtggaaaagtaactaaattacgtggggaggctgcaggaagataggcattattttaccacggtctgtttct

SEQ ID NO: 6775586 - DNA, 56 bp, Homo sapiens
tcatttactggatccataagcacttgtaaacattgctaatggagtttgctaaatga

SEQ ID NO: 6775587 - DNA, 67 bp, Homo sapiens
tagtagacggatggtgccaaaacattaccaggtgcaaactgaacactaggaggagccgtccctacta

SEQ ID NO: 6775588 - DNA, 61 bp, Homo sapiens
gacccacttggcctgccagcctgtgtggattaattctcactggtctttggctaggtgtgtt

SEQ ID NO: 6775589 - DNA, 90 bp, Homo sapiens
ggagatgaggtatcaggactgggtggctagccaggttccaggccgggcctcaggatagctgcgcagcctggcattttcgcctcactttcc

SEQ ID NO: 6775590 - DNA, 76 bp, Homo sapiens
tgtcaggcatgactgaggtcttagagtcacccaaataaaacttatctatgtgctctgacctctcctccttctgaca

SEQ ID NO: 6775591 - DNA, 69 bp, Homo sapiens
gtgttcactttctccttctctatttgctgtatggagtagaaacagccagggtcagggagagaggaacat

SEQ ID NO: 6775592 - DNA, 129 bp, Homo sapiens
aggttgagaggtaacagatattcttttggtttgtagtaaagaagttaggtgtaacaatatgatctcttaatactttcatttgctgagtattgatttctttcttgcgagtatcctcattcctctctctct

SEQ ID NO: 6775593 - DNA, 81 bp, Homo sapiens
gttttcaaaaactcagtgtgtttcttagtatctggttagacctcttagaattaagaggcatctagagatatttttgaaggc

SEQ ID NO: 6775594 - DNA, 80 bp, Homo sapiens
cataagaaccagtaacagtgatcacctgtgggaattagatgggagattctcacaaatgaccatggttactagtttcaatg

SEQ ID NO: 6775595 - DNA, 72 bp, Homo sapiens
ctcataaatatgtatagagtcttttaaattatctgttgatggataaggactctgatacatttacataatgag

SEQ ID NO: 6775596 - DNA, 92 bp, Homo sapiens
cagaagaaaggtgaccgtttcatgagtcagagacctcatggagagagacagcatgaggtctctgacttagagatggatgcttggattatctg

SEQ ID NO: 6775597 - DNA, 127 bp, Homo sapiens
cagtaagtgcgtgtataggtttgctacctgggtatattgcatagtgctgaggttcggggtataaaagatcctgtcacctaggtactgagcatctatacccaacagctagcctttcaactcttgcctg

SEQ ID NO: 6775598 - DNA, 86 bp, Homo sapiens
tcatcctcctcagccaggtaatgtggagatggtccagaattatccttggtaatgtctcctgtacattaactctgggagaagcttga

SEQ ID NO: 6775599 - DNA, 88 bp, Homo sapiens
cccaatacttcagaatgtgaccttatttggaaagagggttgttgcagatgtaattggtcaagatgaggtcatactggaatagagaggg

SEQ ID NO: 6775600 - DNA, 72 bp, Homo sapiens
tttaattttatacctctttaaagaccctgtatccaaatatacaagtcacattctgaggtattgggagttaga

SEQ ID NO: 6775601 - DNA, 79 bp, Homo sapiens
gctgtgtgggtgaccagtgttttccagtttgcccagaactttcccagttttgaggctaaaaattctgcatcctcacagc

SEQ ID NO: 6775602 - DNA, 94 bp, Homo sapiens
tgtgtggatgcagtgtttgtccagctgaaggcagcctcactcggctgactacctgatgagtgattttccccaagctgacagctgctccaacaca

SEQ ID NO: 6775603 - DNA, 60 bp, Homo sapiens
ggaaagagtggagaaggggaaggaaagtacctcaatggtccctttctccatacttcatcc

SEQ ID NO: 6775604 - DNA, 94 bp, Homo sapiens
attatttaggacatttagaacagagtatttttatgtaaaaaatttggcaaacatattttgttttcaggtaccttgtgaaagtgttttgaataat

SEQ ID NO: 6775605 - DNA, 61 bp, Homo sapiens
ctgaagggattatttttgcatgtccccatcagaagagcaacatgaaaactggttccttcag

SEQ ID NO: 6775606 - DNA, 68 bp, Homo sapiens
cccttctgactgcccttgtcctggcacacctccgtaggtttgccatgtttaagtggcaattagaaggg

SEQ ID NO: 6775607 - DNA, 88 bp, Homo sapiens
cctaacaagccagatggtatagtagggagagcactggtctgagagttaaagacccagttctgccactactttaccctaggatcttggg

SEQ ID NO: 6775608 - DNA, 61 bp, Homo sapiens
gggcagttatctgactgacaagttttaaatgtgggacctttcagcccaggtgtctttgccc

SEQ ID NO: 6775609 - DNA, 81 bp, Homo sapiens
aagtagcagagaaaattagagattggttgacagatttgggaattttaatttcttcttagtttttaactttcatctttgctt

SEQ ID NO: 6775610 - DNA, 56 bp, Homo sapiens
ggaatctcaagtccatagaatcaggaatcatagttccaatccctggacttgaatct

SEQ ID NO: 6775611 - DNA, 89 bp, Homo sapiens
caggctccctggtctgaatgtttatattggccaaaagggatgttcagagttcttattgtccaataggatgttcctgcagatggtgcctg

SEQ ID NO: 6775612 - DNA, 59 bp, Homo sapiens
ccttaggagttcacttgaatagtcgtttttatatttgtgactgcaagtcacttttaggg

SEQ ID NO: 6775613 - DNA, 86 bp, Homo sapiens
gtcttttgccaggacatctacatgttgatttaaagaagtagattaggcttctgctttgagttaggatgtagaataatgcaaaagac

SEQ ID NO: 6775614 - DNA, 82 bp, Homo sapiens
tgctgccagcagtctagctgccagccaacttgctgtgcctcttcctccagccagcagtcctgctgtgtgcctgtttgctgca

SEQ ID NO: 6775615 - DNA, 58 bp, Homo sapiens
gagaccaatgagcaagtgaaagcagattggtttgaatcttgcatttgctggttggctc

SEQ ID NO: 6775616 - DNA, 61 bp, Homo sapiens
aacttccttttctcactcccaagccgggggagcttgggtcagagtaagcaaggacaaagtt

SEQ ID NO: 6775617 - DNA, 63 bp, Homo sapiens
cttaaaagagatgacggcagggtaagtgcaaagtaaaacctccttgctctagtctcttgggag

SEQ ID NO: 6775618 - DNA, 77 bp, Homo sapiens
ttaagtaaaatagatgggtgtgaaatagatgctttgtaaaatacaaagttttattcaagcattagtcatgtatttaa

SEQ ID NO: 6775619 - DNA, 58 bp, Homo sapiens
gtggcatgtggttaggaacagctcttcagactcagactgagagcctccaaccggctac

SEQ ID NO: 6775620 - DNA, 72 bp, Homo sapiens
cctcaccttgctgagtgacattggtaaatcccagtcccggaattcaggccgtgtccttcagggagagtgtgg

SEQ ID NO: 6775621 - DNA, 90 bp, Homo sapiens
ttcatatccccagggcctgtcacgacgctcatgaaatggttgctgaatgaatgactgaccggccgaatgagtgagtgagtcttgtgtgag

SEQ ID NO: 6775622 - DNA, 84 bp, Homo sapiens
tgggcgggtgtcagtggggacatgggatatcagatcctagggctcccatgctgacccctgtgtccttggcagatatcccgccca

SEQ ID NO: 6775623 - DNA, 75 bp, Homo sapiens
tcgcttgaacccggcaggctgaggttgcagtgagctgagatcgcgccactgcactccagcctggcgacagagcga

SEQ ID NO: 6775624 - DNA, 86 bp, Homo sapiens
ggaagtgctggcgcccactcctggaaaggctgagacagcacaggtcccaaagcccagaggctgggcgtgcattactcagcaaatcc

SEQ ID NO: 6775625 - DNA, 60 bp, Homo sapiens
ggctcaggggccaggcctgtcccccagaaacctgccttgagacctctggccccttagacc

SEQ ID NO: 6775626 - DNA, 111 bp, Homo sapiens
tgtctatttttatatactctcctgaaatgctatcttttttggtaggcacactatcaacaaatgcactttcacaaagcatagcactttatgggatttaaatgaagaaagata

SEQ ID NO: 6775627 - DNA, 55 bp, Homo sapiens
ttggggggatgattggagaggctttctcttatacccctaaactgcagccccccag

SEQ ID NO: 6775628 - DNA, 94 bp, Homo sapiens
acaaaccttaatgaatattgggtgtgggcatcagggtcctgtcatttttgacactatgtcccaagtagcttaaacccaacacttaaggaaaggt

SEQ ID NO: 6775629 - DNA, 129 bp, Homo sapiens
cctacagaattaaaggctatcacatagcaaccagcagagagcagtagagaacttctcgagtgcctgctgctaagctctttgtttctgctgttttaactttgtgtatagaacaatcattgagctgtcagg

SEQ ID NO: 6775630 - DNA, 80 bp, Homo sapiens
aggagaaggttgagggtaatcatatggtagagcaaaaacattctcagagtctctcttatctttcctccttcacctctcct

SEQ ID NO: 6775631 - DNA, 57 bp, Homo sapiens
tgtaaatgcttattagtgtcacaaaattacccattttgtgatgagggagcattaaca

SEQ ID NO: 6775632 - DNA, 59 bp, Homo sapiens
cacaggcagggacctcttgagttcccaagcaacagggaatgtgcaagacttgtctgatg

SEQ ID NO: 6775633 - DNA, 69 bp, Homo sapiens
tgcttctgttaacttatgttcccagcttcattttattattgggaatgaccttaataagtaggcaggaca

SEQ ID NO: 6775634 - DNA, 85 bp, Homo sapiens
ggtttagtttaataataatgttgtaagagtgtaagtaccagtagcttcatgtacattctacaacccaataataattatgctgacc

SEQ ID NO: 6775635 - DNA, 90 bp, Homo sapiens
aggaacaggggacacttgtaatggagaacactaagctatggactgctatggactgctagtgctctccgttacaagtatcccctgttacct

SEQ ID NO: 6775636 - DNA, 78 bp, Homo sapiens
tatcttttccctatagttccaggcatgttattgaattgagtaacagtttgcctgaaatgtattaacctgggatggata

SEQ ID NO: 6775637 - DNA, 106 bp, Homo sapiens
gcaagcgttgccgcgccgctaccgtcgggggccggcccccgggctgcttttcgtgcgcggagcagctcggccagtcaccaggcgcgtgcggaggcggcgagcctgc

SEQ ID NO: 6775638 - DNA, 67 bp, Homo sapiens
ccttggtccgtcacacacactttaactctccctgtgcctggaaattgaagtctgtgatgagaaaggg

SEQ ID NO: 6775639 - DNA, 61 bp, Homo sapiens
gctgatggtctagggactctggtgtaggagtaactgaacttagaaagtcaaagctatcagc

SEQ ID NO: 6775640 - DNA, 61 bp, Homo sapiens
ggacaacatgttttaattaaggaatgttgatcaggcaattgtgctttaaaaacatgtttcc

SEQ ID NO: 6775641 - DNA, 74 bp, Homo sapiens
gtcccccagcatcctcagactctccgtgggactgaaagtttcaataagcttcttgacggatgttctggtgggac

SEQ ID NO: 6775642 - DNA, 65 bp, Homo sapiens
gtgacttacacagcaggctctcttgggctatcgagtccttcatagaacactgctagtataatcac

SEQ ID NO: 6775643 - DNA, 83 bp, Homo sapiens
ggaatttagagtccctgggttttaccgagtctccactgactagcagtgcagctgtgggagaatctctgggtttctgggactcc

SEQ ID NO: 6775644 - DNA, 66 bp, Homo sapiens
aggatgactggccactcagggatgcaggaagtggcttttctgcatggcctgcctggtgagtcacct

SEQ ID NO: 6775645 - DNA, 57 bp, Homo sapiens
gaagactgggacaggctgacttccggatttgtttggatttgaccttctcccgtcttt

SEQ ID NO: 6775646 - DNA, 70 bp, Homo sapiens
ggttccaatcttctttcttaacagtacatgaaacaattgatggtgcattagaggaaaaagatttggtccc

SEQ ID NO: 6775647 - DNA, 67 bp, Homo sapiens
cttcatggctgcagtccgtgccctgggccactgtcagcctagaggctcagcagatgcctgccataag

SEQ ID NO: 6775648 - DNA, 67 bp, Homo sapiens
ggccttgtgggtcaaagaaagcatgtttgttcctgaagacaaatgccatctggtgatgtattaggct

SEQ ID NO: 6775649 - DNA, 99 bp, Homo sapiens
aggtgatgtactcaaaaaacagggcttgttgaaagcggagacaggatgggattccagctgctctgctcaccagccatgtgatttttgaacaagtcactt

SEQ ID NO: 6775650 - DNA, 59 bp, Homo sapiens
gtggaagtggggcggggaggggacaccagtccgtgcctcaccctgaccactacttttgc

SEQ ID NO: 6775651 - DNA, 72 bp, Homo sapiens
catcctggctcctggagacctgctgatacagctgccttgtggctactgctgagtgggtcaccagccagggtg

SEQ ID NO: 6775652 - DNA, 57 bp, Homo sapiens
gtcaccctgctggctgttcagctgatgtttattgctggtgtttcagccagtggtgac

SEQ ID NO: 6775653 - DNA, 67 bp, Homo sapiens
gctgcttgggccctctgtgcctcagtttcctcatctgtaacctacagaagtggcttcaaagagcagt

SEQ ID NO: 6775654 - DNA, 94 bp, Homo sapiens
gcagctccaggaggaatttgcggaagggggtcctctggagacggtgacgccccacctctttgccttctcctcttctgtggattccctgagctgt

SEQ ID NO: 6775655 - DNA, 78 bp, Homo sapiens
ccactgaggccagtttatggagggggtgaaggcatggtaaacatgtctgcctaccccttgataagttgttccagatgg

SEQ ID NO: 6775656 - DNA, 58 bp, Homo sapiens
ctaagcaatgtttcagaaagagttaggacagtttcgtcctattgaatgcattacttgg

SEQ ID NO: 6775657 - DNA, 114 bp, Homo sapiens
ttttttacaagccacgtagtttttggtattttgttataggagctgaaatggactaatacaccagccaacttctgaatgataggagcagacagagactattttaatttgaaaaaa

SEQ ID NO: 6775658 - DNA, 60 bp, Homo sapiens
ctgtgtttctcttgacccaagtgatggttaagaggtggttgttttggaggagaaatatgg

SEQ ID NO: 6775659 - DNA, 58 bp, Homo sapiens
agggcatccctttccccagccttctccaaggccacctgggcagacgggagcttgcctt

SEQ ID NO: 6775660 - DNA, 63 bp, Homo sapiens
ggccgggggcggcggggtgagggggggcagcagctcgccactctgattggtcacctctgctcc

SEQ ID NO: 6775661 - DNA, 117 bp, Homo sapiens
gctgctacatagtctgcttctgttaattttttaaccactgtttaatctggccataattaagtttggctttcttcgttgtttgagattttcagaattcaaggcaagctagtagaaagc

SEQ ID NO: 6775662 - DNA, 62 bp, Homo sapiens
gtgtatacatcacagaggaccaatgatgatcaacaattgggtcattctgtttcatgtgtcac

SEQ ID NO: 6775663 - DNA, 64 bp, Homo sapiens
gccgagcacagtgcagctgccttatcagatggggcacacaggcttgcacagtgagcatctcggc

SEQ ID NO: 6775664 - DNA, 87 bp, Homo sapiens
gtaggaccagctacatgatgtaagagcccatctaggtgtggaacccatgtgaatgtatagtttgtatatccatgaagctgggcctgc

SEQ ID NO: 6775665 - DNA, 70 bp, Homo sapiens
ccattcttcccactgtgttgctgttaatctaccataaaccaggtagattctgcatagttggaagtgatgg

SEQ ID NO: 6775666 - DNA, 79 bp, Homo sapiens
ttctatgctgttagaacatttttagaccaataagaaggacaatttcatatggtctctcaaatgtgcttcttgcaatgaa

SEQ ID NO: 6775667 - DNA, 60 bp, Homo sapiens
ggggccggcgctgacccggctccagccgcctccaggggcggggtctgagcgccgcgccct

SEQ ID NO: 6775668 - DNA, 58 bp, Homo sapiens
accctcttgagattagtcagtagctaggactatcccagtaactgtctctgagagtggt

SEQ ID NO: 6775669 - DNA, 91 bp, Homo sapiens
gagaagctgcatagagagatggcatgaaatgcagcataaggtacgtgttcattcaacatgtcatctaagctccctttgcatcaaacttttc

SEQ ID NO: 6775670 - DNA, 85 bp, Homo sapiens
ttgccttcgataaaaggtagtttattgtatatggtagtttatggtacagccaagactaaataatgatttactggataaaaggcaa

SEQ ID NO: 6775671 - DNA, 68 bp, Homo sapiens
tgaggctgtggtgatgattgggtcaatgggtaaaatccccttcctgtgacaaacatttcatagcttta

SEQ ID NO: 6775672 - DNA, 121 bp, Homo sapiens
gccacacagagcctggtaagcagctctgaaggcattctgtcaggccctggcagccgtgacattctagatgatttttgagcagctgggctgactcagggctgactcacttggcaatgtgggc

SEQ ID NO: 6775673 - DNA, 60 bp, Homo sapiens
gtgccacagttgccaggaaccacatgtgtaaaggtgtggaggcatcagagtgcttggcat

SEQ ID NO: 6775674 - DNA, 55 bp, Homo sapiens
tttgagagtcagatccgaagatgtggtatatccgccatctttagcaactttcaaa

SEQ ID NO: 6775675 - DNA, 75 bp, Homo sapiens
gtgtctagaagtgggccactgagggtggtcattttgttttggaacagggattctcagccttggcaccactgacat

SEQ ID NO: 6775676 - DNA, 80 bp, Homo sapiens
cctttgaggatcactggattagtttgaactgttgatggctgttaaatcagtgtggtgacttgtctgatgggccccagggg

SEQ ID NO: 6775677 - DNA, 92 bp, Homo sapiens
gaattgaaaattacttattttacactgaaaaaactgagcttaaaacttactttgccttttagtgtaggacttggacttggattttctaattc

SEQ ID NO: 6775678 - DNA, 85 bp, Homo sapiens
agactgaattgtttcagaaagtccagggtttaatcccagcttttactcaagagcagagagcctggacttttctgagcctcagttt

SEQ ID NO: 6775679 - DNA, 68 bp, Homo sapiens
gagcacagaggatttttagggcagtgaaactactttgtaggatactgtaatggtggatccatgtcatc

SEQ ID NO: 6775680 - DNA, 124 bp, Homo sapiens
ccagttgtcagcctatattttggataagaaacattattctttccaaagagaagttttcatcagaaaaaggattgggaaaaatattgtttgttatctgaaattcagtaggaggttttcaacttgg

SEQ ID NO: 6775681 - DNA, 76 bp, Homo sapiens
tgacattgttggtaatgctcagaggcccttggagggactctaaattctttctgtcctcagcgatatcaagatgtca

SEQ ID NO: 6775682 - DNA, 130 bp, Homo sapiens
ctggaggcagcagggcggttcacactgtgcccggctgactctgtcctttccttacgatgatcagctcacagggcctcagccagggcagacttttcagttcctaactgcccacctgtgcctgtgcacccag

SEQ ID NO: 6775683 - DNA, 83 bp, Homo sapiens
ccattataagtttcttgaagactgatgtttattgcctcttcttaagtaattataggcatatagtgtttaaaaaaatatattgg

SEQ ID NO: 6775684 - DNA, 60 bp, Homo sapiens
cctgcctgtaagatgggtacaatagtatccacagtgcacagtgcctcttcttcaggtagg

SEQ ID NO: 6775685 - DNA, 57 bp, Homo sapiens
gcattactggcccacagaggttttgagccaatcagctctgagactgggttagaatgt

SEQ ID NO: 6775686 - DNA, 76 bp, Homo sapiens
ggcgcggagagcctccggctggggagctaaaccgctggggactccgcggctgctgcctgagtcgctgtccgctgcc

SEQ ID NO: 6775687 - DNA, 62 bp, Homo sapiens
tttgagaagattcagggagtgtgcatccttgtgaagcccttagcagagtctgacatcttaaa

SEQ ID NO: 6775688 - DNA, 70 bp, Homo sapiens
tttatgtggactgttgttgtttggtttatttcaattgaaaggaaaagatcaatagataaagctacataaa

SEQ ID NO: 6775689 - DNA, 72 bp, Homo sapiens
tgcttgagaatgtgttgcccttctcttgagttaaaccatcaatctttggaaaagagacatttctcatcagca

SEQ ID NO: 6775690 - DNA, 65 bp, Homo sapiens
tccccactcagaagaaacaagagagtttgctgttgcctttcctgaaatctcttctgcagcaggga

SEQ ID NO: 6775691 - DNA, 100 bp, Homo sapiens
tttcttgacattatgtgtggtgaagaagtacaagacaaattttctagatatgaaatgtctttgagtatttctgcaaagggcttgttaccatggtgagaaa

SEQ ID NO: 6775692 - DNA, 66 bp, Homo sapiens
tcccagcctgtggcagaggtctaatgttaacagaagcgttaaaatctatacacgaggtgggtggga

SEQ ID NO: 6775693 - DNA, 73 bp, Homo sapiens
catgtagaagctgcggaagattggtgagttactctttaaaaaaccaatttcttggcttccaaatcactacatg

SEQ ID NO: 6775694 - DNA, 57 bp, Homo sapiens
gacactttctcaggtaaagcatccttggcactatggatgctgataactaggagtgtc

SEQ ID NO: 6775695 - DNA, 60 bp, Homo sapiens
ggcacctctgggctctgttaggtgcctgtggcagacgaaataatggtccccaaagatgtc

SEQ ID NO: 6775696 - DNA, 107 bp, Homo sapiens
gggaggattctttttagctttataatcttttttaaggatgccggcagctgaggcttcggaaataggacatctagaaaaaagacctgttgagctcaaggaaaccgccc

SEQ ID NO: 6775697 - DNA, 83 bp, Homo sapiens
gttattacatgttcaggtagtctctatcattactccataggactttggaaaaatggcaaaaggagttagttgaaaagaatggc

SEQ ID NO: 6775698 - DNA, 55 bp, Homo sapiens
atggtaaatgagtgattagtggctaaatacgagtttgtattgactcatttatcat

SEQ ID NO: 6775699 - DNA, 89 bp, Homo sapiens
ggttctggaatactgagagtgcttgaaaggccagctttcatgtgtgattttggctgcatggcctttaggtacactgagttttaagaacc

SEQ ID NO: 6775700 - DNA, 67 bp, Homo sapiens
gactcaaattctggcagttccttgttgatatattccttcggtgtttctttggcattgctgttgagtc

SEQ ID NO: 6775701 - DNA, 73 bp, Homo sapiens
tgttggctgtatgtactacactagaacatttgtggataattacataagcttagctgtggtataataaataaca

SEQ ID NO: 6775702 - DNA, 102 bp, Homo sapiens
aaatgtgggcttttattccaatattcattaaaatgcagtggttcaagtgactgaatctgtaacctgtgttaagtgaatgttttttggataaaagttacattt

SEQ ID NO: 6775703 - DNA, 84 bp, Homo sapiens
ggtgggaggtggcagaggtgggaagtccaatgttctagaatctaaattggtgactcggagccctagctgtgcatcagaatcacc

SEQ ID NO: 6775704 - DNA, 57 bp, Homo sapiens
ctcttgcttgcaagtggggataaaaatagctaccccatagataattgtaagggatag

SEQ ID NO: 6775705 - DNA, 79 bp, Homo sapiens
gtgagaaaggtctgatgcatcactaaatagtgccgtgggcagaacacgctaacagtggctgcatccgcacttttgttac

SEQ ID NO: 6775706 - DNA, 68 bp, Homo sapiens
tcctggtggctttccctgccttttcctaggatactcagcctggtctgagtcaaaggaagctgccagga

SEQ ID NO: 6775707 - DNA, 58 bp, Homo sapiens
atgaaattctgatattgttaaggatcacacaagggtgtcaagacaagacagaattcat

SEQ ID NO: 6775708 - DNA, 75 bp, Homo sapiens
caattgctggtattttatacacacttagactatacatgatgtactcagtgctgtgtaaatgtattacagtatttg

SEQ ID NO: 6775709 - DNA, 73 bp, Homo sapiens
cagaattcactaattcagtgtttgcagcaactttataaaacataatgattgcaaacattgagaactgactctg

SEQ ID NO: 6775710 - DNA, 64 bp, Homo sapiens
ataatctcagggtaatgaaagacgaatctactctggaattgccttcatatacacctgatattat

SEQ ID NO: 6775711 - DNA, 60 bp, Homo sapiens
cttctgtgggtgcctccagcagtgacagaaagaatgtacaggaggtgtgaccaatagagg

SEQ ID NO: 6775712 - DNA, 101 bp, Homo sapiens
aggttgctgttgaaatgtttggagtctccttcaggatatgtgatatctgaaatctttcaggttttgtgtcatgaggtttgagtctcatttgtctgtaagct

SEQ ID NO: 6775713 - DNA, 76 bp, Homo sapiens
tttcagataaaatacagtgaaagtgagcaaggcagaaaaagtcaacagatgcccaggctcctactgtattctggag

SEQ ID NO: 6775714 - DNA, 72 bp, Homo sapiens
tccatgtataagaatgggaataatgatacctacctttttaggtgctatcactaccccattaaaaaatctgga

SEQ ID NO: 6775715 - DNA, 55 bp, Homo sapiens
cccctggaggtacacaagacagtacttgtctgtgccatcagtctccagagttggg

SEQ ID NO: 6775716 - DNA, 66 bp, Homo sapiens
cctttggcctggctgccctgtctggagtgaggagtctttgtggaaggaggccaggcccagcagagg

SEQ ID NO: 6775717 - DNA, 81 bp, Homo sapiens
ggtggtggtgccactggcatctagtgggttgaggtcagggatgctgctcagcagcctacaatgcacagaacagcccccacc

SEQ ID NO: 6775718 - DNA, 65 bp, Homo sapiens
ggccccagcttgcccaggactgagggcttgagagagtccttggcaaaccagggcagctggtcacc

SEQ ID NO: 6775719 - DNA, 68 bp, Homo sapiens
cacatgaaacagggagtagtaatttacagaaacattttccagtaaacataaaccctgttgacattgtg

SEQ ID NO: 6775720 - DNA, 62 bp, Homo sapiens
ttggcagcagagaaattaaacttctgccattggtttggggatttgtttttctgttcagtcaa

SEQ ID NO: 6775721 - DNA, 76 bp, Homo sapiens
gggccttcggcagggagctgcggtcttgcgaagactacttctctgcgcaaaaacgcacagctcgttcttggtgttc

SEQ ID NO: 6775722 - DNA, 80 bp, Homo sapiens
tctttgattcctgttgaattgatgtttgggtttgtcatttttctttagagacccagtgcatggatagatagctttaaaga

SEQ ID NO: 6775723 - DNA, 63 bp, Homo sapiens
acgggtttgttgacatggtggatattagcttactcattcacgcatggacggtcaacatcctgt

SEQ ID NO: 6775724 - DNA, 81 bp, Homo sapiens
agctttcagtctcaatgatgatcttaatgatgagaacttcctgtcttgtttcttgagagttctgaatgagtaacagaagct

SEQ ID NO: 6775725 - DNA, 65 bp, Homo sapiens
agtctccctccccgcccgacttcaccaccagagccaccagaagagtttgcaagggatgggagatt

SEQ ID NO: 6775726 - DNA, 60 bp, Homo sapiens
ttggagagctgacatcatgatgttgggaaatgaaaccaatgtttgtgtgtcattttctgg

SEQ ID NO: 6775727 - DNA, 102 bp, Homo sapiens
tcttacatataaatgatatcagtgtgaataagtaatgcttttgtagataacttatgttttgtattgcaaatagcctatatttatagtgattatgtatcaaga

SEQ ID NO: 6775728 - DNA, 67 bp, Homo sapiens
taaacatgatcactccggctttttctttgcaaatagggtcaagggagaaggcaggtaggttagtttg

SEQ ID NO: 6775729 - DNA, 85 bp, Homo sapiens
gctatgactgcggacttaaagaatgtggctcagccatgaaggattgcttctgtatgaacccatatacttattgcaggcacaaagc

SEQ ID NO: 6775730 - DNA, 67 bp, Homo sapiens
gggttttacaaggttaatcagcaggttctgggaaagcttgcacctgctcagacttgatctggaactc

SEQ ID NO: 6775731 - DNA, 60 bp, Homo sapiens
cagagctggacgtctgagccctaaggacggcttttgggatctcaaatccagctatgcctg

SEQ ID NO: 6775732 - DNA, 76 bp, Homo sapiens
cgtgggcagtagaagccagatggtccatttttatgacattttacaagttgtgtcagtgccatttgtcttgcctatg

SEQ ID NO: 6775733 - DNA, 104 bp, Homo sapiens
ctcacaaatggatgtcgatgtcatttattctcttattctacagaccttcattggctacatgggtagtatgggcaagagataggtggtcctgacggaggagtggg

SEQ ID NO: 6775734 - DNA, 60 bp, Homo sapiens
ggagttcaccaaggttatgcagcccataaatcggggttggaattcttgtagtgtgactct

SEQ ID NO: 6775735 - DNA, 79 bp, Homo sapiens
catacttgaccaggtgacaacacggtatttgacaaggaaaaagacaaaagatgatagactgccacctggtttaagtgtg

SEQ ID NO: 6775736 - DNA, 64 bp, Homo sapiens
gaagcagggattttgttaggcagcctttctggcttccttttctctcctgaccagactttgcttc

SEQ ID NO: 6775737 - DNA, 102 bp, Homo sapiens
tgtccttcaaattgcactcaccaagcctgagccatgctttactgctgaaacatcctagcagagagaagtaagtggctcagggtggccctcttgtggtggaca

SEQ ID NO: 6775738 - DNA, 79 bp, Homo sapiens
tgtagttgcatgtgactctatttatgcataataaagtaatggagcctatgtaagggtgatggttatatgcaagtttaca

SEQ ID NO: 6775739 - DNA, 56 bp, Homo sapiens
caggccagctggaggggcagctgctgccgactgaggagctggcccccggtggcctg

SEQ ID NO: 6775740 - DNA, 70 bp, Homo sapiens
ggctgtctctcttttgttctatgttgtatcttcagctcccagcaacatgggacagagaaagaggcctgcc

SEQ ID NO: 6775741 - DNA, 69 bp, Homo sapiens
gacaagtcgtctggagtgaggctgaggaatgggtgttttcagaaacttcagctacctctgatgcaagtc

SEQ ID NO: 6775742 - DNA, 62 bp, Homo sapiens
ctcccttattttctagcttgcttgacaatttcactgtctgagctacttaggatataacagag

SEQ ID NO: 6775743 - DNA, 55 bp, Homo sapiens
ctccgaacagtggctccaaggctcccctgcgagctgtacaggaaccagtttggag

SEQ ID NO: 6775744 - DNA, 69 bp, Homo sapiens
atgttgcccattccaggagatatttgaaattataaagagaaaatgagttttcaagggaagggggaacat

SEQ ID NO: 6775745 - DNA, 76 bp, Homo sapiens
agtcacgttccctttggaggatctaagggagaatctctttcctttcctttccatgcttctagaggctgcgtagatt

SEQ ID NO: 6775746 - DNA, 130 bp, Homo sapiens
atataatgtgactgaattattaaaaggcaagtgtcaccagcgtgagcataggaccaagggcagtcatgttgcactaacacagctggtgcactagctctgattctaatgatatattcagcattcaaaatat

SEQ ID NO: 6775747 - DNA, 64 bp, Homo sapiens
gcgctgtgcctggcacccagtgtttctaataatataaattgagacattgtgacatgcagggtgc

SEQ ID NO: 6775748 - DNA, 56 bp, Homo sapiens
gcacatgcctgcatatccgtgtgtgcctgtgtgtgtgtgtgtgtgtgtgtgtgtgt

SEQ ID NO: 6775749 - DNA, 58 bp, Homo sapiens
gagagataggttgcaggaagctttgctccctttggtgtctcctgccttcttgtttttt

SEQ ID NO: 6775750 - DNA, 67 bp, Homo sapiens
aggcatattacaattatagaaggatcatgtctcaaatgatccaggcatctgaattgagtgaatgtct

SEQ ID NO: 6775751 - DNA, 58 bp, Homo sapiens
tgtgaggcgaggccagtgagctttcctggtgaggtgccactggcaaccccgcctcata

SEQ ID NO: 6775752 - DNA, 72 bp, Homo sapiens
cttcagtttcttcttatttaaaatgtgaatactaatgtgtatctcatatgattgtaatgagaataaatggag

SEQ ID NO: 6775753 - DNA, 73 bp, Homo sapiens
ccggtccgcgcctccgccgctttttatagcggccgcgggcggcggcggcagcggttggaggttgtaggaccgg

SEQ ID NO: 6775754 - DNA, 94 bp, Homo sapiens
ggggaagtgtaggcaggccaggcctttctccattcctgcaggcaaggcacaagcccaggaacggggcgcaaaggccgcctggctcatttctgcc

SEQ ID NO: 6775755 - DNA, 59 bp, Homo sapiens
cagattgagtctgggaaaaggctctcaaatgtcccccagcccccaccatgctcaaactg

SEQ ID NO: 6775756 - DNA, 85 bp, Homo sapiens
cggggtagcagctgcagggcacaggctccgggtccaggcccaggtttaaaccctcatcctggcccttacaagctgtatcacctcg

SEQ ID NO: 6775757 - DNA, 67 bp, Homo sapiens
gtagtgacatgcataacaagattggaagtagataattttccattttaatgttagtgtcatgtcttac

SEQ ID NO: 6775758 - DNA, 63 bp, Homo sapiens
cttctttggggaatattctggttgttattttcactttcttagcaacgaggtaatctaaggagg

SEQ ID NO: 6775759 - DNA, 74 bp, Homo sapiens
cctgcacttctttctctgtgttattcataagatatgagagtcttgagtctgagatgatgggataagagggcagg

SEQ ID NO: 6775760 - DNA, 67 bp, Homo sapiens
tttcacattcagctcattaatggtctagtacattgtatttttgatttaaagatggctgaatatgaga

SEQ ID NO: 6775761 - DNA, 63 bp, Homo sapiens
tatcattgtggttttaatttgcatatgcctgattaatttgcatatgcctgatttctaatgatg

SEQ ID NO: 6775762 - DNA, 113 bp, Homo sapiens
ctcatcagcctcttctccctctggatgtcctcccggccagccaccaagaccatgaactttggctggcagagagctggtgaggatcgcggtttggctggagatggggttgagag

SEQ ID NO: 6775763 - DNA, 102 bp, Homo sapiens
agctgtggtttcttctttacagatttagagagagtgaagaacccctaatacaaaactaaagaatgcattatggaataacctttctgaaattgtatcatagct

SEQ ID NO: 6775764 - DNA, 58 bp, Homo sapiens
gagcaaagcaatgagaccgcatcatgggttagagaccactgcacaagttgctttgctt

SEQ ID NO: 6775765 - DNA, 74 bp, Homo sapiens
agcatccttctctgagatagactaagtggcagaataagaaatctgttaaggtctattagtggagaaggaggact

SEQ ID NO: 6775766 - DNA, 111 bp, Homo sapiens
gttaattcagcgggtaacaagcacatggtctgggcccagagtcccctgagcattccaccaagtagactgtgtctagcaccacgtgtcttggacttgctataagaagagagc

SEQ ID NO: 6775767 - DNA, 73 bp, Homo sapiens
gggaggggcagtcaagagggagtctgaatttctggaaagtcggcaccttctcctcccatctgtctgcactctc

SEQ ID NO: 6775768 - DNA, 60 bp, Homo sapiens
ttgctttgatgctggagaactaatcacccagagagagctggtctccaggcaggtgagcga

SEQ ID NO: 6775769 - DNA, 62 bp, Homo sapiens
cagactcctccacagacctactgaatgagaatctgcatttgaacaggactgctgggggtatg

SEQ ID NO: 6775770 - DNA, 60 bp, Homo sapiens
ctggggaggaggctgcagccttggagtttgttgagcatggtgggcacagcctccccccag

SEQ ID NO: 6775771 - DNA, 77 bp, Homo sapiens
gctttcacacgtagtgggtggaaatgactacagctcttttacagttttgtgtagtagcattcacgaagtgtgaaagc

SEQ ID NO: 6775772 - DNA, 106 bp, Homo sapiens
gggccttacaatatcatagaggtttgtgagcatgtttacttgattgatatatgttcagaacaggtcttacagccactttttgcttttgtgatgatttgttttgcct

SEQ ID NO: 6775773 - DNA, 87 bp, Homo sapiens
tcttcttctctgtctcttctggattggtatctgcaaccctgaaccactagcggcagttacttctgagaagtgaaattgggaaggagg

SEQ ID NO: 6775774 - DNA, 72 bp, Homo sapiens
gcatctggaaacttctgtgctctccttggcctctgtgttcttcatctccaggtttagggagcacccgggtgc

SEQ ID NO: 6775775 - DNA, 61 bp, Homo sapiens
tttagggaaattgagggttaagcaacaatgagaacaaggcttgcccctgagtttttctgag

SEQ ID NO: 6775776 - DNA, 56 bp, Homo sapiens
gtagctgtctcggtcaggagttaacagactgcttaacctttactatgactagctac

SEQ ID NO: 6775777 - DNA, 129 bp, Homo sapiens
ggttgggtatcttttgcctatcggagagacgtgaattgttgtggccagaggacacattgtagaaaattgtctgtaaagacggccaccaacatgcatgttgcctctcccatcaagaggtagaacctatct

SEQ ID NO: 6775778 - DNA, 128 bp, Homo sapiens
agggactctgtttttattcacaatgaattttattcattaagttcccatgcctaaaacattgttctagtaggtgctcaggaaatagtttagtgttaagtgaatgccttttgtgagattacactgttttt

SEQ ID NO: 6775779 - DNA, 78 bp, Homo sapiens
agttttattatacaaaggtgacaactaggttcctaagaggaaccttcgtttcccactttgtaaaatggtgataaagct

SEQ ID NO: 6775780 - DNA, 61 bp, Homo sapiens
gcaagaggcctcgtgctcagcgtgcagaacactgaagccacgatagcttcctaacacttgc

SEQ ID NO: 6775781 - DNA, 84 bp, Homo sapiens
tgtatgatgtcatggtaacaaagaagactttcagaatttcctagggactgaaggaaacttttgtgttttaccagggcatttaca

SEQ ID NO: 6775782 - DNA, 79 bp, Homo sapiens
tgctataaactcctgcatactcagaagccatatagtttgtttgcttttaagcttttttagtggcagtgttgctatagta

SEQ ID NO: 6775783 - DNA, 78 bp, Homo sapiens
tctcaattctgcctctaaatatttctggagaagaatggaggaaaaggaatccagagatatttatgagtagaattgaga

SEQ ID NO: 6775784 - DNA, 80 bp, Homo sapiens
tctgctgtgtttgcaacaaacgtccttcataatacaaggagttccttgtctgtgacagacctttgctaagacactggaga

SEQ ID NO: 6775785 - DNA, 75 bp, Homo sapiens
tggtgtataggaagcacttaaagaatttgttgactcattcaccactttgagcctagcttccttatctgtaaacca

SEQ ID NO: 6775786 - DNA, 111 bp, Homo sapiens
aggcagtcagactaaggctgtgcaggtgggggagaagttgtgacacgccacatgtcctgcccctcatatcgctcctcccctgacctcactggcctaccaggatggctgcct

SEQ ID NO: 6775787 - DNA, 76 bp, Homo sapiens
agaacctagaaaatggttttgtctcatcaatgtaatgtcctcctccacacaatgattgaaaccatattaggtctct

SEQ ID NO: 6775788 - DNA, 67 bp, Homo sapiens
aacttcaagatatttctagaatcagattgttcatctccattcttggttctgttattatttggaagtt

SEQ ID NO: 6775789 - DNA, 58 bp, Homo sapiens
tctatcattcgcactcctacttcagcaatctcttggcaaccagtgggaagatggtaga

SEQ ID NO: 6775790 - DNA, 63 bp, Homo sapiens
aggatggaaaggggtgtttgctgatggtaccttctaagggaacagctgcccttttcacatgtt

SEQ ID NO: 6775791 - DNA, 106 bp, Homo sapiens
tctcatttgatttttgtatgtttggttcaactgttcacactgatgtgacgtctcaggcatcacatcagtgtgaacagttgaaccaaacatacaaaatgccctgaga

SEQ ID NO: 6775792 - DNA, 64 bp, Homo sapiens
tcctggagtttgtaaggtgagccaggaccaaggtgccaggattctcattttgtaaggtccagga

SEQ ID NO: 6775793 - DNA, 94 bp, Homo sapiens
cgacgcccctgtttctggaaacgggttcaagcttgatccaggatccttcttgaccaggcaagcttgacctttgatccaggctcagtgggcgttg

SEQ ID NO: 6775794 - DNA, 97 bp, Homo sapiens
ggaaggaggcaggcagttgtagagagggctctgttattgtagtctccctcgtctctgcttcccatctctctcacgcactgtctggtggtctctttct

SEQ ID NO: 6775795 - DNA, 84 bp, Homo sapiens
gcttagggtcacatggtgtattcatgtttttaaaaacattcttttaaaagtgcaaatacacctgggaaaagatatactttaagc

SEQ ID NO: 6775796 - DNA, 82 bp, Homo sapiens
aggcctaatgagtcattttaatcctgttactctggtaattttctattatgggtataacacagttatttccttagtggtgcct

SEQ ID NO: 6775797 - DNA, 125 bp, Homo sapiens
atcagaatcacctggagggcttgttgaagtacagcttgctgggcctcaagctcagatttctgattcagtagatttggtacaggctaggaatttgcttttctaagaagtttccaagtgaggctgat

SEQ ID NO: 6775798 - DNA, 56 bp, Homo sapiens
ggaagtcaggcctccacagggtcttgcaggactggggctctgtctggcctactttt

SEQ ID NO: 6775799 - DNA, 74 bp, Homo sapiens
attcagtttcttagtgacacaaatctcagggtaaatttatgccttcatggtttgtttccttaaaaaatatgagt

SEQ ID NO: 6775800 - DNA, 84 bp, Homo sapiens
ccttacttacatgccaagatcctcgtctttgagcgtgagcccaatgtcaaaatggaatgagactttctttggcaagtgaggagg

SEQ ID NO: 6775801 - DNA, 62 bp, Homo sapiens
tatgctgtgtattcagtgttgaagaaggacgtagtgcttgtcctcagggagtttacagcatg

SEQ ID NO: 6775802 - DNA, 70 bp, Homo sapiens
tctcagctcagtcttgaagcactggcaatattttagaatatgaacctccagatgcaaagttgggaagaga

SEQ ID NO: 6775803 - DNA, 56 bp, Homo sapiens
agcaatttccagtctctaagggtggggacatgaatttacctcagaggcaaattgtt

SEQ ID NO: 6775804 - DNA, 66 bp, Homo sapiens
attttgtatgtgctgaaattttgaaatactgtgcactgacgtgtttcacaatgagcattacagaat

SEQ ID NO: 6775805 - DNA, 79 bp, Homo sapiens
cgccaggtgcttattaggccgtgctccaaagtcatcgtccggtttctcattgtgatgatgaagcatggttacactggcg

SEQ ID NO: 6775806 - DNA, 96 bp, Homo sapiens
gaggcaggagaatcgcttgaactcgggagtcagagggtgcagtgagccaagatcgccactgcactgcagcctggagacagagcgagactccgtctc

SEQ ID NO: 6775807 - DNA, 56 bp, Homo sapiens
gctcactgatgtggtgttggcaggattcagttcctcatgggcaccagacggagagt

SEQ ID NO: 6775808 - DNA, 79 bp, Homo sapiens
gtgtgatgcaaactctctggaagaagtaaaaaccaaaccacctacacacttcaaaatagccagatgtttacattcatac

SEQ ID NO: 6775809 - DNA, 56 bp, Homo sapiens
gaggtagaataagaaaaggtatgagactagaccaatttcattccaagttctacctc

SEQ ID NO: 6775810 - DNA, 79 bp, Homo sapiens
tatattttggaggcttgctagagatactggacattttacacacattatcttatttaacacagcaaaactttaaagtgta

SEQ ID NO: 6775811 - DNA, 130 bp, Homo sapiens
tctcagagggtccaaagtcacagtcacagcagtgagtgggaggaccatggatcaaaacccacagttcagagtttcaggcctggttccacttccgctcttgctgctgacctcccgtatggccttccgaaga

SEQ ID NO: 6775812 - DNA, 63 bp, Homo sapiens
tgctgctgccttcttctgactctattacattgctcagtgatgtctctgactaaggcagtggta

SEQ ID NO: 6775813 - DNA, 83 bp, Homo sapiens
cgtgctgtcagtccctgccagaggcaaagttttagttaattccaggcaaggcctgcctctggcagaaaaggggtgtgtgtgtg

SEQ ID NO: 6775814 - DNA, 93 bp, Homo sapiens
ggccaggtgcggtggctcacacctgtaatcccagcactttgggaggccgaggtgggcagatcacagagtcaggagtttgagactagcctggcc

SEQ ID NO: 6775815 - DNA, 59 bp, Homo sapiens
tgctgtggcttaggaggatggcagggcgctccgtgtcctggcatccgtgggtctgtgca

SEQ ID NO: 6775816 - DNA, 55 bp, Homo sapiens
ccatggagcgggtgagtgagtgtgcaaatcagtggaaattcatctgcaccactgg

SEQ ID NO: 6775817 - DNA, 65 bp, Homo sapiens
gattttgggggaagtatcaagaatttagatttagagatacaagtttgggatgctccttggacatc

SEQ ID NO: 6775818 - DNA, 56 bp, Homo sapiens
agcattgtgagctcaagagtacccaagaaagatgtggcctctaagctcacgaagct

SEQ ID NO: 6775819 - DNA, 57 bp, Homo sapiens
cgcgccgcagggctctctgggctcacagagcctggggagcacagcctggtgggcgcg

SEQ ID NO: 6775820 - DNA, 119 bp, Homo sapiens
ggttgcaggggatgtgtgcccagcatcaggagcacccctgcaggcctcgcagctatagatggtggaagtccagtgctggaggctgagttgggtctcctgtgaggcagtcccccgtggcc

SEQ ID NO: 6775821 - DNA, 59 bp, Homo sapiens
ttcttgtactggagatacatgatatgcaacattaaatattggtgtcctagagataagag

SEQ ID NO: 6775822 - DNA, 79 bp, Homo sapiens
atagaacaaagtaaatgtctggaaagacagtgtaaaccagatagtcatggtttaaatgtcaatagattgcttgggttat

SEQ ID NO: 6775823 - DNA, 76 bp, Homo sapiens
actcaatagcgaggtccattttcacatatgattctgatgacattacctaagtggaaaaggatcctcttcctatagt

SEQ ID NO: 6775824 - DNA, 91 bp, Homo sapiens
ttcagagttcatgtgtgacacagtcaatcagaacagcatgtacagttgcatgtgcagtattcatgcatttgctacacgcatgaactgtgaa

SEQ ID NO: 6775825 - DNA, 62 bp, Homo sapiens
tttagaatgccacttggcatgtaattcatactcctgaagtatttgctactggtaattctgga

SEQ ID NO: 6775826 - DNA, 103 bp, Homo sapiens
atgcctgtgactttgattcttttggttaatattattgttgctggttggcaatgtgagcatcaccaggaggacttctaattcagagatttttacactgtagcat

SEQ ID NO: 6775827 - DNA, 65 bp, Homo sapiens
gagggggcgaacagaagcaaggatcaaaacaaattccatccttatttcttttgttttccctcctc

SEQ ID NO: 6775828 - DNA, 77 bp, Homo sapiens
gtgattttgatgaatgtctgtcccctagccctgattgacaccagcaggctgtggaggatgacaaattgtcagacaac

SEQ ID NO: 6775829 - DNA, 98 bp, Homo sapiens
aagagggttagaaacatatctcagagtgtacaagattacgaattgtttggaatgatttttagctattctgaagatgtgtggacttaacatagcccctt

SEQ ID NO: 6775830 - DNA, 57 bp, Homo sapiens
cagtcacttggattagcaattcttgaaatacctcagggaaagacttgccaatgactg

SEQ ID NO: 6775831 - DNA, 90 bp, Homo sapiens
ctccgcagaggcaggctcttcccagctccacgagaggcggagaattgcaacttcttcctctctgggaacggcctatctagctcctgggag

SEQ ID NO: 6775832 - DNA, 95 bp, Homo sapiens
ggaaagggaacaacacgagaacctctcatttgattaggaaattgtttatactcttaccaagtgaatatgagctgttttttgttgttgatttttct

SEQ ID NO: 6775833 - DNA, 62 bp, Homo sapiens
ataggggttggtccaaggctagctaaaaccctggatgggatgagtctggcacctattcctgt

SEQ ID NO: 6775834 - DNA, 71 bp, Homo sapiens
ggtgatgaatgtatttaatacattgattgtggtgatgatatcacaggtgtatgaatatgttccaaattatc

SEQ ID NO: 6775835 - DNA, 73 bp, Homo sapiens
ttctgatgagagaggtgctagcctgacctgaacaggagatgctgacaggcagtgctgggcatgttgcacagag

SEQ ID NO: 6775836 - DNA, 64 bp, Homo sapiens
acagatgttgcttgtcattctcttgttgttaagcaggcaccagattggatcaagcagcagttgt

SEQ ID NO: 6775837 - DNA, 79 bp, Homo sapiens
ttgttagaggaactggagccaagactgcataaatatcctttctgggcagtggtggtgtttcagtgactgagcttagcag

SEQ ID NO: 6775838 - DNA, 85 bp, Homo sapiens
tcttttctcatgcactctgtagtctgtgccatagctgtgctaaagccagcttgtcctccatatggctaagggtgaaagaaaaaga

SEQ ID NO: 6775839 - DNA, 77 bp, Homo sapiens
gcagtggaggtcaatgtcttgctgagccaatgtgagccttctgtggggcctggcaaagctagacattccctctctgc

SEQ ID NO: 6775840 - DNA, 59 bp, Homo sapiens
aggctgctggctaagaataagataagctcaaaataacttgcactctccccagcagacct

SEQ ID NO: 6775841 - DNA, 71 bp, Homo sapiens
gtagtgtgaagttttagccatgtctgtgggtgttgatttgttccaatgtagtatctaaatgcttacattac

SEQ ID NO: 6775842 - DNA, 91 bp, Homo sapiens
cagtatgtattttgtatgccatgtgttcatgtttttccctttgaagactgcctgggaaaggctaacagtcatggaagtaacaaacatattg

SEQ ID NO: 6775843 - DNA, 74 bp, Homo sapiens
gggacccgggtttgcgcgtgtggaaagcaaaaggggttactctgctggagttcgacattgcaaataaaggtctt

SEQ ID NO: 6775844 - DNA, 62 bp, Homo sapiens
gtgcaggctctctcctagtccttgcctcatacctgaagttactagggactgagagtaaacac

SEQ ID NO: 6775845 - DNA, 58 bp, Homo sapiens
cctggcccagggactttcgcctgggactgcccagtggtgccagctctgtgggcccagg

SEQ ID NO: 6775846 - DNA, 130 bp, Homo sapiens
tcagtgatttttttggttttgatttttgtatttacctggcaacaagggttattatttgcacgtttatagctagtgtgctaaatggcactttgacagcctgccaggaaggtcagtcagaatttcccactga

SEQ ID NO: 6775847 - DNA, 59 bp, Homo sapiens
tcatctgtcccaggcttttttccctcaacatacagtaagagatgcctggagataaatga

SEQ ID NO: 6775848 - DNA, 57 bp, Homo sapiens
aaactattgagatgtagctggcaatgatccagcttcttagttcacttttaatagttt

SEQ ID NO: 6775849 - DNA, 71 bp, Homo sapiens
ggctattttgatgcactatgtaacttacaccatatagatggtcagttgcctccatagtcatccgatgagcc

SEQ ID NO: 6775850 - DNA, 68 bp, Homo sapiens
catttctcctgggtgataaatttccaccaactgtgttctttcatctgtagtttattccaggagaactg

SEQ ID NO: 6775851 - DNA, 91 bp, Homo sapiens
ggagacacaggcaggtaatttacatattgctatagaagagtctagtgcaatacttgtgaattcaaagtctgtcatacctgtctttgttttc

SEQ ID NO: 6775852 - DNA, 84 bp, Homo sapiens
tacagaaatattgacagtgactattggtagcatacatttttcttgaatgtcctaccatagcactgtctggtaaaaatttctgtg

SEQ ID NO: 6775853 - DNA, 58 bp, Homo sapiens
gagttgttataatgtatgtaaggcatttagtacagtgccttgtacatgataaagattt

SEQ ID NO: 6775854 - DNA, 59 bp, Homo sapiens
gaaagaatgtgggtggatatgatgtccaccccttgatatgatcctccacaccttctctc

SEQ ID NO: 6775855 - DNA, 73 bp, Homo sapiens
ttatagaatatttctgggggtgtgtttctcaaaaatattcctttgaggttgtgccttcagaaataatctgtga

SEQ ID NO: 6775856 - DNA, 82 bp, Homo sapiens
tagactagaatgtaagtgagaactaaaccttctgttgtattaagccacagtgcaattagaacttatttattgctgcagtcta

SEQ ID NO: 6775857 - DNA, 63 bp, Homo sapiens
tgtgtgaagcactctgggtgatcccttacaagggaggtaaatacaacctgtgttatcaatgca

SEQ ID NO: 6775858 - DNA, 96 bp, Homo sapiens
catttagaggttggattgcataagtctgggaggacatctttgtttattcattgtcatatacatgtctggctcattttctgcagttcattctaaatg

SEQ ID NO: 6775859 - DNA, 64 bp, Homo sapiens
ttctcagctttcctgcagctaagggtggtagagtgacccacttcagattagagcaacatgagaa

SEQ ID NO: 6775860 - DNA, 71 bp, Homo sapiens
agggactctcccacgttcgactctaagcggaagtacccgctcagggctccggaagtggcctcagagcccct

SEQ ID NO: 6775861 - DNA, 96 bp, Homo sapiens
gagtcattgtgatgtattcctttgactttgttgttgttgttagtgatttccagtgccagcaggaaacttaaaggtaatccaaatccaaaaacactc

SEQ ID NO: 6775862 - DNA, 75 bp, Homo sapiens
agctttgtttctctttaaggtgatttctgctactaataagccatagtatggaaatatcttggaagtcaagaggct

SEQ ID NO: 6775863 - DNA, 100 bp, Homo sapiens
aagcttagatgtactggagtattgacttaatggggaaaaaagcatcacttgaagcaagacatgcagtttgttccattcaccaatgctctgcccacagctt

SEQ ID NO: 6775864 - DNA, 70 bp, Homo sapiens
aaaaagccagagcaagctgtcacagataggctcatatatcaacagcactgtgactttttgtttgcttttt

SEQ ID NO: 6775865 - DNA, 81 bp, Homo sapiens
tctatcgcttcacaccatcagcgaggcaacatttgtaaggtccgagtgtatcaagtgtcgctgaggatgtggagcaataga

SEQ ID NO: 6775866 - DNA, 80 bp, Homo sapiens
ctgcatgatctcagcatgaactccagcagacagacaaagagtctgcagtaagttaatagtgctggtaaacatcattgcag

SEQ ID NO: 6775867 - DNA, 106 bp, Homo sapiens
ttgagacaaagagtctcgctctggcacccaggctggagtgcagtgtcgccatctcggctcactgcaacctccacctcccggggtttaagcaattctcttgcctcag

SEQ ID NO: 6775868 - DNA, 81 bp, Homo sapiens
tttacatgtgagaaggaggtagctcaggtgaacagagggatgactttgagttctgtgtatcctttgtcccacacttgtgaa

SEQ ID NO: 6775869 - DNA, 64 bp, Homo sapiens
ttcctatggtgaacatgaatgaagaaaaagagctttgtgagagtaaagtgcttcaccatgggga

SEQ ID NO: 6775870 - DNA, 70 bp, Homo sapiens
agaggcccatgggtgcatgtgctgttccctttgttatattgtgcaggcaggtgattcaccctgggccttt

SEQ ID NO: 6775871 - DNA, 92 bp, Homo sapiens
ccattgttatctttttagtatttggcctctacagtctcccaaagtcatggtagagacagatttcacatacacactaaggtgacttcagatgg

SEQ ID NO: 6775872 - DNA, 86 bp, Homo sapiens
ggagaatcactcaatcccaggcggcacaggttgcagtgagccgagactgcagcattgcactccagcctgggcgacagcgagactcc

SEQ ID NO: 6775873 - DNA, 68 bp, Homo sapiens
gaatctttggggaccaatttatagtctctctgttgtgtttcagtctgagagaattgccttagatgttc

SEQ ID NO: 6775874 - DNA, 79 bp, Homo sapiens
gtggaagctagcccattacctttggattggaggctttcctttcttcataaagtgaaggatgatgggcatttctttgtac

SEQ ID NO: 6775875 - DNA, 65 bp, Homo sapiens
gcatgtttaagtgaaaacttcaaaggaattccaagtttgaagtcagacactgctttggaatatgc

SEQ ID NO: 6775876 - DNA, 128 bp, Homo sapiens
taggtctcctccaagatattcttatgtaactactctacttgtcacctggacatcaggactttggaaaacttcccaagtgtttccattgtgcaggctgtcatgagaatatcctctctcgggaagactta

SEQ ID NO: 6775877 - DNA, 70 bp, Homo sapiens
tgccagcacaccaggtcccgtctgtacctgaggccaactccggagtgtggagaggacatgggtgggggca

SEQ ID NO: 6775878 - DNA, 69 bp, Homo sapiens
atgcaaatgtttaagttactattgtcattgccctcatcttagctaatagtgattgaaaacattctgtat

SEQ ID NO: 6775879 - DNA, 57 bp, Homo sapiens
ggcgtctgacgtgctatagcagccaatctgcttgtcatcagcagctgtcagaatgcc

SEQ ID NO: 6775880 - DNA, 57 bp, Homo sapiens
atgagaaagttgtttgagtcccttttgaaaccaaatgtcttatacagattttctcat

SEQ ID NO: 6775881 - DNA, 94 bp, Homo sapiens
ccaggaactgtaatgaggattgaggatgcagcagagtataaaacaagcaaaattcttgcatttaaggagctcatattctcatggtggtggaggg

SEQ ID NO: 6775882 - DNA, 64 bp, Homo sapiens
ttgcccatcctagtagcagtgtcaaggtttactacatattttccagctgcagtgggatggggaa

SEQ ID NO: 6775883 - DNA, 104 bp, Homo sapiens
atccttatcctgccctgccccatgagctacaggtgattgggccttgggtgggcgccggacacaaaggcagccaatcatctgcctttggtttgggcaggaggggt

SEQ ID NO: 6775884 - DNA, 55 bp, Homo sapiens
gtccccactcagctcccaggacagaggtaactcatggaagtcttgagtagggggc

SEQ ID NO: 6775885 - DNA, 130 bp, Homo sapiens
gccctaatctgtggtgtctcatctttcctcccctccctcctccttcccactgtgcctgagtgtgtattgtcaaagtgtcaagtgaggagggaaagagaaaaccaggccagataacgcagaattggtatgc

SEQ ID NO: 6775886 - DNA, 55 bp, Homo sapiens
gcaacaccgctgcaaaggagaggcccgccaagtctgcccgcctgcaaagtgttgc

SEQ ID NO: 6775887 - DNA, 65 bp, Homo sapiens
atgatttcttctagcctgcctttgatgtgtcttgcacatttttaagaagtggttggaagaagcat

SEQ ID NO: 6775888 - DNA, 101 bp, Homo sapiens
aatgtgtttatttaattatgctgtgctagatacaatattcagctgttcccaacacatctgtagaatgattatatagtcagttatagtaatagaaacacatt

SEQ ID NO: 6775889 - DNA, 91 bp, Homo sapiens
gcgtggtcgtcgtccaggatggtgacggtggccagcagcggcgccaccagccgccccttgggccgcccgccgccgtccggctcgaacatgc

SEQ ID NO: 6775890 - DNA, 69 bp, Homo sapiens
tcccagaaagttctgatgctgatcaaagtttaagaatcatgctttgggtcatcagtagcttggaaggga

SEQ ID NO: 6775891 - DNA, 68 bp, Homo sapiens
gccatgctaaaccagaacataggagttttccagctaaggacactatccatgtacactgtttgccaggc

SEQ ID NO: 6775892 - DNA, 59 bp, Homo sapiens
tttctattcctgatcttattggatcctcatggtggccccagtgtggtttaggataggga

SEQ ID NO: 6775893 - DNA, 79 bp, Homo sapiens
gtttggctgacctcagattgtggctccgctgttactctctgtgtaatgtgggatcgtaaatttgggacaaagccggtac

SEQ ID NO: 6775894 - DNA, 60 bp, Homo sapiens
gacaaacttcccagacaagctcctttgtgcctctacgtggagagggtgtggaaagttatc

SEQ ID NO: 6775895 - DNA, 71 bp, Homo sapiens
cattagagaaggagacagagcttttaaatttttaattgaaagggacaaaggcaatttcttcttcctgaatg

SEQ ID NO: 6775896 - DNA, 70 bp, Homo sapiens
gtttgatgcagcagtcacaggctttatgtagtgacttatctggagataagagtcttgactgttgttagac

SEQ ID NO: 6775897 - DNA, 75 bp, Homo sapiens
gctgaaaactctttgtggacattaaattcctcctggaaaagagtagtttgatgattacagagaaaatgaatcagt

SEQ ID NO: 6775898 - DNA, 80 bp, Homo sapiens
ggtaggagtagtatagtatcataagttaattaaacagtagacttactatctggtatttcctttgatagctaatacttacc

SEQ ID NO: 6775899 - DNA, 69 bp, Homo sapiens
cgaggtggtggtcttggatgttgctaaccaaagtgttgttccccagcccagcagactgttaccacttcg

SEQ ID NO: 6775900 - DNA, 75 bp, Homo sapiens
ttctcctactggatgtaaatctggaagcgcatagcccagttgcagttcccagccacattacattcacaaggggaa

SEQ ID NO: 6775901 - DNA, 105 bp, Homo sapiens
gaaaattgcagctttgggttaggtcactggagttgggtcaagattctctttgagagcaatggagtatgaaacccactccaatttggtcagacccaggtaattttt

SEQ ID NO: 6775902 - DNA, 86 bp, Homo sapiens
tcttatttggcagctttacctttaggagtaaccttgacaattgcaagccgtgactaccaatggaggtaacagaaaagctagaaaga

SEQ ID NO: 6775903 - DNA, 91 bp, Homo sapiens
tcactatggaatactgaacttagttaagattaagtctcctaaagtattgggggaattgaggtatgctgggcttaccttgttctcattttga

SEQ ID NO: 6775904 - DNA, 66 bp, Homo sapiens
tatctaggaaggtactggcttccttaaattcttcctaagaccagaatctcaatacctttcaagata

SEQ ID NO: 6775905 - DNA, 57 bp, Homo sapiens
ctttttgtctctgtcctgatgatcaaagtccccaaggaaccagtcagagacagaaag

SEQ ID NO: 6775906 - DNA, 59 bp, Homo sapiens
ctcagattcccacgtggttcaggaacccagtgaaccctggaacatttggccatactgag

SEQ ID NO: 6775907 - DNA, 64 bp, Homo sapiens
agcagacaccaggagtaaagaatatgtgaaaccatagtgctttcagtggtcttggctgattgtt

SEQ ID NO: 6775908 - DNA, 100 bp, Homo sapiens
tctttggacagagagtctcagatgtgcatttctcatacactaaatgtgagtcatgagcaagcaagtggaagagaagttatcttagatcctgtgcaacaga

SEQ ID NO: 6775909 - DNA, 55 bp, Homo sapiens
gtttctgccatctgaaaatcttgtttggagtttgaaacagggcagaagcggagac

SEQ ID NO: 6775910 - DNA, 62 bp, Homo sapiens
tgcaggttttctgacatccagcagcatgcagttcccctgcccctgcctgtcagtagatctca

SEQ ID NO: 6775911 - DNA, 59 bp, Homo sapiens
gaccaacctacagcttgtaagccagattgaatattggttattgtggcagaggtatggtt

SEQ ID NO: 6775912 - DNA, 67 bp, Homo sapiens
tgtaaaatatcttaatcattttcatattgattgtatgttgaaatgagaatgctttggatatattgga

SEQ ID NO: 6775913 - DNA, 62 bp, Homo sapiens
cttggccagctgagatttagcacacaggagaggaggtctgtgtggggatgaggttgggcagg

SEQ ID NO: 6775914 - DNA, 66 bp, Homo sapiens
tttcacacccactaggactgttctaatcaaaaagagagataataaggtgttagtgaggatgtgaaa

SEQ ID NO: 6775915 - DNA, 82 bp, Homo sapiens
ttccttccattccctcttttccaacagttgtgttgattttcaggatagctgctgcagagaagagaattcaaagatggaggaa

SEQ ID NO: 6775916 - DNA, 69 bp, Homo sapiens
aggaagttctatatctgcctcaccaacacttcttccaggagggtggagaatcagatatgaattatttct

SEQ ID NO: 6775917 - DNA, 98 bp, Homo sapiens
gtaggtagtttgaagagaagactttatatgtttttggaaagaacacagaataactgtgtcttaagttccaagacattaagcttgccaaactgacttac

SEQ ID NO: 6775918 - DNA, 71 bp, Homo sapiens
ctgcagtgggtgggtgtctgacagtttagaggggactctggaccttgaaaattcacccacctcgtctgaag

SEQ ID NO: 6775919 - DNA, 59 bp, Homo sapiens
tccagacctagctggtcattaaggcaacaagaactggtctaattgtgggctgggctgga

SEQ ID NO: 6775920 - DNA, 86 bp, Homo sapiens
ataccaaataagactccatagtacacatcctacaatgtttggttacttgtgagtgaacaggtgtgtgtgtgtgtgtatgtgtgtgt

SEQ ID NO: 6775921 - DNA, 80 bp, Homo sapiens
tcttcttcccctgggttgtcaccgcagctgtcactgctgttctcactgctgcaggtccagcccctttgtaggggagggga

SEQ ID NO: 6775922 - DNA, 72 bp, Homo sapiens
tagagtctactggttaaaaataatttacttggctccaaaaggatggctgtgaaacattttggcaggacttta

SEQ ID NO: 6775923 - DNA, 114 bp, Homo sapiens
ggttctctttggctgctcctcaggcctcttggcgtctctgggctgacccaggtctccggtggtaaagggactggagcccgtggaggcgcaggctccagagtagctagctttgcc

SEQ ID NO: 6775924 - DNA, 116 bp, Homo sapiens
catactcttccctagttaagagtctgataagaatgcagcttgccagtatcttaattgcagaccgagcagtggaccctgtaaagtcgtgtccagactcttggcctgcggaaactgtg

SEQ ID NO: 6775925 - DNA, 75 bp, Homo sapiens
tggcatgaaccccggaggcggagcttgcagtgagccgagatcgcgccactgtactccagcctgggggacagatcg

SEQ ID NO: 6775926 - DNA, 86 bp, Homo sapiens
gggaccccaggatagtttatttttctaaggtgccacaggcaactaatgtactttgggtttagaataaactccttgggagtagaccc

SEQ ID NO: 6775927 - DNA, 130 bp, Homo sapiens
attctgggccctttacaaaggcactggtggttctcctaggcaatgctgtatgtcctgtggttttgaacactctctatagtccagtgattgtgtagaaccatccctgcttccccatccagcactggaatct

SEQ ID NO: 6775928 - DNA, 86 bp, Homo sapiens
gtccccgctgctggagctgcgcgctaacgggctgctgccaacctaagtgcagcgccccgcgcctggctccaggtggactccagggc

SEQ ID NO: 6775929 - DNA, 60 bp, Homo sapiens
tgcagaaacaagccatcattcatcggacaaagtcacgtgctaattggacttgattctgca

SEQ ID NO: 6775930 - DNA, 59 bp, Homo sapiens
cagggcctctcctccaggaactgcgtctgaacataccagagcctgcagtggagaccttg

SEQ ID NO: 6775931 - DNA, 64 bp, Homo sapiens
ggctgatgaaccatctggctccagaagaggtttttgcttttcctgttagtatggttcttgagct

SEQ ID NO: 6775932 - DNA, 59 bp, Homo sapiens
gctgtgcagtagtaggtacagtcttgcacactgcataaaatgtctgctcctgacatggc

SEQ ID NO: 6775933 - DNA, 60 bp, Homo sapiens
gttagtggctcctattgggttttgagccaccccaggctttcctcacctggaggtgctgat

SEQ ID NO: 6775934 - DNA, 73 bp, Homo sapiens
ggcaaaaaagttcatggtgttatagaaaagtaaacatttttcacttaatgaaaccatgagcttttcatgtgcc

SEQ ID NO: 6775935 - DNA, 60 bp, Homo sapiens
ggtcctgcctgttccctctgtcaccttgctgccattgcaacagcagacaggcttaggacc

SEQ ID NO: 6775936 - DNA, 60 bp, Homo sapiens
acctacatgttccacatagttgtagctgtatctgggtatcactgtgcacatatgataggt

SEQ ID NO: 6775937 - DNA, 87 bp, Homo sapiens
gagtcttggagaagtcttaaccaaataaatgttacttgaattaggtcttaaaaaatgagtcgacatttgttaggatttttatggctc

SEQ ID NO: 6775938 - DNA, 66 bp, Homo sapiens
ctctttagtgcatcttatattccactgtgggtgtgttcattattaacagtggctaagactgagggg

SEQ ID NO: 6775939 - DNA, 60 bp, Homo sapiens
gctgccctctctggccccacactgtttttgagacaggcatctggagcccagagagggggc

SEQ ID NO: 6775940 - DNA, 86 bp, Homo sapiens
attttcgatatgttgaggacattgaaatcgaagagaagacaccaaagggtcttctcctctcttttttcaagtagcatatctgaaat

SEQ ID NO: 6775941 - DNA, 56 bp, Homo sapiens
gctcccctccctggactgtggccgcacccagcctgggccatcctgggaagggctgc

SEQ ID NO: 6775942 - DNA, 59 bp, Homo sapiens
gttgctgaaggcatgccagagaaggacccaaatactatccaggcagcttgactagcaac

SEQ ID NO: 6775943 - DNA, 68 bp, Homo sapiens
aggtgtgaattttccagataagccctgttgctccagaaaagccacaaatactggaaatttctccacct

SEQ ID NO: 6775944 - DNA, 77 bp, Homo sapiens
attttgtagaaatcaatcttcaatcctgatttattctgagtggtttgcatcagtgactgggagataattcacaagat

SEQ ID NO: 6775945 - DNA, 78 bp, Homo sapiens
ggagggacctgtgtgccagggcatgcacagggctcgcagacatgccctgggcatctcatgcacctgcacattctctcc

SEQ ID NO: 6775946 - DNA, 56 bp, Homo sapiens
aatcctgacctgggcatgcttgagaccagaagacactcaatgattccatcaggatt

SEQ ID NO: 6775947 - DNA, 129 bp, Homo sapiens
tggtctgcagtgtctaagggggcatggaggcagagccaggctgggattgaatctttgtagaggaacgtgaccttgcaaagagataatcctaggctgctgttatcctggtgccagccctccctgactcca

SEQ ID NO: 6775948 - DNA, 73 bp, Homo sapiens
caccccccaacccgaaggctgccagtggccctcttggggtcctccaggagcgcagcccaagggttggggactg

SEQ ID NO: 6775949 - DNA, 56 bp, Homo sapiens
ccaggaggctctgcccatcccaagcatccgtgggtgactgggtctccacctcttgg

SEQ ID NO: 6775950 - DNA, 58 bp, Homo sapiens
tcagacccaggtgccaagctgtacgggcatgctgccagcagccaggactttgggctgg

SEQ ID NO: 6775951 - DNA, 82 bp, Homo sapiens
ttaagttgggctctcatcagggatgcctcggtgctttggctctgggagtgaaaagccatgcatacctaagagctcagggtaa

SEQ ID NO: 6775952 - DNA, 72 bp, Homo sapiens
ctataatatgtggccttttatgtctgacttctatcacatagcaacatattttcaaggtcattcgtgttgtag

SEQ ID NO: 6775953 - DNA, 59 bp, Homo sapiens
ctggtgtgggagatatttggatcaagcacatccttgtgtcctctaatctcaccacccag

SEQ ID NO: 6775954 - DNA, 129 bp, Homo sapiens
tccttggacctagccaggaatgctctcatgggaatggcagaggcaaagatggtaagctcagccatgcaagtactttcaagcctctgttgcgtctcctctgctgacatctcattggccaaagcacagcaa

SEQ ID NO: 6775955 - DNA, 93 bp, Homo sapiens
gtctccctgccccgagccaatgtcctcctgcctgcgactggcctatgacagcgtaggacccagaggcagaggacgtggcattgccatggcgac

SEQ ID NO: 6775956 - DNA, 72 bp, Homo sapiens
gggctaaacagagagcttccttgattatgttcagattgaatgaaatcaaacccttttctgatattgtggtcc

SEQ ID NO: 6775957 - DNA, 63 bp, Homo sapiens
ccaaacttgtggtggagaagcctaggatttatttccttggagtcatataaccaccatagtagg

SEQ ID NO: 6775958 - DNA, 64 bp, Homo sapiens
atttcaaggtcatttttgccttctattttcttaggactctgaggagaaagatgatttatgaaat

SEQ ID NO: 6775959 - DNA, 58 bp, Homo sapiens
gactcagttttatccactgactcacagttgtggtcaaagttgaagaagggcatgagtc

SEQ ID NO: 6775960 - DNA, 66 bp, Homo sapiens
accggaacgatcgtgcaggtcataaatggttgatcttggagtttggcatgacctgcgcttcacggt

SEQ ID NO: 6775961 - DNA, 63 bp, Homo sapiens
gcagacagcatgttgggctattatcccaccccgaatagggagggaagcccaggcatcgtctgc

SEQ ID NO: 6775962 - DNA, 81 bp, Homo sapiens
gaaagttatgtatgtttttgtatgtgtgtgtatatatgattcatatatgacacataaaacaaggactgctacaagaaattc

SEQ ID NO: 6775963 - DNA, 60 bp, Homo sapiens
gatgtagattcatatgtggtgtcctagaatttccactccatgtatagttggaactacatc

SEQ ID NO: 6775964 - DNA, 97 bp, Homo sapiens
gagttttgcttttcattttgtaaaatgctacattcacttatgcaagacacagttcatgggtgaggatgatgaggcagcttaaaatgagggaagtctc

SEQ ID NO: 6775965 - DNA, 86 bp, Homo sapiens
tcacagctaatgagcagctggaggccttgttggaagttaataaactcatcttcagaggaggcaggctgtgctgcaccttgttgtga

SEQ ID NO: 6775966 - DNA, 55 bp, Homo sapiens
ggcagagcctcagccctccacccagtctttggtgggaattgcagggggttctgcc

SEQ ID NO: 6775967 - DNA, 58 bp, Homo sapiens
agttcacagaatggccagaactggggcttagcactcttcaattctggccaagtgggct

SEQ ID NO: 6775968 - DNA, 100 bp, Homo sapiens
tgatttggctttatataaagacttttaaacagtgtttcatgtggggctgtgctcatgcggccccaaacatctgatctgtttggtgaagtcagtcaagtca

SEQ ID NO: 6775969 - DNA, 83 bp, Homo sapiens
tagctttaaaacatctttgataaacttagtgatgaatgtggcgttttgaagtaattattagtttgttggagagtgggaagttg

SEQ ID NO: 6775970 - DNA, 56 bp, Homo sapiens
accttactcaagtctcactggtaattacttcattttgcagatgagaaaagtgaggt

SEQ ID NO: 6775971 - DNA, 55 bp, Homo sapiens
tgtgggagttacttgtactagccttttaagaggttctatacaaagatttctcaca

SEQ ID NO: 6775972 - DNA, 77 bp, Homo sapiens
gttcccttctctcccggctaagagcttcccgtattgtctcgaggatgggaaaacacaagttgggggaaggaggaggc

SEQ ID NO: 6775973 - DNA, 67 bp, Homo sapiens
gactcttggcagggatatagtggcagggatatagtaaaacaggccacacatatggttggtaggagtt

SEQ ID NO: 6775974 - DNA, 69 bp, Homo sapiens
tcacagttgagcaggttgtgcactgcaccatgttagccctggtacagtacacaacctgcccaactgtga

SEQ ID NO: 6775975 - DNA, 78 bp, Homo sapiens
gagaaaggctatctgttgtagtacagatgatacaatgagtgtgttcattttactgtaaatagcagagaggtttatctc

SEQ ID NO: 6775976 - DNA, 56 bp, Homo sapiens
gtgttttgagagttggataagattatgtaaatcctctagtccaatacttagtccat

SEQ ID NO: 6775977 - DNA, 60 bp, Homo sapiens
ggacattgcagtagcctgggactgagagtgagtcttcccacatccaggcctgaagtgtcc

SEQ ID NO: 6775978 - DNA, 68 bp, Homo sapiens
gactgaatcaattgtgaagactatgatgccccaaagagcagagcatgatatctcatcaatggttcatc

SEQ ID NO: 6775979 - DNA, 80 bp, Homo sapiens
tgaaaaacaattgagggagatgttgacttcagttcttattgggggagcaagaggttatgacatttgtctttaaatattcg

SEQ ID NO: 6775980 - DNA, 56 bp, Homo sapiens
gccaaggcctgcagcacctcatactcgacctggtggtgcatgctctcggccttggc

SEQ ID NO: 6775981 - DNA, 90 bp, Homo sapiens
gcatggcatgagataactgtcagcagatttctggaattcacataaatggcatccaaaggaagaggctgtcagtcatcaggtcatctgtgt

SEQ ID NO: 6775982 - DNA, 120 bp, Homo sapiens
ctaccagtgctgcttagattggcaaatgcccatgcagtttgaagagggcaggcggatgactggatgcctgccaggaagtgtgtgggcctgatgccactgctggactccatagcctggtag

SEQ ID NO: 6775983 - DNA, 57 bp, Homo sapiens
cagtgacactggtttaggtatgtatctctggtactttccaaagctgcagtgtttctg

SEQ ID NO: 6775984 - DNA, 75 bp, Homo sapiens
tttggttatatccaaagtttctcagaaactggatataaacttcttcagttctgaaaaactttggatataaccaga

SEQ ID NO: 6775985 - DNA, 85 bp, Homo sapiens
ggcaggcagctgattgttgaaggtcaccccgtagccattggcagagccagaacttgcagctgtgatttgtgccgcggctcctgcc

SEQ ID NO: 6775986 - DNA, 89 bp, Homo sapiens
agggtgagaagtagtctatctatggttagtggccattttctctagttcacagaccatgcatattgattatagattcagaaagttaccct

SEQ ID NO: 6775987 - DNA, 55 bp, Homo sapiens
cagccagcttcagatccaagccacactccgaggctgccctgtctgtggctgtctg

SEQ ID NO: 6775988 - DNA, 59 bp, Homo sapiens
ccagcaggactttggaaatatgacatgccttgtttatgttactaatctgttctggttgg

SEQ ID NO: 6775989 - DNA, 67 bp, Homo sapiens
ggaggacaggagtgaatctggcacttatctttcagtggggcctgagtgcaaattcttcctaccttcc

SEQ ID NO: 6775990 - DNA, 55 bp, Homo sapiens
aggcttaaatgcttgggttcctcccttctacactgggacccaggttttgaagctt

SEQ ID NO: 6775991 - DNA, 56 bp, Homo sapiens
gccagtggcttgccaggcaggacggaagcgctgcccggccataaatgaccgctggc

SEQ ID NO: 6775992 - DNA, 58 bp, Homo sapiens
gcacagctctccccaagacgaaaccttcagctttcgattgtaaatccaagagctgtgt

SEQ ID NO: 6775993 - DNA, 57 bp, Homo sapiens
gggtgttaacttgtttatgacaatagactttctctgttgtgcacaagatggtcactc

SEQ ID NO: 6775994 - DNA, 62 bp, Homo sapiens
aggtctacatgcttaatatatcaaacaaattatagctttaggtgattgagcatgacagacct

SEQ ID NO: 6775995 - DNA, 77 bp, Homo sapiens
ctatggcagtcaatatttcaataacccattttcactagaagatagggcatcctttattgagatttgcatgactatgg

SEQ ID NO: 6775996 - DNA, 55 bp, Homo sapiens
agtgttgtgggagggctacagcaggtcgcagatgtgaaagccagttcatagcact

SEQ ID NO: 6775997 - DNA, 68 bp, Homo sapiens
tcctagtctgtagtcacacaggtgacagctggggttgcatctgttccttgcctacaggtgaactggga

SEQ ID NO: 6775998 - DNA, 56 bp, Homo sapiens
ttattgtatttgattaattttttagatttttaaaaaagactagtcgagtgcagtag

SEQ ID NO: 6775999 - DNA, 61 bp, Homo sapiens
gtctgaggcttgtcctctcagcttcttgggttcctctgaaggctaaagaataagcccagac

SEQ ID NO: 6776000 - DNA, 70 bp, Homo sapiens
cgatgtgacctgttggacgttgttgttaggtgcccacctgaaagccagaattcgtccagcctggtgaccg

SEQ ID NO: 6776001 - DNA, 89 bp, Homo sapiens
gccaggggctcttctcccaggaggtgtagctgcgtggcttgagtgtatagcagaggcctgagttgggctttctgggttcgaatcctggc

SEQ ID NO: 6776002 - DNA, 82 bp, Homo sapiens
agttttagggtacgtatgcacaacatgcaggtttgttacatatgtatacatgtgccatgttggtgtgctgcacccattaact

SEQ ID NO: 6776003 - DNA, 55 bp, Homo sapiens
ttattcagtgcctttgaaagaaacactatagtgtgttattttcttaactggataa

SEQ ID NO: 6776004 - DNA, 62 bp, Homo sapiens
ccagctgttggagtaaagcacttagattgaactatgtctgggttttaaagatccaaagctgg

SEQ ID NO: 6776005 - DNA, 60 bp, Homo sapiens
ctgtggctttggggcggaggactcactccctattgtgtcttgagcctttgaatgcttcag

SEQ ID NO: 6776006 - DNA, 73 bp, Homo sapiens
gctgtgtcatcagcatataagacagtgcctggttacaaataggcatttaataattatttgctggtggatgagt

SEQ ID NO: 6776007 - DNA, 103 bp, Homo sapiens
tgaatttggtgtgcgtaagtattttcattctgtgtgactgtgcatattgttggctgtctttgcagacgtgcatgagtgaggaagggtatgaacatgaaaatca

SEQ ID NO: 6776008 - DNA, 55 bp, Homo sapiens
gaaaacacagtgcaatgtatctgacctgctgctgggtcagcagcactgtgatttc

SEQ ID NO: 6776009 - DNA, 64 bp, Homo sapiens
tctgggaagggatgtaaacatgaataagaaatggtcgttgcacatgtttttatctcaaaccaga

SEQ ID NO: 6776010 - DNA, 67 bp, Homo sapiens
catttgtagggtttctgtctagtatggactctcctatgttcagtaaggcctgaggaccagataaatg

SEQ ID NO: 6776011 - DNA, 94 bp, Homo sapiens
ttttgaaaaaaatgaagttctcaataatcatgttgcaaacaaacttttagaaaagacataattataaatggtgggctgcatatatttttcaaga

SEQ ID NO: 6776012 - DNA, 68 bp, Homo sapiens
ctggcaaggctggaggtttgttgcggctggatttctaatagctagggacagataccagccagtggcag

SEQ ID NO: 6776013 - DNA, 77 bp, Homo sapiens
ggcagtctgggaggaaaagaaagttggggtggcagatccaagtggggcagcacacccaaatttctctctcaggtgtt

SEQ ID NO: 6776014 - DNA, 68 bp, Homo sapiens
gaggcgggtggatcacctgaggtcaggagtttgaaaccagcctgaccaacatggtgaaaccttgtctc

SEQ ID NO: 6776015 - DNA, 64 bp, Homo sapiens
ttatttagtcctcacaacaactttaagagctagataccttttaaggcacagagaggttaagtaa

SEQ ID NO: 6776016 - DNA, 78 bp, Homo sapiens
cagggtcaatcagctaaataaactagtcattcagtcaactagcattgattagattttagcaagatggaattgactttg

SEQ ID NO: 6776017 - DNA, 58 bp, Homo sapiens
acccaggctggagtgcagtggggcgatctctgctcactgcaagctccgcctcccgggt

SEQ ID NO: 6776018 - DNA, 84 bp, Homo sapiens
cctcagaaaggacagagtgagggtggtatttctctatctattcgaatcagtactttcctactccttacttttcttttgcttagg

SEQ ID NO: 6776019 - DNA, 129 bp, Homo sapiens
aagtgctaggattacaggtgtgagccactgtgcccagcctcatgggctttcttatttttaattttcctcctgtaagattcatttattctgggctgggcgaggtggctcatgtctgtaatcctagcactt

SEQ ID NO: 6776020 - DNA, 65 bp, Homo sapiens
gctcatgcacgctgcctgttttctgattgttcaacacagtctgcctctcagagcagctgttgggc

SEQ ID NO: 6776021 - DNA, 61 bp, Homo sapiens
atctttctgtggccactgctaggaacatgttcctggttcttgaggagccatgtgattagat

SEQ ID NO: 6776022 - DNA, 56 bp, Homo sapiens
gcttctctgcagctcctggctgggccccttcatcttgtaaacgctgcaatgagagc

SEQ ID NO: 6776023 - DNA, 58 bp, Homo sapiens
cagggcttcccctagcggaggtgggaagcaggaacttccctgtgggatgaggactctg

SEQ ID NO: 6776024 - DNA, 64 bp, Homo sapiens
agggattattactagaaaaatcagacagctccgctcacaatggggctgtcctggtttggtccct

SEQ ID NO: 6776025 - DNA, 88 bp, Homo sapiens
tgcttaaagtgaagaaggagctactaataagagggtgtctatttagggctttttaattgaacgtagtctccaatcagtcacccaagca

SEQ ID NO: 6776026 - DNA, 69 bp, Homo sapiens
aaggtgtaagtggggcagaataatgtgttgaaatattaatttgtgttttattctccctatactcacttt

SEQ ID NO: 6776027 - DNA, 75 bp, Homo sapiens
atctgaatgaacaataggaaatgtttgtaagtaaaaagatatggacaaatgtgtctaattgtgccttttcaagat

SEQ ID NO: 6776028 - DNA, 58 bp, Homo sapiens
tcttttctgcctctaaacaattgacaaagggcaagagtttctaaggaggaagaaaaga

SEQ ID NO: 6776029 - DNA, 61 bp, Homo sapiens
gtaccctggatcactggggagctttaaaaaatcctctttcgggctgcccactccagagtac

SEQ ID NO: 6776030 - DNA, 63 bp, Homo sapiens
gttgagtgggttaggatgctgacatatcttttgagggccactaactattcaacccactacaac

SEQ ID NO: 6776031 - DNA, 61 bp, Homo sapiens
cagagtgattcgttcaagaaccagcctgtgacccacgctggaccgttgagaatcaattctg

SEQ ID NO: 6776032 - DNA, 102 bp, Homo sapiens
tgatttcaagtttatttcctatggacaatgaaatggcctttcacaatgctttatgaaattacaaatcatttcagttgttccctggttgagaaacttaaatta

SEQ ID NO: 6776033 - DNA, 56 bp, Homo sapiens
gagtaaaataatcctcctctcttactgaatattaagagaggaggattattttattc

SEQ ID NO: 6776034 - DNA, 76 bp, Homo sapiens
gcagcacagggcagtgattaaactcaggcactcaccccaccctacctgggaatctgaattctgtcttttctgctgc

SEQ ID NO: 6776035 - DNA, 87 bp, Homo sapiens
tcctctgactggaatgatctttcctcttgtttgtctgaaaaaaaattggtttcaacattcagctgatgggtcatattctcagtagga

SEQ ID NO: 6776036 - DNA, 66 bp, Homo sapiens
aaatgcaaattgctggatcctactcccagagatttgtaaattcctggggtcagataatttgcattt

SEQ ID NO: 6776037 - DNA, 89 bp, Homo sapiens
gcagccagctgagtggaatgcacttccaacatctattagatgatgcagtttataaaagtgggtgccgaagtgtccctcctgtgtacagc

SEQ ID NO: 6776038 - DNA, 86 bp, Homo sapiens
acggaaaatcttatgggtctatctagaaagctgtgtggatgtgattgtgaatctccacacacatttctatgtgcattacccaccgt

SEQ ID NO: 6776039 - DNA, 66 bp, Homo sapiens
ttgggacttgggtctgtcctgctgtgcatccatagtgggtgctttagaaacgggaggcccacccga

SEQ ID NO: 6776040 - DNA, 87 bp, Homo sapiens
cagctgactgcctgggaatccaggagggctgactccttagcccacacttagctgagagtctcagacctcctggttcaggcacagctg

SEQ ID NO: 6776041 - DNA, 76 bp, Homo sapiens
tctggagctaggaagtccaagatcagagtgctggcaaattcaatatctggtaaggatctgctttctagttcataga

SEQ ID NO: 6776042 - DNA, 115 bp, Homo sapiens
tagggctgactgagttggggagtgggtggagtgtaaaatggcagcttgaccaggctgggccatagccactcatctgaccactttatctctcacctcttcccccactttggccttg

SEQ ID NO: 6776043 - DNA, 68 bp, Homo sapiens
attttctttctcacttgcttccctgtgtctgaccctggcatttgggaagagcaggtgggtaagaaaat

SEQ ID NO: 6776044 - DNA, 130 bp, Homo sapiens
gtcttatttgttttttaggcttaagattacttttcataggaaaaatgtgaggtgatacaactgtgtttactttattatcttgcagatttccaatgacagatttttttctcttattaaattcatattccac

SEQ ID NO: 6776045 - DNA, 87 bp, Homo sapiens
gcttgagtgggcaagtttttgcttctgcaagactgcagggagctcattggcatgtccttcgtaggggcagcagctggcctacggtgc

SEQ ID NO: 6776046 - DNA, 106 bp, Homo sapiens
gtggctgagatggtgactcactggttttctagtccactggcttgaagatacgtcttacatttccaagtctctgaaccagataggccaaggattaagtctcatccac

SEQ ID NO: 6776047 - DNA, 61 bp, Homo sapiens
ccctgggagcgcagcaggcacaacccttgcatctggtgtttgcctcctgcagctcctccgg

SEQ ID NO: 6776048 - DNA, 128 bp, Homo sapiens
acggattgtggctcacctaagcagggaagccgatttggaacttaaacaagctcccaagttgtgatcagtcgagcttggcaagcactgtttgagagagtaggcttcccgcaagcaggagccggttttgt

SEQ ID NO: 6776049 - DNA, 118 bp, Homo sapiens
cacaagcaattcccatgacagcccatgctctccaaaccctgtggctttggttttctcatccagaatgttatacatttggagactgtgtcagctctctcttggatggggtttgcttgtg

SEQ ID NO: 6776050 - DNA, 59 bp, Homo sapiens
ctttgcattacttgactttagttttcaccaaagtaagagagcaaagaagtgatggggag

SEQ ID NO: 6776051 - DNA, 99 bp, Homo sapiens
gaccacagtgttgggtacgtgacatgggctgacccagtcgtggcacaccatttccctgtccacactgatcggttcacttatgggtacttgacgcaagtc

SEQ ID NO: 6776052 - DNA, 64 bp, Homo sapiens
ccaaaccattctgtttaatgaatgaaatatgaacaatattttccacagtgcagagatgggatgg

SEQ ID NO: 6776053 - DNA, 83 bp, Homo sapiens
ggtgccagcagagtgtacaggaggccacattggaagacgatggtctttgctgtcttcttacctttctgtatgctccctgggcc

SEQ ID NO: 6776054 - DNA, 119 bp, Homo sapiens
ttggtatattcagatttttggataacagactgacagttttatttgcataattataatcagcattgtacatagaaaggatacagctgctttttgttaaatccacactttctaaatgtcaa

SEQ ID NO: 6776055 - DNA, 73 bp, Homo sapiens
gatccaggggctggaggctggggaggatgaggtcagctgatgggaatcacacccagctccaggaccttggatc

SEQ ID NO: 6776056 - DNA, 83 bp, Homo sapiens
cttgtgtgtgtgtgcatatgtgtatttagttctatacaatgttaacatatgtgtagatttgcatatttaccaccatagtcaag

SEQ ID NO: 6776057 - DNA, 65 bp, Homo sapiens
tgtgggctacacacagcagtaatggggttatttccttccacaaactggctgagtttatgttcaca

SEQ ID NO: 6776058 - DNA, 60 bp, Homo sapiens
actggaaagcagaagagtagagatctaatcttgtctctgactaggtctgattttctgagt

SEQ ID NO: 6776059 - DNA, 80 bp, Homo sapiens
tattacacaagtagctaatcaccccaaagtgatgattttgaatggtcagcactcttctgtgatagttgtatgttgtttta

SEQ ID NO: 6776060 - DNA, 103 bp, Homo sapiens
atgatgtgaaaggattcggtcatagtggctggtagttactgagcactcactatgtgctgacacttataattgccaggtatatattgacttatttaatcatcat

SEQ ID NO: 6776061 - DNA, 67 bp, Homo sapiens
agtgcctagatgggtgtgtgcttactatgagtgtgcttactatgtattagccattcttctaagtact

SEQ ID NO: 6776062 - DNA, 57 bp, Homo sapiens
ccgggttcaccttgcttaggtatgtctcgctttagatcataaggcaattggatttgg

SEQ ID NO: 6776063 - DNA, 74 bp, Homo sapiens
gcagttcctccccagagctctgacccaggcattgatatgggccctggaaggtagggcagctgggagggacatgc

SEQ ID NO: 6776064 - DNA, 111 bp, Homo sapiens
tattactgggctttcttgtttctttggttgatgtgtctgttttaggccagtacgatgctgtttttgattgcaatagttttatgaaatcttttgaaattaggaagtgtgatg

SEQ ID NO: 6776065 - DNA, 76 bp, Homo sapiens
ctgttgagttgtacaaattcagttctagggtggggcttccactcacctttcaagagaatttagtgcagcttttaag

SEQ ID NO: 6776066 - DNA, 95 bp, Homo sapiens
cctgcttctgtgtgatcctggggaagtcacttctctttgggtctctgcaaaattaaagagttggactttctcaggcatttgtagggaaagaaagg

SEQ ID NO: 6776067 - DNA, 63 bp, Homo sapiens
gtcagaggctgctgaggccaccacgctgccagaggtgatagtgtcatggcctgagcaggtgac

SEQ ID NO: 6776068 - DNA, 66 bp, Homo sapiens
gtagatgctagcaccaagaacccagcattgagctgctcctatgctttagttgagtctggggtctac

SEQ ID NO: 6776069 - DNA, 72 bp, Homo sapiens
tctttaaggtaagggctgtagacaagattgctggactcgaacagcaaactaattgcagttctggattgagga

SEQ ID NO: 6776070 - DNA, 63 bp, Homo sapiens
ccttcctttatgtcttaggctgtttatgagacccattcttctccactgtcacataaaggaagg

SEQ ID NO: 6776071 - DNA, 64 bp, Homo sapiens
cataaggagcacacaatctagaaccctcgcatgggtggttcacagtaaggtttgtgcttctatg

SEQ ID NO: 6776072 - DNA, 89 bp, Homo sapiens
ctgggttagctctgtgtttttccaaacatgattctataactcctctgtagaatacagtatgcaaaaagatggaaatacttgttattcag

SEQ ID NO: 6776073 - DNA, 67 bp, Homo sapiens
accctgatataggtccaagagcaatgaggtaggtctctgaaactcaaggttctttctattcatgggt

SEQ ID NO: 6776074 - DNA, 108 bp, Homo sapiens
gcaaagccatggtactcagaggcagctgctcaccccatgctctcagcctcctcctcttcccagcatgtattccaaatgggtgacatcttttctggcagatggctctgc

SEQ ID NO: 6776075 - DNA, 65 bp, Homo sapiens
ggagctgcagctgcagttctgagagaaactctatttttcagccagaatacagttgcaaaggaccc

SEQ ID NO: 6776076 - DNA, 71 bp, Homo sapiens
tgggaaggtaacattgcctccatctgaaaggcaaaatcacttgaactcagagaaggtaagtgacctgccca

SEQ ID NO: 6776077 - DNA, 106 bp, Homo sapiens
tgaggccaagtcggctgaactctaatgggcctggcctctctgtccatgcctgaccccagagtgcaggcaaaagggccaggccactgttggaaaggccgtggcttca

SEQ ID NO: 6776078 - DNA, 71 bp, Homo sapiens
gagggtcctggctgtggtctgataggatttacatgggagatgataaacctgcaactatagccaccattctc

SEQ ID NO: 6776079 - DNA, 91 bp, Homo sapiens
agtaggtgagagcttctcacagagctgctttgccaatgcgttcctgggtcatgggcctgggaatggcagtagagcgaggctcccacctatt

SEQ ID NO: 6776080 - DNA, 58 bp, Homo sapiens
gtgctgatgttgcttcccttgggctcattattggcattagagaaagcaggcacagcac

SEQ ID NO: 6776081 - DNA, 60 bp, Homo sapiens
accatggttcccgggggagtgcctgaagggaggacctgaagagattccctgggagatggt

SEQ ID NO: 6776082 - DNA, 59 bp, Homo sapiens
ggagagggggcagtgagcctggcacaggcagagtggcaggcacagcctcccccaactcc

SEQ ID NO: 6776083 - DNA, 69 bp, Homo sapiens
ggctgatgactggagacctcagtagggtctccatgacaaagactctctctgatggaactttagccagcc

SEQ ID NO: 6776084 - DNA, 68 bp, Homo sapiens
cacttcaatacacctcaggcagcaaagtctcagcttttgagccgtggtctctgagggtgttggatgtg

SEQ ID NO: 6776085 - DNA, 65 bp, Homo sapiens
cagggaaagtcacttccttctgtcagcctcctccatgaaatcgaggtgacctagttgaccccctg

SEQ ID NO: 6776086 - DNA, 61 bp, Homo sapiens
actgaggcatgtcttattctcagtacttagtatagtacctggcacagagtatgctctcagt

SEQ ID NO: 6776087 - DNA, 72 bp, Homo sapiens
actgttatttgtaatccattatttggccagtatgggtctgaattttgtaatgggtgtgccttagtatacagt

SEQ ID NO: 6776088 - DNA, 72 bp, Homo sapiens
gttgttcattggtactaggacaggactaggccctaataccccagccatgttcagtcattggccgagaacaac

SEQ ID NO: 6776089 - DNA, 55 bp, Homo sapiens
gtgtatgatatattgttctaggagcacacatggactaagacagtgtctcaagcac

SEQ ID NO: 6776090 - DNA, 55 bp, Homo sapiens
atcctgtctctacccatcggctcctacagcaggacagagaggcagaggctggggt

SEQ ID NO: 6776091 - DNA, 82 bp, Homo sapiens
cagtcctatatgaacagatggcccagcagagggttttactctagagagtcctgcttgattctatgttgcacagggtgggctg

SEQ ID NO: 6776092 - DNA, 103 bp, Homo sapiens
aactctatcaaatgtactaacacttcccttgaaagctttgcgtcttctagcttacccggcagggttctgggaggccaccaagcccaagagaacagtgagagtt

SEQ ID NO: 6776093 - DNA, 59 bp, Homo sapiens
gggctttaatcttgttaactagggaggagccactgtgtcctaataatcttttaaagccc

SEQ ID NO: 6776094 - DNA, 102 bp, Homo sapiens
tgaggcaggggaattgcttgaacccgggaggtggagattgcggtgagccaaaatcaggccatcgcactccactctaggcaacaagagcgaaactccgtctca

SEQ ID NO: 6776095 - DNA, 112 bp, Homo sapiens
gtgtgtgtgtgtctccccagaatgccccctgcgtgtcttagcatggaacatgttgcataacaccagccccagagctaaacacacaggctgggactggtggaagcaccaccac

SEQ ID NO: 6776096 - DNA, 86 bp, Homo sapiens
ggcagaaaagtgggggtagttaagaggccagtgtaataatccggtattactatgtccatcttaatgggctaatcatgtgttctgcc

SEQ ID NO: 6776097 - DNA, 73 bp, Homo sapiens
gtcgcattaaatgtgagaaatataggccgtgctgggattacaggcatgaaatatttctcacattaaacatggc

SEQ ID NO: 6776098 - DNA, 90 bp, Homo sapiens
ctgactagatgccaagtgccctgaagtgatagaaaataggctccttgcctcaaagactatatattttatttggggacttacactatacag

SEQ ID NO: 6776099 - DNA, 69 bp, Homo sapiens
gcagttctggagatggataatggtgatagttgcacaataatgtgaacgtagttaatgccactgaactgt

SEQ ID NO: 6776100 - DNA, 122 bp, Homo sapiens
cctctctcgaagccatctgtgtgtgtggttttgtgaagcaattaagctccaggtgtgcaatagaaatgaagtagccgcttaattatttggtgaaacagcaggcatttgggattcaagattgg

SEQ ID NO: 6776101 - DNA, 83 bp, Homo sapiens
agatgtagacctcaaacttaggttatcaatcctggggacagtaatctgctcagaatttagggctctgaggttggtctgcgtct

SEQ ID NO: 6776102 - DNA, 129 bp, Homo sapiens
gcgtttgacttcatgcaggaatttcacaccttcccagaccttagagtgcaggtggagggtgtctggcagagaaggcgccaagtactgcctgctggggctgggaaggactgctcccatggcaagggaggc

SEQ ID NO: 6776103 - DNA, 83 bp, Homo sapiens
cttttgttaggtatgttaaggtattgtttatatgtaataaaattcacattttatagggacagttcttggagttttgacaaaag

SEQ ID NO: 6776104 - DNA, 70 bp, Homo sapiens
caggcaggagccagggattccaggaatttgtaaccttctgtgtgtcctggcctgctctggttctttcttg

SEQ ID NO: 6776105 - DNA, 84 bp, Homo sapiens
cataaaagagaaagaaaaggtatatctgatccatgagggagaacttgcttttttatgtctctgatgttctaatctgattttatg

SEQ ID NO: 6776106 - DNA, 78 bp, Homo sapiens
ccgtaggtgttctttatatatctgtaaacaaaccttttttggatgtatgtgttgcaattatgttttctcactctgcgg

SEQ ID NO: 6776107 - DNA, 55 bp, Homo sapiens
ggcttcaggggtctgtctgcacaggggctagcccctcccagacctctgtgaagcc

SEQ ID NO: 6776108 - DNA, 63 bp, Homo sapiens
catccccagagcagttccactatgtgtcctctttatcaccagcgggacttagcactgggcttg

SEQ ID NO: 6776109 - DNA, 56 bp, Homo sapiens
ctgacagagaagcttctgcctccatttctcttcctggagcccagcttatttgtcag

SEQ ID NO: 6776110 - DNA, 105 bp, Homo sapiens
gcaactttctttctcttcttgtttcagcttcctttactgcagccaatgccacacttcatacctgagtataaaggctgaaagaaaggagagcggagaaagataggc

SEQ ID NO: 6776111 - DNA, 63 bp, Homo sapiens
tgcagaggcacagccccagatgaaggaattcttggctctttcccatgggctcactgccctgca

SEQ ID NO: 6776112 - DNA, 94 bp, Homo sapiens
acagccctgtgagataggtatcactctccctgggttacagatgaggagactgaagctcagagaagttgtgcctggccaaggtcacacgggttgt

SEQ ID NO: 6776113 - DNA, 72 bp, Homo sapiens
gggagaggagaaaggcaatttgttgtgaggattttcatcctgaaagcctttaatgaattgttctttgctccc

SEQ ID NO: 6776114 - DNA, 89 bp, Homo sapiens
gagcatcaactggatggagtcaccctaagctttccttccacctgggtggaatcattgtgacaagctcccggtggccctcctgcatgctc

SEQ ID NO: 6776115 - DNA, 80 bp, Homo sapiens
ggttcaaggcccatttgcagttccatccaggcagatggaggcaactctaccctcttcctatggggctgcaggaagccacc

SEQ ID NO: 6776116 - DNA, 74 bp, Homo sapiens
agccctgtcatctggcctgattggtgtggatgtggtaccccactaagacattcctcagtgccagttgaggagct

SEQ ID NO: 6776117 - DNA, 84 bp, Homo sapiens
gtgccaagggctgttctcccaccagcaacagatggaaccaaggcaggagagacctgttgtcaggtgggagaacagtcaggtcat

SEQ ID NO: 6776118 - DNA, 109 bp, Homo sapiens
gggggaaggtgactcacctggagagtggagtgtgtgtgtgtgtgtgtgggtgtgggtgtacacacatgcataagccttcccttcttctagagtgggtgtcccatccccc

SEQ ID NO: 6776119 - DNA, 75 bp, Homo sapiens
tcaaccatgatgacttacaagactaggattaagagaaacatcctaggcatttttcttgaaggtctatcgccttga

SEQ ID NO: 6776120 - DNA, 75 bp, Homo sapiens
cactggagagtgtatgcgcaccccagatagcatgtgaataaaccatctgtttgctggtgcatgggtttccgagtg

SEQ ID NO: 6776121 - DNA, 129 bp, Homo sapiens
tcttccaatcatgggtttcctgtgaatcctccctcattcttcctctggcctcctttcagcaagaacgcgaccccactgaggtggctgaagagtgggtgagggtttccagaggccaggcactctggtaga

SEQ ID NO: 6776122 - DNA, 61 bp, Homo sapiens
cctgtaccatctcagcattcaggaacaatggtgtccacatgtctttttgaggttgtacagg

SEQ ID NO: 6776123 - DNA, 65 bp, Homo sapiens
ctcttgaccttttcatgtatctctgtctcctaatttggcaggaaatataggaaaaggaacaaggg

SEQ ID NO: 6776124 - DNA, 111 bp, Homo sapiens
tggagacttgtgactcttgtggttgagtagtgctgcaaggatggagaggcagacacctgccctgcagaccctgcagtgtcctgaatagccaagcaaggaagcaggtcttca

SEQ ID NO: 6776125 - DNA, 80 bp, Homo sapiens
tctattctgagctgcaacactaacatctgggcttcttttgtttgcattttcaaatgtagtttggggctagatttattaga

SEQ ID NO: 6776126 - DNA, 76 bp, Homo sapiens
gcctgcagctccctggcttttacagtgtaactgctttgtccagctctgcaagttggagcctgggaagctggcgggt

SEQ ID NO: 6776127 - DNA, 101 bp, Homo sapiens
ctacacatgaggagctgccttttctaccagtgacaggcccagtgggatgcaggaagcagcctgccctcgctgtggtcagttagggggtacattatctgtag

SEQ ID NO: 6776128 - DNA, 130 bp, Homo sapiens
aatcagatttatctgtcatgatctcagatgtttgtgtgtcactgaaagaaatctgtgtaacttgattgaatcctaatctattcagggagaggtttctagggacatgcaaagtttatgatagaaaatacgt

SEQ ID NO: 6776129 - DNA, 61 bp, Homo sapiens
ttctaacagcattttttaaaaatcagggcatgctttgtgccctcagtagaaaatgttagaa

SEQ ID NO: 6776130 - DNA, 63 bp, Homo sapiens
ggcttctctggcagactggctgggctgtgggtattaatagctccacattcacgctgagaagcc

SEQ ID NO: 6776131 - DNA, 61 bp, Homo sapiens
acttatttccagtccagaaatttaagatttgtgggtgatggatgtaggggtggaaataagt

SEQ ID NO: 6776132 - DNA, 105 bp, Homo sapiens
catgttggccaggctggtctcgaactcctgaccttgtgatccacccgccttggcctcccaaagtgctaggattacaagcgtgagccaccatgcctggccaagatg

SEQ ID NO: 6776133 - DNA, 57 bp, Homo sapiens
gattcaaagacagactcatttcaagggcactcagactcctagaaggtcctttgagtt

SEQ ID NO: 6776134 - DNA, 58 bp, Homo sapiens
aatcagatttaaacatgtacaagagcctcgtttcactttgatacatgtgtatctgatt

SEQ ID NO: 6776135 - DNA, 71 bp, Homo sapiens
gtttcttaacagattaggggtttcatctcaatttgcaattgggacttaatatgcccttgatttccggaaac

SEQ ID NO: 6776136 - DNA, 90 bp, Homo sapiens
gaatgagaagtctctggtgatgcaggaaaagtaaaactccatactctgcttttctctttttctgtgtatccaggcttcctttaattattt

SEQ ID NO: 6776137 - DNA, 66 bp, Homo sapiens
tgccgtgccgggctggctgctctgatacccgtcaatgggctcattcagccagggcccggttttgca

SEQ ID NO: 6776138 - DNA, 78 bp, Homo sapiens
tttagtcaactgtatacaattgtcagacatgtagaaatcatcagtgtctcctttcaggggtgtatagaattgtcttga

SEQ ID NO: 6776139 - DNA, 60 bp, Homo sapiens
tcagtttcctcatctgtgaaatgagatcaatgcctacttattgccacagataaaaactga

SEQ ID NO: 6776140 - DNA, 63 bp, Homo sapiens
caagacgatagtgacatgcaatgccacagacattccatggcatgtgcaggaactgtgcttttg

SEQ ID NO: 6776141 - DNA, 85 bp, Homo sapiens
ttcactttagatttgtcacataaaatggagactgcgcaatgacatgcaaagtaatctgtttatgtgtctaaataaaatatgtgaa

SEQ ID NO: 6776142 - DNA, 63 bp, Homo sapiens
ctttgctaggagctcatctgagggaagagacacagaccttccctggagctagtctgagcagag

SEQ ID NO: 6776143 - DNA, 84 bp, Homo sapiens
gctttgtcagcatctgtttttctgacccaggataagatcttccttttagatctgctggtcaagggacagagctgaactctaagc

SEQ ID NO: 6776144 - DNA, 85 bp, Homo sapiens
tgagcatgaatggaaatcccagcttttgcacaactggctccgtgggtgtggtcaacttgcaagatgctgggcttcagcatcttta

SEQ ID NO: 6776145 - DNA, 72 bp, Homo sapiens
gtatccagcgcagctgggaggcccacgttgggaagtcggagaccgaccccgcctcccgactgcgccgactgc

SEQ ID NO: 6776146 - DNA, 68 bp, Homo sapiens
atgtttcacttttaagagtcagtgtattaatgcatacacggggaatacatctctttgaagtgctttat

SEQ ID NO: 6776147 - DNA, 59 bp, Homo sapiens
attgaagaaacccaaataatggttgcagttgtgctgccattgtttttgttattattaat

SEQ ID NO: 6776148 - DNA, 63 bp, Homo sapiens
atgcttgcttcagggaagttagaggcaccaggccctgcatctcacttccctgcagcatcccgt

SEQ ID NO: 6776149 - DNA, 73 bp, Homo sapiens
gcaataattccaaaatgttaccaatatttattacatgattatgtagaaattaggatgatagtggaattaaggc

SEQ ID NO: 6776150 - DNA, 58 bp, Homo sapiens
gtttctgaacagtacttggccagtttctttaacaggagatggctttgcttttagaagc

SEQ ID NO: 6776151 - DNA, 58 bp, Homo sapiens
gttcatgactctttcataaatgcatataaacttgagcttcagtgaagagtcattgaat

SEQ ID NO: 6776152 - DNA, 71 bp, Homo sapiens
gcataggagtgcaaatagtccagagaaaagatcagactgtttcctctggttatacttgcacccagccatgc

SEQ ID NO: 6776153 - DNA, 69 bp, Homo sapiens
caggcagaatgagattacttcaaggtttctcttaattgttttcttcctttaagtaaagagcactgcctg

SEQ ID NO: 6776154 - DNA, 70 bp, Homo sapiens
agtggcagagccaagtagagcccagaccttcaaccttctattcctggggctctttgcacagctctgccct

SEQ ID NO: 6776155 - DNA, 118 bp, Homo sapiens
acagtgctctggcccaggctttgtccatgctctggtggatgaatgtcctcgtacaatgagtcaccctttatctgacaggtcattttctatagagaaagccaattaaaacagagactgt

SEQ ID NO: 6776156 - DNA, 58 bp, Homo sapiens
cttccagagccagtctctgcgggacagagcccgccgcttcgaagaggccttgaggaag

SEQ ID NO: 6776157 - DNA, 66 bp, Homo sapiens
aggtcagacaccgtctattttgcctggtctctgacccatcaggtaacaggcataggcttctgactt

SEQ ID NO: 6776158 - DNA, 67 bp, Homo sapiens
gttagaagattggcagcttaactgtccatttttatcagttaggaaacaaacctgcctcttctttagc

SEQ ID NO: 6776159 - DNA, 80 bp, Homo sapiens
tctcaggatttactaatttcaagggtgtactctgtaaggggttggttgagtaaaattttgagtctagagaaagcttgaga

SEQ ID NO: 6776160 - DNA, 83 bp, Homo sapiens
ttaaatggaaatcgatgtctaagttacatactcaggagttaaataattaatggtaactagatatagactttctacatatttga

SEQ ID NO: 6776161 - DNA, 62 bp, Homo sapiens
gactgggttggttctgtgaatcagaggagtcaaggctaaatcaggactctcacagatcagtc

SEQ ID NO: 6776162 - DNA, 60 bp, Homo sapiens
ggccagctgccaccagccctatggtgtgaatggcaaggaagtggggactggcggctggcc

SEQ ID NO: 6776163 - DNA, 60 bp, Homo sapiens
ctgtaattgttctatgtgttcataatggaacatccatttaagaatacagataataagcag

SEQ ID NO: 6776164 - DNA, 59 bp, Homo sapiens
acatggcgggagtttcagataccatacaagtcactggtctctctggaacaacttcatgt

SEQ ID NO: 6776165 - DNA, 78 bp, Homo sapiens
tcacacccagatatatgtctttaatagccaccatggccacaatgtggagatgggttaatggagagaatcttggtgtgg

SEQ ID NO: 6776166 - DNA, 57 bp, Homo sapiens
gtgcaccccagtctaaaaccagcctctagatgaaggaggcagagatttggggtgggc

SEQ ID NO: 6776167 - DNA, 61 bp, Homo sapiens
tatataaaaggtacagggtattagattatgtatggatgcatgataatgtattttttatatg

SEQ ID NO: 6776168 - DNA, 69 bp, Homo sapiens
tcttcaggaggagcattagcgtctcaaagagattaacgagttaaatgagtgtaggtgcttcctgttaga

SEQ ID NO: 6776169 - DNA, 63 bp, Homo sapiens
ggtccattgactagagtcacagttgcagttgctgaactggataattagctcaaagcttggact

SEQ ID NO: 6776170 - DNA, 64 bp, Homo sapiens
gttaaagaccatgacctgccactaagcaaggtcttacctggctggcaatggtgtggtctggtat

SEQ ID NO: 6776171 - DNA, 78 bp, Homo sapiens
agtagcgcgccacgtagattcctccatgcgcagttcacagtagggtttgtgctcctatgagaatctaatgccgctgct

SEQ ID NO: 6776172 - DNA, 83 bp, Homo sapiens
tagattgttacttcgtttcttcacaagcatagacttctttgtctgctgcttctgttgaagcacataaatccaagtggcagctg

SEQ ID NO: 6776173 - DNA, 63 bp, Homo sapiens
caagaaacatacagctgatgaacccagctcacagttgcactgaaatcacctggtgtttccttg

SEQ ID NO: 6776174 - DNA, 56 bp, Homo sapiens
tcaagccactggcagaagattactttctaagagtgagagccttcccagggcttcga

SEQ ID NO: 6776175 - DNA, 77 bp, Homo sapiens
tgtttccacacaggctctactactcatatttgtaatcagactcaagtacacaagtggacagagcttgcctggattca

SEQ ID NO: 6776176 - DNA, 58 bp, Homo sapiens
acaactttaatttgggtgtcagagtcctttgtggactttataagccctttaaagttgt

SEQ ID NO: 6776177 - DNA, 107 bp, Homo sapiens
ctctgcaaatggggttcggggagtgacttttctctggcaggaagggtacaagtggcttttctaagggaaacgtcctcctccactcttgcaaaactccatgaacagag

SEQ ID NO: 6776178 - DNA, 68 bp, Homo sapiens
gctggtagacctcactgcactcactgtctaaattgtccatggagttactgtgctgatggtccattagt

SEQ ID NO: 6776179 - DNA, 57 bp, Homo sapiens
atttgcttggtcttctctccgtagataatggggttaagcatgggggaacaagcaagt

SEQ ID NO: 6776180 - DNA, 60 bp, Homo sapiens
gctctcccttttttgtatgctcttatttcttgttgaaatcagctttgaaagagggtctgt

SEQ ID NO: 6776181 - DNA, 61 bp, Homo sapiens
aggcctcttcagggagcatggagagctgtgttctgcctccctgcgcattagatgagcgcct

SEQ ID NO: 6776182 - DNA, 78 bp, Homo sapiens
aaatttgcatccaagcttcaccctaggatgtttaaagaagatttttgccttgtggtatggggcatggtgggccaattt

SEQ ID NO: 6776183 - DNA, 70 bp, Homo sapiens
tgattatccaggcagaaattttgtttcattgttgctctataatgataagaatttgtgtttattgtgatta

SEQ ID NO: 6776184 - DNA, 65 bp, Homo sapiens
ttagcagtttccattttggtcacattacaatcaatgatgagcaacagggggatggccactgttga

SEQ ID NO: 6776185 - DNA, 60 bp, Homo sapiens
tgtggtgttggcatagcatgtatcatagcatatagctatgctagctgtgccaacaccata

SEQ ID NO: 6776186 - DNA, 58 bp, Homo sapiens
ccctcagagcctgaagcaagcatatacagggctcttctttgctgcagtcaggcgaggg

SEQ ID NO: 6776187 - DNA, 88 bp, Homo sapiens
agtgggctactgaaggacattatgttcagtagcttaaaaatctgatggtctcttttaagcccctggactttgatgttttatgcctttt

SEQ ID NO: 6776188 - DNA, 77 bp, Homo sapiens
tccctgagctgtcaaggtacagtgaacctggggcttcccgctcccgctgtgaggctgcactatgcatggctctgggg

SEQ ID NO: 6776189 - DNA, 62 bp, Homo sapiens
ctgtcaacattggtgtctgtcagctggtggttagacacttgaacagactttgccaattacag

SEQ ID NO: 6776190 - DNA, 79 bp, Homo sapiens
ccctttccttatcaggtcctctgggtcccagcccctgacccagggagcgggaccgaacaggaaaaagaggaggaagggg

SEQ ID NO: 6776191 - DNA, 58 bp, Homo sapiens
agcaagttgaaatactgttttatctgtcaaattagaaaaacagtttttgctaactgct

SEQ ID NO: 6776192 - DNA, 66 bp, Homo sapiens
gagatattgcaggacaatgatggtccctctgaaggcactagggaagcatctctgttctgtcttctc

SEQ ID NO: 6776193 - DNA, 56 bp, Homo sapiens
ccctgcccttcctcctctcactgggcatccacaggttcaggagaaagggaccaggg

SEQ ID NO: 6776194 - DNA, 68 bp, Homo sapiens
aatagctgcataaagtatagaaggctataaagaattgcctggactatcatatctctgtgcagactatt

SEQ ID NO: 6776195 - DNA, 90 bp, Homo sapiens
atgtcactgtttacccaaaagtcactcaggagcaagtttttacttttcatgtaattgtgtggttttgagagatctttttggtattgacat

SEQ ID NO: 6776196 - DNA, 130 bp, Homo sapiens
tgggccctcctgggggttgcagtgccttgggcttggcctttgaagatctttgcattgcagggaagcctctctacactccagagtctcatcatgcttcccagggtcctgctttaaatctcttcccagccca

SEQ ID NO: 6776197 - DNA, 105 bp, Homo sapiens
ctggccgcagtgcccggccggcccaggccacacggcggctccctgctcctgcagctgtgtgtgtgcgtcctgctcgtgctggccctgggcctatactgcggccgg

SEQ ID NO: 6776198 - DNA, 80 bp, Homo sapiens
gggtctaagtaggcagacaatctgtctgttaggctacagcagatgtcctagctattaagattatctactacacagtgccc

SEQ ID NO: 6776199 - DNA, 68 bp, Homo sapiens
ccactctggactaacagcagcctcagggtgttaaagctcactctgaggctgctgtaagtctagagtgg

SEQ ID NO: 6776200 - DNA, 76 bp, Homo sapiens
tggagggtccgtgttgccccaagggagcccagcacaccatgtcttgcttgggctggagtccctaggggtccctcca

SEQ ID NO: 6776201 - DNA, 70 bp, Homo sapiens
aaagattgtacaggaacatgtctccaattagacagaagtctctcaggaggcaggttcctacaaggttttt

SEQ ID NO: 6776202 - DNA, 63 bp, Homo sapiens
ctggcacatgacagatgcaaaggattggaaaatatttgaatacagaaatttgcatgtgtgcag

SEQ ID NO: 6776203 - DNA, 112 bp, Homo sapiens
gactatgatttgtttgtctttatatctgtcccagctgctgagatagtgcttgtcacatcataggtattcaactctttgctgaatgaatgaagacattaacaagtgaaaagtc

SEQ ID NO: 6776204 - DNA, 79 bp, Homo sapiens
gttcctcagttgaaatagttactgtattctcattatctacaacagtagcaacaatggaagtaacttcaggctcaggaac

SEQ ID NO: 6776205 - DNA, 66 bp, Homo sapiens
cctggccctccctctcttctcccaccactttagggcctgtgagagaaattggagggaatgcttagg

SEQ ID NO: 6776206 - DNA, 91 bp, Homo sapiens
gctgggcggaggctgggtgaccaaggaagaggggagccagggctgggcctgagggctgtctgaagcttgggagtcacggtctcagctcagc

SEQ ID NO: 6776207 - DNA, 58 bp, Homo sapiens
cagctgagaaggtctgatcaggttgcattgtttcctcttggttggatttctctggctg

SEQ ID NO: 6776208 - DNA, 60 bp, Homo sapiens
gtggtcgtgggtgtttcccatgtgcctttcatgggatccttctttgacctcacagacggc

SEQ ID NO: 6776209 - DNA, 60 bp, Homo sapiens
aggcagcttacaccccccaagattctggacctcctccaggactgcatgtggaagttgctt

SEQ ID NO: 6776210 - DNA, 63 bp, Homo sapiens
gaagaccgaggtgaggtgttatttagatggaatggctgaatccacctctacctctggattttt

SEQ ID NO: 6776211 - DNA, 62 bp, Homo sapiens
agggataatgtcttagcccacaaaaattcacttttttgacaggatataaagacataatctct

SEQ ID NO: 6776212 - DNA, 66 bp, Homo sapiens
cacaggatgcacctgccctcctctcctccatggggtgagcccaaggagccaggtgcagcccttgtg

SEQ ID NO: 6776213 - DNA, 74 bp, Homo sapiens
gaggggtccatacggcgctgttctggattcccgttgtaacttaaagggaaactttcacaatgtccggagccctt

SEQ ID NO: 6776214 - DNA, 115 bp, Homo sapiens
ccacagacaaccgtaatgcaaggtgtaccttgtgctcaggaagctgttcctgctaagggggctgggggtcagggaaggtttcctgggggagggccacctgtgctgtgtttcgtgg

SEQ ID NO: 6776215 - DNA, 99 bp, Homo sapiens
ctgtggtactgccaggggacagtgttgcctctgttgagccttggctgctgtgggaagttgtaggttcctgactgaggcctgaggtggtggtgctgtcag

SEQ ID NO: 6776216 - DNA, 116 bp, Homo sapiens
cacaaaagggacctcacatcaaagcccattacagctaggcagactgagctctagggccaagggtttgccctgcaggtcgctgctggggtaagggtgagggtggggtccctccagtg

SEQ ID NO: 6776217 - DNA, 60 bp, Homo sapiens
aggcactttccttgaggagtttttgcaagagttaattgagataattcatggaaggtgctt

SEQ ID NO: 6776218 - DNA, 67 bp, Homo sapiens
ctccttctcttctgttctgcagctcattcaaaagagcccatagaaacacagagagacccatgaggag

SEQ ID NO: 6776219 - DNA, 64 bp, Homo sapiens
cccccttctcttctcctcccggctccttcctcctccctcctaaggcccaaggtccagaaggggg

SEQ ID NO: 6776220 - DNA, 78 bp, Homo sapiens
tagagaccagattctgattctgattaactgggagtacgatgatacagctaatcagaaattgagggtctggttactttg

SEQ ID NO: 6776221 - DNA, 118 bp, Homo sapiens
tggctaattaaagggtaaagttgaaagtagacatgagcaatgataatttatcagttctatttctgaatatttccatgaagtttagttatatttttagaaagcttcttttttttttcca

SEQ ID NO: 6776222 - DNA, 89 bp, Homo sapiens
aaatacctttctagctccatataaagcaggatgccacagcctacatgtattaaatcatgcattgtattgagttgaattgaatggtattt

SEQ ID NO: 6776223 - DNA, 71 bp, Homo sapiens
gaagcatcacagctgtgagagtgcattgaagggggattctcttgatgcagatcatagccaaggtatgtatc

SEQ ID NO: 6776224 - DNA, 71 bp, Homo sapiens
tttgagaagtaaataacagagaaaatgggaagagcaattcttccccattgtctttattatttccttccaaa

SEQ ID NO: 6776225 - DNA, 57 bp, Homo sapiens
gctcatttgtggtttgtgaaggacaggcaagcagtcatgtacatgcataaatgaagc

SEQ ID NO: 6776226 - DNA, 67 bp, Homo sapiens
aggggtcaagctcagaatcctagaatgccatacctggggattgtctaggcatttgagtttgccacct

SEQ ID NO: 6776227 - DNA, 113 bp, Homo sapiens
agggaatcggataaagaacaccaatttctgtaggaatagttggccagggtgcaatagcccaagcctgctgttaactgcaggaattcattgtgccttgggtcaaatttttccct

SEQ ID NO: 6776228 - DNA, 92 bp, Homo sapiens
gttttgaatttacatcgcctgtttcaagcaatagcatttcaccacaggttgccttatgaacttttatttgatgacaggagatgttccaaaac

SEQ ID NO: 6776229 - DNA, 88 bp, Homo sapiens
gttcctttttagttttgcgataaagtgtgtgtctctttttcagttgcccagggactcacactgatggcagatccattcagagagaagc

SEQ ID NO: 6776230 - DNA, 78 bp, Homo sapiens
ttcctatctttctaacttgagattgttgagtgatttaaaatcatgttaatcatttcaacattctcagttgtaggggaa

SEQ ID NO: 6776231 - DNA, 56 bp, Homo sapiens
tagtaagtactcaccactttacgtgataataatcatcattgttatgggtgctacta
